United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 100

SEQ ID NO: 3557091 - RNA, 22 nt, Pseudomonas putida KT2440
gcgcgucacugcaccucccgcc

SEQ ID NO: 3557092 - RNA, 18 nt, Pseudomonas putida KT2440
gcgcgucauccgccaaca

SEQ ID NO: 3557093 - RNA, 14 nt, Pseudomonas putida KT2440
gcgcguccagcaac

SEQ ID NO: 3557094 - RNA, 13 nt, Pseudomonas putida KT2440
gcgcguccagccc

SEQ ID NO: 3557095 - RNA, 22 nt, Pseudomonas putida KT2440
gcgcgucccccgguaccagcag

SEQ ID NO: 3557096 - RNA, 21 nt, Pseudomonas putida KT2440
gcgcgucgacaaaccgcaccc

SEQ ID NO: 3557097 - RNA, 21 nt, Pseudomonas putida KT2440
gcgcgucucuuucaggcacag

SEQ ID NO: 3557098 - RNA, 23 nt, Pseudomonas putida KT2440
gcgcgucucuuucaggcacagca

SEQ ID NO: 3557099 - RNA, 22 nt, Pseudomonas putida KT2440
gcgcgucugauagccagggccu

SEQ ID NO: 3557100 - RNA, 21 nt, Pseudomonas putida KT2440
gcgcgugcggggcaucgccga

SEQ ID NO: 3557101 - RNA, 19 nt, Pseudomonas putida KT2440
gcgcgugcuugcaccgaca

SEQ ID NO: 3557102 - RNA, 21 nt, Pseudomonas putida KT2440
gcgcguguagcccgcugaagg

SEQ ID NO: 3557103 - RNA, 14 nt, Pseudomonas putida KT2440
gcgcgugugcaggu

SEQ ID NO: 3557104 - RNA, 15 nt, Pseudomonas putida KT2440
gcgcguuaggcgaga

SEQ ID NO: 3557105 - RNA, 16 nt, Pseudomonas putida KT2440
gcgcguuaggcgagau

SEQ ID NO: 3557106 - RNA, 16 nt, Pseudomonas putida KT2440
gcgcguuggcgaucga

SEQ ID NO: 3557107 - RNA, 20 nt, Pseudomonas putida KT2440
gcgcuaaaccugugggagcg

SEQ ID NO: 3557108 - RNA, 20 nt, Pseudomonas putida KT2440
gcgcuaccccuguaggagcg

SEQ ID NO: 3557109 - RNA, 22 nt, Pseudomonas putida KT2440
gcgcuaccgaggucugcgcggg

SEQ ID NO: 3557110 - RNA, 18 nt, Pseudomonas putida KT2440
gcgcuaccugugggagcg

SEQ ID NO: 3557111 - RNA, 22 nt, Pseudomonas putida KT2440
gcgcuaccugugggagcgggcg

SEQ ID NO: 3557112 - RNA, 19 nt, Pseudomonas putida KT2440
gcgcuagucgaaaaaccga

SEQ ID NO: 3557113 - RNA, 17 nt, Pseudomonas putida KT2440
gcgcucaaccagccgcc

SEQ ID NO: 3557114 - RNA, 21 nt, Pseudomonas putida KT2440
gcgcucaagcgugacggccag

SEQ ID NO: 3557115 - RNA, 18 nt, Pseudomonas putida KT2440
gcgcucaaggucacggcu

SEQ ID NO: 3557116 - RNA, 21 nt, Pseudomonas putida KT2440
gcgcucauccagcguggccug

SEQ ID NO: 3557117 - RNA, 13 nt, Pseudomonas putida KT2440
gcgcuccaacugg

SEQ ID NO: 3557118 - RNA, 14 nt, Pseudomonas putida KT2440
gcgcuccaacuggc

SEQ ID NO: 3557119 - RNA, 19 nt, Pseudomonas putida KT2440
gcgcuccagcagcuccaca

SEQ ID NO: 3557120 - RNA, 13 nt, Pseudomonas putida KT2440
gcgcuccagcagg

SEQ ID NO: 3557121 - RNA, 16 nt, Pseudomonas putida KT2440
gcgcuccauccagucg

SEQ ID NO: 3557122 - RNA, 16 nt, Pseudomonas putida KT2440
gcgcucccaggccucg

SEQ ID NO: 3557123 - RNA, 14 nt, Pseudomonas putida KT2440
gcgcuccgccaaac

SEQ ID NO: 3557124 - RNA, 13 nt, Pseudomonas putida KT2440
gcgcuccugguca

SEQ ID NO: 3557125 - RNA, 13 nt, Pseudomonas putida KT2440
gcgcucgaagucg

SEQ ID NO: 3557126 - RNA, 18 nt, Pseudomonas putida KT2440
gcgcucgacauccagcgc

SEQ ID NO: 3557127 - RNA, 20 nt, Pseudomonas putida KT2440
gcgcucgacauccagcgccg

SEQ ID NO: 3557128 - RNA, 15 nt, Pseudomonas putida KT2440
gcgcucgagcccgcc

SEQ ID NO: 3557129 - RNA, 19 nt, Pseudomonas putida KT2440
gcgcucgagcccgccagca

SEQ ID NO: 3557130 - RNA, 23 nt, Pseudomonas putida KT2440
gcgcucgaucucacaggcgauga

SEQ ID NO: 3557131 - RNA, 14 nt, Pseudomonas putida KT2440
gcgcucgcgaaugu

SEQ ID NO: 3557132 - RNA, 16 nt, Pseudomonas putida KT2440
gcgcucgcugccggcg

SEQ ID NO: 3557133 - RNA, 20 nt, Pseudomonas putida KT2440
gcgcucgcugccggcguggc

SEQ ID NO: 3557134 - RNA, 22 nt, Pseudomonas putida KT2440
gcgcucgcugccggcguggcga

SEQ ID NO: 3557135 - RNA, 21 nt, Pseudomonas putida KT2440
gcgcucggucucacaggcgcu

SEQ ID NO: 3557136 - RNA, 15 nt, Pseudomonas putida KT2440
gcgcucgguugaugc

SEQ ID NO: 3557137 - RNA, 22 nt, Pseudomonas putida KT2440
gcgcucgguugaugcagcgccc

SEQ ID NO: 3557138 - RNA, 15 nt, Pseudomonas putida KT2440
gcgcucguaggcuuc

SEQ ID NO: 3557139 - RNA, 14 nt, Pseudomonas putida KT2440
gcgcucugcgccug

SEQ ID NO: 3557140 - RNA, 23 nt, Pseudomonas putida KT2440
gcgcugaagccaguacgcgccug

SEQ ID NO: 3557141 - RNA, 23 nt, Pseudomonas putida KT2440
gcgcugaaggaauuaccaggcgc

SEQ ID NO: 3557142 - RNA, 19 nt, Pseudomonas putida KT2440
gcgcugaaguagcgcagau

SEQ ID NO: 3557143 - RNA, 17 nt, Pseudomonas putida KT2440
gcgcugaccgggacgca

SEQ ID NO: 3557144 - RNA, 20 nt, Pseudomonas putida KT2440
gcgcugaccgggacgcaggc

SEQ ID NO: 3557145 - RNA, 19 nt, Pseudomonas putida KT2440
gcgcugacgaacaacgcca

SEQ ID NO: 3557146 - RNA, 17 nt, Pseudomonas putida KT2440
gcgcugacgcagggccu

SEQ ID NO: 3557147 - RNA, 20 nt, Pseudomonas putida KT2440
gcgcugacgcagggccucga

SEQ ID NO: 3557148 - RNA, 17 nt, Pseudomonas putida KT2440
gcgcugacugccaggcc

SEQ ID NO: 3557149 - RNA, 15 nt, Pseudomonas putida KT2440
gcgcugagcgacagc

SEQ ID NO: 3557150 - RNA, 16 nt, Pseudomonas putida KT2440
gcgcugagcgacagca

SEQ ID NO: 3557151 - RNA, 21 nt, Pseudomonas putida KT2440
gcggcaauucggccggccaga

SEQ ID NO: 3557152 - RNA, 12 nt, Pseudomonas putida KT2440
gcggcaccgcca

SEQ ID NO: 3557153 - RNA, 15 nt, Pseudomonas putida KT2440
gcggcaccgccagcu

SEQ ID NO: 3557154 - RNA, 17 nt, Pseudomonas putida KT2440
gcggcaccgucgccugc

SEQ ID NO: 3557155 - RNA, 22 nt, Pseudomonas putida KT2440
gcggcaccgucgccugcaaccc

SEQ ID NO: 3557156 - RNA, 21 nt, Pseudomonas putida KT2440
gcggcaccucguccagguuga

SEQ ID NO: 3557157 - RNA, 20 nt, Pseudomonas putida KT2440
gcggcacugaugcccaugcc

SEQ ID NO: 3557158 - RNA, 15 nt, Pseudomonas putida KT2440
gcggcagaacacauc

SEQ ID NO: 3557159 - RNA, 17 nt, Pseudomonas putida KT2440
gcggcagaacacaucgg

SEQ ID NO: 3557160 - RNA, 15 nt, Pseudomonas putida KT2440
gcggcagacacaggc

SEQ ID NO: 3557161 - RNA, 23 nt, Pseudomonas putida KT2440
gcggcagcaucgaccugccacug

SEQ ID NO: 3557162 - RNA, 14 nt, Pseudomonas putida KT2440
gcggcagcgacgau

SEQ ID NO: 3557163 - RNA, 17 nt, Pseudomonas putida KT2440
gcggcagcggcgaacgg

SEQ ID NO: 3557164 - RNA, 15 nt, Pseudomonas putida KT2440
gcggcaggcgcagcu

SEQ ID NO: 3557165 - RNA, 18 nt, Pseudomonas putida KT2440
gcggcaggcgcagcugcc

SEQ ID NO: 3557166 - RNA, 13 nt, Pseudomonas putida KT2440
gcggcaggcuggc

SEQ ID NO: 3557167 - RNA, 14 nt, Pseudomonas putida KT2440
gcggcaggcuggcg

SEQ ID NO: 3557168 - RNA, 17 nt, Pseudomonas putida KT2440
gcggcagguaggcccag

SEQ ID NO: 3557169 - RNA, 22 nt, Pseudomonas putida KT2440
gcggcagguaggcccagcccag

SEQ ID NO: 3557170 - RNA, 20 nt, Pseudomonas putida KT2440
gcggcaguugcaggcgcagg

SEQ ID NO: 3557171 - RNA, 22 nt, Pseudomonas putida KT2440
gcggcaguugccugccuugcga

SEQ ID NO: 3557172 - RNA, 14 nt, Pseudomonas putida KT2440
gcggcauccaggcg

SEQ ID NO: 3557173 - RNA, 18 nt, Pseudomonas putida KT2440
gcggcauccaggcgggcg

SEQ ID NO: 3557174 - RNA, 16 nt, Pseudomonas putida KT2440
gcggcauuggcgcgcu

SEQ ID NO: 3557175 - RNA, 19 nt, Pseudomonas putida KT2440
gcggcauuggcgcgcucga

SEQ ID NO: 3557176 - RNA, 19 nt, Pseudomonas putida KT2440
gcggccaaagcuguugaag

SEQ ID NO: 3557177 - RNA, 22 nt, Pseudomonas putida KT2440
gcggccaacgcugcucggccuc

SEQ ID NO: 3557178 - RNA, 20 nt, Pseudomonas putida KT2440
gcggccaaugaucgagcgca

SEQ ID NO: 3557179 - RNA, 15 nt, Pseudomonas putida KT2440
gcggccacagcgcca

SEQ ID NO: 3557180 - RNA, 19 nt, Pseudomonas putida KT2440
gcggccagcacgaacagca

SEQ ID NO: 3557181 - RNA, 20 nt, Pseudomonas putida KT2440
gcggccagcacgaacagcaa

SEQ ID NO: 3557182 - RNA, 17 nt, Pseudomonas putida KT2440
gcggccagcgcaucggc

SEQ ID NO: 3557183 - RNA, 16 nt, Pseudomonas putida KT2440
gcggccagcgccuggc

SEQ ID NO: 3557184 - RNA, 17 nt, Pseudomonas putida KT2440
gcggccagcgccuggcg

SEQ ID NO: 3557185 - RNA, 15 nt, Pseudomonas putida KT2440
gcggccaggccggcg

SEQ ID NO: 3557186 - RNA, 22 nt, Pseudomonas putida KT2440
gcggccaguaaggaucgcgcag

SEQ ID NO: 3557187 - RNA, 15 nt, Pseudomonas putida KT2440
gcggccaucgaacac

SEQ ID NO: 3557188 - RNA, 13 nt, Pseudomonas putida KT2440
gcggccaucgcag

SEQ ID NO: 3557189 - RNA, 22 nt, Pseudomonas putida KT2440
gcggccaugauuacgcugaaag

SEQ ID NO: 3557190 - RNA, 23 nt, Pseudomonas putida KT2440
gcggccaugauuacgcugaaagg

SEQ ID NO: 3557191 - RNA, 15 nt, Pseudomonas putida KT2440
gcggcccaaucgcca

SEQ ID NO: 3557192 - RNA, 16 nt, Pseudomonas putida KT2440
gcggcccaaucgccac

SEQ ID NO: 3557193 - RNA, 17 nt, Pseudomonas putida KT2440
gcggcccaaucgccaca

SEQ ID NO: 3557194 - RNA, 13 nt, Pseudomonas putida KT2440
gcggcccagccag

SEQ ID NO: 3557195 - RNA, 13 nt, Pseudomonas putida KT2440
gcggcccagccca

SEQ ID NO: 3557196 - RNA, 14 nt, Pseudomonas putida KT2440
gcggcccagcccag

SEQ ID NO: 3557197 - RNA, 15 nt, Pseudomonas putida KT2440
gcggcccauucgcgg

SEQ ID NO: 3557198 - RNA, 21 nt, Pseudomonas putida KT2440
gcggcccauucgcgggcaagc

SEQ ID NO: 3557199 - RNA, 22 nt, Pseudomonas putida KT2440
gcggccccaagcuucaccucag

SEQ ID NO: 3557200 - RNA, 22 nt, Pseudomonas putida KT2440
gcggccccagauuucucagcug

SEQ ID NO: 3557201 - RNA, 23 nt, Pseudomonas putida KT2440
gcggccccagauuucucagcugg

SEQ ID NO: 3557202 - RNA, 23 nt, Pseudomonas putida KT2440
gcggccccaggugccaacgguca

SEQ ID NO: 3557203 - RNA, 13 nt, Pseudomonas putida KT2440
gcggcccccagca

SEQ ID NO: 3557204 - RNA, 21 nt, Pseudomonas putida KT2440
gcggccccggcgccgccaggc

SEQ ID NO: 3557205 - RNA, 22 nt, Pseudomonas putida KT2440
gcggccccugugggagcggggg

SEQ ID NO: 3557206 - RNA, 22 nt, Pseudomonas putida KT2440
gcggccccuucgauucaggccu

SEQ ID NO: 3557207 - RNA, 15 nt, Pseudomonas putida KT2440
gcggcccgccggcaa

SEQ ID NO: 3557208 - RNA, 17 nt, Pseudomonas putida KT2440
gcggcccuaucgcgacg

SEQ ID NO: 3557209 - RNA, 19 nt, Pseudomonas putida KT2440
gcggcccuaucgcgacgca

SEQ ID NO: 3557210 - RNA, 16 nt, Pseudomonas putida KT2440
gcggcccuucgcgggc

SEQ ID NO: 3557211 - RNA, 16 nt, Pseudomonas putida KT2440
gcggcccuuggcagcg

SEQ ID NO: 3557212 - RNA, 15 nt, Pseudomonas putida KT2440
gcggccgaaggggcg

SEQ ID NO: 3557213 - RNA, 13 nt, Pseudomonas putida KT2440
gcggccgaagugg

SEQ ID NO: 3557214 - RNA, 14 nt, Pseudomonas putida KT2440
gcggccgcagcccc

SEQ ID NO: 3557215 - RNA, 19 nt, Pseudomonas putida KT2440
gcggccgcagccccaccuc

SEQ ID NO: 3557216 - RNA, 20 nt, Pseudomonas putida KT2440
gcggccgcagccccaccucg

SEQ ID NO: 3557217 - RNA, 20 nt, Pseudomonas putida KT2440
gcggccgccuccugcugcug

SEQ ID NO: 3557218 - RNA, 19 nt, Pseudomonas putida KT2440
gcggccggcccccccauca

SEQ ID NO: 3557219 - RNA, 20 nt, Pseudomonas putida KT2440
gcggccggucacccccauca

SEQ ID NO: 3557220 - RNA, 22 nt, Pseudomonas putida KT2440
gcggccgucaacgaggccgcca

SEQ ID NO: 3557221 - RNA, 14 nt, Pseudomonas putida KT2440
gcggccgucaugcg

SEQ ID NO: 3557222 - RNA, 16 nt, Pseudomonas putida KT2440
gcggccgucgcggcug

SEQ ID NO: 3557223 - RNA, 16 nt, Pseudomonas putida KT2440
gcggccuacccgggcg

SEQ ID NO: 3557224 - RNA, 16 nt, Pseudomonas putida KT2440
gcggccucgguccacc

SEQ ID NO: 3557225 - RNA, 21 nt, Pseudomonas putida KT2440
gcggccucguccggugccgcc

SEQ ID NO: 3557226 - RNA, 19 nt, Pseudomonas putida KT2440
gcggccucgugucgcgaaa

SEQ ID NO: 3557227 - RNA, 15 nt, Pseudomonas putida KT2440
gcggccugcuccaca

SEQ ID NO: 3557228 - RNA, 16 nt, Pseudomonas putida KT2440
gcggccugcuccacaa

SEQ ID NO: 3557229 - RNA, 17 nt, Pseudomonas putida KT2440
gcggccugugcccaacc

SEQ ID NO: 3557230 - RNA, 22 nt, Pseudomonas putida KT2440
gcggccugugcccaaccaccga

SEQ ID NO: 3557231 - RNA, 15 nt, Pseudomonas putida KT2440
gcggccuugaccacu

SEQ ID NO: 3557232 - RNA, 17 nt, Pseudomonas putida KT2440
gcggccuugaccacuuc

SEQ ID NO: 3557233 - RNA, 17 nt, Pseudomonas putida KT2440
gcggccuugugcggccc

SEQ ID NO: 3557234 - RNA, 17 nt, Pseudomonas putida KT2440
gcggcgaaagccagcag

SEQ ID NO: 3557235 - RNA, 20 nt, Pseudomonas putida KT2440
gcggcgaaggauggaccgac

SEQ ID NO: 3557236 - RNA, 14 nt, Pseudomonas putida KT2440
gcggcgacaggugc

SEQ ID NO: 3557237 - RNA, 22 nt, Pseudomonas putida KT2440
gcggcgauagggaacagggcag

SEQ ID NO: 3557238 - RNA, 16 nt, Pseudomonas putida KT2440
gcggcgaucaacgcag

SEQ ID NO: 3557239 - RNA, 17 nt, Pseudomonas putida KT2440
gcggcgaucagcgcggu

SEQ ID NO: 3557240 - RNA, 22 nt, Pseudomonas putida KT2440
gcggcgaugcaucaauggcugg

SEQ ID NO: 3557241 - RNA, 13 nt, Pseudomonas putida KT2440
gcggcgcagcgca

SEQ ID NO: 3557242 - RNA, 14 nt, Pseudomonas putida KT2440
gcggcgcagggccu

SEQ ID NO: 3557243 - RNA, 15 nt, Pseudomonas putida KT2440
gcggcgcagggccuc

SEQ ID NO: 3557244 - RNA, 15 nt, Pseudomonas putida KT2440
gcggcgcaucgcgag

SEQ ID NO: 3557245 - RNA, 11 nt, Pseudomonas putida KT2440
gcggcgccauc

SEQ ID NO: 3557246 - RNA, 13 nt, Pseudomonas putida KT2440
gcggcgccugcca

SEQ ID NO: 3557247 - RNA, 23 nt, Pseudomonas putida KT2440
gcggcgcgagaaccacaucacga

SEQ ID NO: 3557248 - RNA, 11 nt, Pseudomonas putida KT2440
gcggcgcuggc

SEQ ID NO: 3557249 - RNA, 19 nt, Pseudomonas putida KT2440
gcggcgcuuauggcgccgc

SEQ ID NO: 3557250 - RNA, 21 nt, Pseudomonas putida KT2440
gcggcgcuuauggcgccgcga

SEQ ID NO: 3557251 - RNA, 13 nt, Pseudomonas putida KT2440
gcggcggaacggu

SEQ ID NO: 3557252 - RNA, 15 nt, Pseudomonas putida KT2440
gcggcggaucggcgu

SEQ ID NO: 3557253 - RNA, 12 nt, Pseudomonas putida KT2440
gcggcggcaacg

SEQ ID NO: 3557254 - RNA, 15 nt, Pseudomonas putida KT2440
gcggcggcaauggcg

SEQ ID NO: 3557255 - RNA, 20 nt, Pseudomonas putida KT2440
gcggcggcagcgcgggcaga

SEQ ID NO: 3557256 - RNA, 19 nt, Pseudomonas putida KT2440
gcgggggccccaccaggca

SEQ ID NO: 3557257 - RNA, 22 nt, Pseudomonas putida KT2440
gcgggggccccaccaggcaccg

SEQ ID NO: 3557258 - RNA, 22 nt, Pseudomonas putida KT2440
gcggggucuuuucgccacuggc

SEQ ID NO: 3557259 - RNA, 14 nt, Pseudomonas putida KT2440
gcggggugcucugc

SEQ ID NO: 3557260 - RNA, 15 nt, Pseudomonas putida KT2440
gcggggugcucugcc

SEQ ID NO: 3557261 - RNA, 15 nt, Pseudomonas putida KT2440
gcgggguuuuuucua

SEQ ID NO: 3557262 - RNA, 16 nt, Pseudomonas putida KT2440
gcggguaaacccgcgc

SEQ ID NO: 3557263 - RNA, 19 nt, Pseudomonas putida KT2440
gcggguaaacccgcgccua

SEQ ID NO: 3557264 - RNA, 20 nt, Pseudomonas putida KT2440
gcggguaaacccgcgccuac

SEQ ID NO: 3557265 - RNA, 22 nt, Pseudomonas putida KT2440
gcggguaaacccgcgccuacga

SEQ ID NO: 3557266 - RNA, 14 nt, Pseudomonas putida KT2440
gcggguaagcccgc

SEQ ID NO: 3557267 - RNA, 20 nt, Pseudomonas putida KT2440
gcggguaagcccgcuccuac

SEQ ID NO: 3557268 - RNA, 16 nt, Pseudomonas putida KT2440
gcggguaaugucccgc

SEQ ID NO: 3557269 - RNA, 14 nt, Pseudomonas putida KT2440
gcgggucaagcugg

SEQ ID NO: 3557270 - RNA, 16 nt, Pseudomonas putida KT2440
gcgggucaagcuggau

SEQ ID NO: 3557271 - RNA, 13 nt, Pseudomonas putida KT2440
gcgggucagcagc

SEQ ID NO: 3557272 - RNA, 17 nt, Pseudomonas putida KT2440
gcgggucagcagcaccg

SEQ ID NO: 3557273 - RNA, 21 nt, Pseudomonas putida KT2440
gcggguccucgaaacgcaggc

SEQ ID NO: 3557274 - RNA, 17 nt, Pseudomonas putida KT2440
gcgggucgagccaggcg

SEQ ID NO: 3557275 - RNA, 17 nt, Pseudomonas putida KT2440
gcgggucgcacucggca

SEQ ID NO: 3557276 - RNA, 16 nt, Pseudomonas putida KT2440
gcgggucguugaaaac

SEQ ID NO: 3557277 - RNA, 21 nt, Pseudomonas putida KT2440
gcgggucuuccaccaccucca

SEQ ID NO: 3557278 - RNA, 14 nt, Pseudomonas putida KT2440
gcgggugaacccgc

SEQ ID NO: 3557279 - RNA, 20 nt, Pseudomonas putida KT2440
gcgggugaacccgcuccuac

SEQ ID NO: 3557280 - RNA, 20 nt, Pseudomonas putida KT2440
gcgggugaacccgcuccugc

SEQ ID NO: 3557281 - RNA, 14 nt, Pseudomonas putida KT2440
gcgggugcauggcu

SEQ ID NO: 3557282 - RNA, 22 nt, Pseudomonas putida KT2440
gcgggugccguggguugaacag

SEQ ID NO: 3557283 - RNA, 17 nt, Pseudomonas putida KT2440
gcggguggaaauuggcc

SEQ ID NO: 3557284 - RNA, 22 nt, Pseudomonas putida KT2440
gcggguggaaauuggccagcag

SEQ ID NO: 3557285 - RNA, 17 nt, Pseudomonas putida KT2440
gcggguggagauuggcc

SEQ ID NO: 3557286 - RNA, 19 nt, Pseudomonas putida KT2440
gcggguggcuucgucgcgu

SEQ ID NO: 3557287 - RNA, 23 nt, Pseudomonas putida KT2440
gcggguguggccacacugcucag

SEQ ID NO: 3557288 - RNA, 23 nt, Pseudomonas putida KT2440
gcggguucacccgcgaagcaggc

SEQ ID NO: 3557289 - RNA, 20 nt, Pseudomonas putida KT2440
gcggguucacccgcgaaugg

SEQ ID NO: 3557290 - RNA, 20 nt, Pseudomonas putida KT2440
gcggguugcacagggucagg

SEQ ID NO: 3557291 - RNA, 21 nt, Pseudomonas putida KT2440
gcggguugcacagggucaggu

SEQ ID NO: 3557292 - RNA, 16 nt, Pseudomonas putida KT2440
gcggguuuacccgcga

SEQ ID NO: 3557293 - RNA, 20 nt, Pseudomonas putida KT2440
gcggguuuacccgcgaaagg

SEQ ID NO: 3557294 - RNA, 21 nt, Pseudomonas putida KT2440
gcggguuuacccgcgaacagg

SEQ ID NO: 3557295 - RNA, 18 nt, Pseudomonas putida KT2440
gcggguuuacccgcgaag

SEQ ID NO: 3557296 - RNA, 19 nt, Pseudomonas putida KT2440
gcggguuuacccgcgaagc

SEQ ID NO: 3557297 - RNA, 20 nt, Pseudomonas putida KT2440
gcggguuuacccgcgaaugg

SEQ ID NO: 3557298 - RNA, 20 nt, Pseudomonas putida KT2440
gcggguuuaccugugaaugc

SEQ ID NO: 3557299 - RNA, 19 nt, Pseudomonas putida KT2440
gcggguuugcccgcgagga

SEQ ID NO: 3557300 - RNA, 13 nt, Pseudomonas putida KT2440
gcggguuugcgug

SEQ ID NO: 3557301 - RNA, 21 nt, Pseudomonas putida KT2440
gcggguuugggcagugacuuu

SEQ ID NO: 3557302 - RNA, 20 nt, Pseudomonas putida KT2440
gcggguuuucucgcgaaugc

SEQ ID NO: 3557303 - RNA, 23 nt, Pseudomonas putida KT2440
gcgguaaacgucggcagccaugc

SEQ ID NO: 3557304 - RNA, 20 nt, Pseudomonas putida KT2440
gcgguaaagaacaugaucaa

SEQ ID NO: 3557305 - RNA, 19 nt, Pseudomonas putida KT2440
gcgguacaccgggaacagg

SEQ ID NO: 3557306 - RNA, 21 nt, Pseudomonas putida KT2440
gcgguacaccucaucacgcga

SEQ ID NO: 3557307 - RNA, 20 nt, Pseudomonas putida KT2440
gcgguaccccgccuguuggc

SEQ ID NO: 3557308 - RNA, 15 nt, Pseudomonas putida KT2440
gcgguaccggccagc

SEQ ID NO: 3557309 - RNA, 17 nt, Pseudomonas putida KT2440
gcgguaccggccagcug

SEQ ID NO: 3557310 - RNA, 22 nt, Pseudomonas putida KT2440
gcgguaccggccagcugcgcac

SEQ ID NO: 3557311 - RNA, 15 nt, Pseudomonas putida KT2440
gcgguaccugugggg

SEQ ID NO: 3557312 - RNA, 21 nt, Pseudomonas putida KT2440
gcgguaccuguggggcaacug

SEQ ID NO: 3557313 - RNA, 12 nt, Pseudomonas putida KT2440
gcgguacgccgu

SEQ ID NO: 3557314 - RNA, 22 nt, Pseudomonas putida KT2440
gcgguacuggaagagcaggaag

SEQ ID NO: 3557315 - RNA, 14 nt, Pseudomonas putida KT2440
gcgguagugcaggc

SEQ ID NO: 3557316 - RNA, 17 nt, Pseudomonas putida KT2440
gcgguagugcggccggg

SEQ ID NO: 3557317 - RNA, 16 nt, Pseudomonas putida KT2440
gcgguauaggccgcaa

SEQ ID NO: 3557318 - RNA, 19 nt, Pseudomonas putida KT2440
gcgguauccaucaccauca

SEQ ID NO: 3557319 - RNA, 17 nt, Pseudomonas putida KT2440
gcggucaagcucguccu

SEQ ID NO: 3557320 - RNA, 21 nt, Pseudomonas putida KT2440
gcggucaauuggagcggccuu

SEQ ID NO: 3557321 - RNA, 14 nt, Pseudomonas putida KT2440
gcggucagccugcg

SEQ ID NO: 3557322 - RNA, 16 nt, Pseudomonas putida KT2440
gcggucagcgaauagu

SEQ ID NO: 3557323 - RNA, 16 nt, Pseudomonas putida KT2440
gcggucaggccaagua

SEQ ID NO: 3557324 - RNA, 22 nt, Pseudomonas putida KT2440
gcggucaucaccacccccagcg

SEQ ID NO: 3557325 - RNA, 13 nt, Pseudomonas putida KT2440
gcgguccaccgcc

SEQ ID NO: 3557326 - RNA, 14 nt, Pseudomonas putida KT2440
gcgguccaccgcca

SEQ ID NO: 3557327 - RNA, 22 nt, Pseudomonas putida KT2440
gcgguccgcccuugccaccagu

SEQ ID NO: 3557328 - RNA, 17 nt, Pseudomonas putida KT2440
gcggucgaaaagccgcg

SEQ ID NO: 3557329 - RNA, 20 nt, Pseudomonas putida KT2440
gcggucgccaaauucgacca

SEQ ID NO: 3557330 - RNA, 22 nt, Pseudomonas putida KT2440
gcggucgccaaauucgaccagc

SEQ ID NO: 3557331 - RNA, 12 nt, Pseudomonas putida KT2440
gcggucgccgug

SEQ ID NO: 3557332 - RNA, 17 nt, Pseudomonas putida KT2440
gcggucggucagcaccu

SEQ ID NO: 3557333 - RNA, 22 nt, Pseudomonas putida KT2440
gcggucggucagcaccuggcag

SEQ ID NO: 3557334 - RNA, 22 nt, Pseudomonas putida KT2440
gcggucggugaaaccaccccgg

SEQ ID NO: 3557335 - RNA, 16 nt, Pseudomonas putida KT2440
gcggucguagcccucg

SEQ ID NO: 3557336 - RNA, 17 nt, Pseudomonas putida KT2440
gcggucguuacccaggu

SEQ ID NO: 3557337 - RNA, 13 nt, Pseudomonas putida KT2440
gcggucucggugc

SEQ ID NO: 3557338 - RNA, 16 nt, Pseudomonas putida KT2440
gcggucucggugcucc

SEQ ID NO: 3557339 - RNA, 17 nt, Pseudomonas putida KT2440
gcggucuuguaucccag

SEQ ID NO: 3557340 - RNA, 16 nt, Pseudomonas putida KT2440
gcggugaccgaggcga

SEQ ID NO: 3557341 - RNA, 21 nt, Pseudomonas putida KT2440
gcggugauaugcguacccggc

SEQ ID NO: 3557342 - RNA, 18 nt, Pseudomonas putida KT2440
gcggugauggcgcauggc

SEQ ID NO: 3557343 - RNA, 14 nt, Pseudomonas putida KT2440
gcggugcacggccu

SEQ ID NO: 3557344 - RNA, 15 nt, Pseudomonas putida KT2440
gcggugcacggccug

SEQ ID NO: 3557345 - RNA, 21 nt, Pseudomonas putida KT2440
gcggugcacguagucgucagg

SEQ ID NO: 3557346 - RNA, 23 nt, Pseudomonas putida KT2440
gcggugcagauugcccuguggcu

SEQ ID NO: 3557347 - RNA, 16 nt, Pseudomonas putida KT2440
gcggugcagcaccucc

SEQ ID NO: 3557348 - RNA, 14 nt, Pseudomonas putida KT2440
gcggugccggcagc

SEQ ID NO: 3557349 - RNA, 19 nt, Pseudomonas putida KT2440
gcggugcgcacgaagauca

SEQ ID NO: 3557350 - RNA, 14 nt, Pseudomonas putida KT2440
gcggugcggcgaca

SEQ ID NO: 3557351 - RNA, 20 nt, Pseudomonas putida KT2440
gcggugcggcguagaccagu

SEQ ID NO: 3557352 - RNA, 11 nt, Pseudomonas putida KT2440
gcggugcucga

SEQ ID NO: 3557353 - RNA, 23 nt, Pseudomonas putida KT2440
gcgguggaguaccugugggagcg

SEQ ID NO: 3557354 - RNA, 14 nt, Pseudomonas putida KT2440
gcgguggauggcac

SEQ ID NO: 3557355 - RNA, 15 nt, Pseudomonas putida KT2440
gcgguggauggcacg

SEQ ID NO: 3557356 - RNA, 17 nt, Pseudomonas putida KT2440
gcgguggccgcguacca

SEQ ID NO: 3557357 - RNA, 16 nt, Pseudomonas putida KT2440
gcgguggcuggcaccg

SEQ ID NO: 3557358 - RNA, 18 nt, Pseudomonas putida KT2440
gcggugugggcgaagucc

SEQ ID NO: 3557359 - RNA, 15 nt, Pseudomonas putida KT2440
gcgguuacgacgugc

SEQ ID NO: 3557360 - RNA, 15 nt, Pseudomonas putida KT2440
gcgguucaccagcag

SEQ ID NO: 3557361 - RNA, 17 nt, Pseudomonas putida KT2440
gcgucucauuguuugcg

SEQ ID NO: 3557362 - RNA, 15 nt, Pseudomonas putida KT2440
gcgucucgccaaacu

SEQ ID NO: 3557363 - RNA, 15 nt, Pseudomonas putida KT2440
gcgucugacuggcag

SEQ ID NO: 3557364 - RNA, 15 nt, Pseudomonas putida KT2440
gcgucugauagccag

SEQ ID NO: 3557365 - RNA, 17 nt, Pseudomonas putida KT2440
gcgucuuccacgcccag

SEQ ID NO: 3557366 - RNA, 16 nt, Pseudomonas putida KT2440
gcgucuuguuguccgg

SEQ ID NO: 3557367 - RNA, 11 nt, Pseudomonas putida KT2440
gcgugaaagca

SEQ ID NO: 3557368 - RNA, 19 nt, Pseudomonas putida KT2440
gcgugaaauccucaaccug

SEQ ID NO: 3557369 - RNA, 19 nt, Pseudomonas putida KT2440
gcgugaacuugaucgcguu

SEQ ID NO: 3557370 - RNA, 20 nt, Pseudomonas putida KT2440
gcgugaagcggccaccugcc

SEQ ID NO: 3557371 - RNA, 16 nt, Pseudomonas putida KT2440
gcgugaccagcccggc

SEQ ID NO: 3557372 - RNA, 17 nt, Pseudomonas putida KT2440
gcgugaccagcccggcc

SEQ ID NO: 3557373 - RNA, 16 nt, Pseudomonas putida KT2440
gcgugaccgccccgcc

SEQ ID NO: 3557374 - RNA, 14 nt, Pseudomonas putida KT2440
gcgugauggugguc

SEQ ID NO: 3557375 - RNA, 23 nt, Pseudomonas putida KT2440
gcgugcaagggauaucaggcccu

SEQ ID NO: 3557376 - RNA, 15 nt, Pseudomonas putida KT2440
gcgugccaccucugg

SEQ ID NO: 3557377 - RNA, 15 nt, Pseudomonas putida KT2440
gcgugccaggcuugg

SEQ ID NO: 3557378 - RNA, 18 nt, Pseudomonas putida KT2440
gcgugcccgcgaaugcaa

SEQ ID NO: 3557379 - RNA, 23 nt, Pseudomonas putida KT2440
gcgugcccggcaaucgccaggcg

SEQ ID NO: 3557380 - RNA, 17 nt, Pseudomonas putida KT2440
gcgugccgcaugugcca

SEQ ID NO: 3557381 - RNA, 21 nt, Pseudomonas putida KT2440
gcgugccgucgagcaggucga

SEQ ID NO: 3557382 - RNA, 17 nt, Pseudomonas putida KT2440
gcgugccucgcccaggu

SEQ ID NO: 3557383 - RNA, 13 nt, Pseudomonas putida KT2440
gcgugccucgggc

SEQ ID NO: 3557384 - RNA, 23 nt, Pseudomonas putida KT2440
gcgugccuugccugggccggugg

SEQ ID NO: 3557385 - RNA, 13 nt, Pseudomonas putida KT2440
gcgugcgcccggc

SEQ ID NO: 3557386 - RNA, 15 nt, Pseudomonas putida KT2440
gcgugcgcucaggcg

SEQ ID NO: 3557387 - RNA, 15 nt, Pseudomonas putida KT2440
gcgugcugguccucc

SEQ ID NO: 3557388 - RNA, 13 nt, Pseudomonas putida KT2440
gcgugcugugcac

SEQ ID NO: 3557389 - RNA, 21 nt, Pseudomonas putida KT2440
gcgugcuguugagccagggcg

SEQ ID NO: 3557390 - RNA, 15 nt, Pseudomonas putida KT2440
gcgugcuuccaccuc

SEQ ID NO: 3557391 - RNA, 20 nt, Pseudomonas putida KT2440
gcgugcuugcaccgacaagc

SEQ ID NO: 3557392 - RNA, 23 nt, Pseudomonas putida KT2440
gcguggaacaacggcucacugcu

SEQ ID NO: 3557393 - RNA, 16 nt, Pseudomonas putida KT2440
gcguggcaccggcgaa

SEQ ID NO: 3557394 - RNA, 17 nt, Pseudomonas putida KT2440
gcguggcaccggcgaag

SEQ ID NO: 3557395 - RNA, 14 nt, Pseudomonas putida KT2440
gcguggccagccca

SEQ ID NO: 3557396 - RNA, 16 nt, Pseudomonas putida KT2440
gcguggccagcccaag

SEQ ID NO: 3557397 - RNA, 20 nt, Pseudomonas putida KT2440
gcguggccugcaagccggcg

SEQ ID NO: 3557398 - RNA, 18 nt, Pseudomonas putida KT2440
gcguggccuucucuuccg

SEQ ID NO: 3557399 - RNA, 12 nt, Pseudomonas putida KT2440
gcguggcgaggu

SEQ ID NO: 3557400 - RNA, 17 nt, Pseudomonas putida KT2440
gcguggcggugaugcgc

SEQ ID NO: 3557401 - RNA, 16 nt, Pseudomonas putida KT2440
gcguggcugcguucag

SEQ ID NO: 3557402 - RNA, 18 nt, Pseudomonas putida KT2440
gcguggcugcguucaggc

SEQ ID NO: 3557403 - RNA, 15 nt, Pseudomonas putida KT2440
gcguggucgccggcg

SEQ ID NO: 3557404 - RNA, 17 nt, Pseudomonas putida KT2440
gcguggugaauggcgag

SEQ ID NO: 3557405 - RNA, 15 nt, Pseudomonas putida KT2440
gcgugguggcaccgg

SEQ ID NO: 3557406 - RNA, 20 nt, Pseudomonas putida KT2440
gcgugguuguguagguauca

SEQ ID NO: 3557407 - RNA, 14 nt, Pseudomonas putida KT2440
gcguguccagcagg

SEQ ID NO: 3557408 - RNA, 15 nt, Pseudomonas putida KT2440
gcguguccagcaggu

SEQ ID NO: 3557409 - RNA, 21 nt, Pseudomonas putida KT2440
gcgugugacccaguucgcgga

SEQ ID NO: 3557410 - RNA, 18 nt, Pseudomonas putida KT2440
gcguucacaucgcccuuc

SEQ ID NO: 3557411 - RNA, 21 nt, Pseudomonas putida KT2440
gcguucagcaagaccagaaac

SEQ ID NO: 3557412 - RNA, 16 nt, Pseudomonas putida KT2440
gcguucaggcaggaac

SEQ ID NO: 3557413 - RNA, 17 nt, Pseudomonas putida KT2440
gcguucaggcaggaacu

SEQ ID NO: 3557414 - RNA, 18 nt, Pseudomonas putida KT2440
gcguucaucgaaggccuu

SEQ ID NO: 3557415 - RNA, 23 nt, Pseudomonas putida KT2440
gcguuccagccaggcgucgauca

SEQ ID NO: 3557416 - RNA, 20 nt, Pseudomonas putida KT2440
gcguucgaugcgcagagcca

SEQ ID NO: 3557417 - RNA, 16 nt, Pseudomonas putida KT2440
gcguucgcccuccugc

SEQ ID NO: 3557418 - RNA, 15 nt, Pseudomonas putida KT2440
gcguucggccagcac

SEQ ID NO: 3557419 - RNA, 16 nt, Pseudomonas putida KT2440
gcguugauccggcacu

SEQ ID NO: 3557420 - RNA, 14 nt, Pseudomonas putida KT2440
gcguugcaguccuu

SEQ ID NO: 3557421 - RNA, 22 nt, Pseudomonas putida KT2440
gcguugcggcccuucgcgggca

SEQ ID NO: 3557422 - RNA, 23 nt, Pseudomonas putida KT2440
gcguugcggcccuucgcgggcac

SEQ ID NO: 3557423 - RNA, 15 nt, Pseudomonas putida KT2440
gcguugcuccagcuc

SEQ ID NO: 3557424 - RNA, 17 nt, Pseudomonas putida KT2440
gcguuggcagcaccacg

SEQ ID NO: 3557425 - RNA, 23 nt, Pseudomonas putida KT2440
gcguuggccaaaccguccaggua

SEQ ID NO: 3557426 - RNA, 19 nt, Pseudomonas putida KT2440
gcguuggccaggucgaccg

SEQ ID NO: 3557427 - RNA, 22 nt, Pseudomonas putida KT2440
gcguuggccgaaggccguggca

SEQ ID NO: 3557428 - RNA, 18 nt, Pseudomonas putida KT2440
gcguuggcugcugaaugc

SEQ ID NO: 3557429 - RNA, 19 nt, Pseudomonas putida KT2440
gcguuggcuuccacggcgc

SEQ ID NO: 3557430 - RNA, 21 nt, Pseudomonas putida KT2440
gcguuggcuucuucgcgggca

SEQ ID NO: 3557431 - RNA, 18 nt, Pseudomonas putida KT2440
gcguugucagcaaccgga

SEQ ID NO: 3557432 - RNA, 15 nt, Pseudomonas putida KT2440
gcguuguccagcagg

SEQ ID NO: 3557433 - RNA, 15 nt, Pseudomonas putida KT2440
gcguuguucagcagc

SEQ ID NO: 3557434 - RNA, 19 nt, Pseudomonas putida KT2440
gcguuuaaaccuucaacac

SEQ ID NO: 3557435 - RNA, 20 nt, Pseudomonas putida KT2440
gcguuucggcggccugcagc

SEQ ID NO: 3557436 - RNA, 21 nt, Pseudomonas putida KT2440
gcguuucggcggccugcagcu

SEQ ID NO: 3557437 - RNA, 19 nt, Pseudomonas putida KT2440
gcguuugcaacuggcgcag

SEQ ID NO: 3557438 - RNA, 19 nt, Pseudomonas putida KT2440
gcguuuguaaguaggcgcu

SEQ ID NO: 3557439 - RNA, 15 nt, Pseudomonas putida KT2440
gcguuuuuugugccu

SEQ ID NO: 3557440 - RNA, 18 nt, Pseudomonas putida KT2440
gcuaaaggcauucgcggg

SEQ ID NO: 3557441 - RNA, 18 nt, Pseudomonas putida KT2440
gcuaaccucugcaugcca

SEQ ID NO: 3557442 - RNA, 22 nt, Pseudomonas putida KT2440
gcuaacguagggaagcggauga

SEQ ID NO: 3557443 - RNA, 18 nt, Pseudomonas putida KT2440
gcuaaggcugauaagcaa

SEQ ID NO: 3557444 - RNA, 15 nt, Pseudomonas putida KT2440
gcuaaguuugcccag

SEQ ID NO: 3557445 - RNA, 13 nt, Pseudomonas putida KT2440
gcuaauacccugu

SEQ ID NO: 3557446 - RNA, 14 nt, Pseudomonas putida KT2440
gcuacacgcgcccu

SEQ ID NO: 3557447 - RNA, 20 nt, Pseudomonas putida KT2440
gcuacagaagccucaccgcc

SEQ ID NO: 3557448 - RNA, 19 nt, Pseudomonas putida KT2440
gcuacagaucagccacggg

SEQ ID NO: 3557449 - RNA, 12 nt, Pseudomonas putida KT2440
gcuacagccccu

SEQ ID NO: 3557450 - RNA, 19 nt, Pseudomonas putida KT2440
gcuacagccccuuccccag

SEQ ID NO: 3557451 - RNA, 19 nt, Pseudomonas putida KT2440
gcuaccaaccuccagguca

SEQ ID NO: 3557452 - RNA, 17 nt, Pseudomonas putida KT2440
gcuaccacguuauccag

SEQ ID NO: 3557453 - RNA, 20 nt, Pseudomonas putida KT2440
gcuaccacguuauccagcug

SEQ ID NO: 3557454 - RNA, 16 nt, Pseudomonas putida KT2440
gcuaccagcaguuggc

SEQ ID NO: 3557455 - RNA, 19 nt, Pseudomonas putida KT2440
gcuaccagcaguuggcugc

SEQ ID NO: 3557456 - RNA, 21 nt, Pseudomonas putida KT2440
gcuacccaaacucuugagcug

SEQ ID NO: 3557457 - RNA, 14 nt, Pseudomonas putida KT2440
gcuacccagccggg

SEQ ID NO: 3557458 - RNA, 21 nt, Pseudomonas putida KT2440
gcuacccagccgggcaugcag

SEQ ID NO: 3557459 - RNA, 22 nt, Pseudomonas putida KT2440
gcuaccccacaaccccugcaag

SEQ ID NO: 3557460 - RNA, 15 nt, Pseudomonas putida KT2440
gcuacccgcucggcc

SEQ ID NO: 3557461 - RNA, 20 nt, Pseudomonas putida KT2440
gcuaccgaggucugcgcggg

SEQ ID NO: 3557462 - RNA, 20 nt, Pseudomonas putida KT2440
gcuaccgcauucuuggccag

SEQ ID NO: 3557463 - RNA, 18 nt, Pseudomonas putida KT2440
gcuaccugacuugccugu

SEQ ID NO: 3557464 - RNA, 21 nt, Pseudomonas putida KT2440
gcuaccugguucaucgacuug

SEQ ID NO: 3557465 - RNA, 15 nt, Pseudomonas putida KT2440
gcuaccugugggagc

SEQ ID NO: 3557466 - RNA, 12 nt, Pseudomonas putida KT2440
gcuccaaagcca

SEQ ID NO: 3557467 - RNA, 14 nt, Pseudomonas putida KT2440
gcuccaacaaacuc

SEQ ID NO: 3557468 - RNA, 23 nt, Pseudomonas putida KT2440
gcuccaacaaacucgacgccccg

SEQ ID NO: 3557469 - RNA, 14 nt, Pseudomonas putida KT2440
gcuccaaccccagc

SEQ ID NO: 3557470 - RNA, 16 nt, Pseudomonas putida KT2440
gcuccaaccccagcgc

SEQ ID NO: 3557471 - RNA, 17 nt, Pseudomonas putida KT2440
gcuccaaccccagcgca

SEQ ID NO: 3557472 - RNA, 18 nt, Pseudomonas putida KT2440
gcuccaaccccagcgcau

SEQ ID NO: 3557473 - RNA, 19 nt, Pseudomonas putida KT2440
gcuccaacuggcgcaucuu

SEQ ID NO: 3557474 - RNA, 20 nt, Pseudomonas putida KT2440
gcuccacaucuugccccggu

SEQ ID NO: 3557475 - RNA, 16 nt, Pseudomonas putida KT2440
gcuccaccaaggcuga

SEQ ID NO: 3557476 - RNA, 13 nt, Pseudomonas putida KT2440
gcuccaccacagc

SEQ ID NO: 3557477 - RNA, 15 nt, Pseudomonas putida KT2440
gcuccaccacagcug

SEQ ID NO: 3557478 - RNA, 21 nt, Pseudomonas putida KT2440
gcuccaccacagcugcgccag

SEQ ID NO: 3557479 - RNA, 21 nt, Pseudomonas putida KT2440
gcuccaccgaaaucagcaacg

SEQ ID NO: 3557480 - RNA, 20 nt, Pseudomonas putida KT2440
gcuccaccugccaccccgca

SEQ ID NO: 3557481 - RNA, 17 nt, Pseudomonas putida KT2440
gcuccaccugcuccagc

SEQ ID NO: 3557482 - RNA, 18 nt, Pseudomonas putida KT2440
gcuccaccugcuccagca

SEQ ID NO: 3557483 - RNA, 20 nt, Pseudomonas putida KT2440
gcuccaccugcuccagcacc

SEQ ID NO: 3557484 - RNA, 21 nt, Pseudomonas putida KT2440
gcuccaccugcuccagcaccu

SEQ ID NO: 3557485 - RNA, 21 nt, Pseudomonas putida KT2440
gcuccagacgcuguacgucca

SEQ ID NO: 3557486 - RNA, 16 nt, Pseudomonas putida KT2440
gcuccagcaacugcgc

SEQ ID NO: 3557487 - RNA, 14 nt, Pseudomonas putida KT2440
gcuccagcagcucc

SEQ ID NO: 3557488 - RNA, 17 nt, Pseudomonas putida KT2440
gcuccagcagcuccaca

SEQ ID NO: 3557489 - RNA, 20 nt, Pseudomonas putida KT2440
gcuccagcagggucgccuga

SEQ ID NO: 3557490 - RNA, 17 nt, Pseudomonas putida KT2440
gcuccagcccagcgcca

SEQ ID NO: 3557491 - RNA, 19 nt, Pseudomonas putida KT2440
gcuccagcccagcgccagu

SEQ ID NO: 3557492 - RNA, 14 nt, Pseudomonas putida KT2440
gcuccagcgcacgc

SEQ ID NO: 3557493 - RNA, 15 nt, Pseudomonas putida KT2440
gcuccagcgcacgca

SEQ ID NO: 3557494 - RNA, 13 nt, Pseudomonas putida KT2440
gcuccagcucaca

SEQ ID NO: 3557495 - RNA, 16 nt, Pseudomonas putida KT2440
gcuccagcucacagca

SEQ ID NO: 3557496 - RNA, 17 nt, Pseudomonas putida KT2440
gcuccagcucacagcac

SEQ ID NO: 3557497 - RNA, 17 nt, Pseudomonas putida KT2440
gcuccagcucggcuggc

SEQ ID NO: 3557498 - RNA, 12 nt, Pseudomonas putida KT2440
gcuccaggcaca

SEQ ID NO: 3557499 - RNA, 13 nt, Pseudomonas putida KT2440
gcuccaggcacag

SEQ ID NO: 3557500 - RNA, 14 nt, Pseudomonas putida KT2440
gcuccaggcgacca

SEQ ID NO: 3557501 - RNA, 14 nt, Pseudomonas putida KT2440
gcuccaggcggcca

SEQ ID NO: 3557502 - RNA, 16 nt, Pseudomonas putida KT2440
gcuccaggcggccagc

SEQ ID NO: 3557503 - RNA, 12 nt, Pseudomonas putida KT2440
gcuccagggugc

SEQ ID NO: 3557504 - RNA, 23 nt, Pseudomonas putida KT2440
gcuccagguacucgcgacugaag

SEQ ID NO: 3557505 - RNA, 18 nt, Pseudomonas putida KT2440
gcuccaggugaaucagcg

SEQ ID NO: 3557506 - RNA, 22 nt, Pseudomonas putida KT2440
gcuccaggugaaucagcggcag

SEQ ID NO: 3557507 - RNA, 20 nt, Pseudomonas putida KT2440
gcuccagucguggcgcuggc

SEQ ID NO: 3557508 - RNA, 21 nt, Pseudomonas putida KT2440
gcuccagucguggcgcuggcg

SEQ ID NO: 3557509 - RNA, 14 nt, Pseudomonas putida KT2440
gcuccaguggugca

SEQ ID NO: 3557510 - RNA, 19 nt, Pseudomonas putida KT2440
gcuccaguucauucccggc

SEQ ID NO: 3557511 - RNA, 17 nt, Pseudomonas putida KT2440
gcuccaguugcaagccu

SEQ ID NO: 3557512 - RNA, 21 nt, Pseudomonas putida KT2440
gcuccaguugcaagccuucgu

SEQ ID NO: 3557513 - RNA, 17 nt, Pseudomonas putida KT2440
gcuccaucuccagcuca

SEQ ID NO: 3557514 - RNA, 19 nt, Pseudomonas putida KT2440
gcuccaugcggcuacccag

SEQ ID NO: 3557515 - RNA, 15 nt, Pseudomonas putida KT2440
gcucccacaaaggcc

SEQ ID NO: 3557516 - RNA, 20 nt, Pseudomonas putida KT2440
gcucccacaggaaucaccag

SEQ ID NO: 3557517 - RNA, 23 nt, Pseudomonas putida KT2440
gcucccacaggaaugucaccgcg

SEQ ID NO: 3557518 - RNA, 16 nt, Pseudomonas putida KT2440
gcucccacaggccaac

SEQ ID NO: 3557519 - RNA, 15 nt, Pseudomonas putida KT2440
gcucccacaggggau

SEQ ID NO: 3557520 - RNA, 20 nt, Pseudomonas putida KT2440
gcucccacagguaaugcaca

SEQ ID NO: 3557521 - RNA, 22 nt, Pseudomonas putida KT2440
gcucccacagguaugugagcug

SEQ ID NO: 3557522 - RNA, 19 nt, Pseudomonas putida KT2440
gcucccacagguccagcgc

SEQ ID NO: 3557523 - RNA, 20 nt, Pseudomonas putida KT2440
gcucccacaggugcagcaca

SEQ ID NO: 3557524 - RNA, 17 nt, Pseudomonas putida KT2440
gcucccagaaaggccgc

SEQ ID NO: 3557525 - RNA, 20 nt, Pseudomonas putida KT2440
gcucccagaaaggccgcugu

SEQ ID NO: 3557526 - RNA, 18 nt, Pseudomonas putida KT2440
gcuccccaaccaccuccc

SEQ ID NO: 3557527 - RNA, 17 nt, Pseudomonas putida KT2440
gcucccccaggcugcca

SEQ ID NO: 3557528 - RNA, 18 nt, Pseudomonas putida KT2440
gcucccgcgcaugcugcc

SEQ ID NO: 3557529 - RNA, 12 nt, Pseudomonas putida KT2440
gcucccggcauu

SEQ ID NO: 3557530 - RNA, 20 nt, Pseudomonas putida KT2440
gcucccucguaggagcgggu

SEQ ID NO: 3557531 - RNA, 13 nt, Pseudomonas putida KT2440
gcuccgacaggcu

SEQ ID NO: 3557532 - RNA, 18 nt, Pseudomonas putida KT2440
gcuccgccaaaccccagc

SEQ ID NO: 3557533 - RNA, 19 nt, Pseudomonas putida KT2440
gcuccgccaaaccccagca

SEQ ID NO: 3557534 - RNA, 20 nt, Pseudomonas putida KT2440
gcuccgccaaaccccagcaa

SEQ ID NO: 3557535 - RNA, 12 nt, Pseudomonas putida KT2440
gcuccgccacca

SEQ ID NO: 3557536 - RNA, 21 nt, Pseudomonas putida KT2440
gcuccggaucguugcggguca

SEQ ID NO: 3557537 - RNA, 21 nt, Pseudomonas putida KT2440
gcuccggccaaaaguugcuca

SEQ ID NO: 3557538 - RNA, 22 nt, Pseudomonas putida KT2440
gcuccggcgaauccagcaggcu

SEQ ID NO: 3557539 - RNA, 17 nt, Pseudomonas putida KT2440
gcuccggcguguccagc

SEQ ID NO: 3557540 - RNA, 21 nt, Pseudomonas putida KT2440
gcuccggguacuucucgacca

SEQ ID NO: 3557541 - RNA, 19 nt, Pseudomonas putida KT2440
gcuccuacaagguugcgca

SEQ ID NO: 3557542 - RNA, 21 nt, Pseudomonas putida KT2440
gcuccuacaagguugcgcaag

SEQ ID NO: 3557543 - RNA, 15 nt, Pseudomonas putida KT2440
gcuccuacacaggaa

SEQ ID NO: 3557544 - RNA, 22 nt, Pseudomonas putida KT2440
gcuccuacacaggucauuugca

SEQ ID NO: 3557545 - RNA, 15 nt, Pseudomonas putida KT2440
gcuccuacaggccgc

SEQ ID NO: 3557546 - RNA, 15 nt, Pseudomonas putida KT2440
gcuccuacaggcgac

SEQ ID NO: 3557547 - RNA, 18 nt, Pseudomonas putida KT2440
gcuccuacaggggacgca

SEQ ID NO: 3557548 - RNA, 18 nt, Pseudomonas putida KT2440
gcuccuaccacguacaca

SEQ ID NO: 3557549 - RNA, 20 nt, Pseudomonas putida KT2440
gcuccuacgacggccugcgc

SEQ ID NO: 3557550 - RNA, 19 nt, Pseudomonas putida KT2440
gcuccuacgcggggcagcg

SEQ ID NO: 3557551 - RNA, 19 nt, Pseudomonas putida KT2440
gcuccuacggaaucugcac

SEQ ID NO: 3557552 - RNA, 21 nt, Pseudomonas putida KT2440
gcuccuacggaaucugcaccg

SEQ ID NO: 3557553 - RNA, 17 nt, Pseudomonas putida KT2440
gcuccuacgggcaaccg

SEQ ID NO: 3557554 - RNA, 17 nt, Pseudomonas putida KT2440
gcuccugcacaacccua

SEQ ID NO: 3557555 - RNA, 17 nt, Pseudomonas putida KT2440
gcuccugcagguaucac

SEQ ID NO: 3557556 - RNA, 23 nt, Pseudomonas putida KT2440
gcuccugcgccaccucggcgaaa

SEQ ID NO: 3557557 - RNA, 17 nt, Pseudomonas putida KT2440
gcuccuggcccgcgccc

SEQ ID NO: 3557558 - RNA, 16 nt, Pseudomonas putida KT2440
gcuccuuauccuucag

SEQ ID NO: 3557559 - RNA, 21 nt, Pseudomonas putida KT2440
gcuccuucucgaacagcuggc

SEQ ID NO: 3557560 - RNA, 20 nt, Pseudomonas putida KT2440
gcuccuucuucacccgcagc

SEQ ID NO: 3557561 - RNA, 22 nt, Pseudomonas putida KT2440
gcuccuugagguagucgaucca

SEQ ID NO: 3557562 - RNA, 18 nt, Pseudomonas putida KT2440
gcucgaagcgcucaugca

SEQ ID NO: 3557563 - RNA, 18 nt, Pseudomonas putida KT2440
gcucgaauacacgggaca

SEQ ID NO: 3557564 - RNA, 16 nt, Pseudomonas putida KT2440
gcucgacaaacugcug

SEQ ID NO: 3557565 - RNA, 17 nt, Pseudomonas putida KT2440
gcucgacaaacugcuga

SEQ ID NO: 3557566 - RNA, 18 nt, Pseudomonas putida KT2440
gcucgaccagaucagccg

SEQ ID NO: 3557567 - RNA, 15 nt, Pseudomonas putida KT2440
gcucgacccgcguca

SEQ ID NO: 3557568 - RNA, 12 nt, Pseudomonas putida KT2440
gcucgacgaagg

SEQ ID NO: 3557569 - RNA, 14 nt, Pseudomonas putida KT2440
gcucgacgcgcgca

SEQ ID NO: 3557570 - RNA, 16 nt, Pseudomonas putida KT2440
gcucgacgcgggccaa

SEQ ID NO: 3557571 - RNA, 17 nt, Pseudomonas putida KT2440
gcucugcuccagcugcu

SEQ ID NO: 3557572 - RNA, 17 nt, Pseudomonas putida KT2440
gcucugcuugagcgcag

SEQ ID NO: 3557573 - RNA, 19 nt, Pseudomonas putida KT2440
gcucuggcccgaacagcac

SEQ ID NO: 3557574 - RNA, 22 nt, Pseudomonas putida KT2440
gcucugggcaaaaucgaccagg

SEQ ID NO: 3557575 - RNA, 17 nt, Pseudomonas putida KT2440
gcucuguaucgaacagg

SEQ ID NO: 3557576 - RNA, 18 nt, Pseudomonas putida KT2440
gcucuguuucugccccug

SEQ ID NO: 3557577 - RNA, 19 nt, Pseudomonas putida KT2440
gcucuucaacaccagcaug

SEQ ID NO: 3557578 - RNA, 21 nt, Pseudomonas putida KT2440
gcucuucaaccaguucagcgc

SEQ ID NO: 3557579 - RNA, 12 nt, Pseudomonas putida KT2440
gcucuucaaccg

SEQ ID NO: 3557580 - RNA, 23 nt, Pseudomonas putida KT2440
gcucuucgaguuuggccagccga

SEQ ID NO: 3557581 - RNA, 18 nt, Pseudomonas putida KT2440
gcucuucgauccgcgcca

SEQ ID NO: 3557582 - RNA, 23 nt, Pseudomonas putida KT2440
gcucuucgauccgcgccaucagc

SEQ ID NO: 3557583 - RNA, 13 nt, Pseudomonas putida KT2440
gcucuucgcgggu

SEQ ID NO: 3557584 - RNA, 14 nt, Pseudomonas putida KT2440
gcucuucgcgggug

SEQ ID NO: 3557585 - RNA, 19 nt, Pseudomonas putida KT2440
gcucuucgcgggugaaccc

SEQ ID NO: 3557586 - RNA, 17 nt, Pseudomonas putida KT2440
gcucuucucgucguagc

SEQ ID NO: 3557587 - RNA, 13 nt, Pseudomonas putida KT2440
gcucuucuuucag

SEQ ID NO: 3557588 - RNA, 14 nt, Pseudomonas putida KT2440
gcucuucuuucagg

SEQ ID NO: 3557589 - RNA, 15 nt, Pseudomonas putida KT2440
gcucuugcagcgagu

SEQ ID NO: 3557590 - RNA, 14 nt, Pseudomonas putida KT2440
gcucuugcggauca

SEQ ID NO: 3557591 - RNA, 18 nt, Pseudomonas putida KT2440
gcucuugucgacagugaa

SEQ ID NO: 3557592 - RNA, 13 nt, Pseudomonas putida KT2440
gcugaaacaucag

SEQ ID NO: 3557593 - RNA, 15 nt, Pseudomonas putida KT2440
gcugaaaccgcgaau

SEQ ID NO: 3557594 - RNA, 21 nt, Pseudomonas putida KT2440
gcugaaagucgucggcaagcu

SEQ ID NO: 3557595 - RNA, 19 nt, Pseudomonas putida KT2440
gcugaaauggcggcccagc

SEQ ID NO: 3557596 - RNA, 17 nt, Pseudomonas putida KT2440
gcugaacaacuccgggu

SEQ ID NO: 3557597 - RNA, 17 nt, Pseudomonas putida KT2440
gcugaacacgcccgcgu

SEQ ID NO: 3557598 - RNA, 22 nt, Pseudomonas putida KT2440
gcugaacacgcucaugaacagc

SEQ ID NO: 3557599 - RNA, 16 nt, Pseudomonas putida KT2440
gcugaacagccggccc

SEQ ID NO: 3557600 - RNA, 20 nt, Pseudomonas putida KT2440
gcugaacagccggcccuucu

SEQ ID NO: 3557601 - RNA, 13 nt, Pseudomonas putida KT2440
gcugaaccugacc

SEQ ID NO: 3557602 - RNA, 21 nt, Pseudomonas putida KT2440
gcugaacuuccaggucggggu

SEQ ID NO: 3557603 - RNA, 23 nt, Pseudomonas putida KT2440
gcugaagccaguacgcgccugca

SEQ ID NO: 3557604 - RNA, 17 nt, Pseudomonas putida KT2440
gcugaagcucuccagca

SEQ ID NO: 3557605 - RNA, 19 nt, Pseudomonas putida KT2440
gcugaagcucuccagcagg

SEQ ID NO: 3557606 - RNA, 20 nt, Pseudomonas putida KT2440
gcugaagcucuccagcaggu

SEQ ID NO: 3557607 - RNA, 20 nt, Pseudomonas putida KT2440
gcugaaguagcgcagauccc

SEQ ID NO: 3557608 - RNA, 17 nt, Pseudomonas putida KT2440
gcugaagugccaaggcu

SEQ ID NO: 3557609 - RNA, 20 nt, Pseudomonas putida KT2440
gcugaaugaaaaagccccgc

SEQ ID NO: 3557610 - RNA, 23 nt, Pseudomonas putida KT2440
gcugaaugaaaaagccccgccag

SEQ ID NO: 3557611 - RNA, 15 nt, Pseudomonas putida KT2440
gcugacaccgcugcc

SEQ ID NO: 3557612 - RNA, 12 nt, Pseudomonas putida KT2440
gcugaccaguug

SEQ ID NO: 3557613 - RNA, 19 nt, Pseudomonas putida KT2440
gcugaccauaccucccgca

SEQ ID NO: 3557614 - RNA, 18 nt, Pseudomonas putida KT2440
gcugaccccacccuugaa

SEQ ID NO: 3557615 - RNA, 18 nt, Pseudomonas putida KT2440
gcugaccgccugcgcacg

SEQ ID NO: 3557616 - RNA, 19 nt, Pseudomonas putida KT2440
gcugaccgggucgacgcgc

SEQ ID NO: 3557617 - RNA, 20 nt, Pseudomonas putida KT2440
gcugaccuguucgcgcaaca

SEQ ID NO: 3557618 - RNA, 22 nt, Pseudomonas putida KT2440
gcugaccuguucgcgcaacacu

SEQ ID NO: 3557619 - RNA, 15 nt, Pseudomonas putida KT2440
gcugacgcgccgugc

SEQ ID NO: 3557620 - RNA, 14 nt, Pseudomonas putida KT2440
gcugacucagcggc

SEQ ID NO: 3557621 - RNA, 18 nt, Pseudomonas putida KT2440
gcugacucagcggccuuu

SEQ ID NO: 3557622 - RNA, 17 nt, Pseudomonas putida KT2440
gcugacuuccagcagca

SEQ ID NO: 3557623 - RNA, 17 nt, Pseudomonas putida KT2440
gcugagcaagcgcgcgc

SEQ ID NO: 3557624 - RNA, 15 nt, Pseudomonas putida KT2440
gcugagcagaccagc

SEQ ID NO: 3557625 - RNA, 11 nt, Pseudomonas putida KT2440
gcugagcagcg

SEQ ID NO: 3557626 - RNA, 19 nt, Pseudomonas putida KT2440
gcugagcagguuguccacc

SEQ ID NO: 3557627 - RNA, 15 nt, Pseudomonas putida KT2440
gcugagccaguucac

SEQ ID NO: 3557628 - RNA, 17 nt, Pseudomonas putida KT2440
gcugagccaguucacgg

SEQ ID NO: 3557629 - RNA, 16 nt, Pseudomonas putida KT2440
gcugagcccaaccucu

SEQ ID NO: 3557630 - RNA, 15 nt, Pseudomonas putida KT2440
gcugagccggcuggc

SEQ ID NO: 3557631 - RNA, 15 nt, Pseudomonas putida KT2440
gcugagcgacagcau

SEQ ID NO: 3557632 - RNA, 22 nt, Pseudomonas putida KT2440
gcugagcgccauccaccuguga

SEQ ID NO: 3557633 - RNA, 20 nt, Pseudomonas putida KT2440
gcugagguucagcgcaccgc

SEQ ID NO: 3557634 - RNA, 22 nt, Pseudomonas putida KT2440
gcugauacgagucauccucacc

SEQ ID NO: 3557635 - RNA, 17 nt, Pseudomonas putida KT2440
gcugaucaagcccgcuc

SEQ ID NO: 3557636 - RNA, 19 nt, Pseudomonas putida KT2440
gcugaucaagcccgcucgc

SEQ ID NO: 3557637 - RNA, 20 nt, Pseudomonas putida KT2440
gcugaucaagcccgcucgcc

SEQ ID NO: 3557638 - RNA, 12 nt, Pseudomonas putida KT2440
gcugaucaccag

SEQ ID NO: 3557639 - RNA, 21 nt, Pseudomonas putida KT2440
gcugaucagcaugucccgggu

SEQ ID NO: 3557640 - RNA, 20 nt, Pseudomonas putida KT2440
gcugaucaggaacacuucgc

SEQ ID NO: 3557641 - RNA, 21 nt, Pseudomonas putida KT2440
gcugaucagguugcccgcaug

SEQ ID NO: 3557642 - RNA, 20 nt, Pseudomonas putida KT2440
gcugaucaucgacaggugcg

SEQ ID NO: 3557643 - RNA, 16 nt, Pseudomonas putida KT2440
gcugauccgccuggcc

SEQ ID NO: 3557644 - RNA, 19 nt, Pseudomonas putida KT2440
gcugauccgccuggcccgu

SEQ ID NO: 3557645 - RNA, 21 nt, Pseudomonas putida KT2440
gcugaucgccgucgaccaggc

SEQ ID NO: 3557646 - RNA, 17 nt, Pseudomonas putida KT2440
gcugaucugaaaguuca

SEQ ID NO: 3557647 - RNA, 14 nt, Pseudomonas putida KT2440
gcugaucuucccgg

SEQ ID NO: 3557648 - RNA, 15 nt, Pseudomonas putida KT2440
gcugaucuucccggg

SEQ ID NO: 3557649 - RNA, 22 nt, Pseudomonas putida KT2440
gcugaugagguuugccaaggca

SEQ ID NO: 3557650 - RNA, 19 nt, Pseudomonas putida KT2440
gcugaugauauuugccacu

SEQ ID NO: 3557651 - RNA, 12 nt, Pseudomonas putida KT2440
gcugaugcccaa

SEQ ID NO: 3557652 - RNA, 12 nt, Pseudomonas putida KT2440
gcugaugcgccg

SEQ ID NO: 3557653 - RNA, 15 nt, Pseudomonas putida KT2440
gcugaugcgccgcuc

SEQ ID NO: 3557654 - RNA, 17 nt, Pseudomonas putida KT2440
gcugaugcgcuggcccu

SEQ ID NO: 3557655 - RNA, 19 nt, Pseudomonas putida KT2440
gcugaugcgggaccagcac

SEQ ID NO: 3557656 - RNA, 20 nt, Pseudomonas putida KT2440
gcugaugcgggaccagcacc

SEQ ID NO: 3557657 - RNA, 22 nt, Pseudomonas putida KT2440
gcugaugcgguagugcaggcga

SEQ ID NO: 3557658 - RNA, 20 nt, Pseudomonas putida KT2440
gcugauggauuccucgcgcu

SEQ ID NO: 3557659 - RNA, 17 nt, Pseudomonas putida KT2440
gcugauucagcacaccg

SEQ ID NO: 3557660 - RNA, 18 nt, Pseudomonas putida KT2440
gcugauucagcacaccgc

SEQ ID NO: 3557661 - RNA, 16 nt, Pseudomonas putida KT2440
gcugcaaagcagaccc

SEQ ID NO: 3557662 - RNA, 18 nt, Pseudomonas putida KT2440
gcugcaaagcgggcaacu

SEQ ID NO: 3557663 - RNA, 18 nt, Pseudomonas putida KT2440
gcugcaacagaaaaugcc

SEQ ID NO: 3557664 - RNA, 14 nt, Pseudomonas putida KT2440
gcugcaacagcggc

SEQ ID NO: 3557665 - RNA, 15 nt, Pseudomonas putida KT2440
gcugcaacagcggcg

SEQ ID NO: 3557666 - RNA, 18 nt, Pseudomonas putida KT2440
gcugcaacagcucaucca

SEQ ID NO: 3557667 - RNA, 20 nt, Pseudomonas putida KT2440
gcugcaacagcucauccagg

SEQ ID NO: 3557668 - RNA, 17 nt, Pseudomonas putida KT2440
gcugcaacagcuccagc

SEQ ID NO: 3557669 - RNA, 17 nt, Pseudomonas putida KT2440
gcugcaagcgcaccugc

SEQ ID NO: 3557670 - RNA, 18 nt, Pseudomonas putida KT2440
gcugcaagcgcaccugca

SEQ ID NO: 3557671 - RNA, 19 nt, Pseudomonas putida KT2440
gcugcaaggcagccccugc

SEQ ID NO: 3557672 - RNA, 20 nt, Pseudomonas putida KT2440
gcugcaaggcagccccugca

SEQ ID NO: 3557673 - RNA, 18 nt, Pseudomonas putida KT2440
gcugcaagguccaggcgu

SEQ ID NO: 3557674 - RNA, 19 nt, Pseudomonas putida KT2440
gcugcaaucgagccgaaca

SEQ ID NO: 3557675 - RNA, 14 nt, Pseudomonas putida KT2440
gcugcacaggccag

SEQ ID NO: 3557676 - RNA, 17 nt, Pseudomonas putida KT2440
gcugcgcagcuggucga

SEQ ID NO: 3557677 - RNA, 13 nt, Pseudomonas putida KT2440
gcugcgcagguau

SEQ ID NO: 3557678 - RNA, 15 nt, Pseudomonas putida KT2440
gcugcgcaguacagg

SEQ ID NO: 3557679 - RNA, 20 nt, Pseudomonas putida KT2440
gcugcgcaguacaggcugcc

SEQ ID NO: 3557680 - RNA, 23 nt, Pseudomonas putida KT2440
gcugcgcaguacaggcugccgcc

SEQ ID NO: 3557681 - RNA, 21 nt, Pseudomonas putida KT2440
gcugcgcaucacccgccccuc

SEQ ID NO: 3557682 - RNA, 17 nt, Pseudomonas putida KT2440
gcugcgcaugaaacucg

SEQ ID NO: 3557683 - RNA, 14 nt, Pseudomonas putida KT2440
gcugcgccagccgc

SEQ ID NO: 3557684 - RNA, 15 nt, Pseudomonas putida KT2440
gcugcgccccagguu

SEQ ID NO: 3557685 - RNA, 14 nt, Pseudomonas putida KT2440
gcugcgccgaucag

SEQ ID NO: 3557686 - RNA, 16 nt, Pseudomonas putida KT2440
gcugcgccgcucugcc

SEQ ID NO: 3557687 - RNA, 18 nt, Pseudomonas putida KT2440
gcugcgccgcucugcccg

SEQ ID NO: 3557688 - RNA, 21 nt, Pseudomonas putida KT2440
gcugcgccgcucugcccgcgc

SEQ ID NO: 3557689 - RNA, 19 nt, Pseudomonas putida KT2440
gcugcgccgguguucgcgg

SEQ ID NO: 3557690 - RNA, 20 nt, Pseudomonas putida KT2440
gcugcgccgguguucgcggg

SEQ ID NO: 3557691 - RNA, 16 nt, Pseudomonas putida KT2440
gcugcgccucgcaggu

SEQ ID NO: 3557692 - RNA, 17 nt, Pseudomonas putida KT2440
gcugcgccugccgggcc

SEQ ID NO: 3557693 - RNA, 19 nt, Pseudomonas putida KT2440
gcugcgccugccgggccag

SEQ ID NO: 3557694 - RNA, 16 nt, Pseudomonas putida KT2440
gcugcgcgauucgggg

SEQ ID NO: 3557695 - RNA, 16 nt, Pseudomonas putida KT2440
gcugcgcgccauggcg

SEQ ID NO: 3557696 - RNA, 12 nt, Pseudomonas putida KT2440
gcugcgcggcag

SEQ ID NO: 3557697 - RNA, 15 nt, Pseudomonas putida KT2440
gcugcgcggcagccc

SEQ ID NO: 3557698 - RNA, 15 nt, Pseudomonas putida KT2440
gcugcgcggccccug

SEQ ID NO: 3557699 - RNA, 20 nt, Pseudomonas putida KT2440
gcugcgcucgauccugugga

SEQ ID NO: 3557700 - RNA, 22 nt, Pseudomonas putida KT2440
gcugcggaucaucuccaugaag

SEQ ID NO: 3557701 - RNA, 16 nt, Pseudomonas putida KT2440
gcugcggcaggcuggc

SEQ ID NO: 3557702 - RNA, 14 nt, Pseudomonas putida KT2440
gcugcggcaugaag

SEQ ID NO: 3557703 - RNA, 21 nt, Pseudomonas putida KT2440
gcugcggcaugaaggcccagc

SEQ ID NO: 3557704 - RNA, 20 nt, Pseudomonas putida KT2440
gcugcggcgaaagccagcag

SEQ ID NO: 3557705 - RNA, 23 nt, Pseudomonas putida KT2440
gcugcgggcguuguguugcuggg

SEQ ID NO: 3557706 - RNA, 16 nt, Pseudomonas putida KT2440
gcugcggggcagcccc

SEQ ID NO: 3557707 - RNA, 17 nt, Pseudomonas putida KT2440
gcugcggguaaugccac

SEQ ID NO: 3557708 - RNA, 19 nt, Pseudomonas putida KT2440
gcugcggguaaugccaccu

SEQ ID NO: 3557709 - RNA, 14 nt, Pseudomonas putida KT2440
gcugcgggugcccg

SEQ ID NO: 3557710 - RNA, 19 nt, Pseudomonas putida KT2440
gcugcgguaccggccagcu

SEQ ID NO: 3557711 - RNA, 18 nt, Pseudomonas putida KT2440
gcugcgguagcgcagccu

SEQ ID NO: 3557712 - RNA, 14 nt, Pseudomonas putida KT2440
gcugcggucggguc

SEQ ID NO: 3557713 - RNA, 17 nt, Pseudomonas putida KT2440
gcugcguaaggccggga

SEQ ID NO: 3557714 - RNA, 16 nt, Pseudomonas putida KT2440
gcugcguacgcucugg

SEQ ID NO: 3557715 - RNA, 18 nt, Pseudomonas putida KT2440
gcugcgucagcauccaac

SEQ ID NO: 3557716 - RNA, 21 nt, Pseudomonas putida KT2440
gcugcgucagcauccaacccu

SEQ ID NO: 3557717 - RNA, 23 nt, Pseudomonas putida KT2440
gcugcgucagcauccaacccugc

SEQ ID NO: 3557718 - RNA, 17 nt, Pseudomonas putida KT2440
gcugcgucaggccaugc

SEQ ID NO: 3557719 - RNA, 14 nt, Pseudomonas putida KT2440
gcugcguccucgga

SEQ ID NO: 3557720 - RNA, 18 nt, Pseudomonas putida KT2440
gcugcgugccugcugcuc

SEQ ID NO: 3557721 - RNA, 15 nt, Pseudomonas putida KT2440
gcugcgugccuugcc

SEQ ID NO: 3557722 - RNA, 18 nt, Pseudomonas putida KT2440
gcugcguggcauccuuua

SEQ ID NO: 3557723 - RNA, 17 nt, Pseudomonas putida KT2440
gcugcguucaggcagga

SEQ ID NO: 3557724 - RNA, 20 nt, Pseudomonas putida KT2440
gcugcguugcggucagcgcu

SEQ ID NO: 3557725 - RNA, 15 nt, Pseudomonas putida KT2440
gcugcguuuaccggc

SEQ ID NO: 3557726 - RNA, 20 nt, Pseudomonas putida KT2440
gcugcguuuaccggcaccgc

SEQ ID NO: 3557727 - RNA, 13 nt, Pseudomonas putida KT2440
gcugcuacgccgc

SEQ ID NO: 3557728 - RNA, 13 nt, Pseudomonas putida KT2440
gcugcucaccaug

SEQ ID NO: 3557729 - RNA, 19 nt, Pseudomonas putida KT2440
gcugcucauacugcugacc

SEQ ID NO: 3557730 - RNA, 23 nt, Pseudomonas putida KT2440
gcugcucauacugcugacccgga

SEQ ID NO: 3557731 - RNA, 19 nt, Pseudomonas putida KT2440
gcugcuccaugaucucgcg

SEQ ID NO: 3557732 - RNA, 18 nt, Pseudomonas putida KT2440
gcugcucgaucagguuga

SEQ ID NO: 3557733 - RNA, 14 nt, Pseudomonas putida KT2440
gcugcucgcccgcc

SEQ ID NO: 3557734 - RNA, 14 nt, Pseudomonas putida KT2440
gcugcucgccucac

SEQ ID NO: 3557735 - RNA, 23 nt, Pseudomonas putida KT2440
gcugcucugcaaugccgccaacu

SEQ ID NO: 3557736 - RNA, 14 nt, Pseudomonas putida KT2440
gcugcucugccgcc

SEQ ID NO: 3557737 - RNA, 20 nt, Pseudomonas putida KT2440
gcugcugcagcacugccugc

SEQ ID NO: 3557738 - RNA, 19 nt, Pseudomonas putida KT2440
gcugcugcagggcccagcc

SEQ ID NO: 3557739 - RNA, 14 nt, Pseudomonas putida KT2440
gcugcugccauccu

SEQ ID NO: 3557740 - RNA, 17 nt, Pseudomonas putida KT2440
gcugcugccccaugcga

SEQ ID NO: 3557741 - RNA, 16 nt, Pseudomonas putida KT2440
gcugcugcgcagcccu

SEQ ID NO: 3557742 - RNA, 17 nt, Pseudomonas putida KT2440
gcugcugcgcagcccug

SEQ ID NO: 3557743 - RNA, 15 nt, Pseudomonas putida KT2440
gcugcugcgccucgc

SEQ ID NO: 3557744 - RNA, 20 nt, Pseudomonas putida KT2440
gcugcuggauugccugauca

SEQ ID NO: 3557745 - RNA, 12 nt, Pseudomonas putida KT2440
gcugcuggcacg

SEQ ID NO: 3557746 - RNA, 16 nt, Pseudomonas putida KT2440
gcugcuggcacgccuu

SEQ ID NO: 3557747 - RNA, 18 nt, Pseudomonas putida KT2440
gcugcuggcacgccuuca

SEQ ID NO: 3557748 - RNA, 20 nt, Pseudomonas putida KT2440
gcugcuguccagacgccgca

SEQ ID NO: 3557749 - RNA, 22 nt, Pseudomonas putida KT2440
gcugcuguccagacgccgcagu

SEQ ID NO: 3557750 - RNA, 14 nt, Pseudomonas putida KT2440
gcugcugucgguca

SEQ ID NO: 3557751 - RNA, 18 nt, Pseudomonas putida KT2440
gcugcugugcggcuggcg

SEQ ID NO: 3557752 - RNA, 22 nt, Pseudomonas putida KT2440
gcugcuuaccagcuuggcgccc

SEQ ID NO: 3557753 - RNA, 21 nt, Pseudomonas putida KT2440
gcugcuuccggcugguacucc

SEQ ID NO: 3557754 - RNA, 15 nt, Pseudomonas putida KT2440
gcugcuuugcagccc

SEQ ID NO: 3557755 - RNA, 18 nt, Pseudomonas putida KT2440
gcugcuuugcagcccauu

SEQ ID NO: 3557756 - RNA, 15 nt, Pseudomonas putida KT2440
gcuggaacugcugca

SEQ ID NO: 3557757 - RNA, 20 nt, Pseudomonas putida KT2440
gcuggaagugcugagagggu

SEQ ID NO: 3557758 - RNA, 19 nt, Pseudomonas putida KT2440
gcuggaauuauuggccagc

SEQ ID NO: 3557759 - RNA, 20 nt, Pseudomonas putida KT2440
gcuggaauuauuggccagca

SEQ ID NO: 3557760 - RNA, 22 nt, Pseudomonas putida KT2440
gcuggacaagccaaccaaagga

SEQ ID NO: 3557761 - RNA, 18 nt, Pseudomonas putida KT2440
gcuggacaccucccgcgc

SEQ ID NO: 3557762 - RNA, 13 nt, Pseudomonas putida KT2440
gcuggacagcggc

SEQ ID NO: 3557763 - RNA, 23 nt, Pseudomonas putida KT2440
gcuggacagcggcagcaucgacc

SEQ ID NO: 3557764 - RNA, 15 nt, Pseudomonas putida KT2440
gcuggacaugcacgc

SEQ ID NO: 3557765 - RNA, 15 nt, Pseudomonas putida KT2440
gcuggacccaaucgc

SEQ ID NO: 3557766 - RNA, 19 nt, Pseudomonas putida KT2440
gcuggacccaaucgcugug

SEQ ID NO: 3557767 - RNA, 21 nt, Pseudomonas putida KT2440
gcuggacccaaucgcugugca

SEQ ID NO: 3557768 - RNA, 22 nt, Pseudomonas putida KT2440
gcuggacccaaucgcugugcaa

SEQ ID NO: 3557769 - RNA, 12 nt, Pseudomonas putida KT2440
gcuggaccuggc

SEQ ID NO: 3557770 - RNA, 18 nt, Pseudomonas putida KT2440
gcuggaccuggcuggcgg

SEQ ID NO: 3557771 - RNA, 16 nt, Pseudomonas putida KT2440
gcuggagcuauuuggc

SEQ ID NO: 3557772 - RNA, 23 nt, Pseudomonas putida KT2440
gcuggauaagaucacugcgcagc

SEQ ID NO: 3557773 - RNA, 14 nt, Pseudomonas putida KT2440
gcuggauacccagc

SEQ ID NO: 3557774 - RNA, 17 nt, Pseudomonas putida KT2440
gcuggauacccagcgcc

SEQ ID NO: 3557775 - RNA, 18 nt, Pseudomonas putida KT2440
gcuggauacccagcgccg

SEQ ID NO: 3557776 - RNA, 18 nt, Pseudomonas putida KT2440
gcuggauagaguacucgg

SEQ ID NO: 3557777 - RNA, 12 nt, Pseudomonas putida KT2440
gcuggaucacca

SEQ ID NO: 3557778 - RNA, 14 nt, Pseudomonas putida KT2440
gcuggaucaccacc

SEQ ID NO: 3557779 - RNA, 22 nt, Pseudomonas putida KT2440
gcuggaucagugucugcgccug

SEQ ID NO: 3557780 - RNA, 19 nt, Pseudomonas putida KT2440
gcuggaucugaugcuucug

SEQ ID NO: 3557781 - RNA, 14 nt, Pseudomonas putida KT2440
gcuggaucuugcug

SEQ ID NO: 3557782 - RNA, 16 nt, Pseudomonas putida KT2440
gcuggauuccgacaag

SEQ ID NO: 3557783 - RNA, 17 nt, Pseudomonas putida KT2440
gcuggcacccacgcgcu

SEQ ID NO: 3557784 - RNA, 13 nt, Pseudomonas putida KT2440
gcuggcaccggcg

SEQ ID NO: 3557785 - RNA, 21 nt, Pseudomonas putida KT2440
gcuggcacgccuucagcagcc

SEQ ID NO: 3557786 - RNA, 16 nt, Pseudomonas putida KT2440
gcuggcacugcggcuc

SEQ ID NO: 3557787 - RNA, 16 nt, Pseudomonas putida KT2440
gcuggcagcacgauca

SEQ ID NO: 3557788 - RNA, 15 nt, Pseudomonas putida KT2440
gcuggcauucaacgc

SEQ ID NO: 3557789 - RNA, 18 nt, Pseudomonas putida KT2440
gcuggccaaggucuccag

SEQ ID NO: 3557790 - RNA, 20 nt, Pseudomonas putida KT2440
gcuggccaaggucuccagca

SEQ ID NO: 3557791 - RNA, 16 nt, Pseudomonas putida KT2440
gcuggccaaucuccac

SEQ ID NO: 3557792 - RNA, 23 nt, Pseudomonas putida KT2440
gcuggccaaucuccacccgccgu

SEQ ID NO: 3557793 - RNA, 22 nt, Pseudomonas putida KT2440
gcuggccaccaccaucucgccc

SEQ ID NO: 3557794 - RNA, 14 nt, Pseudomonas putida KT2440
gcuggccaccauga

SEQ ID NO: 3557795 - RNA, 19 nt, Pseudomonas putida KT2440
gcuggccaccaugaacagc

SEQ ID NO: 3557796 - RNA, 14 nt, Pseudomonas putida KT2440
gcuggccagccgcu

SEQ ID NO: 3557797 - RNA, 20 nt, Pseudomonas putida KT2440
gcuggccauuucgcggcgca

SEQ ID NO: 3557798 - RNA, 21 nt, Pseudomonas putida KT2440
gcuggccauuucgcggcgcag

SEQ ID NO: 3557799 - RNA, 15 nt, Pseudomonas putida KT2440
gcuggcccuucgcgg

SEQ ID NO: 3557800 - RNA, 16 nt, Pseudomonas putida KT2440
gcuggcccuucgcgga

SEQ ID NO: 3557801 - RNA, 23 nt, Pseudomonas putida KT2440
gcuggccgcacccagcaggccga

SEQ ID NO: 3557802 - RNA, 21 nt, Pseudomonas putida KT2440
gcuggccgccacggugccgaa

SEQ ID NO: 3557803 - RNA, 22 nt, Pseudomonas putida KT2440
gcuggccgccagacaacuggcc

SEQ ID NO: 3557804 - RNA, 14 nt, Pseudomonas putida KT2440
gcuggccguccagc

SEQ ID NO: 3557805 - RNA, 15 nt, Pseudomonas putida KT2440
gcuggccguccagcu

SEQ ID NO: 3557806 - RNA, 17 nt, Pseudomonas putida KT2440
gcuggccguccagcuga

SEQ ID NO: 3557807 - RNA, 22 nt, Pseudomonas putida KT2440
gcuggccguccagcugagcgcc

SEQ ID NO: 3557808 - RNA, 22 nt, Pseudomonas putida KT2440
gcuggccugcagccguugcugg

SEQ ID NO: 3557809 - RNA, 22 nt, Pseudomonas putida KT2440
gcuggccuguucguucccacaa

SEQ ID NO: 3557810 - RNA, 23 nt, Pseudomonas putida KT2440
gcuggccuugcaggaagcggcgc

SEQ ID NO: 3557811 - RNA, 19 nt, Pseudomonas putida KT2440
gcuggccuugcggcaagcu

SEQ ID NO: 3557812 - RNA, 19 nt, Pseudomonas putida KT2440
gcuggccuuuucgcgggua

SEQ ID NO: 3557813 - RNA, 15 nt, Pseudomonas putida KT2440
gcuggcgacgaagcu

SEQ ID NO: 3557814 - RNA, 17 nt, Pseudomonas putida KT2440
gcuggcgacgccacccc

SEQ ID NO: 3557815 - RNA, 18 nt, Pseudomonas putida KT2440
gcuggcgacgcugcccag

SEQ ID NO: 3557816 - RNA, 13 nt, Pseudomonas putida KT2440
gcuggcgaucagg

SEQ ID NO: 3557817 - RNA, 14 nt, Pseudomonas putida KT2440
gcuggcgaucaggc

SEQ ID NO: 3557818 - RNA, 16 nt, Pseudomonas putida KT2440
gcuggcgaucaggcag

SEQ ID NO: 3557819 - RNA, 18 nt, Pseudomonas putida KT2440
gcuggcgaucaggcaggc

SEQ ID NO: 3557820 - RNA, 22 nt, Pseudomonas putida KT2440
gcuggcgaucaggcaggccagc

SEQ ID NO: 3557821 - RNA, 14 nt, Pseudomonas putida KT2440
gcuggcgaucggcu

SEQ ID NO: 3557822 - RNA, 19 nt, Pseudomonas putida KT2440
gcuggcgaucggcuggucc

SEQ ID NO: 3557823 - RNA, 20 nt, Pseudomonas putida KT2440
gcuggcgcaagccgugccug

SEQ ID NO: 3557824 - RNA, 17 nt, Pseudomonas putida KT2440
gcuggcgcagagggucu

SEQ ID NO: 3557825 - RNA, 17 nt, Pseudomonas putida KT2440
gcuggcgccugcggcau

SEQ ID NO: 3557826 - RNA, 14 nt, Pseudomonas putida KT2440
gcuggcgcgcggcc

SEQ ID NO: 3557827 - RNA, 21 nt, Pseudomonas putida KT2440
gcuggcgcucaauggcaccgu

SEQ ID NO: 3557828 - RNA, 13 nt, Pseudomonas putida KT2440
gcuggcggcugcc

SEQ ID NO: 3557829 - RNA, 16 nt, Pseudomonas putida KT2440
gcuggcgguuugcucc

SEQ ID NO: 3557830 - RNA, 15 nt, Pseudomonas putida KT2440
gcuggcgucauccug

SEQ ID NO: 3557831 - RNA, 12 nt, Pseudomonas putida KT2440
gcuggcguggug

SEQ ID NO: 3557832 - RNA, 20 nt, Pseudomonas putida KT2440
gcuggcucgcugccccaguc

SEQ ID NO: 3557833 - RNA, 13 nt, Pseudomonas putida KT2440
gcuggcugccgcg

SEQ ID NO: 3557834 - RNA, 17 nt, Pseudomonas putida KT2440
gcuggcuggucuccagc

SEQ ID NO: 3557835 - RNA, 21 nt, Pseudomonas putida KT2440
gcuggcuguaccggccucuuc

SEQ ID NO: 3557836 - RNA, 15 nt, Pseudomonas putida KT2440
gcuggcuucaaacag

SEQ ID NO: 3557837 - RNA, 19 nt, Pseudomonas putida KT2440
gcuggcuuuggagccugcg

SEQ ID NO: 3557838 - RNA, 18 nt, Pseudomonas putida KT2440
gcugggaauccagugcag

SEQ ID NO: 3557839 - RNA, 17 nt, Pseudomonas putida KT2440
gcugggagagcgccugc

SEQ ID NO: 3557840 - RNA, 17 nt, Pseudomonas putida KT2440
gcugggcaugaucgcgc

SEQ ID NO: 3557841 - RNA, 20 nt, Pseudomonas putida KT2440
gcugggcgaacgccugcagg

SEQ ID NO: 3557842 - RNA, 19 nt, Pseudomonas putida KT2440
gcugggcgugccaggcuug

SEQ ID NO: 3557843 - RNA, 15 nt, Pseudomonas putida KT2440
gcugggcguuuccag

SEQ ID NO: 3557844 - RNA, 16 nt, Pseudomonas putida KT2440
gcugggcuucuucgug

SEQ ID NO: 3557845 - RNA, 17 nt, Pseudomonas putida KT2440
gcugggcuuugggagca

SEQ ID NO: 3557846 - RNA, 22 nt, Pseudomonas putida KT2440
gcuggggauuuggggcgcccgg

SEQ ID NO: 3557847 - RNA, 13 nt, Pseudomonas putida KT2440
gcuggggccgcaa

SEQ ID NO: 3557848 - RNA, 20 nt, Pseudomonas putida KT2440
gcuggguaccgugcugcagg

SEQ ID NO: 3557849 - RNA, 15 nt, Pseudomonas putida KT2440
gcugggucagcgcug

SEQ ID NO: 3557850 - RNA, 18 nt, Pseudomonas putida KT2440
gcugggugccaucagggc

SEQ ID NO: 3557851 - RNA, 19 nt, Pseudomonas putida KT2440
gcugggugccaucagggcg

SEQ ID NO: 3557852 - RNA, 23 nt, Pseudomonas putida KT2440
gcugggugcgcgggucauccagg

SEQ ID NO: 3557853 - RNA, 15 nt, Pseudomonas putida KT2440
gcugguacagcagga

SEQ ID NO: 3557854 - RNA, 16 nt, Pseudomonas putida KT2440
gcugguacagccggcu

SEQ ID NO: 3557855 - RNA, 18 nt, Pseudomonas putida KT2440
gcugguacaugccgccga

SEQ ID NO: 3557856 - RNA, 18 nt, Pseudomonas putida KT2440
gcugguacuccacuucca

SEQ ID NO: 3557857 - RNA, 19 nt, Pseudomonas putida KT2440
gcugguagaaccacuccag

SEQ ID NO: 3557858 - RNA, 21 nt, Pseudomonas putida KT2440
gcugguagaaccacuccaggg

SEQ ID NO: 3557859 - RNA, 19 nt, Pseudomonas putida KT2440
gcuggucagugcacuugcg

SEQ ID NO: 3557860 - RNA, 22 nt, Pseudomonas putida KT2440
gcugguccacgguucuggcagc

SEQ ID NO: 3557861 - RNA, 21 nt, Pseudomonas putida KT2440
gcugguccgggcccaugccac

SEQ ID NO: 3557862 - RNA, 14 nt, Pseudomonas putida KT2440
gcugguccucgacg

SEQ ID NO: 3557863 - RNA, 15 nt, Pseudomonas putida KT2440
gcuggucgaaccagu

SEQ ID NO: 3557864 - RNA, 22 nt, Pseudomonas putida KT2440
gcuggucgagcaaggcauccac

SEQ ID NO: 3557865 - RNA, 16 nt, Pseudomonas putida KT2440
gcuggucgaggcggcu

SEQ ID NO: 3557866 - RNA, 20 nt, Pseudomonas putida KT2440
gcuggucgcugcccucggcc

SEQ ID NO: 3557867 - RNA, 13 nt, Pseudomonas putida KT2440
gcuggucggcaau

SEQ ID NO: 3557868 - RNA, 14 nt, Pseudomonas putida KT2440
gcuggucguuggug

SEQ ID NO: 3557869 - RNA, 16 nt, Pseudomonas putida KT2440
gcuggugaaggcaggu

SEQ ID NO: 3557870 - RNA, 17 nt, Pseudomonas putida KT2440
gcuggugagcguccauc

SEQ ID NO: 3557871 - RNA, 14 nt, Pseudomonas putida KT2440
gcugguggcaaugc

SEQ ID NO: 3557872 - RNA, 14 nt, Pseudomonas putida KT2440
gcugguggcggcau

SEQ ID NO: 3557873 - RNA, 17 nt, Pseudomonas putida KT2440
gcuggugggcgaugauc

SEQ ID NO: 3557874 - RNA, 22 nt, Pseudomonas putida KT2440
gcuggugucggccagggcccgc

SEQ ID NO: 3557875 - RNA, 18 nt, Pseudomonas putida KT2440
gcugguuagcgucgaugc

SEQ ID NO: 3557876 - RNA, 16 nt, Pseudomonas putida KT2440
gcugguuaugagccua

SEQ ID NO: 3557877 - RNA, 19 nt, Pseudomonas putida KT2440
gcugguucgauuccagcag

SEQ ID NO: 3557878 - RNA, 16 nt, Pseudomonas putida KT2440
gcugguucugcugcag

SEQ ID NO: 3557879 - RNA, 15 nt, Pseudomonas putida KT2440
gcugguugaucaacu

SEQ ID NO: 3557880 - RNA, 18 nt, Pseudomonas putida KT2440
gcugguuuaucagcagcu

SEQ ID NO: 3557881 - RNA, 13 nt, Pseudomonas putida KT2440
gcuguaaccuggu

SEQ ID NO: 3557882 - RNA, 14 nt, Pseudomonas putida KT2440
gcuguaaccugguu

SEQ ID NO: 3557883 - RNA, 19 nt, Pseudomonas putida KT2440
gcuguacaacgcagccggc

SEQ ID NO: 3557884 - RNA, 16 nt, Pseudomonas putida KT2440
gcuguacaccaggacu

SEQ ID NO: 3557885 - RNA, 14 nt, Pseudomonas putida KT2440
gcuguacaggugcg

SEQ ID NO: 3557886 - RNA, 13 nt, Pseudomonas putida KT2440
gcuuccaggucgc

SEQ ID NO: 3557887 - RNA, 15 nt, Pseudomonas putida KT2440
gcuucccggccuggc

SEQ ID NO: 3557888 - RNA, 20 nt, Pseudomonas putida KT2440
gcuucccgguaacgggccag

SEQ ID NO: 3557889 - RNA, 18 nt, Pseudomonas putida KT2440
gcuuccgccaccacgaac

SEQ ID NO: 3557890 - RNA, 24 nt, Pseudomonas putida KT2440
gcuuccgccaccacgaacaguggc

SEQ ID NO: 3557891 - RNA, 16 nt, Pseudomonas putida KT2440
gcuuccucacggcagu

SEQ ID NO: 3557892 - RNA, 15 nt, Pseudomonas putida KT2440
gcuuccuugcgcacg

SEQ ID NO: 3557893 - RNA, 12 nt, Pseudomonas putida KT2440
gcuuccuugucc

SEQ ID NO: 3557894 - RNA, 15 nt, Pseudomonas putida KT2440
gcuucgaugcccggc

SEQ ID NO: 3557895 - RNA, 22 nt, Pseudomonas putida KT2440
gcuucgcagacgucuuccaugc

SEQ ID NO: 3557896 - RNA, 21 nt, Pseudomonas putida KT2440
gcuucgccagcgccaccgcgc

SEQ ID NO: 3557897 - RNA, 19 nt, Pseudomonas putida KT2440
gcuucgcccucguucgcgg

SEQ ID NO: 3557898 - RNA, 21 nt, Pseudomonas putida KT2440
gcuucgcccucguucgcgggc

SEQ ID NO: 3557899 - RNA, 23 nt, Pseudomonas putida KT2440
gcuucgcccucguucgcgggcac

SEQ ID NO: 3557900 - RNA, 13 nt, Pseudomonas putida KT2440
gcuucgccgcgcu

SEQ ID NO: 3557901 - RNA, 16 nt, Pseudomonas putida KT2440
gcuucgccgcgcugug

SEQ ID NO: 3557902 - RNA, 19 nt, Pseudomonas putida KT2440
gcuucgccgcgcuguggcg

SEQ ID NO: 3557903 - RNA, 19 nt, Pseudomonas putida KT2440
gcuucgccgguguucgcgg

SEQ ID NO: 3557904 - RNA, 20 nt, Pseudomonas putida KT2440
gcuucgccgguguucgcggg

SEQ ID NO: 3557905 - RNA, 18 nt, Pseudomonas putida KT2440
gcuucgcggaucaacccg

SEQ ID NO: 3557906 - RNA, 16 nt, Pseudomonas putida KT2440
gcuucgcggccaagcc

SEQ ID NO: 3557907 - RNA, 13 nt, Pseudomonas putida KT2440
gcuucggcaugca

SEQ ID NO: 3557908 - RNA, 23 nt, Pseudomonas putida KT2440
gcuucggccacgguguauccagc

SEQ ID NO: 3557909 - RNA, 22 nt, Pseudomonas putida KT2440
gcuucggcggcuuucagcgccg

SEQ ID NO: 3557910 - RNA, 18 nt, Pseudomonas putida KT2440
gcuucggcugaucucuuc

SEQ ID NO: 3557911 - RNA, 20 nt, Pseudomonas putida KT2440
gcuucgggaauaccaggccc

SEQ ID NO: 3557912 - RNA, 20 nt, Pseudomonas putida KT2440
gcuucggugugcuccagcuc

SEQ ID NO: 3557913 - RNA, 21 nt, Pseudomonas putida KT2440
gcuucggugugcuccagcucc

SEQ ID NO: 3557914 - RNA, 18 nt, Pseudomonas putida KT2440
gcuucucaagcaucuggu

SEQ ID NO: 3557915 - RNA, 12 nt, Pseudomonas putida KT2440
gcuucucacgca

SEQ ID NO: 3557916 - RNA, 19 nt, Pseudomonas putida KT2440
gcuucuccagcaagcgcuc

SEQ ID NO: 3557917 - RNA, 16 nt, Pseudomonas putida KT2440
gcuucucggcaaagcg

SEQ ID NO: 3557918 - RNA, 21 nt, Pseudomonas putida KT2440
gcuucucggcaaagcguucgg

SEQ ID NO: 3557919 - RNA, 22 nt, Pseudomonas putida KT2440
gcuucugagccagccgcggcag

SEQ ID NO: 3557920 - RNA, 14 nt, Pseudomonas putida KT2440
gcuucugcaacucc

SEQ ID NO: 3557921 - RNA, 14 nt, Pseudomonas putida KT2440
gcuucugcacuccc

SEQ ID NO: 3557922 - RNA, 22 nt, Pseudomonas putida KT2440
gcuucugcugguccuugcacag

SEQ ID NO: 3557923 - RNA, 17 nt, Pseudomonas putida KT2440
gcuucugcuucagcucg

SEQ ID NO: 3557924 - RNA, 23 nt, Pseudomonas putida KT2440
gcuucugggcaaagaacggugcu

SEQ ID NO: 3557925 - RNA, 18 nt, Pseudomonas putida KT2440
gcuucuguaccgccguca

SEQ ID NO: 3557926 - RNA, 21 nt, Pseudomonas putida KT2440
gcuucuucaacaaaucggccu

SEQ ID NO: 3557927 - RNA, 18 nt, Pseudomonas putida KT2440
gcuucuugcaccgcuccg

SEQ ID NO: 3557928 - RNA, 14 nt, Pseudomonas putida KT2440
gcuugaacaacggc

SEQ ID NO: 3557929 - RNA, 15 nt, Pseudomonas putida KT2440
gcuugaacaacggcg

SEQ ID NO: 3557930 - RNA, 22 nt, Pseudomonas putida KT2440
gcuugaacccgugcaucugcuc

SEQ ID NO: 3557931 - RNA, 14 nt, Pseudomonas putida KT2440
gcuugaacuugcuc

SEQ ID NO: 3557932 - RNA, 14 nt, Pseudomonas putida KT2440
gcuugaagcggccu

SEQ ID NO: 3557933 - RNA, 14 nt, Pseudomonas putida KT2440
gcuugaccauggcg

SEQ ID NO: 3557934 - RNA, 12 nt, Pseudomonas putida KT2440
gcuugacccccu

SEQ ID NO: 3557935 - RNA, 14 nt, Pseudomonas putida KT2440
gcuugacccccuuc

SEQ ID NO: 3557936 - RNA, 18 nt, Pseudomonas putida KT2440
gcuugaccguuugcagcg

SEQ ID NO: 3557937 - RNA, 21 nt, Pseudomonas putida KT2440
gcuugaccuugucagcaacca

SEQ ID NO: 3557938 - RNA, 21 nt, Pseudomonas putida KT2440
gcuugacgaucuucugcacgc

SEQ ID NO: 3557939 - RNA, 16 nt, Pseudomonas putida KT2440
gcuugagaccaggccu

SEQ ID NO: 3557940 - RNA, 22 nt, Pseudomonas putida KT2440
gcuugagaccaggccuggaugc

SEQ ID NO: 3557941 - RNA, 11 nt, Pseudomonas putida KT2440
gcuugagcagg

SEQ ID NO: 3557942 - RNA, 18 nt, Pseudomonas putida KT2440
gcuugagccuugugcugu

SEQ ID NO: 3557943 - RNA, 21 nt, Pseudomonas putida KT2440
gcuugagcgaaacccggcgca

SEQ ID NO: 3557944 - RNA, 16 nt, Pseudomonas putida KT2440
gcuugagcgcagcgac

SEQ ID NO: 3557945 - RNA, 18 nt, Pseudomonas putida KT2440
gcuugaggugccauagca

SEQ ID NO: 3557946 - RNA, 20 nt, Pseudomonas putida KT2440
gcuugagugguuuucuuccc

SEQ ID NO: 3557947 - RNA, 23 nt, Pseudomonas putida KT2440
gcuugauauccagcaccggcgug

SEQ ID NO: 3557948 - RNA, 18 nt, Pseudomonas putida KT2440
gcuugaucaggcccggcu

SEQ ID NO: 3557949 - RNA, 14 nt, Pseudomonas putida KT2440
gcuugaucugguca

SEQ ID NO: 3557950 - RNA, 15 nt, Pseudomonas putida KT2440
gcuugaucuggucac

SEQ ID NO: 3557951 - RNA, 21 nt, Pseudomonas putida KT2440
gcuugaugcugucgaagcgcu

SEQ ID NO: 3557952 - RNA, 17 nt, Pseudomonas putida KT2440
gcuugcaaccgacgcga

SEQ ID NO: 3557953 - RNA, 20 nt, Pseudomonas putida KT2440
gcuugcacagguaucgccgc

SEQ ID NO: 3557954 - RNA, 14 nt, Pseudomonas putida KT2440
gcuugccaccaucg

SEQ ID NO: 3557955 - RNA, 22 nt, Pseudomonas putida KT2440
gcuugccaccaucgaccuggcc

SEQ ID NO: 3557956 - RNA, 13 nt, Pseudomonas putida KT2440
gcuugccagcguu

SEQ ID NO: 3557957 - RNA, 17 nt, Pseudomonas putida KT2440
gcuugccauucuugucc

SEQ ID NO: 3557958 - RNA, 12 nt, Pseudomonas putida KT2440
gcuugcccauca

SEQ ID NO: 3557959 - RNA, 22 nt, Pseudomonas putida KT2440
gcuugcccgaggaacggcuggc

SEQ ID NO: 3557960 - RNA, 17 nt, Pseudomonas putida KT2440
gcuugcccgccuuggca

SEQ ID NO: 3557961 - RNA, 15 nt, Pseudomonas putida KT2440
gcuugcccgcgaaga

SEQ ID NO: 3557962 - RNA, 22 nt, Pseudomonas putida KT2440
gcuugcccgcgaagcagccacc

SEQ ID NO: 3557963 - RNA, 17 nt, Pseudomonas putida KT2440
gcuugcccggcuccagg

SEQ ID NO: 3557964 - RNA, 19 nt, Pseudomonas putida KT2440
gcuugcccggcuccaggua

SEQ ID NO: 3557965 - RNA, 14 nt, Pseudomonas putida KT2440
gcuugccgcgugcg

SEQ ID NO: 3557966 - RNA, 13 nt, Pseudomonas putida KT2440
gcuugccgcuggc

SEQ ID NO: 3557967 - RNA, 24 nt, Pseudomonas putida KT2440
gcuugccgcuggcauccaccaggu

SEQ ID NO: 3557968 - RNA, 10 nt, Pseudomonas putida KT2440
gcuugccgga

SEQ ID NO: 3557969 - RNA, 19 nt, Pseudomonas putida KT2440
gcuugccggcaauaccggc

SEQ ID NO: 3557970 - RNA, 13 nt, Pseudomonas putida KT2440
gcuugccuuccgg

SEQ ID NO: 3557971 - RNA, 18 nt, Pseudomonas putida KT2440
gcuugcgcauggccgcca

SEQ ID NO: 3557972 - RNA, 13 nt, Pseudomonas putida KT2440
gcuugcgcgaucc

SEQ ID NO: 3557973 - RNA, 12 nt, Pseudomonas putida KT2440
gcuugcgcggca

SEQ ID NO: 3557974 - RNA, 18 nt, Pseudomonas putida KT2440
gcuugcggaacaccccuu

SEQ ID NO: 3557975 - RNA, 14 nt, Pseudomonas putida KT2440
gcuugcggaacagg

SEQ ID NO: 3557976 - RNA, 16 nt, Pseudomonas putida KT2440
gcuugcgguccugcac

SEQ ID NO: 3557977 - RNA, 18 nt, Pseudomonas putida KT2440
gcuugcgguccugcacca

SEQ ID NO: 3557978 - RNA, 13 nt, Pseudomonas putida KT2440
gcuugcucaaggu

SEQ ID NO: 3557979 - RNA, 13 nt, Pseudomonas putida KT2440
gcuugcucaggcu

SEQ ID NO: 3557980 - RNA, 22 nt, Pseudomonas putida KT2440
gcuuggaaauguucaacagccg

SEQ ID NO: 3557981 - RNA, 18 nt, Pseudomonas putida KT2440
gcuuggacaggccccagu

SEQ ID NO: 3557982 - RNA, 21 nt, Pseudomonas putida KT2440
gcuuggagaagcgaucgaaag

SEQ ID NO: 3557983 - RNA, 17 nt, Pseudomonas putida KT2440
gcuuggcaccggcagca

SEQ ID NO: 3557984 - RNA, 14 nt, Pseudomonas putida KT2440
gcuuggcacgcugg

SEQ ID NO: 3557985 - RNA, 16 nt, Pseudomonas putida KT2440
gcuuggcacgcuggcu

SEQ ID NO: 3557986 - RNA, 15 nt, Pseudomonas putida KT2440
gcuuggcagcggcug

SEQ ID NO: 3557987 - RNA, 16 nt, Pseudomonas putida KT2440
gcuuggcagcggcugg

SEQ ID NO: 3557988 - RNA, 13 nt, Pseudomonas putida KT2440
gcuuggccaccac

SEQ ID NO: 3557989 - RNA, 20 nt, Pseudomonas putida KT2440
gcuuggccagaaacggcggc

SEQ ID NO: 3557990 - RNA, 18 nt, Pseudomonas putida KT2440
gcuuggccagacucagcu

SEQ ID NO: 3557991 - RNA, 22 nt, Pseudomonas putida KT2440
ggaacucgcccgguuuggccug

SEQ ID NO: 3557992 - RNA, 21 nt, Pseudomonas putida KT2440
ggaacucuggcgugaagcucu

SEQ ID NO: 3557993 - RNA, 22 nt, Pseudomonas putida KT2440
ggaacuggcugaccagugucug

SEQ ID NO: 3557994 - RNA, 20 nt, Pseudomonas putida KT2440
ggaacuugucgacgaugcuu

SEQ ID NO: 3557995 - RNA, 20 nt, Pseudomonas putida KT2440
ggaagaucacgucggccugc

SEQ ID NO: 3557996 - RNA, 17 nt, Pseudomonas putida KT2440
ggaagccccgcgcgucc

SEQ ID NO: 3557997 - RNA, 14 nt, Pseudomonas putida KT2440
ggaagcgcccgccc

SEQ ID NO: 3557998 - RNA, 17 nt, Pseudomonas putida KT2440
ggaagcugcagcagcuu

SEQ ID NO: 3557999 - RNA, 19 nt, Pseudomonas putida KT2440
ggaagcugggaauccagug

SEQ ID NO: 3558000 - RNA, 18 nt, Pseudomonas putida KT2440
ggaagcuguacagcgcau

SEQ ID NO: 3558001 - RNA, 15 nt, Pseudomonas putida KT2440
ggaagcuucucgagc

SEQ ID NO: 3558002 - RNA, 16 nt, Pseudomonas putida KT2440
ggaaggcaaagauuua

SEQ ID NO: 3558003 - RNA, 20 nt, Pseudomonas putida KT2440
ggaaggcuacauccaggcug

SEQ ID NO: 3558004 - RNA, 17 nt, Pseudomonas putida KT2440
ggaaggucuucagcuca

SEQ ID NO: 3558005 - RNA, 20 nt, Pseudomonas putida KT2440
ggaagugcuucaccuugccu

SEQ ID NO: 3558006 - RNA, 14 nt, Pseudomonas putida KT2440
ggaagugguuggca

SEQ ID NO: 3558007 - RNA, 22 nt, Pseudomonas putida KT2440
ggaaguucacacucagccgcug

SEQ ID NO: 3558008 - RNA, 19 nt, Pseudomonas putida KT2440
ggaauagaacacuggcagg

SEQ ID NO: 3558009 - RNA, 24 nt, Pseudomonas putida KT2440
ggaauagaacacuggcaggcucag

SEQ ID NO: 3558010 - RNA, 12 nt, Pseudomonas putida KT2440
ggaaucacgcgg

SEQ ID NO: 3558011 - RNA, 19 nt, Pseudomonas putida KT2440
ggaaucacgcggcgucacc

SEQ ID NO: 3558012 - RNA, 15 nt, Pseudomonas putida KT2440
ggaauccagugcagg

SEQ ID NO: 3558013 - RNA, 23 nt, Pseudomonas putida KT2440
ggaaucggcuccaggcacaggcg

SEQ ID NO: 3558014 - RNA, 15 nt, Pseudomonas putida KT2440
ggaauggcccagcca

SEQ ID NO: 3558015 - RNA, 17 nt, Pseudomonas putida KT2440
ggaaugucaccgcggca

SEQ ID NO: 3558016 - RNA, 14 nt, Pseudomonas putida KT2440
ggaauuauuggcca

SEQ ID NO: 3558017 - RNA, 17 nt, Pseudomonas putida KT2440
ggaauuauuggccagca

SEQ ID NO: 3558018 - RNA, 22 nt, Pseudomonas putida KT2440
ggaauuucggcguugaccgagg

SEQ ID NO: 3558019 - RNA, 15 nt, Pseudomonas putida KT2440
ggacaaauccagguc

SEQ ID NO: 3558020 - RNA, 13 nt, Pseudomonas putida KT2440
ggacacaggccgu

SEQ ID NO: 3558021 - RNA, 13 nt, Pseudomonas putida KT2440
ggacaccaggcug

SEQ ID NO: 3558022 - RNA, 17 nt, Pseudomonas putida KT2440
ggacaccaggcugguga

SEQ ID NO: 3558023 - RNA, 14 nt, Pseudomonas putida KT2440
ggacaccauggccu

SEQ ID NO: 3558024 - RNA, 23 nt, Pseudomonas putida KT2440
ggacacgucacugaugcgccagu

SEQ ID NO: 3558025 - RNA, 13 nt, Pseudomonas putida KT2440
ggacacugccgug

SEQ ID NO: 3558026 - RNA, 13 nt, Pseudomonas putida KT2440
ggacagcaauucc

SEQ ID NO: 3558027 - RNA, 21 nt, Pseudomonas putida KT2440
ggacagcaauuccaaugagaa

SEQ ID NO: 3558028 - RNA, 18 nt, Pseudomonas putida KT2440
ggacagccacaugccagc

SEQ ID NO: 3558029 - RNA, 16 nt, Pseudomonas putida KT2440
ggacagcccaaggccu

SEQ ID NO: 3558030 - RNA, 20 nt, Pseudomonas putida KT2440
ggacagcgcccggcgcagca

SEQ ID NO: 3558031 - RNA, 12 nt, Pseudomonas putida KT2440
ggacaggcccca

SEQ ID NO: 3558032 - RNA, 14 nt, Pseudomonas putida KT2440
ggacaggcgcuuga

SEQ ID NO: 3558033 - RNA, 20 nt, Pseudomonas putida KT2440
ggacagggucagcggggugu

SEQ ID NO: 3558034 - RNA, 19 nt, Pseudomonas putida KT2440
ggacagguagaucugcucu

SEQ ID NO: 3558035 - RNA, 20 nt, Pseudomonas putida KT2440
ggacauaccacacaccccag

SEQ ID NO: 3558036 - RNA, 22 nt, Pseudomonas putida KT2440
ggacauaccacacaccccagaa

SEQ ID NO: 3558037 - RNA, 12 nt, Pseudomonas putida KT2440
ggacaucaccag

SEQ ID NO: 3558038 - RNA, 14 nt, Pseudomonas putida KT2440
ggaccagacccgcu

SEQ ID NO: 3558039 - RNA, 18 nt, Pseudomonas putida KT2440
ggaccaggugcagguacu

SEQ ID NO: 3558040 - RNA, 14 nt, Pseudomonas putida KT2440
ggacccaaucgcug

SEQ ID NO: 3558041 - RNA, 16 nt, Pseudomonas putida KT2440
ggacccaaucgcugug

SEQ ID NO: 3558042 - RNA, 18 nt, Pseudomonas putida KT2440
ggacccaaucgcugugca

SEQ ID NO: 3558043 - RNA, 15 nt, Pseudomonas putida KT2440
ggacccggcuggaag

SEQ ID NO: 3558044 - RNA, 13 nt, Pseudomonas putida KT2440
ggaccuggcuggc

SEQ ID NO: 3558045 - RNA, 13 nt, Pseudomonas putida KT2440
ggaccuugcgggu

SEQ ID NO: 3558046 - RNA, 14 nt, Pseudomonas putida KT2440
ggacgaacccuuga

SEQ ID NO: 3558047 - RNA, 17 nt, Pseudomonas putida KT2440
ggacgaacccuugaccu

SEQ ID NO: 3558048 - RNA, 13 nt, Pseudomonas putida KT2440
ggacgcauauccu

SEQ ID NO: 3558049 - RNA, 23 nt, Pseudomonas putida KT2440
ggacggucaugcucagcugggcg

SEQ ID NO: 3558050 - RNA, 15 nt, Pseudomonas putida KT2440
ggacgucccagcagg

SEQ ID NO: 3558051 - RNA, 17 nt, Pseudomonas putida KT2440
ggacgucccagcaggca

SEQ ID NO: 3558052 - RNA, 16 nt, Pseudomonas putida KT2440
ggacgucgcgcuggcc

SEQ ID NO: 3558053 - RNA, 17 nt, Pseudomonas putida KT2440
ggacgucgcgcuggccg

SEQ ID NO: 3558054 - RNA, 19 nt, Pseudomonas putida KT2440
ggacgucgcgcuggccgcc

SEQ ID NO: 3558055 - RNA, 15 nt, Pseudomonas putida KT2440
ggacuaacaggugcu

SEQ ID NO: 3558056 - RNA, 18 nt, Pseudomonas putida KT2440
ggacuauccggagcuccc

SEQ ID NO: 3558057 - RNA, 18 nt, Pseudomonas putida KT2440
ggacucauagcucagcug

SEQ ID NO: 3558058 - RNA, 17 nt, Pseudomonas putida KT2440
ggacuccggccggggcu

SEQ ID NO: 3558059 - RNA, 17 nt, Pseudomonas putida KT2440
ggacucgacgucguagg

SEQ ID NO: 3558060 - RNA, 14 nt, Pseudomonas putida KT2440
ggacucgaucugug

SEQ ID NO: 3558061 - RNA, 15 nt, Pseudomonas putida KT2440
ggacucgaucugugg

SEQ ID NO: 3558062 - RNA, 16 nt, Pseudomonas putida KT2440
ggacugcaccaggucc

SEQ ID NO: 3558063 - RNA, 22 nt, Pseudomonas putida KT2440
ggacugcaccagguccagcgug

SEQ ID NO: 3558064 - RNA, 14 nt, Pseudomonas putida KT2440
ggacugcaccauga

SEQ ID NO: 3558065 - RNA, 14 nt, Pseudomonas putida KT2440
ggacuucagcaguu

SEQ ID NO: 3558066 - RNA, 16 nt, Pseudomonas putida KT2440
ggacuucuucaacgcg

SEQ ID NO: 3558067 - RNA, 20 nt, Pseudomonas putida KT2440
ggagaacgggcugucgagca

SEQ ID NO: 3558068 - RNA, 13 nt, Pseudomonas putida KT2440
ggagaccuuuccc

SEQ ID NO: 3558069 - RNA, 19 nt, Pseudomonas putida KT2440
ggagaucuugucgaccugg

SEQ ID NO: 3558070 - RNA, 12 nt, Pseudomonas putida KT2440
ggagaugcaguu

SEQ ID NO: 3558071 - RNA, 16 nt, Pseudomonas putida KT2440
ggagauucuauggccg

SEQ ID NO: 3558072 - RNA, 12 nt, Pseudomonas putida KT2440
ggagauuggcca

SEQ ID NO: 3558073 - RNA, 14 nt, Pseudomonas putida KT2440
ggagauuggccagc

SEQ ID NO: 3558074 - RNA, 17 nt, Pseudomonas putida KT2440
ggagauuggccagcagg

SEQ ID NO: 3558075 - RNA, 18 nt, Pseudomonas putida KT2440
ggagccggcuguggcaau

SEQ ID NO: 3558076 - RNA, 16 nt, Pseudomonas putida KT2440
ggagcgacuucgacca

SEQ ID NO: 3558077 - RNA, 18 nt, Pseudomonas putida KT2440
ggagcggaacucgcccgg

SEQ ID NO: 3558078 - RNA, 16 nt, Pseudomonas putida KT2440
ggagcggccuucaggg

SEQ ID NO: 3558079 - RNA, 20 nt, Pseudomonas putida KT2440
ggagcggccuugcgucgcga

SEQ ID NO: 3558080 - RNA, 21 nt, Pseudomonas putida KT2440
ggagcggccuugcgucgcgaa

SEQ ID NO: 3558081 - RNA, 20 nt, Pseudomonas putida KT2440
ggagcggccuugugucgcga

SEQ ID NO: 3558082 - RNA, 20 nt, Pseudomonas putida KT2440
ggagcggccuugugucucga

SEQ ID NO: 3558083 - RNA, 20 nt, Pseudomonas putida KT2440
ggagcggcuuugcgucccga

SEQ ID NO: 3558084 - RNA, 21 nt, Pseudomonas putida KT2440
ggagcggcuuugcgucccgaa

SEQ ID NO: 3558085 - RNA, 14 nt, Pseudomonas putida KT2440
ggagcgggcgcgcc

SEQ ID NO: 3558086 - RNA, 15 nt, Pseudomonas putida KT2440
ggagcgggcgugccc

SEQ ID NO: 3558087 - RNA, 19 nt, Pseudomonas putida KT2440
ggagcgggcgugcccgcga

SEQ ID NO: 3558088 - RNA, 20 nt, Pseudomonas putida KT2440
ggagcgggcgugcccgcgaa

SEQ ID NO: 3558089 - RNA, 21 nt, Pseudomonas putida KT2440
ggagcgggcgugcccgcgaau

SEQ ID NO: 3558090 - RNA, 19 nt, Pseudomonas putida KT2440
ggagcgggcuuacccgcga

SEQ ID NO: 3558091 - RNA, 20 nt, Pseudomonas putida KT2440
ggagcgggcuuacccgcgaa

SEQ ID NO: 3558092 - RNA, 19 nt, Pseudomonas putida KT2440
ggagcgggcuugcccgcga

SEQ ID NO: 3558093 - RNA, 18 nt, Pseudomonas putida KT2440
ggagcgggucagccugcc

SEQ ID NO: 3558094 - RNA, 19 nt, Pseudomonas putida KT2440
ggagcgggucuacccgcga

SEQ ID NO: 3558095 - RNA, 20 nt, Pseudomonas putida KT2440
ggagcgggucuacccgcgaa

SEQ ID NO: 3558096 - RNA, 15 nt, Pseudomonas putida KT2440
ggagcggguucaccc

SEQ ID NO: 3558097 - RNA, 14 nt, Pseudomonas putida KT2440
ggcaacagcugcgc

SEQ ID NO: 3558098 - RNA, 17 nt, Pseudomonas putida KT2440
ggcaaccacauggccgu

SEQ ID NO: 3558099 - RNA, 18 nt, Pseudomonas putida KT2440
ggcaaccacauggccguu

SEQ ID NO: 3558100 - RNA, 23 nt, Pseudomonas putida KT2440
ggcaaccaggugugccacuucau

SEQ ID NO: 3558101 - RNA, 13 nt, Pseudomonas putida KT2440
ggcaaccauggcu

SEQ ID NO: 3558102 - RNA, 14 nt, Pseudomonas putida KT2440
ggcaacccgccucc

SEQ ID NO: 3558103 - RNA, 18 nt, Pseudomonas putida KT2440
ggcaacccggcagucagg

SEQ ID NO: 3558104 - RNA, 19 nt, Pseudomonas putida KT2440
ggcaacccuucggccagca

SEQ ID NO: 3558105 - RNA, 21 nt, Pseudomonas putida KT2440
ggcaacccuucggccagcagu

SEQ ID NO: 3558106 - RNA, 20 nt, Pseudomonas putida KT2440
ggcaaccgagaucucgguac

SEQ ID NO: 3558107 - RNA, 19 nt, Pseudomonas putida KT2440
ggcaaccggagcgacuucg

SEQ ID NO: 3558108 - RNA, 20 nt, Pseudomonas putida KT2440
ggcaaccugcucgcucaggc

SEQ ID NO: 3558109 - RNA, 15 nt, Pseudomonas putida KT2440
ggcaacgccagcaau

SEQ ID NO: 3558110 - RNA, 17 nt, Pseudomonas putida KT2440
ggcaacggugaacggcg

SEQ ID NO: 3558111 - RNA, 17 nt, Pseudomonas putida KT2440
ggcaacgucaucggccc

SEQ ID NO: 3558112 - RNA, 19 nt, Pseudomonas putida KT2440
ggcaagcaaucagaacguc

SEQ ID NO: 3558113 - RNA, 15 nt, Pseudomonas putida KT2440
ggcaagcccauggcu

SEQ ID NO: 3558114 - RNA, 18 nt, Pseudomonas putida KT2440
ggcaagcccauggcuggc

SEQ ID NO: 3558115 - RNA, 23 nt, Pseudomonas putida KT2440
ggcaagcccgcgaagaggccagg

SEQ ID NO: 3558116 - RNA, 21 nt, Pseudomonas putida KT2440
ggcaagcccgcucccacagga

SEQ ID NO: 3558117 - RNA, 21 nt, Pseudomonas putida KT2440
ggcaagcccgcucccacaggg

SEQ ID NO: 3558118 - RNA, 17 nt, Pseudomonas putida KT2440
ggcaagcccgcuccuac

SEQ ID NO: 3558119 - RNA, 18 nt, Pseudomonas putida KT2440
ggcaagcccgcuccuaca

SEQ ID NO: 3558120 - RNA, 14 nt, Pseudomonas putida KT2440
ggcaaggcauccag

SEQ ID NO: 3558121 - RNA, 15 nt, Pseudomonas putida KT2440
ggcaaggcauccaga

SEQ ID NO: 3558122 - RNA, 17 nt, Pseudomonas putida KT2440
ggcaaggcgaucuggcg

SEQ ID NO: 3558123 - RNA, 19 nt, Pseudomonas putida KT2440
ggcaagggccugcaggcag

SEQ ID NO: 3558124 - RNA, 16 nt, Pseudomonas putida KT2440
ggcaagggcgaaccag

SEQ ID NO: 3558125 - RNA, 14 nt, Pseudomonas putida KT2440
ggcaaguggaagcg

SEQ ID NO: 3558126 - RNA, 22 nt, Pseudomonas putida KT2440
ggcaauaaaaaaccccggcaca

SEQ ID NO: 3558127 - RNA, 16 nt, Pseudomonas putida KT2440
ggcaauacaacgauca

SEQ ID NO: 3558128 - RNA, 16 nt, Pseudomonas putida KT2440
ggcaauaccggccacg

SEQ ID NO: 3558129 - RNA, 20 nt, Pseudomonas putida KT2440
ggcaauaccggccacgcgcg

SEQ ID NO: 3558130 - RNA, 15 nt, Pseudomonas putida KT2440
ggcaaucagggcauc

SEQ ID NO: 3558131 - RNA, 13 nt, Pseudomonas putida KT2440
ggcaaucaguaag

SEQ ID NO: 3558132 - RNA, 15 nt, Pseudomonas putida KT2440
ggcaaucgccaaggu

SEQ ID NO: 3558133 - RNA, 15 nt, Pseudomonas putida KT2440
ggcaaucgccaggcg

SEQ ID NO: 3558134 - RNA, 17 nt, Pseudomonas putida KT2440
ggcaaucgccgggcgca

SEQ ID NO: 3558135 - RNA, 12 nt, Pseudomonas putida KT2440
ggcaaucggcag

SEQ ID NO: 3558136 - RNA, 18 nt, Pseudomonas putida KT2440
ggcaaucggcaggccggc

SEQ ID NO: 3558137 - RNA, 23 nt, Pseudomonas putida KT2440
ggcaaucggguacacgccacgga

SEQ ID NO: 3558138 - RNA, 20 nt, Pseudomonas putida KT2440
ggcaaucgugaucaucccca

SEQ ID NO: 3558139 - RNA, 18 nt, Pseudomonas putida KT2440
ggcaaucugcagcagcau

SEQ ID NO: 3558140 - RNA, 17 nt, Pseudomonas putida KT2440
ggcaaucugcucgacga

SEQ ID NO: 3558141 - RNA, 18 nt, Pseudomonas putida KT2440
ggcaaucugcucgacgaa

SEQ ID NO: 3558142 - RNA, 16 nt, Pseudomonas putida KT2440
ggcaaugaccaagcaa

SEQ ID NO: 3558143 - RNA, 23 nt, Pseudomonas putida KT2440
ggcaaugaucagcccuugccagu

SEQ ID NO: 3558144 - RNA, 19 nt, Pseudomonas putida KT2440
ggcaaugcccauggccagg

SEQ ID NO: 3558145 - RNA, 21 nt, Pseudomonas putida KT2440
ggcaaugcccauggccaggcu

SEQ ID NO: 3558146 - RNA, 20 nt, Pseudomonas putida KT2440
ggcaaugcgagacgccacca

SEQ ID NO: 3558147 - RNA, 16 nt, Pseudomonas putida KT2440
ggcaaugcgguccucc

SEQ ID NO: 3558148 - RNA, 17 nt, Pseudomonas putida KT2440
ggcaaugcucgccugcu

SEQ ID NO: 3558149 - RNA, 20 nt, Pseudomonas putida KT2440
ggcaaugcucgccugcuugg

SEQ ID NO: 3558150 - RNA, 14 nt, Pseudomonas putida KT2440
ggcaauggccugca

SEQ ID NO: 3558151 - RNA, 19 nt, Pseudomonas putida KT2440
ggcaauggcgcgaacaggg

SEQ ID NO: 3558152 - RNA, 22 nt, Pseudomonas putida KT2440
ggcaauguaaugcgccgucgcc

SEQ ID NO: 3558153 - RNA, 15 nt, Pseudomonas putida KT2440
ggcaauguccagccc

SEQ ID NO: 3558154 - RNA, 18 nt, Pseudomonas putida KT2440
ggcaauguucgcugccag

SEQ ID NO: 3558155 - RNA, 22 nt, Pseudomonas putida KT2440
ggcaauuacuuugucgccuacc

SEQ ID NO: 3558156 - RNA, 22 nt, Pseudomonas putida KT2440
ggcaauucgccggcagcaaacc

SEQ ID NO: 3558157 - RNA, 14 nt, Pseudomonas putida KT2440
ggcaauugccaccg

SEQ ID NO: 3558158 - RNA, 15 nt, Pseudomonas putida KT2440
ggcaauuucauccac

SEQ ID NO: 3558159 - RNA, 19 nt, Pseudomonas putida KT2440
ggcacaaccgaacccgcug

SEQ ID NO: 3558160 - RNA, 14 nt, Pseudomonas putida KT2440
ggcacacuucgccg

SEQ ID NO: 3558161 - RNA, 13 nt, Pseudomonas putida KT2440
ggcacagaacaau

SEQ ID NO: 3558162 - RNA, 22 nt, Pseudomonas putida KT2440
ggcacagaucaacgccgccagc

SEQ ID NO: 3558163 - RNA, 23 nt, Pseudomonas putida KT2440
ggcacagaucaacgccgccagcg

SEQ ID NO: 3558164 - RNA, 13 nt, Pseudomonas putida KT2440
ggcacagcccagc

SEQ ID NO: 3558165 - RNA, 12 nt, Pseudomonas putida KT2440
ggcacaggccag

SEQ ID NO: 3558166 - RNA, 13 nt, Pseudomonas putida KT2440
ggcacaggcccag

SEQ ID NO: 3558167 - RNA, 20 nt, Pseudomonas putida KT2440
ggcacaggcccagcaacagc

SEQ ID NO: 3558168 - RNA, 20 nt, Pseudomonas putida KT2440
ggcacaggcuuacaacugcu

SEQ ID NO: 3558169 - RNA, 15 nt, Pseudomonas putida KT2440
ggcacaucaccagca

SEQ ID NO: 3558170 - RNA, 16 nt, Pseudomonas putida KT2440
ggcacaucaccagcag

SEQ ID NO: 3558171 - RNA, 18 nt, Pseudomonas putida KT2440
ggcacaucaccagcagcu

SEQ ID NO: 3558172 - RNA, 19 nt, Pseudomonas putida KT2440
ggcaccagauucaagcccg

SEQ ID NO: 3558173 - RNA, 20 nt, Pseudomonas putida KT2440
ggcaccagauucaagcccgg

SEQ ID NO: 3558174 - RNA, 18 nt, Pseudomonas putida KT2440
ggcaccagcaccagcucc

SEQ ID NO: 3558175 - RNA, 12 nt, Pseudomonas putida KT2440
ggcaccagcuuc

SEQ ID NO: 3558176 - RNA, 18 nt, Pseudomonas putida KT2440
ggcacccaauagcccacc

SEQ ID NO: 3558177 - RNA, 19 nt, Pseudomonas putida KT2440
ggcacccacagcgccugcu

SEQ ID NO: 3558178 - RNA, 22 nt, Pseudomonas putida KT2440
ggcacccacagcgccugcugcu

SEQ ID NO: 3558179 - RNA, 16 nt, Pseudomonas putida KT2440
ggcacccagccagcga

SEQ ID NO: 3558180 - RNA, 17 nt, Pseudomonas putida KT2440
ggcacccgcacaugccu

SEQ ID NO: 3558181 - RNA, 23 nt, Pseudomonas putida KT2440
ggcacccuggcgguugaccaggg

SEQ ID NO: 3558182 - RNA, 15 nt, Pseudomonas putida KT2440
ggcaccgacggcggu

SEQ ID NO: 3558183 - RNA, 13 nt, Pseudomonas putida KT2440
ggcaccgaucacc

SEQ ID NO: 3558184 - RNA, 14 nt, Pseudomonas putida KT2440
ggcaccgaucaccu

SEQ ID NO: 3558185 - RNA, 13 nt, Pseudomonas putida KT2440
ggcaccgccgccc

SEQ ID NO: 3558186 - RNA, 16 nt, Pseudomonas putida KT2440
ggcaccggcuucgccg

SEQ ID NO: 3558187 - RNA, 21 nt, Pseudomonas putida KT2440
ggcaccgggaugcucugcagc

SEQ ID NO: 3558188 - RNA, 15 nt, Pseudomonas putida KT2440
ggcaccgggcggcgg

SEQ ID NO: 3558189 - RNA, 19 nt, Pseudomonas putida KT2440
ggcaccuaucgcugccgcc

SEQ ID NO: 3558190 - RNA, 19 nt, Pseudomonas putida KT2440
ggcaccuuucuccaggugg

SEQ ID NO: 3558191 - RNA, 16 nt, Pseudomonas putida KT2440
ggcacgaagcccaguu

SEQ ID NO: 3558192 - RNA, 19 nt, Pseudomonas putida KT2440
ggcacgacugaacaccugc

SEQ ID NO: 3558193 - RNA, 18 nt, Pseudomonas putida KT2440
ggcacgagcaugccgagg

SEQ ID NO: 3558194 - RNA, 15 nt, Pseudomonas putida KT2440
ggcacgaucagcagc

SEQ ID NO: 3558195 - RNA, 16 nt, Pseudomonas putida KT2440
ggcacgaucagcagca

SEQ ID NO: 3558196 - RNA, 17 nt, Pseudomonas putida KT2440
ggcacgaucagcagcaa

SEQ ID NO: 3558197 - RNA, 20 nt, Pseudomonas putida KT2440
ggcacgauccugugggagcg

SEQ ID NO: 3558198 - RNA, 17 nt, Pseudomonas putida KT2440
ggcacgccaaucaccug

SEQ ID NO: 3558199 - RNA, 15 nt, Pseudomonas putida KT2440
ggcacgcccagcaac

SEQ ID NO: 3558200 - RNA, 11 nt, Pseudomonas putida KT2440
ggcacgcccau

SEQ ID NO: 3558201 - RNA, 18 nt, Pseudomonas putida KT2440
ggcacgcccggcaccugc

SEQ ID NO: 3558202 - RNA, 15 nt, Pseudomonas putida KT2440
ggcagggccggcccu

SEQ ID NO: 3558203 - RNA, 19 nt, Pseudomonas putida KT2440
ggcaggggacagccacaug

SEQ ID NO: 3558204 - RNA, 19 nt, Pseudomonas putida KT2440
ggcagggugaucgcgcugg

SEQ ID NO: 3558205 - RNA, 23 nt, Pseudomonas putida KT2440
ggcagggugaucgcgcuggcacu

SEQ ID NO: 3558206 - RNA, 13 nt, Pseudomonas putida KT2440
ggcaggucagcga

SEQ ID NO: 3558207 - RNA, 21 nt, Pseudomonas putida KT2440
ggcaggucgacgucggcgacg

SEQ ID NO: 3558208 - RNA, 14 nt, Pseudomonas putida KT2440
ggcagguucgacca

SEQ ID NO: 3558209 - RNA, 17 nt, Pseudomonas putida KT2440
ggcagguugcuggccuu

SEQ ID NO: 3558210 - RNA, 13 nt, Pseudomonas putida KT2440
ggcagguuggcgc

SEQ ID NO: 3558211 - RNA, 14 nt, Pseudomonas putida KT2440
ggcaguaggccacc

SEQ ID NO: 3558212 - RNA, 17 nt, Pseudomonas putida KT2440
ggcagucacccaccggc

SEQ ID NO: 3558213 - RNA, 18 nt, Pseudomonas putida KT2440
ggcagugaacuccaacgc

SEQ ID NO: 3558214 - RNA, 16 nt, Pseudomonas putida KT2440
ggcaguggcggugacc

SEQ ID NO: 3558215 - RNA, 16 nt, Pseudomonas putida KT2440
ggcaguguaaauagcu

SEQ ID NO: 3558216 - RNA, 17 nt, Pseudomonas putida KT2440
ggcaguguacauggccg

SEQ ID NO: 3558217 - RNA, 21 nt, Pseudomonas putida KT2440
ggcaguguggcaagggcggag

SEQ ID NO: 3558218 - RNA, 16 nt, Pseudomonas putida KT2440
ggcaguuucaggcgcu

SEQ ID NO: 3558219 - RNA, 16 nt, Pseudomonas putida KT2440
ggcaguuugccgauga

SEQ ID NO: 3558220 - RNA, 19 nt, Pseudomonas putida KT2440
ggcauaacggcuggcgcau

SEQ ID NO: 3558221 - RNA, 13 nt, Pseudomonas putida KT2440
ggcauacagcucc

SEQ ID NO: 3558222 - RNA, 19 nt, Pseudomonas putida KT2440
ggcauaccgcaacaccugc

SEQ ID NO: 3558223 - RNA, 19 nt, Pseudomonas putida KT2440
ggcauacgaggccgucgua

SEQ ID NO: 3558224 - RNA, 14 nt, Pseudomonas putida KT2440
ggcauagcaguccu

SEQ ID NO: 3558225 - RNA, 19 nt, Pseudomonas putida KT2440
ggcauagcgcucgcgcagg

SEQ ID NO: 3558226 - RNA, 16 nt, Pseudomonas putida KT2440
ggcauaguccaggaag

SEQ ID NO: 3558227 - RNA, 20 nt, Pseudomonas putida KT2440
ggcauauccggccuuuucau

SEQ ID NO: 3558228 - RNA, 16 nt, Pseudomonas putida KT2440
ggcaucaaugcaaugu

SEQ ID NO: 3558229 - RNA, 15 nt, Pseudomonas putida KT2440
ggcaucacgcuggcc

SEQ ID NO: 3558230 - RNA, 22 nt, Pseudomonas putida KT2440
ggcaucauccugcucgacaagc

SEQ ID NO: 3558231 - RNA, 17 nt, Pseudomonas putida KT2440
ggcaucauccugcuggc

SEQ ID NO: 3558232 - RNA, 22 nt, Pseudomonas putida KT2440
ggcauccacacccugcgaaguc

SEQ ID NO: 3558233 - RNA, 13 nt, Pseudomonas putida KT2440
ggcauccagcucg

SEQ ID NO: 3558234 - RNA, 16 nt, Pseudomonas putida KT2440
ggcauccgccucaucc

SEQ ID NO: 3558235 - RNA, 18 nt, Pseudomonas putida KT2440
ggcauccggcagcucacc

SEQ ID NO: 3558236 - RNA, 17 nt, Pseudomonas putida KT2440
ggcauccgucgacucau

SEQ ID NO: 3558237 - RNA, 20 nt, Pseudomonas putida KT2440
ggcauccucaagcugcaccg

SEQ ID NO: 3558238 - RNA, 17 nt, Pseudomonas putida KT2440
ggcaucgaacagcuugc

SEQ ID NO: 3558239 - RNA, 14 nt, Pseudomonas putida KT2440
ggcaucgaagcgca

SEQ ID NO: 3558240 - RNA, 19 nt, Pseudomonas putida KT2440
ggcaucgaagcgcaccagu

SEQ ID NO: 3558241 - RNA, 22 nt, Pseudomonas putida KT2440
ggcaucgaagcgcaccagugua

SEQ ID NO: 3558242 - RNA, 18 nt, Pseudomonas putida KT2440
ggcaucgaaggugguagc

SEQ ID NO: 3558243 - RNA, 18 nt, Pseudomonas putida KT2440
ggcaucgacaaucggcuc

SEQ ID NO: 3558244 - RNA, 16 nt, Pseudomonas putida KT2440
ggcaucgacgaugccg

SEQ ID NO: 3558245 - RNA, 18 nt, Pseudomonas putida KT2440
ggcaucgcucaacuggcu

SEQ ID NO: 3558246 - RNA, 23 nt, Pseudomonas putida KT2440
ggcaucgcugcccgggcaaagca

SEQ ID NO: 3558247 - RNA, 22 nt, Pseudomonas putida KT2440
ggcaucggccuggggcaggccc

SEQ ID NO: 3558248 - RNA, 23 nt, Pseudomonas putida KT2440
ggcaucggccuggggcaggcccg

SEQ ID NO: 3558249 - RNA, 12 nt, Pseudomonas putida KT2440
ggcaucggcgcc

SEQ ID NO: 3558250 - RNA, 17 nt, Pseudomonas putida KT2440
ggcaucggcgccuucgc

SEQ ID NO: 3558251 - RNA, 18 nt, Pseudomonas putida KT2440
ggcaucggcgugcugcgu

SEQ ID NO: 3558252 - RNA, 16 nt, Pseudomonas putida KT2440
ggcaucgggcaaggcg

SEQ ID NO: 3558253 - RNA, 18 nt, Pseudomonas putida KT2440
ggcaucggucaccgggua

SEQ ID NO: 3558254 - RNA, 22 nt, Pseudomonas putida KT2440
ggcaucugccgggucggccugc

SEQ ID NO: 3558255 - RNA, 11 nt, Pseudomonas putida KT2440
ggcaucugcug

SEQ ID NO: 3558256 - RNA, 19 nt, Pseudomonas putida KT2440
ggcaugcacuuccaggaag

SEQ ID NO: 3558257 - RNA, 20 nt, Pseudomonas putida KT2440
ggcaugcacuuccaggaagg

SEQ ID NO: 3558258 - RNA, 14 nt, Pseudomonas putida KT2440
ggcaugccagcagc

SEQ ID NO: 3558259 - RNA, 17 nt, Pseudomonas putida KT2440
ggcaugccagcagcugg

SEQ ID NO: 3558260 - RNA, 22 nt, Pseudomonas putida KT2440
ggcaugcccaguucgcgugcca

SEQ ID NO: 3558261 - RNA, 18 nt, Pseudomonas putida KT2440
ggcaugcccgccccugcc

SEQ ID NO: 3558262 - RNA, 21 nt, Pseudomonas putida KT2440
ggcaugcccgcucccacaggu

SEQ ID NO: 3558263 - RNA, 13 nt, Pseudomonas putida KT2440
ggcaugcgcaggc

SEQ ID NO: 3558264 - RNA, 16 nt, Pseudomonas putida KT2440
ggcaugcgucuggcgg

SEQ ID NO: 3558265 - RNA, 20 nt, Pseudomonas putida KT2440
ggcaugcgucuggcggcccu

SEQ ID NO: 3558266 - RNA, 18 nt, Pseudomonas putida KT2440
ggcaugggugagcacggc

SEQ ID NO: 3558267 - RNA, 22 nt, Pseudomonas putida KT2440
ggcaugucgaugcggugcucau

SEQ ID NO: 3558268 - RNA, 16 nt, Pseudomonas putida KT2440
ggcaugugcacuggca

SEQ ID NO: 3558269 - RNA, 16 nt, Pseudomonas putida KT2440
ggcauguucaucaccg

SEQ ID NO: 3558270 - RNA, 20 nt, Pseudomonas putida KT2440
ggcauguucaucaccggcca

SEQ ID NO: 3558271 - RNA, 17 nt, Pseudomonas putida KT2440
ggcauucggcgagccuu

SEQ ID NO: 3558272 - RNA, 16 nt, Pseudomonas putida KT2440
ggcauugagguugacg

SEQ ID NO: 3558273 - RNA, 17 nt, Pseudomonas putida KT2440
ggcauuggcgcgcucga

SEQ ID NO: 3558274 - RNA, 14 nt, Pseudomonas putida KT2440
ggcauuuccagcgu

SEQ ID NO: 3558275 - RNA, 19 nt, Pseudomonas putida KT2440
ggcauuuucgauacggccg

SEQ ID NO: 3558276 - RNA, 22 nt, Pseudomonas putida KT2440
ggcauuuucgauacggccgugg

SEQ ID NO: 3558277 - RNA, 16 nt, Pseudomonas putida KT2440
ggccaaaccguccagg

SEQ ID NO: 3558278 - RNA, 17 nt, Pseudomonas putida KT2440
ggccaaaccguccaggu

SEQ ID NO: 3558279 - RNA, 21 nt, Pseudomonas putida KT2440
ggccaacauucacggcgucga

SEQ ID NO: 3558280 - RNA, 16 nt, Pseudomonas putida KT2440
ggccaaccagccggca

SEQ ID NO: 3558281 - RNA, 15 nt, Pseudomonas putida KT2440
ggccaacgacagguc

SEQ ID NO: 3558282 - RNA, 16 nt, Pseudomonas putida KT2440
ggccaacgauuggcag

SEQ ID NO: 3558283 - RNA, 19 nt, Pseudomonas putida KT2440
ggccaacuccccacccagg

SEQ ID NO: 3558284 - RNA, 20 nt, Pseudomonas putida KT2440
ggccaacuccccacccaggu

SEQ ID NO: 3558285 - RNA, 14 nt, Pseudomonas putida KT2440
ggccaacugcagca

SEQ ID NO: 3558286 - RNA, 19 nt, Pseudomonas putida KT2440
ggccaagccaccgccacca

SEQ ID NO: 3558287 - RNA, 13 nt, Pseudomonas putida KT2440
ggccaagccgcug

SEQ ID NO: 3558288 - RNA, 16 nt, Pseudomonas putida KT2440
ggccaagccgcugcca

SEQ ID NO: 3558289 - RNA, 19 nt, Pseudomonas putida KT2440
ggccaagccgcugccacag

SEQ ID NO: 3558290 - RNA, 21 nt, Pseudomonas putida KT2440
ggccaagccgcugccacaggu

SEQ ID NO: 3558291 - RNA, 23 nt, Pseudomonas putida KT2440
ggccaaggucaucgggaucagca

SEQ ID NO: 3558292 - RNA, 18 nt, Pseudomonas putida KT2440
ggccaaggucuccagcac

SEQ ID NO: 3558293 - RNA, 17 nt, Pseudomonas putida KT2440
ggccaagguugccacca

SEQ ID NO: 3558294 - RNA, 20 nt, Pseudomonas putida KT2440
ggccaagguugccaccagca

SEQ ID NO: 3558295 - RNA, 17 nt, Pseudomonas putida KT2440
ggccaaguacggccagc

SEQ ID NO: 3558296 - RNA, 23 nt, Pseudomonas putida KT2440
ggccaauaucuggugcagguuga

SEQ ID NO: 3558297 - RNA, 17 nt, Pseudomonas putida KT2440
ggccaaucgaucugcuc

SEQ ID NO: 3558298 - RNA, 19 nt, Pseudomonas putida KT2440
ggccaaucgaucugcucgc

SEQ ID NO: 3558299 - RNA, 13 nt, Pseudomonas putida KT2440
ggccaauggcagg

SEQ ID NO: 3558300 - RNA, 14 nt, Pseudomonas putida KT2440
ggccaauggcaggu

SEQ ID NO: 3558301 - RNA, 22 nt, Pseudomonas putida KT2440
ggccacacgcugcugcuggccg

SEQ ID NO: 3558302 - RNA, 19 nt, Pseudomonas putida KT2440
ggccacauggaucagcuca

SEQ ID NO: 3558303 - RNA, 17 nt, Pseudomonas putida KT2440
ggccaccacacugguca

SEQ ID NO: 3558304 - RNA, 16 nt, Pseudomonas putida KT2440
ggccaccaccagcaac

SEQ ID NO: 3558305 - RNA, 13 nt, Pseudomonas putida KT2440
ggccaccacuucu

SEQ ID NO: 3558306 - RNA, 12 nt, Pseudomonas putida KT2440
ggccaccagcac

SEQ ID NO: 3558307 - RNA, 12 nt, Pseudomonas putida KT2440
ggccaucagcaa

SEQ ID NO: 3558308 - RNA, 20 nt, Pseudomonas putida KT2440
ggccaucagcaagccgccga

SEQ ID NO: 3558309 - RNA, 17 nt, Pseudomonas putida KT2440
ggccauccagucgauca

SEQ ID NO: 3558310 - RNA, 23 nt, Pseudomonas putida KT2440
ggccauccagucgaucagcgaca

SEQ ID NO: 3558311 - RNA, 15 nt, Pseudomonas putida KT2440
ggccauccugcugua

SEQ ID NO: 3558312 - RNA, 19 nt, Pseudomonas putida KT2440
ggccauccugcuguagcgc

SEQ ID NO: 3558313 - RNA, 13 nt, Pseudomonas putida KT2440
ggccaucgacccg

SEQ ID NO: 3558314 - RNA, 17 nt, Pseudomonas putida KT2440
ggccaucuaagccucca

SEQ ID NO: 3558315 - RNA, 23 nt, Pseudomonas putida KT2440
ggccaucugguugcuggcgccag

SEQ ID NO: 3558316 - RNA, 14 nt, Pseudomonas putida KT2440
ggccaugaucgccg

SEQ ID NO: 3558317 - RNA, 18 nt, Pseudomonas putida KT2440
ggccaugauuacgcugaa

SEQ ID NO: 3558318 - RNA, 18 nt, Pseudomonas putida KT2440
ggccaugcccaccgcauu

SEQ ID NO: 3558319 - RNA, 19 nt, Pseudomonas putida KT2440
ggccaugcccuugccuucg

SEQ ID NO: 3558320 - RNA, 17 nt, Pseudomonas putida KT2440
ggccaugcugcgccagg

SEQ ID NO: 3558321 - RNA, 20 nt, Pseudomonas putida KT2440
ggccauggcgcggacgauca

SEQ ID NO: 3558322 - RNA, 13 nt, Pseudomonas putida KT2440
ggccauguccggg

SEQ ID NO: 3558323 - RNA, 14 nt, Pseudomonas putida KT2440
ggccaugugcucgg

SEQ ID NO: 3558324 - RNA, 17 nt, Pseudomonas putida KT2440
ggccauucgcgggcaug

SEQ ID NO: 3558325 - RNA, 17 nt, Pseudomonas putida KT2440
ggccauugagguugacg

SEQ ID NO: 3558326 - RNA, 14 nt, Pseudomonas putida KT2440
ggccauugccgcgc

SEQ ID NO: 3558327 - RNA, 23 nt, Pseudomonas putida KT2440
ggcccaaacaacaaagccccggc

SEQ ID NO: 3558328 - RNA, 14 nt, Pseudomonas putida KT2440
ggcccaacagcgcg

SEQ ID NO: 3558329 - RNA, 15 nt, Pseudomonas putida KT2440
ggcccaacagcgcgg

SEQ ID NO: 3558330 - RNA, 13 nt, Pseudomonas putida KT2440
ggcccaaggcacc

SEQ ID NO: 3558331 - RNA, 15 nt, Pseudomonas putida KT2440
ggcccaaggcgaugu

SEQ ID NO: 3558332 - RNA, 23 nt, Pseudomonas putida KT2440
ggcccaaggugcacaccuugggc

SEQ ID NO: 3558333 - RNA, 16 nt, Pseudomonas putida KT2440
ggcccacccggcugaa

SEQ ID NO: 3558334 - RNA, 22 nt, Pseudomonas putida KT2440
ggcccacgccuuccaccgguac

SEQ ID NO: 3558335 - RNA, 20 nt, Pseudomonas putida KT2440
ggcccacgcucuguaucgaa

SEQ ID NO: 3558336 - RNA, 16 nt, Pseudomonas putida KT2440
ggcccacggcguccag

SEQ ID NO: 3558337 - RNA, 15 nt, Pseudomonas putida KT2440
ggcccacugcacggc

SEQ ID NO: 3558338 - RNA, 13 nt, Pseudomonas putida KT2440
ggcccagcaggua

SEQ ID NO: 3558339 - RNA, 13 nt, Pseudomonas putida KT2440
ggcccagccaccg

SEQ ID NO: 3558340 - RNA, 20 nt, Pseudomonas putida KT2440
ggcccagccaggcacuggcc

SEQ ID NO: 3558341 - RNA, 21 nt, Pseudomonas putida KT2440
ggcccagccaggcacuggcca

SEQ ID NO: 3558342 - RNA, 23 nt, Pseudomonas putida KT2440
ggcccagccaggcacuggccagc

SEQ ID NO: 3558343 - RNA, 22 nt, Pseudomonas putida KT2440
ggcccagccaucgagcaccggc

SEQ ID NO: 3558344 - RNA, 17 nt, Pseudomonas putida KT2440
ggcccagcccagcccgg

SEQ ID NO: 3558345 - RNA, 17 nt, Pseudomonas putida KT2440
ggcccagcccaguagau

SEQ ID NO: 3558346 - RNA, 12 nt, Pseudomonas putida KT2440
ggcccagccccg

SEQ ID NO: 3558347 - RNA, 21 nt, Pseudomonas putida KT2440
ggcccagccccgagcaaagcc

SEQ ID NO: 3558348 - RNA, 13 nt, Pseudomonas putida KT2440
ggcccagccccgc

SEQ ID NO: 3558349 - RNA, 13 nt, Pseudomonas putida KT2440
ggcccagccgcga

SEQ ID NO: 3558350 - RNA, 17 nt, Pseudomonas putida KT2440
ggcccagcuacgcgagc

SEQ ID NO: 3558351 - RNA, 19 nt, Pseudomonas putida KT2440
ggcccagcuacgcgagcca

SEQ ID NO: 3558352 - RNA, 15 nt, Pseudomonas putida KT2440
ggcccaggggcaggu

SEQ ID NO: 3558353 - RNA, 16 nt, Pseudomonas putida KT2440
ggcccaggggcagguc

SEQ ID NO: 3558354 - RNA, 11 nt, Pseudomonas putida KT2440
ggcccaguucg

SEQ ID NO: 3558355 - RNA, 15 nt, Pseudomonas putida KT2440
ggcccaguucuccgg

SEQ ID NO: 3558356 - RNA, 18 nt, Pseudomonas putida KT2440
ggcccaguucuccggcag

SEQ ID NO: 3558357 - RNA, 17 nt, Pseudomonas putida KT2440
ggcccaguuucgccagu

SEQ ID NO: 3558358 - RNA, 18 nt, Pseudomonas putida KT2440
ggcccauaccguuucgau

SEQ ID NO: 3558359 - RNA, 22 nt, Pseudomonas putida KT2440
ggcccaugacguucuucggcag

SEQ ID NO: 3558360 - RNA, 16 nt, Pseudomonas putida KT2440
ggcccauucgcgggca

SEQ ID NO: 3558361 - RNA, 19 nt, Pseudomonas putida KT2440
ggccccaagcuucaccuca

SEQ ID NO: 3558362 - RNA, 21 nt, Pseudomonas putida KT2440
ggccccaauugcuucaaccgu

SEQ ID NO: 3558363 - RNA, 23 nt, Pseudomonas putida KT2440
ggccccacaauaagaugcggcgc

SEQ ID NO: 3558364 - RNA, 21 nt, Pseudomonas putida KT2440
ggccccacccaacucgcuucc

SEQ ID NO: 3558365 - RNA, 13 nt, Pseudomonas putida KT2440
ggccccacgcagu

SEQ ID NO: 3558366 - RNA, 21 nt, Pseudomonas putida KT2440
ggccccaggccauccagcggc

SEQ ID NO: 3558367 - RNA, 13 nt, Pseudomonas putida KT2440
ggccccaggcggu

SEQ ID NO: 3558368 - RNA, 16 nt, Pseudomonas putida KT2440
ggccccaggcggugca

SEQ ID NO: 3558369 - RNA, 16 nt, Pseudomonas putida KT2440
ggccccagggaucgau

SEQ ID NO: 3558370 - RNA, 13 nt, Pseudomonas putida KT2440
ggccccaggugcc

SEQ ID NO: 3558371 - RNA, 12 nt, Pseudomonas putida KT2440
ggcccccacgcc

SEQ ID NO: 3558372 - RNA, 16 nt, Pseudomonas putida KT2440
ggccccccagccagca

SEQ ID NO: 3558373 - RNA, 18 nt, Pseudomonas putida KT2440
ggccccccagccagcaga

SEQ ID NO: 3558374 - RNA, 23 nt, Pseudomonas putida KT2440
ggcccccugguuuuccaccggca

SEQ ID NO: 3558375 - RNA, 14 nt, Pseudomonas putida KT2440
ggccccggccccag

SEQ ID NO: 3558376 - RNA, 16 nt, Pseudomonas putida KT2440
ggccccuucgauucag

SEQ ID NO: 3558377 - RNA, 20 nt, Pseudomonas putida KT2440
ggccccuucgauucaggccu

SEQ ID NO: 3558378 - RNA, 22 nt, Pseudomonas putida KT2440
ggccccuucgauucaggccuuu

SEQ ID NO: 3558379 - RNA, 18 nt, Pseudomonas putida KT2440
ggccccuuggccaacggc

SEQ ID NO: 3558380 - RNA, 16 nt, Pseudomonas putida KT2440
ggcccgaaacaaaugu

SEQ ID NO: 3558381 - RNA, 15 nt, Pseudomonas putida KT2440
ggcccgaacgcagcg

SEQ ID NO: 3558382 - RNA, 19 nt, Pseudomonas putida KT2440
ggcccgaagguguuugacc

SEQ ID NO: 3558383 - RNA, 21 nt, Pseudomonas putida KT2440
ggcccgacaaagaagcgccgc

SEQ ID NO: 3558384 - RNA, 16 nt, Pseudomonas putida KT2440
ggcccgaccucacgca

SEQ ID NO: 3558385 - RNA, 15 nt, Pseudomonas putida KT2440
ggcccgacuccaccg

SEQ ID NO: 3558386 - RNA, 20 nt, Pseudomonas putida KT2440
ggcccgaugaucaggccgcu

SEQ ID NO: 3558387 - RNA, 19 nt, Pseudomonas putida KT2440
ggcccgaugggcgucgccu

SEQ ID NO: 3558388 - RNA, 13 nt, Pseudomonas putida KT2440
ggcccgcagcgcu

SEQ ID NO: 3558389 - RNA, 19 nt, Pseudomonas putida KT2440
ggcccgccaguaggcugca

SEQ ID NO: 3558390 - RNA, 24 nt, Pseudomonas putida KT2440
ggcccgccaguaggcugcagccuu

SEQ ID NO: 3558391 - RNA, 15 nt, Pseudomonas putida KT2440
ggcccgcccagcugg

SEQ ID NO: 3558392 - RNA, 22 nt, Pseudomonas putida KT2440
ggcccgccccuuuagcaggcaa

SEQ ID NO: 3558393 - RNA, 15 nt, Pseudomonas putida KT2440
ggcccgccgccacca

SEQ ID NO: 3558394 - RNA, 19 nt, Pseudomonas putida KT2440
ggcccgccgccaccagcgc

SEQ ID NO: 3558395 - RNA, 14 nt, Pseudomonas putida KT2440
ggcccgccggcaac

SEQ ID NO: 3558396 - RNA, 21 nt, Pseudomonas putida KT2440
ggcccgccggcaacuccucca

SEQ ID NO: 3558397 - RNA, 23 nt, Pseudomonas putida KT2440
ggcccgccggcaacuccuccagc

SEQ ID NO: 3558398 - RNA, 14 nt, Pseudomonas putida KT2440
ggcccgcgaugccg

SEQ ID NO: 3558399 - RNA, 18 nt, Pseudomonas putida KT2440
ggcccgcgaugccgacag

SEQ ID NO: 3558400 - RNA, 14 nt, Pseudomonas putida KT2440
ggcccgcgccaggc

SEQ ID NO: 3558401 - RNA, 18 nt, Pseudomonas putida KT2440
ggcccgcgccgacagccu

SEQ ID NO: 3558402 - RNA, 20 nt, Pseudomonas putida KT2440
ggcccgcucguacgucgccu

SEQ ID NO: 3558403 - RNA, 16 nt, Pseudomonas putida KT2440
ggcccggcagguugau

SEQ ID NO: 3558404 - RNA, 17 nt, Pseudomonas putida KT2440
ggcccggcauccuuggg

SEQ ID NO: 3558405 - RNA, 20 nt, Pseudomonas putida KT2440
ggcccggcccuuucgcgggu

SEQ ID NO: 3558406 - RNA, 14 nt, Pseudomonas putida KT2440
ggcccggcuggcca

SEQ ID NO: 3558407 - RNA, 22 nt, Pseudomonas putida KT2440
ggcccggggaucuugcuggccg

SEQ ID NO: 3558408 - RNA, 14 nt, Pseudomonas putida KT2440
ggcccggucccgcu

SEQ ID NO: 3558409 - RNA, 18 nt, Pseudomonas putida KT2440
ggcccgguuggcgcuucc

SEQ ID NO: 3558410 - RNA, 16 nt, Pseudomonas putida KT2440
ggcccgugacgaaggc

SEQ ID NO: 3558411 - RNA, 17 nt, Pseudomonas putida KT2440
ggcccgugacgaaggcg

SEQ ID NO: 3558412 - RNA, 17 nt, Pseudomonas putida KT2440
ggccgcggcugaacacg

SEQ ID NO: 3558413 - RNA, 17 nt, Pseudomonas putida KT2440
ggccgcguaccagcagg

SEQ ID NO: 3558414 - RNA, 18 nt, Pseudomonas putida KT2440
ggccgcguaccagcaggg

SEQ ID NO: 3558415 - RNA, 18 nt, Pseudomonas putida KT2440
ggccgcguucgcccaggc

SEQ ID NO: 3558416 - RNA, 20 nt, Pseudomonas putida KT2440
ggccgcucaccggccagcgc

SEQ ID NO: 3558417 - RNA, 22 nt, Pseudomonas putida KT2440
ggccgcucaccggccagcgcgc

SEQ ID NO: 3558418 - RNA, 15 nt, Pseudomonas putida KT2440
ggccgcuccagcucg

SEQ ID NO: 3558419 - RNA, 16 nt, Pseudomonas putida KT2440
ggccgcuccuucacca

SEQ ID NO: 3558420 - RNA, 21 nt, Pseudomonas putida KT2440
ggccgcugaacaacuccgggu

SEQ ID NO: 3558421 - RNA, 20 nt, Pseudomonas putida KT2440
ggccgcugaaccucaccgcc

SEQ ID NO: 3558422 - RNA, 16 nt, Pseudomonas putida KT2440
ggccgcuggcccuucg

SEQ ID NO: 3558423 - RNA, 14 nt, Pseudomonas putida KT2440
ggccgcuucgcgga

SEQ ID NO: 3558424 - RNA, 18 nt, Pseudomonas putida KT2440
ggccgcuugcaaccgacg

SEQ ID NO: 3558425 - RNA, 17 nt, Pseudomonas putida KT2440
ggccgcuugcugaucaa

SEQ ID NO: 3558426 - RNA, 13 nt, Pseudomonas putida KT2440
ggccggaacaggc

SEQ ID NO: 3558427 - RNA, 18 nt, Pseudomonas putida KT2440
ggccggauagagcccggc

SEQ ID NO: 3558428 - RNA, 11 nt, Pseudomonas putida KT2440
ggccggcaacg

SEQ ID NO: 3558429 - RNA, 19 nt, Pseudomonas putida KT2440
ggccggcacagacaccaca

SEQ ID NO: 3558430 - RNA, 21 nt, Pseudomonas putida KT2440
ggccggcacagacaccgcaaa

SEQ ID NO: 3558431 - RNA, 14 nt, Pseudomonas putida KT2440
ggccggcacaggaa

SEQ ID NO: 3558432 - RNA, 18 nt, Pseudomonas putida KT2440
ggccggcacaggaaggca

SEQ ID NO: 3558433 - RNA, 17 nt, Pseudomonas putida KT2440
ggccggcaccgacagca

SEQ ID NO: 3558434 - RNA, 21 nt, Pseudomonas putida KT2440
ggccggcacgacuucgcacac

SEQ ID NO: 3558435 - RNA, 15 nt, Pseudomonas putida KT2440
ggccggcacugacca

SEQ ID NO: 3558436 - RNA, 16 nt, Pseudomonas putida KT2440
ggccggcagccagggc

SEQ ID NO: 3558437 - RNA, 21 nt, Pseudomonas putida KT2440
ggccggcaggcccggcccuuu

SEQ ID NO: 3558438 - RNA, 23 nt, Pseudomonas putida KT2440
ggccggcaggcccggcccuuucg

SEQ ID NO: 3558439 - RNA, 15 nt, Pseudomonas putida KT2440
ggccggcaucgcagc

SEQ ID NO: 3558440 - RNA, 17 nt, Pseudomonas putida KT2440
ggccggccaccagugcu

SEQ ID NO: 3558441 - RNA, 16 nt, Pseudomonas putida KT2440
ggccggccccacgcag

SEQ ID NO: 3558442 - RNA, 13 nt, Pseudomonas putida KT2440
ggccggccccggc

SEQ ID NO: 3558443 - RNA, 14 nt, Pseudomonas putida KT2440
ggccggcccuuucg

SEQ ID NO: 3558444 - RNA, 15 nt, Pseudomonas putida KT2440
ggccggcccuuucgc

SEQ ID NO: 3558445 - RNA, 17 nt, Pseudomonas putida KT2440
ggccggcugugcagaua

SEQ ID NO: 3558446 - RNA, 18 nt, Pseudomonas putida KT2440
ggccgggcacgacacucc

SEQ ID NO: 3558447 - RNA, 20 nt, Pseudomonas putida KT2440
ggccgggucacggcugaaga

SEQ ID NO: 3558448 - RNA, 15 nt, Pseudomonas putida KT2440
ggccgggucgaaggc

SEQ ID NO: 3558449 - RNA, 16 nt, Pseudomonas putida KT2440
ggccgggucgaaggca

SEQ ID NO: 3558450 - RNA, 14 nt, Pseudomonas putida KT2440
ggccgguacaggcu

SEQ ID NO: 3558451 - RNA, 20 nt, Pseudomonas putida KT2440
ggccggucacccccaucagc

SEQ ID NO: 3558452 - RNA, 16 nt, Pseudomonas putida KT2440
ggccggucccaauaau

SEQ ID NO: 3558453 - RNA, 21 nt, Pseudomonas putida KT2440
ggccggucguuacccaccagc

SEQ ID NO: 3558454 - RNA, 20 nt, Pseudomonas putida KT2440
ggccggugggcaacagcugc

SEQ ID NO: 3558455 - RNA, 22 nt, Pseudomonas putida KT2440
ggccgguguggccaaggcggcg

SEQ ID NO: 3558456 - RNA, 19 nt, Pseudomonas putida KT2440
ggccgguuaaaacccaggc

SEQ ID NO: 3558457 - RNA, 16 nt, Pseudomonas putida KT2440
ggccguaguaggagcg

SEQ ID NO: 3558458 - RNA, 22 nt, Pseudomonas putida KT2440
ggccgucacauaguugggcugu

SEQ ID NO: 3558459 - RNA, 17 nt, Pseudomonas putida KT2440
ggccgucaccgcugccg

SEQ ID NO: 3558460 - RNA, 13 nt, Pseudomonas putida KT2440
ggccgucagcagc

SEQ ID NO: 3558461 - RNA, 15 nt, Pseudomonas putida KT2440
ggccgucagcagcag

SEQ ID NO: 3558462 - RNA, 16 nt, Pseudomonas putida KT2440
ggccgucagcagcagg

SEQ ID NO: 3558463 - RNA, 14 nt, Pseudomonas putida KT2440
ggccgucgcggcug

SEQ ID NO: 3558464 - RNA, 18 nt, Pseudomonas putida KT2440
ggccgucguguaggagcg

SEQ ID NO: 3558465 - RNA, 16 nt, Pseudomonas putida KT2440
ggccgugaacacgugg

SEQ ID NO: 3558466 - RNA, 21 nt, Pseudomonas putida KT2440
ggccgugcaggcggcgacaac

SEQ ID NO: 3558467 - RNA, 16 nt, Pseudomonas putida KT2440
ggccguggcaaggccc

SEQ ID NO: 3558468 - RNA, 19 nt, Pseudomonas putida KT2440
ggccguggguccugcgcca

SEQ ID NO: 3558469 - RNA, 22 nt, Pseudomonas putida KT2440
ggccguggucgccuucacugcg

SEQ ID NO: 3558470 - RNA, 15 nt, Pseudomonas putida KT2440
ggccguguucaggca

SEQ ID NO: 3558471 - RNA, 15 nt, Pseudomonas putida KT2440
ggccguucccacaaa

SEQ ID NO: 3558472 - RNA, 20 nt, Pseudomonas putida KT2440
ggccguucccacaaaguacg

SEQ ID NO: 3558473 - RNA, 22 nt, Pseudomonas putida KT2440
ggccguugcuuucagcucuucg

SEQ ID NO: 3558474 - RNA, 15 nt, Pseudomonas putida KT2440
ggccguuggccagca

SEQ ID NO: 3558475 - RNA, 16 nt, Pseudomonas putida KT2440
ggccuagcaaggccuc

SEQ ID NO: 3558476 - RNA, 19 nt, Pseudomonas putida KT2440
ggccuagcaaggccuccag

SEQ ID NO: 3558477 - RNA, 13 nt, Pseudomonas putida KT2440
ggccuaugccggg

SEQ ID NO: 3558478 - RNA, 14 nt, Pseudomonas putida KT2440
ggccucaauuccag

SEQ ID NO: 3558479 - RNA, 15 nt, Pseudomonas putida KT2440
ggccucaauuccagu

SEQ ID NO: 3558480 - RNA, 14 nt, Pseudomonas putida KT2440
ggccucagccggcu

SEQ ID NO: 3558481 - RNA, 17 nt, Pseudomonas putida KT2440
ggccuccauacgcuggu

SEQ ID NO: 3558482 - RNA, 11 nt, Pseudomonas putida KT2440
ggccuccucga

SEQ ID NO: 3558483 - RNA, 15 nt, Pseudomonas putida KT2440
ggccuccucgcgggc

SEQ ID NO: 3558484 - RNA, 19 nt, Pseudomonas putida KT2440
ggccucggcgaucgccagg

SEQ ID NO: 3558485 - RNA, 16 nt, Pseudomonas putida KT2440
ggccucgguacccgcc

SEQ ID NO: 3558486 - RNA, 20 nt, Pseudomonas putida KT2440
ggccucgguacccgccagca

SEQ ID NO: 3558487 - RNA, 18 nt, Pseudomonas putida KT2440
ggccucucucagcaaccu

SEQ ID NO: 3558488 - RNA, 14 nt, Pseudomonas putida KT2440
ggccucuucgcggg

SEQ ID NO: 3558489 - RNA, 15 nt, Pseudomonas putida KT2440
ggccucuucgcgggc

SEQ ID NO: 3558490 - RNA, 15 nt, Pseudomonas putida KT2440
ggccucuucgcgggu

SEQ ID NO: 3558491 - RNA, 16 nt, Pseudomonas putida KT2440
ggccucuucucgggca

SEQ ID NO: 3558492 - RNA, 22 nt, Pseudomonas putida KT2440
ggccugaaacccauccacggcg

SEQ ID NO: 3558493 - RNA, 16 nt, Pseudomonas putida KT2440
ggccugaccgcccagc

SEQ ID NO: 3558494 - RNA, 14 nt, Pseudomonas putida KT2440
ggccugaugccuca

SEQ ID NO: 3558495 - RNA, 17 nt, Pseudomonas putida KT2440
ggccugaugccucauca

SEQ ID NO: 3558496 - RNA, 16 nt, Pseudomonas putida KT2440
ggccugauuggcaucg

SEQ ID NO: 3558497 - RNA, 15 nt, Pseudomonas putida KT2440
ggccugcaagccggc

SEQ ID NO: 3558498 - RNA, 20 nt, Pseudomonas putida KT2440
ggccugcaagccggcgaaca

SEQ ID NO: 3558499 - RNA, 15 nt, Pseudomonas putida KT2440
ggccugcacaaacuu

SEQ ID NO: 3558500 - RNA, 20 nt, Pseudomonas putida KT2440
ggccugcaccauuugggcua

SEQ ID NO: 3558501 - RNA, 17 nt, Pseudomonas putida KT2440
ggccugcacgaucgacc

SEQ ID NO: 3558502 - RNA, 18 nt, Pseudomonas putida KT2440
ggccugcacgaucgaccg

SEQ ID NO: 3558503 - RNA, 21 nt, Pseudomonas putida KT2440
ggccugcagagacaucuccau

SEQ ID NO: 3558504 - RNA, 11 nt, Pseudomonas putida KT2440
ggccugcagcc

SEQ ID NO: 3558505 - RNA, 17 nt, Pseudomonas putida KT2440
ggccugcagccguugcu

SEQ ID NO: 3558506 - RNA, 20 nt, Pseudomonas putida KT2440
ggccugcauccacaccagcg

SEQ ID NO: 3558507 - RNA, 23 nt, Pseudomonas putida KT2440
ggccugcauccacaccagcggcg

SEQ ID NO: 3558508 - RNA, 12 nt, Pseudomonas putida KT2440
ggccugcccggu

SEQ ID NO: 3558509 - RNA, 16 nt, Pseudomonas putida KT2440
ggccugcgcuccagca

SEQ ID NO: 3558510 - RNA, 16 nt, Pseudomonas putida KT2440
ggccugcggcagccag

SEQ ID NO: 3558511 - RNA, 12 nt, Pseudomonas putida KT2440
ggccugcggcca

SEQ ID NO: 3558512 - RNA, 13 nt, Pseudomonas putida KT2440
ggccugcuccaca

SEQ ID NO: 3558513 - RNA, 14 nt, Pseudomonas putida KT2440
ggccuggaugcggu

SEQ ID NO: 3558514 - RNA, 14 nt, Pseudomonas putida KT2440
ggccuggccaagcg

SEQ ID NO: 3558515 - RNA, 23 nt, Pseudomonas putida KT2440
ggccuggcccggugcaaggucaa

SEQ ID NO: 3558516 - RNA, 15 nt, Pseudomonas putida KT2440
ggccuggccugcaug

SEQ ID NO: 3558517 - RNA, 22 nt, Pseudomonas putida KT2440
ggccuggcgguaaacgugguca

SEQ ID NO: 3558518 - RNA, 12 nt, Pseudomonas putida KT2440
ggcgcagcaagg

SEQ ID NO: 3558519 - RNA, 18 nt, Pseudomonas putida KT2440
ggcgcagcaaggucgccg

SEQ ID NO: 3558520 - RNA, 19 nt, Pseudomonas putida KT2440
ggcgcagcaaggucgccgc

SEQ ID NO: 3558521 - RNA, 16 nt, Pseudomonas putida KT2440
ggcgcagcagguccag

SEQ ID NO: 3558522 - RNA, 22 nt, Pseudomonas putida KT2440
ggcgcagcaucaucucugccga

SEQ ID NO: 3558523 - RNA, 19 nt, Pseudomonas putida KT2440
ggcgcagccguucuggcca

SEQ ID NO: 3558524 - RNA, 19 nt, Pseudomonas putida KT2440
ggcgcagcgcaugcucgcg

SEQ ID NO: 3558525 - RNA, 13 nt, Pseudomonas putida KT2440
ggcgcaggccgac

SEQ ID NO: 3558526 - RNA, 15 nt, Pseudomonas putida KT2440
ggcgcaggccgacaa

SEQ ID NO: 3558527 - RNA, 16 nt, Pseudomonas putida KT2440
ggcgcaggccgacaac

SEQ ID NO: 3558528 - RNA, 21 nt, Pseudomonas putida KT2440
ggcgcaggccgacaacagcau

SEQ ID NO: 3558529 - RNA, 14 nt, Pseudomonas putida KT2440
ggcgcaggcugucg

SEQ ID NO: 3558530 - RNA, 19 nt, Pseudomonas putida KT2440
ggcgcaggcugucgaacag

SEQ ID NO: 3558531 - RNA, 13 nt, Pseudomonas putida KT2440
ggcgcaggguguc

SEQ ID NO: 3558532 - RNA, 22 nt, Pseudomonas putida KT2440
ggcgcagggugucgguggcggc

SEQ ID NO: 3558533 - RNA, 22 nt, Pseudomonas putida KT2440
ggcgcagugccgugaguggccu

SEQ ID NO: 3558534 - RNA, 17 nt, Pseudomonas putida KT2440
ggcgcaguucguccagg

SEQ ID NO: 3558535 - RNA, 18 nt, Pseudomonas putida KT2440
ggcgcaguucguccaggc

SEQ ID NO: 3558536 - RNA, 20 nt, Pseudomonas putida KT2440
ggcgcauccucggugcgcgg

SEQ ID NO: 3558537 - RNA, 21 nt, Pseudomonas putida KT2440
ggcgcauccucggugcgcggu

SEQ ID NO: 3558538 - RNA, 13 nt, Pseudomonas putida KT2440
ggcgcaucgcgag

SEQ ID NO: 3558539 - RNA, 11 nt, Pseudomonas putida KT2440
ggcgcauggcc

SEQ ID NO: 3558540 - RNA, 23 nt, Pseudomonas putida KT2440
ggcgcauggccuggucgaagguc

SEQ ID NO: 3558541 - RNA, 19 nt, Pseudomonas putida KT2440
ggcgcauugauagcggcag

SEQ ID NO: 3558542 - RNA, 14 nt, Pseudomonas putida KT2440
ggcgccacccagaa

SEQ ID NO: 3558543 - RNA, 17 nt, Pseudomonas putida KT2440
ggcgccacugaggcgua

SEQ ID NO: 3558544 - RNA, 13 nt, Pseudomonas putida KT2440
ggcgccaucgccc

SEQ ID NO: 3558545 - RNA, 18 nt, Pseudomonas putida KT2440
ggcgccaucgcccacggc

SEQ ID NO: 3558546 - RNA, 16 nt, Pseudomonas putida KT2440
ggcgccauuggugccc

SEQ ID NO: 3558547 - RNA, 22 nt, Pseudomonas putida KT2440
ggcgcccggcagaucgagcgcc

SEQ ID NO: 3558548 - RNA, 17 nt, Pseudomonas putida KT2440
ggcgcccgggccaugcu

SEQ ID NO: 3558549 - RNA, 17 nt, Pseudomonas putida KT2440
ggcgccgaccgaaccgg

SEQ ID NO: 3558550 - RNA, 11 nt, Pseudomonas putida KT2440
ggcgccgagcc

SEQ ID NO: 3558551 - RNA, 17 nt, Pseudomonas putida KT2440
ggcgccgagccauagcg

SEQ ID NO: 3558552 - RNA, 16 nt, Pseudomonas putida KT2440
ggcgccgagcgcggcg

SEQ ID NO: 3558553 - RNA, 20 nt, Pseudomonas putida KT2440
ggcgccgaugaagcaggccg

SEQ ID NO: 3558554 - RNA, 16 nt, Pseudomonas putida KT2440
ggcgccgccagcugcu

SEQ ID NO: 3558555 - RNA, 22 nt, Pseudomonas putida KT2440
ggcgccgccagcugcugcccca

SEQ ID NO: 3558556 - RNA, 13 nt, Pseudomonas putida KT2440
ggcgccgccaggc

SEQ ID NO: 3558557 - RNA, 14 nt, Pseudomonas putida KT2440
ggcgccgccaggca

SEQ ID NO: 3558558 - RNA, 18 nt, Pseudomonas putida KT2440
ggcgccgccaggcagcag

SEQ ID NO: 3558559 - RNA, 20 nt, Pseudomonas putida KT2440
ggcgccgccaggcagcagac

SEQ ID NO: 3558560 - RNA, 15 nt, Pseudomonas putida KT2440
ggcgccggacuucuu

SEQ ID NO: 3558561 - RNA, 20 nt, Pseudomonas putida KT2440
ggcgccgguggcggccgcag

SEQ ID NO: 3558562 - RNA, 22 nt, Pseudomonas putida KT2440
ggcgccgguggcggccgcagcc

SEQ ID NO: 3558563 - RNA, 20 nt, Pseudomonas putida KT2440
ggcgccuaucagaucgagcg

SEQ ID NO: 3558564 - RNA, 23 nt, Pseudomonas putida KT2440
ggcgccuaucagaucgagcgccc

SEQ ID NO: 3558565 - RNA, 20 nt, Pseudomonas putida KT2440
ggcgccuauccugugggagc

SEQ ID NO: 3558566 - RNA, 13 nt, Pseudomonas putida KT2440
ggcgccugcggca

SEQ ID NO: 3558567 - RNA, 19 nt, Pseudomonas putida KT2440
ggcgccuugauuaccagcg

SEQ ID NO: 3558568 - RNA, 21 nt, Pseudomonas putida KT2440
ggcgccuugauuaccagcgcc

SEQ ID NO: 3558569 - RNA, 20 nt, Pseudomonas putida KT2440
ggcgcgaaaagccugcacca

SEQ ID NO: 3558570 - RNA, 16 nt, Pseudomonas putida KT2440
ggcgcgaacagggccu

SEQ ID NO: 3558571 - RNA, 17 nt, Pseudomonas putida KT2440
ggcgcgaauuuccgggu

SEQ ID NO: 3558572 - RNA, 17 nt, Pseudomonas putida KT2440
ggcgcgacaaucaggcg

SEQ ID NO: 3558573 - RNA, 13 nt, Pseudomonas putida KT2440
ggcgcgacagcgu

SEQ ID NO: 3558574 - RNA, 22 nt, Pseudomonas putida KT2440
ggcgcgacaugaucagcggggu

SEQ ID NO: 3558575 - RNA, 21 nt, Pseudomonas putida KT2440
ggcgcgaccaucaccgccagc

SEQ ID NO: 3558576 - RNA, 15 nt, Pseudomonas putida KT2440
ggcgcgaucaucgaa

SEQ ID NO: 3558577 - RNA, 20 nt, Pseudomonas putida KT2440
ggcgcgaucccugugggagc

SEQ ID NO: 3558578 - RNA, 14 nt, Pseudomonas putida KT2440
ggcgcgcccgcgaa

SEQ ID NO: 3558579 - RNA, 17 nt, Pseudomonas putida KT2440
ggcgcgcccgcucccac

SEQ ID NO: 3558580 - RNA, 21 nt, Pseudomonas putida KT2440
ggcgcgcccgcucccacaggu

SEQ ID NO: 3558581 - RNA, 20 nt, Pseudomonas putida KT2440
ggcgcgcccugcucauccag

SEQ ID NO: 3558582 - RNA, 22 nt, Pseudomonas putida KT2440
ggcgcgcccugcucauccagca

SEQ ID NO: 3558583 - RNA, 20 nt, Pseudomonas putida KT2440
ggcgcgcgcauccacaggcg

SEQ ID NO: 3558584 - RNA, 16 nt, Pseudomonas putida KT2440
ggcgcgcggcucggcc

SEQ ID NO: 3558585 - RNA, 12 nt, Pseudomonas putida KT2440
ggcgcgcugcug

SEQ ID NO: 3558586 - RNA, 18 nt, Pseudomonas putida KT2440
ggcgcggaauucgcggcg

SEQ ID NO: 3558587 - RNA, 20 nt, Pseudomonas putida KT2440
ggcgcggaauucgcggcggc

SEQ ID NO: 3558588 - RNA, 11 nt, Pseudomonas putida KT2440
ggcgcggcaca

SEQ ID NO: 3558589 - RNA, 18 nt, Pseudomonas putida KT2440
ggcgcggcagcaugaaca

SEQ ID NO: 3558590 - RNA, 18 nt, Pseudomonas putida KT2440
ggcgcggccugcuccaca

SEQ ID NO: 3558591 - RNA, 16 nt, Pseudomonas putida KT2440
ggcgcggcguggccuc

SEQ ID NO: 3558592 - RNA, 18 nt, Pseudomonas putida KT2440
ggcgcgggcacccuggcg

SEQ ID NO: 3558593 - RNA, 16 nt, Pseudomonas putida KT2440
ggcgcgggcgcaggca

SEQ ID NO: 3558594 - RNA, 19 nt, Pseudomonas putida KT2440
ggcgcggguuuacccgcga

SEQ ID NO: 3558595 - RNA, 19 nt, Pseudomonas putida KT2440
ggcgcggguuugcccgcga

SEQ ID NO: 3558596 - RNA, 20 nt, Pseudomonas putida KT2440
ggcgcggguuugcccgcgaa

SEQ ID NO: 3558597 - RNA, 20 nt, Pseudomonas putida KT2440
ggcgcggucaagcucguccu

SEQ ID NO: 3558598 - RNA, 17 nt, Pseudomonas putida KT2440
ggcgcggugaggcaacg

SEQ ID NO: 3558599 - RNA, 19 nt, Pseudomonas putida KT2440
ggcgcggugaggcaacggc

SEQ ID NO: 3558600 - RNA, 15 nt, Pseudomonas putida KT2440
ggcgcggugccggca

SEQ ID NO: 3558601 - RNA, 21 nt, Pseudomonas putida KT2440
ggcgcggugcggcgacagggc

SEQ ID NO: 3558602 - RNA, 20 nt, Pseudomonas putida KT2440
ggcgcguaguacuccagcag

SEQ ID NO: 3558603 - RNA, 22 nt, Pseudomonas putida KT2440
ggcgcguaguacuccagcagcg

SEQ ID NO: 3558604 - RNA, 22 nt, Pseudomonas putida KT2440
ggcgcgucccccgguaccagca

SEQ ID NO: 3558605 - RNA, 20 nt, Pseudomonas putida KT2440
ggcgcgugccgcaugugcca

SEQ ID NO: 3558606 - RNA, 23 nt, Pseudomonas putida KT2440
ggcgcgugccgcaugugccaggu

SEQ ID NO: 3558607 - RNA, 16 nt, Pseudomonas putida KT2440
ggcgcguguagcccgc

SEQ ID NO: 3558608 - RNA, 20 nt, Pseudomonas putida KT2440
ggcgcguguagcccgcugaa

SEQ ID NO: 3558609 - RNA, 23 nt, Pseudomonas putida KT2440
ggcgcguguagcccgcugaaggu

SEQ ID NO: 3558610 - RNA, 13 nt, Pseudomonas putida KT2440
ggcgcuaccccug

SEQ ID NO: 3558611 - RNA, 14 nt, Pseudomonas putida KT2440
ggcgcucaagguca

SEQ ID NO: 3558612 - RNA, 13 nt, Pseudomonas putida KT2440
ggcgcuccagcac

SEQ ID NO: 3558613 - RNA, 16 nt, Pseudomonas putida KT2440
ggcgcuccuccagcca

SEQ ID NO: 3558614 - RNA, 13 nt, Pseudomonas putida KT2440
ggcgcucgcucca

SEQ ID NO: 3558615 - RNA, 14 nt, Pseudomonas putida KT2440
ggcgcucgggggug

SEQ ID NO: 3558616 - RNA, 13 nt, Pseudomonas putida KT2440
ggcgcugaagcca

SEQ ID NO: 3558617 - RNA, 14 nt, Pseudomonas putida KT2440
ggcgcugagcgaca

SEQ ID NO: 3558618 - RNA, 18 nt, Pseudomonas putida KT2440
ggcgcugaucaagcccgc

SEQ ID NO: 3558619 - RNA, 19 nt, Pseudomonas putida KT2440
ggcgcugaucaagcccgcu

SEQ ID NO: 3558620 - RNA, 20 nt, Pseudomonas putida KT2440
ggcgcugaucaagcccgcuc

SEQ ID NO: 3558621 - RNA, 17 nt, Pseudomonas putida KT2440
ggcgcugaucagcuggu

SEQ ID NO: 3558622 - RNA, 19 nt, Pseudomonas putida KT2440
ggcgcugaucaucgacagg

SEQ ID NO: 3558623 - RNA, 12 nt, Pseudomonas putida KT2440
ggcgucuuccac

SEQ ID NO: 3558624 - RNA, 23 nt, Pseudomonas putida KT2440
ggcgucuuccacgcccaggcgcu

SEQ ID NO: 3558625 - RNA, 14 nt, Pseudomonas putida KT2440
ggcgucuucgccag

SEQ ID NO: 3558626 - RNA, 22 nt, Pseudomonas putida KT2440
ggcgugacggauacaucgcaua

SEQ ID NO: 3558627 - RNA, 22 nt, Pseudomonas putida KT2440
ggcgugcacgcuugagcgcgcc

SEQ ID NO: 3558628 - RNA, 20 nt, Pseudomonas putida KT2440
ggcgugcccgcgaagagggc

SEQ ID NO: 3558629 - RNA, 13 nt, Pseudomonas putida KT2440
ggcgugccgucca

SEQ ID NO: 3558630 - RNA, 14 nt, Pseudomonas putida KT2440
ggcgugcgcccggc

SEQ ID NO: 3558631 - RNA, 22 nt, Pseudomonas putida KT2440
ggcgugcgcugcauggcggcac

SEQ ID NO: 3558632 - RNA, 17 nt, Pseudomonas putida KT2440
ggcgugcucggcaugca

SEQ ID NO: 3558633 - RNA, 20 nt, Pseudomonas putida KT2440
ggcguggcugcguucaggca

SEQ ID NO: 3558634 - RNA, 19 nt, Pseudomonas putida KT2440
ggcguguuagccguggggc

SEQ ID NO: 3558635 - RNA, 22 nt, Pseudomonas putida KT2440
ggcguuaccccguugcgcagca

SEQ ID NO: 3558636 - RNA, 22 nt, Pseudomonas putida KT2440
ggcguucagcuugucgaccagg

SEQ ID NO: 3558637 - RNA, 23 nt, Pseudomonas putida KT2440
ggcguucagcuugucgaccagga

SEQ ID NO: 3558638 - RNA, 16 nt, Pseudomonas putida KT2440
ggcguucaucgaaggc

SEQ ID NO: 3558639 - RNA, 17 nt, Pseudomonas putida KT2440
ggcguucaucgaaggcc

SEQ ID NO: 3558640 - RNA, 17 nt, Pseudomonas putida KT2440
ggcguugauccggcacu

SEQ ID NO: 3558641 - RNA, 15 nt, Pseudomonas putida KT2440
ggcguugcgaaggcg

SEQ ID NO: 3558642 - RNA, 14 nt, Pseudomonas putida KT2440
ggcguuggcaguga

SEQ ID NO: 3558643 - RNA, 21 nt, Pseudomonas putida KT2440
ggcguuggccaaaccguccag

SEQ ID NO: 3558644 - RNA, 13 nt, Pseudomonas putida KT2440
ggcguugggcacg

SEQ ID NO: 3558645 - RNA, 16 nt, Pseudomonas putida KT2440
ggcguugggcacgaag

SEQ ID NO: 3558646 - RNA, 14 nt, Pseudomonas putida KT2440
ggcguugucagccu

SEQ ID NO: 3558647 - RNA, 15 nt, Pseudomonas putida KT2440
ggcguuguccagcag

SEQ ID NO: 3558648 - RNA, 18 nt, Pseudomonas putida KT2440
ggcguuguguugcugggc

SEQ ID NO: 3558649 - RNA, 19 nt, Pseudomonas putida KT2440
ggcguuguguugcugggcg

SEQ ID NO: 3558650 - RNA, 22 nt, Pseudomonas putida KT2440
ggcguuuucguuuacacgguau

SEQ ID NO: 3558651 - RNA, 22 nt, Pseudomonas putida KT2440
ggcguuuuuugugccuggcgcu

SEQ ID NO: 3558652 - RNA, 22 nt, Pseudomonas putida KT2440
ggcuaaaaauugcuuggcggcu

SEQ ID NO: 3558653 - RNA, 16 nt, Pseudomonas putida KT2440
ggcuacagaucagcca

SEQ ID NO: 3558654 - RNA, 17 nt, Pseudomonas putida KT2440
ggcuacauccaggcugu

SEQ ID NO: 3558655 - RNA, 20 nt, Pseudomonas putida KT2440
ggcuaccccgaugcgcugau

SEQ ID NO: 3558656 - RNA, 14 nt, Pseudomonas putida KT2440
ggcuaccgcugcgc

SEQ ID NO: 3558657 - RNA, 23 nt, Pseudomonas putida KT2440
ggcuaccgcugcgcaccaaggcg

SEQ ID NO: 3558658 - RNA, 19 nt, Pseudomonas putida KT2440
ggcuacgaaccgagcgguc

SEQ ID NO: 3558659 - RNA, 14 nt, Pseudomonas putida KT2440
ggcuagaugcuggu

SEQ ID NO: 3558660 - RNA, 16 nt, Pseudomonas putida KT2440
ggcuagccacggcggu

SEQ ID NO: 3558661 - RNA, 22 nt, Pseudomonas putida KT2440
ggcuauagcucagcugggagag

SEQ ID NO: 3558662 - RNA, 13 nt, Pseudomonas putida KT2440
ggcuauccuucug

SEQ ID NO: 3558663 - RNA, 18 nt, Pseudomonas putida KT2440
ggcuaucucaggccaguu

SEQ ID NO: 3558664 - RNA, 16 nt, Pseudomonas putida KT2440
ggcuauucuccuugga

SEQ ID NO: 3558665 - RNA, 23 nt, Pseudomonas putida KT2440
ggcucaacaccagacucagcgcu

SEQ ID NO: 3558666 - RNA, 18 nt, Pseudomonas putida KT2440
ggcucaacagcaggugca

SEQ ID NO: 3558667 - RNA, 15 nt, Pseudomonas putida KT2440
ggcucaacagccacg

SEQ ID NO: 3558668 - RNA, 13 nt, Pseudomonas putida KT2440
ggcucaacuggca

SEQ ID NO: 3558669 - RNA, 18 nt, Pseudomonas putida KT2440
ggcucaauagcggcgguc

SEQ ID NO: 3558670 - RNA, 13 nt, Pseudomonas putida KT2440
ggcucacacccag

SEQ ID NO: 3558671 - RNA, 18 nt, Pseudomonas putida KT2440
ggcucacagcccgggcau

SEQ ID NO: 3558672 - RNA, 19 nt, Pseudomonas putida KT2440
ggcucacaucaucgcccuc

SEQ ID NO: 3558673 - RNA, 19 nt, Pseudomonas putida KT2440
ggcucaccgcagcccagcg

SEQ ID NO: 3558674 - RNA, 16 nt, Pseudomonas putida KT2440
ggcucacugaccaggu

SEQ ID NO: 3558675 - RNA, 14 nt, Pseudomonas putida KT2440
ggcucagcucggca

SEQ ID NO: 3558676 - RNA, 15 nt, Pseudomonas putida KT2440
ggcucagcucggcau

SEQ ID NO: 3558677 - RNA, 14 nt, Pseudomonas putida KT2440
ggcucagcucgucg

SEQ ID NO: 3558678 - RNA, 17 nt, Pseudomonas putida KT2440
ggcucagggcagcaacg

SEQ ID NO: 3558679 - RNA, 20 nt, Pseudomonas putida KT2440
ggcucagucgcaucgacagg

SEQ ID NO: 3558680 - RNA, 14 nt, Pseudomonas putida KT2440
ggcucaguggcugc

SEQ ID NO: 3558681 - RNA, 24 nt, Pseudomonas putida KT2440
ggcucaguugcaagucucgcgccu

SEQ ID NO: 3558682 - RNA, 23 nt, Pseudomonas putida KT2440
ggcucaucagcaacccggccagg

SEQ ID NO: 3558683 - RNA, 16 nt, Pseudomonas putida KT2440
ggcucaucaggcgauu

SEQ ID NO: 3558684 - RNA, 14 nt, Pseudomonas putida KT2440
ggcucaucugccgg

SEQ ID NO: 3558685 - RNA, 15 nt, Pseudomonas putida KT2440
ggcucaucugccggc

SEQ ID NO: 3558686 - RNA, 17 nt, Pseudomonas putida KT2440
ggcucaucugccggcga

SEQ ID NO: 3558687 - RNA, 14 nt, Pseudomonas putida KT2440
ggcucaugcgccag

SEQ ID NO: 3558688 - RNA, 21 nt, Pseudomonas putida KT2440
ggcuccaccacagcugcgcca

SEQ ID NO: 3558689 - RNA, 21 nt, Pseudomonas putida KT2440
ggcuccaccgaaaucagcaac

SEQ ID NO: 3558690 - RNA, 19 nt, Pseudomonas putida KT2440
ggcuccaccugcuccagca

SEQ ID NO: 3558691 - RNA, 21 nt, Pseudomonas putida KT2440
ggcuccaccugcuccagcacc

SEQ ID NO: 3558692 - RNA, 21 nt, Pseudomonas putida KT2440
ggcuccaggcacaggcgcaca

SEQ ID NO: 3558693 - RNA, 22 nt, Pseudomonas putida KT2440
ggcuccaggcacaggcgcacac

SEQ ID NO: 3558694 - RNA, 15 nt, Pseudomonas putida KT2440
ggcuccaucuccagc

SEQ ID NO: 3558695 - RNA, 22 nt, Pseudomonas putida KT2440
ggcucccggcuacgcacccgca

SEQ ID NO: 3558696 - RNA, 16 nt, Pseudomonas putida KT2440
ggcuccgcgcaagcgg

SEQ ID NO: 3558697 - RNA, 23 nt, Pseudomonas putida KT2440
ggcuccuucucgaacagcuggcg

SEQ ID NO: 3558698 - RNA, 18 nt, Pseudomonas putida KT2440
ggcucgaaucaagccugc

SEQ ID NO: 3558699 - RNA, 22 nt, Pseudomonas putida KT2440
ggcucgacacgcuugcgaagga

SEQ ID NO: 3558700 - RNA, 18 nt, Pseudomonas putida KT2440
ggcucgacgcggacccgg

SEQ ID NO: 3558701 - RNA, 12 nt, Pseudomonas putida KT2440
ggcucgcagcca

SEQ ID NO: 3558702 - RNA, 18 nt, Pseudomonas putida KT2440
ggcucgcagccaaugcug

SEQ ID NO: 3558703 - RNA, 20 nt, Pseudomonas putida KT2440
ggcucgcaugagccggggcu

SEQ ID NO: 3558704 - RNA, 18 nt, Pseudomonas putida KT2440
ggcucgcccgggucaggu

SEQ ID NO: 3558705 - RNA, 19 nt, Pseudomonas putida KT2440
ggcucgcccucgcggcggc

SEQ ID NO: 3558706 - RNA, 15 nt, Pseudomonas putida KT2440
ggcucgcgauccauc

SEQ ID NO: 3558707 - RNA, 22 nt, Pseudomonas putida KT2440
ggcucgcgcucuucaucgcggu

SEQ ID NO: 3558708 - RNA, 22 nt, Pseudomonas putida KT2440
ggcucgcugaacacgcaggucu

SEQ ID NO: 3558709 - RNA, 16 nt, Pseudomonas putida KT2440
ggcucgcugccccagu

SEQ ID NO: 3558710 - RNA, 17 nt, Pseudomonas putida KT2440
ggcucggugugcaccug

SEQ ID NO: 3558711 - RNA, 18 nt, Pseudomonas putida KT2440
ggcucgucacugccguca

SEQ ID NO: 3558712 - RNA, 13 nt, Pseudomonas putida KT2440
ggcucucagccca

SEQ ID NO: 3558713 - RNA, 19 nt, Pseudomonas putida KT2440
ggcucucagcccauuucac

SEQ ID NO: 3558714 - RNA, 12 nt, Pseudomonas putida KT2440
ggcucugcagcg

SEQ ID NO: 3558715 - RNA, 18 nt, Pseudomonas putida KT2440
ggcucugccgguguucgc

SEQ ID NO: 3558716 - RNA, 17 nt, Pseudomonas putida KT2440
ggcucugcuugagcgca

SEQ ID NO: 3558717 - RNA, 20 nt, Pseudomonas putida KT2440
ggcucugcuugagcgcagcg

SEQ ID NO: 3558718 - RNA, 22 nt, Pseudomonas putida KT2440
ggcucugggcaaaaucgaccag

SEQ ID NO: 3558719 - RNA, 17 nt, Pseudomonas putida KT2440
ggcucuguuccauuuca

SEQ ID NO: 3558720 - RNA, 15 nt, Pseudomonas putida KT2440
ggcucuucuuucagg

SEQ ID NO: 3558721 - RNA, 18 nt, Pseudomonas putida KT2440
ggcucuugaacugggcau

SEQ ID NO: 3558722 - RNA, 20 nt, Pseudomonas putida KT2440
ggcucuugaacugggcaucc

SEQ ID NO: 3558723 - RNA, 19 nt, Pseudomonas putida KT2440
ggcucuugaggucggcgcg

SEQ ID NO: 3558724 - RNA, 21 nt, Pseudomonas putida KT2440
ggcugaaaccgcgaaucgcuc

SEQ ID NO: 3558725 - RNA, 17 nt, Pseudomonas putida KT2440
ggcugaaaucuuugcuu

SEQ ID NO: 3558726 - RNA, 18 nt, Pseudomonas putida KT2440
ggcugaaaucuuugcuuc

SEQ ID NO: 3558727 - RNA, 21 nt, Pseudomonas putida KT2440
ggcugaaauggcggcccagcc

SEQ ID NO: 3558728 - RNA, 19 nt, Pseudomonas putida KT2440
ggcuguuccucgccauggc

SEQ ID NO: 3558729 - RNA, 17 nt, Pseudomonas putida KT2440
ggcuguucgucggccuu

SEQ ID NO: 3558730 - RNA, 21 nt, Pseudomonas putida KT2440
ggcuguugcgguugccaagca

SEQ ID NO: 3558731 - RNA, 13 nt, Pseudomonas putida KT2440
ggcuguuggcggu

SEQ ID NO: 3558732 - RNA, 18 nt, Pseudomonas putida KT2440
ggcuguuguacggcagcu

SEQ ID NO: 3558733 - RNA, 18 nt, Pseudomonas putida KT2440
ggcuguuucagcccuugc

SEQ ID NO: 3558734 - RNA, 13 nt, Pseudomonas putida KT2440
ggcuucaaggucg

SEQ ID NO: 3558735 - RNA, 22 nt, Pseudomonas putida KT2440
ggcuucaaguuuggcuuugccc

SEQ ID NO: 3558736 - RNA, 24 nt, Pseudomonas putida KT2440
ggcuucagaagccuuggccuuggc

SEQ ID NO: 3558737 - RNA, 19 nt, Pseudomonas putida KT2440
ggcuucagguucacuucca

SEQ ID NO: 3558738 - RNA, 13 nt, Pseudomonas putida KT2440
ggcuuccagcgau

SEQ ID NO: 3558739 - RNA, 14 nt, Pseudomonas putida KT2440
ggcuuccagcgaug

SEQ ID NO: 3558740 - RNA, 20 nt, Pseudomonas putida KT2440
ggcuuccagcgauggcggau

SEQ ID NO: 3558741 - RNA, 16 nt, Pseudomonas putida KT2440
ggcuuccagcuuggaa

SEQ ID NO: 3558742 - RNA, 12 nt, Pseudomonas putida KT2440
ggcuuccagucg

SEQ ID NO: 3558743 - RNA, 16 nt, Pseudomonas putida KT2440
ggcuuccagucggccu

SEQ ID NO: 3558744 - RNA, 17 nt, Pseudomonas putida KT2440
ggcuuccccagccuuca

SEQ ID NO: 3558745 - RNA, 23 nt, Pseudomonas putida KT2440
ggcuucccgguaacgggccagcc

SEQ ID NO: 3558746 - RNA, 13 nt, Pseudomonas putida KT2440
ggcuuccggcgcu

SEQ ID NO: 3558747 - RNA, 11 nt, Pseudomonas putida KT2440
ggcuuccucuu

SEQ ID NO: 3558748 - RNA, 18 nt, Pseudomonas putida KT2440
ggcuucgaugaaggcugc

SEQ ID NO: 3558749 - RNA, 16 nt, Pseudomonas putida KT2440
ggcuucgaugcccggc

SEQ ID NO: 3558750 - RNA, 21 nt, Pseudomonas putida KT2440
ggcuucgcccguguucgcggg

SEQ ID NO: 3558751 - RNA, 23 nt, Pseudomonas putida KT2440
ggcuucguccguguucgcgagga

SEQ ID NO: 3558752 - RNA, 14 nt, Pseudomonas putida KT2440
ggcuucuaccacug

SEQ ID NO: 3558753 - RNA, 15 nt, Pseudomonas putida KT2440
ggcuucuaccacugg

SEQ ID NO: 3558754 - RNA, 16 nt, Pseudomonas putida KT2440
ggcuucuucgcgggca

SEQ ID NO: 3558755 - RNA, 14 nt, Pseudomonas putida KT2440
ggcuucuucgugcg

SEQ ID NO: 3558756 - RNA, 22 nt, Pseudomonas putida KT2440
ggcuucuucgugcgccucaugc

SEQ ID NO: 3558757 - RNA, 20 nt, Pseudomonas putida KT2440
ggcuucuugacgggugacca

SEQ ID NO: 3558758 - RNA, 19 nt, Pseudomonas putida KT2440
ggcuucuuugcaagccuug

SEQ ID NO: 3558759 - RNA, 17 nt, Pseudomonas putida KT2440
ggcuugcccgcgaagca

SEQ ID NO: 3558760 - RNA, 21 nt, Pseudomonas putida KT2440
ggcuugcgacuugugcauccu

SEQ ID NO: 3558761 - RNA, 16 nt, Pseudomonas putida KT2440
ggcuugcgcugaagga

SEQ ID NO: 3558762 - RNA, 17 nt, Pseudomonas putida KT2440
ggcuugcucaagguguc

SEQ ID NO: 3558763 - RNA, 15 nt, Pseudomonas putida KT2440
ggcuuggcacgcugg

SEQ ID NO: 3558764 - RNA, 16 nt, Pseudomonas putida KT2440
ggcuuggcacgcuggc

SEQ ID NO: 3558765 - RNA, 17 nt, Pseudomonas putida KT2440
ggcuuggcacgcuggcu

SEQ ID NO: 3558766 - RNA, 18 nt, Pseudomonas putida KT2440
ggcuuggcuucggcggcu

SEQ ID NO: 3558767 - RNA, 14 nt, Pseudomonas putida KT2440
ggcuuggugcucau

SEQ ID NO: 3558768 - RNA, 22 nt, Pseudomonas putida KT2440
ggcuuguccuuguugaccccgg

SEQ ID NO: 3558769 - RNA, 14 nt, Pseudomonas putida KT2440
ggcuugugcaucag

SEQ ID NO: 3558770 - RNA, 15 nt, Pseudomonas putida KT2440
ggcuuguucagcugg

SEQ ID NO: 3558771 - RNA, 22 nt, Pseudomonas putida KT2440
ggcuuguucagcuggugggcga

SEQ ID NO: 3558772 - RNA, 14 nt, Pseudomonas putida KT2440
ggcuuguucggcau

SEQ ID NO: 3558773 - RNA, 14 nt, Pseudomonas putida KT2440
ggcuuucggccacc

SEQ ID NO: 3558774 - RNA, 19 nt, Pseudomonas putida KT2440
ggcuuucggcgcacccggc

SEQ ID NO: 3558775 - RNA, 19 nt, Pseudomonas putida KT2440
ggcuuuucguuggccagcu

SEQ ID NO: 3558776 - RNA, 21 nt, Pseudomonas putida KT2440
ggcuuuuuuauugccuuugaa

SEQ ID NO: 3558777 - RNA, 17 nt, Pseudomonas putida KT2440
ggcuuuuuugugccuca

SEQ ID NO: 3558778 - RNA, 13 nt, Pseudomonas putida KT2440
ggcuuuuuuugcc

SEQ ID NO: 3558779 - RNA, 15 nt, Pseudomonas putida KT2440
gggaaaccuccggca

SEQ ID NO: 3558780 - RNA, 11 nt, Pseudomonas putida KT2440
gggaacagcag

SEQ ID NO: 3558781 - RNA, 12 nt, Pseudomonas putida KT2440
gggaacagcagc

SEQ ID NO: 3558782 - RNA, 17 nt, Pseudomonas putida KT2440
gggaacagcucuggcag

SEQ ID NO: 3558783 - RNA, 14 nt, Pseudomonas putida KT2440
gggaacagggcaga

SEQ ID NO: 3558784 - RNA, 16 nt, Pseudomonas putida KT2440
gggaagaugcacacca

SEQ ID NO: 3558785 - RNA, 22 nt, Pseudomonas putida KT2440
gggaagcgcccgcccaccacca

SEQ ID NO: 3558786 - RNA, 16 nt, Pseudomonas putida KT2440
gggaaguccgccagga

SEQ ID NO: 3558787 - RNA, 24 nt, Pseudomonas putida KT2440
gggaagugcacugccuggcucagg

SEQ ID NO: 3558788 - RNA, 23 nt, Pseudomonas putida KT2440
gggaauggcccagccagcguggg

SEQ ID NO: 3558789 - RNA, 18 nt, Pseudomonas putida KT2440
gggaauugcagcccgcag

SEQ ID NO: 3558790 - RNA, 15 nt, Pseudomonas putida KT2440
gggacagccacaugc

SEQ ID NO: 3558791 - RNA, 18 nt, Pseudomonas putida KT2440
gggacagccacaugccag

SEQ ID NO: 3558792 - RNA, 19 nt, Pseudomonas putida KT2440
gggacagccacaugccagc

SEQ ID NO: 3558793 - RNA, 20 nt, Pseudomonas putida KT2440
gggagacccguuccuacgca

SEQ ID NO: 3558794 - RNA, 12 nt, Pseudomonas putida KT2440
gggagcaguggu

SEQ ID NO: 3558795 - RNA, 20 nt, Pseudomonas putida KT2440
gggagcgggcgcgcccgcga

SEQ ID NO: 3558796 - RNA, 20 nt, Pseudomonas putida KT2440
gggagcgggcgugcccgcga

SEQ ID NO: 3558797 - RNA, 16 nt, Pseudomonas putida KT2440
gggaggauucggucac

SEQ ID NO: 3558798 - RNA, 17 nt, Pseudomonas putida KT2440
gggaggccgucaggccu

SEQ ID NO: 3558799 - RNA, 23 nt, Pseudomonas putida KT2440
gggaguaacggcccuugcucaau

SEQ ID NO: 3558800 - RNA, 19 nt, Pseudomonas putida KT2440
gggagucgaaccugcccgg

SEQ ID NO: 3558801 - RNA, 22 nt, Pseudomonas putida KT2440
gggagucgaaccugcccgggaa

SEQ ID NO: 3558802 - RNA, 20 nt, Pseudomonas putida KT2440
gggauaccggugucuuccgg

SEQ ID NO: 3558803 - RNA, 18 nt, Pseudomonas putida KT2440
gggauacugcgcacgaau

SEQ ID NO: 3558804 - RNA, 16 nt, Pseudomonas putida KT2440
gggauagagccgccuu

SEQ ID NO: 3558805 - RNA, 15 nt, Pseudomonas putida KT2440
gggauaucaggcccu

SEQ ID NO: 3558806 - RNA, 19 nt, Pseudomonas putida KT2440
gggaucaccgcaagcugca

SEQ ID NO: 3558807 - RNA, 21 nt, Pseudomonas putida KT2440
gggaucaccucguaaggccug

SEQ ID NO: 3558808 - RNA, 17 nt, Pseudomonas putida KT2440
gggaucagcacgcccau

SEQ ID NO: 3558809 - RNA, 18 nt, Pseudomonas putida KT2440
gggaucgagaucaggugg

SEQ ID NO: 3558810 - RNA, 18 nt, Pseudomonas putida KT2440
gggaucgcgcaagccuuu

SEQ ID NO: 3558811 - RNA, 20 nt, Pseudomonas putida KT2440
gggaucgcgcaagccuuugc

SEQ ID NO: 3558812 - RNA, 16 nt, Pseudomonas putida KT2440
gggaucuggccgaugc

SEQ ID NO: 3558813 - RNA, 18 nt, Pseudomonas putida KT2440
gggaugcagucgaccggg

SEQ ID NO: 3558814 - RNA, 14 nt, Pseudomonas putida KT2440
gggauggcaccggc

SEQ ID NO: 3558815 - RNA, 20 nt, Pseudomonas putida KT2440
gggauggcaccggcucugcc

SEQ ID NO: 3558816 - RNA, 14 nt, Pseudomonas putida KT2440
gggauggcggcgcc

SEQ ID NO: 3558817 - RNA, 16 nt, Pseudomonas putida KT2440
gggauuguucccacag

SEQ ID NO: 3558818 - RNA, 19 nt, Pseudomonas putida KT2440
gggauuucggcggcgaugc

SEQ ID NO: 3558819 - RNA, 14 nt, Pseudomonas putida KT2440
gggauuuggggcgc

SEQ ID NO: 3558820 - RNA, 20 nt, Pseudomonas putida KT2440
gggauuuggggcgcccggca

SEQ ID NO: 3558821 - RNA, 21 nt, Pseudomonas putida KT2440
gggcaaaaugcagcaagcugg

SEQ ID NO: 3558822 - RNA, 13 nt, Pseudomonas putida KT2440
gggcaaacccgcg

SEQ ID NO: 3558823 - RNA, 13 nt, Pseudomonas putida KT2440
gggcaaacuggcg

SEQ ID NO: 3558824 - RNA, 15 nt, Pseudomonas putida KT2440
gggcaaacuggcgcc

SEQ ID NO: 3558825 - RNA, 19 nt, Pseudomonas putida KT2440
gggcaaagaacagcgcgga

SEQ ID NO: 3558826 - RNA, 17 nt, Pseudomonas putida KT2440
gggcaaagcccauuucg

SEQ ID NO: 3558827 - RNA, 18 nt, Pseudomonas putida KT2440
gggcaacagcugcgcgaa

SEQ ID NO: 3558828 - RNA, 12 nt, Pseudomonas putida KT2440
gggcaaccuggg

SEQ ID NO: 3558829 - RNA, 20 nt, Pseudomonas putida KT2440
gggcaagcccgcacccacag

SEQ ID NO: 3558830 - RNA, 16 nt, Pseudomonas putida KT2440
gggcaagcccgcgaag

SEQ ID NO: 3558831 - RNA, 14 nt, Pseudomonas putida KT2440
gggcaagcccgcuc

SEQ ID NO: 3558832 - RNA, 17 nt, Pseudomonas putida KT2440
gggcaagugcgugcaag

SEQ ID NO: 3558833 - RNA, 17 nt, Pseudomonas putida KT2440
gggcgcuuugcaccccu

SEQ ID NO: 3558834 - RNA, 20 nt, Pseudomonas putida KT2440
gggcggaucugagcagcaga

SEQ ID NO: 3558835 - RNA, 22 nt, Pseudomonas putida KT2440
gggcggaucugagcagcagaga

SEQ ID NO: 3558836 - RNA, 19 nt, Pseudomonas putida KT2440
gggcggccucgugucgcga

SEQ ID NO: 3558837 - RNA, 14 nt, Pseudomonas putida KT2440
gggcggcgcccagu

SEQ ID NO: 3558838 - RNA, 13 nt, Pseudomonas putida KT2440
gggcggcgcuuga

SEQ ID NO: 3558839 - RNA, 21 nt, Pseudomonas putida KT2440
gggcggcgugaccagcccggc

SEQ ID NO: 3558840 - RNA, 14 nt, Pseudomonas putida KT2440
gggcguaaagcgcc

SEQ ID NO: 3558841 - RNA, 15 nt, Pseudomonas putida KT2440
gggcguauucgccca

SEQ ID NO: 3558842 - RNA, 18 nt, Pseudomonas putida KT2440
gggcgucggucgccccca

SEQ ID NO: 3558843 - RNA, 14 nt, Pseudomonas putida KT2440
gggcgugacggcga

SEQ ID NO: 3558844 - RNA, 14 nt, Pseudomonas putida KT2440
gggcgugccaggcu

SEQ ID NO: 3558845 - RNA, 15 nt, Pseudomonas putida KT2440
gggcgugccugcgaa

SEQ ID NO: 3558846 - RNA, 21 nt, Pseudomonas putida KT2440
gggcgugcguuugcgaaccuc

SEQ ID NO: 3558847 - RNA, 13 nt, Pseudomonas putida KT2440
gggcgugcucggc

SEQ ID NO: 3558848 - RNA, 12 nt, Pseudomonas putida KT2440
gggcguucagca

SEQ ID NO: 3558849 - RNA, 17 nt, Pseudomonas putida KT2440
gggcguuccagccaggc

SEQ ID NO: 3558850 - RNA, 23 nt, Pseudomonas putida KT2440
gggcguugaucuguugcugcagg

SEQ ID NO: 3558851 - RNA, 20 nt, Pseudomonas putida KT2440
gggcguuguguugcugggcg

SEQ ID NO: 3558852 - RNA, 16 nt, Pseudomonas putida KT2440
gggcuacacgcgcccu

SEQ ID NO: 3558853 - RNA, 19 nt, Pseudomonas putida KT2440
gggcuacaugaaccacaca

SEQ ID NO: 3558854 - RNA, 20 nt, Pseudomonas putida KT2440
gggcuacaugaaccacacac

SEQ ID NO: 3558855 - RNA, 23 nt, Pseudomonas putida KT2440
gggcuacgaucaaaugaucgcca

SEQ ID NO: 3558856 - RNA, 14 nt, Pseudomonas putida KT2440
gggcuagaugcugg

SEQ ID NO: 3558857 - RNA, 18 nt, Pseudomonas putida KT2440
gggcucaacgccagggca

SEQ ID NO: 3558858 - RNA, 12 nt, Pseudomonas putida KT2440
gggcucagccgc

SEQ ID NO: 3558859 - RNA, 17 nt, Pseudomonas putida KT2440
gggcucgcccacacggc

SEQ ID NO: 3558860 - RNA, 20 nt, Pseudomonas putida KT2440
gggcucgcccacucccacag

SEQ ID NO: 3558861 - RNA, 22 nt, Pseudomonas putida KT2440
gggcugacgcgccgugccaggu

SEQ ID NO: 3558862 - RNA, 19 nt, Pseudomonas putida KT2440
gggcugauugagcagcugg

SEQ ID NO: 3558863 - RNA, 19 nt, Pseudomonas putida KT2440
gggcugcaaagcagccccc

SEQ ID NO: 3558864 - RNA, 20 nt, Pseudomonas putida KT2440
gggcugcaaagcagccccca

SEQ ID NO: 3558865 - RNA, 21 nt, Pseudomonas putida KT2440
gggcugcaaagcagccccggc

SEQ ID NO: 3558866 - RNA, 19 nt, Pseudomonas putida KT2440
gggcugcaaagcgggcaac

SEQ ID NO: 3558867 - RNA, 20 nt, Pseudomonas putida KT2440
gggcugcaaagcgggcaacu

SEQ ID NO: 3558868 - RNA, 20 nt, Pseudomonas putida KT2440
gggcugcaagguguugguca

SEQ ID NO: 3558869 - RNA, 20 nt, Pseudomonas putida KT2440
gggcugcaccgcagccccag

SEQ ID NO: 3558870 - RNA, 19 nt, Pseudomonas putida KT2440
gggcugcccggugccgcgc

SEQ ID NO: 3558871 - RNA, 21 nt, Pseudomonas putida KT2440
gggcugcccggugccgcgcca

SEQ ID NO: 3558872 - RNA, 18 nt, Pseudomonas putida KT2440
gggcugccgcgcagccca

SEQ ID NO: 3558873 - RNA, 22 nt, Pseudomonas putida KT2440
gggcugccuugcagccccugca

SEQ ID NO: 3558874 - RNA, 19 nt, Pseudomonas putida KT2440
gggcugccuugcagcccuu

SEQ ID NO: 3558875 - RNA, 22 nt, Pseudomonas putida KT2440
gggcugcgauagaacuccacca

SEQ ID NO: 3558876 - RNA, 18 nt, Pseudomonas putida KT2440
gggcugcgcggcagcccu

SEQ ID NO: 3558877 - RNA, 19 nt, Pseudomonas putida KT2440
gggcugcgcggcagcccuu

SEQ ID NO: 3558878 - RNA, 18 nt, Pseudomonas putida KT2440
gggcugcugcgcagccca

SEQ ID NO: 3558879 - RNA, 20 nt, Pseudomonas putida KT2440
gggcugcugcgcagcccauu

SEQ ID NO: 3558880 - RNA, 18 nt, Pseudomonas putida KT2440
gggcugcuuugcagccca

SEQ ID NO: 3558881 - RNA, 20 nt, Pseudomonas putida KT2440
gggcugcuuugcagcccauu

SEQ ID NO: 3558882 - RNA, 23 nt, Pseudomonas putida KT2440
gggcuggcauaguccaggaagca

SEQ ID NO: 3558883 - RNA, 23 nt, Pseudomonas putida KT2440
gggcuggcauucaacgcccgccg

SEQ ID NO: 3558884 - RNA, 14 nt, Pseudomonas putida KT2440
gggcugucgagcag

SEQ ID NO: 3558885 - RNA, 20 nt, Pseudomonas putida KT2440
gggcuugauccgcgcuaccu

SEQ ID NO: 3558886 - RNA, 13 nt, Pseudomonas putida KT2440
gggcuugcccgcg

SEQ ID NO: 3558887 - RNA, 22 nt, Pseudomonas putida KT2440
gggcuugggaaugugucagggc

SEQ ID NO: 3558888 - RNA, 18 nt, Pseudomonas putida KT2440
gggcuuggugaugggcgu

SEQ ID NO: 3558889 - RNA, 21 nt, Pseudomonas putida KT2440
gggcuuuaucgaugaucucga

SEQ ID NO: 3558890 - RNA, 19 nt, Pseudomonas putida KT2440
gggcuuuuacuugagucug

SEQ ID NO: 3558891 - RNA, 15 nt, Pseudomonas putida KT2440
gggcuuuuuccagcg

SEQ ID NO: 3558892 - RNA, 16 nt, Pseudomonas putida KT2440
gggcuuuuucguuugc

SEQ ID NO: 3558893 - RNA, 22 nt, Pseudomonas putida KT2440
gggcuuuuuuuguuggccugga

SEQ ID NO: 3558894 - RNA, 16 nt, Pseudomonas putida KT2440
ggggaagguugcaggu

SEQ ID NO: 3558895 - RNA, 16 nt, Pseudomonas putida KT2440
ggggaauggcccagcc

SEQ ID NO: 3558896 - RNA, 14 nt, Pseudomonas putida KT2440
ggggacgaucugca

SEQ ID NO: 3558897 - RNA, 19 nt, Pseudomonas putida KT2440
ggggaucgggauguucagg

SEQ ID NO: 3558898 - RNA, 13 nt, Pseudomonas putida KT2440
ggggaucuugcug

SEQ ID NO: 3558899 - RNA, 20 nt, Pseudomonas putida KT2440
ggggaucuugcuggccggug

SEQ ID NO: 3558900 - RNA, 20 nt, Pseudomonas putida KT2440
ggggauggcaccggcucugc

SEQ ID NO: 3558901 - RNA, 15 nt, Pseudomonas putida KT2440
ggggcaacugcgcga

SEQ ID NO: 3558902 - RNA, 21 nt, Pseudomonas putida KT2440
ggggcagacuaccaacaccgg

SEQ ID NO: 3558903 - RNA, 17 nt, Pseudomonas putida KT2440
ggggcagaugcuccaac

SEQ ID NO: 3558904 - RNA, 12 nt, Pseudomonas putida KT2440
ggggcagcauca

SEQ ID NO: 3558905 - RNA, 12 nt, Pseudomonas putida KT2440
ggggcaggcugu

SEQ ID NO: 3558906 - RNA, 13 nt, Pseudomonas putida KT2440
ggggcaggcugug

SEQ ID NO: 3558907 - RNA, 16 nt, Pseudomonas putida KT2440
ggggcagugcccaguc

SEQ ID NO: 3558908 - RNA, 16 nt, Pseudomonas putida KT2440
ggggccaaguggcugg

SEQ ID NO: 3558909 - RNA, 14 nt, Pseudomonas putida KT2440
ggggcccggacagg

SEQ ID NO: 3558910 - RNA, 16 nt, Pseudomonas putida KT2440
ggggccgcuuggcggc

SEQ ID NO: 3558911 - RNA, 17 nt, Pseudomonas putida KT2440
ggggcgacgcaucugca

SEQ ID NO: 3558912 - RNA, 16 nt, Pseudomonas putida KT2440
ggggcgcaaugcgccc

SEQ ID NO: 3558913 - RNA, 13 nt, Pseudomonas putida KT2440
ggggcgcuggaag

SEQ ID NO: 3558914 - RNA, 16 nt, Pseudomonas putida KT2440
ggggcgcuuugcaccc

SEQ ID NO: 3558915 - RNA, 21 nt, Pseudomonas putida KT2440
ggggcgggugggugcagcuga

SEQ ID NO: 3558916 - RNA, 17 nt, Pseudomonas putida KT2440
ggggcguuuaaaccuuc

SEQ ID NO: 3558917 - RNA, 18 nt, Pseudomonas putida KT2440
ggggcuagcuacucggca

SEQ ID NO: 3558918 - RNA, 15 nt, Pseudomonas putida KT2440
ggggcucagcccgcc

SEQ ID NO: 3558919 - RNA, 15 nt, Pseudomonas putida KT2440
ggggcugacgcgccg

SEQ ID NO: 3558920 - RNA, 22 nt, Pseudomonas putida KT2440
ggggcugacgcgccgugccagg

SEQ ID NO: 3558921 - RNA, 20 nt, Pseudomonas putida KT2440
ggggcugcauugcagcccca

SEQ ID NO: 3558922 - RNA, 20 nt, Pseudomonas putida KT2440
ggggcugccuugcagccccu

SEQ ID NO: 3558923 - RNA, 22 nt, Pseudomonas putida KT2440
ggggcugccuugcagccccugc

SEQ ID NO: 3558924 - RNA, 20 nt, Pseudomonas putida KT2440
ggggcugccuugcagcccuu

SEQ ID NO: 3558925 - RNA, 21 nt, Pseudomonas putida KT2440
ggggcugcugcgcagccccaa

SEQ ID NO: 3558926 - RNA, 20 nt, Pseudomonas putida KT2440
ggggcugcuuugcagcccau

SEQ ID NO: 3558927 - RNA, 14 nt, Pseudomonas putida KT2440
gggggagcgggcga

SEQ ID NO: 3558928 - RNA, 17 nt, Pseudomonas putida KT2440
gggggcagugcccaguc

SEQ ID NO: 3558929 - RNA, 23 nt, Pseudomonas putida KT2440
gggggccccaccaggcaccgagu

SEQ ID NO: 3558930 - RNA, 18 nt, Pseudomonas putida KT2440
gggggcguaaagcgcccc

SEQ ID NO: 3558931 - RNA, 15 nt, Pseudomonas putida KT2440
gggggcucagcccgc

SEQ ID NO: 3558932 - RNA, 22 nt, Pseudomonas putida KT2440
ggggguauuaagggcauggccg

SEQ ID NO: 3558933 - RNA, 15 nt, Pseudomonas putida KT2440
gggguaaccgccuga

SEQ ID NO: 3558934 - RNA, 17 nt, Pseudomonas putida KT2440
ggggucgcggccuaccc

SEQ ID NO: 3558935 - RNA, 20 nt, Pseudomonas putida KT2440
ggggucugcccggccagcag

SEQ ID NO: 3558936 - RNA, 19 nt, Pseudomonas putida KT2440
ggggugcaaagcgccccca

SEQ ID NO: 3558937 - RNA, 18 nt, Pseudomonas putida KT2440
ggggugccuucgagcaug

SEQ ID NO: 3558938 - RNA, 22 nt, Pseudomonas putida KT2440
ggucagcgaauaguagaagcag

SEQ ID NO: 3558939 - RNA, 11 nt, Pseudomonas putida KT2440
ggucagcgacu

SEQ ID NO: 3558940 - RNA, 11 nt, Pseudomonas putida KT2440
ggucagcgccu

SEQ ID NO: 3558941 - RNA, 17 nt, Pseudomonas putida KT2440
ggucagcgcucaaaaaa

SEQ ID NO: 3558942 - RNA, 23 nt, Pseudomonas putida KT2440
ggucagcgcugacucagcggccu

SEQ ID NO: 3558943 - RNA, 18 nt, Pseudomonas putida KT2440
ggucagcggaccaggugc

SEQ ID NO: 3558944 - RNA, 16 nt, Pseudomonas putida KT2440
ggucagcuccucugcc

SEQ ID NO: 3558945 - RNA, 16 nt, Pseudomonas putida KT2440
ggucagcucgaucagg

SEQ ID NO: 3558946 - RNA, 21 nt, Pseudomonas putida KT2440
ggucagcuggccuucgaacag

SEQ ID NO: 3558947 - RNA, 16 nt, Pseudomonas putida KT2440
ggucagcuucugggua

SEQ ID NO: 3558948 - RNA, 15 nt, Pseudomonas putida KT2440
ggucagguggcugua

SEQ ID NO: 3558949 - RNA, 18 nt, Pseudomonas putida KT2440
ggucaguaccuggccgcg

SEQ ID NO: 3558950 - RNA, 17 nt, Pseudomonas putida KT2440
ggucaguuugacgguga

SEQ ID NO: 3558951 - RNA, 21 nt, Pseudomonas putida KT2440
ggucaguuugacggugaauuc

SEQ ID NO: 3558952 - RNA, 13 nt, Pseudomonas putida KT2440
ggucauacagccc

SEQ ID NO: 3558953 - RNA, 13 nt, Pseudomonas putida KT2440
ggucauacaucca

SEQ ID NO: 3558954 - RNA, 14 nt, Pseudomonas putida KT2440
ggucauacauccag

SEQ ID NO: 3558955 - RNA, 15 nt, Pseudomonas putida KT2440
ggucauccaggaaaa

SEQ ID NO: 3558956 - RNA, 15 nt, Pseudomonas putida KT2440
ggucauccaggcugg

SEQ ID NO: 3558957 - RNA, 18 nt, Pseudomonas putida KT2440
ggucauccaggcuggcca

SEQ ID NO: 3558958 - RNA, 17 nt, Pseudomonas putida KT2440
ggucaucgaacaccucu

SEQ ID NO: 3558959 - RNA, 14 nt, Pseudomonas putida KT2440
ggucaucgggauca

SEQ ID NO: 3558960 - RNA, 17 nt, Pseudomonas putida KT2440
ggucaugcaggucaucg

SEQ ID NO: 3558961 - RNA, 13 nt, Pseudomonas putida KT2440
ggucaugccaccg

SEQ ID NO: 3558962 - RNA, 22 nt, Pseudomonas putida KT2440
ggucaugccauccucggccagg

SEQ ID NO: 3558963 - RNA, 16 nt, Pseudomonas putida KT2440
ggucauggucguguug

SEQ ID NO: 3558964 - RNA, 17 nt, Pseudomonas putida KT2440
ggucauuugcagugcuu

SEQ ID NO: 3558965 - RNA, 13 nt, Pseudomonas putida KT2440
gguccaccagccc

SEQ ID NO: 3558966 - RNA, 15 nt, Pseudomonas putida KT2440
gguccacccacccuc

SEQ ID NO: 3558967 - RNA, 21 nt, Pseudomonas putida KT2440
gguccaccgccagugcgguga

SEQ ID NO: 3558968 - RNA, 13 nt, Pseudomonas putida KT2440
gguccaccucugc

SEQ ID NO: 3558969 - RNA, 20 nt, Pseudomonas putida KT2440
gguccacgguucuggcagcu

SEQ ID NO: 3558970 - RNA, 22 nt, Pseudomonas putida KT2440
gguccagcguucggccagcacu

SEQ ID NO: 3558971 - RNA, 12 nt, Pseudomonas putida KT2440
gguccagcucug

SEQ ID NO: 3558972 - RNA, 15 nt, Pseudomonas putida KT2440
gguccaggccagcuu

SEQ ID NO: 3558973 - RNA, 23 nt, Pseudomonas putida KT2440
gguccauccccgcacgcgguggg

SEQ ID NO: 3558974 - RNA, 18 nt, Pseudomonas putida KT2440
gguccauguaggagcggg

SEQ ID NO: 3558975 - RNA, 20 nt, Pseudomonas putida KT2440
ggucccaauaauaaaaaaag

SEQ ID NO: 3558976 - RNA, 21 nt, Pseudomonas putida KT2440
gguccccauagcuuuccagca

SEQ ID NO: 3558977 - RNA, 20 nt, Pseudomonas putida KT2440
gguccccuucgucgaugucc

SEQ ID NO: 3558978 - RNA, 21 nt, Pseudomonas putida KT2440
ggucccguaauucuggcuggc

SEQ ID NO: 3558979 - RNA, 22 nt, Pseudomonas putida KT2440
ggucccugacucgaccgccgca

SEQ ID NO: 3558980 - RNA, 15 nt, Pseudomonas putida KT2440
gguccgccucgauca

SEQ ID NO: 3558981 - RNA, 21 nt, Pseudomonas putida KT2440
gguccggacuuggaccccgaa

SEQ ID NO: 3558982 - RNA, 23 nt, Pseudomonas putida KT2440
gguccggcaucacuacccaggcc

SEQ ID NO: 3558983 - RNA, 20 nt, Pseudomonas putida KT2440
gguccggcccuucuccgccu

SEQ ID NO: 3558984 - RNA, 22 nt, Pseudomonas putida KT2440
gguccggcccuucuccgccuac

SEQ ID NO: 3558985 - RNA, 19 nt, Pseudomonas putida KT2440
gguccucgaaacgcaggcu

SEQ ID NO: 3558986 - RNA, 15 nt, Pseudomonas putida KT2440
gguccugcaauugca

SEQ ID NO: 3558987 - RNA, 18 nt, Pseudomonas putida KT2440
gguccugcaccacaugca

SEQ ID NO: 3558988 - RNA, 14 nt, Pseudomonas putida KT2440
gguccuucaccacc

SEQ ID NO: 3558989 - RNA, 15 nt, Pseudomonas putida KT2440
gguccuucaccacca

SEQ ID NO: 3558990 - RNA, 20 nt, Pseudomonas putida KT2440
gguccuugaguucccaggca

SEQ ID NO: 3558991 - RNA, 18 nt, Pseudomonas putida KT2440
ggucgaaaagccgcggua

SEQ ID NO: 3558992 - RNA, 20 nt, Pseudomonas putida KT2440
ggucgaaccggucugcacgc

SEQ ID NO: 3558993 - RNA, 21 nt, Pseudomonas putida KT2440
ggucgaccgagaagcagaaca

SEQ ID NO: 3558994 - RNA, 14 nt, Pseudomonas putida KT2440
ggucgaccugcccg

SEQ ID NO: 3558995 - RNA, 23 nt, Pseudomonas putida KT2440
ggucgacgucggcguccuucagg

SEQ ID NO: 3558996 - RNA, 14 nt, Pseudomonas putida KT2440
ggucgacugaccgc

SEQ ID NO: 3558997 - RNA, 14 nt, Pseudomonas putida KT2440
ggucgagcugccca

SEQ ID NO: 3558998 - RNA, 21 nt, Pseudomonas putida KT2440
ggucgaggcggcugucgcaga

SEQ ID NO: 3558999 - RNA, 18 nt, Pseudomonas putida KT2440
ggucgaucccggacagca

SEQ ID NO: 3559000 - RNA, 17 nt, Pseudomonas putida KT2440
ggucgaucuucagcgca

SEQ ID NO: 3559001 - RNA, 21 nt, Pseudomonas putida KT2440
ggucgaucuucgccggcaucg

SEQ ID NO: 3559002 - RNA, 18 nt, Pseudomonas putida KT2440
ggucgaugcaggagcggc

SEQ ID NO: 3559003 - RNA, 19 nt, Pseudomonas putida KT2440
ggucgaugcaggagcggcu

SEQ ID NO: 3559004 - RNA, 20 nt, Pseudomonas putida KT2440
ggucgaugcaggagcggcuu

SEQ ID NO: 3559005 - RNA, 23 nt, Pseudomonas putida KT2440
ggucgccaaacaguuggugggca

SEQ ID NO: 3559006 - RNA, 12 nt, Pseudomonas putida KT2440
ggucgccagcac

SEQ ID NO: 3559007 - RNA, 14 nt, Pseudomonas putida KT2440
ggucgccagcacca

SEQ ID NO: 3559008 - RNA, 16 nt, Pseudomonas putida KT2440
ggucgccagguuggcc

SEQ ID NO: 3559009 - RNA, 20 nt, Pseudomonas putida KT2440
ggucgccgacggcauggccg

SEQ ID NO: 3559010 - RNA, 21 nt, Pseudomonas putida KT2440
ggucgccgccgucgggugcgc

SEQ ID NO: 3559011 - RNA, 18 nt, Pseudomonas putida KT2440
ggucgccgucgcacaggc

SEQ ID NO: 3559012 - RNA, 15 nt, Pseudomonas putida KT2440
ggucgccgugcagca

SEQ ID NO: 3559013 - RNA, 16 nt, Pseudomonas putida KT2440
ggucgcgccgacaucg

SEQ ID NO: 3559014 - RNA, 21 nt, Pseudomonas putida KT2440
ggucgcgccgacaucgaagca

SEQ ID NO: 3559015 - RNA, 12 nt, Pseudomonas putida KT2440
ggucgcggcggc

SEQ ID NO: 3559016 - RNA, 15 nt, Pseudomonas putida KT2440
ggucgcggcggcaac

SEQ ID NO: 3559017 - RNA, 21 nt, Pseudomonas putida KT2440
ggucgcgguucgacugccgcu

SEQ ID NO: 3559018 - RNA, 18 nt, Pseudomonas putida KT2440
ggucgcguucuuucuccc

SEQ ID NO: 3559019 - RNA, 22 nt, Pseudomonas putida KT2440
ggucgcguucuuucucccaggc

SEQ ID NO: 3559020 - RNA, 15 nt, Pseudomonas putida KT2440
ggucgcuaucggcag

SEQ ID NO: 3559021 - RNA, 21 nt, Pseudomonas putida KT2440
ggucgcugcccucggccgggg

SEQ ID NO: 3559022 - RNA, 21 nt, Pseudomonas putida KT2440
ggucgcugccgugcaggucag

SEQ ID NO: 3559023 - RNA, 15 nt, Pseudomonas putida KT2440
ggucgcuugucgcca

SEQ ID NO: 3559024 - RNA, 22 nt, Pseudomonas putida KT2440
ggucggagaucgagugcucgaa

SEQ ID NO: 3559025 - RNA, 12 nt, Pseudomonas putida KT2440
ggucggcaacca

SEQ ID NO: 3559026 - RNA, 14 nt, Pseudomonas putida KT2440
ggucggcagggccg

SEQ ID NO: 3559027 - RNA, 17 nt, Pseudomonas putida KT2440
ggucggccaucgacgug

SEQ ID NO: 3559028 - RNA, 15 nt, Pseudomonas putida KT2440
ggucggcgccaggcc

SEQ ID NO: 3559029 - RNA, 13 nt, Pseudomonas putida KT2440
ggucggcggggcc

SEQ ID NO: 3559030 - RNA, 21 nt, Pseudomonas putida KT2440
ggucggcggggcccggacagg

SEQ ID NO: 3559031 - RNA, 18 nt, Pseudomonas putida KT2440
ggucggcguccacugcac

SEQ ID NO: 3559032 - RNA, 17 nt, Pseudomonas putida KT2440
ggucgggaacagcucug

SEQ ID NO: 3559033 - RNA, 15 nt, Pseudomonas putida KT2440
ggucgggcacaggcc

SEQ ID NO: 3559034 - RNA, 22 nt, Pseudomonas putida KT2440
ggucgggucgcugccgugcagg

SEQ ID NO: 3559035 - RNA, 20 nt, Pseudomonas putida KT2440
ggucgguagggaucaccgcc

SEQ ID NO: 3559036 - RNA, 18 nt, Pseudomonas putida KT2440
ggucggucagcaccguga

SEQ ID NO: 3559037 - RNA, 16 nt, Pseudomonas putida KT2440
ggucgucgcccaggcg

SEQ ID NO: 3559038 - RNA, 13 nt, Pseudomonas putida KT2440
ggucgugcgcgau

SEQ ID NO: 3559039 - RNA, 17 nt, Pseudomonas putida KT2440
ggucguuacccagguag

SEQ ID NO: 3559040 - RNA, 17 nt, Pseudomonas putida KT2440
ggucuaaccgcgcuggu

SEQ ID NO: 3559041 - RNA, 19 nt, Pseudomonas putida KT2440
ggucucgaacgcugugccg

SEQ ID NO: 3559042 - RNA, 21 nt, Pseudomonas putida KT2440
ggucucgaacugaugaccggc

SEQ ID NO: 3559043 - RNA, 13 nt, Pseudomonas putida KT2440
gguggcugccagc

SEQ ID NO: 3559044 - RNA, 17 nt, Pseudomonas putida KT2440
gguggcuggcaccggcu

SEQ ID NO: 3559045 - RNA, 19 nt, Pseudomonas putida KT2440
gguggcuucguggugcugg

SEQ ID NO: 3559046 - RNA, 12 nt, Pseudomonas putida KT2440
gguggggugcca

SEQ ID NO: 3559047 - RNA, 19 nt, Pseudomonas putida KT2440
ggugguaauuggccggcag

SEQ ID NO: 3559048 - RNA, 16 nt, Pseudomonas putida KT2440
gguggucaccagcacg

SEQ ID NO: 3559049 - RNA, 16 nt, Pseudomonas putida KT2440
gguggucagccaggcg

SEQ ID NO: 3559050 - RNA, 12 nt, Pseudomonas putida KT2440
ggugguccccuu

SEQ ID NO: 3559051 - RNA, 18 nt, Pseudomonas putida KT2440
gguggucgcugcggcaca

SEQ ID NO: 3559052 - RNA, 14 nt, Pseudomonas putida KT2440
gguggugcgcccgg

SEQ ID NO: 3559053 - RNA, 15 nt, Pseudomonas putida KT2440
gguggugcugggcau

SEQ ID NO: 3559054 - RNA, 20 nt, Pseudomonas putida KT2440
ggugguuggacacaggccgu

SEQ ID NO: 3559055 - RNA, 18 nt, Pseudomonas putida KT2440
gguguagaacggcagcag

SEQ ID NO: 3559056 - RNA, 21 nt, Pseudomonas putida KT2440
gguguaguugaccgacgccag

SEQ ID NO: 3559057 - RNA, 12 nt, Pseudomonas putida KT2440
ggugucaccgcg

SEQ ID NO: 3559058 - RNA, 16 nt, Pseudomonas putida KT2440
ggugucaccgcgagca

SEQ ID NO: 3559059 - RNA, 18 nt, Pseudomonas putida KT2440
ggugucaccgcgagcagc

SEQ ID NO: 3559060 - RNA, 23 nt, Pseudomonas putida KT2440
gguguccacuuuuagguggacac

SEQ ID NO: 3559061 - RNA, 15 nt, Pseudomonas putida KT2440
gguguccuugcacuc

SEQ ID NO: 3559062 - RNA, 18 nt, Pseudomonas putida KT2440
gguguccuugcacucccc

SEQ ID NO: 3559063 - RNA, 14 nt, Pseudomonas putida KT2440
gguguccuugucgg

SEQ ID NO: 3559064 - RNA, 17 nt, Pseudomonas putida KT2440
gguguccuugucggcga

SEQ ID NO: 3559065 - RNA, 19 nt, Pseudomonas putida KT2440
ggugucgacgacaguaccu

SEQ ID NO: 3559066 - RNA, 20 nt, Pseudomonas putida KT2440
ggugucgauacucacccgcu

SEQ ID NO: 3559067 - RNA, 15 nt, Pseudomonas putida KT2440
ggugucggccagcug

SEQ ID NO: 3559068 - RNA, 16 nt, Pseudomonas putida KT2440
ggugucgguggcggcc

SEQ ID NO: 3559069 - RNA, 15 nt, Pseudomonas putida KT2440
ggugugcuccagcuc

SEQ ID NO: 3559070 - RNA, 12 nt, Pseudomonas putida KT2440
ggugugcugcug

SEQ ID NO: 3559071 - RNA, 12 nt, Pseudomonas putida KT2440
gguguggcagcu

SEQ ID NO: 3559072 - RNA, 14 nt, Pseudomonas putida KT2440
ggugugguagcugu

SEQ ID NO: 3559073 - RNA, 19 nt, Pseudomonas putida KT2440
gguguguagguucacagaa

SEQ ID NO: 3559074 - RNA, 13 nt, Pseudomonas putida KT2440
gguguuacgccag

SEQ ID NO: 3559075 - RNA, 16 nt, Pseudomonas putida KT2440
gguguuacgccaggcg

SEQ ID NO: 3559076 - RNA, 15 nt, Pseudomonas putida KT2440
gguguucgcgggcau

SEQ ID NO: 3559077 - RNA, 20 nt, Pseudomonas putida KT2440
gguguucgcgggcaugcccg

SEQ ID NO: 3559078 - RNA, 22 nt, Pseudomonas putida KT2440
gguguucgcgggcaugcccgcu

SEQ ID NO: 3559079 - RNA, 16 nt, Pseudomonas putida KT2440
gguguucgcgggcgcg

SEQ ID NO: 3559080 - RNA, 18 nt, Pseudomonas putida KT2440
gguguugcuugucccagg

SEQ ID NO: 3559081 - RNA, 23 nt, Pseudomonas putida KT2440
gguguugggcgggccgccgaaca

SEQ ID NO: 3559082 - RNA, 15 nt, Pseudomonas putida KT2440
gguguuggucagggc

SEQ ID NO: 3559083 - RNA, 18 nt, Pseudomonas putida KT2440
gguguuuccacagguacc

SEQ ID NO: 3559084 - RNA, 19 nt, Pseudomonas putida KT2440
gguguuugaccaccagacg

SEQ ID NO: 3559085 - RNA, 20 nt, Pseudomonas putida KT2440
gguuaagcgccaccaccgcu

SEQ ID NO: 3559086 - RNA, 19 nt, Pseudomonas putida KT2440
gguuacggcggccugcugc

SEQ ID NO: 3559087 - RNA, 14 nt, Pseudomonas putida KT2440
gguuacuggccaau

SEQ ID NO: 3559088 - RNA, 19 nt, Pseudomonas putida KT2440
gguuauacgccgccgaggc

SEQ ID NO: 3559089 - RNA, 22 nt, Pseudomonas putida KT2440
gguucacagaaaagcugcacgc

SEQ ID NO: 3559090 - RNA, 22 nt, Pseudomonas putida KT2440
gguucagcgcaccgcugaccac

SEQ ID NO: 3559091 - RNA, 14 nt, Pseudomonas putida KT2440
gguucagcgucaug

SEQ ID NO: 3559092 - RNA, 18 nt, Pseudomonas putida KT2440
gguucaucaccagccccc

SEQ ID NO: 3559093 - RNA, 13 nt, Pseudomonas putida KT2440
gguuccagcgcac

SEQ ID NO: 3559094 - RNA, 13 nt, Pseudomonas putida KT2440
gguuccaggccac

SEQ ID NO: 3559095 - RNA, 14 nt, Pseudomonas putida KT2440
gguuccccagcaag

SEQ ID NO: 3559096 - RNA, 20 nt, Pseudomonas putida KT2440
gguucgaaucgcucaugccc

SEQ ID NO: 3559097 - RNA, 14 nt, Pseudomonas putida KT2440
gguucgacugccgc

SEQ ID NO: 3559098 - RNA, 21 nt, Pseudomonas putida KT2440
gguucgcccgguuccagcgca

SEQ ID NO: 3559099 - RNA, 13 nt, Pseudomonas putida KT2440
gguucguccccuu

SEQ ID NO: 3559100 - RNA, 21 nt, Pseudomonas putida KT2440
gguucgucucgcugucgucga

SEQ ID NO: 3559101 - RNA, 19 nt, Pseudomonas putida KT2440
gguucuccugugccggccu

SEQ ID NO: 3559102 - RNA, 15 nt, Pseudomonas putida KT2440
gguucugccggggca

SEQ ID NO: 3559103 - RNA, 23 nt, Pseudomonas putida KT2440
gguucuguagcgcaaugcccagc

SEQ ID NO: 3559104 - RNA, 21 nt, Pseudomonas putida KT2440
gguugaacagcagcgccgcca

SEQ ID NO: 3559105 - RNA, 15 nt, Pseudomonas putida KT2440
gguugaagaucaggu

SEQ ID NO: 3559106 - RNA, 16 nt, Pseudomonas putida KT2440
gguugaagaugcgcgc

SEQ ID NO: 3559107 - RNA, 23 nt, Pseudomonas putida KT2440
gguugaccagggcgucgaacacg

SEQ ID NO: 3559108 - RNA, 18 nt, Pseudomonas putida KT2440
gguugaccgagaacaggc

SEQ ID NO: 3559109 - RNA, 23 nt, Pseudomonas putida KT2440
gguugagcacacgguaguccugc

SEQ ID NO: 3559110 - RNA, 14 nt, Pseudomonas putida KT2440
gguugauccagccc

SEQ ID NO: 3559111 - RNA, 21 nt, Pseudomonas putida KT2440
gguugcaccucggaugccacg

SEQ ID NO: 3559112 - RNA, 13 nt, Pseudomonas putida KT2440
gguugcagguucu

SEQ ID NO: 3559113 - RNA, 14 nt, Pseudomonas putida KT2440
gguugcccagcaug

SEQ ID NO: 3559114 - RNA, 19 nt, Pseudomonas putida KT2440
gguugcccagcaugcgcuu

SEQ ID NO: 3559115 - RNA, 17 nt, Pseudomonas putida KT2440
gguugccccugauagga

SEQ ID NO: 3559116 - RNA, 23 nt, Pseudomonas putida KT2440
gguugccggucggggugcugcgc

SEQ ID NO: 3559117 - RNA, 21 nt, Pseudomonas putida KT2440
gguugccucaucaccucggca

SEQ ID NO: 3559118 - RNA, 16 nt, Pseudomonas putida KT2440
gguugcguugaccugc

SEQ ID NO: 3559119 - RNA, 22 nt, Pseudomonas putida KT2440
gguugcucaggcgcuccagcag

SEQ ID NO: 3559120 - RNA, 15 nt, Pseudomonas putida KT2440
gguuggacagcgccc

SEQ ID NO: 3559121 - RNA, 15 nt, Pseudomonas putida KT2440
gguuggccgccgcca

SEQ ID NO: 3559122 - RNA, 16 nt, Pseudomonas putida KT2440
gguuggcuuguccagc

SEQ ID NO: 3559123 - RNA, 14 nt, Pseudomonas putida KT2440
gguugugcuggccc

SEQ ID NO: 3559124 - RNA, 17 nt, Pseudomonas putida KT2440
gguuguggcuuggccca

SEQ ID NO: 3559125 - RNA, 23 nt, Pseudomonas putida KT2440
gguuuaaaccgcgaagcaggcug

SEQ ID NO: 3559126 - RNA, 21 nt, Pseudomonas putida KT2440
gguuuacccgcgaacaccggc

SEQ ID NO: 3559127 - RNA, 20 nt, Pseudomonas putida KT2440
gguuuacccgcgaacaggcc

SEQ ID NO: 3559128 - RNA, 21 nt, Pseudomonas putida KT2440
gguuuacccgcgaagaagccg

SEQ ID NO: 3559129 - RNA, 19 nt, Pseudomonas putida KT2440
gguuuacccgcgaagaggc

SEQ ID NO: 3559130 - RNA, 16 nt, Pseudomonas putida KT2440
gguuuacccgcgaaua

SEQ ID NO: 3559131 - RNA, 20 nt, Pseudomonas putida KT2440
gguuuacccgcgaauacgau

SEQ ID NO: 3559132 - RNA, 20 nt, Pseudomonas putida KT2440
gguuuacccgcgaauacggu

SEQ ID NO: 3559133 - RNA, 22 nt, Pseudomonas putida KT2440
gguuuaccggccgcucaccggc

SEQ ID NO: 3559134 - RNA, 20 nt, Pseudomonas putida KT2440
gguuuaccugcgaauacggu

SEQ ID NO: 3559135 - RNA, 15 nt, Pseudomonas putida KT2440
gguuuagcgcuggcu

SEQ ID NO: 3559136 - RNA, 15 nt, Pseudomonas putida KT2440
gguuuccagcccuuc

SEQ ID NO: 3559137 - RNA, 17 nt, Pseudomonas putida KT2440
gguuucccgaugaagaa

SEQ ID NO: 3559138 - RNA, 17 nt, Pseudomonas putida KT2440
gguuucgccguugucgg

SEQ ID NO: 3559139 - RNA, 17 nt, Pseudomonas putida KT2440
gguuucggugcgcugcu

SEQ ID NO: 3559140 - RNA, 14 nt, Pseudomonas putida KT2440
gguuugaagcccgg

SEQ ID NO: 3559141 - RNA, 15 nt, Pseudomonas putida KT2440
gguuugacgcugcuc

SEQ ID NO: 3559142 - RNA, 16 nt, Pseudomonas putida KT2440
gguuugcguugccugu

SEQ ID NO: 3559143 - RNA, 17 nt, Pseudomonas putida KT2440
gguuuggggugagcgaa

SEQ ID NO: 3559144 - RNA, 23 nt, Pseudomonas putida KT2440
gguuuuagcguagugcaggcgca

SEQ ID NO: 3559145 - RNA, 13 nt, Pseudomonas putida KT2440
gguuuucggcgcc

SEQ ID NO: 3559146 - RNA, 18 nt, Pseudomonas putida KT2440
gguuuuggcaggccguca

SEQ ID NO: 3559147 - RNA, 20 nt, Pseudomonas putida KT2440
gguuuuuuauugccugccag

SEQ ID NO: 3559148 - RNA, 18 nt, Pseudomonas putida KT2440
guacgcuggccaaggccu

SEQ ID NO: 3559149 - RNA, 15 nt, Pseudomonas putida KT2440
guacggcagcucgag

SEQ ID NO: 3559150 - RNA, 21 nt, Pseudomonas putida KT2440
guacggcagcucgagcaugcg

SEQ ID NO: 3559151 - RNA, 15 nt, Pseudomonas putida KT2440
guacggccagcaggu

SEQ ID NO: 3559152 - RNA, 21 nt, Pseudomonas putida KT2440
guacggcccaugucgaucagc

SEQ ID NO: 3559153 - RNA, 13 nt, Pseudomonas putida KT2440
guacggccuuggc

SEQ ID NO: 3559154 - RNA, 15 nt, Pseudomonas putida KT2440
guacggcgcugagga

SEQ ID NO: 3559155 - RNA, 13 nt, Pseudomonas putida KT2440
guacggcuugccg

SEQ ID NO: 3559156 - RNA, 17 nt, Pseudomonas putida KT2440
guacggcuugccggcaa

SEQ ID NO: 3559157 - RNA, 18 nt, Pseudomonas putida KT2440
guacggcuugccggcaau

SEQ ID NO: 3559158 - RNA, 15 nt, Pseudomonas putida KT2440
guacggguggcucug

SEQ ID NO: 3559159 - RNA, 16 nt, Pseudomonas putida KT2440
guacgucguacgccga

SEQ ID NO: 3559160 - RNA, 13 nt, Pseudomonas putida KT2440
guacgucucaucg

SEQ ID NO: 3559161 - RNA, 13 nt, Pseudomonas putida KT2440
guacucaggggca

SEQ ID NO: 3559162 - RNA, 20 nt, Pseudomonas putida KT2440
guacuccacuuccagcagcu

SEQ ID NO: 3559163 - RNA, 13 nt, Pseudomonas putida KT2440
guacuccagcagc

SEQ ID NO: 3559164 - RNA, 14 nt, Pseudomonas putida KT2440
guacucgaacagcu

SEQ ID NO: 3559165 - RNA, 18 nt, Pseudomonas putida KT2440
guacucgcaagcuccagg

SEQ ID NO: 3559166 - RNA, 20 nt, Pseudomonas putida KT2440
guacucucgucgaggcuguc

SEQ ID NO: 3559167 - RNA, 22 nt, Pseudomonas putida KT2440
guacucucgucgaggcugucga

SEQ ID NO: 3559168 - RNA, 15 nt, Pseudomonas putida KT2440
guacucugucacccg

SEQ ID NO: 3559169 - RNA, 20 nt, Pseudomonas putida KT2440
guacucuucgacggucggca

SEQ ID NO: 3559170 - RNA, 13 nt, Pseudomonas putida KT2440
guacugcggcuga

SEQ ID NO: 3559171 - RNA, 17 nt, Pseudomonas putida KT2440
guacuggaagagcagga

SEQ ID NO: 3559172 - RNA, 11 nt, Pseudomonas putida KT2440
guacuggcuga

SEQ ID NO: 3559173 - RNA, 22 nt, Pseudomonas putida KT2440
guacuggucgcgugccgccagu

SEQ ID NO: 3559174 - RNA, 12 nt, Pseudomonas putida KT2440
guacuugcugca

SEQ ID NO: 3559175 - RNA, 20 nt, Pseudomonas putida KT2440
guacuugcugcagggcacgc

SEQ ID NO: 3559176 - RNA, 17 nt, Pseudomonas putida KT2440
guacuuuuucagguuua

SEQ ID NO: 3559177 - RNA, 13 nt, Pseudomonas putida KT2440
guagaacacccgc

SEQ ID NO: 3559178 - RNA, 14 nt, Pseudomonas putida KT2440
guagaacaggccug

SEQ ID NO: 3559179 - RNA, 19 nt, Pseudomonas putida KT2440
guagaagggggcaaugcgg

SEQ ID NO: 3559180 - RNA, 20 nt, Pseudomonas putida KT2440
guagaaggucggugcggcaa

SEQ ID NO: 3559181 - RNA, 22 nt, Pseudomonas putida KT2440
guagacuucugcgugcguuggg

SEQ ID NO: 3559182 - RNA, 15 nt, Pseudomonas putida KT2440
guagagcccccagca

SEQ ID NO: 3559183 - RNA, 18 nt, Pseudomonas putida KT2440
guagagccuuuggcugga

SEQ ID NO: 3559184 - RNA, 18 nt, Pseudomonas putida KT2440
guagauaggcuguuggcg

SEQ ID NO: 3559185 - RNA, 14 nt, Pseudomonas putida KT2440
guagaucaucagcg

SEQ ID NO: 3559186 - RNA, 18 nt, Pseudomonas putida KT2440
guagaucauuaccugcag

SEQ ID NO: 3559187 - RNA, 17 nt, Pseudomonas putida KT2440
guagaucgccggcagca

SEQ ID NO: 3559188 - RNA, 21 nt, Pseudomonas putida KT2440
guagcacgggcgcugaagcca

SEQ ID NO: 3559189 - RNA, 16 nt, Pseudomonas putida KT2440
guagcagguacgcgca

SEQ ID NO: 3559190 - RNA, 20 nt, Pseudomonas putida KT2440
guagcagguacgcgcaggca

SEQ ID NO: 3559191 - RNA, 23 nt, Pseudomonas putida KT2440
guagccaaccgagucaacacggc

SEQ ID NO: 3559192 - RNA, 19 nt, Pseudomonas putida KT2440
guagccaaucaucuugcca

SEQ ID NO: 3559193 - RNA, 22 nt, Pseudomonas putida KT2440
guagccagucugcuccaccgca

SEQ ID NO: 3559194 - RNA, 15 nt, Pseudomonas putida KT2440
guagccccagccggc

SEQ ID NO: 3559195 - RNA, 23 nt, Pseudomonas putida KT2440
guagccgucuuugagggucagcu

SEQ ID NO: 3559196 - RNA, 21 nt, Pseudomonas putida KT2440
guagccgugcggccaaagcug

SEQ ID NO: 3559197 - RNA, 17 nt, Pseudomonas putida KT2440
guagccguuugaagcca

SEQ ID NO: 3559198 - RNA, 19 nt, Pseudomonas putida KT2440
guagccguuugaagccaac

SEQ ID NO: 3559199 - RNA, 15 nt, Pseudomonas putida KT2440
guagccuuccagcuc

SEQ ID NO: 3559200 - RNA, 20 nt, Pseudomonas putida KT2440
guagccuuccagcuccuucu

SEQ ID NO: 3559201 - RNA, 20 nt, Pseudomonas putida KT2440
guagccuucuucggucagcu

SEQ ID NO: 3559202 - RNA, 16 nt, Pseudomonas putida KT2440
guagcgagcaccggca

SEQ ID NO: 3559203 - RNA, 17 nt, Pseudomonas putida KT2440
guagcgauaaggcuugc

SEQ ID NO: 3559204 - RNA, 22 nt, Pseudomonas putida KT2440
guagcgcaaaugguuguccacc

SEQ ID NO: 3559205 - RNA, 16 nt, Pseudomonas putida KT2440
guagcggccagcccgc

SEQ ID NO: 3559206 - RNA, 16 nt, Pseudomonas putida KT2440
guagcggucaugcagc

SEQ ID NO: 3559207 - RNA, 17 nt, Pseudomonas putida KT2440
guagcgguggcguugcc

SEQ ID NO: 3559208 - RNA, 14 nt, Pseudomonas putida KT2440
guagcgguugcgca

SEQ ID NO: 3559209 - RNA, 17 nt, Pseudomonas putida KT2440
guagcuccagcccagcg

SEQ ID NO: 3559210 - RNA, 23 nt, Pseudomonas putida KT2440
guagcucgacgccgugguagcac

SEQ ID NO: 3559211 - RNA, 22 nt, Pseudomonas putida KT2440
guagcugaccuuggacagggug

SEQ ID NO: 3559212 - RNA, 15 nt, Pseudomonas putida KT2440
guagcugggcccgcc

SEQ ID NO: 3559213 - RNA, 23 nt, Pseudomonas putida KT2440
guagcuguuaggcuugacgaccg

SEQ ID NO: 3559214 - RNA, 17 nt, Pseudomonas putida KT2440
guaggacaucuggucag

SEQ ID NO: 3559215 - RNA, 20 nt, Pseudomonas putida KT2440
guaggagcgggcuuacccgc

SEQ ID NO: 3559216 - RNA, 22 nt, Pseudomonas putida KT2440
guaggagcgggcuuacccgcga

SEQ ID NO: 3559217 - RNA, 20 nt, Pseudomonas putida KT2440
guaggagcggguucacccgc

SEQ ID NO: 3559218 - RNA, 19 nt, Pseudomonas putida KT2440
guaggagcggguuuacccg

SEQ ID NO: 3559219 - RNA, 20 nt, Pseudomonas putida KT2440
guaggagcggguuuacccgc

SEQ ID NO: 3559220 - RNA, 16 nt, Pseudomonas putida KT2440
guaggaucaaguaccc

SEQ ID NO: 3559221 - RNA, 20 nt, Pseudomonas putida KT2440
guaggaucggguuuacccgc

SEQ ID NO: 3559222 - RNA, 15 nt, Pseudomonas putida KT2440
guaggcaaugccuug

SEQ ID NO: 3559223 - RNA, 17 nt, Pseudomonas putida KT2440
guaggcacgaugaccgu

SEQ ID NO: 3559224 - RNA, 15 nt, Pseudomonas putida KT2440
guaggcacggucggu

SEQ ID NO: 3559225 - RNA, 19 nt, Pseudomonas putida KT2440
guaggcacggucgguagcc

SEQ ID NO: 3559226 - RNA, 13 nt, Pseudomonas putida KT2440
guaggcagcugcc

SEQ ID NO: 3559227 - RNA, 19 nt, Pseudomonas putida KT2440
guaggccagguacaggcaa

SEQ ID NO: 3559228 - RNA, 20 nt, Pseudomonas putida KT2440
guaggccauuucccaaagau

SEQ ID NO: 3559229 - RNA, 16 nt, Pseudomonas putida KT2440
guaggcccagcccagc

SEQ ID NO: 3559230 - RNA, 14 nt, Pseudomonas putida KT2440
guaggccgcagcca

SEQ ID NO: 3559231 - RNA, 17 nt, Pseudomonas putida KT2440
guaggccuugaccagcu

SEQ ID NO: 3559232 - RNA, 16 nt, Pseudomonas putida KT2440
guaggcgcaacucagc

SEQ ID NO: 3559233 - RNA, 17 nt, Pseudomonas putida KT2440
guaggcgggagagcagg

SEQ ID NO: 3559234 - RNA, 19 nt, Pseudomonas putida KT2440
guaggcgggagagcagggc

SEQ ID NO: 3559235 - RNA, 20 nt, Pseudomonas putida KT2440
guaggcgggagagcagggcu

SEQ ID NO: 3559236 - RNA, 19 nt, Pseudomonas putida KT2440
guaggcugcagcgaacacu

SEQ ID NO: 3559237 - RNA, 13 nt, Pseudomonas putida KT2440
guaggcuucacgc

SEQ ID NO: 3559238 - RNA, 13 nt, Pseudomonas putida KT2440
guagggaucaccg

SEQ ID NO: 3559239 - RNA, 14 nt, Pseudomonas putida KT2440
guaggggcuaaaac

SEQ ID NO: 3559240 - RNA, 20 nt, Pseudomonas putida KT2440
guaggucaccaucagccgcg

SEQ ID NO: 3559241 - RNA, 20 nt, Pseudomonas putida KT2440
guaggucuaaccgcgcuggu

SEQ ID NO: 3559242 - RNA, 21 nt, Pseudomonas putida KT2440
guaggucuaaccgcgcuggua

SEQ ID NO: 3559243 - RNA, 13 nt, Pseudomonas putida KT2440
guaggugcaggcg

SEQ ID NO: 3559244 - RNA, 17 nt, Pseudomonas putida KT2440
guaggugcaggcguaac

SEQ ID NO: 3559245 - RNA, 23 nt, Pseudomonas putida KT2440
guaggugcugaccgccugcgcac

SEQ ID NO: 3559246 - RNA, 15 nt, Pseudomonas putida KT2440
guaguacuccagcag

SEQ ID NO: 3559247 - RNA, 20 nt, Pseudomonas putida KT2440
guaguccccaucacgcagcg

SEQ ID NO: 3559248 - RNA, 24 nt, Pseudomonas putida KT2440
guaguccccaucacgcagcgcgga

SEQ ID NO: 3559249 - RNA, 13 nt, Pseudomonas putida KT2440
guaguccggcacg

SEQ ID NO: 3559250 - RNA, 19 nt, Pseudomonas putida KT2440
guagucggcaaucagcagg

SEQ ID NO: 3559251 - RNA, 12 nt, Pseudomonas putida KT2440
guaguucggcgg

SEQ ID NO: 3559252 - RNA, 15 nt, Pseudomonas putida KT2440
guauaacgcacgugg

SEQ ID NO: 3559253 - RNA, 12 nt, Pseudomonas putida KT2440
gucaggcucagc

SEQ ID NO: 3559254 - RNA, 13 nt, Pseudomonas putida KT2440
gucagggcugcaa

SEQ ID NO: 3559255 - RNA, 14 nt, Pseudomonas putida KT2440
gucagggcugcaag

SEQ ID NO: 3559256 - RNA, 22 nt, Pseudomonas putida KT2440
gucagggcuuuuuccagcgcca

SEQ ID NO: 3559257 - RNA, 14 nt, Pseudomonas putida KT2440
gucagggucuuccg

SEQ ID NO: 3559258 - RNA, 22 nt, Pseudomonas putida KT2440
gucagguagccuuccagcuccu

SEQ ID NO: 3559259 - RNA, 20 nt, Pseudomonas putida KT2440
gucagguagcucgacgccgu

SEQ ID NO: 3559260 - RNA, 17 nt, Pseudomonas putida KT2440
gucagguccgccaaggu

SEQ ID NO: 3559261 - RNA, 21 nt, Pseudomonas putida KT2440
gucaggucgaucccgccgagc

SEQ ID NO: 3559262 - RNA, 20 nt, Pseudomonas putida KT2440
gucaggugcaucgucacauc

SEQ ID NO: 3559263 - RNA, 15 nt, Pseudomonas putida KT2440
gucaggugcggggca

SEQ ID NO: 3559264 - RNA, 12 nt, Pseudomonas putida KT2440
gucagguggcug

SEQ ID NO: 3559265 - RNA, 22 nt, Pseudomonas putida KT2440
gucaguaccuggccgcguucgc

SEQ ID NO: 3559266 - RNA, 13 nt, Pseudomonas putida KT2440
gucagugacaggc

SEQ ID NO: 3559267 - RNA, 16 nt, Pseudomonas putida KT2440
gucagugacaggcagu

SEQ ID NO: 3559268 - RNA, 16 nt, Pseudomonas putida KT2440
gucagugaugcuugcg

SEQ ID NO: 3559269 - RNA, 18 nt, Pseudomonas putida KT2440
gucaguggucuucaaggc

SEQ ID NO: 3559270 - RNA, 15 nt, Pseudomonas putida KT2440
gucaguucagccagg

SEQ ID NO: 3559271 - RNA, 16 nt, Pseudomonas putida KT2440
gucaguuccugaacca

SEQ ID NO: 3559272 - RNA, 20 nt, Pseudomonas putida KT2440
gucaguucuaccccuucggc

SEQ ID NO: 3559273 - RNA, 16 nt, Pseudomonas putida KT2440
gucaguucugcucagc

SEQ ID NO: 3559274 - RNA, 22 nt, Pseudomonas putida KT2440
gucauaagccuuucaucgcuuu

SEQ ID NO: 3559275 - RNA, 15 nt, Pseudomonas putida KT2440
gucauaccucgaccg

SEQ ID NO: 3559276 - RNA, 19 nt, Pseudomonas putida KT2440
gucauacucuucgcgggcu

SEQ ID NO: 3559277 - RNA, 21 nt, Pseudomonas putida KT2440
gucauacucuucgcgggcucg

SEQ ID NO: 3559278 - RNA, 20 nt, Pseudomonas putida KT2440
gucauaguuguggcaacgau

SEQ ID NO: 3559279 - RNA, 13 nt, Pseudomonas putida KT2440
gucaucaccaccc

SEQ ID NO: 3559280 - RNA, 20 nt, Pseudomonas putida KT2440
gucaucaccacuucacugac

SEQ ID NO: 3559281 - RNA, 22 nt, Pseudomonas putida KT2440
gucaucacccgggaacagcagc

SEQ ID NO: 3559282 - RNA, 13 nt, Pseudomonas putida KT2440
gucaucaucagca

SEQ ID NO: 3559283 - RNA, 21 nt, Pseudomonas putida KT2440
gucauccaggcuggccagcaa

SEQ ID NO: 3559284 - RNA, 23 nt, Pseudomonas putida KT2440
gucauccaggcuggccagcaagu

SEQ ID NO: 3559285 - RNA, 22 nt, Pseudomonas putida KT2440
gucauccgccaacaccaccucc

SEQ ID NO: 3559286 - RNA, 15 nt, Pseudomonas putida KT2440
gucauccgccaggcu

SEQ ID NO: 3559287 - RNA, 17 nt, Pseudomonas putida KT2440
gucauccggcgcggccu

SEQ ID NO: 3559288 - RNA, 20 nt, Pseudomonas putida KT2440
gucauccggcgcggccugcu

SEQ ID NO: 3559289 - RNA, 22 nt, Pseudomonas putida KT2440
gucauccgggccgucaccgcug

SEQ ID NO: 3559290 - RNA, 23 nt, Pseudomonas putida KT2440
gucauccgggccgucaccgcugc

SEQ ID NO: 3559291 - RNA, 13 nt, Pseudomonas putida KT2440
gucauccucaggg

SEQ ID NO: 3559292 - RNA, 14 nt, Pseudomonas putida KT2440
gucaucgaacaccu

SEQ ID NO: 3559293 - RNA, 22 nt, Pseudomonas putida KT2440
gucaucgaagaucagcucaugg

SEQ ID NO: 3559294 - RNA, 20 nt, Pseudomonas putida KT2440
gucaucgggaucagcacgcc

SEQ ID NO: 3559295 - RNA, 16 nt, Pseudomonas putida KT2440
gucaucugaggcccga

SEQ ID NO: 3559296 - RNA, 14 nt, Pseudomonas putida KT2440
gucaucugcgcacg

SEQ ID NO: 3559297 - RNA, 15 nt, Pseudomonas putida KT2440
gucaugcagcgccaa

SEQ ID NO: 3559298 - RNA, 20 nt, Pseudomonas putida KT2440
gucaugccauccucggccag

SEQ ID NO: 3559299 - RNA, 13 nt, Pseudomonas putida KT2440
gucaugcgguaca

SEQ ID NO: 3559300 - RNA, 16 nt, Pseudomonas putida KT2440
gucaugcgguacagca

SEQ ID NO: 3559301 - RNA, 19 nt, Pseudomonas putida KT2440
gucaugcgguacagcacug

SEQ ID NO: 3559302 - RNA, 17 nt, Pseudomonas putida KT2440
gucaugggucacucccg

SEQ ID NO: 3559303 - RNA, 19 nt, Pseudomonas putida KT2440
gucaugguccuugaacggc

SEQ ID NO: 3559304 - RNA, 17 nt, Pseudomonas putida KT2440
gucauucaaggucagcu

SEQ ID NO: 3559305 - RNA, 14 nt, Pseudomonas putida KT2440
gucauugaaggcca

SEQ ID NO: 3559306 - RNA, 15 nt, Pseudomonas putida KT2440
gucauugcucaccgu

SEQ ID NO: 3559307 - RNA, 18 nt, Pseudomonas putida KT2440
guccaaauugggcugggc

SEQ ID NO: 3559308 - RNA, 19 nt, Pseudomonas putida KT2440
guccaaccgcaagcggcuc

SEQ ID NO: 3559309 - RNA, 19 nt, Pseudomonas putida KT2440
guccacaccaaagucagcc

SEQ ID NO: 3559310 - RNA, 15 nt, Pseudomonas putida KT2440
guccacagcgaugaa

SEQ ID NO: 3559311 - RNA, 16 nt, Pseudomonas putida KT2440
guccaccagcaggcug

SEQ ID NO: 3559312 - RNA, 22 nt, Pseudomonas putida KT2440
guccaccaucuccagcucgccg

SEQ ID NO: 3559313 - RNA, 20 nt, Pseudomonas putida KT2440
guccaccccacccucguaac

SEQ ID NO: 3559314 - RNA, 19 nt, Pseudomonas putida KT2440
guccacccccgucucggca

SEQ ID NO: 3559315 - RNA, 17 nt, Pseudomonas putida KT2440
guccaccgcgcaacgcg

SEQ ID NO: 3559316 - RNA, 17 nt, Pseudomonas putida KT2440
guccaccucugcggccu

SEQ ID NO: 3559317 - RNA, 14 nt, Pseudomonas putida KT2440
guccacgaaccugu

SEQ ID NO: 3559318 - RNA, 17 nt, Pseudomonas putida KT2440
guccacgcgcaggccac

SEQ ID NO: 3559319 - RNA, 21 nt, Pseudomonas putida KT2440
guccacgcgcaggccacggua

SEQ ID NO: 3559320 - RNA, 14 nt, Pseudomonas putida KT2440
guccacgcuuacag

SEQ ID NO: 3559321 - RNA, 16 nt, Pseudomonas putida KT2440
guccacgguucuggca

SEQ ID NO: 3559322 - RNA, 18 nt, Pseudomonas putida KT2440
guccacuaccuccagccc

SEQ ID NO: 3559323 - RNA, 15 nt, Pseudomonas putida KT2440
guccacucaccggca

SEQ ID NO: 3559324 - RNA, 16 nt, Pseudomonas putida KT2440
guccacucaccggcau

SEQ ID NO: 3559325 - RNA, 20 nt, Pseudomonas putida KT2440
guccacugcacccgugcagg

SEQ ID NO: 3559326 - RNA, 17 nt, Pseudomonas putida KT2440
guccacugcggacagca

SEQ ID NO: 3559327 - RNA, 18 nt, Pseudomonas putida KT2440
guccacuugcguucgccg

SEQ ID NO: 3559328 - RNA, 19 nt, Pseudomonas putida KT2440
guccagaaaauaugcuguu

SEQ ID NO: 3559329 - RNA, 13 nt, Pseudomonas putida KT2440
guccagacgccgc

SEQ ID NO: 3559330 - RNA, 20 nt, Pseudomonas putida KT2440
guccagacgccgcagugaca

SEQ ID NO: 3559331 - RNA, 14 nt, Pseudomonas putida KT2440
guccagagggccug

SEQ ID NO: 3559332 - RNA, 15 nt, Pseudomonas putida KT2440
guccagcaacagcug

SEQ ID NO: 3559333 - RNA, 20 nt, Pseudomonas putida KT2440
guccagcaacagcugccggg

SEQ ID NO: 3559334 - RNA, 21 nt, Pseudomonas putida KT2440
guccagcaagcucaucaccag

SEQ ID NO: 3559335 - RNA, 15 nt, Pseudomonas putida KT2440
guccagcaagggccu

SEQ ID NO: 3559336 - RNA, 15 nt, Pseudomonas putida KT2440
guccagcacacugag

SEQ ID NO: 3559337 - RNA, 13 nt, Pseudomonas putida KT2440
guccagcagcagc

SEQ ID NO: 3559338 - RNA, 21 nt, Pseudomonas putida KT2440
guccagcagguuggacagcgc

SEQ ID NO: 3559339 - RNA, 21 nt, Pseudomonas putida KT2440
guccagcagguuuuccagccc

SEQ ID NO: 3559340 - RNA, 23 nt, Pseudomonas putida KT2440
guccagcagguuuuccagcccgu

SEQ ID NO: 3559341 - RNA, 14 nt, Pseudomonas putida KT2440
guccagcagugcca

SEQ ID NO: 3559342 - RNA, 19 nt, Pseudomonas putida KT2440
guccagcgcaucaacgccu

SEQ ID NO: 3559343 - RNA, 17 nt, Pseudomonas putida KT2440
guccagcgcggccacgc

SEQ ID NO: 3559344 - RNA, 22 nt, Pseudomonas putida KT2440
guccagcgucugcuugcccaga

SEQ ID NO: 3559345 - RNA, 17 nt, Pseudomonas putida KT2440
guccagcguucggccag

SEQ ID NO: 3559346 - RNA, 15 nt, Pseudomonas putida KT2440
guccagcucaacgcg

SEQ ID NO: 3559347 - RNA, 12 nt, Pseudomonas putida KT2440
guccagcucgcg

SEQ ID NO: 3559348 - RNA, 22 nt, Pseudomonas putida KT2440
guccagcucgcgcagggcaucg

SEQ ID NO: 3559349 - RNA, 22 nt, Pseudomonas putida KT2440
guccaggaacgcugccuccaca

SEQ ID NO: 3559350 - RNA, 20 nt, Pseudomonas putida KT2440
guccaggcccgccagagcau

SEQ ID NO: 3559351 - RNA, 13 nt, Pseudomonas putida KT2440
guccaggcucagc

SEQ ID NO: 3559352 - RNA, 15 nt, Pseudomonas putida KT2440
guccaggcucagcuc

SEQ ID NO: 3559353 - RNA, 20 nt, Pseudomonas putida KT2440
guccagguaguacggcaggc

SEQ ID NO: 3559354 - RNA, 23 nt, Pseudomonas putida KT2440
guccagguaguacggcaggcgaa

SEQ ID NO: 3559355 - RNA, 17 nt, Pseudomonas putida KT2440
guccagguccaggccag

SEQ ID NO: 3559356 - RNA, 21 nt, Pseudomonas putida KT2440
guccagguuuggguuggcuuu

SEQ ID NO: 3559357 - RNA, 15 nt, Pseudomonas putida KT2440
guccagugcggugga

SEQ ID NO: 3559358 - RNA, 19 nt, Pseudomonas putida KT2440
gucgagcagggugccuuca

SEQ ID NO: 3559359 - RNA, 20 nt, Pseudomonas putida KT2440
gucgagcaggucgaucccgg

SEQ ID NO: 3559360 - RNA, 15 nt, Pseudomonas putida KT2440
gucgagcaucugcug

SEQ ID NO: 3559361 - RNA, 13 nt, Pseudomonas putida KT2440
gucgagccaggcg

SEQ ID NO: 3559362 - RNA, 18 nt, Pseudomonas putida KT2440
gucgagcucgaucggcaa

SEQ ID NO: 3559363 - RNA, 20 nt, Pseudomonas putida KT2440
gucgaggcugucgaucagac

SEQ ID NO: 3559364 - RNA, 13 nt, Pseudomonas putida KT2440
gucgagguugcgc

SEQ ID NO: 3559365 - RNA, 17 nt, Pseudomonas putida KT2440
gucgaucagauaaguca

SEQ ID NO: 3559366 - RNA, 15 nt, Pseudomonas putida KT2440
gucgaucagcggcuc

SEQ ID NO: 3559367 - RNA, 20 nt, Pseudomonas putida KT2440
gucgaucagcuugugaaccc

SEQ ID NO: 3559368 - RNA, 13 nt, Pseudomonas putida KT2440
gucgauccaggug

SEQ ID NO: 3559369 - RNA, 17 nt, Pseudomonas putida KT2440
gucgaucccgccgagca

SEQ ID NO: 3559370 - RNA, 16 nt, Pseudomonas putida KT2440
gucgauccgggugcug

SEQ ID NO: 3559371 - RNA, 15 nt, Pseudomonas putida KT2440
gucgaucuccaggug

SEQ ID NO: 3559372 - RNA, 16 nt, Pseudomonas putida KT2440
gucgaucugcaggugg

SEQ ID NO: 3559373 - RNA, 22 nt, Pseudomonas putida KT2440
gucgaucuucgccggcaucgcc

SEQ ID NO: 3559374 - RNA, 16 nt, Pseudomonas putida KT2440
gucgaugaucgccgcc

SEQ ID NO: 3559375 - RNA, 18 nt, Pseudomonas putida KT2440
gucgaugaucgccgccgc

SEQ ID NO: 3559376 - RNA, 13 nt, Pseudomonas putida KT2440
gucgaugaugcgu

SEQ ID NO: 3559377 - RNA, 15 nt, Pseudomonas putida KT2440
gucgaugauggcugc

SEQ ID NO: 3559378 - RNA, 18 nt, Pseudomonas putida KT2440
gucgaugauggcugccag

SEQ ID NO: 3559379 - RNA, 20 nt, Pseudomonas putida KT2440
gucgaugauggucgcgacga

SEQ ID NO: 3559380 - RNA, 15 nt, Pseudomonas putida KT2440
gucgaugcaggagcg

SEQ ID NO: 3559381 - RNA, 20 nt, Pseudomonas putida KT2440
gucgaugccuacugcuggcg

SEQ ID NO: 3559382 - RNA, 17 nt, Pseudomonas putida KT2440
gucgaugccugugucga

SEQ ID NO: 3559383 - RNA, 21 nt, Pseudomonas putida KT2440
gucgaugccugugucgaacca

SEQ ID NO: 3559384 - RNA, 22 nt, Pseudomonas putida KT2440
gucgaugccuuccaggcgacgg

SEQ ID NO: 3559385 - RNA, 17 nt, Pseudomonas putida KT2440
gucgaugcggccacagc

SEQ ID NO: 3559386 - RNA, 13 nt, Pseudomonas putida KT2440
gucgaugcugcug

SEQ ID NO: 3559387 - RNA, 16 nt, Pseudomonas putida KT2440
gucgauggcggugcgc

SEQ ID NO: 3559388 - RNA, 16 nt, Pseudomonas putida KT2440
gucgaugucugccgcu

SEQ ID NO: 3559389 - RNA, 16 nt, Pseudomonas putida KT2440
gucgauguucagcacc

SEQ ID NO: 3559390 - RNA, 22 nt, Pseudomonas putida KT2440
gucgauuacccagcgcgaagcc

SEQ ID NO: 3559391 - RNA, 15 nt, Pseudomonas putida KT2440
gucgauuuucacgcc

SEQ ID NO: 3559392 - RNA, 21 nt, Pseudomonas putida KT2440
gucgcacagguccagccgcca

SEQ ID NO: 3559393 - RNA, 17 nt, Pseudomonas putida KT2440
gucgcacaugaagccgc

SEQ ID NO: 3559394 - RNA, 19 nt, Pseudomonas putida KT2440
gucgcacaugaagccgcgc

SEQ ID NO: 3559395 - RNA, 14 nt, Pseudomonas putida KT2440
gucgcacccaccgc

SEQ ID NO: 3559396 - RNA, 14 nt, Pseudomonas putida KT2440
gucgcacucggcaa

SEQ ID NO: 3559397 - RNA, 14 nt, Pseudomonas putida KT2440
gucgcaucgacagg

SEQ ID NO: 3559398 - RNA, 18 nt, Pseudomonas putida KT2440
gucgcaucgacaggucca

SEQ ID NO: 3559399 - RNA, 15 nt, Pseudomonas putida KT2440
gucgccaaacaguug

SEQ ID NO: 3559400 - RNA, 16 nt, Pseudomonas putida KT2440
gucgccaaccgccagc

SEQ ID NO: 3559401 - RNA, 14 nt, Pseudomonas putida KT2440
gucgccacgcgggc

SEQ ID NO: 3559402 - RNA, 16 nt, Pseudomonas putida KT2440
gucgccaggaucaccu

SEQ ID NO: 3559403 - RNA, 13 nt, Pseudomonas putida KT2440
gucgccaggcuuc

SEQ ID NO: 3559404 - RNA, 20 nt, Pseudomonas putida KT2440
gucgccagugaacaccacug

SEQ ID NO: 3559405 - RNA, 21 nt, Pseudomonas putida KT2440
gucgccccgccagcgccuggc

SEQ ID NO: 3559406 - RNA, 20 nt, Pseudomonas putida KT2440
gucgcccuuugguacugcgc

SEQ ID NO: 3559407 - RNA, 19 nt, Pseudomonas putida KT2440
gucgccgaaccccaccagc

SEQ ID NO: 3559408 - RNA, 20 nt, Pseudomonas putida KT2440
gucgccgaaccccaccagca

SEQ ID NO: 3559409 - RNA, 12 nt, Pseudomonas putida KT2440
gucgccgauacc

SEQ ID NO: 3559410 - RNA, 20 nt, Pseudomonas putida KT2440
gucgccgccgucgggugcgc

SEQ ID NO: 3559411 - RNA, 23 nt, Pseudomonas putida KT2440
gucgccgccgucgggugcgccag

SEQ ID NO: 3559412 - RNA, 18 nt, Pseudomonas putida KT2440
gucgccgucgcacaggcg

SEQ ID NO: 3559413 - RNA, 19 nt, Pseudomonas putida KT2440
gucgccgugcaacgccggu

SEQ ID NO: 3559414 - RNA, 18 nt, Pseudomonas putida KT2440
gucgccucgacgcagaca

SEQ ID NO: 3559415 - RNA, 13 nt, Pseudomonas putida KT2440
gucgccugaacgc

SEQ ID NO: 3559416 - RNA, 20 nt, Pseudomonas putida KT2440
gucgccuucacacaggcugu

SEQ ID NO: 3559417 - RNA, 19 nt, Pseudomonas putida KT2440
gucgccuuuuuuccaguug

SEQ ID NO: 3559418 - RNA, 18 nt, Pseudomonas putida KT2440
gucgcgaaagggccgcaa

SEQ ID NO: 3559419 - RNA, 15 nt, Pseudomonas putida KT2440
gucgcgaaaggggcg

SEQ ID NO: 3559420 - RNA, 18 nt, Pseudomonas putida KT2440
gucgcgagucaggcugca

SEQ ID NO: 3559421 - RNA, 19 nt, Pseudomonas putida KT2440
gucgcgauaggggcccgca

SEQ ID NO: 3559422 - RNA, 15 nt, Pseudomonas putida KT2440
gucgcgaugggcugc

SEQ ID NO: 3559423 - RNA, 12 nt, Pseudomonas putida KT2440
gucgcgcagggc

SEQ ID NO: 3559424 - RNA, 21 nt, Pseudomonas putida KT2440
gucgcgccaguuccacgaccg

SEQ ID NO: 3559425 - RNA, 19 nt, Pseudomonas putida KT2440
gucgcgccccaagcgggcc

SEQ ID NO: 3559426 - RNA, 23 nt, Pseudomonas putida KT2440
gucgcggccuacccgggcgcagg

SEQ ID NO: 3559427 - RNA, 12 nt, Pseudomonas putida KT2440
gucgcggcgcug

SEQ ID NO: 3559428 - RNA, 14 nt, Pseudomonas putida KT2440
gucgcggcgcuggc

SEQ ID NO: 3559429 - RNA, 16 nt, Pseudomonas putida KT2440
gucgcggcgcuggccg

SEQ ID NO: 3559430 - RNA, 14 nt, Pseudomonas putida KT2440
gucgcgggccagcc

SEQ ID NO: 3559431 - RNA, 22 nt, Pseudomonas putida KT2440
gucgcgggccagcccauccagg

SEQ ID NO: 3559432 - RNA, 18 nt, Pseudomonas putida KT2440
gucgcgguucgacugccg

SEQ ID NO: 3559433 - RNA, 15 nt, Pseudomonas putida KT2440
gucgcgucgcccaga

SEQ ID NO: 3559434 - RNA, 16 nt, Pseudomonas putida KT2440
gucgcguuguucagca

SEQ ID NO: 3559435 - RNA, 19 nt, Pseudomonas putida KT2440
gucgcguuguucagcagcg

SEQ ID NO: 3559436 - RNA, 12 nt, Pseudomonas putida KT2440
gucgcuacgcgc

SEQ ID NO: 3559437 - RNA, 21 nt, Pseudomonas putida KT2440
gucgcuaucggcaggcuggau

SEQ ID NO: 3559438 - RNA, 22 nt, Pseudomonas putida KT2440
gucgcucaacuccauggccagg

SEQ ID NO: 3559439 - RNA, 14 nt, Pseudomonas putida KT2440
gucgcucuucaacc

SEQ ID NO: 3559440 - RNA, 22 nt, Pseudomonas putida KT2440
gucgcugccgccaaccagcuca

SEQ ID NO: 3559441 - RNA, 17 nt, Pseudomonas putida KT2440
gucgcugccgugcaggu

SEQ ID NO: 3559442 - RNA, 22 nt, Pseudomonas putida KT2440
gucgcuguucuugaacucgccg

SEQ ID NO: 3559443 - RNA, 18 nt, Pseudomonas putida KT2440
gucgcuugucgccacccg

SEQ ID NO: 3559444 - RNA, 13 nt, Pseudomonas putida KT2440
gucgcuuugcggg

SEQ ID NO: 3559445 - RNA, 21 nt, Pseudomonas putida KT2440
gucggaucgaaacauugacag

SEQ ID NO: 3559446 - RNA, 19 nt, Pseudomonas putida KT2440
gucggcaaucugcucgacg

SEQ ID NO: 3559447 - RNA, 20 nt, Pseudomonas putida KT2440
gucggcaaucugcucgacga

SEQ ID NO: 3559448 - RNA, 16 nt, Pseudomonas putida KT2440
gucggcacgagcaugc

SEQ ID NO: 3559449 - RNA, 14 nt, Pseudomonas putida KT2440
gucggcacgguguc

SEQ ID NO: 3559450 - RNA, 15 nt, Pseudomonas putida KT2440
gucggcagagcgcca

SEQ ID NO: 3559451 - RNA, 17 nt, Pseudomonas putida KT2440
gucggcagagcgccagc

SEQ ID NO: 3559452 - RNA, 20 nt, Pseudomonas putida KT2440
gucggcagcucaaccgacac

SEQ ID NO: 3559453 - RNA, 15 nt, Pseudomonas putida KT2440
gucggcauacagcuc

SEQ ID NO: 3559454 - RNA, 15 nt, Pseudomonas putida KT2440
gucggcaugcacuuc

SEQ ID NO: 3559455 - RNA, 14 nt, Pseudomonas putida KT2440
gucggccagcugcu

SEQ ID NO: 3559456 - RNA, 15 nt, Pseudomonas putida KT2440
gucggccagcugcug

SEQ ID NO: 3559457 - RNA, 14 nt, Pseudomonas putida KT2440
gucggccaucgacg

SEQ ID NO: 3559458 - RNA, 13 nt, Pseudomonas putida KT2440
gucggcccacugc

SEQ ID NO: 3559459 - RNA, 17 nt, Pseudomonas putida KT2440
gucggccgcauccaugc

SEQ ID NO: 3559460 - RNA, 23 nt, Pseudomonas putida KT2440
gucggccugcacuaccucgcuca

SEQ ID NO: 3559461 - RNA, 20 nt, Pseudomonas putida KT2440
gucggccugcccgguacgca

SEQ ID NO: 3559462 - RNA, 13 nt, Pseudomonas putida KT2440
gucggcgaaggcu

SEQ ID NO: 3559463 - RNA, 14 nt, Pseudomonas putida KT2440
gucggcgccaggcc

SEQ ID NO: 3559464 - RNA, 15 nt, Pseudomonas putida KT2440
gucuucguugucgcc

SEQ ID NO: 3559465 - RNA, 17 nt, Pseudomonas putida KT2440
gucuuguaucccaggcg

SEQ ID NO: 3559466 - RNA, 22 nt, Pseudomonas putida KT2440
gugaaaaugcuggucgaacaac

SEQ ID NO: 3559467 - RNA, 22 nt, Pseudomonas putida KT2440
gugaaaccgaaaaagccuacac

SEQ ID NO: 3559468 - RNA, 19 nt, Pseudomonas putida KT2440
gugaaagucgaccagcagc

SEQ ID NO: 3559469 - RNA, 22 nt, Pseudomonas putida KT2440
gugaaccccaccccagcguucc

SEQ ID NO: 3559470 - RNA, 22 nt, Pseudomonas putida KT2440
gugaacgaucagggaugcugga

SEQ ID NO: 3559471 - RNA, 13 nt, Pseudomonas putida KT2440
gugaacggcgggu

SEQ ID NO: 3559472 - RNA, 21 nt, Pseudomonas putida KT2440
gugaagaauucaggcaucuga

SEQ ID NO: 3559473 - RNA, 13 nt, Pseudomonas putida KT2440
gugaagaucgccg

SEQ ID NO: 3559474 - RNA, 14 nt, Pseudomonas putida KT2440
gugaagcccugcug

SEQ ID NO: 3559475 - RNA, 18 nt, Pseudomonas putida KT2440
gugaagcggacagcuauc

SEQ ID NO: 3559476 - RNA, 23 nt, Pseudomonas putida KT2440
gugaagcucgaucugccugccuc

SEQ ID NO: 3559477 - RNA, 20 nt, Pseudomonas putida KT2440
gugaaggccaggaacagcgc

SEQ ID NO: 3559478 - RNA, 23 nt, Pseudomonas putida KT2440
gugaaggccaggaacagcgcagc

SEQ ID NO: 3559479 - RNA, 15 nt, Pseudomonas putida KT2440
gugaaucgcgcuugc

SEQ ID NO: 3559480 - RNA, 17 nt, Pseudomonas putida KT2440
gugaauuccuugcagcu

SEQ ID NO: 3559481 - RNA, 14 nt, Pseudomonas putida KT2440
gugacaagcugcgc

SEQ ID NO: 3559482 - RNA, 18 nt, Pseudomonas putida KT2440
gugaccagcggcagcaag

SEQ ID NO: 3559483 - RNA, 18 nt, Pseudomonas putida KT2440
gugaccaggcccagcagg

SEQ ID NO: 3559484 - RNA, 20 nt, Pseudomonas putida KT2440
gugaccaggcccagcaggua

SEQ ID NO: 3559485 - RNA, 17 nt, Pseudomonas putida KT2440
gugacccaguucgcgga

SEQ ID NO: 3559486 - RNA, 21 nt, Pseudomonas putida KT2440
gugaccgguuuuggcaggccg

SEQ ID NO: 3559487 - RNA, 16 nt, Pseudomonas putida KT2440
gugacgccgugggcua

SEQ ID NO: 3559488 - RNA, 13 nt, Pseudomonas putida KT2440
gugacgcuggucg

SEQ ID NO: 3559489 - RNA, 13 nt, Pseudomonas putida KT2440
gugacuagaggau

SEQ ID NO: 3559490 - RNA, 16 nt, Pseudomonas putida KT2440
gugacuaguggccacu

SEQ ID NO: 3559491 - RNA, 13 nt, Pseudomonas putida KT2440
gugacugaugaug

SEQ ID NO: 3559492 - RNA, 14 nt, Pseudomonas putida KT2440
gugacugaugauga

SEQ ID NO: 3559493 - RNA, 14 nt, Pseudomonas putida KT2440
gugacugccagcac

SEQ ID NO: 3559494 - RNA, 15 nt, Pseudomonas putida KT2440
gugacugccagcacg

SEQ ID NO: 3559495 - RNA, 19 nt, Pseudomonas putida KT2440
gugacuggaacugguugac

SEQ ID NO: 3559496 - RNA, 21 nt, Pseudomonas putida KT2440
gugagccaugccguaagccgc

SEQ ID NO: 3559497 - RNA, 11 nt, Pseudomonas putida KT2440
gugagcccugu

SEQ ID NO: 3559498 - RNA, 22 nt, Pseudomonas putida KT2440
gugagccugcacccgcgcgccc

SEQ ID NO: 3559499 - RNA, 19 nt, Pseudomonas putida KT2440
gugaggcauggaagggcgg

SEQ ID NO: 3559500 - RNA, 23 nt, Pseudomonas putida KT2440
gugaggccuucagcgcggcaacc

SEQ ID NO: 3559501 - RNA, 21 nt, Pseudomonas putida KT2440
gugauacagcacgcgcaugcc

SEQ ID NO: 3559502 - RNA, 15 nt, Pseudomonas putida KT2440
gugauaguccagcaa

SEQ ID NO: 3559503 - RNA, 17 nt, Pseudomonas putida KT2440
gugaucagcaaugccag

SEQ ID NO: 3559504 - RNA, 19 nt, Pseudomonas putida KT2440
gugaucgccacaacggcgc

SEQ ID NO: 3559505 - RNA, 18 nt, Pseudomonas putida KT2440
gugaucgccucgugcagc

SEQ ID NO: 3559506 - RNA, 15 nt, Pseudomonas putida KT2440
gugaucgcgcuggca

SEQ ID NO: 3559507 - RNA, 17 nt, Pseudomonas putida KT2440
gugaucguacgccggcg

SEQ ID NO: 3559508 - RNA, 17 nt, Pseudomonas putida KT2440
gugaucguugcgcgcca

SEQ ID NO: 3559509 - RNA, 20 nt, Pseudomonas putida KT2440
gugaugccccugcgccgcca

SEQ ID NO: 3559510 - RNA, 15 nt, Pseudomonas putida KT2440
gugauggcgcauggc

SEQ ID NO: 3559511 - RNA, 16 nt, Pseudomonas putida KT2440
gugauguugcccggca

SEQ ID NO: 3559512 - RNA, 21 nt, Pseudomonas putida KT2440
gugcaaaaccugccggugcgc

SEQ ID NO: 3559513 - RNA, 24 nt, Pseudomonas putida KT2440
gugcaaaaccugccggugcgcggg

SEQ ID NO: 3559514 - RNA, 14 nt, Pseudomonas putida KT2440
gugcaaacacccag

SEQ ID NO: 3559515 - RNA, 14 nt, Pseudomonas putida KT2440
gugcaaagcgcccc

SEQ ID NO: 3559516 - RNA, 18 nt, Pseudomonas putida KT2440
gugcaacugguucuccag

SEQ ID NO: 3559517 - RNA, 20 nt, Pseudomonas putida KT2440
gugcaaggaucaccaaggcu

SEQ ID NO: 3559518 - RNA, 21 nt, Pseudomonas putida KT2440
gugcaagggauaucaggcccu

SEQ ID NO: 3559519 - RNA, 18 nt, Pseudomonas putida KT2440
gugcaauaccagccuggc

SEQ ID NO: 3559520 - RNA, 23 nt, Pseudomonas putida KT2440
gugcaauaccagccuggccccac

SEQ ID NO: 3559521 - RNA, 20 nt, Pseudomonas putida KT2440
gugcaaucaggucucccgcc

SEQ ID NO: 3559522 - RNA, 21 nt, Pseudomonas putida KT2440
gugcaaucaggucucccgccc

SEQ ID NO: 3559523 - RNA, 16 nt, Pseudomonas putida KT2440
gugcaauugcaguuga

SEQ ID NO: 3559524 - RNA, 16 nt, Pseudomonas putida KT2440
gugcacaaagcccaag

SEQ ID NO: 3559525 - RNA, 21 nt, Pseudomonas putida KT2440
gugcacaagcugcugauaauu

SEQ ID NO: 3559526 - RNA, 19 nt, Pseudomonas putida KT2440
gugcacacgcaacugaugg

SEQ ID NO: 3559527 - RNA, 18 nt, Pseudomonas putida KT2440
gugcacagccgugccuuc

SEQ ID NO: 3559528 - RNA, 16 nt, Pseudomonas putida KT2440
gugcacagggcggcca

SEQ ID NO: 3559529 - RNA, 21 nt, Pseudomonas putida KT2440
gugcacagggcggccaaggcg

SEQ ID NO: 3559530 - RNA, 17 nt, Pseudomonas putida KT2440
gugcaccaacacuucca

SEQ ID NO: 3559531 - RNA, 23 nt, Pseudomonas putida KT2440
gugcaccaacacuuccagcaucg

SEQ ID NO: 3559532 - RNA, 14 nt, Pseudomonas putida KT2440
gugcaccagcacca

SEQ ID NO: 3559533 - RNA, 22 nt, Pseudomonas putida KT2440
gugcaccagcuugugccgcugc

SEQ ID NO: 3559534 - RNA, 21 nt, Pseudomonas putida KT2440
gugcacccaaccugccgaucu

SEQ ID NO: 3559535 - RNA, 15 nt, Pseudomonas putida KT2440
gugcacccacuggcc

SEQ ID NO: 3559536 - RNA, 16 nt, Pseudomonas putida KT2440
gugcacccgugccugc

SEQ ID NO: 3559537 - RNA, 20 nt, Pseudomonas putida KT2440
gugcaccgcucagugccggg

SEQ ID NO: 3559538 - RNA, 13 nt, Pseudomonas putida KT2440
gugcaccuccgcc

SEQ ID NO: 3559539 - RNA, 20 nt, Pseudomonas putida KT2440
gugcacgaacacguccagcc

SEQ ID NO: 3559540 - RNA, 21 nt, Pseudomonas putida KT2440
gugcacgaacacguccagccc

SEQ ID NO: 3559541 - RNA, 15 nt, Pseudomonas putida KT2440
gugcacgccagccag

SEQ ID NO: 3559542 - RNA, 16 nt, Pseudomonas putida KT2440
gugcacgcgggcgcga

SEQ ID NO: 3559543 - RNA, 18 nt, Pseudomonas putida KT2440
gugcacggguucacggaa

SEQ ID NO: 3559544 - RNA, 22 nt, Pseudomonas putida KT2440
gugcacugcgaagcccaguucg

SEQ ID NO: 3559545 - RNA, 16 nt, Pseudomonas putida KT2440
gugcacuggcaggccu

SEQ ID NO: 3559546 - RNA, 21 nt, Pseudomonas putida KT2440
gugcagaacguacuggccgcu

SEQ ID NO: 3559547 - RNA, 19 nt, Pseudomonas putida KT2440
gugcagaccugugggagcg

SEQ ID NO: 3559548 - RNA, 15 nt, Pseudomonas putida KT2440
gugcagauccaggug

SEQ ID NO: 3559549 - RNA, 22 nt, Pseudomonas putida KT2440
gugcagauccaggugcccauga

SEQ ID NO: 3559550 - RNA, 21 nt, Pseudomonas putida KT2440
gugcagauugcccuguggcug

SEQ ID NO: 3559551 - RNA, 13 nt, Pseudomonas putida KT2440
gugcagcaccucc

SEQ ID NO: 3559552 - RNA, 16 nt, Pseudomonas putida KT2440
gugcagcaccuccacc

SEQ ID NO: 3559553 - RNA, 23 nt, Pseudomonas putida KT2440
gugcagcacggaaucacgcggcg

SEQ ID NO: 3559554 - RNA, 15 nt, Pseudomonas putida KT2440
gugcagcugaugagg

SEQ ID NO: 3559555 - RNA, 18 nt, Pseudomonas putida KT2440
gugcagcugcaccgaccg

SEQ ID NO: 3559556 - RNA, 21 nt, Pseudomonas putida KT2440
gugcaggaucuucaugccauu

SEQ ID NO: 3559557 - RNA, 20 nt, Pseudomonas putida KT2440
gugcagggaagggcaaugau

SEQ ID NO: 3559558 - RNA, 22 nt, Pseudomonas putida KT2440
gugcagggaagggcaaugauca

SEQ ID NO: 3559559 - RNA, 11 nt, Pseudomonas putida KT2440
gugcagggcug

SEQ ID NO: 3559560 - RNA, 21 nt, Pseudomonas putida KT2440
gugcaggggucugugcagcga

SEQ ID NO: 3559561 - RNA, 16 nt, Pseudomonas putida KT2440
gugcaggguaggggug

SEQ ID NO: 3559562 - RNA, 13 nt, Pseudomonas putida KT2440
gugcaggucagcg

SEQ ID NO: 3559563 - RNA, 21 nt, Pseudomonas putida KT2440
gugcaggucgauguccaggcc

SEQ ID NO: 3559564 - RNA, 15 nt, Pseudomonas putida KT2440
gugcagguucgacca

SEQ ID NO: 3559565 - RNA, 15 nt, Pseudomonas putida KT2440
gugcagguuggagcg

SEQ ID NO: 3559566 - RNA, 20 nt, Pseudomonas putida KT2440
gugcaguguguugcggugga

SEQ ID NO: 3559567 - RNA, 19 nt, Pseudomonas putida KT2440
gugcaucaagucgcccagu

SEQ ID NO: 3559568 - RNA, 23 nt, Pseudomonas putida KT2440
gugcucacgccccuuggcacggc

SEQ ID NO: 3559569 - RNA, 22 nt, Pseudomonas putida KT2440
gugcucagcacauucagcagcg

SEQ ID NO: 3559570 - RNA, 12 nt, Pseudomonas putida KT2440
gugcucaggcuc

SEQ ID NO: 3559571 - RNA, 15 nt, Pseudomonas putida KT2440
gugcucaucggcggc

SEQ ID NO: 3559572 - RNA, 16 nt, Pseudomonas putida KT2440
gugcucaugauccagu

SEQ ID NO: 3559573 - RNA, 15 nt, Pseudomonas putida KT2440
gugcuccagcuccag

SEQ ID NO: 3559574 - RNA, 19 nt, Pseudomonas putida KT2440
gugcuccaggccugcggca

SEQ ID NO: 3559575 - RNA, 23 nt, Pseudomonas putida KT2440
gugcucgaacucuuccagcucgc

SEQ ID NO: 3559576 - RNA, 20 nt, Pseudomonas putida KT2440
gugcucgaucagauaggcgc

SEQ ID NO: 3559577 - RNA, 18 nt, Pseudomonas putida KT2440
gugcucgaugcgcacggc

SEQ ID NO: 3559578 - RNA, 16 nt, Pseudomonas putida KT2440
gugcucgccucacagc

SEQ ID NO: 3559579 - RNA, 12 nt, Pseudomonas putida KT2440
gugcucggccug

SEQ ID NO: 3559580 - RNA, 13 nt, Pseudomonas putida KT2440
gugcucggccugg

SEQ ID NO: 3559581 - RNA, 14 nt, Pseudomonas putida KT2440
gugcucggccuugc

SEQ ID NO: 3559582 - RNA, 19 nt, Pseudomonas putida KT2440
gugcucggguucguacagg

SEQ ID NO: 3559583 - RNA, 13 nt, Pseudomonas putida KT2440
gugcucguccagu

SEQ ID NO: 3559584 - RNA, 18 nt, Pseudomonas putida KT2440
gugcucgucuucgaucug

SEQ ID NO: 3559585 - RNA, 22 nt, Pseudomonas putida KT2440
gugcucugccgcaccaggucca

SEQ ID NO: 3559586 - RNA, 22 nt, Pseudomonas putida KT2440
gugcugcaaaugggucgcgaag

SEQ ID NO: 3559587 - RNA, 15 nt, Pseudomonas putida KT2440
gugcugcaggcuggc

SEQ ID NO: 3559588 - RNA, 13 nt, Pseudomonas putida KT2440
gugcugccgaggc

SEQ ID NO: 3559589 - RNA, 21 nt, Pseudomonas putida KT2440
gugcugccggucggccugcac

SEQ ID NO: 3559590 - RNA, 19 nt, Pseudomonas putida KT2440
gugcugcgaguucaggcgc

SEQ ID NO: 3559591 - RNA, 17 nt, Pseudomonas putida KT2440
gugcuggcugaucagca

SEQ ID NO: 3559592 - RNA, 17 nt, Pseudomonas putida KT2440
gugcugguccuccccuu

SEQ ID NO: 3559593 - RNA, 15 nt, Pseudomonas putida KT2440
gugcugguggccacg

SEQ ID NO: 3559594 - RNA, 15 nt, Pseudomonas putida KT2440
gugcugucggugaag

SEQ ID NO: 3559595 - RNA, 12 nt, Pseudomonas putida KT2440
gugcugugcacu

SEQ ID NO: 3559596 - RNA, 14 nt, Pseudomonas putida KT2440
gugcuguugagcca

SEQ ID NO: 3559597 - RNA, 17 nt, Pseudomonas putida KT2440
gugcuucacagcguugc

SEQ ID NO: 3559598 - RNA, 18 nt, Pseudomonas putida KT2440
gugcuucacagcguugca

SEQ ID NO: 3559599 - RNA, 16 nt, Pseudomonas putida KT2440
gugcuucacugccggc

SEQ ID NO: 3559600 - RNA, 21 nt, Pseudomonas putida KT2440
gugcuucaucgcugacuucca

SEQ ID NO: 3559601 - RNA, 21 nt, Pseudomonas putida KT2440
gugcuucuggauaugcuccau

SEQ ID NO: 3559602 - RNA, 14 nt, Pseudomonas putida KT2440
gugcuugugguagu

SEQ ID NO: 3559603 - RNA, 17 nt, Pseudomonas putida KT2440
gugcuugugguagugau

SEQ ID NO: 3559604 - RNA, 22 nt, Pseudomonas putida KT2440
gugcuuuacggcuuguggggcg

SEQ ID NO: 3559605 - RNA, 16 nt, Pseudomonas putida KT2440
guggaaauuggccagc

SEQ ID NO: 3559606 - RNA, 20 nt, Pseudomonas putida KT2440
guggaaauuggccagcaggc

SEQ ID NO: 3559607 - RNA, 20 nt, Pseudomonas putida KT2440
guggaacaggauggcaaagc

SEQ ID NO: 3559608 - RNA, 15 nt, Pseudomonas putida KT2440
guggaagcgcggguu

SEQ ID NO: 3559609 - RNA, 20 nt, Pseudomonas putida KT2440
guggaagcgggcgugcccgc

SEQ ID NO: 3559610 - RNA, 22 nt, Pseudomonas putida KT2440
guggaagugcuucaccuugccu

SEQ ID NO: 3559611 - RNA, 15 nt, Pseudomonas putida KT2440
guggaaucggcucca

SEQ ID NO: 3559612 - RNA, 13 nt, Pseudomonas putida KT2440
guggacagcagcu

SEQ ID NO: 3559613 - RNA, 12 nt, Pseudomonas putida KT2440
guggaccagagc

SEQ ID NO: 3559614 - RNA, 21 nt, Pseudomonas putida KT2440
guggagaucgucguaggagcg

SEQ ID NO: 3559615 - RNA, 18 nt, Pseudomonas putida KT2440
guggaggauauaagccgc

SEQ ID NO: 3559616 - RNA, 13 nt, Pseudomonas putida KT2440
guggaucagccgc

SEQ ID NO: 3559617 - RNA, 18 nt, Pseudomonas putida KT2440
guggaucagccgcgcuga

SEQ ID NO: 3559618 - RNA, 20 nt, Pseudomonas putida KT2440
guggcaacgauugggcggca

SEQ ID NO: 3559619 - RNA, 23 nt, Pseudomonas putida KT2440
guggcaauggccugcaugucggc

SEQ ID NO: 3559620 - RNA, 19 nt, Pseudomonas putida KT2440
guggcaauugcacccgcgg

SEQ ID NO: 3559621 - RNA, 19 nt, Pseudomonas putida KT2440
guggcacccacagcgccug

SEQ ID NO: 3559622 - RNA, 20 nt, Pseudomonas putida KT2440
guggcacccacagcgccugc

SEQ ID NO: 3559623 - RNA, 21 nt, Pseudomonas putida KT2440
guggcacccacagcgccugcu

SEQ ID NO: 3559624 - RNA, 22 nt, Pseudomonas putida KT2440
guggcacccacagcgccugcug

SEQ ID NO: 3559625 - RNA, 19 nt, Pseudomonas putida KT2440
guggcacgcucgcgcagga

SEQ ID NO: 3559626 - RNA, 16 nt, Pseudomonas putida KT2440
guggcagaacucccau

SEQ ID NO: 3559627 - RNA, 13 nt, Pseudomonas putida KT2440
guggcagcccccc

SEQ ID NO: 3559628 - RNA, 16 nt, Pseudomonas putida KT2440
guggcagguucgacca

SEQ ID NO: 3559629 - RNA, 16 nt, Pseudomonas putida KT2440
guggcauagcgcggcg

SEQ ID NO: 3559630 - RNA, 16 nt, Pseudomonas putida KT2440
guggcauuggcgugcu

SEQ ID NO: 3559631 - RNA, 15 nt, Pseudomonas putida KT2440
guggccagugccaug

SEQ ID NO: 3559632 - RNA, 13 nt, Pseudomonas putida KT2440
guggcccaaggcg

SEQ ID NO: 3559633 - RNA, 13 nt, Pseudomonas putida KT2440
guggcccugaccg

SEQ ID NO: 3559634 - RNA, 20 nt, Pseudomonas putida KT2440
guggcccugaccgcggugcu

SEQ ID NO: 3559635 - RNA, 19 nt, Pseudomonas putida KT2440
guggccgccaugaucugcc

SEQ ID NO: 3559636 - RNA, 14 nt, Pseudomonas putida KT2440
guggccgcgcgggu

SEQ ID NO: 3559637 - RNA, 13 nt, Pseudomonas putida KT2440
guggccggcaacg

SEQ ID NO: 3559638 - RNA, 19 nt, Pseudomonas putida KT2440
guggccggcaacggccacg

SEQ ID NO: 3559639 - RNA, 15 nt, Pseudomonas putida KT2440
guggccugagccggu

SEQ ID NO: 3559640 - RNA, 15 nt, Pseudomonas putida KT2440
guggccuucgcgggc

SEQ ID NO: 3559641 - RNA, 22 nt, Pseudomonas putida KT2440
guggcgauccacagcgggucga

SEQ ID NO: 3559642 - RNA, 14 nt, Pseudomonas putida KT2440
guggcgaucccugu

SEQ ID NO: 3559643 - RNA, 21 nt, Pseudomonas putida KT2440
guggcgaucccuguaggagcg

SEQ ID NO: 3559644 - RNA, 12 nt, Pseudomonas putida KT2440
guggcgcagcau

SEQ ID NO: 3559645 - RNA, 16 nt, Pseudomonas putida KT2440
guggcgcagcaucauc

SEQ ID NO: 3559646 - RNA, 19 nt, Pseudomonas putida KT2440
guggcgcagcaucaucucu

SEQ ID NO: 3559647 - RNA, 19 nt, Pseudomonas putida KT2440
guggcgccuaucagaucga

SEQ ID NO: 3559648 - RNA, 19 nt, Pseudomonas putida KT2440
guggcgcugaccaacaggc

SEQ ID NO: 3559649 - RNA, 16 nt, Pseudomonas putida KT2440
guggcggccagcgcau

SEQ ID NO: 3559650 - RNA, 18 nt, Pseudomonas putida KT2440
guggcggccgcagcccca

SEQ ID NO: 3559651 - RNA, 13 nt, Pseudomonas putida KT2440
guggcguaccggg

SEQ ID NO: 3559652 - RNA, 18 nt, Pseudomonas putida KT2440
guggcguggccacgcccg

SEQ ID NO: 3559653 - RNA, 16 nt, Pseudomonas putida KT2440
guggcguugucagcaa

SEQ ID NO: 3559654 - RNA, 19 nt, Pseudomonas putida KT2440
guggcguugucagcaaccg

SEQ ID NO: 3559655 - RNA, 21 nt, Pseudomonas putida KT2440
guggcugccacgggcauagcc

SEQ ID NO: 3559656 - RNA, 17 nt, Pseudomonas putida KT2440
guggcugccagcgcgcu

SEQ ID NO: 3559657 - RNA, 17 nt, Pseudomonas putida KT2440
guggcuggcaccggcug

SEQ ID NO: 3559658 - RNA, 17 nt, Pseudomonas putida KT2440
guggcuguugcgguugc

SEQ ID NO: 3559659 - RNA, 22 nt, Pseudomonas putida KT2440
guggcuuucauaccccuccggc

SEQ ID NO: 3559660 - RNA, 23 nt, Pseudomonas putida KT2440
guggcuuucauaccccuccggcc

SEQ ID NO: 3559661 - RNA, 18 nt, Pseudomonas putida KT2440
gugggagcacaagcacgc

SEQ ID NO: 3559662 - RNA, 20 nt, Pseudomonas putida KT2440
gugggagcgggcaugcccgc

SEQ ID NO: 3559663 - RNA, 13 nt, Pseudomonas putida KT2440
gugggagcgggcg

SEQ ID NO: 3559664 - RNA, 23 nt, Pseudomonas putida KT2440
gugggauugcgccgaugggcgca

SEQ ID NO: 3559665 - RNA, 16 nt, Pseudomonas putida KT2440
gugggccgugcaggcg

SEQ ID NO: 3559666 - RNA, 17 nt, Pseudomonas putida KT2440
guggggcaacugcgcga

SEQ ID NO: 3559667 - RNA, 18 nt, Pseudomonas putida KT2440
guggggcgugcucggcau

SEQ ID NO: 3559668 - RNA, 21 nt, Pseudomonas putida KT2440
guggggucugcccggccagca

SEQ ID NO: 3559669 - RNA, 18 nt, Pseudomonas putida KT2440
gugggguugaccaggcag

SEQ ID NO: 3559670 - RNA, 23 nt, Pseudomonas putida KT2440
guggguaacccugcucgccaucg

SEQ ID NO: 3559671 - RNA, 19 nt, Pseudomonas putida KT2440
guggguaauuucgcuaagu

SEQ ID NO: 3559672 - RNA, 20 nt, Pseudomonas putida KT2440
gugggucaugucggcagcca

SEQ ID NO: 3559673 - RNA, 22 nt, Pseudomonas putida KT2440
guucagcccuugcugcagcagg

SEQ ID NO: 3559674 - RNA, 18 nt, Pseudomonas putida KT2440
guucagcggguugguaug

SEQ ID NO: 3559675 - RNA, 19 nt, Pseudomonas putida KT2440
guucagcuugucgaccagg

SEQ ID NO: 3559676 - RNA, 19 nt, Pseudomonas putida KT2440
guucaggcaggaacuggcu

SEQ ID NO: 3559677 - RNA, 16 nt, Pseudomonas putida KT2440
guucaggcgccugccg

SEQ ID NO: 3559678 - RNA, 14 nt, Pseudomonas putida KT2440
guucagguacagca

SEQ ID NO: 3559679 - RNA, 20 nt, Pseudomonas putida KT2440
guucagguaggccgcagcca

SEQ ID NO: 3559680 - RNA, 13 nt, Pseudomonas putida KT2440
guucaggucguga

SEQ ID NO: 3559681 - RNA, 20 nt, Pseudomonas putida KT2440
guucagguguggaaacccgc

SEQ ID NO: 3559682 - RNA, 20 nt, Pseudomonas putida KT2440
guucagguguuccagcacgu

SEQ ID NO: 3559683 - RNA, 22 nt, Pseudomonas putida KT2440
guucagucgguaugcgcccauc

SEQ ID NO: 3559684 - RNA, 16 nt, Pseudomonas putida KT2440
guucagugccugcucc

SEQ ID NO: 3559685 - RNA, 14 nt, Pseudomonas putida KT2440
guucaucgaaggcc

SEQ ID NO: 3559686 - RNA, 17 nt, Pseudomonas putida KT2440
guucaugcccaccgcug

SEQ ID NO: 3559687 - RNA, 19 nt, Pseudomonas putida KT2440
guucaugcccaccgcugca

SEQ ID NO: 3559688 - RNA, 13 nt, Pseudomonas putida KT2440
guucaugcccuuc

SEQ ID NO: 3559689 - RNA, 12 nt, Pseudomonas putida KT2440
guucaugccggc

SEQ ID NO: 3559690 - RNA, 23 nt, Pseudomonas putida KT2440
guucauuaccauccaucaccaug

SEQ ID NO: 3559691 - RNA, 21 nt, Pseudomonas putida KT2440
guucauugacggucagugaag

SEQ ID NO: 3559692 - RNA, 23 nt, Pseudomonas putida KT2440
guuccagaagcggcuaccgcugc

SEQ ID NO: 3559693 - RNA, 16 nt, Pseudomonas putida KT2440
guuccagcaucggcac

SEQ ID NO: 3559694 - RNA, 20 nt, Pseudomonas putida KT2440
guuccagccguccucgaccc

SEQ ID NO: 3559695 - RNA, 21 nt, Pseudomonas putida KT2440
guuccagcguagccguccuuu

SEQ ID NO: 3559696 - RNA, 17 nt, Pseudomonas putida KT2440
guuccauuucccuacag

SEQ ID NO: 3559697 - RNA, 12 nt, Pseudomonas putida KT2440
guucccagcacc

SEQ ID NO: 3559698 - RNA, 12 nt, Pseudomonas putida KT2440
guucccccaccg

SEQ ID NO: 3559699 - RNA, 19 nt, Pseudomonas putida KT2440
guuccccgaccaaaugagu

SEQ ID NO: 3559700 - RNA, 22 nt, Pseudomonas putida KT2440
guucccgcgcaaaugcaccccu

SEQ ID NO: 3559701 - RNA, 15 nt, Pseudomonas putida KT2440
guucccgugcgccua

SEQ ID NO: 3559702 - RNA, 21 nt, Pseudomonas putida KT2440
guuccgaacugccccggcggc

SEQ ID NO: 3559703 - RNA, 15 nt, Pseudomonas putida KT2440
guuccgcguccuuga

SEQ ID NO: 3559704 - RNA, 14 nt, Pseudomonas putida KT2440
guuccggcaaacca

SEQ ID NO: 3559705 - RNA, 18 nt, Pseudomonas putida KT2440
guuccggcccuuucgcgg

SEQ ID NO: 3559706 - RNA, 19 nt, Pseudomonas putida KT2440
guuccuacgcaggcaccgc

SEQ ID NO: 3559707 - RNA, 17 nt, Pseudomonas putida KT2440
guuccucaagcggccuc

SEQ ID NO: 3559708 - RNA, 20 nt, Pseudomonas putida KT2440
guuccucaagcggccucgac

SEQ ID NO: 3559709 - RNA, 16 nt, Pseudomonas putida KT2440
guuccucgccauggcc

SEQ ID NO: 3559710 - RNA, 20 nt, Pseudomonas putida KT2440
guuccuggcgcuccuccagc

SEQ ID NO: 3559711 - RNA, 20 nt, Pseudomonas putida KT2440
guuccuucuugugcacaaag

SEQ ID NO: 3559712 - RNA, 13 nt, Pseudomonas putida KT2440
guuccuuucucaa

SEQ ID NO: 3559713 - RNA, 15 nt, Pseudomonas putida KT2440
guucgaaaaccugcu

SEQ ID NO: 3559714 - RNA, 17 nt, Pseudomonas putida KT2440
guucgaaaccacccuga

SEQ ID NO: 3559715 - RNA, 16 nt, Pseudomonas putida KT2440
guucgaauccugcuga

SEQ ID NO: 3559716 - RNA, 20 nt, Pseudomonas putida KT2440
guucgacagguugugguagu

SEQ ID NO: 3559717 - RNA, 14 nt, Pseudomonas putida KT2440
guucgacagugccc

SEQ ID NO: 3559718 - RNA, 17 nt, Pseudomonas putida KT2440
guucgaccaauggcugc

SEQ ID NO: 3559719 - RNA, 17 nt, Pseudomonas putida KT2440
guucgaccgacaugcca

SEQ ID NO: 3559720 - RNA, 12 nt, Pseudomonas putida KT2440
guucgacgcugc

SEQ ID NO: 3559721 - RNA, 14 nt, Pseudomonas putida KT2440
guucgacucccgcu

SEQ ID NO: 3559722 - RNA, 14 nt, Pseudomonas putida KT2440
guucgaguccaggu

SEQ ID NO: 3559723 - RNA, 23 nt, Pseudomonas putida KT2440
guucgaugcgcagagccacgggu

SEQ ID NO: 3559724 - RNA, 13 nt, Pseudomonas putida KT2440
guucgcagccaua

SEQ ID NO: 3559725 - RNA, 13 nt, Pseudomonas putida KT2440
guucgccacggua

SEQ ID NO: 3559726 - RNA, 18 nt, Pseudomonas putida KT2440
guucgccaugacguugca

SEQ ID NO: 3559727 - RNA, 18 nt, Pseudomonas putida KT2440
guucgcccuccugcagca

SEQ ID NO: 3559728 - RNA, 17 nt, Pseudomonas putida KT2440
guucgccgucagccuuu

SEQ ID NO: 3559729 - RNA, 15 nt, Pseudomonas putida KT2440
guucgcgcaccaucg

SEQ ID NO: 3559730 - RNA, 12 nt, Pseudomonas putida KT2440
guucgcgggcau

SEQ ID NO: 3559731 - RNA, 22 nt, Pseudomonas putida KT2440
guucgcugccagcguuuccggg

SEQ ID NO: 3559732 - RNA, 17 nt, Pseudomonas putida KT2440
guucggaaaacuccugc

SEQ ID NO: 3559733 - RNA, 17 nt, Pseudomonas putida KT2440
guucggacaggcgcuug

SEQ ID NO: 3559734 - RNA, 19 nt, Pseudomonas putida KT2440
guucggcaccuuucuccag

SEQ ID NO: 3559735 - RNA, 14 nt, Pseudomonas putida KT2440
guucggccagcacu

SEQ ID NO: 3559736 - RNA, 15 nt, Pseudomonas putida KT2440
guucggccagcacua

SEQ ID NO: 3559737 - RNA, 20 nt, Pseudomonas putida KT2440
guucgggaaguuacgggucg

SEQ ID NO: 3559738 - RNA, 18 nt, Pseudomonas putida KT2440
guucggguucagcuucuc

SEQ ID NO: 3559739 - RNA, 16 nt, Pseudomonas putida KT2440
guucggugcucaggcu

SEQ ID NO: 3559740 - RNA, 18 nt, Pseudomonas putida KT2440
guucggugcucaggcuca

SEQ ID NO: 3559741 - RNA, 14 nt, Pseudomonas putida KT2440
guucgguguccuug

SEQ ID NO: 3559742 - RNA, 15 nt, Pseudomonas putida KT2440
guucgguguccuugc

SEQ ID NO: 3559743 - RNA, 20 nt, Pseudomonas putida KT2440
guucguacagguugcggcca

SEQ ID NO: 3559744 - RNA, 20 nt, Pseudomonas putida KT2440
guucgucgagcaucugcugc

SEQ ID NO: 3559745 - RNA, 14 nt, Pseudomonas putida KT2440
guucuccggcaggu

SEQ ID NO: 3559746 - RNA, 15 nt, Pseudomonas putida KT2440
guucuccugcggaaa

SEQ ID NO: 3559747 - RNA, 15 nt, Pseudomonas putida KT2440
guucucgacagccac

SEQ ID NO: 3559748 - RNA, 17 nt, Pseudomonas putida KT2440
guucucgacagccaccu

SEQ ID NO: 3559749 - RNA, 18 nt, Pseudomonas putida KT2440
guucucgguauccggcuc

SEQ ID NO: 3559750 - RNA, 16 nt, Pseudomonas putida KT2440
guucugcagccugacg

SEQ ID NO: 3559751 - RNA, 23 nt, Pseudomonas putida KT2440
guucugcagucagguugcacagc

SEQ ID NO: 3559752 - RNA, 14 nt, Pseudomonas putida KT2440
guucugccggggca

SEQ ID NO: 3559753 - RNA, 16 nt, Pseudomonas putida KT2440
guucuggcagcuccag

SEQ ID NO: 3559754 - RNA, 15 nt, Pseudomonas putida KT2440
guucugguacaucac

SEQ ID NO: 3559755 - RNA, 15 nt, Pseudomonas putida KT2440
guucuguuucaccag

SEQ ID NO: 3559756 - RNA, 16 nt, Pseudomonas putida KT2440
guucuucaacuccugc

SEQ ID NO: 3559757 - RNA, 13 nt, Pseudomonas putida KT2440
guucuugaccuug

SEQ ID NO: 3559758 - RNA, 14 nt, Pseudomonas putida KT2440
guucuugccgagca

SEQ ID NO: 3559759 - RNA, 17 nt, Pseudomonas putida KT2440
guucuuucucccaggcc

SEQ ID NO: 3559760 - RNA, 17 nt, Pseudomonas putida KT2440
guugaaagacugcuccg

SEQ ID NO: 3559761 - RNA, 12 nt, Pseudomonas putida KT2440
guugaacagcag

SEQ ID NO: 3559762 - RNA, 14 nt, Pseudomonas putida KT2440
guugaacagcagcg

SEQ ID NO: 3559763 - RNA, 21 nt, Pseudomonas putida KT2440
guugaacgcaaaaaaccgcac

SEQ ID NO: 3559764 - RNA, 14 nt, Pseudomonas putida KT2440
guugaagaagaagg

SEQ ID NO: 3559765 - RNA, 19 nt, Pseudomonas putida KT2440
guugaagaagaaggagagc

SEQ ID NO: 3559766 - RNA, 20 nt, Pseudomonas putida KT2440
guugaagaagaucaggucgc

SEQ ID NO: 3559767 - RNA, 15 nt, Pseudomonas putida KT2440
guugaaggcgaauga

SEQ ID NO: 3559768 - RNA, 16 nt, Pseudomonas putida KT2440
guugaaggcgaaugag

SEQ ID NO: 3559769 - RNA, 23 nt, Pseudomonas putida KT2440
guugaaggcguauuugaccagcc

SEQ ID NO: 3559770 - RNA, 15 nt, Pseudomonas putida KT2440
guugaaugccgccau

SEQ ID NO: 3559771 - RNA, 14 nt, Pseudomonas putida KT2440
guugacaagcaaaa

SEQ ID NO: 3559772 - RNA, 17 nt, Pseudomonas putida KT2440
guugacacccucuugaa

SEQ ID NO: 3559773 - RNA, 12 nt, Pseudomonas putida KT2440
guugacagcgcu

SEQ ID NO: 3559774 - RNA, 21 nt, Pseudomonas putida KT2440
guugaccaaggaacugcgcug

SEQ ID NO: 3559775 - RNA, 21 nt, Pseudomonas putida KT2440
guugaccagggcgucgaacac

SEQ ID NO: 3559776 - RNA, 22 nt, Pseudomonas putida KT2440
guugaccccgggcacaugcagg

SEQ ID NO: 3559777 - RNA, 17 nt, Pseudomonas putida KT2440
guugaccgacgccagga

SEQ ID NO: 3559778 - RNA, 23 nt, Pseudomonas putida KT2440
guugaccgccgccaccaucgacu

SEQ ID NO: 3559779 - RNA, 15 nt, Pseudomonas putida KT2440
guuucacuaccaccu

SEQ ID NO: 3559780 - RNA, 22 nt, Pseudomonas putida KT2440
guuucagcagcguugcauucca

SEQ ID NO: 3559781 - RNA, 16 nt, Pseudomonas putida KT2440
guuucagccuuggccg

SEQ ID NO: 3559782 - RNA, 18 nt, Pseudomonas putida KT2440
guuucagccuuggccgcc

SEQ ID NO: 3559783 - RNA, 14 nt, Pseudomonas putida KT2440
guuucagucagcca

SEQ ID NO: 3559784 - RNA, 16 nt, Pseudomonas putida KT2440
guuucagucgaagucu

SEQ ID NO: 3559785 - RNA, 16 nt, Pseudomonas putida KT2440
guuuccagcccuucca

SEQ ID NO: 3559786 - RNA, 16 nt, Pseudomonas putida KT2440
guuuccgguuggucga

SEQ ID NO: 3559787 - RNA, 18 nt, Pseudomonas putida KT2440
guuucgcuggccugcccc

SEQ ID NO: 3559788 - RNA, 15 nt, Pseudomonas putida KT2440
guuucggcggccugc

SEQ ID NO: 3559789 - RNA, 16 nt, Pseudomonas putida KT2440
guuucggcggccugca

SEQ ID NO: 3559790 - RNA, 18 nt, Pseudomonas putida KT2440
guuucucgcagcagcacc

SEQ ID NO: 3559791 - RNA, 16 nt, Pseudomonas putida KT2440
guuucugcucuucugc

SEQ ID NO: 3559792 - RNA, 17 nt, Pseudomonas putida KT2440
guuugaagcccggccgc

SEQ ID NO: 3559793 - RNA, 20 nt, Pseudomonas putida KT2440
guuugaagcuaaacgaguuu

SEQ ID NO: 3559794 - RNA, 23 nt, Pseudomonas putida KT2440
guuugaagcuaaacgaguuucuc

SEQ ID NO: 3559795 - RNA, 16 nt, Pseudomonas putida KT2440
guuugacagcccugca

SEQ ID NO: 3559796 - RNA, 12 nt, Pseudomonas putida KT2440
guuugagccggc

SEQ ID NO: 3559797 - RNA, 18 nt, Pseudomonas putida KT2440
guuugagccggcgcuggg

SEQ ID NO: 3559798 - RNA, 19 nt, Pseudomonas putida KT2440
guuugaucauuucaucgcc

SEQ ID NO: 3559799 - RNA, 20 nt, Pseudomonas putida KT2440
guuugaucauuucaucgcca

SEQ ID NO: 3559800 - RNA, 16 nt, Pseudomonas putida KT2440
guuugcaacuggcgca

SEQ ID NO: 3559801 - RNA, 13 nt, Pseudomonas putida KT2440
guuugccaaggca

SEQ ID NO: 3559802 - RNA, 19 nt, Pseudomonas putida KT2440
guuugccgagguucuucca

SEQ ID NO: 3559803 - RNA, 20 nt, Pseudomonas putida KT2440
guuugcgaagguaaccuggu

SEQ ID NO: 3559804 - RNA, 21 nt, Pseudomonas putida KT2440
guuugcgaagguaaccugguu

SEQ ID NO: 3559805 - RNA, 18 nt, Pseudomonas putida KT2440
guuugggccugugccggc

SEQ ID NO: 3559806 - RNA, 22 nt, Pseudomonas putida KT2440
guuugggcggcgugaccagccc

SEQ ID NO: 3559807 - RNA, 13 nt, Pseudomonas putida KT2440
guuugguuuuuuc

SEQ ID NO: 3559808 - RNA, 13 nt, Pseudomonas putida KT2440
guuuuccauugca

SEQ ID NO: 3559809 - RNA, 13 nt, Pseudomonas putida KT2440
guuuucgcugauc

SEQ ID NO: 3559810 - RNA, 16 nt, Pseudomonas putida KT2440
guuuugccuccagcuu

SEQ ID NO: 3559811 - RNA, 20 nt, Pseudomonas putida KT2440
guuuugggcacgaugaaaua

SEQ ID NO: 3559812 - RNA, 22 nt, Pseudomonas putida KT2440
guuuuggucacccgugcugcuc

SEQ ID NO: 3559813 - RNA, 22 nt, Pseudomonas putida KT2440
guuuuuuggaggguuuuccuag

SEQ ID NO: 3559814 - RNA, 23 nt, Pseudomonas putida KT2440
uaaaaaaaccggccacgaaggcc

SEQ ID NO: 3559815 - RNA, 12 nt, Pseudomonas putida KT2440
uaaaaacaacag

SEQ ID NO: 3559816 - RNA, 21 nt, Pseudomonas putida KT2440
uaaaaacgccaucggccucuc

SEQ ID NO: 3559817 - RNA, 15 nt, Pseudomonas putida KT2440
uaaaaacuggccagc

SEQ ID NO: 3559818 - RNA, 21 nt, Pseudomonas putida KT2440
uaaaaacuggccagcagcccc

SEQ ID NO: 3559819 - RNA, 21 nt, Pseudomonas putida KT2440
uaaaacuaauauuugaacacc

SEQ ID NO: 3559820 - RNA, 22 nt, Pseudomonas putida KT2440
uaaaagccaacugcucuaccaa

SEQ ID NO: 3559821 - RNA, 15 nt, Pseudomonas putida KT2440
uaaaagcuggcgcga

SEQ ID NO: 3559822 - RNA, 19 nt, Pseudomonas putida KT2440
uaaacaauucccagccuuu

SEQ ID NO: 3559823 - RNA, 20 nt, Pseudomonas putida KT2440
uaaacaauucccagccuuuc

SEQ ID NO: 3559824 - RNA, 14 nt, Pseudomonas putida KT2440
uaaacacgaacauc

SEQ ID NO: 3559825 - RNA, 15 nt, Pseudomonas putida KT2440
uaaacacgaacauca

SEQ ID NO: 3559826 - RNA, 19 nt, Pseudomonas putida KT2440
uaaacacgaacaucagcag

SEQ ID NO: 3559827 - RNA, 22 nt, Pseudomonas putida KT2440
uaaaccagcagcgccugcagcg

SEQ ID NO: 3559828 - RNA, 19 nt, Pseudomonas putida KT2440
uaaaccccagccuucagca

SEQ ID NO: 3559829 - RNA, 14 nt, Pseudomonas putida KT2440
uaaacccgccccua

SEQ ID NO: 3559830 - RNA, 11 nt, Pseudomonas putida KT2440
uaaacccgcgc

SEQ ID NO: 3559831 - RNA, 17 nt, Pseudomonas putida KT2440
uaaacccgcucccacaa

SEQ ID NO: 3559832 - RNA, 16 nt, Pseudomonas putida KT2440
uaaacccgcuccuaca

SEQ ID NO: 3559833 - RNA, 19 nt, Pseudomonas putida KT2440
uaaacccgcuccuacaggg

SEQ ID NO: 3559834 - RNA, 18 nt, Pseudomonas putida KT2440
uaaaccggguaggcccca

SEQ ID NO: 3559835 - RNA, 13 nt, Pseudomonas putida KT2440
uaaaccugccacc

SEQ ID NO: 3559836 - RNA, 22 nt, Pseudomonas putida KT2440
uaaacgaccggcuugucuucca

SEQ ID NO: 3559837 - RNA, 22 nt, Pseudomonas putida KT2440
uaaacgugagacuuagucucga

SEQ ID NO: 3559838 - RNA, 18 nt, Pseudomonas putida KT2440
uaaacguggucagccacg

SEQ ID NO: 3559839 - RNA, 15 nt, Pseudomonas putida KT2440
uaaagagaagcugca

SEQ ID NO: 3559840 - RNA, 15 nt, Pseudomonas putida KT2440
uaaagauuaggcucc

SEQ ID NO: 3559841 - RNA, 14 nt, Pseudomonas putida KT2440
uaaagccagcagcc

SEQ ID NO: 3559842 - RNA, 16 nt, Pseudomonas putida KT2440
uaaagccagcagccug

SEQ ID NO: 3559843 - RNA, 17 nt, Pseudomonas putida KT2440
uaaaggcgugccgucca

SEQ ID NO: 3559844 - RNA, 14 nt, Pseudomonas putida KT2440
uaaaggguuuucaa

SEQ ID NO: 3559845 - RNA, 22 nt, Pseudomonas putida KT2440
uaaagguaaucccggucaccuc

SEQ ID NO: 3559846 - RNA, 22 nt, Pseudomonas putida KT2440
uaaagguugacgcccucucgaa

SEQ ID NO: 3559847 - RNA, 17 nt, Pseudomonas putida KT2440
uaaaugguccccgcuuc

SEQ ID NO: 3559848 - RNA, 21 nt, Pseudomonas putida KT2440
uaaauguucucgccgccgcga

SEQ ID NO: 3559849 - RNA, 11 nt, Pseudomonas putida KT2440
uaacaaggcac

SEQ ID NO: 3559850 - RNA, 12 nt, Pseudomonas putida KT2440
uaacaaggcacg

SEQ ID NO: 3559851 - RNA, 22 nt, Pseudomonas putida KT2440
uaacaaguucaaggucaucgcu

SEQ ID NO: 3559852 - RNA, 15 nt, Pseudomonas putida KT2440
uaacagggaaacaaa

SEQ ID NO: 3559853 - RNA, 19 nt, Pseudomonas putida KT2440
uaaccaaccccugcggcgu

SEQ ID NO: 3559854 - RNA, 17 nt, Pseudomonas putida KT2440
uaaccaauuggucguag

SEQ ID NO: 3559855 - RNA, 18 nt, Pseudomonas putida KT2440
uaaccauguugaaaauag

SEQ ID NO: 3559856 - RNA, 20 nt, Pseudomonas putida KT2440
uaacccugguacagauggca

SEQ ID NO: 3559857 - RNA, 22 nt, Pseudomonas putida KT2440
uaaccgcgcugguaagccucga

SEQ ID NO: 3559858 - RNA, 12 nt, Pseudomonas putida KT2440
uaaccgcugcca

SEQ ID NO: 3559859 - RNA, 16 nt, Pseudomonas putida KT2440
uaaccugcauugcgcg

SEQ ID NO: 3559860 - RNA, 15 nt, Pseudomonas putida KT2440
uaaccuggcucggcu

SEQ ID NO: 3559861 - RNA, 17 nt, Pseudomonas putida KT2440
uaacgaaucugcagugc

SEQ ID NO: 3559862 - RNA, 22 nt, Pseudomonas putida KT2440
uaacgacccggaaaauggucgg

SEQ ID NO: 3559863 - RNA, 14 nt, Pseudomonas putida KT2440
uaacgcccacguuc

SEQ ID NO: 3559864 - RNA, 17 nt, Pseudomonas putida KT2440
uaacgcgccgcugccug

SEQ ID NO: 3559865 - RNA, 18 nt, Pseudomonas putida KT2440
uaacgcgccgcugccugg

SEQ ID NO: 3559866 - RNA, 14 nt, Pseudomonas putida KT2440
uaacgcuuggccag

SEQ ID NO: 3559867 - RNA, 15 nt, Pseudomonas putida KT2440
uaacgcuuggccaga

SEQ ID NO: 3559868 - RNA, 16 nt, Pseudomonas putida KT2440
uaacgcuuggccagac

SEQ ID NO: 3559869 - RNA, 22 nt, Pseudomonas putida KT2440
uaacgcuuggccagacucagcu

SEQ ID NO: 3559870 - RNA, 17 nt, Pseudomonas putida KT2440
uaacgggcaaggcuggc

SEQ ID NO: 3559871 - RNA, 12 nt, Pseudomonas putida KT2440
uaacgggccagc

SEQ ID NO: 3559872 - RNA, 23 nt, Pseudomonas putida KT2440
uaacgggccagccgcgccagguc

SEQ ID NO: 3559873 - RNA, 20 nt, Pseudomonas putida KT2440
uaacggucacugagccaggc

SEQ ID NO: 3559874 - RNA, 17 nt, Pseudomonas putida KT2440
uaacguggacagcagcu

SEQ ID NO: 3559875 - RNA, 18 nt, Pseudomonas putida KT2440
uaacugcgcaccagaggg

SEQ ID NO: 3559876 - RNA, 13 nt, Pseudomonas putida KT2440
uaacuggcccacc

SEQ ID NO: 3559877 - RNA, 20 nt, Pseudomonas putida KT2440
uaacuggcccacccggcuga

SEQ ID NO: 3559878 - RNA, 23 nt, Pseudomonas putida KT2440
uaagaagcaaccgcugcauggcc

SEQ ID NO: 3559879 - RNA, 19 nt, Pseudomonas putida KT2440
uaagacaggcguucacauc

SEQ ID NO: 3559880 - RNA, 13 nt, Pseudomonas putida KT2440
uaagagcggccuu

SEQ ID NO: 3559881 - RNA, 15 nt, Pseudomonas putida KT2440
uaagaucacugcgca

SEQ ID NO: 3559882 - RNA, 14 nt, Pseudomonas putida KT2440
uaagcagcaagccu

SEQ ID NO: 3559883 - RNA, 15 nt, Pseudomonas putida KT2440
uaagccaugcgcagg

SEQ ID NO: 3559884 - RNA, 20 nt, Pseudomonas putida KT2440
uacccaugguaaaagccgcc

SEQ ID NO: 3559885 - RNA, 19 nt, Pseudomonas putida KT2440
uaccccgcugccugcgcuu

SEQ ID NO: 3559886 - RNA, 20 nt, Pseudomonas putida KT2440
uaccccucgacgccuuggcg

SEQ ID NO: 3559887 - RNA, 22 nt, Pseudomonas putida KT2440
uaccccuuugcugccugugccg

SEQ ID NO: 3559888 - RNA, 15 nt, Pseudomonas putida KT2440
uacccgcauaaccac

SEQ ID NO: 3559889 - RNA, 13 nt, Pseudomonas putida KT2440
uacccgccagcaa

SEQ ID NO: 3559890 - RNA, 20 nt, Pseudomonas putida KT2440
uacccgcgaaagggccagca

SEQ ID NO: 3559891 - RNA, 23 nt, Pseudomonas putida KT2440
uacccgcgaacaggcccugacag

SEQ ID NO: 3559892 - RNA, 16 nt, Pseudomonas putida KT2440
uacccgcgaagaagcc

SEQ ID NO: 3559893 - RNA, 21 nt, Pseudomonas putida KT2440
uacccgcgaagaagccggcau

SEQ ID NO: 3559894 - RNA, 16 nt, Pseudomonas putida KT2440
uacccgcgaagaggcc

SEQ ID NO: 3559895 - RNA, 19 nt, Pseudomonas putida KT2440
uacccgcguuggcagcacc

SEQ ID NO: 3559896 - RNA, 19 nt, Pseudomonas putida KT2440
uacccgggcgcaggggucu

SEQ ID NO: 3559897 - RNA, 21 nt, Pseudomonas putida KT2440
uacccgguaaaaccgcucgaa

SEQ ID NO: 3559898 - RNA, 12 nt, Pseudomonas putida KT2440
uacccucggcau

SEQ ID NO: 3559899 - RNA, 15 nt, Pseudomonas putida KT2440
uacccugcgggagcg

SEQ ID NO: 3559900 - RNA, 15 nt, Pseudomonas putida KT2440
uacccuguacccgcu

SEQ ID NO: 3559901 - RNA, 21 nt, Pseudomonas putida KT2440
uacccuguacccgcuggcuga

SEQ ID NO: 3559902 - RNA, 21 nt, Pseudomonas putida KT2440
uacccuguugcgucaacucau

SEQ ID NO: 3559903 - RNA, 15 nt, Pseudomonas putida KT2440
uaccgaacagcaccg

SEQ ID NO: 3559904 - RNA, 14 nt, Pseudomonas putida KT2440
uaccgcaacaccug

SEQ ID NO: 3559905 - RNA, 16 nt, Pseudomonas putida KT2440
uaccgcaacaccugcc

SEQ ID NO: 3559906 - RNA, 21 nt, Pseudomonas putida KT2440
uaccgcacagcaucacccgcg

SEQ ID NO: 3559907 - RNA, 21 nt, Pseudomonas putida KT2440
uaccgccaguagcaaucaggu

SEQ ID NO: 3559908 - RNA, 20 nt, Pseudomonas putida KT2440
uaccgcccucuucgcgggca

SEQ ID NO: 3559909 - RNA, 20 nt, Pseudomonas putida KT2440
uaccgccguccaccaucucc

SEQ ID NO: 3559910 - RNA, 18 nt, Pseudomonas putida KT2440
uaccgcgccuccagcugg

SEQ ID NO: 3559911 - RNA, 23 nt, Pseudomonas putida KT2440
uaccgcugcgcaccaaggcggca

SEQ ID NO: 3559912 - RNA, 17 nt, Pseudomonas putida KT2440
uaccgcugggcacccug

SEQ ID NO: 3559913 - RNA, 14 nt, Pseudomonas putida KT2440
uaccggauugggaa

SEQ ID NO: 3559914 - RNA, 23 nt, Pseudomonas putida KT2440
uaccggccagcugcgcaccggcu

SEQ ID NO: 3559915 - RNA, 19 nt, Pseudomonas putida KT2440
uaccggccgcucaccggcc

SEQ ID NO: 3559916 - RNA, 21 nt, Pseudomonas putida KT2440
uaccggccgcucaccggccag

SEQ ID NO: 3559917 - RNA, 15 nt, Pseudomonas putida KT2440
uaccggcgccgccca

SEQ ID NO: 3559918 - RNA, 23 nt, Pseudomonas putida KT2440
uaccgggcggccaccggccacgc

SEQ ID NO: 3559919 - RNA, 15 nt, Pseudomonas putida KT2440
uaccguagcggucau

SEQ ID NO: 3559920 - RNA, 18 nt, Pseudomonas putida KT2440
uaccguagcggucaugca

SEQ ID NO: 3559921 - RNA, 16 nt, Pseudomonas putida KT2440
uaccgucgaucagcuu

SEQ ID NO: 3559922 - RNA, 18 nt, Pseudomonas putida KT2440
uaccuaggguucaaaucc

SEQ ID NO: 3559923 - RNA, 22 nt, Pseudomonas putida KT2440
uaccucaagguaggggcagcca

SEQ ID NO: 3559924 - RNA, 17 nt, Pseudomonas putida KT2440
uaccucacugacagcau

SEQ ID NO: 3559925 - RNA, 13 nt, Pseudomonas putida KT2440
uaccuccagcccg

SEQ ID NO: 3559926 - RNA, 16 nt, Pseudomonas putida KT2440
uaccucccgcacugcu

SEQ ID NO: 3559927 - RNA, 18 nt, Pseudomonas putida KT2440
uaccucccgcacugcugc

SEQ ID NO: 3559928 - RNA, 15 nt, Pseudomonas putida KT2440
uaccucgcucaggcc

SEQ ID NO: 3559929 - RNA, 20 nt, Pseudomonas putida KT2440
uaccugacuugccugucaug

SEQ ID NO: 3559930 - RNA, 19 nt, Pseudomonas putida KT2440
uaccugagccugcagggcc

SEQ ID NO: 3559931 - RNA, 17 nt, Pseudomonas putida KT2440
uaccugcacacugccca

SEQ ID NO: 3559932 - RNA, 21 nt, Pseudomonas putida KT2440
uaccugcagcucagccagcaa

SEQ ID NO: 3559933 - RNA, 16 nt, Pseudomonas putida KT2440
uaccugcuccugauag

SEQ ID NO: 3559934 - RNA, 22 nt, Pseudomonas putida KT2440
uaccugcuuaucggcugaccug

SEQ ID NO: 3559935 - RNA, 14 nt, Pseudomonas putida KT2440
uaccuggguccagg

SEQ ID NO: 3559936 - RNA, 16 nt, Pseudomonas putida KT2440
uaccuggguccaggca

SEQ ID NO: 3559937 - RNA, 13 nt, Pseudomonas putida KT2440
uacgaacgccagu

SEQ ID NO: 3559938 - RNA, 20 nt, Pseudomonas putida KT2440
uacgaacggguuggcauggc

SEQ ID NO: 3559939 - RNA, 16 nt, Pseudomonas putida KT2440
uacgaacuacgcgcca

SEQ ID NO: 3559940 - RNA, 22 nt, Pseudomonas putida KT2440
uacgaagccaugucuucacgag

SEQ ID NO: 3559941 - RNA, 19 nt, Pseudomonas putida KT2440
uacgaauacggucgaucuu

SEQ ID NO: 3559942 - RNA, 12 nt, Pseudomonas putida KT2440
uacgacgcauca

SEQ ID NO: 3559943 - RNA, 16 nt, Pseudomonas putida KT2440
uacgcacacgaccuug

SEQ ID NO: 3559944 - RNA, 21 nt, Pseudomonas putida KT2440
uacgcacaggcgcagcagcuu

SEQ ID NO: 3559945 - RNA, 19 nt, Pseudomonas putida KT2440
uacgcacugggugcacagg

SEQ ID NO: 3559946 - RNA, 22 nt, Pseudomonas putida KT2440
uacgcagcacccggucgccgac

SEQ ID NO: 3559947 - RNA, 16 nt, Pseudomonas putida KT2440
uacgcaucagcgcagc

SEQ ID NO: 3559948 - RNA, 21 nt, Pseudomonas putida KT2440
uacgcauggucacguagaaca

SEQ ID NO: 3559949 - RNA, 18 nt, Pseudomonas putida KT2440
uacgccaugugcgcccga

SEQ ID NO: 3559950 - RNA, 13 nt, Pseudomonas putida KT2440
uacgcccauccaa

SEQ ID NO: 3559951 - RNA, 14 nt, Pseudomonas putida KT2440
uacgccgccccacu

SEQ ID NO: 3559952 - RNA, 18 nt, Pseudomonas putida KT2440
uacgccgcugucauccug

SEQ ID NO: 3559953 - RNA, 16 nt, Pseudomonas putida KT2440
uacgccggccaagguc

SEQ ID NO: 3559954 - RNA, 19 nt, Pseudomonas putida KT2440
uacgccggccaaggucagc

SEQ ID NO: 3559955 - RNA, 20 nt, Pseudomonas putida KT2440
uacgccggccaaggucagca

SEQ ID NO: 3559956 - RNA, 23 nt, Pseudomonas putida KT2440
uacgccggccaaggucagcaagc

SEQ ID NO: 3559957 - RNA, 20 nt, Pseudomonas putida KT2440
uacgccucgaaguaggcaaa

SEQ ID NO: 3559958 - RNA, 17 nt, Pseudomonas putida KT2440
uacgcgacaguucgcca

SEQ ID NO: 3559959 - RNA, 20 nt, Pseudomonas putida KT2440
uacgcgagccaccgucgaac

SEQ ID NO: 3559960 - RNA, 21 nt, Pseudomonas putida KT2440
uacgcgaggcauccacacccu

SEQ ID NO: 3559961 - RNA, 14 nt, Pseudomonas putida KT2440
uacgcgccagcaug

SEQ ID NO: 3559962 - RNA, 15 nt, Pseudomonas putida KT2440
uacgcgccagucaga

SEQ ID NO: 3559963 - RNA, 22 nt, Pseudomonas putida KT2440
uacgcgccagucagaagcagcu

SEQ ID NO: 3559964 - RNA, 19 nt, Pseudomonas putida KT2440
uacgcgccaucaaaugggu

SEQ ID NO: 3559965 - RNA, 20 nt, Pseudomonas putida KT2440
uacgcgccauccgccacauc

SEQ ID NO: 3559966 - RNA, 18 nt, Pseudomonas putida KT2440
uacgcgccugcaccuggc

SEQ ID NO: 3559967 - RNA, 21 nt, Pseudomonas putida KT2440
uacgcgccugcaccuggcuga

SEQ ID NO: 3559968 - RNA, 17 nt, Pseudomonas putida KT2440
uacgcgucaucugcgca

SEQ ID NO: 3559969 - RNA, 21 nt, Pseudomonas putida KT2440
uacgcucguaauccucgucca

SEQ ID NO: 3559970 - RNA, 16 nt, Pseudomonas putida KT2440
uacgcucguccaggcc

SEQ ID NO: 3559971 - RNA, 18 nt, Pseudomonas putida KT2440
uacgcuucgaacacccgc

SEQ ID NO: 3559972 - RNA, 20 nt, Pseudomonas putida KT2440
uacgcuuucggcgguuaaga

SEQ ID NO: 3559973 - RNA, 16 nt, Pseudomonas putida KT2440
uacggcagaacggcuu

SEQ ID NO: 3559974 - RNA, 12 nt, Pseudomonas putida KT2440
uacggcccaugu

SEQ ID NO: 3559975 - RNA, 22 nt, Pseudomonas putida KT2440
uacggccguggucgccuucacu

SEQ ID NO: 3559976 - RNA, 18 nt, Pseudomonas putida KT2440
uacggccuguguccaaca

SEQ ID NO: 3559977 - RNA, 16 nt, Pseudomonas putida KT2440
uacggcgccgacccug

SEQ ID NO: 3559978 - RNA, 18 nt, Pseudomonas putida KT2440
uacggcggccugcugccg

SEQ ID NO: 3559979 - RNA, 23 nt, Pseudomonas putida KT2440
uacggcuugauauccagcaccgg

SEQ ID NO: 3559980 - RNA, 20 nt, Pseudomonas putida KT2440
uacgggcuugugcaucagcg

SEQ ID NO: 3559981 - RNA, 17 nt, Pseudomonas putida KT2440
uacggggguucacagcc

SEQ ID NO: 3559982 - RNA, 18 nt, Pseudomonas putida KT2440
uacgggucgugcgcgauc

SEQ ID NO: 3559983 - RNA, 20 nt, Pseudomonas putida KT2440
uacggguguuuccaccccgg

SEQ ID NO: 3559984 - RNA, 17 nt, Pseudomonas putida KT2440
uacggguucaagggcag

SEQ ID NO: 3559985 - RNA, 20 nt, Pseudomonas putida KT2440
uacggucgaucuucgccggc

SEQ ID NO: 3559986 - RNA, 15 nt, Pseudomonas putida KT2440
uacgucaaguaggca

SEQ ID NO: 3559987 - RNA, 23 nt, Pseudomonas putida KT2440
uacgucggggaauggcccagcca

SEQ ID NO: 3559988 - RNA, 18 nt, Pseudomonas putida KT2440
uaggcagcugccuuggca

SEQ ID NO: 3559989 - RNA, 15 nt, Pseudomonas putida KT2440
uaggcauucggugug

SEQ ID NO: 3559990 - RNA, 19 nt, Pseudomonas putida KT2440
uaggccaagguugccacca

SEQ ID NO: 3559991 - RNA, 22 nt, Pseudomonas putida KT2440
uaggccaagguugccaccagca

SEQ ID NO: 3559992 - RNA, 17 nt, Pseudomonas putida KT2440
uaggcccagcccagccc

SEQ ID NO: 3559993 - RNA, 18 nt, Pseudomonas putida KT2440
uaggcccagcccagcccg

SEQ ID NO: 3559994 - RNA, 16 nt, Pseudomonas putida KT2440
uaggccgucagcagca

SEQ ID NO: 3559995 - RNA, 19 nt, Pseudomonas putida KT2440
uaggccugcgaaaggcgcu

SEQ ID NO: 3559996 - RNA, 17 nt, Pseudomonas putida KT2440
uaggccuugaccagcuu

SEQ ID NO: 3559997 - RNA, 18 nt, Pseudomonas putida KT2440
uaggcgaacuuuucgcca

SEQ ID NO: 3559998 - RNA, 19 nt, Pseudomonas putida KT2440
uaggcgaacuuuucgccac

SEQ ID NO: 3559999 - RNA, 21 nt, Pseudomonas putida KT2440
uaggcgcaacucagcgcagcu

SEQ ID NO: 3560000 - RNA, 14 nt, Pseudomonas putida KT2440
uaggcgccacgccg

SEQ ID NO: 3560001 - RNA, 20 nt, Pseudomonas putida KT2440
uaggcgcggguuuacccgcg

SEQ ID NO: 3560002 - RNA, 20 nt, Pseudomonas putida KT2440
uaggcgcggguuugcccgcg

SEQ ID NO: 3560003 - RNA, 14 nt, Pseudomonas putida KT2440
uaggcgucuuccac

SEQ ID NO: 3560004 - RNA, 20 nt, Pseudomonas putida KT2440
uaggcgucuuccacgcccag

SEQ ID NO: 3560005 - RNA, 17 nt, Pseudomonas putida KT2440
uaggcuugcgcugaagg

SEQ ID NO: 3560006 - RNA, 18 nt, Pseudomonas putida KT2440
uagggaucaccgccagca

SEQ ID NO: 3560007 - RNA, 21 nt, Pseudomonas putida KT2440
uagggcguucagcaagaccag

SEQ ID NO: 3560008 - RNA, 21 nt, Pseudomonas putida KT2440
uaggggcuaaaaccgguucag

SEQ ID NO: 3560009 - RNA, 17 nt, Pseudomonas putida KT2440
uagggggccgcuuugcg

SEQ ID NO: 3560010 - RNA, 23 nt, Pseudomonas putida KT2440
uaggguucgaugggcaugccgcg

SEQ ID NO: 3560011 - RNA, 13 nt, Pseudomonas putida KT2440
uaggucaccauca

SEQ ID NO: 3560012 - RNA, 22 nt, Pseudomonas putida KT2440
uaggucacguuguagcccacca

SEQ ID NO: 3560013 - RNA, 16 nt, Pseudomonas putida KT2440
uaggucacuucagugc

SEQ ID NO: 3560014 - RNA, 14 nt, Pseudomonas putida KT2440
uaggucaggucgcu

SEQ ID NO: 3560015 - RNA, 17 nt, Pseudomonas putida KT2440
uagguccagcucugguc

SEQ ID NO: 3560016 - RNA, 19 nt, Pseudomonas putida KT2440
uagguggacaccauggccu

SEQ ID NO: 3560017 - RNA, 16 nt, Pseudomonas putida KT2440
uagguuuucggcugga

SEQ ID NO: 3560018 - RNA, 18 nt, Pseudomonas putida KT2440
uagguuuucggcuggagc

SEQ ID NO: 3560019 - RNA, 14 nt, Pseudomonas putida KT2440
uaguacuccagcag

SEQ ID NO: 3560020 - RNA, 18 nt, Pseudomonas putida KT2440
uaguagcuccagcccagc

SEQ ID NO: 3560021 - RNA, 23 nt, Pseudomonas putida KT2440
uaguaggagcggguuuacccgcg

SEQ ID NO: 3560022 - RNA, 21 nt, Pseudomonas putida KT2440
uagucagaaaguuugguuuuu

SEQ ID NO: 3560023 - RNA, 11 nt, Pseudomonas putida KT2440
uagucagggug

SEQ ID NO: 3560024 - RNA, 19 nt, Pseudomonas putida KT2440
uagucaucuguaagugaug

SEQ ID NO: 3560025 - RNA, 16 nt, Pseudomonas putida KT2440
uaguccagcaacuccc

SEQ ID NO: 3560026 - RNA, 13 nt, Pseudomonas putida KT2440
uaguccugcagcg

SEQ ID NO: 3560027 - RNA, 21 nt, Pseudomonas putida KT2440
uagucgacaauuuggggcugc

SEQ ID NO: 3560028 - RNA, 15 nt, Pseudomonas putida KT2440
uagucguccugcccc

SEQ ID NO: 3560029 - RNA, 15 nt, Pseudomonas putida KT2440
uagugaugcaucagc

SEQ ID NO: 3560030 - RNA, 13 nt, Pseudomonas putida KT2440
uagugcaccaacg

SEQ ID NO: 3560031 - RNA, 15 nt, Pseudomonas putida KT2440
uagugcaggcgcagg

SEQ ID NO: 3560032 - RNA, 19 nt, Pseudomonas putida KT2440
uaguucacccacacccgcg

SEQ ID NO: 3560033 - RNA, 17 nt, Pseudomonas putida KT2440
uaguucacuggccagca

SEQ ID NO: 3560034 - RNA, 15 nt, Pseudomonas putida KT2440
uaguucaucuucuug

SEQ ID NO: 3560035 - RNA, 17 nt, Pseudomonas putida KT2440
uaguucuggcugccuuc

SEQ ID NO: 3560036 - RNA, 20 nt, Pseudomonas putida KT2440
uaguugaccgugaucaucag

SEQ ID NO: 3560037 - RNA, 16 nt, Pseudomonas putida KT2440
uaguuugacagcccug

SEQ ID NO: 3560038 - RNA, 20 nt, Pseudomonas putida KT2440
uauaccgcgcacgcaucugc

SEQ ID NO: 3560039 - RNA, 20 nt, Pseudomonas putida KT2440
uauagucagaaaguuugguu

SEQ ID NO: 3560040 - RNA, 19 nt, Pseudomonas putida KT2440
uauaucucgggcuuccagu

SEQ ID NO: 3560041 - RNA, 23 nt, Pseudomonas putida KT2440
uaucagcgccagcacgcaggcca

SEQ ID NO: 3560042 - RNA, 15 nt, Pseudomonas putida KT2440
uauccaccaggccga

SEQ ID NO: 3560043 - RNA, 11 nt, Pseudomonas putida KT2440
uauccagcccg

SEQ ID NO: 3560044 - RNA, 22 nt, Pseudomonas putida KT2440
uauccagcugcaacagcggcga

SEQ ID NO: 3560045 - RNA, 19 nt, Pseudomonas putida KT2440
uauccagugcuucacugcc

SEQ ID NO: 3560046 - RNA, 20 nt, Pseudomonas putida KT2440
uauccgacacagucgucggc

SEQ ID NO: 3560047 - RNA, 22 nt, Pseudomonas putida KT2440
uauccuacgcgccagucagaag

SEQ ID NO: 3560048 - RNA, 15 nt, Pseudomonas putida KT2440
uauccuccagcccug

SEQ ID NO: 3560049 - RNA, 19 nt, Pseudomonas putida KT2440
uauccuccagcccugcucg

SEQ ID NO: 3560050 - RNA, 16 nt, Pseudomonas putida KT2440
uauccugcagcaccag

SEQ ID NO: 3560051 - RNA, 19 nt, Pseudomonas putida KT2440
uauccugugggagcgggcu

SEQ ID NO: 3560052 - RNA, 17 nt, Pseudomonas putida KT2440
uauccuugcccaccagg

SEQ ID NO: 3560053 - RNA, 13 nt, Pseudomonas putida KT2440
uaucgagcauggc

SEQ ID NO: 3560054 - RNA, 17 nt, Pseudomonas putida KT2440
uaucgaucaggaaggca

SEQ ID NO: 3560055 - RNA, 17 nt, Pseudomonas putida KT2440
uaucgcgacgcaaggcc

SEQ ID NO: 3560056 - RNA, 13 nt, Pseudomonas putida KT2440
uaucgcucuggca

SEQ ID NO: 3560057 - RNA, 15 nt, Pseudomonas putida KT2440
uaucgcucuggcacu

SEQ ID NO: 3560058 - RNA, 22 nt, Pseudomonas putida KT2440
uaucgcuuacagaugucuggca

SEQ ID NO: 3560059 - RNA, 14 nt, Pseudomonas putida KT2440
uaucggccauggcc

SEQ ID NO: 3560060 - RNA, 21 nt, Pseudomonas putida KT2440
uaucguucuccagcuccuggc

SEQ ID NO: 3560061 - RNA, 15 nt, Pseudomonas putida KT2440
uaucucgggcuucca

SEQ ID NO: 3560062 - RNA, 14 nt, Pseudomonas putida KT2440
uaucuucaggcauc

SEQ ID NO: 3560063 - RNA, 16 nt, Pseudomonas putida KT2440
uaugaaaaggcccugc

SEQ ID NO: 3560064 - RNA, 21 nt, Pseudomonas putida KT2440
uaugagccuacagcaaccgcg

SEQ ID NO: 3560065 - RNA, 21 nt, Pseudomonas putida KT2440
uaugccaagccacuggccagc

SEQ ID NO: 3560066 - RNA, 16 nt, Pseudomonas putida KT2440
uaugccaccuguugcc

SEQ ID NO: 3560067 - RNA, 19 nt, Pseudomonas putida KT2440
uaugcccggcucaccgcag

SEQ ID NO: 3560068 - RNA, 21 nt, Pseudomonas putida KT2440
uaugccggccccguauaccca

SEQ ID NO: 3560069 - RNA, 18 nt, Pseudomonas putida KT2440
uaugcggggucgcuacca

SEQ ID NO: 3560070 - RNA, 17 nt, Pseudomonas putida KT2440
uaugcgugcauguccug

SEQ ID NO: 3560071 - RNA, 18 nt, Pseudomonas putida KT2440
uauggccgagcaggagcu

SEQ ID NO: 3560072 - RNA, 19 nt, Pseudomonas putida KT2440
uauggccuuucugcuucca

SEQ ID NO: 3560073 - RNA, 18 nt, Pseudomonas putida KT2440
uauggcgcuuucacuggc

SEQ ID NO: 3560074 - RNA, 13 nt, Pseudomonas putida KT2440
uauggcuccacca

SEQ ID NO: 3560075 - RNA, 12 nt, Pseudomonas putida KT2440
uauggcuucacg

SEQ ID NO: 3560076 - RNA, 13 nt, Pseudomonas putida KT2440
uaugggcagcacc

SEQ ID NO: 3560077 - RNA, 22 nt, Pseudomonas putida KT2440
uaugggucgacugaccgcgcau

SEQ ID NO: 3560078 - RNA, 18 nt, Pseudomonas putida KT2440
uauguccauccaugcaau

SEQ ID NO: 3560079 - RNA, 19 nt, Pseudomonas putida KT2440
uaugugcacauucuccagu

SEQ ID NO: 3560080 - RNA, 18 nt, Pseudomonas putida KT2440
uauucagugcgcagguac

SEQ ID NO: 3560081 - RNA, 18 nt, Pseudomonas putida KT2440
uauugccccggccaguga

SEQ ID NO: 3560082 - RNA, 12 nt, Pseudomonas putida KT2440
uauuggccaggu

SEQ ID NO: 3560083 - RNA, 22 nt, Pseudomonas putida KT2440
uauuguggcaauugcacccgcg

SEQ ID NO: 3560084 - RNA, 19 nt, Pseudomonas putida KT2440
uauuuagucaggguguccg

SEQ ID NO: 3560085 - RNA, 14 nt, Pseudomonas putida KT2440
uauuucaaagaucu

SEQ ID NO: 3560086 - RNA, 16 nt, Pseudomonas putida KT2440
uauuucucuuccuggc

SEQ ID NO: 3560087 - RNA, 17 nt, Pseudomonas putida KT2440
uauuugaccagcccgcu

SEQ ID NO: 3560088 - RNA, 19 nt, Pseudomonas putida KT2440
uauuugugaaacaccacac

SEQ ID NO: 3560089 - RNA, 18 nt, Pseudomonas putida KT2440
uauuuucgugagaccugc

SEQ ID NO: 3560090 - RNA, 15 nt, Pseudomonas putida KT2440
ucaaaacucugcagg

SEQ ID NO: 3560091 - RNA, 18 nt, Pseudomonas putida KT2440
ucaaaacucugcagguca

SEQ ID NO: 3560092 - RNA, 16 nt, Pseudomonas putida KT2440
ucaaaccccugucaag

SEQ ID NO: 3560093 - RNA, 12 nt, Pseudomonas putida KT2440
ucaccagggcau

SEQ ID NO: 3560094 - RNA, 17 nt, Pseudomonas putida KT2440
ucaccagguugcgugcc

SEQ ID NO: 3560095 - RNA, 15 nt, Pseudomonas putida KT2440
ucaccagguugcguu

SEQ ID NO: 3560096 - RNA, 17 nt, Pseudomonas putida KT2440
ucaccagguuguggccc

SEQ ID NO: 3560097 - RNA, 19 nt, Pseudomonas putida KT2440
ucaccaguuuuuguaccug

SEQ ID NO: 3560098 - RNA, 16 nt, Pseudomonas putida KT2440
ucaccaugggccugga

SEQ ID NO: 3560099 - RNA, 17 nt, Pseudomonas putida KT2440
ucaccauugaugaacga

SEQ ID NO: 3560100 - RNA, 16 nt, Pseudomonas putida KT2440
ucacccacacccgcgc

SEQ ID NO: 3560101 - RNA, 22 nt, Pseudomonas putida KT2440
ucacccaccagccaaacccggc

SEQ ID NO: 3560102 - RNA, 12 nt, Pseudomonas putida KT2440
ucacccagcacu

SEQ ID NO: 3560103 - RNA, 12 nt, Pseudomonas putida KT2440
ucacccagcgcu

SEQ ID NO: 3560104 - RNA, 20 nt, Pseudomonas putida KT2440
ucacccaggugcaacccggc

SEQ ID NO: 3560105 - RNA, 16 nt, Pseudomonas putida KT2440
ucacccagucaccuug

SEQ ID NO: 3560106 - RNA, 20 nt, Pseudomonas putida KT2440
ucacccccgaaucagugcac

SEQ ID NO: 3560107 - RNA, 15 nt, Pseudomonas putida KT2440
ucaccccguacaccc

SEQ ID NO: 3560108 - RNA, 16 nt, Pseudomonas putida KT2440
ucaccccguggccccg

SEQ ID NO: 3560109 - RNA, 17 nt, Pseudomonas putida KT2440
ucaccccguucgcccug

SEQ ID NO: 3560110 - RNA, 17 nt, Pseudomonas putida KT2440
ucaccccuuuacuggcc

SEQ ID NO: 3560111 - RNA, 21 nt, Pseudomonas putida KT2440
ucacccgaccagaucaggccg

SEQ ID NO: 3560112 - RNA, 23 nt, Pseudomonas putida KT2440
ucacccgaccagaucaggccgcu

SEQ ID NO: 3560113 - RNA, 14 nt, Pseudomonas putida KT2440
ucacccgcaggguc

SEQ ID NO: 3560114 - RNA, 17 nt, Pseudomonas putida KT2440
ucacccgcgaagaggcc

SEQ ID NO: 3560115 - RNA, 17 nt, Pseudomonas putida KT2440
ucacccgggaacagcag

SEQ ID NO: 3560116 - RNA, 19 nt, Pseudomonas putida KT2440
ucacccgggaacagcagca

SEQ ID NO: 3560117 - RNA, 22 nt, Pseudomonas putida KT2440
ucacccgggaacagcagcaccg

SEQ ID NO: 3560118 - RNA, 18 nt, Pseudomonas putida KT2440
ucacccgugcugcucgcc

SEQ ID NO: 3560119 - RNA, 19 nt, Pseudomonas putida KT2440
ucacccucgcgcagcaucu

SEQ ID NO: 3560120 - RNA, 16 nt, Pseudomonas putida KT2440
ucacccugacgcugca

SEQ ID NO: 3560121 - RNA, 23 nt, Pseudomonas putida KT2440
ucacccugacgcugcacuuccac

SEQ ID NO: 3560122 - RNA, 14 nt, Pseudomonas putida KT2440
ucacccuuggccac

SEQ ID NO: 3560123 - RNA, 22 nt, Pseudomonas putida KT2440
ucacccuugggcaccagcuucc

SEQ ID NO: 3560124 - RNA, 16 nt, Pseudomonas putida KT2440
ucacccuuggucagga

SEQ ID NO: 3560125 - RNA, 14 nt, Pseudomonas putida KT2440
ucaccgacccacag

SEQ ID NO: 3560126 - RNA, 17 nt, Pseudomonas putida KT2440
ucaccgacgugugccca

SEQ ID NO: 3560127 - RNA, 21 nt, Pseudomonas putida KT2440
ucaccgagcugcccaaguaca

SEQ ID NO: 3560128 - RNA, 18 nt, Pseudomonas putida KT2440
ucaccgcaagcugcaccg

SEQ ID NO: 3560129 - RNA, 22 nt, Pseudomonas putida KT2440
ucaccgcagcccagcgccgccg

SEQ ID NO: 3560130 - RNA, 16 nt, Pseudomonas putida KT2440
ucaccgccagcggcaa

SEQ ID NO: 3560131 - RNA, 13 nt, Pseudomonas putida KT2440
ucaccgccccagc

SEQ ID NO: 3560132 - RNA, 15 nt, Pseudomonas putida KT2440
ucaccgcccgcgccg

SEQ ID NO: 3560133 - RNA, 21 nt, Pseudomonas putida KT2440
ucaccgccggcucgucacugc

SEQ ID NO: 3560134 - RNA, 18 nt, Pseudomonas putida KT2440
ucaccgcgcccaagguca

SEQ ID NO: 3560135 - RNA, 11 nt, Pseudomonas putida KT2440
ucaccggcacc

SEQ ID NO: 3560136 - RNA, 21 nt, Pseudomonas putida KT2440
ucaccgggaucgagaucaggu

SEQ ID NO: 3560137 - RNA, 14 nt, Pseudomonas putida KT2440
ucaccgguaccggc

SEQ ID NO: 3560138 - RNA, 17 nt, Pseudomonas putida KT2440
ucaccguguuguucgcc

SEQ ID NO: 3560139 - RNA, 20 nt, Pseudomonas putida KT2440
ucaccguucuugauccagcu

SEQ ID NO: 3560140 - RNA, 15 nt, Pseudomonas putida KT2440
ucaccguugccgcca

SEQ ID NO: 3560141 - RNA, 15 nt, Pseudomonas putida KT2440
ucaccuccaguugcc

SEQ ID NO: 3560142 - RNA, 19 nt, Pseudomonas putida KT2440
ucaccucgguaaaggugcc

SEQ ID NO: 3560143 - RNA, 18 nt, Pseudomonas putida KT2440
ucaccugaccaucagccu

SEQ ID NO: 3560144 - RNA, 13 nt, Pseudomonas putida KT2440
ucaccugcggccu

SEQ ID NO: 3560145 - RNA, 13 nt, Pseudomonas putida KT2440
ucaccuggcccac

SEQ ID NO: 3560146 - RNA, 13 nt, Pseudomonas putida KT2440
ucaccuggccgug

SEQ ID NO: 3560147 - RNA, 12 nt, Pseudomonas putida KT2440
ucaccugggcga

SEQ ID NO: 3560148 - RNA, 21 nt, Pseudomonas putida KT2440
ucaccugguaccccucgacgc

SEQ ID NO: 3560149 - RNA, 15 nt, Pseudomonas putida KT2440
ucaccugguuugagg

SEQ ID NO: 3560150 - RNA, 21 nt, Pseudomonas putida KT2440
ucaccuguucccccaccggcc

SEQ ID NO: 3560151 - RNA, 15 nt, Pseudomonas putida KT2440
ucaccuucguccuug

SEQ ID NO: 3560152 - RNA, 21 nt, Pseudomonas putida KT2440
ucaccuugcugaaauccagcc

SEQ ID NO: 3560153 - RNA, 22 nt, Pseudomonas putida KT2440
ucaccuugcuggaacugcugca

SEQ ID NO: 3560154 - RNA, 12 nt, Pseudomonas putida KT2440
ucaccuuggccg

SEQ ID NO: 3560155 - RNA, 13 nt, Pseudomonas putida KT2440
ucaccuuggccgc

SEQ ID NO: 3560156 - RNA, 17 nt, Pseudomonas putida KT2440
ucaccuuguccagcagg

SEQ ID NO: 3560157 - RNA, 17 nt, Pseudomonas putida KT2440
ucaccuuugagugcuuc

SEQ ID NO: 3560158 - RNA, 15 nt, Pseudomonas putida KT2440
ucacgaacaccagcc

SEQ ID NO: 3560159 - RNA, 15 nt, Pseudomonas putida KT2440
ucacgaacagccaga

SEQ ID NO: 3560160 - RNA, 22 nt, Pseudomonas putida KT2440
ucacgaaccugugaagccaggg

SEQ ID NO: 3560161 - RNA, 21 nt, Pseudomonas putida KT2440
ucacgaagccguugaggccga

SEQ ID NO: 3560162 - RNA, 22 nt, Pseudomonas putida KT2440
ucacgacuuugaugccaacuuc

SEQ ID NO: 3560163 - RNA, 15 nt, Pseudomonas putida KT2440
ucacgaucaugcugg

SEQ ID NO: 3560164 - RNA, 18 nt, Pseudomonas putida KT2440
ucacgauccccaccagca

SEQ ID NO: 3560165 - RNA, 16 nt, Pseudomonas putida KT2440
ucacgaucgccaaccc

SEQ ID NO: 3560166 - RNA, 20 nt, Pseudomonas putida KT2440
ucacgaugacccuuccagcc

SEQ ID NO: 3560167 - RNA, 17 nt, Pseudomonas putida KT2440
ucacgcaagcggcccug

SEQ ID NO: 3560168 - RNA, 21 nt, Pseudomonas putida KT2440
ucacgcaagcggcccugaucc

SEQ ID NO: 3560169 - RNA, 15 nt, Pseudomonas putida KT2440
ucacgcacggccuuc

SEQ ID NO: 3560170 - RNA, 18 nt, Pseudomonas putida KT2440
ucacgcagcccuuucagg

SEQ ID NO: 3560171 - RNA, 19 nt, Pseudomonas putida KT2440
ucacgcagcccuuucaggg

SEQ ID NO: 3560172 - RNA, 12 nt, Pseudomonas putida KT2440
ucacgcagggcc

SEQ ID NO: 3560173 - RNA, 15 nt, Pseudomonas putida KT2440
ucacgcaucugcgcu

SEQ ID NO: 3560174 - RNA, 18 nt, Pseudomonas putida KT2440
ucacgcaucugcgcuacc

SEQ ID NO: 3560175 - RNA, 23 nt, Pseudomonas putida KT2440
ucacgcauguaguccaaagcuuu

SEQ ID NO: 3560176 - RNA, 21 nt, Pseudomonas putida KT2440
ucacgcccaucaggaacagcu

SEQ ID NO: 3560177 - RNA, 20 nt, Pseudomonas putida KT2440
ucacgccccuuggcacggcc

SEQ ID NO: 3560178 - RNA, 17 nt, Pseudomonas putida KT2440
ucacgcccgacuggcug

SEQ ID NO: 3560179 - RNA, 14 nt, Pseudomonas putida KT2440
ucacgcccgggcca

SEQ ID NO: 3560180 - RNA, 17 nt, Pseudomonas putida KT2440
ucacgcccgggccaggc

SEQ ID NO: 3560181 - RNA, 17 nt, Pseudomonas putida KT2440
ucacgcgaccucagccg

SEQ ID NO: 3560182 - RNA, 17 nt, Pseudomonas putida KT2440
ucacgcgccacauagcu

SEQ ID NO: 3560183 - RNA, 13 nt, Pseudomonas putida KT2440
ucacgcucaugcu

SEQ ID NO: 3560184 - RNA, 19 nt, Pseudomonas putida KT2440
ucacgcucguuguccagca

SEQ ID NO: 3560185 - RNA, 23 nt, Pseudomonas putida KT2440
ucacgcucguuguccagcagcag

SEQ ID NO: 3560186 - RNA, 14 nt, Pseudomonas putida KT2440
ucacgcuggccauu

SEQ ID NO: 3560187 - RNA, 14 nt, Pseudomonas putida KT2440
ucacggcgcaggcc

SEQ ID NO: 3560188 - RNA, 23 nt, Pseudomonas putida KT2440
ucacggcgcaggccgacaacagc

SEQ ID NO: 3560189 - RNA, 13 nt, Pseudomonas putida KT2440
ucacggcgcgggu

SEQ ID NO: 3560190 - RNA, 22 nt, Pseudomonas putida KT2440
ucacgggucaugccaccgccac

SEQ ID NO: 3560191 - RNA, 21 nt, Pseudomonas putida KT2440
ucacggucaguaccuggccgc

SEQ ID NO: 3560192 - RNA, 16 nt, Pseudomonas putida KT2440
ucacguaaucggcguu

SEQ ID NO: 3560193 - RNA, 17 nt, Pseudomonas putida KT2440
ucacguagaacaggccu

SEQ ID NO: 3560194 - RNA, 21 nt, Pseudomonas putida KT2440
ucacguagaacaggccugcgg

SEQ ID NO: 3560195 - RNA, 16 nt, Pseudomonas putida KT2440
ucacgucacagccaag

SEQ ID NO: 3560196 - RNA, 14 nt, Pseudomonas putida KT2440
ucacgucacccagg

SEQ ID NO: 3560197 - RNA, 20 nt, Pseudomonas putida KT2440
ucacguccaaugccgccuug

SEQ ID NO: 3560198 - RNA, 17 nt, Pseudomonas putida KT2440
ucagcgcguccagcaac

SEQ ID NO: 3560199 - RNA, 18 nt, Pseudomonas putida KT2440
ucagcgcguccagcaaca

SEQ ID NO: 3560200 - RNA, 16 nt, Pseudomonas putida KT2440
ucagcgcucaaaaaaa

SEQ ID NO: 3560201 - RNA, 19 nt, Pseudomonas putida KT2440
ucagcgcucaaaaaaauac

SEQ ID NO: 3560202 - RNA, 21 nt, Pseudomonas putida KT2440
ucagcgcucaaaaaaauacgu

SEQ ID NO: 3560203 - RNA, 22 nt, Pseudomonas putida KT2440
ucagcgcugacucagcggccuu

SEQ ID NO: 3560204 - RNA, 18 nt, Pseudomonas putida KT2440
ucagcggaccaggugcag

SEQ ID NO: 3560205 - RNA, 17 nt, Pseudomonas putida KT2440
ucagcggcaacaccagc

SEQ ID NO: 3560206 - RNA, 20 nt, Pseudomonas putida KT2440
ucagcggcaacaccagcagc

SEQ ID NO: 3560207 - RNA, 14 nt, Pseudomonas putida KT2440
ucagcggcacggcc

SEQ ID NO: 3560208 - RNA, 19 nt, Pseudomonas putida KT2440
ucagcggccuuucugcuuc

SEQ ID NO: 3560209 - RNA, 17 nt, Pseudomonas putida KT2440
ucagcggcuuguucagc

SEQ ID NO: 3560210 - RNA, 20 nt, Pseudomonas putida KT2440
ucagcggcuuguucagcugg

SEQ ID NO: 3560211 - RNA, 19 nt, Pseudomonas putida KT2440
ucagcgggcgauugccagg

SEQ ID NO: 3560212 - RNA, 18 nt, Pseudomonas putida KT2440
ucagcgggucgagccagg

SEQ ID NO: 3560213 - RNA, 20 nt, Pseudomonas putida KT2440
ucagcgggucgagccaggcg

SEQ ID NO: 3560214 - RNA, 20 nt, Pseudomonas putida KT2440
ucagcgguucgaccaauggc

SEQ ID NO: 3560215 - RNA, 16 nt, Pseudomonas putida KT2440
ucagcguacacugcag

SEQ ID NO: 3560216 - RNA, 19 nt, Pseudomonas putida KT2440
ucagcguacacugcaggag

SEQ ID NO: 3560217 - RNA, 14 nt, Pseudomonas putida KT2440
ucagcgucaugaac

SEQ ID NO: 3560218 - RNA, 20 nt, Pseudomonas putida KT2440
ucagcgugacgauggccacc

SEQ ID NO: 3560219 - RNA, 18 nt, Pseudomonas putida KT2440
ucagcgugugcugggugu

SEQ ID NO: 3560220 - RNA, 15 nt, Pseudomonas putida KT2440
ucagcguugcuggcg

SEQ ID NO: 3560221 - RNA, 14 nt, Pseudomonas putida KT2440
ucagcuacgcugga

SEQ ID NO: 3560222 - RNA, 21 nt, Pseudomonas putida KT2440
ucagcuacgcuggacuugccu

SEQ ID NO: 3560223 - RNA, 16 nt, Pseudomonas putida KT2440
ucagcucaagcgcucc

SEQ ID NO: 3560224 - RNA, 16 nt, Pseudomonas putida KT2440
ucagcucaaucagcca

SEQ ID NO: 3560225 - RNA, 23 nt, Pseudomonas putida KT2440
ucagcucacguuugggcggcgug

SEQ ID NO: 3560226 - RNA, 16 nt, Pseudomonas putida KT2440
ucagcucgaacccacu

SEQ ID NO: 3560227 - RNA, 17 nt, Pseudomonas putida KT2440
ucagcucgaucaggcuc

SEQ ID NO: 3560228 - RNA, 15 nt, Pseudomonas putida KT2440
ucagcucgcacaucu

SEQ ID NO: 3560229 - RNA, 16 nt, Pseudomonas putida KT2440
ucagcucggcacugua

SEQ ID NO: 3560230 - RNA, 14 nt, Pseudomonas putida KT2440
ucagcucggcaugu

SEQ ID NO: 3560231 - RNA, 13 nt, Pseudomonas putida KT2440
ucagcucggccac

SEQ ID NO: 3560232 - RNA, 19 nt, Pseudomonas putida KT2440
ucagcucggccacccgcgu

SEQ ID NO: 3560233 - RNA, 20 nt, Pseudomonas putida KT2440
ucagcucgugggucaucuug

SEQ ID NO: 3560234 - RNA, 16 nt, Pseudomonas putida KT2440
ucagcucuucgaucuc

SEQ ID NO: 3560235 - RNA, 14 nt, Pseudomonas putida KT2440
ucagcugccacucu

SEQ ID NO: 3560236 - RNA, 16 nt, Pseudomonas putida KT2440
ucagcugcugcucuuu

SEQ ID NO: 3560237 - RNA, 21 nt, Pseudomonas putida KT2440
ucagcuggaacgcuuggccag

SEQ ID NO: 3560238 - RNA, 19 nt, Pseudomonas putida KT2440
ucagcuggccggcuuggca

SEQ ID NO: 3560239 - RNA, 18 nt, Pseudomonas putida KT2440
ucagcugggagagcgccu

SEQ ID NO: 3560240 - RNA, 15 nt, Pseudomonas putida KT2440
ucagcuggucgaggc

SEQ ID NO: 3560241 - RNA, 19 nt, Pseudomonas putida KT2440
ucagcuggucgaggcggcu

SEQ ID NO: 3560242 - RNA, 16 nt, Pseudomonas putida KT2440
ucagcugguucugcug

SEQ ID NO: 3560243 - RNA, 18 nt, Pseudomonas putida KT2440
ucagcugguucugcugca

SEQ ID NO: 3560244 - RNA, 20 nt, Pseudomonas putida KT2440
ucagcugguucugcugcagc

SEQ ID NO: 3560245 - RNA, 21 nt, Pseudomonas putida KT2440
ucagcugguucugcugcagcc

SEQ ID NO: 3560246 - RNA, 19 nt, Pseudomonas putida KT2440
ucagcuuaacgcuuggcca

SEQ ID NO: 3560247 - RNA, 21 nt, Pseudomonas putida KT2440
ucagcuuaacgcuuggccaga

SEQ ID NO: 3560248 - RNA, 23 nt, Pseudomonas putida KT2440
ucagcuucaaaauagucgaaggc

SEQ ID NO: 3560249 - RNA, 14 nt, Pseudomonas putida KT2440
ucagcuucauggcg

SEQ ID NO: 3560250 - RNA, 21 nt, Pseudomonas putida KT2440
ucagcuucucgcgcuuggcca

SEQ ID NO: 3560251 - RNA, 20 nt, Pseudomonas putida KT2440
ucagcuucuggguaucguuc

SEQ ID NO: 3560252 - RNA, 19 nt, Pseudomonas putida KT2440
ucagcuugccuuccgggaa

SEQ ID NO: 3560253 - RNA, 14 nt, Pseudomonas putida KT2440
ucagcuuguagcgg

SEQ ID NO: 3560254 - RNA, 16 nt, Pseudomonas putida KT2440
ucagcuugucgaccag

SEQ ID NO: 3560255 - RNA, 20 nt, Pseudomonas putida KT2440
ucaggaacaaucuucuucau

SEQ ID NO: 3560256 - RNA, 23 nt, Pseudomonas putida KT2440
ucaggaacagcucgauggccagg

SEQ ID NO: 3560257 - RNA, 21 nt, Pseudomonas putida KT2440
ucaggaugccgugcgcggcau

SEQ ID NO: 3560258 - RNA, 17 nt, Pseudomonas putida KT2440
ucaggaugcuucggcug

SEQ ID NO: 3560259 - RNA, 21 nt, Pseudomonas putida KT2440
ucaggaugcuucggcugaucu

SEQ ID NO: 3560260 - RNA, 23 nt, Pseudomonas putida KT2440
ucaggcaaaacaaaaagcgcagc

SEQ ID NO: 3560261 - RNA, 22 nt, Pseudomonas putida KT2440
ucaggcaaacgaaaucugccug

SEQ ID NO: 3560262 - RNA, 23 nt, Pseudomonas putida KT2440
ucaggcaaacgaaaucugccugc

SEQ ID NO: 3560263 - RNA, 12 nt, Pseudomonas putida KT2440
ucaggcacaggc

SEQ ID NO: 3560264 - RNA, 13 nt, Pseudomonas putida KT2440
ucaggcaccagcg

SEQ ID NO: 3560265 - RNA, 18 nt, Pseudomonas putida KT2440
ucaggcacggcaccagca

SEQ ID NO: 3560266 - RNA, 16 nt, Pseudomonas putida KT2440
ucaggcagaagguagg

SEQ ID NO: 3560267 - RNA, 20 nt, Pseudomonas putida KT2440
ucaggcagcucaaagagcaa

SEQ ID NO: 3560268 - RNA, 16 nt, Pseudomonas putida KT2440
ucaggcaggccagcac

SEQ ID NO: 3560269 - RNA, 22 nt, Pseudomonas putida KT2440
ucaggcaucgcuuucaguagaa

SEQ ID NO: 3560270 - RNA, 15 nt, Pseudomonas putida KT2440
ucaggcaugccagca

SEQ ID NO: 3560271 - RNA, 21 nt, Pseudomonas putida KT2440
ucaggccaaguacggccagca

SEQ ID NO: 3560272 - RNA, 21 nt, Pseudomonas putida KT2440
ucaggcccaccagucugcuca

SEQ ID NO: 3560273 - RNA, 22 nt, Pseudomonas putida KT2440
ucaggcccaccagucugcucag

SEQ ID NO: 3560274 - RNA, 14 nt, Pseudomonas putida KT2440
ucaggccccaguca

SEQ ID NO: 3560275 - RNA, 15 nt, Pseudomonas putida KT2440
ucaggcccugcugcu

SEQ ID NO: 3560276 - RNA, 15 nt, Pseudomonas putida KT2440
ucaggccgaugggca

SEQ ID NO: 3560277 - RNA, 21 nt, Pseudomonas putida KT2440
ucaggccgaugggcaggccau

SEQ ID NO: 3560278 - RNA, 13 nt, Pseudomonas putida KT2440
ucaggccgccuug

SEQ ID NO: 3560279 - RNA, 16 nt, Pseudomonas putida KT2440
ucaggccgccuuggcu

SEQ ID NO: 3560280 - RNA, 16 nt, Pseudomonas putida KT2440
ucaggccguagcgcug

SEQ ID NO: 3560281 - RNA, 20 nt, Pseudomonas putida KT2440
ucaggccguagcgcugacca

SEQ ID NO: 3560282 - RNA, 20 nt, Pseudomonas putida KT2440
ucaggccuucgccacugcca

SEQ ID NO: 3560283 - RNA, 14 nt, Pseudomonas putida KT2440
ucaggcgcagcaca

SEQ ID NO: 3560284 - RNA, 20 nt, Pseudomonas putida KT2440
ucaggcgcuccagcaggguc

SEQ ID NO: 3560285 - RNA, 12 nt, Pseudomonas putida KT2440
ucaggcucagcu

SEQ ID NO: 3560286 - RNA, 18 nt, Pseudomonas putida KT2440
ucaggcucaguugcaagu

SEQ ID NO: 3560287 - RNA, 17 nt, Pseudomonas putida KT2440
ucaggcugagcagacca

SEQ ID NO: 3560288 - RNA, 13 nt, Pseudomonas putida KT2440
ucaggcugaucac

SEQ ID NO: 3560289 - RNA, 18 nt, Pseudomonas putida KT2440
ucaggcugaucaccgccg

SEQ ID NO: 3560290 - RNA, 21 nt, Pseudomonas putida KT2440
ucaggcugaucaccgccgcca

SEQ ID NO: 3560291 - RNA, 21 nt, Pseudomonas putida KT2440
ucaggcugcgcccgcacagca

SEQ ID NO: 3560292 - RNA, 20 nt, Pseudomonas putida KT2440
ucaggcuuugcugcaggucc

SEQ ID NO: 3560293 - RNA, 21 nt, Pseudomonas putida KT2440
ucagggauacugcugaaccug

SEQ ID NO: 3560294 - RNA, 16 nt, Pseudomonas putida KT2440
ucagggcaauagccac

SEQ ID NO: 3560295 - RNA, 15 nt, Pseudomonas putida KT2440
ucagggcacggcugc

SEQ ID NO: 3560296 - RNA, 19 nt, Pseudomonas putida KT2440
ucagggcacggcugcccug

SEQ ID NO: 3560297 - RNA, 23 nt, Pseudomonas putida KT2440
ucagggcacggcugcccugcaug

SEQ ID NO: 3560298 - RNA, 14 nt, Pseudomonas putida KT2440
ucagggcagcaacg

SEQ ID NO: 3560299 - RNA, 18 nt, Pseudomonas putida KT2440
ucagggcccgggcacggg

SEQ ID NO: 3560300 - RNA, 22 nt, Pseudomonas putida KT2440
ucagggccgcagagcggcccug

SEQ ID NO: 3560301 - RNA, 17 nt, Pseudomonas putida KT2440
ucagggcgaugcgcaca

SEQ ID NO: 3560302 - RNA, 22 nt, Pseudomonas putida KT2440
ucauccggcgcggccugcucca

SEQ ID NO: 3560303 - RNA, 20 nt, Pseudomonas putida KT2440
ucauccggguuccagccguc

SEQ ID NO: 3560304 - RNA, 17 nt, Pseudomonas putida KT2440
ucauccucgacgaccag

SEQ ID NO: 3560305 - RNA, 14 nt, Pseudomonas putida KT2440
ucaucgaacaccuc

SEQ ID NO: 3560306 - RNA, 18 nt, Pseudomonas putida KT2440
ucaucgaagaucagcuca

SEQ ID NO: 3560307 - RNA, 15 nt, Pseudomonas putida KT2440
ucaucgacuggaugc

SEQ ID NO: 3560308 - RNA, 17 nt, Pseudomonas putida KT2440
ucaucgacuggaugcuc

SEQ ID NO: 3560309 - RNA, 18 nt, Pseudomonas putida KT2440
ucaucgacuggaugcucg

SEQ ID NO: 3560310 - RNA, 16 nt, Pseudomonas putida KT2440
ucaucgagauguggcc

SEQ ID NO: 3560311 - RNA, 15 nt, Pseudomonas putida KT2440
ucaucgauacccacg

SEQ ID NO: 3560312 - RNA, 22 nt, Pseudomonas putida KT2440
ucaucgaugcccgucccuucau

SEQ ID NO: 3560313 - RNA, 19 nt, Pseudomonas putida KT2440
ucaucgccaagccgccauu

SEQ ID NO: 3560314 - RNA, 20 nt, Pseudomonas putida KT2440
ucaucgccggguccaccagc

SEQ ID NO: 3560315 - RNA, 15 nt, Pseudomonas putida KT2440
ucaucgcgccgacca

SEQ ID NO: 3560316 - RNA, 23 nt, Pseudomonas putida KT2440
ucaucggcaaaugaucaccgcgu

SEQ ID NO: 3560317 - RNA, 20 nt, Pseudomonas putida KT2440
ucaucggcacgcccagcaac

SEQ ID NO: 3560318 - RNA, 21 nt, Pseudomonas putida KT2440
ucaucggcaguagagccccca

SEQ ID NO: 3560319 - RNA, 17 nt, Pseudomonas putida KT2440
ucaucgggaucagcacg

SEQ ID NO: 3560320 - RNA, 20 nt, Pseudomonas putida KT2440
ucaucgggaucagcacgccc

SEQ ID NO: 3560321 - RNA, 21 nt, Pseudomonas putida KT2440
ucaucgggaucagcacgccca

SEQ ID NO: 3560322 - RNA, 17 nt, Pseudomonas putida KT2440
ucaucgguuuuuccaug

SEQ ID NO: 3560323 - RNA, 13 nt, Pseudomonas putida KT2440
ucaucuaccagcu

SEQ ID NO: 3560324 - RNA, 12 nt, Pseudomonas putida KT2440
ucaucuccauga

SEQ ID NO: 3560325 - RNA, 15 nt, Pseudomonas putida KT2440
ucaucugcccgcgcc

SEQ ID NO: 3560326 - RNA, 17 nt, Pseudomonas putida KT2440
ucaucugcgccugugca

SEQ ID NO: 3560327 - RNA, 11 nt, Pseudomonas putida KT2440
ucaucuucuug

SEQ ID NO: 3560328 - RNA, 14 nt, Pseudomonas putida KT2440
ucaugaacagcgcc

SEQ ID NO: 3560329 - RNA, 18 nt, Pseudomonas putida KT2440
ucaugaacagcgcccaga

SEQ ID NO: 3560330 - RNA, 13 nt, Pseudomonas putida KT2440
ucaugaaggcggg

SEQ ID NO: 3560331 - RNA, 22 nt, Pseudomonas putida KT2440
ucaugcacaacgcgcgggcaau

SEQ ID NO: 3560332 - RNA, 15 nt, Pseudomonas putida KT2440
ucaugcacgcagcaa

SEQ ID NO: 3560333 - RNA, 14 nt, Pseudomonas putida KT2440
ucaugcccaccgcu

SEQ ID NO: 3560334 - RNA, 15 nt, Pseudomonas putida KT2440
ucaugcccauggcca

SEQ ID NO: 3560335 - RNA, 22 nt, Pseudomonas putida KT2440
ucaugcccgcgucugccgcagc

SEQ ID NO: 3560336 - RNA, 16 nt, Pseudomonas putida KT2440
ucaugccggccccaga

SEQ ID NO: 3560337 - RNA, 15 nt, Pseudomonas putida KT2440
ucaugcgacaggcgu

SEQ ID NO: 3560338 - RNA, 17 nt, Pseudomonas putida KT2440
ucaugcgcuggccacga

SEQ ID NO: 3560339 - RNA, 23 nt, Pseudomonas putida KT2440
ucaugcgggaagccaugcaccuc

SEQ ID NO: 3560340 - RNA, 15 nt, Pseudomonas putida KT2440
ucaugcgguacagca

SEQ ID NO: 3560341 - RNA, 22 nt, Pseudomonas putida KT2440
ucaugcugcugcagcacugccu

SEQ ID NO: 3560342 - RNA, 13 nt, Pseudomonas putida KT2440
ucaugcuggccag

SEQ ID NO: 3560343 - RNA, 14 nt, Pseudomonas putida KT2440
ucaugcuggccagg

SEQ ID NO: 3560344 - RNA, 18 nt, Pseudomonas putida KT2440
ucaugcuggccaggaugc

SEQ ID NO: 3560345 - RNA, 19 nt, Pseudomonas putida KT2440
ucaugcuggccaggaugcc

SEQ ID NO: 3560346 - RNA, 11 nt, Pseudomonas putida KT2440
ucauggcaguc

SEQ ID NO: 3560347 - RNA, 23 nt, Pseudomonas putida KT2440
ucauggcagucguacgcgggcag

SEQ ID NO: 3560348 - RNA, 21 nt, Pseudomonas putida KT2440
ucauggcgcgccaugccccua

SEQ ID NO: 3560349 - RNA, 14 nt, Pseudomonas putida KT2440
ucauggcucacacc

SEQ ID NO: 3560350 - RNA, 23 nt, Pseudomonas putida KT2440
ucauggcuugagcuuagcgcgca

SEQ ID NO: 3560351 - RNA, 13 nt, Pseudomonas putida KT2440
ucaugggccaugc

SEQ ID NO: 3560352 - RNA, 15 nt, Pseudomonas putida KT2440
ucauggucaacagcc

SEQ ID NO: 3560353 - RNA, 14 nt, Pseudomonas putida KT2440
ucauggucagccgg

SEQ ID NO: 3560354 - RNA, 23 nt, Pseudomonas putida KT2440
ucaugguggauggucagcgcuuc

SEQ ID NO: 3560355 - RNA, 23 nt, Pseudomonas putida KT2440
ucauguaggcauauccggccuuu

SEQ ID NO: 3560356 - RNA, 15 nt, Pseudomonas putida KT2440
ucaugucggcagcca

SEQ ID NO: 3560357 - RNA, 17 nt, Pseudomonas putida KT2440
ucauucaaagccugcuc

SEQ ID NO: 3560358 - RNA, 16 nt, Pseudomonas putida KT2440
ucauucagcuuuggcu

SEQ ID NO: 3560359 - RNA, 16 nt, Pseudomonas putida KT2440
ucauugaguuggugag

SEQ ID NO: 3560360 - RNA, 17 nt, Pseudomonas putida KT2440
ucauugcccaagcgcuc

SEQ ID NO: 3560361 - RNA, 14 nt, Pseudomonas putida KT2440
ucauugcucaccgu

SEQ ID NO: 3560362 - RNA, 23 nt, Pseudomonas putida KT2440
ucauugcugcgguaccggccagc

SEQ ID NO: 3560363 - RNA, 18 nt, Pseudomonas putida KT2440
ucauugggucccugguuc

SEQ ID NO: 3560364 - RNA, 19 nt, Pseudomonas putida KT2440
ucauuuccugaaccaugcg

SEQ ID NO: 3560365 - RNA, 13 nt, Pseudomonas putida KT2440
uccaaaccugcga

SEQ ID NO: 3560366 - RNA, 15 nt, Pseudomonas putida KT2440
uccaaauaaagaucu

SEQ ID NO: 3560367 - RNA, 12 nt, Pseudomonas putida KT2440
uccaacaaacuc

SEQ ID NO: 3560368 - RNA, 18 nt, Pseudomonas putida KT2440
uccaacaagucuuccccu

SEQ ID NO: 3560369 - RNA, 15 nt, Pseudomonas putida KT2440
uccaaccagccagcc

SEQ ID NO: 3560370 - RNA, 17 nt, Pseudomonas putida KT2440
uccaacgcauccaggcg

SEQ ID NO: 3560371 - RNA, 22 nt, Pseudomonas putida KT2440
uccaacgggcggaacuggcccu

SEQ ID NO: 3560372 - RNA, 17 nt, Pseudomonas putida KT2440
uccaagccgcuucacug

SEQ ID NO: 3560373 - RNA, 15 nt, Pseudomonas putida KT2440
uccaagugccgugca

SEQ ID NO: 3560374 - RNA, 19 nt, Pseudomonas putida KT2440
uccaauacauacaccaacg

SEQ ID NO: 3560375 - RNA, 18 nt, Pseudomonas putida KT2440
uccaaugagaauaauucu

SEQ ID NO: 3560376 - RNA, 21 nt, Pseudomonas putida KT2440
uccaaugccgccuugcagaaa

SEQ ID NO: 3560377 - RNA, 14 nt, Pseudomonas putida KT2440
uccacaaaccccga

SEQ ID NO: 3560378 - RNA, 23 nt, Pseudomonas putida KT2440
uccacaaaccccgacgccggccu

SEQ ID NO: 3560379 - RNA, 23 nt, Pseudomonas putida KT2440
uccacaaacucuccuugcguugc

SEQ ID NO: 3560380 - RNA, 22 nt, Pseudomonas putida KT2440
uccacaccaaagucagccagcc

SEQ ID NO: 3560381 - RNA, 12 nt, Pseudomonas putida KT2440
uccacaccagcg

SEQ ID NO: 3560382 - RNA, 17 nt, Pseudomonas putida KT2440
uccacaccuucggcaug

SEQ ID NO: 3560383 - RNA, 15 nt, Pseudomonas putida KT2440
uccacacgcugcugc

SEQ ID NO: 3560384 - RNA, 18 nt, Pseudomonas putida KT2440
uccacacucgacgcugcc

SEQ ID NO: 3560385 - RNA, 12 nt, Pseudomonas putida KT2440
uccacagccucc

SEQ ID NO: 3560386 - RNA, 20 nt, Pseudomonas putida KT2440
uccacagguaccaggcugcc

SEQ ID NO: 3560387 - RNA, 15 nt, Pseudomonas putida KT2440
uccacauaggccagc

SEQ ID NO: 3560388 - RNA, 17 nt, Pseudomonas putida KT2440
uccacaucacugcugua

SEQ ID NO: 3560389 - RNA, 18 nt, Pseudomonas putida KT2440
uccaccacagcugcgcca

SEQ ID NO: 3560390 - RNA, 16 nt, Pseudomonas putida KT2440
uccaccaccugcaggg

SEQ ID NO: 3560391 - RNA, 14 nt, Pseudomonas putida KT2440
uccaccagccgccg

SEQ ID NO: 3560392 - RNA, 13 nt, Pseudomonas putida KT2440
uccaccagcggcu

SEQ ID NO: 3560393 - RNA, 17 nt, Pseudomonas putida KT2440
uccaccagcucacgcaa

SEQ ID NO: 3560394 - RNA, 12 nt, Pseudomonas putida KT2440
uccaccaggccg

SEQ ID NO: 3560395 - RNA, 14 nt, Pseudomonas putida KT2440
uccaccaggccgau

SEQ ID NO: 3560396 - RNA, 21 nt, Pseudomonas putida KT2440
uccaccaggcuggccaccacc

SEQ ID NO: 3560397 - RNA, 19 nt, Pseudomonas putida KT2440
uccaccaucaagucauccg

SEQ ID NO: 3560398 - RNA, 16 nt, Pseudomonas putida KT2440
uccaccaucuccagcu

SEQ ID NO: 3560399 - RNA, 17 nt, Pseudomonas putida KT2440
uccaccauucccugcac

SEQ ID NO: 3560400 - RNA, 16 nt, Pseudomonas putida KT2440
uccacccacccucgca

SEQ ID NO: 3560401 - RNA, 15 nt, Pseudomonas putida KT2440
uccaccccacccucg

SEQ ID NO: 3560402 - RNA, 23 nt, Pseudomonas putida KT2440
uccacccccgcuccuacggccga

SEQ ID NO: 3560403 - RNA, 22 nt, Pseudomonas putida KT2440
uccaccccgcaggccgcagccu

SEQ ID NO: 3560404 - RNA, 19 nt, Pseudomonas putida KT2440
uccaccccggcagugccug

SEQ ID NO: 3560405 - RNA, 21 nt, Pseudomonas putida KT2440
uccacccggucccgcccggcc

SEQ ID NO: 3560406 - RNA, 20 nt, Pseudomonas putida KT2440
uccaccgaaaucagcaacgc

SEQ ID NO: 3560407 - RNA, 18 nt, Pseudomonas putida KT2440
uccagcuuuggcugcagg

SEQ ID NO: 3560408 - RNA, 14 nt, Pseudomonas putida KT2440
uccaggaacgcugc

SEQ ID NO: 3560409 - RNA, 23 nt, Pseudomonas putida KT2440
uccaggaacgcugccuccacacc

SEQ ID NO: 3560410 - RNA, 16 nt, Pseudomonas putida KT2440
uccaggaagcaggcgu

SEQ ID NO: 3560411 - RNA, 22 nt, Pseudomonas putida KT2440
uccaggacaaaccagcggucug

SEQ ID NO: 3560412 - RNA, 12 nt, Pseudomonas putida KT2440
uccaggcacacc

SEQ ID NO: 3560413 - RNA, 17 nt, Pseudomonas putida KT2440
uccaggcacaccgagcc

SEQ ID NO: 3560414 - RNA, 18 nt, Pseudomonas putida KT2440
uccaggcagccugccagg

SEQ ID NO: 3560415 - RNA, 23 nt, Pseudomonas putida KT2440
uccaggcccgugacgaaggcggu

SEQ ID NO: 3560416 - RNA, 17 nt, Pseudomonas putida KT2440
uccaggccgaaaccgcc

SEQ ID NO: 3560417 - RNA, 21 nt, Pseudomonas putida KT2440
uccaggcgcaaguagaaccac

SEQ ID NO: 3560418 - RNA, 19 nt, Pseudomonas putida KT2440
uccaggcguucaucgaagg

SEQ ID NO: 3560419 - RNA, 22 nt, Pseudomonas putida KT2440
uccaggcguucaucgaaggccu

SEQ ID NO: 3560420 - RNA, 13 nt, Pseudomonas putida KT2440
uccaggcucagcu

SEQ ID NO: 3560421 - RNA, 16 nt, Pseudomonas putida KT2440
uccaggcucagcucgu

SEQ ID NO: 3560422 - RNA, 15 nt, Pseudomonas putida KT2440
uccaggcugcacugg

SEQ ID NO: 3560423 - RNA, 23 nt, Pseudomonas putida KT2440
uccaggcugcgcaucaggcugcg

SEQ ID NO: 3560424 - RNA, 18 nt, Pseudomonas putida KT2440
uccaggcuggccagcaag

SEQ ID NO: 3560425 - RNA, 23 nt, Pseudomonas putida KT2440
uccagggcaauggcgucacagac

SEQ ID NO: 3560426 - RNA, 14 nt, Pseudomonas putida KT2440
uccaggguggcguu

SEQ ID NO: 3560427 - RNA, 18 nt, Pseudomonas putida KT2440
uccagguagcgcaaaugg

SEQ ID NO: 3560428 - RNA, 19 nt, Pseudomonas putida KT2440
uccagguagcgcucgacau

SEQ ID NO: 3560429 - RNA, 16 nt, Pseudomonas putida KT2440
uccagguccaggccag

SEQ ID NO: 3560430 - RNA, 17 nt, Pseudomonas putida KT2440
uccagguccaggccagc

SEQ ID NO: 3560431 - RNA, 15 nt, Pseudomonas putida KT2440
uccagguccugcucc

SEQ ID NO: 3560432 - RNA, 15 nt, Pseudomonas putida KT2440
uccagguccuugcug

SEQ ID NO: 3560433 - RNA, 16 nt, Pseudomonas putida KT2440
uccaggugaaucagcg

SEQ ID NO: 3560434 - RNA, 22 nt, Pseudomonas putida KT2440
uccaggugcccaugaucuugcu

SEQ ID NO: 3560435 - RNA, 17 nt, Pseudomonas putida KT2440
uccaggugcgcaccuug

SEQ ID NO: 3560436 - RNA, 11 nt, Pseudomonas putida KT2440
uccagguggcc

SEQ ID NO: 3560437 - RNA, 17 nt, Pseudomonas putida KT2440
uccagguucucgcucca

SEQ ID NO: 3560438 - RNA, 17 nt, Pseudomonas putida KT2440
uccagguuuggguuggc

SEQ ID NO: 3560439 - RNA, 18 nt, Pseudomonas putida KT2440
uccagucgaucagcgaca

SEQ ID NO: 3560440 - RNA, 19 nt, Pseudomonas putida KT2440
uccagugaagcuuccaguu

SEQ ID NO: 3560441 - RNA, 17 nt, Pseudomonas putida KT2440
uccagugcuucacugcc

SEQ ID NO: 3560442 - RNA, 19 nt, Pseudomonas putida KT2440
uccagugcuucacugccgg

SEQ ID NO: 3560443 - RNA, 22 nt, Pseudomonas putida KT2440
uccagugcuucacugccggcaa

SEQ ID NO: 3560444 - RNA, 18 nt, Pseudomonas putida KT2440
uccaguuccugcuugccg

SEQ ID NO: 3560445 - RNA, 19 nt, Pseudomonas putida KT2440
uccaguugcaagccuucgu

SEQ ID NO: 3560446 - RNA, 11 nt, Pseudomonas putida KT2440
uccaucaaucg

SEQ ID NO: 3560447 - RNA, 13 nt, Pseudomonas putida KT2440
uccaucaccgcca

SEQ ID NO: 3560448 - RNA, 14 nt, Pseudomonas putida KT2440
uccaucaccugccc

SEQ ID NO: 3560449 - RNA, 17 nt, Pseudomonas putida KT2440
uccaucgcaauccccuc

SEQ ID NO: 3560450 - RNA, 16 nt, Pseudomonas putida KT2440
uccaucgucugcauca

SEQ ID NO: 3560451 - RNA, 15 nt, Pseudomonas putida KT2440
uccaucuccagcuca

SEQ ID NO: 3560452 - RNA, 15 nt, Pseudomonas putida KT2440
uccaucuugcugcuc

SEQ ID NO: 3560453 - RNA, 15 nt, Pseudomonas putida KT2440
uccaugaaggccggc

SEQ ID NO: 3560454 - RNA, 17 nt, Pseudomonas putida KT2440
uccaugaaggccggcau

SEQ ID NO: 3560455 - RNA, 22 nt, Pseudomonas putida KT2440
uccaugaaggccggcaucgacg

SEQ ID NO: 3560456 - RNA, 18 nt, Pseudomonas putida KT2440
uccauggcaaaacucacc

SEQ ID NO: 3560457 - RNA, 17 nt, Pseudomonas putida KT2440
uccauggcaaucagcga

SEQ ID NO: 3560458 - RNA, 14 nt, Pseudomonas putida KT2440
uccaugggcaggcc

SEQ ID NO: 3560459 - RNA, 14 nt, Pseudomonas putida KT2440
uccauguagcaccu

SEQ ID NO: 3560460 - RNA, 18 nt, Pseudomonas putida KT2440
uccauguaggagcggguu

SEQ ID NO: 3560461 - RNA, 16 nt, Pseudomonas putida KT2440
uccaugucauaaacgc

SEQ ID NO: 3560462 - RNA, 22 nt, Pseudomonas putida KT2440
uccaugucggaagccugcaucc

SEQ ID NO: 3560463 - RNA, 15 nt, Pseudomonas putida KT2440
uccauugagcacuca

SEQ ID NO: 3560464 - RNA, 16 nt, Pseudomonas putida KT2440
uccauugcgccuguca

SEQ ID NO: 3560465 - RNA, 18 nt, Pseudomonas putida KT2440
uccauugcucgucucugg

SEQ ID NO: 3560466 - RNA, 14 nt, Pseudomonas putida KT2440
uccauuucccuaca

SEQ ID NO: 3560467 - RNA, 23 nt, Pseudomonas putida KT2440
uccauuucgaagcugucuucuuu

SEQ ID NO: 3560468 - RNA, 22 nt, Pseudomonas putida KT2440
ucccaacgcaaauccuccugcg

SEQ ID NO: 3560469 - RNA, 19 nt, Pseudomonas putida KT2440
ucccacaaaaaagcagggc

SEQ ID NO: 3560470 - RNA, 15 nt, Pseudomonas putida KT2440
ucccacaaaggccgc

SEQ ID NO: 3560471 - RNA, 22 nt, Pseudomonas putida KT2440
ucccacagggaccucacagccu

SEQ ID NO: 3560472 - RNA, 22 nt, Pseudomonas putida KT2440
ucccacaggggccgcgcagccu

SEQ ID NO: 3560473 - RNA, 16 nt, Pseudomonas putida KT2440
ucccacagguccagcg

SEQ ID NO: 3560474 - RNA, 20 nt, Pseudomonas putida KT2440
ucccacagguccagcgcagg

SEQ ID NO: 3560475 - RNA, 15 nt, Pseudomonas putida KT2440
ucccacaggugcagc

SEQ ID NO: 3560476 - RNA, 19 nt, Pseudomonas putida KT2440
ucccacaggugcagcacag

SEQ ID NO: 3560477 - RNA, 13 nt, Pseudomonas putida KT2440
ucccacagguucg

SEQ ID NO: 3560478 - RNA, 14 nt, Pseudomonas putida KT2440
ucccacauguaaug

SEQ ID NO: 3560479 - RNA, 23 nt, Pseudomonas putida KT2440
ucccagccugggcgugaaagcag

SEQ ID NO: 3560480 - RNA, 21 nt, Pseudomonas putida KT2440
ucccagcgcugucccccagcc

SEQ ID NO: 3560481 - RNA, 22 nt, Pseudomonas putida KT2440
ucccagcgcugucccccagccc

SEQ ID NO: 3560482 - RNA, 20 nt, Pseudomonas putida KT2440
ucccagcuggcaaugcaacu

SEQ ID NO: 3560483 - RNA, 18 nt, Pseudomonas putida KT2440
ucccaggacuucagcagu

SEQ ID NO: 3560484 - RNA, 12 nt, Pseudomonas putida KT2440
ucccaggcagcc

SEQ ID NO: 3560485 - RNA, 19 nt, Pseudomonas putida KT2440
ucccaggcagccuccaggu

SEQ ID NO: 3560486 - RNA, 18 nt, Pseudomonas putida KT2440
ucccauagccaaucccua

SEQ ID NO: 3560487 - RNA, 18 nt, Pseudomonas putida KT2440
ucccauguagaccaccag

SEQ ID NO: 3560488 - RNA, 22 nt, Pseudomonas putida KT2440
ucccauguagaccaccagcguu

SEQ ID NO: 3560489 - RNA, 17 nt, Pseudomonas putida KT2440
uccccaaccaugcuggc

SEQ ID NO: 3560490 - RNA, 20 nt, Pseudomonas putida KT2440
uccccaaccaugcuggccaa

SEQ ID NO: 3560491 - RNA, 22 nt, Pseudomonas putida KT2440
uccccaaccaugcuggccaagg

SEQ ID NO: 3560492 - RNA, 20 nt, Pseudomonas putida KT2440
uccccaaccggguuugaagc

SEQ ID NO: 3560493 - RNA, 22 nt, Pseudomonas putida KT2440
uccccaaucaccaggauugccg

SEQ ID NO: 3560494 - RNA, 17 nt, Pseudomonas putida KT2440
uccccaccggcaccauc

SEQ ID NO: 3560495 - RNA, 12 nt, Pseudomonas putida KT2440
uccccagcaacg

SEQ ID NO: 3560496 - RNA, 11 nt, Pseudomonas putida KT2440
uccccagcauu

SEQ ID NO: 3560497 - RNA, 14 nt, Pseudomonas putida KT2440
uccccaucacgcag

SEQ ID NO: 3560498 - RNA, 18 nt, Pseudomonas putida KT2440
uccccaucacgcgguauu

SEQ ID NO: 3560499 - RNA, 14 nt, Pseudomonas putida KT2440
uccccaucagcagc

SEQ ID NO: 3560500 - RNA, 18 nt, Pseudomonas putida KT2440
ucccccaaucuccagccc

SEQ ID NO: 3560501 - RNA, 16 nt, Pseudomonas putida KT2440
ucccccacccccgccc

SEQ ID NO: 3560502 - RNA, 14 nt, Pseudomonas putida KT2440
ucccccagccaacg

SEQ ID NO: 3560503 - RNA, 22 nt, Pseudomonas putida KT2440
ucccccaucaguugcagcaacg

SEQ ID NO: 3560504 - RNA, 18 nt, Pseudomonas putida KT2440
uccccccacgcacaucac

SEQ ID NO: 3560505 - RNA, 17 nt, Pseudomonas putida KT2440
ucccccccaaucgccgc

SEQ ID NO: 3560506 - RNA, 15 nt, Pseudomonas putida KT2440
ucccccggcccagcc

SEQ ID NO: 3560507 - RNA, 16 nt, Pseudomonas putida KT2440
ucccccuccacccggu

SEQ ID NO: 3560508 - RNA, 15 nt, Pseudomonas putida KT2440
uccccgacugacgcu

SEQ ID NO: 3560509 - RNA, 16 nt, Pseudomonas putida KT2440
uccccgcccaagcggc

SEQ ID NO: 3560510 - RNA, 17 nt, Pseudomonas putida KT2440
uccccgcccaagcggca

SEQ ID NO: 3560511 - RNA, 16 nt, Pseudomonas putida KT2440
uccccgccgugcaguu

SEQ ID NO: 3560512 - RNA, 14 nt, Pseudomonas putida KT2440
uccgcuuagcagcu

SEQ ID NO: 3560513 - RNA, 22 nt, Pseudomonas putida KT2440
uccgcuucaucaggucgccuug

SEQ ID NO: 3560514 - RNA, 21 nt, Pseudomonas putida KT2440
uccgcuugacgaucgccagcc

SEQ ID NO: 3560515 - RNA, 17 nt, Pseudomonas putida KT2440
uccggaauuucugcacc

SEQ ID NO: 3560516 - RNA, 20 nt, Pseudomonas putida KT2440
uccggagcuccccucagaca

SEQ ID NO: 3560517 - RNA, 14 nt, Pseudomonas putida KT2440
uccggaucguugcg

SEQ ID NO: 3560518 - RNA, 16 nt, Pseudomonas putida KT2440
uccggauggaucgccu

SEQ ID NO: 3560519 - RNA, 12 nt, Pseudomonas putida KT2440
uccggcaaacca

SEQ ID NO: 3560520 - RNA, 16 nt, Pseudomonas putida KT2440
uccggcaaaccaugga

SEQ ID NO: 3560521 - RNA, 21 nt, Pseudomonas putida KT2440
uccggcaaaccauggaagcuc

SEQ ID NO: 3560522 - RNA, 23 nt, Pseudomonas putida KT2440
uccggcaaccccgccaaccccuc

SEQ ID NO: 3560523 - RNA, 19 nt, Pseudomonas putida KT2440
uccggcaccccuuucucca

SEQ ID NO: 3560524 - RNA, 14 nt, Pseudomonas putida KT2440
uccggcagcucacc

SEQ ID NO: 3560525 - RNA, 18 nt, Pseudomonas putida KT2440
uccggcagcucaccggca

SEQ ID NO: 3560526 - RNA, 18 nt, Pseudomonas putida KT2440
uccggcagguaagucggc

SEQ ID NO: 3560527 - RNA, 22 nt, Pseudomonas putida KT2440
uccggcaggucgaugaucgccg

SEQ ID NO: 3560528 - RNA, 17 nt, Pseudomonas putida KT2440
uccggcaucauccugcu

SEQ ID NO: 3560529 - RNA, 12 nt, Pseudomonas putida KT2440
uccggcccggca

SEQ ID NO: 3560530 - RNA, 13 nt, Pseudomonas putida KT2440
uccggcccggcau

SEQ ID NO: 3560531 - RNA, 22 nt, Pseudomonas putida KT2440
uccggccgacucuucaccagcu

SEQ ID NO: 3560532 - RNA, 19 nt, Pseudomonas putida KT2440
uccggccucuucgcgggca

SEQ ID NO: 3560533 - RNA, 23 nt, Pseudomonas putida KT2440
uccggcgaagcacugucgauggc

SEQ ID NO: 3560534 - RNA, 17 nt, Pseudomonas putida KT2440
uccggcgacagcucaag

SEQ ID NO: 3560535 - RNA, 15 nt, Pseudomonas putida KT2440
uccggcgcggccugc

SEQ ID NO: 3560536 - RNA, 21 nt, Pseudomonas putida KT2440
uccggcuugcugugagauucc

SEQ ID NO: 3560537 - RNA, 13 nt, Pseudomonas putida KT2440
uccgggcaaugca

SEQ ID NO: 3560538 - RNA, 18 nt, Pseudomonas putida KT2440
uccgggcaaugcaggcag

SEQ ID NO: 3560539 - RNA, 17 nt, Pseudomonas putida KT2440
uccgggccgucaccgcu

SEQ ID NO: 3560540 - RNA, 12 nt, Pseudomonas putida KT2440
uccgggcugcug

SEQ ID NO: 3560541 - RNA, 19 nt, Pseudomonas putida KT2440
uccggggccgcaaggcggc

SEQ ID NO: 3560542 - RNA, 22 nt, Pseudomonas putida KT2440
uccggguccauccccgcacgcg

SEQ ID NO: 3560543 - RNA, 19 nt, Pseudomonas putida KT2440
uccggguuaccgcacagca

SEQ ID NO: 3560544 - RNA, 19 nt, Pseudomonas putida KT2440
uccggguucugcaggaugu

SEQ ID NO: 3560545 - RNA, 13 nt, Pseudomonas putida KT2440
uccgguaacggua

SEQ ID NO: 3560546 - RNA, 12 nt, Pseudomonas putida KT2440
uccgguaacugg

SEQ ID NO: 3560547 - RNA, 19 nt, Pseudomonas putida KT2440
uccggucacugcgcggccg

SEQ ID NO: 3560548 - RNA, 11 nt, Pseudomonas putida KT2440
uccgguccagu

SEQ ID NO: 3560549 - RNA, 15 nt, Pseudomonas putida KT2440
uccgguggcaucacc

SEQ ID NO: 3560550 - RNA, 12 nt, Pseudomonas putida KT2440
uccgucgccggc

SEQ ID NO: 3560551 - RNA, 22 nt, Pseudomonas putida KT2440
uccgucgccggccggcucgcca

SEQ ID NO: 3560552 - RNA, 21 nt, Pseudomonas putida KT2440
uccguguccguccgcaaaucc

SEQ ID NO: 3560553 - RNA, 20 nt, Pseudomonas putida KT2440
uccguuacaauaccgacaag

SEQ ID NO: 3560554 - RNA, 23 nt, Pseudomonas putida KT2440
uccuacaagguaccccaccggcc

SEQ ID NO: 3560555 - RNA, 17 nt, Pseudomonas putida KT2440
uccuacaggauggccgc

SEQ ID NO: 3560556 - RNA, 22 nt, Pseudomonas putida KT2440
uccuacaggauggccgcaggcc

SEQ ID NO: 3560557 - RNA, 22 nt, Pseudomonas putida KT2440
uccuaccacguacacacaucug

SEQ ID NO: 3560558 - RNA, 21 nt, Pseudomonas putida KT2440
uccuacgcgccagucagaagc

SEQ ID NO: 3560559 - RNA, 16 nt, Pseudomonas putida KT2440
uccuacgcucuauccc

SEQ ID NO: 3560560 - RNA, 23 nt, Pseudomonas putida KT2440
uccuacggaaucugcaccgccuu

SEQ ID NO: 3560561 - RNA, 14 nt, Pseudomonas putida KT2440
uccuacgggcaacc

SEQ ID NO: 3560562 - RNA, 15 nt, Pseudomonas putida KT2440
uccuacgggcaaccg

SEQ ID NO: 3560563 - RNA, 16 nt, Pseudomonas putida KT2440
uccuagcggcgucaau

SEQ ID NO: 3560564 - RNA, 18 nt, Pseudomonas putida KT2440
uccuaugagacuagcagu

SEQ ID NO: 3560565 - RNA, 21 nt, Pseudomonas putida KT2440
uccucaaaggcagccucguaa

SEQ ID NO: 3560566 - RNA, 22 nt, Pseudomonas putida KT2440
uccucaagggguacgaacgcca

SEQ ID NO: 3560567 - RNA, 21 nt, Pseudomonas putida KT2440
uccucaaucacauccacagcc

SEQ ID NO: 3560568 - RNA, 16 nt, Pseudomonas putida KT2440
uccucaccgcaggcau

SEQ ID NO: 3560569 - RNA, 17 nt, Pseudomonas putida KT2440
uccucaccggcaaagcu

SEQ ID NO: 3560570 - RNA, 21 nt, Pseudomonas putida KT2440
uccucacggcagugcacccgc

SEQ ID NO: 3560571 - RNA, 22 nt, Pseudomonas putida KT2440
uccucagggguaaugccccagc

SEQ ID NO: 3560572 - RNA, 19 nt, Pseudomonas putida KT2440
uccucauaaugcuccgcca

SEQ ID NO: 3560573 - RNA, 19 nt, Pseudomonas putida KT2440
uccucaucgaugcccgucc

SEQ ID NO: 3560574 - RNA, 12 nt, Pseudomonas putida KT2440
uccuccaacaau

SEQ ID NO: 3560575 - RNA, 11 nt, Pseudomonas putida KT2440
uccuccagcuc

SEQ ID NO: 3560576 - RNA, 11 nt, Pseudomonas putida KT2440
uccuccccuuc

SEQ ID NO: 3560577 - RNA, 18 nt, Pseudomonas putida KT2440
uccuccccuucccgccau

SEQ ID NO: 3560578 - RNA, 14 nt, Pseudomonas putida KT2440
uccuccgcccugcc

SEQ ID NO: 3560579 - RNA, 16 nt, Pseudomonas putida KT2440
uccuccgcccugcccu

SEQ ID NO: 3560580 - RNA, 21 nt, Pseudomonas putida KT2440
uccucgaaacgcaggcucugc

SEQ ID NO: 3560581 - RNA, 14 nt, Pseudomonas putida KT2440
uccucgaacucaug

SEQ ID NO: 3560582 - RNA, 19 nt, Pseudomonas putida KT2440
uccucgacacccagucgcc

SEQ ID NO: 3560583 - RNA, 16 nt, Pseudomonas putida KT2440
uccucgacgaccaguu

SEQ ID NO: 3560584 - RNA, 15 nt, Pseudomonas putida KT2440
uccucgaucaccugc

SEQ ID NO: 3560585 - RNA, 16 nt, Pseudomonas putida KT2440
uccucgcccaccagcu

SEQ ID NO: 3560586 - RNA, 20 nt, Pseudomonas putida KT2440
uccucgcgggcaaacccgcg

SEQ ID NO: 3560587 - RNA, 13 nt, Pseudomonas putida KT2440
uccucggccaggc

SEQ ID NO: 3560588 - RNA, 14 nt, Pseudomonas putida KT2440
uccucggccaggcc

SEQ ID NO: 3560589 - RNA, 18 nt, Pseudomonas putida KT2440
uccucggccaggcccacc

SEQ ID NO: 3560590 - RNA, 12 nt, Pseudomonas putida KT2440
uccucggccuuu

SEQ ID NO: 3560591 - RNA, 23 nt, Pseudomonas putida KT2440
uccucggccuuuucgaacaaggc

SEQ ID NO: 3560592 - RNA, 15 nt, Pseudomonas putida KT2440
uccucguaggucaug

SEQ ID NO: 3560593 - RNA, 17 nt, Pseudomonas putida KT2440
uccucgugaccgaccac

SEQ ID NO: 3560594 - RNA, 16 nt, Pseudomonas putida KT2440
uccucucccaccagca

SEQ ID NO: 3560595 - RNA, 14 nt, Pseudomonas putida KT2440
uccucuucgaagac

SEQ ID NO: 3560596 - RNA, 21 nt, Pseudomonas putida KT2440
uccucuucgaagacgccgcca

SEQ ID NO: 3560597 - RNA, 23 nt, Pseudomonas putida KT2440
uccugaaccaugcgccgcugcuc

SEQ ID NO: 3560598 - RNA, 13 nt, Pseudomonas putida KT2440
uccugaacgaugc

SEQ ID NO: 3560599 - RNA, 22 nt, Pseudomonas putida KT2440
uccugaagggccgaaaggugca

SEQ ID NO: 3560600 - RNA, 22 nt, Pseudomonas putida KT2440
uccugaagugaauagccggcac

SEQ ID NO: 3560601 - RNA, 20 nt, Pseudomonas putida KT2440
uccugaccaacuuuucaggu

SEQ ID NO: 3560602 - RNA, 20 nt, Pseudomonas putida KT2440
uccugagcggugaaacccuc

SEQ ID NO: 3560603 - RNA, 23 nt, Pseudomonas putida KT2440
uccugauguaggagcggguuuac

SEQ ID NO: 3560604 - RNA, 16 nt, Pseudomonas putida KT2440
uccugcaacucggccu

SEQ ID NO: 3560605 - RNA, 17 nt, Pseudomonas putida KT2440
uccugcaaggcaaugcc

SEQ ID NO: 3560606 - RNA, 15 nt, Pseudomonas putida KT2440
uccugcaccgaagca

SEQ ID NO: 3560607 - RNA, 20 nt, Pseudomonas putida KT2440
uccugcaccgaagcaccacu

SEQ ID NO: 3560608 - RNA, 18 nt, Pseudomonas putida KT2440
uccugcaccugguugcca

SEQ ID NO: 3560609 - RNA, 21 nt, Pseudomonas putida KT2440
uccugcaccugguugccaggg

SEQ ID NO: 3560610 - RNA, 22 nt, Pseudomonas putida KT2440
uccugcaccuuguuacccgcau

SEQ ID NO: 3560611 - RNA, 15 nt, Pseudomonas putida KT2440
uccugcacugcaaca

SEQ ID NO: 3560612 - RNA, 22 nt, Pseudomonas putida KT2440
uccugcacugcaacaccgguca

SEQ ID NO: 3560613 - RNA, 14 nt, Pseudomonas putida KT2440
uccugcagcaggcc

SEQ ID NO: 3560614 - RNA, 19 nt, Pseudomonas putida KT2440
uccugcagccgcaccugcc

SEQ ID NO: 3560615 - RNA, 21 nt, Pseudomonas putida KT2440
uccugcaggaaccuccguugc

SEQ ID NO: 3560616 - RNA, 13 nt, Pseudomonas putida KT2440
uccugcagggaac

SEQ ID NO: 3560617 - RNA, 18 nt, Pseudomonas putida KT2440
ucgaaugguuuucggcgg

SEQ ID NO: 3560618 - RNA, 16 nt, Pseudomonas putida KT2440
ucgaauguccagaucc

SEQ ID NO: 3560619 - RNA, 23 nt, Pseudomonas putida KT2440
ucgacaaagcucaaaugcuggca

SEQ ID NO: 3560620 - RNA, 22 nt, Pseudomonas putida KT2440
ucgacaaaguugccgaugaugc

SEQ ID NO: 3560621 - RNA, 15 nt, Pseudomonas putida KT2440
ucgacaaaucccgca

SEQ ID NO: 3560622 - RNA, 16 nt, Pseudomonas putida KT2440
ucgacaaccccagccc

SEQ ID NO: 3560623 - RNA, 13 nt, Pseudomonas putida KT2440
ucgacaacccgcg

SEQ ID NO: 3560624 - RNA, 18 nt, Pseudomonas putida KT2440
ucgacaacccgcgcugcc

SEQ ID NO: 3560625 - RNA, 21 nt, Pseudomonas putida KT2440
ucgacaaucggcucaacagcc

SEQ ID NO: 3560626 - RNA, 23 nt, Pseudomonas putida KT2440
ucgacaaucggcucaacagccac

SEQ ID NO: 3560627 - RNA, 12 nt, Pseudomonas putida KT2440
ucgacaaugucu

SEQ ID NO: 3560628 - RNA, 13 nt, Pseudomonas putida KT2440
ucgacacccagca

SEQ ID NO: 3560629 - RNA, 21 nt, Pseudomonas putida KT2440
ucgacagguugugguagucgc

SEQ ID NO: 3560630 - RNA, 14 nt, Pseudomonas putida KT2440
ucgacagugaauuc

SEQ ID NO: 3560631 - RNA, 17 nt, Pseudomonas putida KT2440
ucgacagugaauuccuu

SEQ ID NO: 3560632 - RNA, 12 nt, Pseudomonas putida KT2440
ucgacaguucaa

SEQ ID NO: 3560633 - RNA, 15 nt, Pseudomonas putida KT2440
ucgacauccagcgcc

SEQ ID NO: 3560634 - RNA, 21 nt, Pseudomonas putida KT2440
ucgacaugcaguugagcccuc

SEQ ID NO: 3560635 - RNA, 20 nt, Pseudomonas putida KT2440
ucgaccaauggcugcggcag

SEQ ID NO: 3560636 - RNA, 18 nt, Pseudomonas putida KT2440
ucgaccaccgccaaggca

SEQ ID NO: 3560637 - RNA, 20 nt, Pseudomonas putida KT2440
ucgaccaccgccaaggcacg

SEQ ID NO: 3560638 - RNA, 21 nt, Pseudomonas putida KT2440
ucgaccacgaucuuggccagg

SEQ ID NO: 3560639 - RNA, 18 nt, Pseudomonas putida KT2440
ucgaccacgcacagcugu

SEQ ID NO: 3560640 - RNA, 22 nt, Pseudomonas putida KT2440
ucgaccagaagggcgcaaaagu

SEQ ID NO: 3560641 - RNA, 16 nt, Pseudomonas putida KT2440
ucgaccagaucagccg

SEQ ID NO: 3560642 - RNA, 23 nt, Pseudomonas putida KT2440
ucgaccaggaucuucucggcgcg

SEQ ID NO: 3560643 - RNA, 20 nt, Pseudomonas putida KT2440
ucgaccagggccuuggccug

SEQ ID NO: 3560644 - RNA, 22 nt, Pseudomonas putida KT2440
ucgaccagggccuuggccuggg

SEQ ID NO: 3560645 - RNA, 11 nt, Pseudomonas putida KT2440
ucgacccaguc

SEQ ID NO: 3560646 - RNA, 18 nt, Pseudomonas putida KT2440
ucgacccccuugccagca

SEQ ID NO: 3560647 - RNA, 20 nt, Pseudomonas putida KT2440
ucgacccccuugccagcaug

SEQ ID NO: 3560648 - RNA, 13 nt, Pseudomonas putida KT2440
ucgacccgcugcc

SEQ ID NO: 3560649 - RNA, 14 nt, Pseudomonas putida KT2440
ucgacccgcugccc

SEQ ID NO: 3560650 - RNA, 13 nt, Pseudomonas putida KT2440
ucgaccgccgccu

SEQ ID NO: 3560651 - RNA, 15 nt, Pseudomonas putida KT2440
ucgaccgggcagacc

SEQ ID NO: 3560652 - RNA, 14 nt, Pseudomonas putida KT2440
ucgaccucgaucuc

SEQ ID NO: 3560653 - RNA, 18 nt, Pseudomonas putida KT2440
ucgaccugccagucgcac

SEQ ID NO: 3560654 - RNA, 12 nt, Pseudomonas putida KT2440
ucgaccugcccg

SEQ ID NO: 3560655 - RNA, 13 nt, Pseudomonas putida KT2440
ucgaccuggcccg

SEQ ID NO: 3560656 - RNA, 11 nt, Pseudomonas putida KT2440
ucgaccuggcu

SEQ ID NO: 3560657 - RNA, 12 nt, Pseudomonas putida KT2440
ucgaccuggcuc

SEQ ID NO: 3560658 - RNA, 14 nt, Pseudomonas putida KT2440
ucgaccuggcucuu

SEQ ID NO: 3560659 - RNA, 16 nt, Pseudomonas putida KT2440
ucgaccugggccaggu

SEQ ID NO: 3560660 - RNA, 19 nt, Pseudomonas putida KT2440
ucgacgaccaguucgacgc

SEQ ID NO: 3560661 - RNA, 22 nt, Pseudomonas putida KT2440
ucgacgaucgacuucaucaccu

SEQ ID NO: 3560662 - RNA, 23 nt, Pseudomonas putida KT2440
ucgacgaucgacuucaucaccuc

SEQ ID NO: 3560663 - RNA, 19 nt, Pseudomonas putida KT2440
ucgacgaucgccgccacga

SEQ ID NO: 3560664 - RNA, 18 nt, Pseudomonas putida KT2440
ucgacgaugaggcgaugc

SEQ ID NO: 3560665 - RNA, 19 nt, Pseudomonas putida KT2440
ucgacgaugaggcgaugca

SEQ ID NO: 3560666 - RNA, 21 nt, Pseudomonas putida KT2440
ucgacgaugaggcgaugcagg

SEQ ID NO: 3560667 - RNA, 14 nt, Pseudomonas putida KT2440
ucgacgcgcgcagc

SEQ ID NO: 3560668 - RNA, 16 nt, Pseudomonas putida KT2440
ucgacgcgcgcagccu

SEQ ID NO: 3560669 - RNA, 19 nt, Pseudomonas putida KT2440
ucgacgcgcgcagccuggc

SEQ ID NO: 3560670 - RNA, 14 nt, Pseudomonas putida KT2440
ucgacgcugcuguc

SEQ ID NO: 3560671 - RNA, 16 nt, Pseudomonas putida KT2440
ucgacguugguagcgg

SEQ ID NO: 3560672 - RNA, 23 nt, Pseudomonas putida KT2440
ucgacucauuuuguaaaaccgcg

SEQ ID NO: 3560673 - RNA, 15 nt, Pseudomonas putida KT2440
ucgacucccgcugcc

SEQ ID NO: 3560674 - RNA, 16 nt, Pseudomonas putida KT2440
ucgacucccgcugccu

SEQ ID NO: 3560675 - RNA, 18 nt, Pseudomonas putida KT2440
ucgacucccgcugccuuc

SEQ ID NO: 3560676 - RNA, 16 nt, Pseudomonas putida KT2440
ucgacuucaucaccuc

SEQ ID NO: 3560677 - RNA, 13 nt, Pseudomonas putida KT2440
ucgacuucccgca

SEQ ID NO: 3560678 - RNA, 22 nt, Pseudomonas putida KT2440
ucgacuucccgcaagccagccu

SEQ ID NO: 3560679 - RNA, 15 nt, Pseudomonas putida KT2440
ucgacuucggccauu

SEQ ID NO: 3560680 - RNA, 16 nt, Pseudomonas putida KT2440
ucgagaaacgccagcu

SEQ ID NO: 3560681 - RNA, 16 nt, Pseudomonas putida KT2440
ucgagaaaugccucgg

SEQ ID NO: 3560682 - RNA, 21 nt, Pseudomonas putida KT2440
ucgagaccuugccuuccggcc

SEQ ID NO: 3560683 - RNA, 15 nt, Pseudomonas putida KT2440
ucgagagccgggcaa

SEQ ID NO: 3560684 - RNA, 16 nt, Pseudomonas putida KT2440
ucgagauguaguccac

SEQ ID NO: 3560685 - RNA, 21 nt, Pseudomonas putida KT2440
ucgagcagcuuauugcgcagg

SEQ ID NO: 3560686 - RNA, 14 nt, Pseudomonas putida KT2440
ucgagcauccaggu

SEQ ID NO: 3560687 - RNA, 23 nt, Pseudomonas putida KT2440
ucgagcaucugcugcggcaggcu

SEQ ID NO: 3560688 - RNA, 12 nt, Pseudomonas putida KT2440
ucgagccacuga

SEQ ID NO: 3560689 - RNA, 16 nt, Pseudomonas putida KT2440
ucgagcccgccagcag

SEQ ID NO: 3560690 - RNA, 21 nt, Pseudomonas putida KT2440
ucgagccgaucaggaagcccc

SEQ ID NO: 3560691 - RNA, 12 nt, Pseudomonas putida KT2440
ucgagcgcaccu

SEQ ID NO: 3560692 - RNA, 14 nt, Pseudomonas putida KT2440
ucgagcgcaccugg

SEQ ID NO: 3560693 - RNA, 17 nt, Pseudomonas putida KT2440
ucgagcgcaccuggaug

SEQ ID NO: 3560694 - RNA, 17 nt, Pseudomonas putida KT2440
ucgagcuacagccccuu

SEQ ID NO: 3560695 - RNA, 16 nt, Pseudomonas putida KT2440
ucgagcuuggcgucca

SEQ ID NO: 3560696 - RNA, 21 nt, Pseudomonas putida KT2440
ucgagcuuggcguccacagcc

SEQ ID NO: 3560697 - RNA, 19 nt, Pseudomonas putida KT2440
ucgaggauuuucaccuucg

SEQ ID NO: 3560698 - RNA, 20 nt, Pseudomonas putida KT2440
ucgagguacgagucagcgug

SEQ ID NO: 3560699 - RNA, 22 nt, Pseudomonas putida KT2440
ucgagguacuugagcagggugc

SEQ ID NO: 3560700 - RNA, 15 nt, Pseudomonas putida KT2440
ucgagguaucugccg

SEQ ID NO: 3560701 - RNA, 14 nt, Pseudomonas putida KT2440
ucgagguguacgcg

SEQ ID NO: 3560702 - RNA, 16 nt, Pseudomonas putida KT2440
ucgagguugcgcucca

SEQ ID NO: 3560703 - RNA, 16 nt, Pseudomonas putida KT2440
ucgagucgacagugac

SEQ ID NO: 3560704 - RNA, 14 nt, Pseudomonas putida KT2440
ucgauacccaggcg

SEQ ID NO: 3560705 - RNA, 19 nt, Pseudomonas putida KT2440
ucgauacccaggcgcgccu

SEQ ID NO: 3560706 - RNA, 17 nt, Pseudomonas putida KT2440
ucgauaucggcgcggcc

SEQ ID NO: 3560707 - RNA, 17 nt, Pseudomonas putida KT2440
ucgauauuggggcugcu

SEQ ID NO: 3560708 - RNA, 19 nt, Pseudomonas putida KT2440
ucgaucaacgugguaaugc

SEQ ID NO: 3560709 - RNA, 22 nt, Pseudomonas putida KT2440
ucgaucacacccucugccaucu

SEQ ID NO: 3560710 - RNA, 17 nt, Pseudomonas putida KT2440
ucgaucagauaagucau

SEQ ID NO: 3560711 - RNA, 16 nt, Pseudomonas putida KT2440
ucgaucagcggcucca

SEQ ID NO: 3560712 - RNA, 15 nt, Pseudomonas putida KT2440
ucgaucaggaaggca

SEQ ID NO: 3560713 - RNA, 13 nt, Pseudomonas putida KT2440
ucgaucaggcucu

SEQ ID NO: 3560714 - RNA, 19 nt, Pseudomonas putida KT2440
ucgaucaucgccaccggca

SEQ ID NO: 3560715 - RNA, 16 nt, Pseudomonas putida KT2440
ucgauccaggugcgca

SEQ ID NO: 3560716 - RNA, 22 nt, Pseudomonas putida KT2440
ucgauccggccguguucaggca

SEQ ID NO: 3560717 - RNA, 16 nt, Pseudomonas putida KT2440
ucgaucuccaggugca

SEQ ID NO: 3560718 - RNA, 16 nt, Pseudomonas putida KT2440
ucgaucugccugccuc

SEQ ID NO: 3560719 - RNA, 22 nt, Pseudomonas putida KT2440
ucgaucuucgccggcaucgccu

SEQ ID NO: 3560720 - RNA, 21 nt, Pseudomonas putida KT2440
ucgaucuuguuggucaggcca

SEQ ID NO: 3560721 - RNA, 23 nt, Pseudomonas putida KT2440
ucgaugaaggcugcuucguucac

SEQ ID NO: 3560722 - RNA, 21 nt, Pseudomonas putida KT2440
ucgccgcccuuggugcaccag

SEQ ID NO: 3560723 - RNA, 15 nt, Pseudomonas putida KT2440
ucgccgccgccucga

SEQ ID NO: 3560724 - RNA, 18 nt, Pseudomonas putida KT2440
ucgccgccgucgggugcg

SEQ ID NO: 3560725 - RNA, 22 nt, Pseudomonas putida KT2440
ucgccgcgcuguggcgcccggc

SEQ ID NO: 3560726 - RNA, 19 nt, Pseudomonas putida KT2440
ucgccgcggguaccaccug

SEQ ID NO: 3560727 - RNA, 21 nt, Pseudomonas putida KT2440
ucgccgcuucggcaugcacgg

SEQ ID NO: 3560728 - RNA, 11 nt, Pseudomonas putida KT2440
ucgccggcacg

SEQ ID NO: 3560729 - RNA, 23 nt, Pseudomonas putida KT2440
ucgccggcacgcuaccaccuggc

SEQ ID NO: 3560730 - RNA, 24 nt, Pseudomonas putida KT2440
ucgccggcacgcuaccaccuggcu

SEQ ID NO: 3560731 - RNA, 15 nt, Pseudomonas putida KT2440
ucgccggcagcacgu

SEQ ID NO: 3560732 - RNA, 17 nt, Pseudomonas putida KT2440
ucgccggcagcugauac

SEQ ID NO: 3560733 - RNA, 18 nt, Pseudomonas putida KT2440
ucgccggcaucgccucca

SEQ ID NO: 3560734 - RNA, 21 nt, Pseudomonas putida KT2440
ucgccggcaucgccuccagcg

SEQ ID NO: 3560735 - RNA, 14 nt, Pseudomonas putida KT2440
ucgccggccuuggc

SEQ ID NO: 3560736 - RNA, 15 nt, Pseudomonas putida KT2440
ucgccgggcgcacca

SEQ ID NO: 3560737 - RNA, 18 nt, Pseudomonas putida KT2440
ucgccgggcgcaccacga

SEQ ID NO: 3560738 - RNA, 19 nt, Pseudomonas putida KT2440
ucgccggugugcauccagc

SEQ ID NO: 3560739 - RNA, 16 nt, Pseudomonas putida KT2440
ucgccguacucggucu

SEQ ID NO: 3560740 - RNA, 17 nt, Pseudomonas putida KT2440
ucgccguacuggcugca

SEQ ID NO: 3560741 - RNA, 22 nt, Pseudomonas putida KT2440
ucgccguacuggcugcacuggg

SEQ ID NO: 3560742 - RNA, 16 nt, Pseudomonas putida KT2440
ucgccgucgaccaggc

SEQ ID NO: 3560743 - RNA, 17 nt, Pseudomonas putida KT2440
ucgccgucgaccaggca

SEQ ID NO: 3560744 - RNA, 14 nt, Pseudomonas putida KT2440
ucgccgugcagcac

SEQ ID NO: 3560745 - RNA, 14 nt, Pseudomonas putida KT2440
ucgccguuguucac

SEQ ID NO: 3560746 - RNA, 17 nt, Pseudomonas putida KT2440
ucgccguuguucacggu

SEQ ID NO: 3560747 - RNA, 13 nt, Pseudomonas putida KT2440
ucgccucacagcg

SEQ ID NO: 3560748 - RNA, 16 nt, Pseudomonas putida KT2440
ucgccucccccuccac

SEQ ID NO: 3560749 - RNA, 12 nt, Pseudomonas putida KT2440
ucgccucggggu

SEQ ID NO: 3560750 - RNA, 13 nt, Pseudomonas putida KT2440
ucgccucgucggc

SEQ ID NO: 3560751 - RNA, 15 nt, Pseudomonas putida KT2440
ucgccucgugcagcu

SEQ ID NO: 3560752 - RNA, 18 nt, Pseudomonas putida KT2440
ucgccucgugcagcugca

SEQ ID NO: 3560753 - RNA, 17 nt, Pseudomonas putida KT2440
ucgccugcuuggcaccu

SEQ ID NO: 3560754 - RNA, 20 nt, Pseudomonas putida KT2440
ucgccugcuuggcaccuauc

SEQ ID NO: 3560755 - RNA, 13 nt, Pseudomonas putida KT2440
ucgccuggccggc

SEQ ID NO: 3560756 - RNA, 15 nt, Pseudomonas putida KT2440
ucgccuguaccggcc

SEQ ID NO: 3560757 - RNA, 17 nt, Pseudomonas putida KT2440
ucgccuguaccggccuu

SEQ ID NO: 3560758 - RNA, 18 nt, Pseudomonas putida KT2440
ucgccuucacugcgcggu

SEQ ID NO: 3560759 - RNA, 16 nt, Pseudomonas putida KT2440
ucgccuucguacaucg

SEQ ID NO: 3560760 - RNA, 15 nt, Pseudomonas putida KT2440
ucgccuuucaggucg

SEQ ID NO: 3560761 - RNA, 18 nt, Pseudomonas putida KT2440
ucgccuuucuuaugccug

SEQ ID NO: 3560762 - RNA, 14 nt, Pseudomonas putida KT2440
ucgccuuuuuucca

SEQ ID NO: 3560763 - RNA, 23 nt, Pseudomonas putida KT2440
ucgcgaaagggccgcaaagcggc

SEQ ID NO: 3560764 - RNA, 23 nt, Pseudomonas putida KT2440
ucgcgaaagggccgcaaggccgc

SEQ ID NO: 3560765 - RNA, 13 nt, Pseudomonas putida KT2440
ucgcgaaaggggc

SEQ ID NO: 3560766 - RNA, 18 nt, Pseudomonas putida KT2440
ucgcgaagcggcccccug

SEQ ID NO: 3560767 - RNA, 15 nt, Pseudomonas putida KT2440
ucgcgacacaaggcc

SEQ ID NO: 3560768 - RNA, 21 nt, Pseudomonas putida KT2440
ucgcgacacaaggccccacaa

SEQ ID NO: 3560769 - RNA, 22 nt, Pseudomonas putida KT2440
ucgcgacacaaggccgcuccca

SEQ ID NO: 3560770 - RNA, 13 nt, Pseudomonas putida KT2440
ucgcgaccgccau

SEQ ID NO: 3560771 - RNA, 15 nt, Pseudomonas putida KT2440
ucgcgacgcaaggcc

SEQ ID NO: 3560772 - RNA, 20 nt, Pseudomonas putida KT2440
ucgcgagccagaucauggcg

SEQ ID NO: 3560773 - RNA, 15 nt, Pseudomonas putida KT2440
ucgcgagccucuguu

SEQ ID NO: 3560774 - RNA, 17 nt, Pseudomonas putida KT2440
ucgcgagcgagcgguug

SEQ ID NO: 3560775 - RNA, 17 nt, Pseudomonas putida KT2440
ucgcgagucaggcugca

SEQ ID NO: 3560776 - RNA, 18 nt, Pseudomonas putida KT2440
ucgcgagugucgaugucg

SEQ ID NO: 3560777 - RNA, 22 nt, Pseudomonas putida KT2440
ucgcgaucacgcaggcccagca

SEQ ID NO: 3560778 - RNA, 15 nt, Pseudomonas putida KT2440
ucgcgauccaucuuc

SEQ ID NO: 3560779 - RNA, 15 nt, Pseudomonas putida KT2440
ucgcgaugggcugca

SEQ ID NO: 3560780 - RNA, 20 nt, Pseudomonas putida KT2440
ucgcgauugaucagcgccuc

SEQ ID NO: 3560781 - RNA, 22 nt, Pseudomonas putida KT2440
ucgcgauugaucagcgccucgc

SEQ ID NO: 3560782 - RNA, 16 nt, Pseudomonas putida KT2440
ucgcgcaacaccgcca

SEQ ID NO: 3560783 - RNA, 17 nt, Pseudomonas putida KT2440
ucgcgcaacaccgccag

SEQ ID NO: 3560784 - RNA, 24 nt, Pseudomonas putida KT2440
ucgcgcaacaccgccagcgggcug

SEQ ID NO: 3560785 - RNA, 22 nt, Pseudomonas putida KT2440
ucgcgcacugaauacaccagcu

SEQ ID NO: 3560786 - RNA, 14 nt, Pseudomonas putida KT2440
ucgcgcacuugcca

SEQ ID NO: 3560787 - RNA, 23 nt, Pseudomonas putida KT2440
ucgcgcagauggcagacaagucc

SEQ ID NO: 3560788 - RNA, 13 nt, Pseudomonas putida KT2440
ucgcgcagcagcu

SEQ ID NO: 3560789 - RNA, 15 nt, Pseudomonas putida KT2440
ucgcgcagcaucugc

SEQ ID NO: 3560790 - RNA, 21 nt, Pseudomonas putida KT2440
ucgcgcagcaucugcacgucg

SEQ ID NO: 3560791 - RNA, 15 nt, Pseudomonas putida KT2440
ucgcgcagggccuug

SEQ ID NO: 3560792 - RNA, 23 nt, Pseudomonas putida KT2440
ucgcgcagggcgcgaaaagccug

SEQ ID NO: 3560793 - RNA, 21 nt, Pseudomonas putida KT2440
ucgcgcagggugccggccagc

SEQ ID NO: 3560794 - RNA, 22 nt, Pseudomonas putida KT2440
ucgcgcaggguuuucagcgccg

SEQ ID NO: 3560795 - RNA, 20 nt, Pseudomonas putida KT2440
ucgcgcagguuguucggcag

SEQ ID NO: 3560796 - RNA, 16 nt, Pseudomonas putida KT2440
ucgcgcauuucgucca

SEQ ID NO: 3560797 - RNA, 16 nt, Pseudomonas putida KT2440
ucgcgccagcuuuuag

SEQ ID NO: 3560798 - RNA, 17 nt, Pseudomonas putida KT2440
ucgcgccccaagcgggc

SEQ ID NO: 3560799 - RNA, 19 nt, Pseudomonas putida KT2440
ucgcgccuucauaggcggc

SEQ ID NO: 3560800 - RNA, 17 nt, Pseudomonas putida KT2440
ucgcgccuucgcuggcg

SEQ ID NO: 3560801 - RNA, 12 nt, Pseudomonas putida KT2440
ucgcgcggguaa

SEQ ID NO: 3560802 - RNA, 17 nt, Pseudomonas putida KT2440
ucgcgcguaaaucccgc

SEQ ID NO: 3560803 - RNA, 17 nt, Pseudomonas putida KT2440
ucgcgcuaaaggccgcu

SEQ ID NO: 3560804 - RNA, 21 nt, Pseudomonas putida KT2440
ucgcgcuaaaggccgcuccug

SEQ ID NO: 3560805 - RNA, 22 nt, Pseudomonas putida KT2440
ucgcgcucgaacaacgccucgg

SEQ ID NO: 3560806 - RNA, 14 nt, Pseudomonas putida KT2440
ucgcgcugcagcuc

SEQ ID NO: 3560807 - RNA, 15 nt, Pseudomonas putida KT2440
ucgcgcuuggcaccg

SEQ ID NO: 3560808 - RNA, 13 nt, Pseudomonas putida KT2440
ucgcggagccaga

SEQ ID NO: 3560809 - RNA, 17 nt, Pseudomonas putida KT2440
ucgcggaucaacccgcg

SEQ ID NO: 3560810 - RNA, 22 nt, Pseudomonas putida KT2440
ucgcggcaaagaucgcccagcu

SEQ ID NO: 3560811 - RNA, 22 nt, Pseudomonas putida KT2440
ucgcggccaagccgcugccaca

SEQ ID NO: 3560812 - RNA, 22 nt, Pseudomonas putida KT2440
ucgcggccuacccgggcgcagg

SEQ ID NO: 3560813 - RNA, 15 nt, Pseudomonas putida KT2440
ucgcggcgcaccgcu

SEQ ID NO: 3560814 - RNA, 14 nt, Pseudomonas putida KT2440
ucgcggcgcuggcc

SEQ ID NO: 3560815 - RNA, 20 nt, Pseudomonas putida KT2440
ucgcggcggcuaagcgccag

SEQ ID NO: 3560816 - RNA, 18 nt, Pseudomonas putida KT2440
ucgcggcguugucagccu

SEQ ID NO: 3560817 - RNA, 22 nt, Pseudomonas putida KT2440
ucgcggcuggugucggccaggg

SEQ ID NO: 3560818 - RNA, 13 nt, Pseudomonas putida KT2440
ucgcgggcaaacc

SEQ ID NO: 3560819 - RNA, 17 nt, Pseudomonas putida KT2440
ucgcgggcaaacccgcg

SEQ ID NO: 3560820 - RNA, 18 nt, Pseudomonas putida KT2440
ucgcgggcaaacccgcgc

SEQ ID NO: 3560821 - RNA, 21 nt, Pseudomonas putida KT2440
ucgcgggcaaacccgcgccua

SEQ ID NO: 3560822 - RNA, 21 nt, Pseudomonas putida KT2440
ucgcgggcaagcccgcuccca

SEQ ID NO: 3560823 - RNA, 23 nt, Pseudomonas putida KT2440
ucgcgggcaagcccgcucccaca

SEQ ID NO: 3560824 - RNA, 21 nt, Pseudomonas putida KT2440
ucgcgggcaagcccgcuccga

SEQ ID NO: 3560825 - RNA, 15 nt, Pseudomonas putida KT2440
ucgcgggcacgcccg

SEQ ID NO: 3560826 - RNA, 21 nt, Pseudomonas putida KT2440
ucgcgggcacgcccgcuccca

SEQ ID NO: 3560827 - RNA, 17 nt, Pseudomonas putida KT2440
ucggcaucgaacagcuu

SEQ ID NO: 3560828 - RNA, 13 nt, Pseudomonas putida KT2440
ucggcaucgacga

SEQ ID NO: 3560829 - RNA, 16 nt, Pseudomonas putida KT2440
ucggcaucggccuggg

SEQ ID NO: 3560830 - RNA, 22 nt, Pseudomonas putida KT2440
ucggcaucggugcuuucugcug

SEQ ID NO: 3560831 - RNA, 16 nt, Pseudomonas putida KT2440
ucggcaugcacuucca

SEQ ID NO: 3560832 - RNA, 20 nt, Pseudomonas putida KT2440
ucggcauguucaucaccggc

SEQ ID NO: 3560833 - RNA, 21 nt, Pseudomonas putida KT2440
ucggcauguucaucaccggcc

SEQ ID NO: 3560834 - RNA, 15 nt, Pseudomonas putida KT2440
ucggccaaucgcggc

SEQ ID NO: 3560835 - RNA, 21 nt, Pseudomonas putida KT2440
ucggccacacgggcguucagc

SEQ ID NO: 3560836 - RNA, 18 nt, Pseudomonas putida KT2440
ucggccaccacccgcugg

SEQ ID NO: 3560837 - RNA, 13 nt, Pseudomonas putida KT2440
ucggccacccgcg

SEQ ID NO: 3560838 - RNA, 14 nt, Pseudomonas putida KT2440
ucggccacccgcgu

SEQ ID NO: 3560839 - RNA, 22 nt, Pseudomonas putida KT2440
ucggccacgguguauccagccc

SEQ ID NO: 3560840 - RNA, 18 nt, Pseudomonas putida KT2440
ucggccagcacuacgccg

SEQ ID NO: 3560841 - RNA, 14 nt, Pseudomonas putida KT2440
ucggccagcaguuc

SEQ ID NO: 3560842 - RNA, 16 nt, Pseudomonas putida KT2440
ucggccagcucgccaa

SEQ ID NO: 3560843 - RNA, 13 nt, Pseudomonas putida KT2440
ucggccagcugcg

SEQ ID NO: 3560844 - RNA, 16 nt, Pseudomonas putida KT2440
ucggccagcugcgcac

SEQ ID NO: 3560845 - RNA, 22 nt, Pseudomonas putida KT2440
ucggccagcugcgcacgcagga

SEQ ID NO: 3560846 - RNA, 16 nt, Pseudomonas putida KT2440
ucggccagcugcugcg

SEQ ID NO: 3560847 - RNA, 17 nt, Pseudomonas putida KT2440
ucggccagcugcugcgg

SEQ ID NO: 3560848 - RNA, 17 nt, Pseudomonas putida KT2440
ucggccagugcgcccga

SEQ ID NO: 3560849 - RNA, 18 nt, Pseudomonas putida KT2440
ucggccagugcgugcagu

SEQ ID NO: 3560850 - RNA, 15 nt, Pseudomonas putida KT2440
ucggccaucgacgug

SEQ ID NO: 3560851 - RNA, 16 nt, Pseudomonas putida KT2440
ucggccaucgacgugc

SEQ ID NO: 3560852 - RNA, 21 nt, Pseudomonas putida KT2440
ucggccaugaucucgcccaug

SEQ ID NO: 3560853 - RNA, 15 nt, Pseudomonas putida KT2440
ucggccauggccgag

SEQ ID NO: 3560854 - RNA, 23 nt, Pseudomonas putida KT2440
ucggccaugucguaccacacauc

SEQ ID NO: 3560855 - RNA, 17 nt, Pseudomonas putida KT2440
ucggccauuugcucgac

SEQ ID NO: 3560856 - RNA, 14 nt, Pseudomonas putida KT2440
ucggcccacugcac

SEQ ID NO: 3560857 - RNA, 15 nt, Pseudomonas putida KT2440
ucggccccggcccca

SEQ ID NO: 3560858 - RNA, 13 nt, Pseudomonas putida KT2440
ucggccgaugcca

SEQ ID NO: 3560859 - RNA, 16 nt, Pseudomonas putida KT2440
ucggccgcauccaugc

SEQ ID NO: 3560860 - RNA, 12 nt, Pseudomonas putida KT2440
ucggccggcagc

SEQ ID NO: 3560861 - RNA, 19 nt, Pseudomonas putida KT2440
ucggccggcggauagcccc

SEQ ID NO: 3560862 - RNA, 15 nt, Pseudomonas putida KT2440
ucggccucagccggc

SEQ ID NO: 3560863 - RNA, 16 nt, Pseudomonas putida KT2440
ucggccucagccggcu

SEQ ID NO: 3560864 - RNA, 17 nt, Pseudomonas putida KT2440
ucggccucuccgaggcc

SEQ ID NO: 3560865 - RNA, 12 nt, Pseudomonas putida KT2440
ucggccugcgcu

SEQ ID NO: 3560866 - RNA, 14 nt, Pseudomonas putida KT2440
ucggccugcgcucc

SEQ ID NO: 3560867 - RNA, 18 nt, Pseudomonas putida KT2440
ucggccugcgcuccagca

SEQ ID NO: 3560868 - RNA, 20 nt, Pseudomonas putida KT2440
ucggccugcucgcuggcuug

SEQ ID NO: 3560869 - RNA, 22 nt, Pseudomonas putida KT2440
ucggccugcucgcuggcuuguu

SEQ ID NO: 3560870 - RNA, 15 nt, Pseudomonas putida KT2440
ucggccuugccgcug

SEQ ID NO: 3560871 - RNA, 18 nt, Pseudomonas putida KT2440
ucggccuugccgcuguug

SEQ ID NO: 3560872 - RNA, 14 nt, Pseudomonas putida KT2440
ucggccuugcgcug

SEQ ID NO: 3560873 - RNA, 16 nt, Pseudomonas putida KT2440
ucggccuugucuggca

SEQ ID NO: 3560874 - RNA, 15 nt, Pseudomonas putida KT2440
ucggccuuguucaac

SEQ ID NO: 3560875 - RNA, 18 nt, Pseudomonas putida KT2440
ucggcgaaaagccgggua

SEQ ID NO: 3560876 - RNA, 17 nt, Pseudomonas putida KT2440
ucggcgaaggcuggccu

SEQ ID NO: 3560877 - RNA, 16 nt, Pseudomonas putida KT2440
ucggcgacgacuuauc

SEQ ID NO: 3560878 - RNA, 22 nt, Pseudomonas putida KT2440
ucggcgacgucguugaaggcgu

SEQ ID NO: 3560879 - RNA, 21 nt, Pseudomonas putida KT2440
ucggcgauauggcuccaccac

SEQ ID NO: 3560880 - RNA, 22 nt, Pseudomonas putida KT2440
ucggcgauauggcuccaccaca

SEQ ID NO: 3560881 - RNA, 13 nt, Pseudomonas putida KT2440
ucggcgaucagcu

SEQ ID NO: 3560882 - RNA, 15 nt, Pseudomonas putida KT2440
ucggcgaucuggucg

SEQ ID NO: 3560883 - RNA, 24 nt, Pseudomonas putida KT2440
ucggcgaucuggucgaagcucagg

SEQ ID NO: 3560884 - RNA, 20 nt, Pseudomonas putida KT2440
ucggcgcacccggcuggucg

SEQ ID NO: 3560885 - RNA, 15 nt, Pseudomonas putida KT2440
ucggcgccaggaucg

SEQ ID NO: 3560886 - RNA, 22 nt, Pseudomonas putida KT2440
ucggcgccgaacgaauagccgg

SEQ ID NO: 3560887 - RNA, 17 nt, Pseudomonas putida KT2440
ucggcgccuucgcccga

SEQ ID NO: 3560888 - RNA, 20 nt, Pseudomonas putida KT2440
ucggcgcgcggcucggccac

SEQ ID NO: 3560889 - RNA, 15 nt, Pseudomonas putida KT2440
ucggcgcggcccagu

SEQ ID NO: 3560890 - RNA, 14 nt, Pseudomonas putida KT2440
ucggcgcgugccgc

SEQ ID NO: 3560891 - RNA, 15 nt, Pseudomonas putida KT2440
ucggcgcgugccgca

SEQ ID NO: 3560892 - RNA, 18 nt, Pseudomonas putida KT2440
ucggcggccccggcgccg

SEQ ID NO: 3560893 - RNA, 20 nt, Pseudomonas putida KT2440
ucggcggcgguaccccgccu

SEQ ID NO: 3560894 - RNA, 19 nt, Pseudomonas putida KT2440
ucggcggcuuucagcgccg

SEQ ID NO: 3560895 - RNA, 12 nt, Pseudomonas putida KT2440
ucggcgguugca

SEQ ID NO: 3560896 - RNA, 17 nt, Pseudomonas putida KT2440
ucggcguacugcacgcu

SEQ ID NO: 3560897 - RNA, 17 nt, Pseudomonas putida KT2440
ucggcguauggcuucac

SEQ ID NO: 3560898 - RNA, 18 nt, Pseudomonas putida KT2440
ucggcguauggcuucacg

SEQ ID NO: 3560899 - RNA, 20 nt, Pseudomonas putida KT2440
ucggcguauggcuucacggc

SEQ ID NO: 3560900 - RNA, 19 nt, Pseudomonas putida KT2440
ucggcgucgcuucaucggc

SEQ ID NO: 3560901 - RNA, 16 nt, Pseudomonas putida KT2440
ucggcgucguggccuu

SEQ ID NO: 3560902 - RNA, 19 nt, Pseudomonas putida KT2440
ucggcgucguggccuucgc

SEQ ID NO: 3560903 - RNA, 19 nt, Pseudomonas putida KT2440
ucggcguggaacaacggcu

SEQ ID NO: 3560904 - RNA, 16 nt, Pseudomonas putida KT2440
ucggcgugguccagcg

SEQ ID NO: 3560905 - RNA, 18 nt, Pseudomonas putida KT2440
ucggcuacgccgccgcug

SEQ ID NO: 3560906 - RNA, 14 nt, Pseudomonas putida KT2440
ucggcuagcgccug

SEQ ID NO: 3560907 - RNA, 18 nt, Pseudomonas putida KT2440
ucggcuccagcgcacgca

SEQ ID NO: 3560908 - RNA, 15 nt, Pseudomonas putida KT2440
ucggcucuccuuuuu

SEQ ID NO: 3560909 - RNA, 19 nt, Pseudomonas putida KT2440
ucggcucuucuuucaggua

SEQ ID NO: 3560910 - RNA, 15 nt, Pseudomonas putida KT2440
ucggcugaucucuuc

SEQ ID NO: 3560911 - RNA, 16 nt, Pseudomonas putida KT2440
ucgggaacucgucgac

SEQ ID NO: 3560912 - RNA, 16 nt, Pseudomonas putida KT2440
ucgggaauaccaggcc

SEQ ID NO: 3560913 - RNA, 20 nt, Pseudomonas putida KT2440
ucgggaauuguacgaccccc

SEQ ID NO: 3560914 - RNA, 14 nt, Pseudomonas putida KT2440
ucgggaucaugccg

SEQ ID NO: 3560915 - RNA, 13 nt, Pseudomonas putida KT2440
ucgggcaaggcga

SEQ ID NO: 3560916 - RNA, 18 nt, Pseudomonas putida KT2440
ucgggcacgaucagcagc

SEQ ID NO: 3560917 - RNA, 19 nt, Pseudomonas putida KT2440
ucgggcacgaucagcagca

SEQ ID NO: 3560918 - RNA, 15 nt, Pseudomonas putida KT2440
ucgggcacucggguu

SEQ ID NO: 3560919 - RNA, 16 nt, Pseudomonas putida KT2440
ucgggcaguucgaugc

SEQ ID NO: 3560920 - RNA, 14 nt, Pseudomonas putida KT2440
ucgggcgcgucguc

SEQ ID NO: 3560921 - RNA, 23 nt, Pseudomonas putida KT2440
ucgggcgcucgcgguucaucggc

SEQ ID NO: 3560922 - RNA, 13 nt, Pseudomonas putida KT2440
ucgggcgguuggg

SEQ ID NO: 3560923 - RNA, 11 nt, Pseudomonas putida KT2440
ucgggcugcug

SEQ ID NO: 3560924 - RNA, 13 nt, Pseudomonas putida KT2440
ucgggcugcugcc

SEQ ID NO: 3560925 - RNA, 17 nt, Pseudomonas putida KT2440
ucgggcuggcugcccga

SEQ ID NO: 3560926 - RNA, 19 nt, Pseudomonas putida KT2440
ucgggcuuggcuucggcgg

SEQ ID NO: 3560927 - RNA, 21 nt, Pseudomonas putida KT2440
ucggggaauggcccagccagc

SEQ ID NO: 3560928 - RNA, 23 nt, Pseudomonas putida KT2440
ucgggugaaaaggcccucagagu

SEQ ID NO: 3560929 - RNA, 24 nt, Pseudomonas putida KT2440
ucgggugaaaaggcccucagaguu

SEQ ID NO: 3560930 - RNA, 14 nt, Pseudomonas putida KT2440
ucgggugaggauga

SEQ ID NO: 3560931 - RNA, 16 nt, Pseudomonas putida KT2440
ucgguaaaacagccuu

SEQ ID NO: 3560932 - RNA, 20 nt, Pseudomonas putida KT2440
ucgguaaacaauucccagcc

SEQ ID NO: 3560933 - RNA, 22 nt, Pseudomonas putida KT2440
ucuaguacuuuuucagguuuac

SEQ ID NO: 3560934 - RNA, 18 nt, Pseudomonas putida KT2440
ucuauggccggaggcaaa

SEQ ID NO: 3560935 - RNA, 17 nt, Pseudomonas putida KT2440
ucucaacguucaucccc

SEQ ID NO: 3560936 - RNA, 14 nt, Pseudomonas putida KT2440
ucucaagccugcca

SEQ ID NO: 3560937 - RNA, 22 nt, Pseudomonas putida KT2440
ucucaagccugccaaaucccuu

SEQ ID NO: 3560938 - RNA, 12 nt, Pseudomonas putida KT2440
ucucaagcuuca

SEQ ID NO: 3560939 - RNA, 19 nt, Pseudomonas putida KT2440
ucucaaggcuuuccaccug

SEQ ID NO: 3560940 - RNA, 12 nt, Pseudomonas putida KT2440
ucucacagcggg

SEQ ID NO: 3560941 - RNA, 22 nt, Pseudomonas putida KT2440
ucucacaggcgcugaaacuguc

SEQ ID NO: 3560942 - RNA, 19 nt, Pseudomonas putida KT2440
ucucacgcgccacauagcu

SEQ ID NO: 3560943 - RNA, 14 nt, Pseudomonas putida KT2440
ucucagcaccauuu

SEQ ID NO: 3560944 - RNA, 19 nt, Pseudomonas putida KT2440
ucucagcccauuucaccug

SEQ ID NO: 3560945 - RNA, 14 nt, Pseudomonas putida KT2440
ucucaggcccacca

SEQ ID NO: 3560946 - RNA, 22 nt, Pseudomonas putida KT2440
ucucauaggguguugcccucac

SEQ ID NO: 3560947 - RNA, 19 nt, Pseudomonas putida KT2440
ucucauuguuugcgucggu

SEQ ID NO: 3560948 - RNA, 22 nt, Pseudomonas putida KT2440
ucuccaacgucaaccgugcccg

SEQ ID NO: 3560949 - RNA, 14 nt, Pseudomonas putida KT2440
ucuccagcagugcc

SEQ ID NO: 3560950 - RNA, 16 nt, Pseudomonas putida KT2440
ucuccagccgcugcug

SEQ ID NO: 3560951 - RNA, 15 nt, Pseudomonas putida KT2440
ucuccagcuccuggc

SEQ ID NO: 3560952 - RNA, 23 nt, Pseudomonas putida KT2440
ucuccaggugcaccaacacuucc

SEQ ID NO: 3560953 - RNA, 18 nt, Pseudomonas putida KT2440
ucuccagguucucgcucc

SEQ ID NO: 3560954 - RNA, 20 nt, Pseudomonas putida KT2440
ucuccagguucucgcuccag

SEQ ID NO: 3560955 - RNA, 14 nt, Pseudomonas putida KT2440
ucuccaugcugcug

SEQ ID NO: 3560956 - RNA, 14 nt, Pseudomonas putida KT2440
ucuccauugcgccu

SEQ ID NO: 3560957 - RNA, 15 nt, Pseudomonas putida KT2440
ucuccauugcgccug

SEQ ID NO: 3560958 - RNA, 12 nt, Pseudomonas putida KT2440
ucuccccuuccc

SEQ ID NO: 3560959 - RNA, 16 nt, Pseudomonas putida KT2440
ucuccgcgcuugcuca

SEQ ID NO: 3560960 - RNA, 18 nt, Pseudomonas putida KT2440
ucuccggcgaaauaccca

SEQ ID NO: 3560961 - RNA, 18 nt, Pseudomonas putida KT2440
ucuccggugcaaagcugu

SEQ ID NO: 3560962 - RNA, 21 nt, Pseudomonas putida KT2440
ucuccuaugagacuagcaguc

SEQ ID NO: 3560963 - RNA, 19 nt, Pseudomonas putida KT2440
ucuccugugccggccucuu

SEQ ID NO: 3560964 - RNA, 14 nt, Pseudomonas putida KT2440
ucucgaacgcugug

SEQ ID NO: 3560965 - RNA, 16 nt, Pseudomonas putida KT2440
ucucgacaagcgcauu

SEQ ID NO: 3560966 - RNA, 20 nt, Pseudomonas putida KT2440
ucucgacaagcgcauugauc

SEQ ID NO: 3560967 - RNA, 20 nt, Pseudomonas putida KT2440
ucucgaugcaauccgccaca

SEQ ID NO: 3560968 - RNA, 12 nt, Pseudomonas putida KT2440
ucucgcagcagc

SEQ ID NO: 3560969 - RNA, 14 nt, Pseudomonas putida KT2440
ucucgcagcagcac

SEQ ID NO: 3560970 - RNA, 23 nt, Pseudomonas putida KT2440
ucucgccagccugcagcgcggcg

SEQ ID NO: 3560971 - RNA, 22 nt, Pseudomonas putida KT2440
ucucgcccacgaucucacgcgc

SEQ ID NO: 3560972 - RNA, 14 nt, Pseudomonas putida KT2440
ucucgcccuugucc

SEQ ID NO: 3560973 - RNA, 18 nt, Pseudomonas putida KT2440
ucucgcgcuuggccaggg

SEQ ID NO: 3560974 - RNA, 18 nt, Pseudomonas putida KT2440
ucucgcucaaauggguac

SEQ ID NO: 3560975 - RNA, 14 nt, Pseudomonas putida KT2440
ucucgcugucgucc

SEQ ID NO: 3560976 - RNA, 18 nt, Pseudomonas putida KT2440
ucucgcugucguccagcu

SEQ ID NO: 3560977 - RNA, 19 nt, Pseudomonas putida KT2440
ucucgcugucguccagcuc

SEQ ID NO: 3560978 - RNA, 22 nt, Pseudomonas putida KT2440
ucucgcugucguccagcucgcg

SEQ ID NO: 3560979 - RNA, 12 nt, Pseudomonas putida KT2440
ucucggccagca

SEQ ID NO: 3560980 - RNA, 13 nt, Pseudomonas putida KT2440
ucucggccagcag

SEQ ID NO: 3560981 - RNA, 18 nt, Pseudomonas putida KT2440
ucucgggguguagcgcag

SEQ ID NO: 3560982 - RNA, 14 nt, Pseudomonas putida KT2440
ucucgucacuggcu

SEQ ID NO: 3560983 - RNA, 17 nt, Pseudomonas putida KT2440
ucucugccgagaggauc

SEQ ID NO: 3560984 - RNA, 18 nt, Pseudomonas putida KT2440
ucucuuccgccagccaac

SEQ ID NO: 3560985 - RNA, 18 nt, Pseudomonas putida KT2440
ucucuucggccaguuuca

SEQ ID NO: 3560986 - RNA, 19 nt, Pseudomonas putida KT2440
ucugaaagaacuuggucca

SEQ ID NO: 3560987 - RNA, 22 nt, Pseudomonas putida KT2440
ucugaaaggcguaggcacaccc

SEQ ID NO: 3560988 - RNA, 21 nt, Pseudomonas putida KT2440
ucugacauaacaagaacaaca

SEQ ID NO: 3560989 - RNA, 22 nt, Pseudomonas putida KT2440
ucugacauaacaagaacaacac

SEQ ID NO: 3560990 - RNA, 15 nt, Pseudomonas putida KT2440
ucugaccggcacugc

SEQ ID NO: 3560991 - RNA, 17 nt, Pseudomonas putida KT2440
ucugaccggcacugcac

SEQ ID NO: 3560992 - RNA, 13 nt, Pseudomonas putida KT2440
ucugagccagccg

SEQ ID NO: 3560993 - RNA, 21 nt, Pseudomonas putida KT2440
ucugagcgucauuagccuuca

SEQ ID NO: 3560994 - RNA, 22 nt, Pseudomonas putida KT2440
ucugaguugcguggggccugcc

SEQ ID NO: 3560995 - RNA, 14 nt, Pseudomonas putida KT2440
ucugauagccaggg

SEQ ID NO: 3560996 - RNA, 15 nt, Pseudomonas putida KT2440
ucugaugugugcccc

SEQ ID NO: 3560997 - RNA, 15 nt, Pseudomonas putida KT2440
ucugauuugcgcuac

SEQ ID NO: 3560998 - RNA, 23 nt, Pseudomonas putida KT2440
ucugauuugcgcuacagcuuuga

SEQ ID NO: 3560999 - RNA, 13 nt, Pseudomonas putida KT2440
ucugcaaagcgcg

SEQ ID NO: 3561000 - RNA, 15 nt, Pseudomonas putida KT2440
ucugcaacagcucca

SEQ ID NO: 3561001 - RNA, 20 nt, Pseudomonas putida KT2440
ucugcaacuccucgaucacc

SEQ ID NO: 3561002 - RNA, 23 nt, Pseudomonas putida KT2440
ucugcaacuccucgaucaccugc

SEQ ID NO: 3561003 - RNA, 15 nt, Pseudomonas putida KT2440
ucugcaagcgcagcc

SEQ ID NO: 3561004 - RNA, 17 nt, Pseudomonas putida KT2440
ucugcacagcgcggaac

SEQ ID NO: 3561005 - RNA, 13 nt, Pseudomonas putida KT2440
ucugcaccggcag

SEQ ID NO: 3561006 - RNA, 14 nt, Pseudomonas putida KT2440
ucugcaccggcagc

SEQ ID NO: 3561007 - RNA, 15 nt, Pseudomonas putida KT2440
ucugcaccuugcccg

SEQ ID NO: 3561008 - RNA, 14 nt, Pseudomonas putida KT2440
ucugcacucccgcu

SEQ ID NO: 3561009 - RNA, 21 nt, Pseudomonas putida KT2440
ucugcagcaccgacuggcgua

SEQ ID NO: 3561010 - RNA, 13 nt, Pseudomonas putida KT2440
ucugcagcagcau

SEQ ID NO: 3561011 - RNA, 12 nt, Pseudomonas putida KT2440
ucugcagcagcg

SEQ ID NO: 3561012 - RNA, 16 nt, Pseudomonas putida KT2440
ucugcagccaccacgu

SEQ ID NO: 3561013 - RNA, 21 nt, Pseudomonas putida KT2440
ucugcagccugacgcgccgcc

SEQ ID NO: 3561014 - RNA, 13 nt, Pseudomonas putida KT2440
ucugcaggauguc

SEQ ID NO: 3561015 - RNA, 13 nt, Pseudomonas putida KT2440
ucugcaggucaug

SEQ ID NO: 3561016 - RNA, 12 nt, Pseudomonas putida KT2440
ucugcagguggu

SEQ ID NO: 3561017 - RNA, 18 nt, Pseudomonas putida KT2440
ucugcagguggugguccc

SEQ ID NO: 3561018 - RNA, 22 nt, Pseudomonas putida KT2440
ucugcagguggugguccccuuc

SEQ ID NO: 3561019 - RNA, 11 nt, Pseudomonas putida KT2440
ucugcaugcca

SEQ ID NO: 3561020 - RNA, 14 nt, Pseudomonas putida KT2440
ucugcaugccagua

SEQ ID NO: 3561021 - RNA, 21 nt, Pseudomonas putida KT2440
ucugcauguccagcccguucu

SEQ ID NO: 3561022 - RNA, 23 nt, Pseudomonas putida KT2440
ucugccagugucaguugcucgcc

SEQ ID NO: 3561023 - RNA, 22 nt, Pseudomonas putida KT2440
ucugcccgcgccuugcgcacgc

SEQ ID NO: 3561024 - RNA, 13 nt, Pseudomonas putida KT2440
ucugccgcaccag

SEQ ID NO: 3561025 - RNA, 13 nt, Pseudomonas putida KT2440
ucugccgcagccc

SEQ ID NO: 3561026 - RNA, 22 nt, Pseudomonas putida KT2440
ucugccgccccuccacccaccu

SEQ ID NO: 3561027 - RNA, 14 nt, Pseudomonas putida KT2440
ucugccgcuucguc

SEQ ID NO: 3561028 - RNA, 17 nt, Pseudomonas putida KT2440
ucugccggaucuggcag

SEQ ID NO: 3561029 - RNA, 15 nt, Pseudomonas putida KT2440
ucugccguuggcccg

SEQ ID NO: 3561030 - RNA, 17 nt, Pseudomonas putida KT2440
ucugccguuguucggca

SEQ ID NO: 3561031 - RNA, 14 nt, Pseudomonas putida KT2440
ucugccguuugcug

SEQ ID NO: 3561032 - RNA, 19 nt, Pseudomonas putida KT2440
ucugccguuugcuggccug

SEQ ID NO: 3561033 - RNA, 13 nt, Pseudomonas putida KT2440
ucugccugcugca

SEQ ID NO: 3561034 - RNA, 20 nt, Pseudomonas putida KT2440
ucugcgcaaaggcuuuggcc

SEQ ID NO: 3561035 - RNA, 23 nt, Pseudomonas putida KT2440
ucugcggugggcacacaccgggu

SEQ ID NO: 3561036 - RNA, 13 nt, Pseudomonas putida KT2440
ucugcgugcaccc

SEQ ID NO: 3561037 - RNA, 14 nt, Pseudomonas putida KT2440
ucugcguggcaguu

SEQ ID NO: 3561038 - RNA, 20 nt, Pseudomonas putida KT2440
ucugcucgccaucuggcguu

SEQ ID NO: 3561039 - RNA, 22 nt, Pseudomonas putida KT2440
ucuucugccaguugcuucugca

SEQ ID NO: 3561040 - RNA, 20 nt, Pseudomonas putida KT2440
ucuucuuuaagccccugcgg

SEQ ID NO: 3561041 - RNA, 13 nt, Pseudomonas putida KT2440
ucuucuuucaggu

SEQ ID NO: 3561042 - RNA, 23 nt, Pseudomonas putida KT2440
ucuugaacugggcauccagcuug

SEQ ID NO: 3561043 - RNA, 16 nt, Pseudomonas putida KT2440
ucuugaagaugaccuu

SEQ ID NO: 3561044 - RNA, 20 nt, Pseudomonas putida KT2440
ucuugaagcguucagucagu

SEQ ID NO: 3561045 - RNA, 17 nt, Pseudomonas putida KT2440
ucuugaauccccuuaua

SEQ ID NO: 3561046 - RNA, 21 nt, Pseudomonas putida KT2440
ucuugaccccgccuggggguc

SEQ ID NO: 3561047 - RNA, 18 nt, Pseudomonas putida KT2440
ucuugacgggugaccagg

SEQ ID NO: 3561048 - RNA, 15 nt, Pseudomonas putida KT2440
ucuugagcuggccgu

SEQ ID NO: 3561049 - RNA, 13 nt, Pseudomonas putida KT2440
ucuugcaccgcuc

SEQ ID NO: 3561050 - RNA, 19 nt, Pseudomonas putida KT2440
ucuugcaccugucccagcu

SEQ ID NO: 3561051 - RNA, 14 nt, Pseudomonas putida KT2440
ucuugccgagcagc

SEQ ID NO: 3561052 - RNA, 15 nt, Pseudomonas putida KT2440
ucuugccgagcagcg

SEQ ID NO: 3561053 - RNA, 23 nt, Pseudomonas putida KT2440
ucuugccgugcucguccuugccg

SEQ ID NO: 3561054 - RNA, 20 nt, Pseudomonas putida KT2440
ucuugcgaaaggcuuucgau

SEQ ID NO: 3561055 - RNA, 23 nt, Pseudomonas putida KT2440
ucuugcgcacgcgcuuuuccagc

SEQ ID NO: 3561056 - RNA, 19 nt, Pseudomonas putida KT2440
ucuugcgcgccagcgcaug

SEQ ID NO: 3561057 - RNA, 20 nt, Pseudomonas putida KT2440
ucuugcgugcaugggccagg

SEQ ID NO: 3561058 - RNA, 14 nt, Pseudomonas putida KT2440
ucuugcugaacagc

SEQ ID NO: 3561059 - RNA, 18 nt, Pseudomonas putida KT2440
ucuugcugaacagccggc

SEQ ID NO: 3561060 - RNA, 21 nt, Pseudomonas putida KT2440
ucuugcuggccgguggcuucg

SEQ ID NO: 3561061 - RNA, 16 nt, Pseudomonas putida KT2440
ucuuggagcggccuuu

SEQ ID NO: 3561062 - RNA, 21 nt, Pseudomonas putida KT2440
ucuugucgacagugaauuccu

SEQ ID NO: 3561063 - RNA, 21 nt, Pseudomonas putida KT2440
ucuugucuuuacgcauugccg

SEQ ID NO: 3561064 - RNA, 13 nt, Pseudomonas putida KT2440
ucuugugcugcga

SEQ ID NO: 3561065 - RNA, 19 nt, Pseudomonas putida KT2440
ucuuguggcucauguaaua

SEQ ID NO: 3561066 - RNA, 15 nt, Pseudomonas putida KT2440
ucuuguguuuugccu

SEQ ID NO: 3561067 - RNA, 18 nt, Pseudomonas putida KT2440
ucuuuaccguuggcuagc

SEQ ID NO: 3561068 - RNA, 20 nt, Pseudomonas putida KT2440
ucuuucagcucaaucagcca

SEQ ID NO: 3561069 - RNA, 18 nt, Pseudomonas putida KT2440
ucuuucagguaacgggca

SEQ ID NO: 3561070 - RNA, 23 nt, Pseudomonas putida KT2440
ucuuucgcguacugcauguacuc

SEQ ID NO: 3561071 - RNA, 19 nt, Pseudomonas putida KT2440
ucuuucggcagcacccgcu

SEQ ID NO: 3561072 - RNA, 12 nt, Pseudomonas putida KT2440
ucuuucucccag

SEQ ID NO: 3561073 - RNA, 15 nt, Pseudomonas putida KT2440
ucuuugccacucagc

SEQ ID NO: 3561074 - RNA, 12 nt, Pseudomonas putida KT2440
ucuuugccuggg

SEQ ID NO: 3561075 - RNA, 15 nt, Pseudomonas putida KT2440
ucuuuggccugcuug

SEQ ID NO: 3561076 - RNA, 14 nt, Pseudomonas putida KT2440
ugaaaaaaggcccu

SEQ ID NO: 3561077 - RNA, 15 nt, Pseudomonas putida KT2440
ugaaaaggcccugca

SEQ ID NO: 3561078 - RNA, 15 nt, Pseudomonas putida KT2440
ugaaaccgucuuuac

SEQ ID NO: 3561079 - RNA, 20 nt, Pseudomonas putida KT2440
ugaaacgaguggaucaaccg

SEQ ID NO: 3561080 - RNA, 17 nt, Pseudomonas putida KT2440
ugaaacugaucagcuuc

SEQ ID NO: 3561081 - RNA, 20 nt, Pseudomonas putida KT2440
ugaaagaacuugguccagaa

SEQ ID NO: 3561082 - RNA, 20 nt, Pseudomonas putida KT2440
ugaaagcguauugccagaag

SEQ ID NO: 3561083 - RNA, 19 nt, Pseudomonas putida KT2440
ugaaagucgaccagcagcu

SEQ ID NO: 3561084 - RNA, 21 nt, Pseudomonas putida KT2440
ugaaaugguugaagaucaggu

SEQ ID NO: 3561085 - RNA, 14 nt, Pseudomonas putida KT2440
ugaaauuaaagguu

SEQ ID NO: 3561086 - RNA, 18 nt, Pseudomonas putida KT2440
ugaaauuaaagguugacg

SEQ ID NO: 3561087 - RNA, 13 nt, Pseudomonas putida KT2440
ugaaauucaccug

SEQ ID NO: 3561088 - RNA, 18 nt, Pseudomonas putida KT2440
ugaaauuuuugaaauuuu

SEQ ID NO: 3561089 - RNA, 17 nt, Pseudomonas putida KT2440
ugaacaacggcgcuguc

SEQ ID NO: 3561090 - RNA, 13 nt, Pseudomonas putida KT2440
ugaacacaugcca

SEQ ID NO: 3561091 - RNA, 15 nt, Pseudomonas putida KT2440
ugaacaccugccagc

SEQ ID NO: 3561092 - RNA, 19 nt, Pseudomonas putida KT2440
ugaacaccugccagccccg

SEQ ID NO: 3561093 - RNA, 19 nt, Pseudomonas putida KT2440
ugaacaccuuaauaguuaa

SEQ ID NO: 3561094 - RNA, 19 nt, Pseudomonas putida KT2440
ugaacacgcaggucuugcc

SEQ ID NO: 3561095 - RNA, 20 nt, Pseudomonas putida KT2440
ugaacacgcccgcgugcuuc

SEQ ID NO: 3561096 - RNA, 18 nt, Pseudomonas putida KT2440
ugaacacgccgucgaccu

SEQ ID NO: 3561097 - RNA, 23 nt, Pseudomonas putida KT2440
ugaacagcagcgccgccaggccc

SEQ ID NO: 3561098 - RNA, 13 nt, Pseudomonas putida KT2440
ugaacagcgccca

SEQ ID NO: 3561099 - RNA, 13 nt, Pseudomonas putida KT2440
ugaacagcgccuu

SEQ ID NO: 3561100 - RNA, 20 nt, Pseudomonas putida KT2440
ugaacagcgcugcgaggccc

SEQ ID NO: 3561101 - RNA, 17 nt, Pseudomonas putida KT2440
ugaacagguugcgcgcc

SEQ ID NO: 3561102 - RNA, 16 nt, Pseudomonas putida KT2440
ugaacagguugcugcc

SEQ ID NO: 3561103 - RNA, 19 nt, Pseudomonas putida KT2440
ugaaccaugcgccgcugcu

SEQ ID NO: 3561104 - RNA, 16 nt, Pseudomonas putida KT2440
ugaacccgcuccuaca

SEQ ID NO: 3561105 - RNA, 22 nt, Pseudomonas putida KT2440
ugaaccgcgccuacaggcccca

SEQ ID NO: 3561106 - RNA, 15 nt, Pseudomonas putida KT2440
ugaaccucaccgccg

SEQ ID NO: 3561107 - RNA, 13 nt, Pseudomonas putida KT2440
ugaacgagccagc

SEQ ID NO: 3561108 - RNA, 13 nt, Pseudomonas putida KT2440
ugaacgaucaggg

SEQ ID NO: 3561109 - RNA, 16 nt, Pseudomonas putida KT2440
ugaacgaugcccgggc

SEQ ID NO: 3561110 - RNA, 18 nt, Pseudomonas putida KT2440
ugaacgcaaaaaaccgca

SEQ ID NO: 3561111 - RNA, 19 nt, Pseudomonas putida KT2440
ugaacgcaauaugcaccuu

SEQ ID NO: 3561112 - RNA, 16 nt, Pseudomonas putida KT2440
ugaacgcagcuuccgc

SEQ ID NO: 3561113 - RNA, 20 nt, Pseudomonas putida KT2440
ugaacggcauuuccagcguc

SEQ ID NO: 3561114 - RNA, 16 nt, Pseudomonas putida KT2440
ugaacuucuucggguc

SEQ ID NO: 3561115 - RNA, 13 nt, Pseudomonas putida KT2440
ugaacuugcgcuc

SEQ ID NO: 3561116 - RNA, 18 nt, Pseudomonas putida KT2440
ugaacuuggccuccagca

SEQ ID NO: 3561117 - RNA, 11 nt, Pseudomonas putida KT2440
ugaagaagccc

SEQ ID NO: 3561118 - RNA, 21 nt, Pseudomonas putida KT2440
ugaagaagcuaccccacaacc

SEQ ID NO: 3561119 - RNA, 14 nt, Pseudomonas putida KT2440
ugaagaagcucccg

SEQ ID NO: 3561120 - RNA, 18 nt, Pseudomonas putida KT2440
ugaagacgcacacucccc

SEQ ID NO: 3561121 - RNA, 15 nt, Pseudomonas putida KT2440
ugaagacgcucgaca

SEQ ID NO: 3561122 - RNA, 20 nt, Pseudomonas putida KT2440
ugaagacgcuugcgcauggc

SEQ ID NO: 3561123 - RNA, 23 nt, Pseudomonas putida KT2440
ugaagacgcuugcgcauggccgc

SEQ ID NO: 3561124 - RNA, 15 nt, Pseudomonas putida KT2440
ugaagaguggaucgu

SEQ ID NO: 3561125 - RNA, 21 nt, Pseudomonas putida KT2440
ugaagaguggaucguggccgg

SEQ ID NO: 3561126 - RNA, 15 nt, Pseudomonas putida KT2440
ugaagauuuucagcc

SEQ ID NO: 3561127 - RNA, 21 nt, Pseudomonas putida KT2440
ugaagcaccagguuugcugcc

SEQ ID NO: 3561128 - RNA, 21 nt, Pseudomonas putida KT2440
ugaagccaguacgcgccugca

SEQ ID NO: 3561129 - RNA, 17 nt, Pseudomonas putida KT2440
ugaagccaugggcagag

SEQ ID NO: 3561130 - RNA, 11 nt, Pseudomonas putida KT2440
ugaagcccgcc

SEQ ID NO: 3561131 - RNA, 18 nt, Pseudomonas putida KT2440
ugaagcccggccgcgcca

SEQ ID NO: 3561132 - RNA, 16 nt, Pseudomonas putida KT2440
ugaagcccugcugcug

SEQ ID NO: 3561133 - RNA, 15 nt, Pseudomonas putida KT2440
ugaagcgagguggcu

SEQ ID NO: 3561134 - RNA, 18 nt, Pseudomonas putida KT2440
ugaagcggccaccugccc

SEQ ID NO: 3561135 - RNA, 12 nt, Pseudomonas putida KT2440
ugaagcggccua

SEQ ID NO: 3561136 - RNA, 16 nt, Pseudomonas putida KT2440
ugaagcgguugaccgc

SEQ ID NO: 3561137 - RNA, 17 nt, Pseudomonas putida KT2440
ugaagcgguugaccgcc

SEQ ID NO: 3561138 - RNA, 22 nt, Pseudomonas putida KT2440
ugaagcgguugaccgccgccac

SEQ ID NO: 3561139 - RNA, 15 nt, Pseudomonas putida KT2440
ugaagcucuccagca

SEQ ID NO: 3561140 - RNA, 17 nt, Pseudomonas putida KT2440
ugaagcuuccaguuggc

SEQ ID NO: 3561141 - RNA, 20 nt, Pseudomonas putida KT2440
ugaagcuuccaguuggccgg

SEQ ID NO: 3561142 - RNA, 18 nt, Pseudomonas putida KT2440
ugaaggaacgacuugaug

SEQ ID NO: 3561143 - RNA, 19 nt, Pseudomonas putida KT2440
ugaaggaauuaccaggcgc

SEQ ID NO: 3561144 - RNA, 17 nt, Pseudomonas putida KT2440
ugacguuggccgccagc

SEQ ID NO: 3561145 - RNA, 18 nt, Pseudomonas putida KT2440
ugacguuggccgccagcg

SEQ ID NO: 3561146 - RNA, 21 nt, Pseudomonas putida KT2440
ugacguuguagcggccaucgc

SEQ ID NO: 3561147 - RNA, 14 nt, Pseudomonas putida KT2440
ugacuauuucuagu

SEQ ID NO: 3561148 - RNA, 14 nt, Pseudomonas putida KT2440
ugacucagcggccu

SEQ ID NO: 3561149 - RNA, 22 nt, Pseudomonas putida KT2440
ugacucagcggccuuucugcuu

SEQ ID NO: 3561150 - RNA, 11 nt, Pseudomonas putida KT2440
ugacucaugcc

SEQ ID NO: 3561151 - RNA, 13 nt, Pseudomonas putida KT2440
ugacuccgcccca

SEQ ID NO: 3561152 - RNA, 15 nt, Pseudomonas putida KT2440
ugacugccagcacga

SEQ ID NO: 3561153 - RNA, 15 nt, Pseudomonas putida KT2440
ugacuggcagcaagg

SEQ ID NO: 3561154 - RNA, 17 nt, Pseudomonas putida KT2440
ugacuggcagcaaggcc

SEQ ID NO: 3561155 - RNA, 19 nt, Pseudomonas putida KT2440
ugacuuccagcuugccguc

SEQ ID NO: 3561156 - RNA, 14 nt, Pseudomonas putida KT2440
ugacuuccagguag

SEQ ID NO: 3561157 - RNA, 17 nt, Pseudomonas putida KT2440
ugacuucgcugcccgag

SEQ ID NO: 3561158 - RNA, 18 nt, Pseudomonas putida KT2440
ugacuucgcugcccgagc

SEQ ID NO: 3561159 - RNA, 23 nt, Pseudomonas putida KT2440
ugacuucucccgggcaaucagua

SEQ ID NO: 3561160 - RNA, 21 nt, Pseudomonas putida KT2440
ugacuuuccauuacuccagaa

SEQ ID NO: 3561161 - RNA, 21 nt, Pseudomonas putida KT2440
ugagaaccuccgccaacugca

SEQ ID NO: 3561162 - RNA, 17 nt, Pseudomonas putida KT2440
ugagaccgaggggccgc

SEQ ID NO: 3561163 - RNA, 20 nt, Pseudomonas putida KT2440
ugagaccugcaaugccgcug

SEQ ID NO: 3561164 - RNA, 16 nt, Pseudomonas putida KT2440
ugagacuagcaguccc

SEQ ID NO: 3561165 - RNA, 20 nt, Pseudomonas putida KT2440
ugagagggucggcgggcgga

SEQ ID NO: 3561166 - RNA, 17 nt, Pseudomonas putida KT2440
ugagaucgagcgccgcc

SEQ ID NO: 3561167 - RNA, 17 nt, Pseudomonas putida KT2440
ugagaugaugguugaca

SEQ ID NO: 3561168 - RNA, 19 nt, Pseudomonas putida KT2440
ugagcaagcgcgcgcccac

SEQ ID NO: 3561169 - RNA, 20 nt, Pseudomonas putida KT2440
ugagcacacgguaguccugc

SEQ ID NO: 3561170 - RNA, 22 nt, Pseudomonas putida KT2440
ugagcacccccgguucacucga

SEQ ID NO: 3561171 - RNA, 19 nt, Pseudomonas putida KT2440
ugagcacgaaacugcgcug

SEQ ID NO: 3561172 - RNA, 20 nt, Pseudomonas putida KT2440
ugagcagaccagccgggcug

SEQ ID NO: 3561173 - RNA, 17 nt, Pseudomonas putida KT2440
ugagcagguuguccacc

SEQ ID NO: 3561174 - RNA, 19 nt, Pseudomonas putida KT2440
ugagcaguucgucgaccgc

SEQ ID NO: 3561175 - RNA, 21 nt, Pseudomonas putida KT2440
ugagcauggcaaacagcacca

SEQ ID NO: 3561176 - RNA, 22 nt, Pseudomonas putida KT2440
ugagcauggcaaacagcaccag

SEQ ID NO: 3561177 - RNA, 22 nt, Pseudomonas putida KT2440
ugagccaggagaacacccagcg

SEQ ID NO: 3561178 - RNA, 14 nt, Pseudomonas putida KT2440
ugagccaggccgac

SEQ ID NO: 3561179 - RNA, 16 nt, Pseudomonas putida KT2440
ugagccaggccgacaa

SEQ ID NO: 3561180 - RNA, 15 nt, Pseudomonas putida KT2440
ugagccggcgcuggg

SEQ ID NO: 3561181 - RNA, 16 nt, Pseudomonas putida KT2440
ugagccggcgcugggc

SEQ ID NO: 3561182 - RNA, 20 nt, Pseudomonas putida KT2440
ugagccguccggcaaucugc

SEQ ID NO: 3561183 - RNA, 22 nt, Pseudomonas putida KT2440
ugagccguccggcaaucugccc

SEQ ID NO: 3561184 - RNA, 16 nt, Pseudomonas putida KT2440
ugagccuggccggugu

SEQ ID NO: 3561185 - RNA, 14 nt, Pseudomonas putida KT2440
ugagccuuguucgc

SEQ ID NO: 3561186 - RNA, 17 nt, Pseudomonas putida KT2440
ugagcgaaacccggcgc

SEQ ID NO: 3561187 - RNA, 17 nt, Pseudomonas putida KT2440
ugagcgacgcugccgca

SEQ ID NO: 3561188 - RNA, 23 nt, Pseudomonas putida KT2440
ugagcgagcucaaccagcugcgu

SEQ ID NO: 3561189 - RNA, 17 nt, Pseudomonas putida KT2440
ugagcgaugcgcuggca

SEQ ID NO: 3561190 - RNA, 22 nt, Pseudomonas putida KT2440
ugagcgcagcgacgaccugcac

SEQ ID NO: 3561191 - RNA, 18 nt, Pseudomonas putida KT2440
ugagcgccauccaccugu

SEQ ID NO: 3561192 - RNA, 16 nt, Pseudomonas putida KT2440
ugagcgccgcgaugau

SEQ ID NO: 3561193 - RNA, 18 nt, Pseudomonas putida KT2440
ugagcgcgccgccuucgc

SEQ ID NO: 3561194 - RNA, 19 nt, Pseudomonas putida KT2440
ugagcggcucgcgcucuuc

SEQ ID NO: 3561195 - RNA, 20 nt, Pseudomonas putida KT2440
ugagcggcucgcgcucuuca

SEQ ID NO: 3561196 - RNA, 15 nt, Pseudomonas putida KT2440
ugagcguggcaaacc

SEQ ID NO: 3561197 - RNA, 16 nt, Pseudomonas putida KT2440
ugagcguggcaaaccc

SEQ ID NO: 3561198 - RNA, 17 nt, Pseudomonas putida KT2440
ugagcucuacaccuaac

SEQ ID NO: 3561199 - RNA, 14 nt, Pseudomonas putida KT2440
ugagcugcgcgcga

SEQ ID NO: 3561200 - RNA, 22 nt, Pseudomonas putida KT2440
ugagcuggccguccagcugagc

SEQ ID NO: 3561201 - RNA, 18 nt, Pseudomonas putida KT2440
ugagcuguuucaugcugc

SEQ ID NO: 3561202 - RNA, 12 nt, Pseudomonas putida KT2440
ugagcuucagcg

SEQ ID NO: 3561203 - RNA, 17 nt, Pseudomonas putida KT2440
ugagcuucagcgcgcca

SEQ ID NO: 3561204 - RNA, 16 nt, Pseudomonas putida KT2440
ugagcuugacuuccag

SEQ ID NO: 3561205 - RNA, 19 nt, Pseudomonas putida KT2440
ugaggaaguagaacacccg

SEQ ID NO: 3561206 - RNA, 14 nt, Pseudomonas putida KT2440
ugaggaccuugcgg

SEQ ID NO: 3561207 - RNA, 15 nt, Pseudomonas putida KT2440
ugaggaccuugcggg

SEQ ID NO: 3561208 - RNA, 14 nt, Pseudomonas putida KT2440
ugaggaugugcgcu

SEQ ID NO: 3561209 - RNA, 19 nt, Pseudomonas putida KT2440
ugaggcaacggcuaccagc

SEQ ID NO: 3561210 - RNA, 16 nt, Pseudomonas putida KT2440
ugaggcacaaaaaagc

SEQ ID NO: 3561211 - RNA, 20 nt, Pseudomonas putida KT2440
ugaggcacaaaaaagcccgg

SEQ ID NO: 3561212 - RNA, 20 nt, Pseudomonas putida KT2440
ugaggccgaacaccgccagc

SEQ ID NO: 3561213 - RNA, 13 nt, Pseudomonas putida KT2440
ugaggccuucagc

SEQ ID NO: 3561214 - RNA, 21 nt, Pseudomonas putida KT2440
ugaggcguagcacaagggcca

SEQ ID NO: 3561215 - RNA, 23 nt, Pseudomonas putida KT2440
ugaggcguagcacaagggccagg

SEQ ID NO: 3561216 - RNA, 20 nt, Pseudomonas putida KT2440
ugaggcuguggcccaaggcg

SEQ ID NO: 3561217 - RNA, 20 nt, Pseudomonas putida KT2440
ugagggccucuucgcgggua

SEQ ID NO: 3561218 - RNA, 15 nt, Pseudomonas putida KT2440
ugagggcucauccac

SEQ ID NO: 3561219 - RNA, 12 nt, Pseudomonas putida KT2440
ugagggucagcu

SEQ ID NO: 3561220 - RNA, 22 nt, Pseudomonas putida KT2440
ugaggucuucgaucucggccag

SEQ ID NO: 3561221 - RNA, 21 nt, Pseudomonas putida KT2440
ugaggugccauagcaccagcg

SEQ ID NO: 3561222 - RNA, 20 nt, Pseudomonas putida KT2440
ugaggugcugcagacccgcg

SEQ ID NO: 3561223 - RNA, 15 nt, Pseudomonas putida KT2440
ugagguucagcgcac

SEQ ID NO: 3561224 - RNA, 18 nt, Pseudomonas putida KT2440
ugagucaggcgcccugcc

SEQ ID NO: 3561225 - RNA, 14 nt, Pseudomonas putida KT2440
ugagucuguggaua

SEQ ID NO: 3561226 - RNA, 22 nt, Pseudomonas putida KT2440
ugagugcuucgcccagugccug

SEQ ID NO: 3561227 - RNA, 21 nt, Pseudomonas putida KT2440
ugaguucccaggcagccucca

SEQ ID NO: 3561228 - RNA, 13 nt, Pseudomonas putida KT2440
ugauaacgaaucu

SEQ ID NO: 3561229 - RNA, 21 nt, Pseudomonas putida KT2440
ugauacacccgcuccaacaaa

SEQ ID NO: 3561230 - RNA, 20 nt, Pseudomonas putida KT2440
ugauaccgaggaggaggcug

SEQ ID NO: 3561231 - RNA, 18 nt, Pseudomonas putida KT2440
ugauaccugcuugcugac

SEQ ID NO: 3561232 - RNA, 13 nt, Pseudomonas putida KT2440
ugauagccagggc

SEQ ID NO: 3561233 - RNA, 23 nt, Pseudomonas putida KT2440
ugauagcgagccgcauuggccgg

SEQ ID NO: 3561234 - RNA, 13 nt, Pseudomonas putida KT2440
ugauaggacugcu

SEQ ID NO: 3561235 - RNA, 22 nt, Pseudomonas putida KT2440
ugaucaacaaaccgacccugcu

SEQ ID NO: 3561236 - RNA, 21 nt, Pseudomonas putida KT2440
ugaucaagcuguacaacgcag

SEQ ID NO: 3561237 - RNA, 19 nt, Pseudomonas putida KT2440
ugaucaccagguuguggcc

SEQ ID NO: 3561238 - RNA, 16 nt, Pseudomonas putida KT2440
ugaucacgggcaggcc

SEQ ID NO: 3561239 - RNA, 17 nt, Pseudomonas putida KT2440
ugaucagcaaugccagu

SEQ ID NO: 3561240 - RNA, 22 nt, Pseudomonas putida KT2440
ugaucagcaaugccaguugauc

SEQ ID NO: 3561241 - RNA, 13 nt, Pseudomonas putida KT2440
ugaucagcgacac

SEQ ID NO: 3561242 - RNA, 14 nt, Pseudomonas putida KT2440
ugaucagcgccugc

SEQ ID NO: 3561243 - RNA, 15 nt, Pseudomonas putida KT2440
ugaucagcgccugcu

SEQ ID NO: 3561244 - RNA, 20 nt, Pseudomonas putida KT2440
ugaucagcugccacucuuca

SEQ ID NO: 3561245 - RNA, 23 nt, Pseudomonas putida KT2440
ugaucagguaccccucgcugccc

SEQ ID NO: 3561246 - RNA, 15 nt, Pseudomonas putida KT2440
ugaucaggucggcgg

SEQ ID NO: 3561247 - RNA, 17 nt, Pseudomonas putida KT2440
ugaucagguuacuggcc

SEQ ID NO: 3561248 - RNA, 16 nt, Pseudomonas putida KT2440
ugaucagguugcccgc

SEQ ID NO: 3561249 - RNA, 21 nt, Pseudomonas putida KT2440
ugcacaguucgaaaaccugcu

SEQ ID NO: 3561250 - RNA, 13 nt, Pseudomonas putida KT2440
ugcacaucccaga

SEQ ID NO: 3561251 - RNA, 19 nt, Pseudomonas putida KT2440
ugcacaucuccacugcgcc

SEQ ID NO: 3561252 - RNA, 22 nt, Pseudomonas putida KT2440
ugcaccaacacuuccagcaucg

SEQ ID NO: 3561253 - RNA, 18 nt, Pseudomonas putida KT2440
ugcaccaacgccgauagc

SEQ ID NO: 3561254 - RNA, 15 nt, Pseudomonas putida KT2440
ugcaccaacggcuuc

SEQ ID NO: 3561255 - RNA, 20 nt, Pseudomonas putida KT2440
ugcaccaacggcuucacauc

SEQ ID NO: 3561256 - RNA, 14 nt, Pseudomonas putida KT2440
ugcaccaaugacuc

SEQ ID NO: 3561257 - RNA, 12 nt, Pseudomonas putida KT2440
ugcaccaccugc

SEQ ID NO: 3561258 - RNA, 19 nt, Pseudomonas putida KT2440
ugcaccacgcgcaaaugcu

SEQ ID NO: 3561259 - RNA, 14 nt, Pseudomonas putida KT2440
ugcaccagcaccac

SEQ ID NO: 3561260 - RNA, 19 nt, Pseudomonas putida KT2440
ugcaccaggcccagccggg

SEQ ID NO: 3561261 - RNA, 22 nt, Pseudomonas putida KT2440
ugcaccaggcccagccgggcca

SEQ ID NO: 3561262 - RNA, 17 nt, Pseudomonas putida KT2440
ugcaccaggucaggaca

SEQ ID NO: 3561263 - RNA, 13 nt, Pseudomonas putida KT2440
ugcaccaguuccu

SEQ ID NO: 3561264 - RNA, 20 nt, Pseudomonas putida KT2440
ugcaccaguuccuggcgcuc

SEQ ID NO: 3561265 - RNA, 22 nt, Pseudomonas putida KT2440
ugcaccaguuccuggcgcuccu

SEQ ID NO: 3561266 - RNA, 17 nt, Pseudomonas putida KT2440
ugcaccaugaauucccu

SEQ ID NO: 3561267 - RNA, 14 nt, Pseudomonas putida KT2440
ugcacccacuggcc

SEQ ID NO: 3561268 - RNA, 15 nt, Pseudomonas putida KT2440
ugcacccacuggccg

SEQ ID NO: 3561269 - RNA, 15 nt, Pseudomonas putida KT2440
ugcacccaucggcgc

SEQ ID NO: 3561270 - RNA, 19 nt, Pseudomonas putida KT2440
ugcacccaucggcgcgaag

SEQ ID NO: 3561271 - RNA, 17 nt, Pseudomonas putida KT2440
ugcaccccauaacgccc

SEQ ID NO: 3561272 - RNA, 14 nt, Pseudomonas putida KT2440
ugcacccgccagcc

SEQ ID NO: 3561273 - RNA, 14 nt, Pseudomonas putida KT2440
ugcacccgcgcgcu

SEQ ID NO: 3561274 - RNA, 15 nt, Pseudomonas putida KT2440
ugcacccgugcaggg

SEQ ID NO: 3561275 - RNA, 19 nt, Pseudomonas putida KT2440
ugcacccgugccugccugc

SEQ ID NO: 3561276 - RNA, 13 nt, Pseudomonas putida KT2440
ugcacccguggcg

SEQ ID NO: 3561277 - RNA, 15 nt, Pseudomonas putida KT2440
ugcaccgaagcacca

SEQ ID NO: 3561278 - RNA, 16 nt, Pseudomonas putida KT2440
ugcaccgagaagcaca

SEQ ID NO: 3561279 - RNA, 16 nt, Pseudomonas putida KT2440
ugcaccgcagccccag

SEQ ID NO: 3561280 - RNA, 21 nt, Pseudomonas putida KT2440
ugcaccgcuccgacaaaugca

SEQ ID NO: 3561281 - RNA, 21 nt, Pseudomonas putida KT2440
ugcaccggcaguucgacgccu

SEQ ID NO: 3561282 - RNA, 17 nt, Pseudomonas putida KT2440
ugcaccguggcagcaau

SEQ ID NO: 3561283 - RNA, 21 nt, Pseudomonas putida KT2440
ugcaccuaaccagugggagcg

SEQ ID NO: 3561284 - RNA, 19 nt, Pseudomonas putida KT2440
ugcaccucccgccacggcc

SEQ ID NO: 3561285 - RNA, 13 nt, Pseudomonas putida KT2440
ugcaccuccgccc

SEQ ID NO: 3561286 - RNA, 18 nt, Pseudomonas putida KT2440
ugcaccucggaugccacg

SEQ ID NO: 3561287 - RNA, 23 nt, Pseudomonas putida KT2440
ugcaccugacgagcgaaauaggu

SEQ ID NO: 3561288 - RNA, 22 nt, Pseudomonas putida KT2440
ugcaccuugagaucagcaaccu

SEQ ID NO: 3561289 - RNA, 17 nt, Pseudomonas putida KT2440
ugcaccuuguuacccgc

SEQ ID NO: 3561290 - RNA, 18 nt, Pseudomonas putida KT2440
ugcaccuuguuacccgca

SEQ ID NO: 3561291 - RNA, 22 nt, Pseudomonas putida KT2440
ugcacgaacagauggugaugcc

SEQ ID NO: 3561292 - RNA, 17 nt, Pseudomonas putida KT2440
ugcacgaucgaccgggu

SEQ ID NO: 3561293 - RNA, 15 nt, Pseudomonas putida KT2440
ugcacgccagcauca

SEQ ID NO: 3561294 - RNA, 14 nt, Pseudomonas putida KT2440
ugcacgccagccag

SEQ ID NO: 3561295 - RNA, 19 nt, Pseudomonas putida KT2440
ugcacgcgcagagaagccg

SEQ ID NO: 3561296 - RNA, 15 nt, Pseudomonas putida KT2440
ugcacgcgugccugg

SEQ ID NO: 3561297 - RNA, 19 nt, Pseudomonas putida KT2440
ugcacgcuuucgccgauca

SEQ ID NO: 3561298 - RNA, 20 nt, Pseudomonas putida KT2440
ugcacgcuuucgccgaucag

SEQ ID NO: 3561299 - RNA, 19 nt, Pseudomonas putida KT2440
ugcacggcaaaguccagca

SEQ ID NO: 3561300 - RNA, 22 nt, Pseudomonas putida KT2440
ugcacggcaauugccaccggcg

SEQ ID NO: 3561301 - RNA, 20 nt, Pseudomonas putida KT2440
ugcacggccguuggccagca

SEQ ID NO: 3561302 - RNA, 15 nt, Pseudomonas putida KT2440
ugcacggccugcauc

SEQ ID NO: 3561303 - RNA, 16 nt, Pseudomonas putida KT2440
ugcacuaagggcaggc

SEQ ID NO: 3561304 - RNA, 17 nt, Pseudomonas putida KT2440
ugcacuaagggcaggcc

SEQ ID NO: 3561305 - RNA, 16 nt, Pseudomonas putida KT2440
ugcacucccgcugcug

SEQ ID NO: 3561306 - RNA, 18 nt, Pseudomonas putida KT2440
ugcacucccgcugcugcg

SEQ ID NO: 3561307 - RNA, 14 nt, Pseudomonas putida KT2440
ugcacucgccgaua

SEQ ID NO: 3561308 - RNA, 21 nt, Pseudomonas putida KT2440
ugcacugccugcacggcaaag

SEQ ID NO: 3561309 - RNA, 12 nt, Pseudomonas putida KT2440
ugcacugccugg

SEQ ID NO: 3561310 - RNA, 13 nt, Pseudomonas putida KT2440
ugcacugccuggc

SEQ ID NO: 3561311 - RNA, 15 nt, Pseudomonas putida KT2440
ugcacugccuggcuc

SEQ ID NO: 3561312 - RNA, 13 nt, Pseudomonas putida KT2440
ugcacuggcaggc

SEQ ID NO: 3561313 - RNA, 20 nt, Pseudomonas putida KT2440
ugcacuggcaggccuuguuc

SEQ ID NO: 3561314 - RNA, 15 nt, Pseudomonas putida KT2440
ugcacuggccucuuc

SEQ ID NO: 3561315 - RNA, 15 nt, Pseudomonas putida KT2440
ugcacugggcgaugg

SEQ ID NO: 3561316 - RNA, 13 nt, Pseudomonas putida KT2440
ugcacuguugcug

SEQ ID NO: 3561317 - RNA, 14 nt, Pseudomonas putida KT2440
ugcacuuccacacc

SEQ ID NO: 3561318 - RNA, 21 nt, Pseudomonas putida KT2440
ugcacuucgauacccagccag

SEQ ID NO: 3561319 - RNA, 19 nt, Pseudomonas putida KT2440
ugcacuuucgcggcccagc

SEQ ID NO: 3561320 - RNA, 20 nt, Pseudomonas putida KT2440
ugcacuuucgcggcccagcc

SEQ ID NO: 3561321 - RNA, 15 nt, Pseudomonas putida KT2440
ugcagaaacgccauc

SEQ ID NO: 3561322 - RNA, 17 nt, Pseudomonas putida KT2440
ugcagaaccgccagcac

SEQ ID NO: 3561323 - RNA, 18 nt, Pseudomonas putida KT2440
ugcagaaccgccagcacc

SEQ ID NO: 3561324 - RNA, 19 nt, Pseudomonas putida KT2440
ugcagaaccgccagcacca

SEQ ID NO: 3561325 - RNA, 17 nt, Pseudomonas putida KT2440
ugcagaacguacuggcc

SEQ ID NO: 3561326 - RNA, 22 nt, Pseudomonas putida KT2440
ugcagaacguacuggccgcuga

SEQ ID NO: 3561327 - RNA, 14 nt, Pseudomonas putida KT2440
ugcagacgaucagg

SEQ ID NO: 3561328 - RNA, 16 nt, Pseudomonas putida KT2440
ugcagagcucagcgug

SEQ ID NO: 3561329 - RNA, 16 nt, Pseudomonas putida KT2440
ugcagauccaggugcc

SEQ ID NO: 3561330 - RNA, 15 nt, Pseudomonas putida KT2440
ugcagaugguccggc

SEQ ID NO: 3561331 - RNA, 23 nt, Pseudomonas putida KT2440
ugcagauugcccuguggcugugg

SEQ ID NO: 3561332 - RNA, 15 nt, Pseudomonas putida KT2440
ugcagcacaggucuc

SEQ ID NO: 3561333 - RNA, 14 nt, Pseudomonas putida KT2440
ugcagcaccgacug

SEQ ID NO: 3561334 - RNA, 13 nt, Pseudomonas putida KT2440
ugcagcaccucca

SEQ ID NO: 3561335 - RNA, 18 nt, Pseudomonas putida KT2440
ugcagcaccuccaccuuc

SEQ ID NO: 3561336 - RNA, 22 nt, Pseudomonas putida KT2440
ugcagcacggaaucacgcggcg

SEQ ID NO: 3561337 - RNA, 14 nt, Pseudomonas putida KT2440
ugcagcacugccug

SEQ ID NO: 3561338 - RNA, 15 nt, Pseudomonas putida KT2440
ugcagcacugccugc

SEQ ID NO: 3561339 - RNA, 13 nt, Pseudomonas putida KT2440
ugcagcacuucga

SEQ ID NO: 3561340 - RNA, 20 nt, Pseudomonas putida KT2440
ugcagcacuucgaucaggca

SEQ ID NO: 3561341 - RNA, 24 nt, Pseudomonas putida KT2440
ugcagcagcauuucuucgaccugc

SEQ ID NO: 3561342 - RNA, 15 nt, Pseudomonas putida KT2440
ugcagcagcgcgccg

SEQ ID NO: 3561343 - RNA, 17 nt, Pseudomonas putida KT2440
ugcagcaggccgcugag

SEQ ID NO: 3561344 - RNA, 19 nt, Pseudomonas putida KT2440
ugcagcaggccgcugagga

SEQ ID NO: 3561345 - RNA, 23 nt, Pseudomonas putida KT2440
ugcagcaggcuggcgggguggcc

SEQ ID NO: 3561346 - RNA, 18 nt, Pseudomonas putida KT2440
ugcagccaaccuucaggg

SEQ ID NO: 3561347 - RNA, 16 nt, Pseudomonas putida KT2440
ugcagccccaaugguu

SEQ ID NO: 3561348 - RNA, 20 nt, Pseudomonas putida KT2440
ugcagccccagccucagcug

SEQ ID NO: 3561349 - RNA, 21 nt, Pseudomonas putida KT2440
ugcagccccagccucagcugg

SEQ ID NO: 3561350 - RNA, 16 nt, Pseudomonas putida KT2440
ugcagcccuucgcagg

SEQ ID NO: 3561351 - RNA, 22 nt, Pseudomonas putida KT2440
ugcagcccuucgccggcacgcc

SEQ ID NO: 3561352 - RNA, 15 nt, Pseudomonas putida KT2440
ugcagccgcacccag

SEQ ID NO: 3561353 - RNA, 17 nt, Pseudomonas putida KT2440
ugcagccguugcugggc

SEQ ID NO: 3561354 - RNA, 15 nt, Pseudomonas putida KT2440
ugccacccaaggcau

SEQ ID NO: 3561355 - RNA, 19 nt, Pseudomonas putida KT2440
ugccacccaaggcauccag

SEQ ID NO: 3561356 - RNA, 14 nt, Pseudomonas putida KT2440
ugccacccagauca

SEQ ID NO: 3561357 - RNA, 22 nt, Pseudomonas putida KT2440
ugccacccagaucaucaucggc

SEQ ID NO: 3561358 - RNA, 17 nt, Pseudomonas putida KT2440
ugccacccaggcccuga

SEQ ID NO: 3561359 - RNA, 21 nt, Pseudomonas putida KT2440
ugccacccaggcccugacgcc

SEQ ID NO: 3561360 - RNA, 22 nt, Pseudomonas putida KT2440
ugccacccaggcccugacgcca

SEQ ID NO: 3561361 - RNA, 19 nt, Pseudomonas putida KT2440
ugccacccaugccacccau

SEQ ID NO: 3561362 - RNA, 20 nt, Pseudomonas putida KT2440
ugccacccaugccacccaua

SEQ ID NO: 3561363 - RNA, 20 nt, Pseudomonas putida KT2440
ugccacccauucccacauca

SEQ ID NO: 3561364 - RNA, 15 nt, Pseudomonas putida KT2440
ugccacccgaacaaa

SEQ ID NO: 3561365 - RNA, 16 nt, Pseudomonas putida KT2440
ugccaccggcgcugcg

SEQ ID NO: 3561366 - RNA, 18 nt, Pseudomonas putida KT2440
ugccaccuguugccgcuu

SEQ ID NO: 3561367 - RNA, 16 nt, Pseudomonas putida KT2440
ugccacgacaccggga

SEQ ID NO: 3561368 - RNA, 21 nt, Pseudomonas putida KT2440
ugccacgauggucacccgcga

SEQ ID NO: 3561369 - RNA, 21 nt, Pseudomonas putida KT2440
ugccacgcaccaccaagucga

SEQ ID NO: 3561370 - RNA, 16 nt, Pseudomonas putida KT2440
ugccacgcugaacacg

SEQ ID NO: 3561371 - RNA, 17 nt, Pseudomonas putida KT2440
ugccacggccuucuuca

SEQ ID NO: 3561372 - RNA, 18 nt, Pseudomonas putida KT2440
ugccacggccuucuucac

SEQ ID NO: 3561373 - RNA, 19 nt, Pseudomonas putida KT2440
ugccacguuuucgcggccc

SEQ ID NO: 3561374 - RNA, 14 nt, Pseudomonas putida KT2440
ugccacucagcggg

SEQ ID NO: 3561375 - RNA, 16 nt, Pseudomonas putida KT2440
ugccacucaggcgcaa

SEQ ID NO: 3561376 - RNA, 20 nt, Pseudomonas putida KT2440
ugccacucuucaccaugggc

SEQ ID NO: 3561377 - RNA, 14 nt, Pseudomonas putida KT2440
ugccacuucaccca

SEQ ID NO: 3561378 - RNA, 16 nt, Pseudomonas putida KT2440
ugccacuucacccaau

SEQ ID NO: 3561379 - RNA, 17 nt, Pseudomonas putida KT2440
ugccagagaauuucucc

SEQ ID NO: 3561380 - RNA, 23 nt, Pseudomonas putida KT2440
ugccagaugaaguagaacuggcg

SEQ ID NO: 3561381 - RNA, 14 nt, Pseudomonas putida KT2440
ugccagcaaaugcc

SEQ ID NO: 3561382 - RNA, 21 nt, Pseudomonas putida KT2440
ugccagcaaaugcccacugcg

SEQ ID NO: 3561383 - RNA, 16 nt, Pseudomonas putida KT2440
ugccagcaacaagcug

SEQ ID NO: 3561384 - RNA, 13 nt, Pseudomonas putida KT2440
ugccagcaccagc

SEQ ID NO: 3561385 - RNA, 14 nt, Pseudomonas putida KT2440
ugccagcaccagcg

SEQ ID NO: 3561386 - RNA, 17 nt, Pseudomonas putida KT2440
ugccagcaccagcgcga

SEQ ID NO: 3561387 - RNA, 16 nt, Pseudomonas putida KT2440
ugccagcagcuggcuu

SEQ ID NO: 3561388 - RNA, 15 nt, Pseudomonas putida KT2440
ugccagcagggcagg

SEQ ID NO: 3561389 - RNA, 17 nt, Pseudomonas putida KT2440
ugccagcauggugcagg

SEQ ID NO: 3561390 - RNA, 13 nt, Pseudomonas putida KT2440
ugccagccuucga

SEQ ID NO: 3561391 - RNA, 21 nt, Pseudomonas putida KT2440
ugccagcgccaaucgcaugcu

SEQ ID NO: 3561392 - RNA, 15 nt, Pseudomonas putida KT2440
ugccagcgccucacc

SEQ ID NO: 3561393 - RNA, 17 nt, Pseudomonas putida KT2440
ugccagcgcgcugcgca

SEQ ID NO: 3561394 - RNA, 22 nt, Pseudomonas putida KT2440
ugccagcgcgcugcgcaaggac

SEQ ID NO: 3561395 - RNA, 15 nt, Pseudomonas putida KT2440
ugccagcggccacuu

SEQ ID NO: 3561396 - RNA, 18 nt, Pseudomonas putida KT2440
ugccagcguguuccauca

SEQ ID NO: 3561397 - RNA, 19 nt, Pseudomonas putida KT2440
ugccagcuaucucccagcc

SEQ ID NO: 3561398 - RNA, 18 nt, Pseudomonas putida KT2440
ugccagcugcgcugccug

SEQ ID NO: 3561399 - RNA, 19 nt, Pseudomonas putida KT2440
ugccagcugcgcugccugc

SEQ ID NO: 3561400 - RNA, 14 nt, Pseudomonas putida KT2440
ugccaggcucaggc

SEQ ID NO: 3561401 - RNA, 16 nt, Pseudomonas putida KT2440
ugccaggcucaggccu

SEQ ID NO: 3561402 - RNA, 21 nt, Pseudomonas putida KT2440
ugccaggcuggcgcuaccccu

SEQ ID NO: 3561403 - RNA, 18 nt, Pseudomonas putida KT2440
ugccagggugccagacca

SEQ ID NO: 3561404 - RNA, 20 nt, Pseudomonas putida KT2440
ugccaggugauaguccagca

SEQ ID NO: 3561405 - RNA, 18 nt, Pseudomonas putida KT2440
ugccagguguuugggcuu

SEQ ID NO: 3561406 - RNA, 14 nt, Pseudomonas putida KT2440
ugccaguaaggcuu

SEQ ID NO: 3561407 - RNA, 15 nt, Pseudomonas putida KT2440
ugccaguaaggcuug

SEQ ID NO: 3561408 - RNA, 14 nt, Pseudomonas putida KT2440
ugccaguccuuggc

SEQ ID NO: 3561409 - RNA, 20 nt, Pseudomonas putida KT2440
ugccaguccuuggccaaugc

SEQ ID NO: 3561410 - RNA, 16 nt, Pseudomonas putida KT2440
ugccagucgcacaggu

SEQ ID NO: 3561411 - RNA, 16 nt, Pseudomonas putida KT2440
ugccaguucaugcagc

SEQ ID NO: 3561412 - RNA, 21 nt, Pseudomonas putida KT2440
ugccaguugaucaccgucguc

SEQ ID NO: 3561413 - RNA, 15 nt, Pseudomonas putida KT2440
ugccaguugcuucug

SEQ ID NO: 3561414 - RNA, 23 nt, Pseudomonas putida KT2440
ugccaguugcuucugcagauccu

SEQ ID NO: 3561415 - RNA, 14 nt, Pseudomonas putida KT2440
ugccauacagccag

SEQ ID NO: 3561416 - RNA, 17 nt, Pseudomonas putida KT2440
ugccauagcaccagcgg

SEQ ID NO: 3561417 - RNA, 15 nt, Pseudomonas putida KT2440
ugccauagcgcugca

SEQ ID NO: 3561418 - RNA, 18 nt, Pseudomonas putida KT2440
ugccauagcgcugcaccg

SEQ ID NO: 3561419 - RNA, 14 nt, Pseudomonas putida KT2440
ugccauccaccgcg

SEQ ID NO: 3561420 - RNA, 16 nt, Pseudomonas putida KT2440
ugccauccaccggauc

SEQ ID NO: 3561421 - RNA, 16 nt, Pseudomonas putida KT2440
ugccauccgguaugcc

SEQ ID NO: 3561422 - RNA, 17 nt, Pseudomonas putida KT2440
ugccauccucggccagg

SEQ ID NO: 3561423 - RNA, 18 nt, Pseudomonas putida KT2440
ugccauccucggccaggc

SEQ ID NO: 3561424 - RNA, 22 nt, Pseudomonas putida KT2440
ugccaucgauauggaucccacg

SEQ ID NO: 3561425 - RNA, 22 nt, Pseudomonas putida KT2440
ugccaucgccucggcacugcac

SEQ ID NO: 3561426 - RNA, 13 nt, Pseudomonas putida KT2440
ugccaucuccaau

SEQ ID NO: 3561427 - RNA, 15 nt, Pseudomonas putida KT2440
ugccaucuccaaugc

SEQ ID NO: 3561428 - RNA, 13 nt, Pseudomonas putida KT2440
ugccaucucgcca

SEQ ID NO: 3561429 - RNA, 17 nt, Pseudomonas putida KT2440
ugccaucucgccaagca

SEQ ID NO: 3561430 - RNA, 21 nt, Pseudomonas putida KT2440
ugccaucucgccaagcauucg

SEQ ID NO: 3561431 - RNA, 20 nt, Pseudomonas putida KT2440
ugccaugcaggucgacgaua

SEQ ID NO: 3561432 - RNA, 17 nt, Pseudomonas putida KT2440
ugccaugcgcugcagcg

SEQ ID NO: 3561433 - RNA, 22 nt, Pseudomonas putida KT2440
ugccauguaguugcgcacguug

SEQ ID NO: 3561434 - RNA, 20 nt, Pseudomonas putida KT2440
ugccauuggugccaccgaug

SEQ ID NO: 3561435 - RNA, 14 nt, Pseudomonas putida KT2440
ugccauuucuucag

SEQ ID NO: 3561436 - RNA, 17 nt, Pseudomonas putida KT2440
ugccauuucuucagcag

SEQ ID NO: 3561437 - RNA, 23 nt, Pseudomonas putida KT2440
ugccauuuuggauuuuuuguaga

SEQ ID NO: 3561438 - RNA, 14 nt, Pseudomonas putida KT2440
ugcccaaacgccaa

SEQ ID NO: 3561439 - RNA, 18 nt, Pseudomonas putida KT2440
ugcccaagcgcuccgcca

SEQ ID NO: 3561440 - RNA, 20 nt, Pseudomonas putida KT2440
ugcccaagcggcacuaccag

SEQ ID NO: 3561441 - RNA, 19 nt, Pseudomonas putida KT2440
ugcccaaguaguguucgcc

SEQ ID NO: 3561442 - RNA, 14 nt, Pseudomonas putida KT2440
ugcccaccagcgcu

SEQ ID NO: 3561443 - RNA, 14 nt, Pseudomonas putida KT2440
ugcccaccgcagau

SEQ ID NO: 3561444 - RNA, 20 nt, Pseudomonas putida KT2440
ugcccaccgcauugcaggcc

SEQ ID NO: 3561445 - RNA, 23 nt, Pseudomonas putida KT2440
ugcccaccgcugcaaucgagccg

SEQ ID NO: 3561446 - RNA, 24 nt, Pseudomonas putida KT2440
ugcccacugcguucaucgaacugc

SEQ ID NO: 3561447 - RNA, 13 nt, Pseudomonas putida KT2440
ugcccagaucacu

SEQ ID NO: 3561448 - RNA, 18 nt, Pseudomonas putida KT2440
ugcccagaucacuuccac

SEQ ID NO: 3561449 - RNA, 21 nt, Pseudomonas putida KT2440
ugcccagcgaauagcaacaca

SEQ ID NO: 3561450 - RNA, 18 nt, Pseudomonas putida KT2440
ugcccagcgccaccggca

SEQ ID NO: 3561451 - RNA, 19 nt, Pseudomonas putida KT2440
ugcccagcgccaccggcag

SEQ ID NO: 3561452 - RNA, 19 nt, Pseudomonas putida KT2440
ugcccagcgcgccggcguc

SEQ ID NO: 3561453 - RNA, 16 nt, Pseudomonas putida KT2440
ugcccagcuccagcac

SEQ ID NO: 3561454 - RNA, 15 nt, Pseudomonas putida KT2440
ugcccagcucgcugg

SEQ ID NO: 3561455 - RNA, 17 nt, Pseudomonas putida KT2440
ugcccagcugcgggaug

SEQ ID NO: 3561456 - RNA, 20 nt, Pseudomonas putida KT2440
ugcccaggaucacuggccug

SEQ ID NO: 3561457 - RNA, 17 nt, Pseudomonas putida KT2440
ugcccaggcccgacucc

SEQ ID NO: 3561458 - RNA, 16 nt, Pseudomonas putida KT2440
ugcccagggcugcuuc

SEQ ID NO: 3561459 - RNA, 19 nt, Pseudomonas putida KT2440
ugccgaagucauccauggc

SEQ ID NO: 3561460 - RNA, 14 nt, Pseudomonas putida KT2440
ugccgaauugaacu

SEQ ID NO: 3561461 - RNA, 21 nt, Pseudomonas putida KT2440
ugccgacgccgcuucucaaga

SEQ ID NO: 3561462 - RNA, 21 nt, Pseudomonas putida KT2440
ugccgacuccguguccguccg

SEQ ID NO: 3561463 - RNA, 14 nt, Pseudomonas putida KT2440
ugccgagaacagcu

SEQ ID NO: 3561464 - RNA, 15 nt, Pseudomonas putida KT2440
ugccgagcagcgcgu

SEQ ID NO: 3561465 - RNA, 16 nt, Pseudomonas putida KT2440
ugccgaggacauacca

SEQ ID NO: 3561466 - RNA, 23 nt, Pseudomonas putida KT2440
ugccgauagacaaaaaaaucggc

SEQ ID NO: 3561467 - RNA, 17 nt, Pseudomonas putida KT2440
ugccgaucaccgugccc

SEQ ID NO: 3561468 - RNA, 13 nt, Pseudomonas putida KT2440
ugccgaucagcac

SEQ ID NO: 3561469 - RNA, 23 nt, Pseudomonas putida KT2440
ugccgaucagguugcccagcaug

SEQ ID NO: 3561470 - RNA, 19 nt, Pseudomonas putida KT2440
ugccgaucuucgcccuggg

SEQ ID NO: 3561471 - RNA, 15 nt, Pseudomonas putida KT2440
ugccgaugaccugcg

SEQ ID NO: 3561472 - RNA, 16 nt, Pseudomonas putida KT2440
ugccgaugaccugcgu

SEQ ID NO: 3561473 - RNA, 18 nt, Pseudomonas putida KT2440
ugccgaugaccugcguca

SEQ ID NO: 3561474 - RNA, 21 nt, Pseudomonas putida KT2440
ugccgcaagcagucccagcac

SEQ ID NO: 3561475 - RNA, 14 nt, Pseudomonas putida KT2440
ugccgcaccugccu

SEQ ID NO: 3561476 - RNA, 18 nt, Pseudomonas putida KT2440
ugccgcaucagccggcuu

SEQ ID NO: 3561477 - RNA, 12 nt, Pseudomonas putida KT2440
ugccgcauggca

SEQ ID NO: 3561478 - RNA, 17 nt, Pseudomonas putida KT2440
ugccgcauucgcgggug

SEQ ID NO: 3561479 - RNA, 21 nt, Pseudomonas putida KT2440
ugccgccaacuguuucugcuc

SEQ ID NO: 3561480 - RNA, 17 nt, Pseudomonas putida KT2440
ugccgccaccuggcugc

SEQ ID NO: 3561481 - RNA, 23 nt, Pseudomonas putida KT2440
ugccgccaccuggcugcgggugc

SEQ ID NO: 3561482 - RNA, 14 nt, Pseudomonas putida KT2440
ugccgccagccccg

SEQ ID NO: 3561483 - RNA, 15 nt, Pseudomonas putida KT2440
ugccgccccgugccc

SEQ ID NO: 3561484 - RNA, 14 nt, Pseudomonas putida KT2440
ugccgccgcugcca

SEQ ID NO: 3561485 - RNA, 21 nt, Pseudomonas putida KT2440
ugccgccgguguaccauccag

SEQ ID NO: 3561486 - RNA, 13 nt, Pseudomonas putida KT2440
ugccgccuucucc

SEQ ID NO: 3561487 - RNA, 15 nt, Pseudomonas putida KT2440
ugccgccuucuccag

SEQ ID NO: 3561488 - RNA, 15 nt, Pseudomonas putida KT2440
ugccgccuuggcagc

SEQ ID NO: 3561489 - RNA, 16 nt, Pseudomonas putida KT2440
ugccgcgaauggguca

SEQ ID NO: 3561490 - RNA, 15 nt, Pseudomonas putida KT2440
ugccgcgcacuucgu

SEQ ID NO: 3561491 - RNA, 14 nt, Pseudomonas putida KT2440
ugccgcgccagcuc

SEQ ID NO: 3561492 - RNA, 16 nt, Pseudomonas putida KT2440
ugccgcgccagcuccg

SEQ ID NO: 3561493 - RNA, 13 nt, Pseudomonas putida KT2440
ugccgcgcgcccg

SEQ ID NO: 3561494 - RNA, 14 nt, Pseudomonas putida KT2440
ugccgcucaucgag

SEQ ID NO: 3561495 - RNA, 15 nt, Pseudomonas putida KT2440
ugccgcugcgcggua

SEQ ID NO: 3561496 - RNA, 17 nt, Pseudomonas putida KT2440
ugccgcuucgcggaacu

SEQ ID NO: 3561497 - RNA, 21 nt, Pseudomonas putida KT2440
ugccgcuucgcggaacucggc

SEQ ID NO: 3561498 - RNA, 15 nt, Pseudomonas putida KT2440
ugccgcuucguccag

SEQ ID NO: 3561499 - RNA, 19 nt, Pseudomonas putida KT2440
ugccgcuucguccagguag

SEQ ID NO: 3561500 - RNA, 13 nt, Pseudomonas putida KT2440
ugccgcuuuggca

SEQ ID NO: 3561501 - RNA, 20 nt, Pseudomonas putida KT2440
ugccgcuuuggcagcagccu

SEQ ID NO: 3561502 - RNA, 22 nt, Pseudomonas putida KT2440
ugccggaaaacugcgugucaag

SEQ ID NO: 3561503 - RNA, 16 nt, Pseudomonas putida KT2440
ugccggaacaaccccu

SEQ ID NO: 3561504 - RNA, 16 nt, Pseudomonas putida KT2440
ugccggaagaucaggc

SEQ ID NO: 3561505 - RNA, 23 nt, Pseudomonas putida KT2440
ugccggacucacccgcaccucac

SEQ ID NO: 3561506 - RNA, 21 nt, Pseudomonas putida KT2440
ugccggaguggaagauggucu

SEQ ID NO: 3561507 - RNA, 20 nt, Pseudomonas putida KT2440
ugccggcaacgauacccacg

SEQ ID NO: 3561508 - RNA, 18 nt, Pseudomonas putida KT2440
ugccggcaauaccggcca

SEQ ID NO: 3561509 - RNA, 21 nt, Pseudomonas putida KT2440
ugccggcaauaccggccacgc

SEQ ID NO: 3561510 - RNA, 13 nt, Pseudomonas putida KT2440
ugccggcacagcc

SEQ ID NO: 3561511 - RNA, 14 nt, Pseudomonas putida KT2440
ugccggcagcgagc

SEQ ID NO: 3561512 - RNA, 14 nt, Pseudomonas putida KT2440
ugccggccaaucga

SEQ ID NO: 3561513 - RNA, 15 nt, Pseudomonas putida KT2440
ugccggccagcgccu

SEQ ID NO: 3561514 - RNA, 22 nt, Pseudomonas putida KT2440
ugccggccagcgccugcaggcc

SEQ ID NO: 3561515 - RNA, 16 nt, Pseudomonas putida KT2440
ugccggccagcggcau

SEQ ID NO: 3561516 - RNA, 21 nt, Pseudomonas putida KT2440
ugccggcccaaggcaccaacu

SEQ ID NO: 3561517 - RNA, 20 nt, Pseudomonas putida KT2440
ugccggccucaauuccaguc

SEQ ID NO: 3561518 - RNA, 18 nt, Pseudomonas putida KT2440
ugccggccucuucgcggg

SEQ ID NO: 3561519 - RNA, 23 nt, Pseudomonas putida KT2440
ugccggccucuucgcgggcaagc

SEQ ID NO: 3561520 - RNA, 19 nt, Pseudomonas putida KT2440
ugccggccucuucgcgggu

SEQ ID NO: 3561521 - RNA, 22 nt, Pseudomonas putida KT2440
ugccggcgccuccagcaacauc

SEQ ID NO: 3561522 - RNA, 22 nt, Pseudomonas putida KT2440
ugccggcuggacaccucccgcg

SEQ ID NO: 3561523 - RNA, 17 nt, Pseudomonas putida KT2440
ugccgggcaaagcgggu

SEQ ID NO: 3561524 - RNA, 13 nt, Pseudomonas putida KT2440
ugccgggccaggg

SEQ ID NO: 3561525 - RNA, 17 nt, Pseudomonas putida KT2440
ugccggggcaugcgcag

SEQ ID NO: 3561526 - RNA, 21 nt, Pseudomonas putida KT2440
ugccggggcugcuuugcagcc

SEQ ID NO: 3561527 - RNA, 22 nt, Pseudomonas putida KT2440
ugccgggucaaggccagcgccu

SEQ ID NO: 3561528 - RNA, 17 nt, Pseudomonas putida KT2440
ugccgguaccgccacca

SEQ ID NO: 3561529 - RNA, 14 nt, Pseudomonas putida KT2440
ugccggucacuggc

SEQ ID NO: 3561530 - RNA, 16 nt, Pseudomonas putida KT2440
ugccggucagcagcau

SEQ ID NO: 3561531 - RNA, 19 nt, Pseudomonas putida KT2440
ugccggucggcguccacug

SEQ ID NO: 3561532 - RNA, 17 nt, Pseudomonas putida KT2440
ugccggucgggcaaggc

SEQ ID NO: 3561533 - RNA, 20 nt, Pseudomonas putida KT2440
ugccgguuugauaacgaauc

SEQ ID NO: 3561534 - RNA, 17 nt, Pseudomonas putida KT2440
ugccgguuugcggccuu

SEQ ID NO: 3561535 - RNA, 13 nt, Pseudomonas putida KT2440
ugccgucagaaag

SEQ ID NO: 3561536 - RNA, 16 nt, Pseudomonas putida KT2440
ugccguccaacgggcg

SEQ ID NO: 3561537 - RNA, 19 nt, Pseudomonas putida KT2440
ugccguccagguccaggcc

SEQ ID NO: 3561538 - RNA, 18 nt, Pseudomonas putida KT2440
ugccgucgagcaggucga

SEQ ID NO: 3561539 - RNA, 16 nt, Pseudomonas putida KT2440
ugccgucgggcacgau

SEQ ID NO: 3561540 - RNA, 21 nt, Pseudomonas putida KT2440
ugccgucucgucacuggcugc

SEQ ID NO: 3561541 - RNA, 23 nt, Pseudomonas putida KT2440
ugccgucucgucacuggcugcug

SEQ ID NO: 3561542 - RNA, 15 nt, Pseudomonas putida KT2440
ugccgugaguggccu

SEQ ID NO: 3561543 - RNA, 14 nt, Pseudomonas putida KT2440
ugccgugcgcggca

SEQ ID NO: 3561544 - RNA, 20 nt, Pseudomonas putida KT2440
ugccgugcgcggcaucagcu

SEQ ID NO: 3561545 - RNA, 15 nt, Pseudomonas putida KT2440
ugccgugcucgucca

SEQ ID NO: 3561546 - RNA, 17 nt, Pseudomonas putida KT2440
ugccgugcucguccuug

SEQ ID NO: 3561547 - RNA, 15 nt, Pseudomonas putida KT2440
ugccguggcaggcag

SEQ ID NO: 3561548 - RNA, 20 nt, Pseudomonas putida KT2440
ugccguggcaggcaguucga

SEQ ID NO: 3561549 - RNA, 16 nt, Pseudomonas putida KT2440
ugccgugguucaucac

SEQ ID NO: 3561550 - RNA, 23 nt, Pseudomonas putida KT2440
ugccguuccucaagcggccucga

SEQ ID NO: 3561551 - RNA, 15 nt, Pseudomonas putida KT2440
ugccguuugcuggcc

SEQ ID NO: 3561552 - RNA, 21 nt, Pseudomonas putida KT2440
ugccguuuucgguaaucaccu

SEQ ID NO: 3561553 - RNA, 22 nt, Pseudomonas putida KT2440
ugccguuuucgguaaucaccuu

SEQ ID NO: 3561554 - RNA, 20 nt, Pseudomonas putida KT2440
ugccuaccaccgcauccgca

SEQ ID NO: 3561555 - RNA, 17 nt, Pseudomonas putida KT2440
ugccuacccaggcaacg

SEQ ID NO: 3561556 - RNA, 14 nt, Pseudomonas putida KT2440
ugccuaucucuucc

SEQ ID NO: 3561557 - RNA, 15 nt, Pseudomonas putida KT2440
ugccuaucucuucca

SEQ ID NO: 3561558 - RNA, 17 nt, Pseudomonas putida KT2440
ugccuaucucuuccagc

SEQ ID NO: 3561559 - RNA, 14 nt, Pseudomonas putida KT2440
ugccucacgcaugc

SEQ ID NO: 3561560 - RNA, 14 nt, Pseudomonas putida KT2440
ugccucagccaggc

SEQ ID NO: 3561561 - RNA, 12 nt, Pseudomonas putida KT2440
ugccucagggau

SEQ ID NO: 3561562 - RNA, 14 nt, Pseudomonas putida KT2440
ugccucaucaccuc

SEQ ID NO: 3561563 - RNA, 16 nt, Pseudomonas putida KT2440
ugccucaucaggccga

SEQ ID NO: 3561564 - RNA, 20 nt, Pseudomonas putida KT2440
ugcgcauaucccucgcggau

SEQ ID NO: 3561565 - RNA, 20 nt, Pseudomonas putida KT2440
ugcgcaucaacguucccaau

SEQ ID NO: 3561566 - RNA, 15 nt, Pseudomonas putida KT2440
ugcgcaucaccucga

SEQ ID NO: 3561567 - RNA, 17 nt, Pseudomonas putida KT2440
ugcgcaugaaacucgcg

SEQ ID NO: 3561568 - RNA, 18 nt, Pseudomonas putida KT2440
ugcgcaugcaacggcaca

SEQ ID NO: 3561569 - RNA, 17 nt, Pseudomonas putida KT2440
ugcgcauggccgccaca

SEQ ID NO: 3561570 - RNA, 18 nt, Pseudomonas putida KT2440
ugcgcauggccgccacau

SEQ ID NO: 3561571 - RNA, 19 nt, Pseudomonas putida KT2440
ugcgccaaagcgagcaugg

SEQ ID NO: 3561572 - RNA, 16 nt, Pseudomonas putida KT2440
ugcgccacacccgcua

SEQ ID NO: 3561573 - RNA, 18 nt, Pseudomonas putida KT2440
ugcgccaccgacuccggc

SEQ ID NO: 3561574 - RNA, 15 nt, Pseudomonas putida KT2440
ugcgccagccgcuca

SEQ ID NO: 3561575 - RNA, 17 nt, Pseudomonas putida KT2440
ugcgccagccgcucagc

SEQ ID NO: 3561576 - RNA, 22 nt, Pseudomonas putida KT2440
ugcgccaggaucaacugccgcg

SEQ ID NO: 3561577 - RNA, 17 nt, Pseudomonas putida KT2440
ugcgccaggauggcuuu

SEQ ID NO: 3561578 - RNA, 12 nt, Pseudomonas putida KT2440
ugcgccaggcau

SEQ ID NO: 3561579 - RNA, 19 nt, Pseudomonas putida KT2440
ugcgccaggcauugcucga

SEQ ID NO: 3561580 - RNA, 18 nt, Pseudomonas putida KT2440
ugcgccaguacgccagca

SEQ ID NO: 3561581 - RNA, 21 nt, Pseudomonas putida KT2440
ugcgccaguacgccagcagcg

SEQ ID NO: 3561582 - RNA, 20 nt, Pseudomonas putida KT2440
ugcgccaucagaggcgaugg

SEQ ID NO: 3561583 - RNA, 17 nt, Pseudomonas putida KT2440
ugcgcccaaugcagccg

SEQ ID NO: 3561584 - RNA, 21 nt, Pseudomonas putida KT2440
ugcgcccaguagcgccaccau

SEQ ID NO: 3561585 - RNA, 22 nt, Pseudomonas putida KT2440
ugcgcccaguagcgccaccauc

SEQ ID NO: 3561586 - RNA, 15 nt, Pseudomonas putida KT2440
ugcgccccccaggcg

SEQ ID NO: 3561587 - RNA, 20 nt, Pseudomonas putida KT2440
ugcgccccccaggcggugag

SEQ ID NO: 3561588 - RNA, 14 nt, Pseudomonas putida KT2440
ugcgccccgcucgc

SEQ ID NO: 3561589 - RNA, 18 nt, Pseudomonas putida KT2440
ugcgccccgcucgccugg

SEQ ID NO: 3561590 - RNA, 15 nt, Pseudomonas putida KT2440
ugcgccccucaucaa

SEQ ID NO: 3561591 - RNA, 14 nt, Pseudomonas putida KT2440
ugcgcccgaucacc

SEQ ID NO: 3561592 - RNA, 17 nt, Pseudomonas putida KT2440
ugcgcccgcacagcacg

SEQ ID NO: 3561593 - RNA, 18 nt, Pseudomonas putida KT2440
ugcgcccgcacagcacgu

SEQ ID NO: 3561594 - RNA, 23 nt, Pseudomonas putida KT2440
ugcgcccgcacagcacguucagc

SEQ ID NO: 3561595 - RNA, 12 nt, Pseudomonas putida KT2440
ugcgcccggcaa

SEQ ID NO: 3561596 - RNA, 14 nt, Pseudomonas putida KT2440
ugcgcccugcugcc

SEQ ID NO: 3561597 - RNA, 15 nt, Pseudomonas putida KT2440
ugcgcccuggcggcc

SEQ ID NO: 3561598 - RNA, 15 nt, Pseudomonas putida KT2440
ugcgcccuucgcgga

SEQ ID NO: 3561599 - RNA, 17 nt, Pseudomonas putida KT2440
ugcgcccuucgcggaag

SEQ ID NO: 3561600 - RNA, 21 nt, Pseudomonas putida KT2440
ugcgccgaucaggaaggccuu

SEQ ID NO: 3561601 - RNA, 15 nt, Pseudomonas putida KT2440
ugcgccgcaccaaag

SEQ ID NO: 3561602 - RNA, 15 nt, Pseudomonas putida KT2440
ugcgccgcgcgggcg

SEQ ID NO: 3561603 - RNA, 18 nt, Pseudomonas putida KT2440
ugcgccgcucgcccagca

SEQ ID NO: 3561604 - RNA, 21 nt, Pseudomonas putida KT2440
ugcgccgcucgcccagcagcc

SEQ ID NO: 3561605 - RNA, 21 nt, Pseudomonas putida KT2440
ugcgccgcucugcccgcgcca

SEQ ID NO: 3561606 - RNA, 23 nt, Pseudomonas putida KT2440
ugcgccgggacagcaccaugcgc

SEQ ID NO: 3561607 - RNA, 23 nt, Pseudomonas putida KT2440
ugcgccggucgcguucuuucucc

SEQ ID NO: 3561608 - RNA, 14 nt, Pseudomonas putida KT2440
ugcgccguggccgc

SEQ ID NO: 3561609 - RNA, 15 nt, Pseudomonas putida KT2440
ugcgccguggccgcc

SEQ ID NO: 3561610 - RNA, 18 nt, Pseudomonas putida KT2440
ugcgccuaucaggccuuc

SEQ ID NO: 3561611 - RNA, 14 nt, Pseudomonas putida KT2440
ugcgccuccagcag

SEQ ID NO: 3561612 - RNA, 15 nt, Pseudomonas putida KT2440
ugcgccuccagcagc

SEQ ID NO: 3561613 - RNA, 17 nt, Pseudomonas putida KT2440
ugcgccucgcagguaau

SEQ ID NO: 3561614 - RNA, 15 nt, Pseudomonas putida KT2440
ugcgccugaacagca

SEQ ID NO: 3561615 - RNA, 17 nt, Pseudomonas putida KT2440
ugcgccugaacagcauc

SEQ ID NO: 3561616 - RNA, 21 nt, Pseudomonas putida KT2440
ugcgccugaacagcaucagcc

SEQ ID NO: 3561617 - RNA, 23 nt, Pseudomonas putida KT2440
ugcgccugcaguucgcugcgcaa

SEQ ID NO: 3561618 - RNA, 13 nt, Pseudomonas putida KT2440
ugcgccugccggg

SEQ ID NO: 3561619 - RNA, 22 nt, Pseudomonas putida KT2440
ugcgccugcugguacagccggc

SEQ ID NO: 3561620 - RNA, 21 nt, Pseudomonas putida KT2440
ugcgccuugcuuggcagcggc

SEQ ID NO: 3561621 - RNA, 23 nt, Pseudomonas putida KT2440
ugcgcgaaguggauauccagcga

SEQ ID NO: 3561622 - RNA, 19 nt, Pseudomonas putida KT2440
ugcgcgacagcaucaucag

SEQ ID NO: 3561623 - RNA, 23 nt, Pseudomonas putida KT2440
ugcgcgacagcaucaucaggccg

SEQ ID NO: 3561624 - RNA, 15 nt, Pseudomonas putida KT2440
ugcgcgagaaugcug

SEQ ID NO: 3561625 - RNA, 17 nt, Pseudomonas putida KT2440
ugcgcgagccaauuuca

SEQ ID NO: 3561626 - RNA, 12 nt, Pseudomonas putida KT2440
ugcgcgauagcc

SEQ ID NO: 3561627 - RNA, 13 nt, Pseudomonas putida KT2440
ugcgcgaucagcg

SEQ ID NO: 3561628 - RNA, 13 nt, Pseudomonas putida KT2440
ugcgcgcaacagu

SEQ ID NO: 3561629 - RNA, 17 nt, Pseudomonas putida KT2440
ugcgcgcaacagugccc

SEQ ID NO: 3561630 - RNA, 13 nt, Pseudomonas putida KT2440
ugcgcgccagcgg

SEQ ID NO: 3561631 - RNA, 14 nt, Pseudomonas putida KT2440
ugcgcgccauggcg

SEQ ID NO: 3561632 - RNA, 20 nt, Pseudomonas putida KT2440
ugcgcgccuugcgccaggug

SEQ ID NO: 3561633 - RNA, 17 nt, Pseudomonas putida KT2440
ugcgcgcgggcucugug

SEQ ID NO: 3561634 - RNA, 19 nt, Pseudomonas putida KT2440
ugcgcgcuugaagggggcu

SEQ ID NO: 3561635 - RNA, 15 nt, Pseudomonas putida KT2440
ugcgcggcaccggcu

SEQ ID NO: 3561636 - RNA, 19 nt, Pseudomonas putida KT2440
ugcgcggcucgcugcgcug

SEQ ID NO: 3561637 - RNA, 21 nt, Pseudomonas putida KT2440
ugcgcggggugaucgccucgu

SEQ ID NO: 3561638 - RNA, 19 nt, Pseudomonas putida KT2440
ugcgcgggucauccaggaa

SEQ ID NO: 3561639 - RNA, 18 nt, Pseudomonas putida KT2440
ugcgcggguucugguugc

SEQ ID NO: 3561640 - RNA, 13 nt, Pseudomonas putida KT2440
ugcgcgguaaacg

SEQ ID NO: 3561641 - RNA, 20 nt, Pseudomonas putida KT2440
ugcgcgguaaacgggaaguc

SEQ ID NO: 3561642 - RNA, 19 nt, Pseudomonas putida KT2440
ugcgcgguaaugaccugga

SEQ ID NO: 3561643 - RNA, 14 nt, Pseudomonas putida KT2440
ugcgcggucgaugc

SEQ ID NO: 3561644 - RNA, 21 nt, Pseudomonas putida KT2440
ugcgcgucucuuucaggcaca

SEQ ID NO: 3561645 - RNA, 19 nt, Pseudomonas putida KT2440
ugcgcuacgacccaccgac

SEQ ID NO: 3561646 - RNA, 16 nt, Pseudomonas putida KT2440
ugcgcucaaccagccg

SEQ ID NO: 3561647 - RNA, 14 nt, Pseudomonas putida KT2440
ugcgcuccugguca

SEQ ID NO: 3561648 - RNA, 21 nt, Pseudomonas putida KT2440
ugcgcuccuggucaucgaagc

SEQ ID NO: 3561649 - RNA, 12 nt, Pseudomonas putida KT2440
ugcgcucgacgc

SEQ ID NO: 3561650 - RNA, 17 nt, Pseudomonas putida KT2440
ugcgcucgagcccgcca

SEQ ID NO: 3561651 - RNA, 14 nt, Pseudomonas putida KT2440
ugcgcucgcugccg

SEQ ID NO: 3561652 - RNA, 16 nt, Pseudomonas putida KT2440
ugcgcucgcugccggc

SEQ ID NO: 3561653 - RNA, 19 nt, Pseudomonas putida KT2440
ugcgcucgucgaacucgcg

SEQ ID NO: 3561654 - RNA, 22 nt, Pseudomonas putida KT2440
ugcgcugaucgaaagcugcgca

SEQ ID NO: 3561655 - RNA, 20 nt, Pseudomonas putida KT2440
ugcgcugaucgugcaccguc

SEQ ID NO: 3561656 - RNA, 19 nt, Pseudomonas putida KT2440
ugcgcugauucaacgcccc

SEQ ID NO: 3561657 - RNA, 21 nt, Pseudomonas putida KT2440
ugcgcugcagcgucgccucgg

SEQ ID NO: 3561658 - RNA, 14 nt, Pseudomonas putida KT2440
ugcgcugcauggcg

SEQ ID NO: 3561659 - RNA, 20 nt, Pseudomonas putida KT2440
ugcgcugcauggcggcaccg

SEQ ID NO: 3561660 - RNA, 14 nt, Pseudomonas putida KT2440
ugcgcugccugcug

SEQ ID NO: 3561661 - RNA, 16 nt, Pseudomonas putida KT2440
ugcgcugccugcuggc

SEQ ID NO: 3561662 - RNA, 16 nt, Pseudomonas putida KT2440
ugcgcugcugguacau

SEQ ID NO: 3561663 - RNA, 22 nt, Pseudomonas putida KT2440
ugcgcuggaauuauuggccagc

SEQ ID NO: 3561664 - RNA, 23 nt, Pseudomonas putida KT2440
ugcgcuggccaauggcaaucccc

SEQ ID NO: 3561665 - RNA, 12 nt, Pseudomonas putida KT2440
ugcgcuggccac

SEQ ID NO: 3561666 - RNA, 12 nt, Pseudomonas putida KT2440
ugcgcuggcccu

SEQ ID NO: 3561667 - RNA, 11 nt, Pseudomonas putida KT2440
ugcgcugggca

SEQ ID NO: 3561668 - RNA, 19 nt, Pseudomonas putida KT2440
ugcgcuucaaauagaagaa

SEQ ID NO: 3561669 - RNA, 12 nt, Pseudomonas putida KT2440
ugcucaccgcca

SEQ ID NO: 3561670 - RNA, 15 nt, Pseudomonas putida KT2440
ugcucacugaccacc

SEQ ID NO: 3561671 - RNA, 22 nt, Pseudomonas putida KT2440
ugcucaggaucacgucacccag

SEQ ID NO: 3561672 - RNA, 15 nt, Pseudomonas putida KT2440
ugcucaggcgggcag

SEQ ID NO: 3561673 - RNA, 13 nt, Pseudomonas putida KT2440
ugcucaggcucag

SEQ ID NO: 3561674 - RNA, 15 nt, Pseudomonas putida KT2440
ugcucaggcucagcu

SEQ ID NO: 3561675 - RNA, 20 nt, Pseudomonas putida KT2440
ugcucagugcuggcguguug

SEQ ID NO: 3561676 - RNA, 14 nt, Pseudomonas putida KT2440
ugcucauacugcug

SEQ ID NO: 3561677 - RNA, 18 nt, Pseudomonas putida KT2440
ugcucauccacaccuucg

SEQ ID NO: 3561678 - RNA, 15 nt, Pseudomonas putida KT2440
ugcucauccagcaaa

SEQ ID NO: 3561679 - RNA, 19 nt, Pseudomonas putida KT2440
ugcucaucggcggcuucca

SEQ ID NO: 3561680 - RNA, 18 nt, Pseudomonas putida KT2440
ugcucaugauccagucag

SEQ ID NO: 3561681 - RNA, 23 nt, Pseudomonas putida KT2440
ugcucaugauccagucagacucc

SEQ ID NO: 3561682 - RNA, 15 nt, Pseudomonas putida KT2440
ugcuccaaccccagc

SEQ ID NO: 3561683 - RNA, 17 nt, Pseudomonas putida KT2440
ugcuccaaccccagcgc

SEQ ID NO: 3561684 - RNA, 14 nt, Pseudomonas putida KT2440
ugcuccaccaggcc

SEQ ID NO: 3561685 - RNA, 14 nt, Pseudomonas putida KT2440
ugcuccaccugcca

SEQ ID NO: 3561686 - RNA, 15 nt, Pseudomonas putida KT2440
ugcuccaccugccac

SEQ ID NO: 3561687 - RNA, 13 nt, Pseudomonas putida KT2440
ugcuccagcaccu

SEQ ID NO: 3561688 - RNA, 12 nt, Pseudomonas putida KT2440
ugcuccagcgug

SEQ ID NO: 3561689 - RNA, 19 nt, Pseudomonas putida KT2440
ugcuccagcucacagcacu

SEQ ID NO: 3561690 - RNA, 21 nt, Pseudomonas putida KT2440
ugcuccagcucacagcacucg

SEQ ID NO: 3561691 - RNA, 12 nt, Pseudomonas putida KT2440
ugcuccagcucc

SEQ ID NO: 3561692 - RNA, 13 nt, Pseudomonas putida KT2440
ugcuccagcucca

SEQ ID NO: 3561693 - RNA, 18 nt, Pseudomonas putida KT2440
ugcuccagcuccaggcga

SEQ ID NO: 3561694 - RNA, 14 nt, Pseudomonas putida KT2440
ugcuccagcugcuc

SEQ ID NO: 3561695 - RNA, 21 nt, Pseudomonas putida KT2440
ugcuccaggccugcggcagcc

SEQ ID NO: 3561696 - RNA, 19 nt, Pseudomonas putida KT2440
ugcuccaugggcaggccca

SEQ ID NO: 3561697 - RNA, 21 nt, Pseudomonas putida KT2440
ugcuccaugguagauaagagu

SEQ ID NO: 3561698 - RNA, 21 nt, Pseudomonas putida KT2440
ugcuccccaaccaccucccca

SEQ ID NO: 3561699 - RNA, 16 nt, Pseudomonas putida KT2440
ugcucgaaugccgcug

SEQ ID NO: 3561700 - RNA, 22 nt, Pseudomonas putida KT2440
ugcucgacaagccgcugggcuu

SEQ ID NO: 3561701 - RNA, 13 nt, Pseudomonas putida KT2440
ugcucgaggaagc

SEQ ID NO: 3561702 - RNA, 22 nt, Pseudomonas putida KT2440
ugcucgaucagguugagcaccg

SEQ ID NO: 3561703 - RNA, 22 nt, Pseudomonas putida KT2440
ugcucgccaucgccccgcgccg

SEQ ID NO: 3561704 - RNA, 17 nt, Pseudomonas putida KT2440
ugcucgccucacagcgc

SEQ ID NO: 3561705 - RNA, 13 nt, Pseudomonas putida KT2440
ugcucgccugcuu

SEQ ID NO: 3561706 - RNA, 22 nt, Pseudomonas putida KT2440
ugcucgcgggccuggagcaagg

SEQ ID NO: 3561707 - RNA, 15 nt, Pseudomonas putida KT2440
ugcucgcucaggcuc

SEQ ID NO: 3561708 - RNA, 18 nt, Pseudomonas putida KT2440
ugcucgcucaggcucuug

SEQ ID NO: 3561709 - RNA, 16 nt, Pseudomonas putida KT2440
ugcucgcuggcuuguu

SEQ ID NO: 3561710 - RNA, 22 nt, Pseudomonas putida KT2440
ugcucggcaacggccgugcgcc

SEQ ID NO: 3561711 - RNA, 13 nt, Pseudomonas putida KT2440
ugcucggccagcc

SEQ ID NO: 3561712 - RNA, 13 nt, Pseudomonas putida KT2440
ugcucggccagcu

SEQ ID NO: 3561713 - RNA, 14 nt, Pseudomonas putida KT2440
ugcucggccagcuc

SEQ ID NO: 3561714 - RNA, 12 nt, Pseudomonas putida KT2440
ugcucggccugg

SEQ ID NO: 3561715 - RNA, 17 nt, Pseudomonas putida KT2440
ugcucggcguacuccag

SEQ ID NO: 3561716 - RNA, 18 nt, Pseudomonas putida KT2440
ugcucgggguuggugcca

SEQ ID NO: 3561717 - RNA, 18 nt, Pseudomonas putida KT2440
ugcucggugcugcugcca

SEQ ID NO: 3561718 - RNA, 14 nt, Pseudomonas putida KT2440
ugcucgucaccauc

SEQ ID NO: 3561719 - RNA, 16 nt, Pseudomonas putida KT2440
ugcucguccaucaccg

SEQ ID NO: 3561720 - RNA, 18 nt, Pseudomonas putida KT2440
ugcucguccaucaccgcc

SEQ ID NO: 3561721 - RNA, 22 nt, Pseudomonas putida KT2440
ugcucgucguccucgaacucau

SEQ ID NO: 3561722 - RNA, 17 nt, Pseudomonas putida KT2440
ugcucgucucuggccgc

SEQ ID NO: 3561723 - RNA, 22 nt, Pseudomonas putida KT2440
ugcucguguuagcugggcuuga

SEQ ID NO: 3561724 - RNA, 17 nt, Pseudomonas putida KT2440
ugcucguugcugagcaa

SEQ ID NO: 3561725 - RNA, 14 nt, Pseudomonas putida KT2440
ugcucuaccaacug

SEQ ID NO: 3561726 - RNA, 14 nt, Pseudomonas putida KT2440
ugcucugcaaugcc

SEQ ID NO: 3561727 - RNA, 15 nt, Pseudomonas putida KT2440
ugcucugcaaugccg

SEQ ID NO: 3561728 - RNA, 23 nt, Pseudomonas putida KT2440
ugcucugcagcagcgcgccgaac

SEQ ID NO: 3561729 - RNA, 15 nt, Pseudomonas putida KT2440
ugcucugccgccgca

SEQ ID NO: 3561730 - RNA, 12 nt, Pseudomonas putida KT2440
ugcucuggcccg

SEQ ID NO: 3561731 - RNA, 17 nt, Pseudomonas putida KT2440
ugcucuggcugagcgca

SEQ ID NO: 3561732 - RNA, 20 nt, Pseudomonas putida KT2440
ugcucuucgaguuuggccag

SEQ ID NO: 3561733 - RNA, 22 nt, Pseudomonas putida KT2440
ugcucuucgaguuuggccagcc

SEQ ID NO: 3561734 - RNA, 15 nt, Pseudomonas putida KT2440
ugcucuuguuccgcc

SEQ ID NO: 3561735 - RNA, 21 nt, Pseudomonas putida KT2440
ugcugaaccugaccuugcugc

SEQ ID NO: 3561736 - RNA, 19 nt, Pseudomonas putida KT2440
ugcugaagcucuccagcag

SEQ ID NO: 3561737 - RNA, 20 nt, Pseudomonas putida KT2440
ugcugaagcucuccagcagg

SEQ ID NO: 3561738 - RNA, 14 nt, Pseudomonas putida KT2440
ugcugaccaccgug

SEQ ID NO: 3561739 - RNA, 16 nt, Pseudomonas putida KT2440
ugcugaccaccgugcu

SEQ ID NO: 3561740 - RNA, 15 nt, Pseudomonas putida KT2440
ugcugaccucgaccc

SEQ ID NO: 3561741 - RNA, 15 nt, Pseudomonas putida KT2440
ugcugacgcagggua

SEQ ID NO: 3561742 - RNA, 16 nt, Pseudomonas putida KT2440
ugcugagcaagcgcgc

SEQ ID NO: 3561743 - RNA, 16 nt, Pseudomonas putida KT2440
ugcugagcuugacuuc

SEQ ID NO: 3561744 - RNA, 15 nt, Pseudomonas putida KT2440
ugcugagucagcuug

SEQ ID NO: 3561745 - RNA, 17 nt, Pseudomonas putida KT2440
ugcugagucagcuugug

SEQ ID NO: 3561746 - RNA, 15 nt, Pseudomonas putida KT2440
ugcugaguccgccac

SEQ ID NO: 3561747 - RNA, 15 nt, Pseudomonas putida KT2440
ugcugaucagguugc

SEQ ID NO: 3561748 - RNA, 19 nt, Pseudomonas putida KT2440
ugcugaugcccaaacgcca

SEQ ID NO: 3561749 - RNA, 14 nt, Pseudomonas putida KT2440
ugcugauguuggcc

SEQ ID NO: 3561750 - RNA, 19 nt, Pseudomonas putida KT2440
ugcugauguuggccaucac

SEQ ID NO: 3561751 - RNA, 22 nt, Pseudomonas putida KT2440
ugcugcaacagcucauccaggc

SEQ ID NO: 3561752 - RNA, 15 nt, Pseudomonas putida KT2440
ugcugcaacagcucc

SEQ ID NO: 3561753 - RNA, 20 nt, Pseudomonas putida KT2440
ugcugcaacagcuccagcaa

SEQ ID NO: 3561754 - RNA, 22 nt, Pseudomonas putida KT2440
ugcugcagaaccgccagcacca

SEQ ID NO: 3561755 - RNA, 14 nt, Pseudomonas putida KT2440
ugcugcagauugca

SEQ ID NO: 3561756 - RNA, 16 nt, Pseudomonas putida KT2440
ugcugcagcacugccu

SEQ ID NO: 3561757 - RNA, 19 nt, Pseudomonas putida KT2440
ugcugcaggcucugaaugu

SEQ ID NO: 3561758 - RNA, 22 nt, Pseudomonas putida KT2440
ugcugcagggcacgccaaucac

SEQ ID NO: 3561759 - RNA, 17 nt, Pseudomonas putida KT2440
ugcugcagggcccagcc

SEQ ID NO: 3561760 - RNA, 18 nt, Pseudomonas putida KT2440
ugcugcagggcccagcca

SEQ ID NO: 3561761 - RNA, 20 nt, Pseudomonas putida KT2440
ugcugcauacgcaccaacug

SEQ ID NO: 3561762 - RNA, 14 nt, Pseudomonas putida KT2440
ugcugccccaugcg

SEQ ID NO: 3561763 - RNA, 13 nt, Pseudomonas putida KT2440
ugcugcccgcgug

SEQ ID NO: 3561764 - RNA, 23 nt, Pseudomonas putida KT2440
ugcugcccguugcgcaucaccuc

SEQ ID NO: 3561765 - RNA, 13 nt, Pseudomonas putida KT2440
ugcugccgaggcg

SEQ ID NO: 3561766 - RNA, 21 nt, Pseudomonas putida KT2440
ugcugccgcccucuugcugca

SEQ ID NO: 3561767 - RNA, 20 nt, Pseudomonas putida KT2440
ugcugccuccgccaagcacg

SEQ ID NO: 3561768 - RNA, 14 nt, Pseudomonas putida KT2440
ugcugccugugccg

SEQ ID NO: 3561769 - RNA, 15 nt, Pseudomonas putida KT2440
ugcugccugugccgg

SEQ ID NO: 3561770 - RNA, 20 nt, Pseudomonas putida KT2440
ugcugccuuuuccugcugca

SEQ ID NO: 3561771 - RNA, 23 nt, Pseudomonas putida KT2440
ugcugcgaguucaggcgcccugc

SEQ ID NO: 3561772 - RNA, 17 nt, Pseudomonas putida KT2440
ugcugcgcagcccuguc

SEQ ID NO: 3561773 - RNA, 15 nt, Pseudomonas putida KT2440
ugcugcgccaggauc

SEQ ID NO: 3561774 - RNA, 18 nt, Pseudomonas putida KT2440
ugcugcgccucgcaggua

SEQ ID NO: 3561775 - RNA, 20 nt, Pseudomonas putida KT2440
uggagaucgucguaggagcg

SEQ ID NO: 3561776 - RNA, 15 nt, Pseudomonas putida KT2440
uggagauuggccagc

SEQ ID NO: 3561777 - RNA, 19 nt, Pseudomonas putida KT2440
uggagauuggccagcaggg

SEQ ID NO: 3561778 - RNA, 17 nt, Pseudomonas putida KT2440
uggagcaaggcguuguc

SEQ ID NO: 3561779 - RNA, 17 nt, Pseudomonas putida KT2440
uggagcgggcguuggcg

SEQ ID NO: 3561780 - RNA, 21 nt, Pseudomonas putida KT2440
uggagcugaaacugaucagcu

SEQ ID NO: 3561781 - RNA, 22 nt, Pseudomonas putida KT2440
uggaggagggcugcaucacuug

SEQ ID NO: 3561782 - RNA, 20 nt, Pseudomonas putida KT2440
uggaggucaugugauaccug

SEQ ID NO: 3561783 - RNA, 18 nt, Pseudomonas putida KT2440
uggaguacgggcacaccu

SEQ ID NO: 3561784 - RNA, 17 nt, Pseudomonas putida KT2440
uggauacugcccgucag

SEQ ID NO: 3561785 - RNA, 13 nt, Pseudomonas putida KT2440
uggauagagcauc

SEQ ID NO: 3561786 - RNA, 16 nt, Pseudomonas putida KT2440
uggaucacugccagca

SEQ ID NO: 3561787 - RNA, 11 nt, Pseudomonas putida KT2440
uggaucagccg

SEQ ID NO: 3561788 - RNA, 13 nt, Pseudomonas putida KT2440
uggaucagcucau

SEQ ID NO: 3561789 - RNA, 14 nt, Pseudomonas putida KT2440
uggaucggcgugcg

SEQ ID NO: 3561790 - RNA, 23 nt, Pseudomonas putida KT2440
uggaucggcgugcggcuggcuuc

SEQ ID NO: 3561791 - RNA, 16 nt, Pseudomonas putida KT2440
uggaugacgccgcagc

SEQ ID NO: 3561792 - RNA, 21 nt, Pseudomonas putida KT2440
uggaugacgccgcagccgggc

SEQ ID NO: 3561793 - RNA, 17 nt, Pseudomonas putida KT2440
uggaugaucggcuggcc

SEQ ID NO: 3561794 - RNA, 17 nt, Pseudomonas putida KT2440
uggcaaacaugaaaccg

SEQ ID NO: 3561795 - RNA, 15 nt, Pseudomonas putida KT2440
uggcaaagcgcagca

SEQ ID NO: 3561796 - RNA, 17 nt, Pseudomonas putida KT2440
uggcaaagcgcagcaau

SEQ ID NO: 3561797 - RNA, 22 nt, Pseudomonas putida KT2440
uggcaaagcugaauucgaagug

SEQ ID NO: 3561798 - RNA, 21 nt, Pseudomonas putida KT2440
uggcaaaucgaaaaugcagau

SEQ ID NO: 3561799 - RNA, 20 nt, Pseudomonas putida KT2440
uggcaacccgccuccugaag

SEQ ID NO: 3561800 - RNA, 13 nt, Pseudomonas putida KT2440
uggcaacgccaca

SEQ ID NO: 3561801 - RNA, 14 nt, Pseudomonas putida KT2440
uggcaagccgagca

SEQ ID NO: 3561802 - RNA, 13 nt, Pseudomonas putida KT2440
uggcaagggcgga

SEQ ID NO: 3561803 - RNA, 23 nt, Pseudomonas putida KT2440
uggcaaucacgaacagccagaug

SEQ ID NO: 3561804 - RNA, 17 nt, Pseudomonas putida KT2440
uggcaaucagcucuucg

SEQ ID NO: 3561805 - RNA, 15 nt, Pseudomonas putida KT2440
uggcaaucgggccgg

SEQ ID NO: 3561806 - RNA, 16 nt, Pseudomonas putida KT2440
uggcaaucuucuugcc

SEQ ID NO: 3561807 - RNA, 18 nt, Pseudomonas putida KT2440
uggcaaugcaacucggcg

SEQ ID NO: 3561808 - RNA, 20 nt, Pseudomonas putida KT2440
uggcaauuggcuuccaggug

SEQ ID NO: 3561809 - RNA, 16 nt, Pseudomonas putida KT2440
uggcacaccaugggca

SEQ ID NO: 3561810 - RNA, 14 nt, Pseudomonas putida KT2440
uggcacagaacaau

SEQ ID NO: 3561811 - RNA, 23 nt, Pseudomonas putida KT2440
uggcacagaacaauaaaacuacc

SEQ ID NO: 3561812 - RNA, 23 nt, Pseudomonas putida KT2440
uggcaccaccagggcgcgcuggc

SEQ ID NO: 3561813 - RNA, 21 nt, Pseudomonas putida KT2440
uggcaccagauucaagcccgg

SEQ ID NO: 3561814 - RNA, 15 nt, Pseudomonas putida KT2440
uggcacccacagcgc

SEQ ID NO: 3561815 - RNA, 18 nt, Pseudomonas putida KT2440
uggcacccacgcgcuugg

SEQ ID NO: 3561816 - RNA, 17 nt, Pseudomonas putida KT2440
uggcacccaucacgacg

SEQ ID NO: 3561817 - RNA, 13 nt, Pseudomonas putida KT2440
uggcaccccagcc

SEQ ID NO: 3561818 - RNA, 17 nt, Pseudomonas putida KT2440
uggcaccccagccgcuc

SEQ ID NO: 3561819 - RNA, 17 nt, Pseudomonas putida KT2440
uggcacccucaccaacu

SEQ ID NO: 3561820 - RNA, 22 nt, Pseudomonas putida KT2440
uggcacccucaccaacugccug

SEQ ID NO: 3561821 - RNA, 20 nt, Pseudomonas putida KT2440
uggcaccgaucaccugggcg

SEQ ID NO: 3561822 - RNA, 11 nt, Pseudomonas putida KT2440
uggcaccgccg

SEQ ID NO: 3561823 - RNA, 16 nt, Pseudomonas putida KT2440
uggcaccggcagcagc

SEQ ID NO: 3561824 - RNA, 17 nt, Pseudomonas putida KT2440
uggcaccggcagcagca

SEQ ID NO: 3561825 - RNA, 19 nt, Pseudomonas putida KT2440
uggcaccggcagcagcaau

SEQ ID NO: 3561826 - RNA, 23 nt, Pseudomonas putida KT2440
uggcaccggcgaagacggcagau

SEQ ID NO: 3561827 - RNA, 18 nt, Pseudomonas putida KT2440
uggcaccggcuucgccgg

SEQ ID NO: 3561828 - RNA, 15 nt, Pseudomonas putida KT2440
uggcaccggcuuugc

SEQ ID NO: 3561829 - RNA, 17 nt, Pseudomonas putida KT2440
uggcaccuaucgcugcc

SEQ ID NO: 3561830 - RNA, 18 nt, Pseudomonas putida KT2440
uggcaccuaucgcugccg

SEQ ID NO: 3561831 - RNA, 16 nt, Pseudomonas putida KT2440
uggcacgcccggcacc

SEQ ID NO: 3561832 - RNA, 19 nt, Pseudomonas putida KT2440
uggcacgccuucagcagcc

SEQ ID NO: 3561833 - RNA, 18 nt, Pseudomonas putida KT2440
uggcacgcucgcgcagga

SEQ ID NO: 3561834 - RNA, 14 nt, Pseudomonas putida KT2440
uggcacgcuggcug

SEQ ID NO: 3561835 - RNA, 16 nt, Pseudomonas putida KT2440
uggcacguugcugccu

SEQ ID NO: 3561836 - RNA, 20 nt, Pseudomonas putida KT2440
uggcacguugcugccugugc

SEQ ID NO: 3561837 - RNA, 18 nt, Pseudomonas putida KT2440
uggcacucucgcggugcc

SEQ ID NO: 3561838 - RNA, 16 nt, Pseudomonas putida KT2440
uggcagcaaucggcag

SEQ ID NO: 3561839 - RNA, 21 nt, Pseudomonas putida KT2440
uggcagcaaucggcagcgcgc

SEQ ID NO: 3561840 - RNA, 17 nt, Pseudomonas putida KT2440
uggcagcaccgcugcca

SEQ ID NO: 3561841 - RNA, 16 nt, Pseudomonas putida KT2440
uggcagcacgaucagc

SEQ ID NO: 3561842 - RNA, 17 nt, Pseudomonas putida KT2440
uggcagcacgaucagcg

SEQ ID NO: 3561843 - RNA, 20 nt, Pseudomonas putida KT2440
uggcagcacgaucagcgcgg

SEQ ID NO: 3561844 - RNA, 11 nt, Pseudomonas putida KT2440
uggcagcagcc

SEQ ID NO: 3561845 - RNA, 15 nt, Pseudomonas putida KT2440
uggcagccggcgccg

SEQ ID NO: 3561846 - RNA, 14 nt, Pseudomonas putida KT2440
uggcagccucgucc

SEQ ID NO: 3561847 - RNA, 17 nt, Pseudomonas putida KT2440
uggcagcggcuuggccg

SEQ ID NO: 3561848 - RNA, 15 nt, Pseudomonas putida KT2440
uggcagcgggcugcc

SEQ ID NO: 3561849 - RNA, 23 nt, Pseudomonas putida KT2440
uggcagcgggcugcccggugccg

SEQ ID NO: 3561850 - RNA, 17 nt, Pseudomonas putida KT2440
uggcagcuacgagacgg

SEQ ID NO: 3561851 - RNA, 17 nt, Pseudomonas putida KT2440
uggcagcucugcgacug

SEQ ID NO: 3561852 - RNA, 18 nt, Pseudomonas putida KT2440
uggcagcucugcgacuga

SEQ ID NO: 3561853 - RNA, 13 nt, Pseudomonas putida KT2440
uggcagcugcagu

SEQ ID NO: 3561854 - RNA, 22 nt, Pseudomonas putida KT2440
uggcagcugcagugcugggcau

SEQ ID NO: 3561855 - RNA, 22 nt, Pseudomonas putida KT2440
uggcaggcaguucgagcgccug

SEQ ID NO: 3561856 - RNA, 21 nt, Pseudomonas putida KT2440
uggcagguaaaaaucaugcag

SEQ ID NO: 3561857 - RNA, 22 nt, Pseudomonas putida KT2440
uggcaggugaucguugcgcgcc

SEQ ID NO: 3561858 - RNA, 20 nt, Pseudomonas putida KT2440
uggcagguucgaccacugca

SEQ ID NO: 3561859 - RNA, 14 nt, Pseudomonas putida KT2440
uggcagugaugccg

SEQ ID NO: 3561860 - RNA, 21 nt, Pseudomonas putida KT2440
uggcaucaaugcaauguuuuc

SEQ ID NO: 3561861 - RNA, 15 nt, Pseudomonas putida KT2440
uggcauccaccaggu

SEQ ID NO: 3561862 - RNA, 17 nt, Pseudomonas putida KT2440
uggcauccggcagcuca

SEQ ID NO: 3561863 - RNA, 12 nt, Pseudomonas putida KT2440
uggcaucugcug

SEQ ID NO: 3561864 - RNA, 10 nt, Pseudomonas putida KT2440
uggcaugccc

SEQ ID NO: 3561865 - RNA, 16 nt, Pseudomonas putida KT2440
uggcaugcgacgcggc

SEQ ID NO: 3561866 - RNA, 20 nt, Pseudomonas putida KT2440
uggcaugucgcuuugggggg

SEQ ID NO: 3561867 - RNA, 21 nt, Pseudomonas putida KT2440
uggccaacuccccacccaggu

SEQ ID NO: 3561868 - RNA, 22 nt, Pseudomonas putida KT2440
uggccaagaaucucccgggcca

SEQ ID NO: 3561869 - RNA, 18 nt, Pseudomonas putida KT2440
uggccaagccaccgccac

SEQ ID NO: 3561870 - RNA, 21 nt, Pseudomonas putida KT2440
uggccaaggccucuaccgcug

SEQ ID NO: 3561871 - RNA, 23 nt, Pseudomonas putida KT2440
uggccaaggguuugccaggcgca

SEQ ID NO: 3561872 - RNA, 17 nt, Pseudomonas putida KT2440
uggccaauaccgcugca

SEQ ID NO: 3561873 - RNA, 19 nt, Pseudomonas putida KT2440
uggccaauuucuacccgcc

SEQ ID NO: 3561874 - RNA, 18 nt, Pseudomonas putida KT2440
uggccacacgcugcugcu

SEQ ID NO: 3561875 - RNA, 14 nt, Pseudomonas putida KT2440
uggccaccaccauc

SEQ ID NO: 3561876 - RNA, 18 nt, Pseudomonas putida KT2440
uggccaccagcaccugca

SEQ ID NO: 3561877 - RNA, 20 nt, Pseudomonas putida KT2440
uggccaccagcaccugcagg

SEQ ID NO: 3561878 - RNA, 23 nt, Pseudomonas putida KT2440
uggccaccagcaccugcagguac

SEQ ID NO: 3561879 - RNA, 17 nt, Pseudomonas putida KT2440
uggccaccagcauggcg

SEQ ID NO: 3561880 - RNA, 20 nt, Pseudomonas putida KT2440
uggccuguaccgaccucuuc

SEQ ID NO: 3561881 - RNA, 12 nt, Pseudomonas putida KT2440
uggccuuccagc

SEQ ID NO: 3561882 - RNA, 18 nt, Pseudomonas putida KT2440
uggccuuccuugcccagc

SEQ ID NO: 3561883 - RNA, 13 nt, Pseudomonas putida KT2440
uggccuucucuuc

SEQ ID NO: 3561884 - RNA, 22 nt, Pseudomonas putida KT2440
uggccuucucuuccgccagcca

SEQ ID NO: 3561885 - RNA, 23 nt, Pseudomonas putida KT2440
uggccuuggacaccaggcuggug

SEQ ID NO: 3561886 - RNA, 16 nt, Pseudomonas putida KT2440
uggccuuggcgugcac

SEQ ID NO: 3561887 - RNA, 15 nt, Pseudomonas putida KT2440
uggccuuucugcuuc

SEQ ID NO: 3561888 - RNA, 18 nt, Pseudomonas putida KT2440
uggcgaacacuuggcagc

SEQ ID NO: 3561889 - RNA, 23 nt, Pseudomonas putida KT2440
uggcgaagaccgccgcccagguc

SEQ ID NO: 3561890 - RNA, 18 nt, Pseudomonas putida KT2440
uggcgaaggcugccuggc

SEQ ID NO: 3561891 - RNA, 18 nt, Pseudomonas putida KT2440
uggcgaagucggccuggg

SEQ ID NO: 3561892 - RNA, 19 nt, Pseudomonas putida KT2440
uggcgacacuugguccagg

SEQ ID NO: 3561893 - RNA, 14 nt, Pseudomonas putida KT2440
uggcgacagcccau

SEQ ID NO: 3561894 - RNA, 22 nt, Pseudomonas putida KT2440
uggcgacagcccauagcgccau

SEQ ID NO: 3561895 - RNA, 14 nt, Pseudomonas putida KT2440
uggcgaccggcgug

SEQ ID NO: 3561896 - RNA, 18 nt, Pseudomonas putida KT2440
uggcgacgcugcccagca

SEQ ID NO: 3561897 - RNA, 16 nt, Pseudomonas putida KT2440
uggcgacuucgugcgc

SEQ ID NO: 3561898 - RNA, 20 nt, Pseudomonas putida KT2440
uggcgagcaggcccgccccu

SEQ ID NO: 3561899 - RNA, 12 nt, Pseudomonas putida KT2440
uggcgagcaggu

SEQ ID NO: 3561900 - RNA, 15 nt, Pseudomonas putida KT2440
uggcgagcaggucau

SEQ ID NO: 3561901 - RNA, 18 nt, Pseudomonas putida KT2440
uggcgagcaggucaugca

SEQ ID NO: 3561902 - RNA, 13 nt, Pseudomonas putida KT2440
uggcgagcccggc

SEQ ID NO: 3561903 - RNA, 17 nt, Pseudomonas putida KT2440
uggcgaguagaagcuug

SEQ ID NO: 3561904 - RNA, 22 nt, Pseudomonas putida KT2440
uggcgaguagaagcuuggggcg

SEQ ID NO: 3561905 - RNA, 14 nt, Pseudomonas putida KT2440
uggcgagugccggg

SEQ ID NO: 3561906 - RNA, 20 nt, Pseudomonas putida KT2440
uggcgaucaggcaggccagc

SEQ ID NO: 3561907 - RNA, 22 nt, Pseudomonas putida KT2440
uggcgaucaggcaggccagcac

SEQ ID NO: 3561908 - RNA, 17 nt, Pseudomonas putida KT2440
uggcgauccacagcggg

SEQ ID NO: 3561909 - RNA, 18 nt, Pseudomonas putida KT2440
uggcgauccacagcgggu

SEQ ID NO: 3561910 - RNA, 13 nt, Pseudomonas putida KT2440
uggcgauccauuc

SEQ ID NO: 3561911 - RNA, 20 nt, Pseudomonas putida KT2440
uggcgaucccuguaggagcg

SEQ ID NO: 3561912 - RNA, 15 nt, Pseudomonas putida KT2440
uggcgaucggcuggu

SEQ ID NO: 3561913 - RNA, 23 nt, Pseudomonas putida KT2440
uggcgaucucugcuuccuugcgc

SEQ ID NO: 3561914 - RNA, 14 nt, Pseudomonas putida KT2440
uggcgaugaacugc

SEQ ID NO: 3561915 - RNA, 15 nt, Pseudomonas putida KT2440
uggcgaugaacugcc

SEQ ID NO: 3561916 - RNA, 12 nt, Pseudomonas putida KT2440
uggcgcaaaccc

SEQ ID NO: 3561917 - RNA, 22 nt, Pseudomonas putida KT2440
uggcgcaaauugcccggccagc

SEQ ID NO: 3561918 - RNA, 15 nt, Pseudomonas putida KT2440
uggcgcaagccgugc

SEQ ID NO: 3561919 - RNA, 19 nt, Pseudomonas putida KT2440
uggcgcaccgagcgcucgc

SEQ ID NO: 3561920 - RNA, 23 nt, Pseudomonas putida KT2440
uggcgcagagggucuugggucgc

SEQ ID NO: 3561921 - RNA, 22 nt, Pseudomonas putida KT2440
uggcgcagcaaggucgccgccg

SEQ ID NO: 3561922 - RNA, 15 nt, Pseudomonas putida KT2440
uggcgcagcaccgug

SEQ ID NO: 3561923 - RNA, 18 nt, Pseudomonas putida KT2440
uggcgcagcagguccagc

SEQ ID NO: 3561924 - RNA, 21 nt, Pseudomonas putida KT2440
uggcgcagcagguccagcucc

SEQ ID NO: 3561925 - RNA, 19 nt, Pseudomonas putida KT2440
uggcgcaggccgcuggccg

SEQ ID NO: 3561926 - RNA, 12 nt, Pseudomonas putida KT2440
uggcgcaggcug

SEQ ID NO: 3561927 - RNA, 19 nt, Pseudomonas putida KT2440
uggcgcagguacucuguca

SEQ ID NO: 3561928 - RNA, 16 nt, Pseudomonas putida KT2440
uggcgcaguucgucca

SEQ ID NO: 3561929 - RNA, 17 nt, Pseudomonas putida KT2440
uggcgcaguucguccag

SEQ ID NO: 3561930 - RNA, 18 nt, Pseudomonas putida KT2440
uggcgcaucuuccagcac

SEQ ID NO: 3561931 - RNA, 18 nt, Pseudomonas putida KT2440
uggcgcaugacuuccagg

SEQ ID NO: 3561932 - RNA, 16 nt, Pseudomonas putida KT2440
uggcgccagcgaugcu

SEQ ID NO: 3561933 - RNA, 19 nt, Pseudomonas putida KT2440
uggcgccauuggugcccuu

SEQ ID NO: 3561934 - RNA, 14 nt, Pseudomonas putida KT2440
uggcgcccuccauc

SEQ ID NO: 3561935 - RNA, 12 nt, Pseudomonas putida KT2440
uggcgccgaugu

SEQ ID NO: 3561936 - RNA, 15 nt, Pseudomonas putida KT2440
uggcgccgcccugga

SEQ ID NO: 3561937 - RNA, 18 nt, Pseudomonas putida KT2440
uggcgccggacuucuuca

SEQ ID NO: 3561938 - RNA, 19 nt, Pseudomonas putida KT2440
uggcgccggauuucuucca

SEQ ID NO: 3561939 - RNA, 14 nt, Pseudomonas putida KT2440
uggcgccugacacu

SEQ ID NO: 3561940 - RNA, 21 nt, Pseudomonas putida KT2440
uggcgccugacacuaggagug

SEQ ID NO: 3561941 - RNA, 21 nt, Pseudomonas putida KT2440
uggcgccuugauuaccagcgc

SEQ ID NO: 3561942 - RNA, 17 nt, Pseudomonas putida KT2440
uggcgcgaacagggccu

SEQ ID NO: 3561943 - RNA, 15 nt, Pseudomonas putida KT2440
uggcgcgaccaucac

SEQ ID NO: 3561944 - RNA, 14 nt, Pseudomonas putida KT2440
uggcgcgaucccug

SEQ ID NO: 3561945 - RNA, 21 nt, Pseudomonas putida KT2440
uggcgcgaucccugugggagc

SEQ ID NO: 3561946 - RNA, 16 nt, Pseudomonas putida KT2440
uggcgcgccaugcccc

SEQ ID NO: 3561947 - RNA, 19 nt, Pseudomonas putida KT2440
uggcgcgcugugcucagca

SEQ ID NO: 3561948 - RNA, 17 nt, Pseudomonas putida KT2440
uggcgcggcuggucgcc

SEQ ID NO: 3561949 - RNA, 22 nt, Pseudomonas putida KT2440
uggcgcuaccccuguaggagcg

SEQ ID NO: 3561950 - RNA, 14 nt, Pseudomonas putida KT2440
uggcgcucaauggc

SEQ ID NO: 3561951 - RNA, 14 nt, Pseudomonas putida KT2440
uggcgcuccaugua

SEQ ID NO: 3561952 - RNA, 16 nt, Pseudomonas putida KT2440
uggcgcuuccuggccu

SEQ ID NO: 3561953 - RNA, 18 nt, Pseudomonas putida KT2440
uggcgcuuucacuggcga

SEQ ID NO: 3561954 - RNA, 22 nt, Pseudomonas putida KT2440
uggcggaaugucggcguuaccc

SEQ ID NO: 3561955 - RNA, 13 nt, Pseudomonas putida KT2440
uggcggagccagc

SEQ ID NO: 3561956 - RNA, 22 nt, Pseudomonas putida KT2440
uggcggagccagccacagacgg

SEQ ID NO: 3561957 - RNA, 16 nt, Pseudomonas putida KT2440
uggcggaucagcgcgu

SEQ ID NO: 3561958 - RNA, 14 nt, Pseudomonas putida KT2440
uggcggcagcaacg

SEQ ID NO: 3561959 - RNA, 21 nt, Pseudomonas putida KT2440
uggcggcauacaccaccggcc

SEQ ID NO: 3561960 - RNA, 22 nt, Pseudomonas putida KT2440
uggcggcauacaccaccggccg

SEQ ID NO: 3561961 - RNA, 15 nt, Pseudomonas putida KT2440
uggcggccaaugcug

SEQ ID NO: 3561962 - RNA, 13 nt, Pseudomonas putida KT2440
uggcggcccagcc

SEQ ID NO: 3561963 - RNA, 14 nt, Pseudomonas putida KT2440
uggcggcccagcca

SEQ ID NO: 3561964 - RNA, 16 nt, Pseudomonas putida KT2440
uggcggcccgccggca

SEQ ID NO: 3561965 - RNA, 17 nt, Pseudomonas putida KT2440
uggcggcccgccggcaa

SEQ ID NO: 3561966 - RNA, 16 nt, Pseudomonas putida KT2440
uggcggcugagccggc

SEQ ID NO: 3561967 - RNA, 18 nt, Pseudomonas putida KT2440
uggcgguauucacaccug

SEQ ID NO: 3561968 - RNA, 16 nt, Pseudomonas putida KT2440
uggcgguccaccgcca

SEQ ID NO: 3561969 - RNA, 17 nt, Pseudomonas putida KT2440
uggcgguugaccagggc

SEQ ID NO: 3561970 - RNA, 15 nt, Pseudomonas putida KT2440
uggcguaauccagcu

SEQ ID NO: 3561971 - RNA, 12 nt, Pseudomonas putida KT2440
uggcguaggccu

SEQ ID NO: 3561972 - RNA, 16 nt, Pseudomonas putida KT2440
uggcgucacagacaug

SEQ ID NO: 3561973 - RNA, 13 nt, Pseudomonas putida KT2440
uggcgucaggcgu

SEQ ID NO: 3561974 - RNA, 14 nt, Pseudomonas putida KT2440
uggcguccagcagu

SEQ ID NO: 3561975 - RNA, 18 nt, Pseudomonas putida KT2440
uggcguccagcagugcca

SEQ ID NO: 3561976 - RNA, 16 nt, Pseudomonas putida KT2440
uggcgucgacgaugau

SEQ ID NO: 3561977 - RNA, 22 nt, Pseudomonas putida KT2440
uggcgucgacucgaugccaucg

SEQ ID NO: 3561978 - RNA, 17 nt, Pseudomonas putida KT2440
uggcgucggcgauggcg

SEQ ID NO: 3561979 - RNA, 20 nt, Pseudomonas putida KT2440
uggcgucggcgauggcgucc

SEQ ID NO: 3561980 - RNA, 18 nt, Pseudomonas putida KT2440
uggcgucggucagcgagu

SEQ ID NO: 3561981 - RNA, 14 nt, Pseudomonas putida KT2440
uggcgucuucgcca

SEQ ID NO: 3561982 - RNA, 14 nt, Pseudomonas putida KT2440
uggcgugcaccugu

SEQ ID NO: 3561983 - RNA, 14 nt, Pseudomonas putida KT2440
uggcgugcccggca

SEQ ID NO: 3561984 - RNA, 19 nt, Pseudomonas putida KT2440
uggcgugcucgcgcaugau

SEQ ID NO: 3561985 - RNA, 15 nt, Pseudomonas putida KT2440
uggcguugagcuuga

SEQ ID NO: 3561986 - RNA, 15 nt, Pseudomonas putida KT2440
ugggccggcgcaggu

SEQ ID NO: 3561987 - RNA, 16 nt, Pseudomonas putida KT2440
ugggccggcgcccugc

SEQ ID NO: 3561988 - RNA, 13 nt, Pseudomonas putida KT2440
ugggccgugcagg

SEQ ID NO: 3561989 - RNA, 18 nt, Pseudomonas putida KT2440
ugggccgugcaggcggcg

SEQ ID NO: 3561990 - RNA, 13 nt, Pseudomonas putida KT2440
ugggccugcacga

SEQ ID NO: 3561991 - RNA, 12 nt, Pseudomonas putida KT2440
ugggccugugcc

SEQ ID NO: 3561992 - RNA, 14 nt, Pseudomonas putida KT2440
ugggccugugccgg

SEQ ID NO: 3561993 - RNA, 14 nt, Pseudomonas putida KT2440
ugggccuugcucaa

SEQ ID NO: 3561994 - RNA, 18 nt, Pseudomonas putida KT2440
ugggcgaacgccugcagg

SEQ ID NO: 3561995 - RNA, 23 nt, Pseudomonas putida KT2440
ugggcgaaguugaagcgccggua

SEQ ID NO: 3561996 - RNA, 19 nt, Pseudomonas putida KT2440
ugggcgagcaggugacccu

SEQ ID NO: 3561997 - RNA, 12 nt, Pseudomonas putida KT2440
ugggcgagccac

SEQ ID NO: 3561998 - RNA, 18 nt, Pseudomonas putida KT2440
ugggcgaugaucgagccg

SEQ ID NO: 3561999 - RNA, 19 nt, Pseudomonas putida KT2440
ugggcgaugaucgccuggc

SEQ ID NO: 3562000 - RNA, 21 nt, Pseudomonas putida KT2440
ugggcgaugaucgccuggccg

SEQ ID NO: 3562001 - RNA, 23 nt, Pseudomonas putida KT2440
ugggcgcaacaucgaucugguga

SEQ ID NO: 3562002 - RNA, 18 nt, Pseudomonas putida KT2440
ugggcgcagugccgugag

SEQ ID NO: 3562003 - RNA, 15 nt, Pseudomonas putida KT2440
ugggcgcuuugcacc

SEQ ID NO: 3562004 - RNA, 22 nt, Pseudomonas putida KT2440
ugggcggcgugaccagcccggc

SEQ ID NO: 3562005 - RNA, 18 nt, Pseudomonas putida KT2440
ugggcggggugaucgaca

SEQ ID NO: 3562006 - RNA, 19 nt, Pseudomonas putida KT2440
ugggcgguccuucaugccg

SEQ ID NO: 3562007 - RNA, 23 nt, Pseudomonas putida KT2440
ugggcucagccgccacaugcccg

SEQ ID NO: 3562008 - RNA, 13 nt, Pseudomonas putida KT2440
ugggcuccucaag

SEQ ID NO: 3562009 - RNA, 15 nt, Pseudomonas putida KT2440
ugggcugcaaagcag

SEQ ID NO: 3562010 - RNA, 18 nt, Pseudomonas putida KT2440
ugggcugcaaagcagccc

SEQ ID NO: 3562011 - RNA, 20 nt, Pseudomonas putida KT2440
ugggcugcaaagcagccccc

SEQ ID NO: 3562012 - RNA, 22 nt, Pseudomonas putida KT2440
ugggcugcgcggcagcccuucg

SEQ ID NO: 3562013 - RNA, 21 nt, Pseudomonas putida KT2440
ugggcuguuccagcagcgaca

SEQ ID NO: 3562014 - RNA, 15 nt, Pseudomonas putida KT2440
ugggcuuccccagcc

SEQ ID NO: 3562015 - RNA, 17 nt, Pseudomonas putida KT2440
ugggcuucgacaaccgg

SEQ ID NO: 3562016 - RNA, 15 nt, Pseudomonas putida KT2440
ugggcuuugggagca

SEQ ID NO: 3562017 - RNA, 23 nt, Pseudomonas putida KT2440
ugggcuuuucguuggccagcuug

SEQ ID NO: 3562018 - RNA, 16 nt, Pseudomonas putida KT2440
uggggcaacugcgcga

SEQ ID NO: 3562019 - RNA, 17 nt, Pseudomonas putida KT2440
uggggcaacugcgcgau

SEQ ID NO: 3562020 - RNA, 19 nt, Pseudomonas putida KT2440
uggggccgcuuugcggccc

SEQ ID NO: 3562021 - RNA, 21 nt, Pseudomonas putida KT2440
uggggccugccgguacagccu

SEQ ID NO: 3562022 - RNA, 12 nt, Pseudomonas putida KT2440
uggggcgauguu

SEQ ID NO: 3562023 - RNA, 13 nt, Pseudomonas putida KT2440
uggggcugacgcg

SEQ ID NO: 3562024 - RNA, 18 nt, Pseudomonas putida KT2440
uggggcugcaccgcagcc

SEQ ID NO: 3562025 - RNA, 22 nt, Pseudomonas putida KT2440
uggggcugcaccgcagccccag

SEQ ID NO: 3562026 - RNA, 19 nt, Pseudomonas putida KT2440
uggggcugcauugcagccc

SEQ ID NO: 3562027 - RNA, 18 nt, Pseudomonas putida KT2440
uggggcugcugcgcagcc

SEQ ID NO: 3562028 - RNA, 20 nt, Pseudomonas putida KT2440
ugggguccuguuugccgagg

SEQ ID NO: 3562029 - RNA, 20 nt, Pseudomonas putida KT2440
uggggucugcccggccagca

SEQ ID NO: 3562030 - RNA, 19 nt, Pseudomonas putida KT2440
uggggucugcuuugcagcc

SEQ ID NO: 3562031 - RNA, 13 nt, Pseudomonas putida KT2440
uggggugagcgaa

SEQ ID NO: 3562032 - RNA, 15 nt, Pseudomonas putida KT2440
uggggugagcggcuu

SEQ ID NO: 3562033 - RNA, 16 nt, Pseudomonas putida KT2440
ugggguuggacccagg

SEQ ID NO: 3562034 - RNA, 14 nt, Pseudomonas putida KT2440
uggguaacccugcu

SEQ ID NO: 3562035 - RNA, 21 nt, Pseudomonas putida KT2440
uggguaacccugcucgccauc

SEQ ID NO: 3562036 - RNA, 21 nt, Pseudomonas putida KT2440
uggguaaucaguaccaggccu

SEQ ID NO: 3562037 - RNA, 14 nt, Pseudomonas putida KT2440
ugggucaaccccag

SEQ ID NO: 3562038 - RNA, 13 nt, Pseudomonas putida KT2440
ugggucacccagg

SEQ ID NO: 3562039 - RNA, 14 nt, Pseudomonas putida KT2440
ugggucacccaggu

SEQ ID NO: 3562040 - RNA, 15 nt, Pseudomonas putida KT2440
ugggucacccaggug

SEQ ID NO: 3562041 - RNA, 15 nt, Pseudomonas putida KT2440
ugggucacggcaucc

SEQ ID NO: 3562042 - RNA, 23 nt, Pseudomonas putida KT2440
ugggucagcgcugacucagcggc

SEQ ID NO: 3562043 - RNA, 22 nt, Pseudomonas putida KT2440
ugggucagcugguucugcugca

SEQ ID NO: 3562044 - RNA, 13 nt, Pseudomonas putida KT2440
ugggucaggaugc

SEQ ID NO: 3562045 - RNA, 15 nt, Pseudomonas putida KT2440
ugggucaggaugccg

SEQ ID NO: 3562046 - RNA, 14 nt, Pseudomonas putida KT2440
ugggucaguuugac

SEQ ID NO: 3562047 - RNA, 16 nt, Pseudomonas putida KT2440
ugggugaccaccagca

SEQ ID NO: 3562048 - RNA, 14 nt, Pseudomonas putida KT2440
ugggugcacagguu

SEQ ID NO: 3562049 - RNA, 16 nt, Pseudomonas putida KT2440
ugggugccaucagggc

SEQ ID NO: 3562050 - RNA, 22 nt, Pseudomonas putida KT2440
ugggugccaucagggcgaugcg

SEQ ID NO: 3562051 - RNA, 16 nt, Pseudomonas putida KT2440
ugggugccgcggaugu

SEQ ID NO: 3562052 - RNA, 15 nt, Pseudomonas putida KT2440
ugggugcuguggcgc

SEQ ID NO: 3562053 - RNA, 15 nt, Pseudomonas putida KT2440
uggguggugucgcug

SEQ ID NO: 3562054 - RNA, 22 nt, Pseudomonas putida KT2440
ugggugugcgccgucaccagcg

SEQ ID NO: 3562055 - RNA, 23 nt, Pseudomonas putida KT2440
uggguugaucucuucggccaguu

SEQ ID NO: 3562056 - RNA, 19 nt, Pseudomonas putida KT2440
uggguugcucggcaccacc

SEQ ID NO: 3562057 - RNA, 12 nt, Pseudomonas putida KT2440
ugguaacucacc

SEQ ID NO: 3562058 - RNA, 14 nt, Pseudomonas putida KT2440
ugguaacuggccag

SEQ ID NO: 3562059 - RNA, 15 nt, Pseudomonas putida KT2440
ugguaauaccacauc

SEQ ID NO: 3562060 - RNA, 16 nt, Pseudomonas putida KT2440
ugguaauccucgguag

SEQ ID NO: 3562061 - RNA, 14 nt, Pseudomonas putida KT2440
ugguacaacaacaa

SEQ ID NO: 3562062 - RNA, 13 nt, Pseudomonas putida KT2440
ugguacacggcau

SEQ ID NO: 3562063 - RNA, 15 nt, Pseudomonas putida KT2440
ugguacagggucagg

SEQ ID NO: 3562064 - RNA, 16 nt, Pseudomonas putida KT2440
ugguagcgguggcguu

SEQ ID NO: 3562065 - RNA, 16 nt, Pseudomonas putida KT2440
ugguagggaaauccuc

SEQ ID NO: 3562066 - RNA, 16 nt, Pseudomonas putida KT2440
ugguaguuguccaccu

SEQ ID NO: 3562067 - RNA, 15 nt, Pseudomonas putida KT2440
ugguaucugccagca

SEQ ID NO: 3562068 - RNA, 16 nt, Pseudomonas putida KT2440
ugguaugauuucaggg

SEQ ID NO: 3562069 - RNA, 16 nt, Pseudomonas putida KT2440
ugguauugcccgacaa

SEQ ID NO: 3562070 - RNA, 16 nt, Pseudomonas putida KT2440
uggucacccugacgcu

SEQ ID NO: 3562071 - RNA, 21 nt, Pseudomonas putida KT2440
uggucacccugacgcugcacu

SEQ ID NO: 3562072 - RNA, 20 nt, Pseudomonas putida KT2440
uggucaccuuguccagcagg

SEQ ID NO: 3562073 - RNA, 15 nt, Pseudomonas putida KT2440
uggucacgccauccc

SEQ ID NO: 3562074 - RNA, 22 nt, Pseudomonas putida KT2440
uggucacgccauccccccagcc

SEQ ID NO: 3562075 - RNA, 14 nt, Pseudomonas putida KT2440
uggucacgcggccg

SEQ ID NO: 3562076 - RNA, 18 nt, Pseudomonas putida KT2440
uggucacgcucggccagu

SEQ ID NO: 3562077 - RNA, 17 nt, Pseudomonas putida KT2440
uggucagcgacugccaa

SEQ ID NO: 3562078 - RNA, 21 nt, Pseudomonas putida KT2440
uggucagcgcuucgcucauca

SEQ ID NO: 3562079 - RNA, 11 nt, Pseudomonas putida KT2440
uggucagcgga

SEQ ID NO: 3562080 - RNA, 16 nt, Pseudomonas putida KT2440
uggucagcggaccagg

SEQ ID NO: 3562081 - RNA, 18 nt, Pseudomonas putida KT2440
uggucagcggaccaggug

SEQ ID NO: 3562082 - RNA, 15 nt, Pseudomonas putida KT2440
uggucaggaucaccc

SEQ ID NO: 3562083 - RNA, 23 nt, Pseudomonas putida KT2440
uggucagucgagucgacagugac

SEQ ID NO: 3562084 - RNA, 21 nt, Pseudomonas putida KT2440
uggucaugccauccucggcca

SEQ ID NO: 3562085 - RNA, 19 nt, Pseudomonas putida KT2440
ugguccacgguucuggcag

SEQ ID NO: 3562086 - RNA, 20 nt, Pseudomonas putida KT2440
ugguccacgguucuggcagc

SEQ ID NO: 3562087 - RNA, 14 nt, Pseudomonas putida KT2440
ugguccagccacaa

SEQ ID NO: 3562088 - RNA, 21 nt, Pseudomonas putida KT2440
ugguccagcguucggccagca

SEQ ID NO: 3562089 - RNA, 19 nt, Pseudomonas putida KT2440
ugguccagcuucaccucau

SEQ ID NO: 3562090 - RNA, 17 nt, Pseudomonas putida KT2440
ugguccagggccauggc

SEQ ID NO: 3562091 - RNA, 18 nt, Pseudomonas putida KT2440
ugguccagggccauggcg

SEQ ID NO: 3562092 - RNA, 18 nt, Pseudomonas putida KT2440
uguagccgcuuucgguca

SEQ ID NO: 3562093 - RNA, 20 nt, Pseudomonas putida KT2440
uguagcgccuggccugcaga

SEQ ID NO: 3562094 - RNA, 19 nt, Pseudomonas putida KT2440
uguagcgcgguccggugau

SEQ ID NO: 3562095 - RNA, 20 nt, Pseudomonas putida KT2440
uguaggagcggguucacccg

SEQ ID NO: 3562096 - RNA, 23 nt, Pseudomonas putida KT2440
uguaggagcggguucacccgcga

SEQ ID NO: 3562097 - RNA, 20 nt, Pseudomonas putida KT2440
uguaggagcggguuuacccg

SEQ ID NO: 3562098 - RNA, 20 nt, Pseudomonas putida KT2440
uguaggaucggguuuacccg

SEQ ID NO: 3562099 - RNA, 13 nt, Pseudomonas putida KT2440
uguaguagcucca

SEQ ID NO: 3562100 - RNA, 14 nt, Pseudomonas putida KT2440
uguaguagcuccag

SEQ ID NO: 3562101 - RNA, 23 nt, Pseudomonas putida KT2440
uguagucaccaccggcuuccagc

SEQ ID NO: 3562102 - RNA, 16 nt, Pseudomonas putida KT2440
uguaucccaggcgcuu

SEQ ID NO: 3562103 - RNA, 23 nt, Pseudomonas putida KT2440
uguaugcgugaucuuuacuuucu

SEQ ID NO: 3562104 - RNA, 13 nt, Pseudomonas putida KT2440
uguauucgagcuu

SEQ ID NO: 3562105 - RNA, 18 nt, Pseudomonas putida KT2440
uguauuuagucagggugu

SEQ ID NO: 3562106 - RNA, 19 nt, Pseudomonas putida KT2440
uguauuuagucaggguguc

SEQ ID NO: 3562107 - RNA, 18 nt, Pseudomonas putida KT2440
ugucacccagcacuucgu

SEQ ID NO: 3562108 - RNA, 22 nt, Pseudomonas putida KT2440
ugucacccagcacuucguccag

SEQ ID NO: 3562109 - RNA, 24 nt, Pseudomonas putida KT2440
ugucaccccguucgcccugcgccu

SEQ ID NO: 3562110 - RNA, 21 nt, Pseudomonas putida KT2440
ugucaccgagacgaucaccag

SEQ ID NO: 3562111 - RNA, 13 nt, Pseudomonas putida KT2440
ugucacuccaguc

SEQ ID NO: 3562112 - RNA, 19 nt, Pseudomonas putida KT2440
ugucagaaaaaacagugcc

SEQ ID NO: 3562113 - RNA, 21 nt, Pseudomonas putida KT2440
ugucagaaaaaacagugccgu

SEQ ID NO: 3562114 - RNA, 22 nt, Pseudomonas putida KT2440
ugucagcaaccacgcuuggcuc

SEQ ID NO: 3562115 - RNA, 17 nt, Pseudomonas putida KT2440
ugucagcagcuucagcc

SEQ ID NO: 3562116 - RNA, 22 nt, Pseudomonas putida KT2440
ugucagccuucagauaguccuu

SEQ ID NO: 3562117 - RNA, 12 nt, Pseudomonas putida KT2440
ugucagcgccag

SEQ ID NO: 3562118 - RNA, 23 nt, Pseudomonas putida KT2440
ugucagucucuuucaacagcugg

SEQ ID NO: 3562119 - RNA, 18 nt, Pseudomonas putida KT2440
ugucaguucugcucagcu

SEQ ID NO: 3562120 - RNA, 13 nt, Pseudomonas putida KT2440
uguccacaaacuc

SEQ ID NO: 3562121 - RNA, 17 nt, Pseudomonas putida KT2440
uguccacaaacucuccu

SEQ ID NO: 3562122 - RNA, 17 nt, Pseudomonas putida KT2440
uguccaccccacccucg

SEQ ID NO: 3562123 - RNA, 12 nt, Pseudomonas putida KT2440
uguccaccgcgc

SEQ ID NO: 3562124 - RNA, 21 nt, Pseudomonas putida KT2440
uguccaccgcgcaacgcgcca

SEQ ID NO: 3562125 - RNA, 21 nt, Pseudomonas putida KT2440
uguccagacgccgcagugaca

SEQ ID NO: 3562126 - RNA, 17 nt, Pseudomonas putida KT2440
uguccagcaagggccug

SEQ ID NO: 3562127 - RNA, 21 nt, Pseudomonas putida KT2440
uguccagcaagggccugugcc

SEQ ID NO: 3562128 - RNA, 15 nt, Pseudomonas putida KT2440
uguccagcagcagcg

SEQ ID NO: 3562129 - RNA, 22 nt, Pseudomonas putida KT2440
uguccagcagcagcgcaccgug

SEQ ID NO: 3562130 - RNA, 23 nt, Pseudomonas putida KT2440
uguccagcagguuggacagcgcc

SEQ ID NO: 3562131 - RNA, 12 nt, Pseudomonas putida KT2440
uguccagcgcau

SEQ ID NO: 3562132 - RNA, 15 nt, Pseudomonas putida KT2440
uguccauccaugcaa

SEQ ID NO: 3562133 - RNA, 19 nt, Pseudomonas putida KT2440
uguccauccaugcaaucac

SEQ ID NO: 3562134 - RNA, 14 nt, Pseudomonas putida KT2440
uguccaugaaggug

SEQ ID NO: 3562135 - RNA, 15 nt, Pseudomonas putida KT2440
uguccauugagcacu

SEQ ID NO: 3562136 - RNA, 15 nt, Pseudomonas putida KT2440
ugucccaggccauca

SEQ ID NO: 3562137 - RNA, 13 nt, Pseudomonas putida KT2440
ugucccccagccc

SEQ ID NO: 3562138 - RNA, 17 nt, Pseudomonas putida KT2440
uguccccgccgugcagu

SEQ ID NO: 3562139 - RNA, 12 nt, Pseudomonas putida KT2440
ugucccgcacga

SEQ ID NO: 3562140 - RNA, 12 nt, Pseudomonas putida KT2440
ugucccggcaca

SEQ ID NO: 3562141 - RNA, 16 nt, Pseudomonas putida KT2440
ugucccggcacaaccg

SEQ ID NO: 3562142 - RNA, 17 nt, Pseudomonas putida KT2440
ugucccggcacaaccga

SEQ ID NO: 3562143 - RNA, 15 nt, Pseudomonas putida KT2440
ugucccggccagggc

SEQ ID NO: 3562144 - RNA, 15 nt, Pseudomonas putida KT2440
ugucccggcccagcc

SEQ ID NO: 3562145 - RNA, 17 nt, Pseudomonas putida KT2440
uguccgcgccagcggcc

SEQ ID NO: 3562146 - RNA, 23 nt, Pseudomonas putida KT2440
uguccucaaucacauccacagcc

SEQ ID NO: 3562147 - RNA, 22 nt, Pseudomonas putida KT2440
uguccugcugcaggcucugaau

SEQ ID NO: 3562148 - RNA, 23 nt, Pseudomonas putida KT2440
uguccuggguuacggcggccugc

SEQ ID NO: 3562149 - RNA, 23 nt, Pseudomonas putida KT2440
uguccuguuuguuuuuacucuuu

SEQ ID NO: 3562150 - RNA, 20 nt, Pseudomonas putida KT2440
uguccuuggccaacugcagc

SEQ ID NO: 3562151 - RNA, 19 nt, Pseudomonas putida KT2440
ugucgaacagcauccagcg

SEQ ID NO: 3562152 - RNA, 23 nt, Pseudomonas putida KT2440
ugucgaacagcauccagcgccag

SEQ ID NO: 3562153 - RNA, 20 nt, Pseudomonas putida KT2440
ugucgaacaggcugccgcgg

SEQ ID NO: 3562154 - RNA, 14 nt, Pseudomonas putida KT2440
ugucgaaccacuga

SEQ ID NO: 3562155 - RNA, 20 nt, Pseudomonas putida KT2440
ugucgaaccccugauguggc

SEQ ID NO: 3562156 - RNA, 20 nt, Pseudomonas putida KT2440
ugucgaacuucuccagcguc

SEQ ID NO: 3562157 - RNA, 16 nt, Pseudomonas putida KT2440
ugucgaagcgcaccuc

SEQ ID NO: 3562158 - RNA, 17 nt, Pseudomonas putida KT2440
ugucgaagcgcucccag

SEQ ID NO: 3562159 - RNA, 17 nt, Pseudomonas putida KT2440
ugucgacagugaauucc

SEQ ID NO: 3562160 - RNA, 21 nt, Pseudomonas putida KT2440
ugucgacagugaauuccuugc

SEQ ID NO: 3562161 - RNA, 17 nt, Pseudomonas putida KT2440
ugucgaccuggcucuuc

SEQ ID NO: 3562162 - RNA, 18 nt, Pseudomonas putida KT2440
ugucgaccugguccagcu

SEQ ID NO: 3562163 - RNA, 20 nt, Pseudomonas putida KT2440
ugucgagguugcgcuccauc

SEQ ID NO: 3562164 - RNA, 19 nt, Pseudomonas putida KT2440
ugucgauacucacccgcuu

SEQ ID NO: 3562165 - RNA, 16 nt, Pseudomonas putida KT2440
ugucgaugccugcuaa

SEQ ID NO: 3562166 - RNA, 14 nt, Pseudomonas putida KT2440
ugucgcccgccucg

SEQ ID NO: 3562167 - RNA, 20 nt, Pseudomonas putida KT2440
ugucgcgacgggcugcuccc

SEQ ID NO: 3562168 - RNA, 22 nt, Pseudomonas putida KT2440
ugucgcugccgccaaccagcuc

SEQ ID NO: 3562169 - RNA, 15 nt, Pseudomonas putida KT2440
ugucgcuguugcgca

SEQ ID NO: 3562170 - RNA, 19 nt, Pseudomonas putida KT2440
ugucggcacgcgccagcag

SEQ ID NO: 3562171 - RNA, 20 nt, Pseudomonas putida KT2440
ugucggcacgcgccagcagc

SEQ ID NO: 3562172 - RNA, 17 nt, Pseudomonas putida KT2440
ugucggcagccagggug

SEQ ID NO: 3562173 - RNA, 20 nt, Pseudomonas putida KT2440
ugucggccagaucggccagc

SEQ ID NO: 3562174 - RNA, 23 nt, Pseudomonas putida KT2440
ugucggccagaucggccagcuug

SEQ ID NO: 3562175 - RNA, 20 nt, Pseudomonas putida KT2440
ugucggcgaaggcuggccuc

SEQ ID NO: 3562176 - RNA, 18 nt, Pseudomonas putida KT2440
ugucggcgucggccaugc

SEQ ID NO: 3562177 - RNA, 14 nt, Pseudomonas putida KT2440
ugucggcgugcacc

SEQ ID NO: 3562178 - RNA, 13 nt, Pseudomonas putida KT2440
ugucgguacuggc

SEQ ID NO: 3562179 - RNA, 16 nt, Pseudomonas putida KT2440
ugucggucacagcagu

SEQ ID NO: 3562180 - RNA, 17 nt, Pseudomonas putida KT2440
ugucggucacagcagug

SEQ ID NO: 3562181 - RNA, 21 nt, Pseudomonas putida KT2440
ugucggucagggcacggcugc

SEQ ID NO: 3562182 - RNA, 18 nt, Pseudomonas putida KT2440
ugucgguggcggccagcg

SEQ ID NO: 3562183 - RNA, 23 nt, Pseudomonas putida KT2440
ugucgucaagcucuuccuugauc

SEQ ID NO: 3562184 - RNA, 14 nt, Pseudomonas putida KT2440
ugucguccagcucg

SEQ ID NO: 3562185 - RNA, 15 nt, Pseudomonas putida KT2440
ugucguccagcucgc

SEQ ID NO: 3562186 - RNA, 14 nt, Pseudomonas putida KT2440
ugucguucgaacuc

SEQ ID NO: 3562187 - RNA, 18 nt, Pseudomonas putida KT2440
ugucuagccgccugccgc

SEQ ID NO: 3562188 - RNA, 19 nt, Pseudomonas putida KT2440
ugucuccgaacgccuuggc

SEQ ID NO: 3562189 - RNA, 22 nt, Pseudomonas putida KT2440
ugucuccgaacgccuuggccuc

SEQ ID NO: 3562190 - RNA, 12 nt, Pseudomonas putida KT2440
ugucuccuuagu

SEQ ID NO: 3562191 - RNA, 14 nt, Pseudomonas putida KT2440
ugucugacagcagg

SEQ ID NO: 3562192 - RNA, 15 nt, Pseudomonas putida KT2440
ugucugcaacugccc

SEQ ID NO: 3562193 - RNA, 20 nt, Pseudomonas putida KT2440
ugucugccaguucaugcagc

SEQ ID NO: 3562194 - RNA, 23 nt, Pseudomonas putida KT2440
ugucugccgcuucguccagguag

SEQ ID NO: 3562195 - RNA, 14 nt, Pseudomonas putida KT2440
ugucugggcacuug

SEQ ID NO: 3562196 - RNA, 17 nt, Pseudomonas putida KT2440
uguuugagccggcgcug

SEQ ID NO: 3562197 - RNA, 20 nt, Pseudomonas putida KT2440
uguuugagccggcgcugggc

SEQ ID NO: 3562198 - RNA, 24 nt, Pseudomonas putida KT2440
uguuugagccggcgcugggcuuac

SEQ ID NO: 3562199 - RNA, 12 nt, Pseudomonas putida KT2440
uguuugggcuug

SEQ ID NO: 3562200 - RNA, 15 nt, Pseudomonas putida KT2440
uuaaaacccaggcaa

SEQ ID NO: 3562201 - RNA, 14 nt, Pseudomonas putida KT2440
uuaaaccuucaaca

SEQ ID NO: 3562202 - RNA, 22 nt, Pseudomonas putida KT2440
uuaaccggcccugaaggccgcu

SEQ ID NO: 3562203 - RNA, 21 nt, Pseudomonas putida KT2440
uuaaccugcggcuguccagca

SEQ ID NO: 3562204 - RNA, 16 nt, Pseudomonas putida KT2440
uuaauuccggccggcu

SEQ ID NO: 3562205 - RNA, 13 nt, Pseudomonas putida KT2440
uuaauuugaacaa

SEQ ID NO: 3562206 - RNA, 14 nt, Pseudomonas putida KT2440
uuacaagggccugu

SEQ ID NO: 3562207 - RNA, 20 nt, Pseudomonas putida KT2440
uuacagaugucuggcaucaa

SEQ ID NO: 3562208 - RNA, 22 nt, Pseudomonas putida KT2440
uuaccaggcgccauuuggcgcc

SEQ ID NO: 3562209 - RNA, 22 nt, Pseudomonas putida KT2440
uuacccaagcacaaggccacug

SEQ ID NO: 3562210 - RNA, 19 nt, Pseudomonas putida KT2440
uuacccgcgaagaggcccu

SEQ ID NO: 3562211 - RNA, 18 nt, Pseudomonas putida KT2440
uuacccucgggacugugc

SEQ ID NO: 3562212 - RNA, 11 nt, Pseudomonas putida KT2440
uuacccugguc

SEQ ID NO: 3562213 - RNA, 19 nt, Pseudomonas putida KT2440
uuacgcugggcgugccagg

SEQ ID NO: 3562214 - RNA, 21 nt, Pseudomonas putida KT2440
uuacggacccuaucggcacug

SEQ ID NO: 3562215 - RNA, 19 nt, Pseudomonas putida KT2440
uuacggcggccugcugccg

SEQ ID NO: 3562216 - RNA, 22 nt, Pseudomonas putida KT2440
uuacuggccaauugcgccauca

SEQ ID NO: 3562217 - RNA, 18 nt, Pseudomonas putida KT2440
uuacugguggacacugcc

SEQ ID NO: 3562218 - RNA, 15 nt, Pseudomonas putida KT2440
uuacuguuugagccg

SEQ ID NO: 3562219 - RNA, 11 nt, Pseudomonas putida KT2440
uuagaacagau

SEQ ID NO: 3562220 - RNA, 16 nt, Pseudomonas putida KT2440
uuagacauuagaaaau

SEQ ID NO: 3562221 - RNA, 23 nt, Pseudomonas putida KT2440
uuagacccgcaagcgggcagugc

SEQ ID NO: 3562222 - RNA, 22 nt, Pseudomonas putida KT2440
uuagacgguuacgugcaggcgc

SEQ ID NO: 3562223 - RNA, 17 nt, Pseudomonas putida KT2440
uuagccugcacuggccu

SEQ ID NO: 3562224 - RNA, 15 nt, Pseudomonas putida KT2440
uuagcuuauucgaug

SEQ ID NO: 3562225 - RNA, 16 nt, Pseudomonas putida KT2440
uuauccugcagcacca

SEQ ID NO: 3562226 - RNA, 16 nt, Pseudomonas putida KT2440
uuauccuucaggcgcu

SEQ ID NO: 3562227 - RNA, 23 nt, Pseudomonas putida KT2440
uuaucuccaagccgcuucacugu

SEQ ID NO: 3562228 - RNA, 20 nt, Pseudomonas putida KT2440
uuaugccgcguuccuuucuc

SEQ ID NO: 3562229 - RNA, 14 nt, Pseudomonas putida KT2440
uuauggaugccaau

SEQ ID NO: 3562230 - RNA, 22 nt, Pseudomonas putida KT2440
uuaugggcagcaccgcguauca

SEQ ID NO: 3562231 - RNA, 20 nt, Pseudomonas putida KT2440
uuauuucucuuccuggcugg

SEQ ID NO: 3562232 - RNA, 15 nt, Pseudomonas putida KT2440
uuauuugugaaacac

SEQ ID NO: 3562233 - RNA, 22 nt, Pseudomonas putida KT2440
uucaaagccauaccgcauccca

SEQ ID NO: 3562234 - RNA, 22 nt, Pseudomonas putida KT2440
uucaaagccugcuccagcaccc

SEQ ID NO: 3562235 - RNA, 22 nt, Pseudomonas putida KT2440
uucaaagcgacauuguggggcu

SEQ ID NO: 3562236 - RNA, 15 nt, Pseudomonas putida KT2440
uucaaauguccauug

SEQ ID NO: 3562237 - RNA, 22 nt, Pseudomonas putida KT2440
uucaacagcgcgacgcagcagc

SEQ ID NO: 3562238 - RNA, 16 nt, Pseudomonas putida KT2440
uucaaccuguuccggc

SEQ ID NO: 3562239 - RNA, 20 nt, Pseudomonas putida KT2440
uucaacgccguacggcccau

SEQ ID NO: 3562240 - RNA, 18 nt, Pseudomonas putida KT2440
uucaaggccgccaccucg

SEQ ID NO: 3562241 - RNA, 10 nt, Pseudomonas putida KT2440
uucaaggcgc

SEQ ID NO: 3562242 - RNA, 12 nt, Pseudomonas putida KT2440
uucaaggucauc

SEQ ID NO: 3562243 - RNA, 22 nt, Pseudomonas putida KT2440
uucaaguccugauagcgcuuuu

SEQ ID NO: 3562244 - RNA, 20 nt, Pseudomonas putida KT2440
uucaaugccagcaguucgca

SEQ ID NO: 3562245 - RNA, 23 nt, Pseudomonas putida KT2440
uucacacaggcugucggcaugca

SEQ ID NO: 3562246 - RNA, 16 nt, Pseudomonas putida KT2440
uucacacucgccagga

SEQ ID NO: 3562247 - RNA, 14 nt, Pseudomonas putida KT2440
uucacagcaaaaaa

SEQ ID NO: 3562248 - RNA, 15 nt, Pseudomonas putida KT2440
uucacagcaaaaaau

SEQ ID NO: 3562249 - RNA, 19 nt, Pseudomonas putida KT2440
uucacagcagaucacaaag

SEQ ID NO: 3562250 - RNA, 23 nt, Pseudomonas putida KT2440
uucacagcguugcagaaacucgu

SEQ ID NO: 3562251 - RNA, 15 nt, Pseudomonas putida KT2440
uucacaucgcccuuc

SEQ ID NO: 3562252 - RNA, 19 nt, Pseudomonas putida KT2440
uucaccacgcccugcacca

SEQ ID NO: 3562253 - RNA, 17 nt, Pseudomonas putida KT2440
uucaccagccaggcaca

SEQ ID NO: 3562254 - RNA, 14 nt, Pseudomonas putida KT2440
uucaccccguacac

SEQ ID NO: 3562255 - RNA, 11 nt, Pseudomonas putida KT2440
uucacccgcga

SEQ ID NO: 3562256 - RNA, 16 nt, Pseudomonas putida KT2440
uucaccgagcugccca

SEQ ID NO: 3562257 - RNA, 20 nt, Pseudomonas putida KT2440
uucaccgcgcaccuccugcg

SEQ ID NO: 3562258 - RNA, 22 nt, Pseudomonas putida KT2440
uucaccguacccaggugaugca

SEQ ID NO: 3562259 - RNA, 14 nt, Pseudomonas putida KT2440
uucaccguugccgc

SEQ ID NO: 3562260 - RNA, 12 nt, Pseudomonas putida KT2440
uucacgcacggc

SEQ ID NO: 3562261 - RNA, 21 nt, Pseudomonas putida KT2440
uucacgcacggccuucccgcc

SEQ ID NO: 3562262 - RNA, 12 nt, Pseudomonas putida KT2440
uucacgcagguc

SEQ ID NO: 3562263 - RNA, 15 nt, Pseudomonas putida KT2440
uucacgggucaugcc

SEQ ID NO: 3562264 - RNA, 22 nt, Pseudomonas putida KT2440
uucacgucuggcaccaguucca

SEQ ID NO: 3562265 - RNA, 12 nt, Pseudomonas putida KT2440
uucacugacaaa

SEQ ID NO: 3562266 - RNA, 22 nt, Pseudomonas putida KT2440
uucacugguuucagaaccagcg

SEQ ID NO: 3562267 - RNA, 14 nt, Pseudomonas putida KT2440
uucacuuccacacg

SEQ ID NO: 3562268 - RNA, 18 nt, Pseudomonas putida KT2440
uucagaucacccuuggcc

SEQ ID NO: 3562269 - RNA, 20 nt, Pseudomonas putida KT2440
uucagaucacccuuggccac

SEQ ID NO: 3562270 - RNA, 22 nt, Pseudomonas putida KT2440
uucagaucacccuuggccaccu

SEQ ID NO: 3562271 - RNA, 17 nt, Pseudomonas putida KT2440
uucagauugcuuauucu

SEQ ID NO: 3562272 - RNA, 15 nt, Pseudomonas putida KT2440
uucagcacaccgcuc

SEQ ID NO: 3562273 - RNA, 20 nt, Pseudomonas putida KT2440
uucagcacaccgcucaaccu

SEQ ID NO: 3562274 - RNA, 17 nt, Pseudomonas putida KT2440
uucagcacgggcagcuu

SEQ ID NO: 3562275 - RNA, 14 nt, Pseudomonas putida KT2440
uucagccaaggcgc

SEQ ID NO: 3562276 - RNA, 21 nt, Pseudomonas putida KT2440
uucagccaggguuucggugac

SEQ ID NO: 3562277 - RNA, 19 nt, Pseudomonas putida KT2440
uucagcccuugcugcagca

SEQ ID NO: 3562278 - RNA, 15 nt, Pseudomonas putida KT2440
uucagccuuuuccag

SEQ ID NO: 3562279 - RNA, 17 nt, Pseudomonas putida KT2440
uucagccuuuuccagcu

SEQ ID NO: 3562280 - RNA, 21 nt, Pseudomonas putida KT2440
uucagcgcccgcaacagaucc

SEQ ID NO: 3562281 - RNA, 17 nt, Pseudomonas putida KT2440
uucagcgccucuuugcc

SEQ ID NO: 3562282 - RNA, 18 nt, Pseudomonas putida KT2440
uucagcgccucuuugccc

SEQ ID NO: 3562283 - RNA, 17 nt, Pseudomonas putida KT2440
uucagcgcggcaaccug

SEQ ID NO: 3562284 - RNA, 20 nt, Pseudomonas putida KT2440
uucagcgcggcaaccugcuc

SEQ ID NO: 3562285 - RNA, 15 nt, Pseudomonas putida KT2440
uucaggcaaaacaaa

SEQ ID NO: 3562286 - RNA, 13 nt, Pseudomonas putida KT2440
uucaggccuucga

SEQ ID NO: 3562287 - RNA, 14 nt, Pseudomonas putida KT2440
uucaggcgcucacc

SEQ ID NO: 3562288 - RNA, 20 nt, Pseudomonas putida KT2440
uucaggcgcucaccccgccc

SEQ ID NO: 3562289 - RNA, 21 nt, Pseudomonas putida KT2440
uucaggcuuugcugcaggucc

SEQ ID NO: 3562290 - RNA, 21 nt, Pseudomonas putida KT2440
uucagggccgguuaaaaccca

SEQ ID NO: 3562291 - RNA, 17 nt, Pseudomonas putida KT2440
uucaggggcccuuggcc

SEQ ID NO: 3562292 - RNA, 19 nt, Pseudomonas putida KT2440
uucagguaauccaccagcc

SEQ ID NO: 3562293 - RNA, 15 nt, Pseudomonas putida KT2440
uucagguacagcagc

SEQ ID NO: 3562294 - RNA, 11 nt, Pseudomonas putida KT2440
uucaggucauu

SEQ ID NO: 3562295 - RNA, 18 nt, Pseudomonas putida KT2440
uucaggugccguuccggc

SEQ ID NO: 3562296 - RNA, 17 nt, Pseudomonas putida KT2440
uucagguguuccagcac

SEQ ID NO: 3562297 - RNA, 21 nt, Pseudomonas putida KT2440
uucagucgguaugcgcccauc

SEQ ID NO: 3562298 - RNA, 23 nt, Pseudomonas putida KT2440
uucagugccugggucagcuccuc

SEQ ID NO: 3562299 - RNA, 19 nt, Pseudomonas putida KT2440
uucaguuggcguccagcag

SEQ ID NO: 3562300 - RNA, 15 nt, Pseudomonas putida KT2440
uucauacagcgccuc

SEQ ID NO: 3562301 - RNA, 15 nt, Pseudomonas putida KT2440
uucgaucgccggcag

SEQ ID NO: 3562302 - RNA, 17 nt, Pseudomonas putida KT2440
uucgaucucuucgguag

SEQ ID NO: 3562303 - RNA, 13 nt, Pseudomonas putida KT2440
uucgaugaaggcu

SEQ ID NO: 3562304 - RNA, 15 nt, Pseudomonas putida KT2440
uucgaugcccggcag

SEQ ID NO: 3562305 - RNA, 16 nt, Pseudomonas putida KT2440
uucgcaacgcuuggca

SEQ ID NO: 3562306 - RNA, 17 nt, Pseudomonas putida KT2440
uucgccaagguccagcc

SEQ ID NO: 3562307 - RNA, 12 nt, Pseudomonas putida KT2440
uucgccacaaaa

SEQ ID NO: 3562308 - RNA, 11 nt, Pseudomonas putida KT2440
uucgccacugc

SEQ ID NO: 3562309 - RNA, 14 nt, Pseudomonas putida KT2440
uucgccagcgccac

SEQ ID NO: 3562310 - RNA, 23 nt, Pseudomonas putida KT2440
uucgccccauaaaaaaacccgcu

SEQ ID NO: 3562311 - RNA, 20 nt, Pseudomonas putida KT2440
uucgcccgaccgccagcccg

SEQ ID NO: 3562312 - RNA, 22 nt, Pseudomonas putida KT2440
uucgcccgguuccagcgcaccg

SEQ ID NO: 3562313 - RNA, 15 nt, Pseudomonas putida KT2440
uucgccggcacgccc

SEQ ID NO: 3562314 - RNA, 19 nt, Pseudomonas putida KT2440
uucgccggcacgcccgcuc

SEQ ID NO: 3562315 - RNA, 20 nt, Pseudomonas putida KT2440
uucgccguacuggcugcacu

SEQ ID NO: 3562316 - RNA, 19 nt, Pseudomonas putida KT2440
uucgccguagccaaccgag

SEQ ID NO: 3562317 - RNA, 13 nt, Pseudomonas putida KT2440
uucgcgaacugca

SEQ ID NO: 3562318 - RNA, 15 nt, Pseudomonas putida KT2440
uucgcgacacaaggc

SEQ ID NO: 3562319 - RNA, 18 nt, Pseudomonas putida KT2440
uucgcgaggaaacccgcg

SEQ ID NO: 3562320 - RNA, 19 nt, Pseudomonas putida KT2440
uucgcgaggaaacccgcgc

SEQ ID NO: 3562321 - RNA, 20 nt, Pseudomonas putida KT2440
uucgcgcagggugccggcca

SEQ ID NO: 3562322 - RNA, 18 nt, Pseudomonas putida KT2440
uucgcgcauuuucaccga

SEQ ID NO: 3562323 - RNA, 18 nt, Pseudomonas putida KT2440
uucgcgggagacccguuc

SEQ ID NO: 3562324 - RNA, 15 nt, Pseudomonas putida KT2440
uucgcgggcaagccc

SEQ ID NO: 3562325 - RNA, 16 nt, Pseudomonas putida KT2440
uucgcgggcaagcccg

SEQ ID NO: 3562326 - RNA, 19 nt, Pseudomonas putida KT2440
uucgcgggcaagcccgcuc

SEQ ID NO: 3562327 - RNA, 19 nt, Pseudomonas putida KT2440
uucgcgggcaugcccgcuc

SEQ ID NO: 3562328 - RNA, 19 nt, Pseudomonas putida KT2440
uucgcgggcgcgcccgcuc

SEQ ID NO: 3562329 - RNA, 11 nt, Pseudomonas putida KT2440
uucgcgggcuc

SEQ ID NO: 3562330 - RNA, 16 nt, Pseudomonas putida KT2440
uucgcgggcucgcccg

SEQ ID NO: 3562331 - RNA, 18 nt, Pseudomonas putida KT2440
uucgcggguaaacccccu

SEQ ID NO: 3562332 - RNA, 19 nt, Pseudomonas putida KT2440
uucgcggguaaacccgcgc

SEQ ID NO: 3562333 - RNA, 18 nt, Pseudomonas putida KT2440
uucgcgggugaacccgcu

SEQ ID NO: 3562334 - RNA, 19 nt, Pseudomonas putida KT2440
uucgcgggugaacccgcuc

SEQ ID NO: 3562335 - RNA, 21 nt, Pseudomonas putida KT2440
uucgcuaaccucugcaugcca

SEQ ID NO: 3562336 - RNA, 14 nt, Pseudomonas putida KT2440
uucgcugcgcauca

SEQ ID NO: 3562337 - RNA, 20 nt, Pseudomonas putida KT2440
uucgcugcgcaucacccgcc

SEQ ID NO: 3562338 - RNA, 21 nt, Pseudomonas putida KT2440
uucgcugcgcaucacccgccc

SEQ ID NO: 3562339 - RNA, 17 nt, Pseudomonas putida KT2440
uucgcuggccugcccca

SEQ ID NO: 3562340 - RNA, 23 nt, Pseudomonas putida KT2440
uucgcuggccugccccagcauca

SEQ ID NO: 3562341 - RNA, 18 nt, Pseudomonas putida KT2440
uucgcugucuuccagggc

SEQ ID NO: 3562342 - RNA, 16 nt, Pseudomonas putida KT2440
uucggaucgucuggca

SEQ ID NO: 3562343 - RNA, 19 nt, Pseudomonas putida KT2440
uucggcaacagccgggcag

SEQ ID NO: 3562344 - RNA, 13 nt, Pseudomonas putida KT2440
uucggcaaggcga

SEQ ID NO: 3562345 - RNA, 21 nt, Pseudomonas putida KT2440
uucggcaaggcgaccugccag

SEQ ID NO: 3562346 - RNA, 17 nt, Pseudomonas putida KT2440
uucggcaugcacggcag

SEQ ID NO: 3562347 - RNA, 20 nt, Pseudomonas putida KT2440
uucggccagcaguucgucga

SEQ ID NO: 3562348 - RNA, 18 nt, Pseudomonas putida KT2440
uucggccaugaucucgcc

SEQ ID NO: 3562349 - RNA, 15 nt, Pseudomonas putida KT2440
uucggcggccugcag

SEQ ID NO: 3562350 - RNA, 19 nt, Pseudomonas putida KT2440
uucggcggugacacugcca

SEQ ID NO: 3562351 - RNA, 18 nt, Pseudomonas putida KT2440
uucggcugaucucuucag

SEQ ID NO: 3562352 - RNA, 22 nt, Pseudomonas putida KT2440
uucggcugaucucuucagccac

SEQ ID NO: 3562353 - RNA, 14 nt, Pseudomonas putida KT2440
uucgggcugcugcc

SEQ ID NO: 3562354 - RNA, 14 nt, Pseudomonas putida KT2440
uucgggcuguccuc

SEQ ID NO: 3562355 - RNA, 21 nt, Pseudomonas putida KT2440
uucgggcuguccucaaucaca

SEQ ID NO: 3562356 - RNA, 16 nt, Pseudomonas putida KT2440
uucgggucgccuuugu

SEQ ID NO: 3562357 - RNA, 12 nt, Pseudomonas putida KT2440
uucgguguccuu

SEQ ID NO: 3562358 - RNA, 17 nt, Pseudomonas putida KT2440
uucgucauccaccgccc

SEQ ID NO: 3562359 - RNA, 21 nt, Pseudomonas putida KT2440
uucguccaggcucagcucguc

SEQ ID NO: 3562360 - RNA, 18 nt, Pseudomonas putida KT2440
uucgucggccuuguucaa

SEQ ID NO: 3562361 - RNA, 21 nt, Pseudomonas putida KT2440
uucgucggugcccuucacugg

SEQ ID NO: 3562362 - RNA, 16 nt, Pseudomonas putida KT2440
uucuccaacuggcgaa

SEQ ID NO: 3562363 - RNA, 13 nt, Pseudomonas putida KT2440
uucuccagcucgc

SEQ ID NO: 3562364 - RNA, 15 nt, Pseudomonas putida KT2440
uucuccagcucgcca

SEQ ID NO: 3562365 - RNA, 12 nt, Pseudomonas putida KT2440
uucucccaggcc

SEQ ID NO: 3562366 - RNA, 14 nt, Pseudomonas putida KT2440
uucucgcagcagca

SEQ ID NO: 3562367 - RNA, 15 nt, Pseudomonas putida KT2440
uucucgcagcagcac

SEQ ID NO: 3562368 - RNA, 17 nt, Pseudomonas putida KT2440
uucucgcagcagcaccg

SEQ ID NO: 3562369 - RNA, 19 nt, Pseudomonas putida KT2440
uucucgcagcagcaccggc

SEQ ID NO: 3562370 - RNA, 21 nt, Pseudomonas putida KT2440
uucucgcucagguaggcagca

SEQ ID NO: 3562371 - RNA, 13 nt, Pseudomonas putida KT2440
uucucggcaaagc

SEQ ID NO: 3562372 - RNA, 16 nt, Pseudomonas putida KT2440
uucucggcaaagcguu

SEQ ID NO: 3562373 - RNA, 20 nt, Pseudomonas putida KT2440
uucucggucgccaaccccac

SEQ ID NO: 3562374 - RNA, 20 nt, Pseudomonas putida KT2440
uucucgucuggcgcggcaca

SEQ ID NO: 3562375 - RNA, 17 nt, Pseudomonas putida KT2440
uucucuuccggcaggua

SEQ ID NO: 3562376 - RNA, 20 nt, Pseudomonas putida KT2440
uucugaaucuggcucugcag

SEQ ID NO: 3562377 - RNA, 19 nt, Pseudomonas putida KT2440
uucugcaacagcuccagca

SEQ ID NO: 3562378 - RNA, 20 nt, Pseudomonas putida KT2440
uucugcaacagcuccagcag

SEQ ID NO: 3562379 - RNA, 14 nt, Pseudomonas putida KT2440
uucugcaccuugcc

SEQ ID NO: 3562380 - RNA, 16 nt, Pseudomonas putida KT2440
uucugcauguccagcc

SEQ ID NO: 3562381 - RNA, 17 nt, Pseudomonas putida KT2440
uucugcauguccagccc

SEQ ID NO: 3562382 - RNA, 13 nt, Pseudomonas putida KT2440
uucugccagcucc

SEQ ID NO: 3562383 - RNA, 22 nt, Pseudomonas putida KT2440
uucugccaguaaggcuugcuca

SEQ ID NO: 3562384 - RNA, 16 nt, Pseudomonas putida KT2440
uucugcucuucugcca

SEQ ID NO: 3562385 - RNA, 16 nt, Pseudomonas putida KT2440
uucuggauaugcucca

SEQ ID NO: 3562386 - RNA, 22 nt, Pseudomonas putida KT2440
uucuggcugccuucgcucaggu

SEQ ID NO: 3562387 - RNA, 22 nt, Pseudomonas putida KT2440
uucuggcuggagccguccagga

SEQ ID NO: 3562388 - RNA, 19 nt, Pseudomonas putida KT2440
uucugguugaacugcuuga

SEQ ID NO: 3562389 - RNA, 15 nt, Pseudomonas putida KT2440
uucuucaggcaaaac

SEQ ID NO: 3562390 - RNA, 16 nt, Pseudomonas putida KT2440
uucuucgccugcagca

SEQ ID NO: 3562391 - RNA, 14 nt, Pseudomonas putida KT2440
uucuucgugcgccu

SEQ ID NO: 3562392 - RNA, 15 nt, Pseudomonas putida KT2440
uucuucgugcgccuc

SEQ ID NO: 3562393 - RNA, 18 nt, Pseudomonas putida KT2440
uucuucuuuaagccccug

SEQ ID NO: 3562394 - RNA, 12 nt, Pseudomonas putida KT2440
uucuugaaauua

SEQ ID NO: 3562395 - RNA, 20 nt, Pseudomonas putida KT2440
uucuugaagaugaccuuguc

SEQ ID NO: 3562396 - RNA, 21 nt, Pseudomonas putida KT2440
uucuugacgggugaccaggcc

SEQ ID NO: 3562397 - RNA, 14 nt, Pseudomonas putida KT2440
uucuugcaguucuu

SEQ ID NO: 3562398 - RNA, 16 nt, Pseudomonas putida KT2440
uucuugccgagcagcg

SEQ ID NO: 3562399 - RNA, 20 nt, Pseudomonas putida KT2440
uucuuggagcggccuuugaa

SEQ ID NO: 3562400 - RNA, 15 nt, Pseudomonas putida KT2440
uucuuguucguucag

SEQ ID NO: 3562401 - RNA, 19 nt, Pseudomonas putida KT2440
uucuuuacaacccagacuc

SEQ ID NO: 3562402 - RNA, 16 nt, Pseudomonas putida KT2440
uucuuucucccaggcc

SEQ ID NO: 3562403 - RNA, 14 nt, Pseudomonas putida KT2440
uugaaauuuuugcu

SEQ ID NO: 3562404 - RNA, 19 nt, Pseudomonas putida KT2440
uugaacacauccucaaagg

SEQ ID NO: 3562405 - RNA, 14 nt, Pseudomonas putida KT2440
uugaacacgaacac

SEQ ID NO: 3562406 - RNA, 13 nt, Pseudomonas putida KT2440
uugaacagcagcg

SEQ ID NO: 3562407 - RNA, 20 nt, Pseudomonas putida KT2440
uugccuguccccuuggcccu

SEQ ID NO: 3562408 - RNA, 17 nt, Pseudomonas putida KT2440
uugccuguugccaaugc

SEQ ID NO: 3562409 - RNA, 21 nt, Pseudomonas putida KT2440
uugccuuccucggccaugcgc

SEQ ID NO: 3562410 - RNA, 17 nt, Pseudomonas putida KT2440
uugccuuccuugaacuc

SEQ ID NO: 3562411 - RNA, 21 nt, Pseudomonas putida KT2440
uugcgaagguaaccugguucu

SEQ ID NO: 3562412 - RNA, 20 nt, Pseudomonas putida KT2440
uugcgcacgcgcuuuuccag

SEQ ID NO: 3562413 - RNA, 23 nt, Pseudomonas putida KT2440
uugcgcaggguggcgcugaccaa

SEQ ID NO: 3562414 - RNA, 19 nt, Pseudomonas putida KT2440
uugcgcagguacacgggca

SEQ ID NO: 3562415 - RNA, 17 nt, Pseudomonas putida KT2440
uugcgcaucaacguucc

SEQ ID NO: 3562416 - RNA, 14 nt, Pseudomonas putida KT2440
uugcgcaucaccuc

SEQ ID NO: 3562417 - RNA, 16 nt, Pseudomonas putida KT2440
uugcgcaucaccucga

SEQ ID NO: 3562418 - RNA, 16 nt, Pseudomonas putida KT2440
uugcgccccagcagcg

SEQ ID NO: 3562419 - RNA, 15 nt, Pseudomonas putida KT2440
uugcgcgccagggca

SEQ ID NO: 3562420 - RNA, 14 nt, Pseudomonas putida KT2440
uugcgcgccgccag

SEQ ID NO: 3562421 - RNA, 23 nt, Pseudomonas putida KT2440
uugcgcgccuugcgccaggugcc

SEQ ID NO: 3562422 - RNA, 13 nt, Pseudomonas putida KT2440
uugcgcggcaccg

SEQ ID NO: 3562423 - RNA, 17 nt, Pseudomonas putida KT2440
uugcgcuggcugccgcg

SEQ ID NO: 3562424 - RNA, 20 nt, Pseudomonas putida KT2440
uugcggaacguuuccaggcu

SEQ ID NO: 3562425 - RNA, 19 nt, Pseudomonas putida KT2440
uugcggccaucgaacacca

SEQ ID NO: 3562426 - RNA, 13 nt, Pseudomonas putida KT2440
uugcggcccuucg

SEQ ID NO: 3562427 - RNA, 14 nt, Pseudomonas putida KT2440
uugcggcccuucgc

SEQ ID NO: 3562428 - RNA, 19 nt, Pseudomonas putida KT2440
uugcgggucagcagcaccg

SEQ ID NO: 3562429 - RNA, 21 nt, Pseudomonas putida KT2440
uugcgggucagcagcaccgcc

SEQ ID NO: 3562430 - RNA, 16 nt, Pseudomonas putida KT2440
uugcgggucagcucga

SEQ ID NO: 3562431 - RNA, 13 nt, Pseudomonas putida KT2440
uugcgguccugca

SEQ ID NO: 3562432 - RNA, 19 nt, Pseudomonas putida KT2440
uugcguaagauacgccgcu

SEQ ID NO: 3562433 - RNA, 20 nt, Pseudomonas putida KT2440
uugcgugccucagccaggcu

SEQ ID NO: 3562434 - RNA, 17 nt, Pseudomonas putida KT2440
uugcguugaccugcugg

SEQ ID NO: 3562435 - RNA, 12 nt, Pseudomonas putida KT2440
uugcuaugggaa

SEQ ID NO: 3562436 - RNA, 15 nt, Pseudomonas putida KT2440
uugcucaacuucccu

SEQ ID NO: 3562437 - RNA, 15 nt, Pseudomonas putida KT2440
uugcuccaccaggcc

SEQ ID NO: 3562438 - RNA, 18 nt, Pseudomonas putida KT2440
uugcuccagcucacagca

SEQ ID NO: 3562439 - RNA, 22 nt, Pseudomonas putida KT2440
uugcuccagcucacagcacucg

SEQ ID NO: 3562440 - RNA, 16 nt, Pseudomonas putida KT2440
uugcuccgcgaggcuc

SEQ ID NO: 3562441 - RNA, 15 nt, Pseudomonas putida KT2440
uugcucggcaccacc

SEQ ID NO: 3562442 - RNA, 16 nt, Pseudomonas putida KT2440
uugcucggcaccaccg

SEQ ID NO: 3562443 - RNA, 20 nt, Pseudomonas putida KT2440
uugcucuaaaucgaccugca

SEQ ID NO: 3562444 - RNA, 19 nt, Pseudomonas putida KT2440
uugcucuuguuccgccgcu

SEQ ID NO: 3562445 - RNA, 12 nt, Pseudomonas putida KT2440
uugcugagccag

SEQ ID NO: 3562446 - RNA, 16 nt, Pseudomonas putida KT2440
uugcugcagcaggcug

SEQ ID NO: 3562447 - RNA, 12 nt, Pseudomonas putida KT2440
uugcugcagguc

SEQ ID NO: 3562448 - RNA, 11 nt, Pseudomonas putida KT2440
uugcugccugu

SEQ ID NO: 3562449 - RNA, 18 nt, Pseudomonas putida KT2440
uugcuggcgacgcugccc

SEQ ID NO: 3562450 - RNA, 15 nt, Pseudomonas putida KT2440
uugcugggcgaacgc

SEQ ID NO: 3562451 - RNA, 20 nt, Pseudomonas putida KT2440
uugcuggguaccgugcugca

SEQ ID NO: 3562452 - RNA, 17 nt, Pseudomonas putida KT2440
uugcugguguggcgcca

SEQ ID NO: 3562453 - RNA, 22 nt, Pseudomonas putida KT2440
uugcugguguggcgccagggca

SEQ ID NO: 3562454 - RNA, 17 nt, Pseudomonas putida KT2440
uugcuuauucuucuggc

SEQ ID NO: 3562455 - RNA, 15 nt, Pseudomonas putida KT2440
uugcuucuugaagcg

SEQ ID NO: 3562456 - RNA, 14 nt, Pseudomonas putida KT2440
uugcuugcagcgcu

SEQ ID NO: 3562457 - RNA, 16 nt, Pseudomonas putida KT2440
uugcuuugaagucacu

SEQ ID NO: 3562458 - RNA, 12 nt, Pseudomonas putida KT2440
uuggaaaaugau

SEQ ID NO: 3562459 - RNA, 14 nt, Pseudomonas putida KT2440
uuggaaaauguuac

SEQ ID NO: 3562460 - RNA, 21 nt, Pseudomonas putida KT2440
uuggaaaauguuacccaagca

SEQ ID NO: 3562461 - RNA, 15 nt, Pseudomonas putida KT2440
uuggaaauguucaac

SEQ ID NO: 3562462 - RNA, 19 nt, Pseudomonas putida KT2440
uuggaaauguucaacagcc

SEQ ID NO: 3562463 - RNA, 14 nt, Pseudomonas putida KT2440
uuggaauggcgcac

SEQ ID NO: 3562464 - RNA, 14 nt, Pseudomonas putida KT2440
uuggacacagaccg

SEQ ID NO: 3562465 - RNA, 15 nt, Pseudomonas putida KT2440
uuggacaccaggcug

SEQ ID NO: 3562466 - RNA, 11 nt, Pseudomonas putida KT2440
uuggaggcugg

SEQ ID NO: 3562467 - RNA, 18 nt, Pseudomonas putida KT2440
uuggaguuuuccuaaagc

SEQ ID NO: 3562468 - RNA, 16 nt, Pseudomonas putida KT2440
uuggcaacaauguacc

SEQ ID NO: 3562469 - RNA, 14 nt, Pseudomonas putida KT2440
uuggcaaucaaggu

SEQ ID NO: 3562470 - RNA, 19 nt, Pseudomonas putida KT2440
uuggcaccggcagcagcaa

SEQ ID NO: 3562471 - RNA, 14 nt, Pseudomonas putida KT2440
uuggcaccuccggu

SEQ ID NO: 3562472 - RNA, 21 nt, Pseudomonas putida KT2440
uuggcacgaaacgccacgccc

SEQ ID NO: 3562473 - RNA, 22 nt, Pseudomonas putida KT2440
uuggcacggccagccagcagcg

SEQ ID NO: 3562474 - RNA, 17 nt, Pseudomonas putida KT2440
uuggcacguugcugccu

SEQ ID NO: 3562475 - RNA, 14 nt, Pseudomonas putida KT2440
uuggcagccccgau

SEQ ID NO: 3562476 - RNA, 17 nt, Pseudomonas putida KT2440
uuggcagcuaccacccc

SEQ ID NO: 3562477 - RNA, 21 nt, Pseudomonas putida KT2440
uuggcagugaucuggcgcagc

SEQ ID NO: 3562478 - RNA, 13 nt, Pseudomonas putida KT2440
uuggcaucugcug

SEQ ID NO: 3562479 - RNA, 14 nt, Pseudomonas putida KT2440
uuggcaucugcugg

SEQ ID NO: 3562480 - RNA, 16 nt, Pseudomonas putida KT2440
uuggccagcaacggug

SEQ ID NO: 3562481 - RNA, 21 nt, Pseudomonas putida KT2440
uuggccagcaggcccggcccu

SEQ ID NO: 3562482 - RNA, 18 nt, Pseudomonas putida KT2440
uuggccaggucgaccgag

SEQ ID NO: 3562483 - RNA, 19 nt, Pseudomonas putida KT2440
uuggccaucaauaccggca

SEQ ID NO: 3562484 - RNA, 16 nt, Pseudomonas putida KT2440
uuggccaucugguugc

SEQ ID NO: 3562485 - RNA, 21 nt, Pseudomonas putida KT2440
uuggcccggggaucuugcugg

SEQ ID NO: 3562486 - RNA, 15 nt, Pseudomonas putida KT2440
uuggccgaaggccgu

SEQ ID NO: 3562487 - RNA, 22 nt, Pseudomonas putida KT2440
uuggccgcgcgcccaucugcac

SEQ ID NO: 3562488 - RNA, 15 nt, Pseudomonas putida KT2440
uuggccgcuggcccu

SEQ ID NO: 3562489 - RNA, 19 nt, Pseudomonas putida KT2440
uuggccgcuggcccuucgc

SEQ ID NO: 3562490 - RNA, 18 nt, Pseudomonas putida KT2440
uuggccuggacuggcccu

SEQ ID NO: 3562491 - RNA, 12 nt, Pseudomonas putida KT2440
uuggccugucca

SEQ ID NO: 3562492 - RNA, 22 nt, Pseudomonas putida KT2440
uuggcgaucgaacgcuugcccg

SEQ ID NO: 3562493 - RNA, 16 nt, Pseudomonas putida KT2440
uuggcggagccagcca

SEQ ID NO: 3562494 - RNA, 13 nt, Pseudomonas putida KT2440
uuggcggcgcagc

SEQ ID NO: 3562495 - RNA, 21 nt, Pseudomonas putida KT2440
uuggcggcgcagcgcacggcu

SEQ ID NO: 3562496 - RNA, 16 nt, Pseudomonas putida KT2440
uuggcguccacagcca

SEQ ID NO: 3562497 - RNA, 13 nt, Pseudomonas putida KT2440
uuggcguccagca

SEQ ID NO: 3562498 - RNA, 18 nt, Pseudomonas putida KT2440
uuggcguccagcagugcc

SEQ ID NO: 3562499 - RNA, 22 nt, Pseudomonas putida KT2440
uuggcguccagcagugccaucg

SEQ ID NO: 3562500 - RNA, 23 nt, Pseudomonas putida KT2440
uuggcgugcggcgucgucaagga

SEQ ID NO: 3562501 - RNA, 24 nt, Pseudomonas putida KT2440
uuggcguugagccgccaacccgug

SEQ ID NO: 3562502 - RNA, 18 nt, Pseudomonas putida KT2440
uuggcuacgcaaggugcc

SEQ ID NO: 3562503 - RNA, 16 nt, Pseudomonas putida KT2440
uuggcuaucagccgug

SEQ ID NO: 3562504 - RNA, 22 nt, Pseudomonas putida KT2440
uuggcuggugaaggcaggucag

SEQ ID NO: 3562505 - RNA, 13 nt, Pseudomonas putida KT2440
uuggcugugagau

SEQ ID NO: 3562506 - RNA, 18 nt, Pseudomonas putida KT2440
uuggcuucuucgcgggca

SEQ ID NO: 3562507 - RNA, 18 nt, Pseudomonas putida KT2440
uugggcaagugcgugcaa

SEQ ID NO: 3562508 - RNA, 11 nt, Pseudomonas putida KT2440
uugggcccaca

SEQ ID NO: 3562509 - RNA, 16 nt, Pseudomonas putida KT2440
uugggcgaggacagca

SEQ ID NO: 3562510 - RNA, 18 nt, Pseudomonas putida KT2440
uugggcgggccgccgaac

SEQ ID NO: 3562511 - RNA, 14 nt, Pseudomonas putida KT2440
uugggcuucaugca

SEQ ID NO: 3562512 - RNA, 18 nt, Pseudomonas putida KT2440
uugggcuuggcagcaccg

SEQ ID NO: 3562513 - RNA, 16 nt, Pseudomonas putida KT2440
uuugaagucacuuugu

SEQ ID NO: 3562514 - RNA, 21 nt, Pseudomonas putida KT2440
uuugacgcugcucauccuuuu

SEQ ID NO: 3562515 - RNA, 16 nt, Pseudomonas putida KT2440
uuugacggugaauucc

SEQ ID NO: 3562516 - RNA, 21 nt, Pseudomonas putida KT2440
uuugacggugaauuccuugca

SEQ ID NO: 3562517 - RNA, 22 nt, Pseudomonas putida KT2440
uuugaucagcgguucgaccgac

SEQ ID NO: 3562518 - RNA, 23 nt, Pseudomonas putida KT2440
uuugcaaaacuuggguagugcau

SEQ ID NO: 3562519 - RNA, 22 nt, Pseudomonas putida KT2440
uuugcaccuaaccagugggagc

SEQ ID NO: 3562520 - RNA, 23 nt, Pseudomonas putida KT2440
uuugcagcccauucgcgggcaag

SEQ ID NO: 3562521 - RNA, 16 nt, Pseudomonas putida KT2440
uuugcgagcgcgggca

SEQ ID NO: 3562522 - RNA, 21 nt, Pseudomonas putida KT2440
uuugcgagcgcgggcagacac

SEQ ID NO: 3562523 - RNA, 23 nt, Pseudomonas putida KT2440
uuugcgccuuagacgguuacgug

SEQ ID NO: 3562524 - RNA, 14 nt, Pseudomonas putida KT2440
uuugcggggcuuuu

SEQ ID NO: 3562525 - RNA, 22 nt, Pseudomonas putida KT2440
uuugcgucaucaucagcaggca

SEQ ID NO: 3562526 - RNA, 15 nt, Pseudomonas putida KT2440
uuugcgucuccacga

SEQ ID NO: 3562527 - RNA, 13 nt, Pseudomonas putida KT2440
uuugcguggcacc

SEQ ID NO: 3562528 - RNA, 22 nt, Pseudomonas putida KT2440
uuugcucuaaaucgaccugcag

SEQ ID NO: 3562529 - RNA, 15 nt, Pseudomonas putida KT2440
uuugcuggccugcag

SEQ ID NO: 3562530 - RNA, 21 nt, Pseudomonas putida KT2440
uuugcuugaguugaguggggu

SEQ ID NO: 3562531 - RNA, 16 nt, Pseudomonas putida KT2440
uuuggccguagccagg

SEQ ID NO: 3562532 - RNA, 17 nt, Pseudomonas putida KT2440
uuugggcugcgcggcag

SEQ ID NO: 3562533 - RNA, 17 nt, Pseudomonas putida KT2440
uuugucaacaaaaaacg

SEQ ID NO: 3562534 - RNA, 12 nt, Pseudomonas putida KT2440
uuuguccauucu

SEQ ID NO: 3562535 - RNA, 11 nt, Pseudomonas putida KT2440
uuuguuugcug

SEQ ID NO: 3562536 - RNA, 14 nt, Pseudomonas putida KT2440
uuuucaaugcugcu

SEQ ID NO: 3562537 - RNA, 14 nt, Pseudomonas putida KT2440
uuuucacacgccac

SEQ ID NO: 3562538 - RNA, 21 nt, Pseudomonas putida KT2440
uuuucaccuccaguugccagu

SEQ ID NO: 3562539 - RNA, 12 nt, Pseudomonas putida KT2440
uuuucaccuucg

SEQ ID NO: 3562540 - RNA, 22 nt, Pseudomonas putida KT2440
uuuucagguuuaccauuuuccu

SEQ ID NO: 3562541 - RNA, 11 nt, Pseudomonas putida KT2440
uuuucaucaaa

SEQ ID NO: 3562542 - RNA, 19 nt, Pseudomonas putida KT2440
uuuuccaguuggcagggca

SEQ ID NO: 3562543 - RNA, 14 nt, Pseudomonas putida KT2440
uuuuccaugcguuc

SEQ ID NO: 3562544 - RNA, 19 nt, Pseudomonas putida KT2440
uuuuccccuuauauuucac

SEQ ID NO: 3562545 - RNA, 22 nt, Pseudomonas putida KT2440
uuuuccugcgggucauccucaa

SEQ ID NO: 3562546 - RNA, 21 nt, Pseudomonas putida KT2440
uuuucgcggguaaacccgcuc

SEQ ID NO: 3562547 - RNA, 21 nt, Pseudomonas putida KT2440
uuuucggcaaggcgaccugcc

SEQ ID NO: 3562548 - RNA, 22 nt, Pseudomonas putida KT2440
uuuucggcggugacacugccau

SEQ ID NO: 3562549 - RNA, 19 nt, Pseudomonas putida KT2440
uuuucgguaaucaccuuga

SEQ ID NO: 3562550 - RNA, 23 nt, Pseudomonas putida KT2440
uuuucuggugccggccucuucgc

SEQ ID NO: 3562551 - RNA, 22 nt, Pseudomonas putida KT2440
uuuucuuuacaacccagacuca

SEQ ID NO: 3562552 - RNA, 16 nt, Pseudomonas putida KT2440
uuuugaaaaaugauca

SEQ ID NO: 3562553 - RNA, 23 nt, Pseudomonas putida KT2440
uuuugcgcagcggcgucaccuuc

SEQ ID NO: 3562554 - RNA, 14 nt, Pseudomonas putida KT2440
uuuugcguggccug

SEQ ID NO: 3562555 - RNA, 13 nt, Pseudomonas putida KT2440
uuuuguccauucu

SEQ ID NO: 3562556 - RNA, 16 nt, Pseudomonas putida KT2440
uuuuguucuccagcau

SEQ ID NO: 3562557 - RNA, 20 nt, Pseudomonas putida KT2440
uuuuucauucagcuuuggcu

SEQ ID NO: 3562558 - RNA, 18 nt, Pseudomonas putida KT2440
uuuuugaaaaaaagauuu

SEQ ID NO: 3562559 - RNA, 16 nt, Pseudomonas putida KT2440
uuuuugaaaaaugauc

SEQ ID NO: 3562560 - RNA, 14 nt, Pseudomonas putida KT2440
uuuuuguccauucu

SEQ ID NO: 3562561 - RNA, 22 nt, Pseudomonas putida KT2440
aaagcgguacgccgucuuccca

SEQ ID NO: 3562562 - RNA, 21 nt, Pseudomonas putida KT2440
aaagcugcgcacauugacguc

SEQ ID NO: 3562563 - RNA, 15 nt, Pseudomonas putida KT2440
aaaggcccucagagu

SEQ ID NO: 3562564 - RNA, 24 nt, Pseudomonas putida KT2440
aaaggccgcguuagucguacuagc

SEQ ID NO: 3562565 - RNA, 14 nt, Pseudomonas putida KT2440
aaagggcaccucca

SEQ ID NO: 3562566 - RNA, 15 nt, Pseudomonas putida KT2440
aaagggcaccuccag

SEQ ID NO: 3562567 - RNA, 19 nt, Pseudomonas putida KT2440
aaagggccagcacaaccac

SEQ ID NO: 3562568 - RNA, 22 nt, Pseudomonas putida KT2440
aaagggccgcgacgcggcccug

SEQ ID NO: 3562569 - RNA, 15 nt, Pseudomonas putida KT2440
aaagggccgggccug

SEQ ID NO: 3562570 - RNA, 17 nt, Pseudomonas putida KT2440
aaaggucugcugcggcc

SEQ ID NO: 3562571 - RNA, 15 nt, Pseudomonas putida KT2440
aaagucagccagccg

SEQ ID NO: 3562572 - RNA, 22 nt, Pseudomonas putida KT2440
aaaguccaaggcggugcauucu

SEQ ID NO: 3562573 - RNA, 22 nt, Pseudomonas putida KT2440
aaaguccaucugcuucuggugg

SEQ ID NO: 3562574 - RNA, 20 nt, Pseudomonas putida KT2440
aaagucgucggcaagcuugc

SEQ ID NO: 3562575 - RNA, 21 nt, Pseudomonas putida KT2440
aaagucgucggcaagcuugcc

SEQ ID NO: 3562576 - RNA, 19 nt, Pseudomonas putida KT2440
aaagugguugacaagcaaa

SEQ ID NO: 3562577 - RNA, 14 nt, Pseudomonas putida KT2440
aaauaaucagaauu

SEQ ID NO: 3562578 - RNA, 17 nt, Pseudomonas putida KT2440
aaauacccaacuccagc

SEQ ID NO: 3562579 - RNA, 19 nt, Pseudomonas putida KT2440
aaauacgguugcagcacac

SEQ ID NO: 3562580 - RNA, 20 nt, Pseudomonas putida KT2440
aaauacucagaccaacaacu

SEQ ID NO: 3562581 - RNA, 22 nt, Pseudomonas putida KT2440
aaaucaagagcccggaagcuuc

SEQ ID NO: 3562582 - RNA, 18 nt, Pseudomonas putida KT2440
aaaucagcuguuugaagc

SEQ ID NO: 3562583 - RNA, 17 nt, Pseudomonas putida KT2440
aaaucaguaaagauuag

SEQ ID NO: 3562584 - RNA, 15 nt, Pseudomonas putida KT2440
aaaucaugcgcuggc

SEQ ID NO: 3562585 - RNA, 16 nt, Pseudomonas putida KT2440
aaauccauccaguuca

SEQ ID NO: 3562586 - RNA, 18 nt, Pseudomonas putida KT2440
aaaugaacggcuguuccu

SEQ ID NO: 3562587 - RNA, 14 nt, Pseudomonas putida KT2440
aaaugaucaagaag

SEQ ID NO: 3562588 - RNA, 16 nt, Pseudomonas putida KT2440
aaaugauccccggcga

SEQ ID NO: 3562589 - RNA, 23 nt, Pseudomonas putida KT2440
aaaugcaccacgcgcaaaugcuu

SEQ ID NO: 3562590 - RNA, 12 nt, Pseudomonas putida KT2440
aaaugcaccccu

SEQ ID NO: 3562591 - RNA, 21 nt, Pseudomonas putida KT2440
aaauguccauugagcacucaa

SEQ ID NO: 3562592 - RNA, 22 nt, Pseudomonas putida KT2440
aaauucgaccagcagugucagc

SEQ ID NO: 3562593 - RNA, 15 nt, Pseudomonas putida KT2440
aaauuggccagcagg

SEQ ID NO: 3562594 - RNA, 23 nt, Pseudomonas putida KT2440
aaauuggccagcaggucaggccc

SEQ ID NO: 3562595 - RNA, 17 nt, Pseudomonas putida KT2440
aaauuggcgagcaggcc

SEQ ID NO: 3562596 - RNA, 15 nt, Pseudomonas putida KT2440
aacaaaucggccuug

SEQ ID NO: 3562597 - RNA, 13 nt, Pseudomonas putida KT2440
aacaaccgugaau

SEQ ID NO: 3562598 - RNA, 22 nt, Pseudomonas putida KT2440
aacaacgacuggucauacucca

SEQ ID NO: 3562599 - RNA, 22 nt, Pseudomonas putida KT2440
aacaacuugguccggucacugc

SEQ ID NO: 3562600 - RNA, 20 nt, Pseudomonas putida KT2440
aacaacuugugcaucaaguc

SEQ ID NO: 3562601 - RNA, 13 nt, Pseudomonas putida KT2440
aacaagaacaaca

SEQ ID NO: 3562602 - RNA, 20 nt, Pseudomonas putida KT2440
aacaagcuggacaugcacgc

SEQ ID NO: 3562603 - RNA, 23 nt, Pseudomonas putida KT2440
aacaaggcaaaggucugcugcgg

SEQ ID NO: 3562604 - RNA, 22 nt, Pseudomonas putida KT2440
aacaaguccacgaaccugugca

SEQ ID NO: 3562605 - RNA, 17 nt, Pseudomonas putida KT2440
aacaaguucaaggucau

SEQ ID NO: 3562606 - RNA, 23 nt, Pseudomonas putida KT2440
aacaaguucaaggucaucgcugc

SEQ ID NO: 3562607 - RNA, 19 nt, Pseudomonas putida KT2440
aacaaucucggucugucaa

SEQ ID NO: 3562608 - RNA, 14 nt, Pseudomonas putida KT2440
aacaaugcacagcg

SEQ ID NO: 3562609 - RNA, 20 nt, Pseudomonas putida KT2440
aacaauuuaguauggaaaug

SEQ ID NO: 3562610 - RNA, 17 nt, Pseudomonas putida KT2440
aacacagcaggccaagg

SEQ ID NO: 3562611 - RNA, 11 nt, Pseudomonas putida KT2440
aacacauccag

SEQ ID NO: 3562612 - RNA, 17 nt, Pseudomonas putida KT2440
aacacauccucaaaggc

SEQ ID NO: 3562613 - RNA, 14 nt, Pseudomonas putida KT2440
aacaccacacuagc

SEQ ID NO: 3562614 - RNA, 13 nt, Pseudomonas putida KT2440
aacaccagcagcc

SEQ ID NO: 3562615 - RNA, 15 nt, Pseudomonas putida KT2440
aacaccaggguggga

SEQ ID NO: 3562616 - RNA, 13 nt, Pseudomonas putida KT2440
aacaccaguguca

SEQ ID NO: 3562617 - RNA, 12 nt, Pseudomonas putida KT2440
aacacccagcgc

SEQ ID NO: 3562618 - RNA, 15 nt, Pseudomonas putida KT2440
aacaccccccagcag

SEQ ID NO: 3562619 - RNA, 21 nt, Pseudomonas putida KT2440
aacaccgccagcccgccaagg

SEQ ID NO: 3562620 - RNA, 22 nt, Pseudomonas putida KT2440
aacaccgcguuaugacuggccu

SEQ ID NO: 3562621 - RNA, 21 nt, Pseudomonas putida KT2440
aacaccggccccccagccagc

SEQ ID NO: 3562622 - RNA, 21 nt, Pseudomonas putida KT2440
aacaccucuccaauccgcagc

SEQ ID NO: 3562623 - RNA, 15 nt, Pseudomonas putida KT2440
aacaccugccgcagc

SEQ ID NO: 3562624 - RNA, 16 nt, Pseudomonas putida KT2440
aacacgaaaaagccag

SEQ ID NO: 3562625 - RNA, 21 nt, Pseudomonas putida KT2440
aacacgaacaucagcaggaag

SEQ ID NO: 3562626 - RNA, 23 nt, Pseudomonas putida KT2440
aacacgacgauggccaccagcac

SEQ ID NO: 3562627 - RNA, 18 nt, Pseudomonas putida KT2440
aacacgcucaugaacagc

SEQ ID NO: 3562628 - RNA, 21 nt, Pseudomonas putida KT2440
aacacgggcgaagcccgugcc

SEQ ID NO: 3562629 - RNA, 15 nt, Pseudomonas putida KT2440
aacacggugaugcgc

SEQ ID NO: 3562630 - RNA, 20 nt, Pseudomonas putida KT2440
aacacgucggcuggcagcuu

SEQ ID NO: 3562631 - RNA, 16 nt, Pseudomonas putida KT2440
aacacuggcaggcuca

SEQ ID NO: 3562632 - RNA, 15 nt, Pseudomonas putida KT2440
aacacuuccgggcug

SEQ ID NO: 3562633 - RNA, 18 nt, Pseudomonas putida KT2440
aacacuuggcagccucga

SEQ ID NO: 3562634 - RNA, 13 nt, Pseudomonas putida KT2440
aacagacaacauc

SEQ ID NO: 3562635 - RNA, 14 nt, Pseudomonas putida KT2440
aacagaggccucaa

SEQ ID NO: 3562636 - RNA, 11 nt, Pseudomonas putida KT2440
aacagcaccag

SEQ ID NO: 3562637 - RNA, 17 nt, Pseudomonas putida KT2440
aacagcacccgcccauc

SEQ ID NO: 3562638 - RNA, 15 nt, Pseudomonas putida KT2440
aacagcaccggccag

SEQ ID NO: 3562639 - RNA, 16 nt, Pseudomonas putida KT2440
aacagcaccggccagg

SEQ ID NO: 3562640 - RNA, 17 nt, Pseudomonas putida KT2440
aacagcaccggccaggc

SEQ ID NO: 3562641 - RNA, 13 nt, Pseudomonas putida KT2440
aacagcagcgccg

SEQ ID NO: 3562642 - RNA, 22 nt, Pseudomonas putida KT2440
aacagcaggcaaagaaugccgc

SEQ ID NO: 3562643 - RNA, 15 nt, Pseudomonas putida KT2440
aacagcaguugcugc

SEQ ID NO: 3562644 - RNA, 19 nt, Pseudomonas putida KT2440
aacagcaguugcugcugcc

SEQ ID NO: 3562645 - RNA, 20 nt, Pseudomonas putida KT2440
aacagcaguuugcugcgcug

SEQ ID NO: 3562646 - RNA, 18 nt, Pseudomonas putida KT2440
aacagcauccaaagccaa

SEQ ID NO: 3562647 - RNA, 11 nt, Pseudomonas putida KT2440
aacagcaugau

SEQ ID NO: 3562648 - RNA, 12 nt, Pseudomonas putida KT2440
aacagccacagc

SEQ ID NO: 3562649 - RNA, 13 nt, Pseudomonas putida KT2440
aacagccacagcu

SEQ ID NO: 3562650 - RNA, 14 nt, Pseudomonas putida KT2440
aacagccacagcug

SEQ ID NO: 3562651 - RNA, 21 nt, Pseudomonas putida KT2440
aacagccccaucaccagcccg

SEQ ID NO: 3562652 - RNA, 20 nt, Pseudomonas putida KT2440
aacagccgcgcaugcugugc

SEQ ID NO: 3562653 - RNA, 21 nt, Pseudomonas putida KT2440
aacagccgcgcaugcugugcc

SEQ ID NO: 3562654 - RNA, 23 nt, Pseudomonas putida KT2440
aacagccuaagguugcuccugca

SEQ ID NO: 3562655 - RNA, 16 nt, Pseudomonas putida KT2440
aacagccuugucucaa

SEQ ID NO: 3562656 - RNA, 19 nt, Pseudomonas putida KT2440
aacagcgcccagaucagca

SEQ ID NO: 3562657 - RNA, 21 nt, Pseudomonas putida KT2440
aacagcgcccagaucagcagc

SEQ ID NO: 3562658 - RNA, 20 nt, Pseudomonas putida KT2440
aacagcgcgacgcagcagcg

SEQ ID NO: 3562659 - RNA, 23 nt, Pseudomonas putida KT2440
aacagcgcugcgaggccccagac

SEQ ID NO: 3562660 - RNA, 11 nt, Pseudomonas putida KT2440
aacagcggcag

SEQ ID NO: 3562661 - RNA, 14 nt, Pseudomonas putida KT2440
aacagcggcagcaa

SEQ ID NO: 3562662 - RNA, 19 nt, Pseudomonas putida KT2440
aacagcuccagcaacugcg

SEQ ID NO: 3562663 - RNA, 14 nt, Pseudomonas putida KT2440
aacagcuccagcag

SEQ ID NO: 3562664 - RNA, 18 nt, Pseudomonas putida KT2440
aacagcucgauggccagg

SEQ ID NO: 3562665 - RNA, 14 nt, Pseudomonas putida KT2440
aacagcugaucgcc

SEQ ID NO: 3562666 - RNA, 21 nt, Pseudomonas putida KT2440
aaccuccggcaucauccugcu

SEQ ID NO: 3562667 - RNA, 21 nt, Pseudomonas putida KT2440
aaccucgagguacgagucagc

SEQ ID NO: 3562668 - RNA, 17 nt, Pseudomonas putida KT2440
aaccucugcaugccagu

SEQ ID NO: 3562669 - RNA, 14 nt, Pseudomonas putida KT2440
aaccugacaagcga

SEQ ID NO: 3562670 - RNA, 16 nt, Pseudomonas putida KT2440
aaccugacccgcgccu

SEQ ID NO: 3562671 - RNA, 19 nt, Pseudomonas putida KT2440
aaccugacccgcgccucga

SEQ ID NO: 3562672 - RNA, 17 nt, Pseudomonas putida KT2440
aaccugccaugcagguc

SEQ ID NO: 3562673 - RNA, 19 nt, Pseudomonas putida KT2440
aaccugcgcuugcaccagg

SEQ ID NO: 3562674 - RNA, 22 nt, Pseudomonas putida KT2440
aaccugguuguagcccgggcag

SEQ ID NO: 3562675 - RNA, 17 nt, Pseudomonas putida KT2440
aaccugugaagccaggg

SEQ ID NO: 3562676 - RNA, 13 nt, Pseudomonas putida KT2440
aaccuguuccagc

SEQ ID NO: 3562677 - RNA, 15 nt, Pseudomonas putida KT2440
aaccuguugaagcga

SEQ ID NO: 3562678 - RNA, 13 nt, Pseudomonas putida KT2440
aaccuuccagcaa

SEQ ID NO: 3562679 - RNA, 16 nt, Pseudomonas putida KT2440
aaccuugaccaccagg

SEQ ID NO: 3562680 - RNA, 22 nt, Pseudomonas putida KT2440
aacgaaaaaaagggcaccucca

SEQ ID NO: 3562681 - RNA, 23 nt, Pseudomonas putida KT2440
aacgaaaaaaagggcaccuccag

SEQ ID NO: 3562682 - RNA, 15 nt, Pseudomonas putida KT2440
aacgaaaucugccug

SEQ ID NO: 3562683 - RNA, 17 nt, Pseudomonas putida KT2440
aacgaaaucugccugcu

SEQ ID NO: 3562684 - RNA, 12 nt, Pseudomonas putida KT2440
aacgaacggaac

SEQ ID NO: 3562685 - RNA, 13 nt, Pseudomonas putida KT2440
aacgacaaacucc

SEQ ID NO: 3562686 - RNA, 12 nt, Pseudomonas putida KT2440
aacgacaaggua

SEQ ID NO: 3562687 - RNA, 13 nt, Pseudomonas putida KT2440
aacgacagcugca

SEQ ID NO: 3562688 - RNA, 17 nt, Pseudomonas putida KT2440
aacgacagcuuguugcc

SEQ ID NO: 3562689 - RNA, 20 nt, Pseudomonas putida KT2440
aacgacuuguaauugaaguu

SEQ ID NO: 3562690 - RNA, 22 nt, Pseudomonas putida KT2440
aacgagguggucgaggcaaaga

SEQ ID NO: 3562691 - RNA, 21 nt, Pseudomonas putida KT2440
aacgaucagcgccgaaccagc

SEQ ID NO: 3562692 - RNA, 18 nt, Pseudomonas putida KT2440
aacgaugcccgggccuuc

SEQ ID NO: 3562693 - RNA, 17 nt, Pseudomonas putida KT2440
aacgauucugccagcuc

SEQ ID NO: 3562694 - RNA, 17 nt, Pseudomonas putida KT2440
aacgauuggcaguccug

SEQ ID NO: 3562695 - RNA, 15 nt, Pseudomonas putida KT2440
aacgcaacaaccccg

SEQ ID NO: 3562696 - RNA, 19 nt, Pseudomonas putida KT2440
aacgcaaugggcacaauug

SEQ ID NO: 3562697 - RNA, 13 nt, Pseudomonas putida KT2440
aacgcagccggca

SEQ ID NO: 3562698 - RNA, 23 nt, Pseudomonas putida KT2440
aacgcauggcguuguccagcagg

SEQ ID NO: 3562699 - RNA, 12 nt, Pseudomonas putida KT2440
aacgccacgccc

SEQ ID NO: 3562700 - RNA, 18 nt, Pseudomonas putida KT2440
aacgccagcuguucgguc

SEQ ID NO: 3562701 - RNA, 21 nt, Pseudomonas putida KT2440
aacgccaggcacccagccagc

SEQ ID NO: 3562702 - RNA, 21 nt, Pseudomonas putida KT2440
aacgccccacccgcucaaagc

SEQ ID NO: 3562703 - RNA, 13 nt, Pseudomonas putida KT2440
aacgccccagcag

SEQ ID NO: 3562704 - RNA, 22 nt, Pseudomonas putida KT2440
aacgccccagcaguucgcgcac

SEQ ID NO: 3562705 - RNA, 15 nt, Pseudomonas putida KT2440
aacgcccccagcccg

SEQ ID NO: 3562706 - RNA, 18 nt, Pseudomonas putida KT2440
aacgcccccagcccggcg

SEQ ID NO: 3562707 - RNA, 18 nt, Pseudomonas putida KT2440
aacgccccgacugguucg

SEQ ID NO: 3562708 - RNA, 17 nt, Pseudomonas putida KT2440
aacgcccgaccuuggcg

SEQ ID NO: 3562709 - RNA, 19 nt, Pseudomonas putida KT2440
aacgcccgaccuuggcgac

SEQ ID NO: 3562710 - RNA, 20 nt, Pseudomonas putida KT2440
aacgcccgcaacaaccuggc

SEQ ID NO: 3562711 - RNA, 11 nt, Pseudomonas putida KT2440
aacgcccuuca

SEQ ID NO: 3562712 - RNA, 21 nt, Pseudomonas putida KT2440
aacgcccuucauacagcgccu

SEQ ID NO: 3562713 - RNA, 23 nt, Pseudomonas putida KT2440
aacgcccuugucgguggugauca

SEQ ID NO: 3562714 - RNA, 16 nt, Pseudomonas putida KT2440
aacgccgagcauuaca

SEQ ID NO: 3562715 - RNA, 21 nt, Pseudomonas putida KT2440
aacgccgagcauuacaggcag

SEQ ID NO: 3562716 - RNA, 13 nt, Pseudomonas putida KT2440
aacgccgccagcg

SEQ ID NO: 3562717 - RNA, 15 nt, Pseudomonas putida KT2440
aacgccgccagcggc

SEQ ID NO: 3562718 - RNA, 20 nt, Pseudomonas putida KT2440
aacgccgggagggcuuugcc

SEQ ID NO: 3562719 - RNA, 16 nt, Pseudomonas putida KT2440
aacgccuucaggcgaa

SEQ ID NO: 3562720 - RNA, 13 nt, Pseudomonas putida KT2440
aacgccuuggccu

SEQ ID NO: 3562721 - RNA, 19 nt, Pseudomonas putida KT2440
aacgcgauacccaauaaaa

SEQ ID NO: 3562722 - RNA, 13 nt, Pseudomonas putida KT2440
aacgcgccgcugc

SEQ ID NO: 3562723 - RNA, 15 nt, Pseudomonas putida KT2440
aacgcggcccugggu

SEQ ID NO: 3562724 - RNA, 21 nt, Pseudomonas putida KT2440
aacgcgggcaauguccaggug

SEQ ID NO: 3562725 - RNA, 19 nt, Pseudomonas putida KT2440
aacgcgguggcuggcaccg

SEQ ID NO: 3562726 - RNA, 14 nt, Pseudomonas putida KT2440
aacgcugccuugcc

SEQ ID NO: 3562727 - RNA, 20 nt, Pseudomonas putida KT2440
aacgcuguuggcagccacga

SEQ ID NO: 3562728 - RNA, 19 nt, Pseudomonas putida KT2440
aacgcuugcccggcuccag

SEQ ID NO: 3562729 - RNA, 21 nt, Pseudomonas putida KT2440
aacggaaauaccggggcaccu

SEQ ID NO: 3562730 - RNA, 18 nt, Pseudomonas putida KT2440
aacggacgucccagcagg

SEQ ID NO: 3562731 - RNA, 16 nt, Pseudomonas putida KT2440
aacggcagcaggccaa

SEQ ID NO: 3562732 - RNA, 13 nt, Pseudomonas putida KT2440
aacggcgcaucca

SEQ ID NO: 3562733 - RNA, 15 nt, Pseudomonas putida KT2440
aacggcggcccggcc

SEQ ID NO: 3562734 - RNA, 22 nt, Pseudomonas putida KT2440
aacggcggcccggccaacaacg

SEQ ID NO: 3562735 - RNA, 15 nt, Pseudomonas putida KT2440
aacggcuaccagcag

SEQ ID NO: 3562736 - RNA, 23 nt, Pseudomonas putida KT2440
aacggcuaccccgaugcgcugau

SEQ ID NO: 3562737 - RNA, 14 nt, Pseudomonas putida KT2440
aacggcuggcgcau

SEQ ID NO: 3562738 - RNA, 23 nt, Pseudomonas putida KT2440
aacggcuguuccucgccauggcc

SEQ ID NO: 3562739 - RNA, 12 nt, Pseudomonas putida KT2440
aacggcuucaca

SEQ ID NO: 3562740 - RNA, 20 nt, Pseudomonas putida KT2440
aacggcuugaacccgugcau

SEQ ID NO: 3562741 - RNA, 21 nt, Pseudomonas putida KT2440
aacgguaacguggacagcagc

SEQ ID NO: 3562742 - RNA, 18 nt, Pseudomonas putida KT2440
aacggugcugccgaggcg

SEQ ID NO: 3562743 - RNA, 16 nt, Pseudomonas putida KT2440
aacgguggccagcagc

SEQ ID NO: 3562744 - RNA, 18 nt, Pseudomonas putida KT2440
aacgucgccacgcgggcu

SEQ ID NO: 3562745 - RNA, 15 nt, Pseudomonas putida KT2440
aacguuuccagcaac

SEQ ID NO: 3562746 - RNA, 16 nt, Pseudomonas putida KT2440
aacuaaaccggugaag

SEQ ID NO: 3562747 - RNA, 21 nt, Pseudomonas putida KT2440
aacuaaaccggugaagcggaa

SEQ ID NO: 3562748 - RNA, 21 nt, Pseudomonas putida KT2440
aacuauccuacgcgccaguca

SEQ ID NO: 3562749 - RNA, 15 nt, Pseudomonas putida KT2440
aacucaacgcaacug

SEQ ID NO: 3562750 - RNA, 20 nt, Pseudomonas putida KT2440
aacucaccacaucggcggca

SEQ ID NO: 3562751 - RNA, 20 nt, Pseudomonas putida KT2440
aacucaccugguuugaggaa

SEQ ID NO: 3562752 - RNA, 11 nt, Pseudomonas putida KT2440
aacucacgcgc

SEQ ID NO: 3562753 - RNA, 17 nt, Pseudomonas putida KT2440
aacucacgcgccagggu

SEQ ID NO: 3562754 - RNA, 15 nt, Pseudomonas putida KT2440
aacuccaccagccca

SEQ ID NO: 3562755 - RNA, 18 nt, Pseudomonas putida KT2440
aacuccaccaucaaguca

SEQ ID NO: 3562756 - RNA, 21 nt, Pseudomonas putida KT2440
aacuccucgaucaccugcggc

SEQ ID NO: 3562757 - RNA, 17 nt, Pseudomonas putida KT2440
aacuccugcguacccag

SEQ ID NO: 3562758 - RNA, 16 nt, Pseudomonas putida KT2440
aacucgcgcauccagc

SEQ ID NO: 3562759 - RNA, 13 nt, Pseudomonas putida KT2440
aacucgucgcugg

SEQ ID NO: 3562760 - RNA, 15 nt, Pseudomonas putida KT2440
aacucguucagugcc

SEQ ID NO: 3562761 - RNA, 15 nt, Pseudomonas putida KT2440
aacucguugaccacg

SEQ ID NO: 3562762 - RNA, 12 nt, Pseudomonas putida KT2440
aacucuccuugc

SEQ ID NO: 3562763 - RNA, 16 nt, Pseudomonas putida KT2440
aacucuccuugcguug

SEQ ID NO: 3562764 - RNA, 18 nt, Pseudomonas putida KT2440
aacucuggcaacagcuca

SEQ ID NO: 3562765 - RNA, 19 nt, Pseudomonas putida KT2440
aacugaauggcuggugaag

SEQ ID NO: 3562766 - RNA, 13 nt, Pseudomonas putida KT2440
aacugaucagcuu

SEQ ID NO: 3562767 - RNA, 23 nt, Pseudomonas putida KT2440
aacugccaauugcggacucauag

SEQ ID NO: 3562768 - RNA, 21 nt, Pseudomonas putida KT2440
aacugccacgcccgcugcaug

SEQ ID NO: 3562769 - RNA, 13 nt, Pseudomonas putida KT2440
aacugccaggcug

SEQ ID NO: 3562770 - RNA, 14 nt, Pseudomonas putida KT2440
aacugccaggcugg

SEQ ID NO: 3562771 - RNA, 12 nt, Pseudomonas putida KT2440
aacugcccagga

SEQ ID NO: 3562772 - RNA, 17 nt, Pseudomonas putida KT2440
aagccgacaaaaacaac

SEQ ID NO: 3562773 - RNA, 21 nt, Pseudomonas putida KT2440
aagccgccacaugaaggccgu

SEQ ID NO: 3562774 - RNA, 23 nt, Pseudomonas putida KT2440
aagccgcucaccccauagggcca

SEQ ID NO: 3562775 - RNA, 16 nt, Pseudomonas putida KT2440
aagccgcugccacagg

SEQ ID NO: 3562776 - RNA, 21 nt, Pseudomonas putida KT2440
aagccggcgcucagcgggcgu

SEQ ID NO: 3562777 - RNA, 22 nt, Pseudomonas putida KT2440
aagccggcuuugcgucaucauc

SEQ ID NO: 3562778 - RNA, 18 nt, Pseudomonas putida KT2440
aagccguaaagcacacaa

SEQ ID NO: 3562779 - RNA, 20 nt, Pseudomonas putida KT2440
aagccuaaucgggcagaugc

SEQ ID NO: 3562780 - RNA, 18 nt, Pseudomonas putida KT2440
aagccucagcgcccgcug

SEQ ID NO: 3562781 - RNA, 16 nt, Pseudomonas putida KT2440
aagccugccagguccg

SEQ ID NO: 3562782 - RNA, 17 nt, Pseudomonas putida KT2440
aagccugccguuucaug

SEQ ID NO: 3562783 - RNA, 16 nt, Pseudomonas putida KT2440
aagccugcuccagcac

SEQ ID NO: 3562784 - RNA, 23 nt, Pseudomonas putida KT2440
aagccuucgucgcuggccagcuu

SEQ ID NO: 3562785 - RNA, 15 nt, Pseudomonas putida KT2440
aagccuugcugauca

SEQ ID NO: 3562786 - RNA, 20 nt, Pseudomonas putida KT2440
aagccuugcugaucagguug

SEQ ID NO: 3562787 - RNA, 14 nt, Pseudomonas putida KT2440
aagcgaaagcuuuc

SEQ ID NO: 3562788 - RNA, 13 nt, Pseudomonas putida KT2440
aagcgacagcggc

SEQ ID NO: 3562789 - RNA, 22 nt, Pseudomonas putida KT2440
aagcgacgugcaaggaucacca

SEQ ID NO: 3562790 - RNA, 19 nt, Pseudomonas putida KT2440
aagcgagguaggccgucag

SEQ ID NO: 3562791 - RNA, 17 nt, Pseudomonas putida KT2440
aagcgcaaaaccaccag

SEQ ID NO: 3562792 - RNA, 17 nt, Pseudomonas putida KT2440
aagcgcaaucaaagcag

SEQ ID NO: 3562793 - RNA, 19 nt, Pseudomonas putida KT2440
aagcgcauugaucgccgcc

SEQ ID NO: 3562794 - RNA, 16 nt, Pseudomonas putida KT2440
aagcgccagggcaucg

SEQ ID NO: 3562795 - RNA, 21 nt, Pseudomonas putida KT2440
aagcgccagggcaucgaccag

SEQ ID NO: 3562796 - RNA, 19 nt, Pseudomonas putida KT2440
aagcgccgcagguccaccu

SEQ ID NO: 3562797 - RNA, 14 nt, Pseudomonas putida KT2440
aagcgcgccuccag

SEQ ID NO: 3562798 - RNA, 20 nt, Pseudomonas putida KT2440
aagcgcgccuccagcugaaa

SEQ ID NO: 3562799 - RNA, 16 nt, Pseudomonas putida KT2440
aagcgcgcgcccaccg

SEQ ID NO: 3562800 - RNA, 15 nt, Pseudomonas putida KT2440
aagcgcuccgccaau

SEQ ID NO: 3562801 - RNA, 19 nt, Pseudomonas putida KT2440
aagcgcugacugccaggcc

SEQ ID NO: 3562802 - RNA, 19 nt, Pseudomonas putida KT2440
aagcggaaguucacacuca

SEQ ID NO: 3562803 - RNA, 17 nt, Pseudomonas putida KT2440
aagcggaucggccggcg

SEQ ID NO: 3562804 - RNA, 15 nt, Pseudomonas putida KT2440
aagcggaugagccuu

SEQ ID NO: 3562805 - RNA, 16 nt, Pseudomonas putida KT2440
aagcggauuucgccac

SEQ ID NO: 3562806 - RNA, 22 nt, Pseudomonas putida KT2440
aagcggcacuaccaggcccaac

SEQ ID NO: 3562807 - RNA, 17 nt, Pseudomonas putida KT2440
aagcggccaccugcccc

SEQ ID NO: 3562808 - RNA, 20 nt, Pseudomonas putida KT2440
aagcggccaccugccccagc

SEQ ID NO: 3562809 - RNA, 14 nt, Pseudomonas putida KT2440
aagcggccuaguuc

SEQ ID NO: 3562810 - RNA, 20 nt, Pseudomonas putida KT2440
aagcggcucgucaaccacag

SEQ ID NO: 3562811 - RNA, 21 nt, Pseudomonas putida KT2440
aagcggcucgucaaccacagc

SEQ ID NO: 3562812 - RNA, 21 nt, Pseudomonas putida KT2440
aagcgggcagugcaauaccag

SEQ ID NO: 3562813 - RNA, 17 nt, Pseudomonas putida KT2440
aagcgggccaaggucau

SEQ ID NO: 3562814 - RNA, 17 nt, Pseudomonas putida KT2440
aagcggucgaaaagccg

SEQ ID NO: 3562815 - RNA, 19 nt, Pseudomonas putida KT2440
aagcggucguuacccaggu

SEQ ID NO: 3562816 - RNA, 18 nt, Pseudomonas putida KT2440
aagcgucuggacccacgg

SEQ ID NO: 3562817 - RNA, 19 nt, Pseudomonas putida KT2440
aagcgucuggacccacgga

SEQ ID NO: 3562818 - RNA, 21 nt, Pseudomonas putida KT2440
aagcguucgcccuccugcagc

SEQ ID NO: 3562819 - RNA, 17 nt, Pseudomonas putida KT2440
aagcuaacccggucucg

SEQ ID NO: 3562820 - RNA, 16 nt, Pseudomonas putida KT2440
aagcuaucgccagcag

SEQ ID NO: 3562821 - RNA, 21 nt, Pseudomonas putida KT2440
aagcuaucgccagcaggccgc

SEQ ID NO: 3562822 - RNA, 21 nt, Pseudomonas putida KT2440
aagcucaucaccaggcccgca

SEQ ID NO: 3562823 - RNA, 20 nt, Pseudomonas putida KT2440
aagcugcgcacauugacguc

SEQ ID NO: 3562824 - RNA, 13 nt, Pseudomonas putida KT2440
aagcugcugauaa

SEQ ID NO: 3562825 - RNA, 16 nt, Pseudomonas putida KT2440
aagcuggagucguugc

SEQ ID NO: 3562826 - RNA, 20 nt, Pseudomonas putida KT2440
aagcuggcgcaagccgugcc

SEQ ID NO: 3562827 - RNA, 19 nt, Pseudomonas putida KT2440
aagcugggaauccagugca

SEQ ID NO: 3562828 - RNA, 13 nt, Pseudomonas putida KT2440
aagcuggucaggu

SEQ ID NO: 3562829 - RNA, 15 nt, Pseudomonas putida KT2440
aagcuggucaggugc

SEQ ID NO: 3562830 - RNA, 15 nt, Pseudomonas putida KT2440
aagcuguacagcgca

SEQ ID NO: 3562831 - RNA, 14 nt, Pseudomonas putida KT2440
aagcuguagucacc

SEQ ID NO: 3562832 - RNA, 22 nt, Pseudomonas putida KT2440
aagcuuccaguuggccggcaug

SEQ ID NO: 3562833 - RNA, 20 nt, Pseudomonas putida KT2440
aaggaacugcgcugccccaa

SEQ ID NO: 3562834 - RNA, 13 nt, Pseudomonas putida KT2440
aaggaccucaagu

SEQ ID NO: 3562835 - RNA, 21 nt, Pseudomonas putida KT2440
aaggaucagcucggcaacgau

SEQ ID NO: 3562836 - RNA, 19 nt, Pseudomonas putida KT2440
aaggcaaagaagucgccac

SEQ ID NO: 3562837 - RNA, 22 nt, Pseudomonas putida KT2440
aaggcaaucgugaucaucccca

SEQ ID NO: 3562838 - RNA, 12 nt, Pseudomonas putida KT2440
aaggcaccaacu

SEQ ID NO: 3562839 - RNA, 15 nt, Pseudomonas putida KT2440
aaggcaccaacugca

SEQ ID NO: 3562840 - RNA, 17 nt, Pseudomonas putida KT2440
aaggcaccacggaaggc

SEQ ID NO: 3562841 - RNA, 20 nt, Pseudomonas putida KT2440
aaggcauccacaccguacug

SEQ ID NO: 3562842 - RNA, 22 nt, Pseudomonas putida KT2440
aaggcauccacaccguacugcu

SEQ ID NO: 3562843 - RNA, 23 nt, Pseudomonas putida KT2440
aaggcauccagcucggcaaggcg

SEQ ID NO: 3562844 - RNA, 17 nt, Pseudomonas putida KT2440
aaggcaucgggcaaggc

SEQ ID NO: 3562845 - RNA, 20 nt, Pseudomonas putida KT2440
aaggcaucguuguaagccau

SEQ ID NO: 3562846 - RNA, 21 nt, Pseudomonas putida KT2440
aaggccaaccacgccugcgcc

SEQ ID NO: 3562847 - RNA, 15 nt, Pseudomonas putida KT2440
aaggccaacugcgcc

SEQ ID NO: 3562848 - RNA, 19 nt, Pseudomonas putida KT2440
aaggccagccgagccaagc

SEQ ID NO: 3562849 - RNA, 13 nt, Pseudomonas putida KT2440
aaggccagcgccu

SEQ ID NO: 3562850 - RNA, 18 nt, Pseudomonas putida KT2440
aaggccagcggaaucacc

SEQ ID NO: 3562851 - RNA, 19 nt, Pseudomonas putida KT2440
aaggccaggaacagcgcag

SEQ ID NO: 3562852 - RNA, 22 nt, Pseudomonas putida KT2440
aaggccagugccgcaagcaguc

SEQ ID NO: 3562853 - RNA, 20 nt, Pseudomonas putida KT2440
aaggcccaguucggacaggc

SEQ ID NO: 3562854 - RNA, 22 nt, Pseudomonas putida KT2440
aaggcccaguucggacaggcgc

SEQ ID NO: 3562855 - RNA, 16 nt, Pseudomonas putida KT2440
aaggcccgcgccgaca

SEQ ID NO: 3562856 - RNA, 15 nt, Pseudomonas putida KT2440
aaggcccgugguugg

SEQ ID NO: 3562857 - RNA, 11 nt, Pseudomonas putida KT2440
aaggcccugca

SEQ ID NO: 3562858 - RNA, 21 nt, Pseudomonas putida KT2440
aaggcccugcauaugcagggc

SEQ ID NO: 3562859 - RNA, 14 nt, Pseudomonas putida KT2440
aaggccgccaccuc

SEQ ID NO: 3562860 - RNA, 19 nt, Pseudomonas putida KT2440
aaggccgccggcaacuggc

SEQ ID NO: 3562861 - RNA, 18 nt, Pseudomonas putida KT2440
aaggccgcucccacgagg

SEQ ID NO: 3562862 - RNA, 17 nt, Pseudomonas putida KT2440
aaggccggcagccaggg

SEQ ID NO: 3562863 - RNA, 18 nt, Pseudomonas putida KT2440
aaggccggcagccagggc

SEQ ID NO: 3562864 - RNA, 16 nt, Pseudomonas putida KT2440
aaggccguggcaaggc

SEQ ID NO: 3562865 - RNA, 19 nt, Pseudomonas putida KT2440
aaggccguucccacaaagu

SEQ ID NO: 3562866 - RNA, 18 nt, Pseudomonas putida KT2440
aaggccucacgcaucugc

SEQ ID NO: 3562867 - RNA, 20 nt, Pseudomonas putida KT2440
aaggccucuaccgcugcucc

SEQ ID NO: 3562868 - RNA, 12 nt, Pseudomonas putida KT2440
aaggccuuggcc

SEQ ID NO: 3562869 - RNA, 13 nt, Pseudomonas putida KT2440
aaggcgaaugaga

SEQ ID NO: 3562870 - RNA, 14 nt, Pseudomonas putida KT2440
aaggcgacuccuga

SEQ ID NO: 3562871 - RNA, 15 nt, Pseudomonas putida KT2440
aaggcguaccggcaa

SEQ ID NO: 3562872 - RNA, 18 nt, Pseudomonas putida KT2440
aaggcguaccugcccccc

SEQ ID NO: 3562873 - RNA, 17 nt, Pseudomonas putida KT2440
aaggcgucguacaggcc

SEQ ID NO: 3562874 - RNA, 16 nt, Pseudomonas putida KT2440
aaggcuagcagcauca

SEQ ID NO: 3562875 - RNA, 16 nt, Pseudomonas putida KT2440
aaggcuagccacggcg

SEQ ID NO: 3562876 - RNA, 20 nt, Pseudomonas putida KT2440
aaggcucaggccuugccgcu

SEQ ID NO: 3562877 - RNA, 15 nt, Pseudomonas putida KT2440
aauacacccacaccu

SEQ ID NO: 3562878 - RNA, 22 nt, Pseudomonas putida KT2440
aauacacccacaccucgacccg

SEQ ID NO: 3562879 - RNA, 15 nt, Pseudomonas putida KT2440
aauacauacaccaac

SEQ ID NO: 3562880 - RNA, 18 nt, Pseudomonas putida KT2440
aauaccaccucacacugg

SEQ ID NO: 3562881 - RNA, 23 nt, Pseudomonas putida KT2440
aauaccaguaaagcuuucauuuu

SEQ ID NO: 3562882 - RNA, 23 nt, Pseudomonas putida KT2440
aauaccggugccccgguccagca

SEQ ID NO: 3562883 - RNA, 17 nt, Pseudomonas putida KT2440
aauacgcuggaucacca

SEQ ID NO: 3562884 - RNA, 16 nt, Pseudomonas putida KT2440
aauacgguagcggcag

SEQ ID NO: 3562885 - RNA, 18 nt, Pseudomonas putida KT2440
aauacucagaccaacaac

SEQ ID NO: 3562886 - RNA, 13 nt, Pseudomonas putida KT2440
aauagcaacacau

SEQ ID NO: 3562887 - RNA, 18 nt, Pseudomonas putida KT2440
aauagcaucgcuagaaaa

SEQ ID NO: 3562888 - RNA, 23 nt, Pseudomonas putida KT2440
aauagcccaccgucaggcucagc

SEQ ID NO: 3562889 - RNA, 17 nt, Pseudomonas putida KT2440
aauagcgcacugagcaa

SEQ ID NO: 3562890 - RNA, 14 nt, Pseudomonas putida KT2440
aauagcgcuuucug

SEQ ID NO: 3562891 - RNA, 16 nt, Pseudomonas putida KT2440
aauagcgcuuucuggu

SEQ ID NO: 3562892 - RNA, 11 nt, Pseudomonas putida KT2440
aauagcggcca

SEQ ID NO: 3562893 - RNA, 21 nt, Pseudomonas putida KT2440
aauagcggcgguucuucaacu

SEQ ID NO: 3562894 - RNA, 22 nt, Pseudomonas putida KT2440
aauagcuccugauccaccucuc

SEQ ID NO: 3562895 - RNA, 22 nt, Pseudomonas putida KT2440
aauaggccggucccaauaauaa

SEQ ID NO: 3562896 - RNA, 22 nt, Pseudomonas putida KT2440
aauagucgaaggcuucguggaa

SEQ ID NO: 3562897 - RNA, 17 nt, Pseudomonas putida KT2440
aauagugcuucuggaua

SEQ ID NO: 3562898 - RNA, 13 nt, Pseudomonas putida KT2440
aauaugcagugcc

SEQ ID NO: 3562899 - RNA, 14 nt, Pseudomonas putida KT2440
aauaugcucuuucc

SEQ ID NO: 3562900 - RNA, 19 nt, Pseudomonas putida KT2440
aaucaccugcacaucggcc

SEQ ID NO: 3562901 - RNA, 13 nt, Pseudomonas putida KT2440
aaucagcaaaccg

SEQ ID NO: 3562902 - RNA, 20 nt, Pseudomonas putida KT2440
aaucagcaucagugcaggug

SEQ ID NO: 3562903 - RNA, 11 nt, Pseudomonas putida KT2440
aaucagccuuc

SEQ ID NO: 3562904 - RNA, 13 nt, Pseudomonas putida KT2440
aaucagccuucag

SEQ ID NO: 3562905 - RNA, 22 nt, Pseudomonas putida KT2440
aaucagccuucagugcuucaca

SEQ ID NO: 3562906 - RNA, 15 nt, Pseudomonas putida KT2440
aaucagcggcaggcu

SEQ ID NO: 3562907 - RNA, 16 nt, Pseudomonas putida KT2440
aaucagcggcaggcug

SEQ ID NO: 3562908 - RNA, 15 nt, Pseudomonas putida KT2440
aaucagcucgucagc

SEQ ID NO: 3562909 - RNA, 16 nt, Pseudomonas putida KT2440
aaucagcucgucagcc

SEQ ID NO: 3562910 - RNA, 20 nt, Pseudomonas putida KT2440
aaucagcucgucagccacca

SEQ ID NO: 3562911 - RNA, 15 nt, Pseudomonas putida KT2440
aaucagcuguuugaa

SEQ ID NO: 3562912 - RNA, 19 nt, Pseudomonas putida KT2440
aaucagggauacugcugaa

SEQ ID NO: 3562913 - RNA, 18 nt, Pseudomonas putida KT2440
aaucagguucagggcaau

SEQ ID NO: 3562914 - RNA, 21 nt, Pseudomonas putida KT2440
aaucauaucgaaccagcagca

SEQ ID NO: 3562915 - RNA, 13 nt, Pseudomonas putida KT2440
aaucaucgccagc

SEQ ID NO: 3562916 - RNA, 17 nt, Pseudomonas putida KT2440
aaucaucgccagcagcg

SEQ ID NO: 3562917 - RNA, 13 nt, Pseudomonas putida KT2440
aauccaaucucca

SEQ ID NO: 3562918 - RNA, 15 nt, Pseudomonas putida KT2440
aauccaccagcucac

SEQ ID NO: 3562919 - RNA, 14 nt, Pseudomonas putida KT2440
aauccagcccucaa

SEQ ID NO: 3562920 - RNA, 15 nt, Pseudomonas putida KT2440
aauccccaaccaugc

SEQ ID NO: 3562921 - RNA, 18 nt, Pseudomonas putida KT2440
aauccccaaccaugcugg

SEQ ID NO: 3562922 - RNA, 18 nt, Pseudomonas putida KT2440
aaucccgccccaaaggaa

SEQ ID NO: 3562923 - RNA, 17 nt, Pseudomonas putida KT2440
aaucccggucaccucgc

SEQ ID NO: 3562924 - RNA, 14 nt, Pseudomonas putida KT2440
aauccgccuggccg

SEQ ID NO: 3562925 - RNA, 19 nt, Pseudomonas putida KT2440
aauccgcuguucaggugug

SEQ ID NO: 3562926 - RNA, 24 nt, Pseudomonas putida KT2440
aauccguuccuucgaccagaacag

SEQ ID NO: 3562927 - RNA, 20 nt, Pseudomonas putida KT2440
aauccuccugcgcaugcaac

SEQ ID NO: 3562928 - RNA, 12 nt, Pseudomonas putida KT2440
aauccugcugag

SEQ ID NO: 3562929 - RNA, 20 nt, Pseudomonas putida KT2440
aaucgaaggcauagcgguac

SEQ ID NO: 3562930 - RNA, 14 nt, Pseudomonas putida KT2440
aaucgacccaccua

SEQ ID NO: 3562931 - RNA, 18 nt, Pseudomonas putida KT2440
aaucgaccugcaggcccu

SEQ ID NO: 3562932 - RNA, 21 nt, Pseudomonas putida KT2440
aaucgauaccuggguccaggc

SEQ ID NO: 3562933 - RNA, 15 nt, Pseudomonas putida KT2440
aaucgaucugcucgc

SEQ ID NO: 3562934 - RNA, 22 nt, Pseudomonas putida KT2440
aaucgccacacaagccccccug

SEQ ID NO: 3562935 - RNA, 15 nt, Pseudomonas putida KT2440
aaucgccaggcccag

SEQ ID NO: 3562936 - RNA, 14 nt, Pseudomonas putida KT2440
aaucgccagggcuc

SEQ ID NO: 3562937 - RNA, 14 nt, Pseudomonas putida KT2440
aaucgccuugcguc

SEQ ID NO: 3562938 - RNA, 17 nt, Pseudomonas putida KT2440
aaucgcuccaggcggcc

SEQ ID NO: 3562939 - RNA, 15 nt, Pseudomonas putida KT2440
aaucgcucugccgca

SEQ ID NO: 3562940 - RNA, 13 nt, Pseudomonas putida KT2440
aaucgcugugcaa

SEQ ID NO: 3562941 - RNA, 19 nt, Pseudomonas putida KT2440
aaucggcagaauuucaggc

SEQ ID NO: 3562942 - RNA, 23 nt, Pseudomonas putida KT2440
aaucggcuucagguucacuucca

SEQ ID NO: 3562943 - RNA, 15 nt, Pseudomonas putida KT2440
aaucgggaucaugcc

SEQ ID NO: 3562944 - RNA, 15 nt, Pseudomonas putida KT2440
aaucggguccaccca

SEQ ID NO: 3562945 - RNA, 21 nt, Pseudomonas putida KT2440
aaucggguccacccacccucg

SEQ ID NO: 3562946 - RNA, 16 nt, Pseudomonas putida KT2440
aaucgggugaggauga

SEQ ID NO: 3562947 - RNA, 18 nt, Pseudomonas putida KT2440
aaucgucggugaugauca

SEQ ID NO: 3562948 - RNA, 20 nt, Pseudomonas putida KT2440
aaucuccagcccgaaaccau

SEQ ID NO: 3562949 - RNA, 16 nt, Pseudomonas putida KT2440
aaucucccgggccaug

SEQ ID NO: 3562950 - RNA, 14 nt, Pseudomonas putida KT2440
aaucugcaccgccu

SEQ ID NO: 3562951 - RNA, 13 nt, Pseudomonas putida KT2440
aaucugcagcagc

SEQ ID NO: 3562952 - RNA, 13 nt, Pseudomonas putida KT2440
aaucugccugcug

SEQ ID NO: 3562953 - RNA, 18 nt, Pseudomonas putida KT2440
aaucugcucgacgaaggu

SEQ ID NO: 3562954 - RNA, 23 nt, Pseudomonas putida KT2440
aaucuucggcuuugaacagcucg

SEQ ID NO: 3562955 - RNA, 23 nt, Pseudomonas putida KT2440
aaucuucggugcccacugcagcc

SEQ ID NO: 3562956 - RNA, 21 nt, Pseudomonas putida KT2440
aaugaccuggaucgccaggcu

SEQ ID NO: 3562957 - RNA, 21 nt, Pseudomonas putida KT2440
aaugagggaugagaaagcccg

SEQ ID NO: 3562958 - RNA, 22 nt, Pseudomonas putida KT2440
aaugaucgaaagcgguugagau

SEQ ID NO: 3562959 - RNA, 21 nt, Pseudomonas putida KT2440
aaugcaccacgcgcaaaugcu

SEQ ID NO: 3562960 - RNA, 21 nt, Pseudomonas putida KT2440
aaugcacuucugcuaaucgcu

SEQ ID NO: 3562961 - RNA, 18 nt, Pseudomonas putida KT2440
aaugcccauggccaggcu

SEQ ID NO: 3562962 - RNA, 22 nt, Pseudomonas putida KT2440
aaugccgccuugcagaaagugc

SEQ ID NO: 3562963 - RNA, 23 nt, Pseudomonas putida KT2440
aaugccgugaugguaucugccag

SEQ ID NO: 3562964 - RNA, 17 nt, Pseudomonas putida KT2440
aaugccuugagcggcuc

SEQ ID NO: 3562965 - RNA, 18 nt, Pseudomonas putida KT2440
aaugcgacugaggcaccg

SEQ ID NO: 3562966 - RNA, 14 nt, Pseudomonas putida KT2440
aaugcgaugguggc

SEQ ID NO: 3562967 - RNA, 11 nt, Pseudomonas putida KT2440
aaugcgcccca

SEQ ID NO: 3562968 - RNA, 15 nt, Pseudomonas putida KT2440
aaugcgcccugcugc

SEQ ID NO: 3562969 - RNA, 17 nt, Pseudomonas putida KT2440
aaugcgguccuccuugg

SEQ ID NO: 3562970 - RNA, 15 nt, Pseudomonas putida KT2440
aaugcggugugcugc

SEQ ID NO: 3562971 - RNA, 21 nt, Pseudomonas putida KT2440
aaugcgugggucguuccagug

SEQ ID NO: 3562972 - RNA, 16 nt, Pseudomonas putida KT2440
aaugcuccgccaccag

SEQ ID NO: 3562973 - RNA, 21 nt, Pseudomonas putida KT2440
aaugcuccggcgacagcucaa

SEQ ID NO: 3562974 - RNA, 23 nt, Pseudomonas putida KT2440
aauggaggagggcugcaucacuu

SEQ ID NO: 3562975 - RNA, 19 nt, Pseudomonas putida KT2440
aauggcaaucgccuggcgc

SEQ ID NO: 3562976 - RNA, 17 nt, Pseudomonas putida KT2440
aauggcacccucaccaa

SEQ ID NO: 3562977 - RNA, 15 nt, Pseudomonas putida KT2440
aauggcccgcuccag

SEQ ID NO: 3562978 - RNA, 17 nt, Pseudomonas putida KT2440
aauggccgaugaacugg

SEQ ID NO: 3562979 - RNA, 16 nt, Pseudomonas putida KT2440
aauggccuuggccauc

SEQ ID NO: 3562980 - RNA, 16 nt, Pseudomonas putida KT2440
aauggcgagcccggcg

SEQ ID NO: 3562981 - RNA, 15 nt, Pseudomonas putida KT2440
aauggcgcgaacagg

SEQ ID NO: 3562982 - RNA, 18 nt, Pseudomonas putida KT2440
acaauuuucgaccaaggc

SEQ ID NO: 3562983 - RNA, 14 nt, Pseudomonas putida KT2440
acacaagccccccu

SEQ ID NO: 3562984 - RNA, 13 nt, Pseudomonas putida KT2440
acacaaggcccca

SEQ ID NO: 3562985 - RNA, 14 nt, Pseudomonas putida KT2440
acacaaggccgcuc

SEQ ID NO: 3562986 - RNA, 20 nt, Pseudomonas putida KT2440
acacaaggccgcucccacag

SEQ ID NO: 3562987 - RNA, 19 nt, Pseudomonas putida KT2440
acacaaggccgcucccacg

SEQ ID NO: 3562988 - RNA, 19 nt, Pseudomonas putida KT2440
acacacauucccuguagga

SEQ ID NO: 3562989 - RNA, 18 nt, Pseudomonas putida KT2440
acacagaugccgccgcug

SEQ ID NO: 3562990 - RNA, 20 nt, Pseudomonas putida KT2440
acacagcauuacgcggcagc

SEQ ID NO: 3562991 - RNA, 17 nt, Pseudomonas putida KT2440
acacagcggcagacaca

SEQ ID NO: 3562992 - RNA, 17 nt, Pseudomonas putida KT2440
acacagcggccuugacc

SEQ ID NO: 3562993 - RNA, 20 nt, Pseudomonas putida KT2440
acacaggcugucggcaugca

SEQ ID NO: 3562994 - RNA, 15 nt, Pseudomonas putida KT2440
acacagucuucggag

SEQ ID NO: 3562995 - RNA, 16 nt, Pseudomonas putida KT2440
acacauaggcagccac

SEQ ID NO: 3562996 - RNA, 18 nt, Pseudomonas putida KT2440
acacauaucagccaacac

SEQ ID NO: 3562997 - RNA, 14 nt, Pseudomonas putida KT2440
acacauccagcgcc

SEQ ID NO: 3562998 - RNA, 15 nt, Pseudomonas putida KT2440
acacaucgaucaggu

SEQ ID NO: 3562999 - RNA, 18 nt, Pseudomonas putida KT2440
acacaucgguacgccgca

SEQ ID NO: 3563000 - RNA, 21 nt, Pseudomonas putida KT2440
acacaugcaaacccuggcccu

SEQ ID NO: 3563001 - RNA, 19 nt, Pseudomonas putida KT2440
acacauuauccaccaggcc

SEQ ID NO: 3563002 - RNA, 17 nt, Pseudomonas putida KT2440
acaccaaagucagccag

SEQ ID NO: 3563003 - RNA, 17 nt, Pseudomonas putida KT2440
acaccaacgcauuuuca

SEQ ID NO: 3563004 - RNA, 21 nt, Pseudomonas putida KT2440
acaccaacuugccaaaauucu

SEQ ID NO: 3563005 - RNA, 14 nt, Pseudomonas putida KT2440
acaccacagcugca

SEQ ID NO: 3563006 - RNA, 12 nt, Pseudomonas putida KT2440
acaccaccaguu

SEQ ID NO: 3563007 - RNA, 22 nt, Pseudomonas putida KT2440
acaccaccgcgaaacacagcag

SEQ ID NO: 3563008 - RNA, 23 nt, Pseudomonas putida KT2440
acaccaccgcgaaacacagcagg

SEQ ID NO: 3563009 - RNA, 13 nt, Pseudomonas putida KT2440
acaccaccuccac

SEQ ID NO: 3563010 - RNA, 11 nt, Pseudomonas putida KT2440
acaccacgcca

SEQ ID NO: 3563011 - RNA, 16 nt, Pseudomonas putida KT2440
acaccacugucagcca

SEQ ID NO: 3563012 - RNA, 15 nt, Pseudomonas putida KT2440
acaccagacucagcg

SEQ ID NO: 3563013 - RNA, 17 nt, Pseudomonas putida KT2440
acaccagacucagcgcu

SEQ ID NO: 3563014 - RNA, 18 nt, Pseudomonas putida KT2440
acaccagcaacaucggug

SEQ ID NO: 3563015 - RNA, 19 nt, Pseudomonas putida KT2440
acaccaggccuucugcgcg

SEQ ID NO: 3563016 - RNA, 22 nt, Pseudomonas putida KT2440
acaccaggccuucugcgcgagu

SEQ ID NO: 3563017 - RNA, 11 nt, Pseudomonas putida KT2440
acaccaggcug

SEQ ID NO: 3563018 - RNA, 21 nt, Pseudomonas putida KT2440
acaccaguucgccaucgcgca

SEQ ID NO: 3563019 - RNA, 18 nt, Pseudomonas putida KT2440
acacccccagguuaucca

SEQ ID NO: 3563020 - RNA, 19 nt, Pseudomonas putida KT2440
acaccccgauucacagcag

SEQ ID NO: 3563021 - RNA, 16 nt, Pseudomonas putida KT2440
acaccccgcgcaugau

SEQ ID NO: 3563022 - RNA, 12 nt, Pseudomonas putida KT2440
acacccgcucgg

SEQ ID NO: 3563023 - RNA, 15 nt, Pseudomonas putida KT2440
acacccggcuugacc

SEQ ID NO: 3563024 - RNA, 23 nt, Pseudomonas putida KT2440
acacccggugugugcccaccgca

SEQ ID NO: 3563025 - RNA, 15 nt, Pseudomonas putida KT2440
acacccucugccauc

SEQ ID NO: 3563026 - RNA, 17 nt, Pseudomonas putida KT2440
acacccucugccaucuc

SEQ ID NO: 3563027 - RNA, 14 nt, Pseudomonas putida KT2440
acacccucuugaau

SEQ ID NO: 3563028 - RNA, 19 nt, Pseudomonas putida KT2440
acacccugcaccacggcag

SEQ ID NO: 3563029 - RNA, 22 nt, Pseudomonas putida KT2440
acaccgcucaaccuuugcggca

SEQ ID NO: 3563030 - RNA, 16 nt, Pseudomonas putida KT2440
acaccggcagagccgg

SEQ ID NO: 3563031 - RNA, 16 nt, Pseudomonas putida KT2440
acaccggccuuggcca

SEQ ID NO: 3563032 - RNA, 20 nt, Pseudomonas putida KT2440
acaccggccuuggccagcuc

SEQ ID NO: 3563033 - RNA, 22 nt, Pseudomonas putida KT2440
acaccggucagguccgccaagg

SEQ ID NO: 3563034 - RNA, 14 nt, Pseudomonas putida KT2440
acaccucccgcgca

SEQ ID NO: 3563035 - RNA, 21 nt, Pseudomonas putida KT2440
acaccucuccaauccgcagcu

SEQ ID NO: 3563036 - RNA, 15 nt, Pseudomonas putida KT2440
acaccugccagcccc

SEQ ID NO: 3563037 - RNA, 18 nt, Pseudomonas putida KT2440
acaccugccagccccgca

SEQ ID NO: 3563038 - RNA, 14 nt, Pseudomonas putida KT2440
acaccugccaggcc

SEQ ID NO: 3563039 - RNA, 14 nt, Pseudomonas putida KT2440
acaccugccgcagc

SEQ ID NO: 3563040 - RNA, 15 nt, Pseudomonas putida KT2440
acaccugccgcagcu

SEQ ID NO: 3563041 - RNA, 21 nt, Pseudomonas putida KT2440
acaccugcgccccgguacgac

SEQ ID NO: 3563042 - RNA, 17 nt, Pseudomonas putida KT2440
acacgaacaucagcagg

SEQ ID NO: 3563043 - RNA, 22 nt, Pseudomonas putida KT2440
acacgaaguugagcaccggcag

SEQ ID NO: 3563044 - RNA, 20 nt, Pseudomonas putida KT2440
acacgaauggguggcagcug

SEQ ID NO: 3563045 - RNA, 19 nt, Pseudomonas putida KT2440
acacgacgauggccaccag

SEQ ID NO: 3563046 - RNA, 18 nt, Pseudomonas putida KT2440
acacgcccgcgugcuuca

SEQ ID NO: 3563047 - RNA, 15 nt, Pseudomonas putida KT2440
acacgccgucgaccu

SEQ ID NO: 3563048 - RNA, 16 nt, Pseudomonas putida KT2440
acacgcucaugaacag

SEQ ID NO: 3563049 - RNA, 16 nt, Pseudomonas putida KT2440
acacgcuccagguagu

SEQ ID NO: 3563050 - RNA, 13 nt, Pseudomonas putida KT2440
acacgcugcugcg

SEQ ID NO: 3563051 - RNA, 15 nt, Pseudomonas putida KT2440
acacgcuuuucaggg

SEQ ID NO: 3563052 - RNA, 17 nt, Pseudomonas putida KT2440
acacggcaagccacgcc

SEQ ID NO: 3563053 - RNA, 19 nt, Pseudomonas putida KT2440
acacggcgguucugcgcac

SEQ ID NO: 3563054 - RNA, 13 nt, Pseudomonas putida KT2440
acacgggcgaagc

SEQ ID NO: 3563055 - RNA, 15 nt, Pseudomonas putida KT2440
acacgggcguucagc

SEQ ID NO: 3563056 - RNA, 17 nt, Pseudomonas putida KT2440
acacgucauacagcccg

SEQ ID NO: 3563057 - RNA, 13 nt, Pseudomonas putida KT2440
acacguccagccc

SEQ ID NO: 3563058 - RNA, 17 nt, Pseudomonas putida KT2440
acacguccagccccgca

SEQ ID NO: 3563059 - RNA, 17 nt, Pseudomonas putida KT2440
acacgucgccugggcau

SEQ ID NO: 3563060 - RNA, 14 nt, Pseudomonas putida KT2440
acacuccccucgac

SEQ ID NO: 3563061 - RNA, 18 nt, Pseudomonas putida KT2440
acacucgccaggaucggc

SEQ ID NO: 3563062 - RNA, 23 nt, Pseudomonas putida KT2440
acacucgcccccaucgcaggguc

SEQ ID NO: 3563063 - RNA, 15 nt, Pseudomonas putida KT2440
acacugaucucgcgc

SEQ ID NO: 3563064 - RNA, 13 nt, Pseudomonas putida KT2440
acacugcccagca

SEQ ID NO: 3563065 - RNA, 14 nt, Pseudomonas putida KT2440
acacugucccggca

SEQ ID NO: 3563066 - RNA, 13 nt, Pseudomonas putida KT2440
acacuucgccggu

SEQ ID NO: 3563067 - RNA, 15 nt, Pseudomonas putida KT2440
acacuugccgcccuc

SEQ ID NO: 3563068 - RNA, 17 nt, Pseudomonas putida KT2440
acacuugguccagggcc

SEQ ID NO: 3563069 - RNA, 22 nt, Pseudomonas putida KT2440
acacuugguccagggccauggc

SEQ ID NO: 3563070 - RNA, 23 nt, Pseudomonas putida KT2440
acagaaaagcugcacgcuuucac

SEQ ID NO: 3563071 - RNA, 12 nt, Pseudomonas putida KT2440
acagaacaauaa

SEQ ID NO: 3563072 - RNA, 15 nt, Pseudomonas putida KT2440
acagaacaauaaaac

SEQ ID NO: 3563073 - RNA, 17 nt, Pseudomonas putida KT2440
acagaagccucaccgcc

SEQ ID NO: 3563074 - RNA, 22 nt, Pseudomonas putida KT2440
acagaaugcgcucgaaacgccg

SEQ ID NO: 3563075 - RNA, 17 nt, Pseudomonas putida KT2440
acagacaccacaaaacc

SEQ ID NO: 3563076 - RNA, 15 nt, Pseudomonas putida KT2440
acagacaccgcaaau

SEQ ID NO: 3563077 - RNA, 15 nt, Pseudomonas putida KT2440
acagacagggccuug

SEQ ID NO: 3563078 - RNA, 13 nt, Pseudomonas putida KT2440
acagacgggucgg

SEQ ID NO: 3563079 - RNA, 16 nt, Pseudomonas putida KT2440
acagaggccucaauca

SEQ ID NO: 3563080 - RNA, 16 nt, Pseudomonas putida KT2440
acagauacuggcgcug

SEQ ID NO: 3563081 - RNA, 12 nt, Pseudomonas putida KT2440
acagaucagcca

SEQ ID NO: 3563082 - RNA, 13 nt, Pseudomonas putida KT2440
acagaugcugcug

SEQ ID NO: 3563083 - RNA, 19 nt, Pseudomonas putida KT2440
acagaugcugcugcagugc

SEQ ID NO: 3563084 - RNA, 15 nt, Pseudomonas putida KT2440
acagauggcacccca

SEQ ID NO: 3563085 - RNA, 14 nt, Pseudomonas putida KT2440
acagauggugaugc

SEQ ID NO: 3563086 - RNA, 20 nt, Pseudomonas putida KT2440
acagcaacaccguagcgagc

SEQ ID NO: 3563087 - RNA, 15 nt, Pseudomonas putida KT2440
acagcaaccgcguga

SEQ ID NO: 3563088 - RNA, 14 nt, Pseudomonas putida KT2440
acaggcuggcaucg

SEQ ID NO: 3563089 - RNA, 18 nt, Pseudomonas putida KT2440
acaggcuggcaucgccuc

SEQ ID NO: 3563090 - RNA, 18 nt, Pseudomonas putida KT2440
acaggcuggccaccauga

SEQ ID NO: 3563091 - RNA, 17 nt, Pseudomonas putida KT2440
acaggcugucggcaugc

SEQ ID NO: 3563092 - RNA, 21 nt, Pseudomonas putida KT2440
acaggcuguguggccggccau

SEQ ID NO: 3563093 - RNA, 19 nt, Pseudomonas putida KT2440
acaggcuuacaacugcucc

SEQ ID NO: 3563094 - RNA, 19 nt, Pseudomonas putida KT2440
acaggcuuacaucggcgac

SEQ ID NO: 3563095 - RNA, 15 nt, Pseudomonas putida KT2440
acaggcuugaagcug

SEQ ID NO: 3563096 - RNA, 24 nt, Pseudomonas putida KT2440
acaggcuugaagcugcgcucgauc

SEQ ID NO: 3563097 - RNA, 14 nt, Pseudomonas putida KT2440
acagggaaacaaau

SEQ ID NO: 3563098 - RNA, 12 nt, Pseudomonas putida KT2440
acagggaccgca

SEQ ID NO: 3563099 - RNA, 19 nt, Pseudomonas putida KT2440
acagggaccgugcagggaa

SEQ ID NO: 3563100 - RNA, 13 nt, Pseudomonas putida KT2440
acagggaccucac

SEQ ID NO: 3563101 - RNA, 21 nt, Pseudomonas putida KT2440
acagggaccucacagccuuca

SEQ ID NO: 3563102 - RNA, 20 nt, Pseudomonas putida KT2440
acagggaucaagccugacuc

SEQ ID NO: 3563103 - RNA, 14 nt, Pseudomonas putida KT2440
acagggccggcccc

SEQ ID NO: 3563104 - RNA, 21 nt, Pseudomonas putida KT2440
acagggccuugaucugcugcg

SEQ ID NO: 3563105 - RNA, 15 nt, Pseudomonas putida KT2440
acagggcgaugcccu

SEQ ID NO: 3563106 - RNA, 16 nt, Pseudomonas putida KT2440
acagggcgcguguagc

SEQ ID NO: 3563107 - RNA, 12 nt, Pseudomonas putida KT2440
acaggggaugcg

SEQ ID NO: 3563108 - RNA, 19 nt, Pseudomonas putida KT2440
acagggucaggaaccgcuc

SEQ ID NO: 3563109 - RNA, 23 nt, Pseudomonas putida KT2440
acaggguuaccacauaacugccg

SEQ ID NO: 3563110 - RNA, 18 nt, Pseudomonas putida KT2440
acagguaagucacaggcu

SEQ ID NO: 3563111 - RNA, 17 nt, Pseudomonas putida KT2440
acagguaaugcacaagu

SEQ ID NO: 3563112 - RNA, 23 nt, Pseudomonas putida KT2440
acagguaauugguggugcugggc

SEQ ID NO: 3563113 - RNA, 22 nt, Pseudomonas putida KT2440
acagguacauguuggucagcgc

SEQ ID NO: 3563114 - RNA, 15 nt, Pseudomonas putida KT2440
acagguaccaggcug

SEQ ID NO: 3563115 - RNA, 21 nt, Pseudomonas putida KT2440
acagguacucgcaagcuccag

SEQ ID NO: 3563116 - RNA, 14 nt, Pseudomonas putida KT2440
acagguaggcgcca

SEQ ID NO: 3563117 - RNA, 19 nt, Pseudomonas putida KT2440
acaggucguaaucgcccgc

SEQ ID NO: 3563118 - RNA, 21 nt, Pseudomonas putida KT2440
acaggucucgaacgcugugcc

SEQ ID NO: 3563119 - RNA, 21 nt, Pseudomonas putida KT2440
acaggugcgcgcgcgacagca

SEQ ID NO: 3563120 - RNA, 17 nt, Pseudomonas putida KT2440
acagguucggcucacug

SEQ ID NO: 3563121 - RNA, 19 nt, Pseudomonas putida KT2440
acagguucggguaguccuc

SEQ ID NO: 3563122 - RNA, 17 nt, Pseudomonas putida KT2440
acagguuuagcgcuggc

SEQ ID NO: 3563123 - RNA, 18 nt, Pseudomonas putida KT2440
acagguuuagcgcuggcu

SEQ ID NO: 3563124 - RNA, 14 nt, Pseudomonas putida KT2440
acagguuugcugag

SEQ ID NO: 3563125 - RNA, 14 nt, Pseudomonas putida KT2440
acagucgucggcac

SEQ ID NO: 3563126 - RNA, 19 nt, Pseudomonas putida KT2440
acagugaauuccuugcugg

SEQ ID NO: 3563127 - RNA, 19 nt, Pseudomonas putida KT2440
acagugcgacccgcuggcc

SEQ ID NO: 3563128 - RNA, 14 nt, Pseudomonas putida KT2440
acagugcuuccagc

SEQ ID NO: 3563129 - RNA, 20 nt, Pseudomonas putida KT2440
acagugcuuccagcaggacc

SEQ ID NO: 3563130 - RNA, 18 nt, Pseudomonas putida KT2440
acaguggguggcacgugc

SEQ ID NO: 3563131 - RNA, 13 nt, Pseudomonas putida KT2440
acaguguggugcg

SEQ ID NO: 3563132 - RNA, 14 nt, Pseudomonas putida KT2440
acaguuucuucagg

SEQ ID NO: 3563133 - RNA, 16 nt, Pseudomonas putida KT2440
acaguuucuucaggug

SEQ ID NO: 3563134 - RNA, 15 nt, Pseudomonas putida KT2440
acauaacaagaacaa

SEQ ID NO: 3563135 - RNA, 17 nt, Pseudomonas putida KT2440
acauaaggcagcagcuc

SEQ ID NO: 3563136 - RNA, 19 nt, Pseudomonas putida KT2440
acauaaggcagcagcucuu

SEQ ID NO: 3563137 - RNA, 22 nt, Pseudomonas putida KT2440
acauaccacacaccccagaacg

SEQ ID NO: 3563138 - RNA, 15 nt, Pseudomonas putida KT2440
acauacgcaucagcg

SEQ ID NO: 3563139 - RNA, 16 nt, Pseudomonas putida KT2440
acauacgcaucagcgc

SEQ ID NO: 3563140 - RNA, 17 nt, Pseudomonas putida KT2440
acauacuccaccgccag

SEQ ID NO: 3563141 - RNA, 19 nt, Pseudomonas putida KT2440
acauacuccaccgccaggg

SEQ ID NO: 3563142 - RNA, 16 nt, Pseudomonas putida KT2440
acauagaacagcauca

SEQ ID NO: 3563143 - RNA, 14 nt, Pseudomonas putida KT2440
acauagcuggcacu

SEQ ID NO: 3563144 - RNA, 22 nt, Pseudomonas putida KT2440
acauagcuggcacugcccaagc

SEQ ID NO: 3563145 - RNA, 16 nt, Pseudomonas putida KT2440
acauaggcagccaccu

SEQ ID NO: 3563146 - RNA, 14 nt, Pseudomonas putida KT2440
acauaucgcgaaac

SEQ ID NO: 3563147 - RNA, 16 nt, Pseudomonas putida KT2440
acaucacacagcggca

SEQ ID NO: 3563148 - RNA, 14 nt, Pseudomonas putida KT2440
acaucacugcugua

SEQ ID NO: 3563149 - RNA, 15 nt, Pseudomonas putida KT2440
acaucacugcuguaa

SEQ ID NO: 3563150 - RNA, 21 nt, Pseudomonas putida KT2440
acaucacugcuguaaucggcg

SEQ ID NO: 3563151 - RNA, 13 nt, Pseudomonas putida KT2440
acaucagccgguc

SEQ ID NO: 3563152 - RNA, 11 nt, Pseudomonas putida KT2440
acaucaucauc

SEQ ID NO: 3563153 - RNA, 22 nt, Pseudomonas putida KT2440
acaucaugccgcccaugccacc

SEQ ID NO: 3563154 - RNA, 16 nt, Pseudomonas putida KT2440
acauccacagccucca

SEQ ID NO: 3563155 - RNA, 17 nt, Pseudomonas putida KT2440
acauccacagccuccag

SEQ ID NO: 3563156 - RNA, 14 nt, Pseudomonas putida KT2440
acauccagcgccgc

SEQ ID NO: 3563157 - RNA, 20 nt, Pseudomonas putida KT2440
acauccagcgccgcgccacc

SEQ ID NO: 3563158 - RNA, 14 nt, Pseudomonas putida KT2440
acauccucugcccg

SEQ ID NO: 3563159 - RNA, 15 nt, Pseudomonas putida KT2440
acauccucugcccgc

SEQ ID NO: 3563160 - RNA, 17 nt, Pseudomonas putida KT2440
acauccugcaaggcaau

SEQ ID NO: 3563161 - RNA, 16 nt, Pseudomonas putida KT2440
acauccuuggucaugg

SEQ ID NO: 3563162 - RNA, 20 nt, Pseudomonas putida KT2440
acaucgaauuucugcaacag

SEQ ID NO: 3563163 - RNA, 16 nt, Pseudomonas putida KT2440
acaucgauuucgccau

SEQ ID NO: 3563164 - RNA, 22 nt, Pseudomonas putida KT2440
acaucgcccccgcugcacaggc

SEQ ID NO: 3563165 - RNA, 15 nt, Pseudomonas putida KT2440
acaucggccaccgcc

SEQ ID NO: 3563166 - RNA, 19 nt, Pseudomonas putida KT2440
acaucggccaccgccgggu

SEQ ID NO: 3563167 - RNA, 18 nt, Pseudomonas putida KT2440
acaucgugaagcaccgcc

SEQ ID NO: 3563168 - RNA, 20 nt, Pseudomonas putida KT2440
acaucgugaagcaccgccac

SEQ ID NO: 3563169 - RNA, 17 nt, Pseudomonas putida KT2440
acaucuccacugcgcca

SEQ ID NO: 3563170 - RNA, 17 nt, Pseudomonas putida KT2440
acaucugcgccagauca

SEQ ID NO: 3563171 - RNA, 12 nt, Pseudomonas putida KT2440
acaugaaaguga

SEQ ID NO: 3563172 - RNA, 15 nt, Pseudomonas putida KT2440
acaugccacggccuu

SEQ ID NO: 3563173 - RNA, 20 nt, Pseudomonas putida KT2440
acaugccacggccuucuuca

SEQ ID NO: 3563174 - RNA, 15 nt, Pseudomonas putida KT2440
acaugccggccacca

SEQ ID NO: 3563175 - RNA, 21 nt, Pseudomonas putida KT2440
acaugccggccaccacacugg

SEQ ID NO: 3563176 - RNA, 19 nt, Pseudomonas putida KT2440
acaugcgagccgcugccaa

SEQ ID NO: 3563177 - RNA, 17 nt, Pseudomonas putida KT2440
acaugcgccacacccgc

SEQ ID NO: 3563178 - RNA, 23 nt, Pseudomonas putida KT2440
acaugcgccacacccgcuacacc

SEQ ID NO: 3563179 - RNA, 13 nt, Pseudomonas putida KT2440
acaugcggaagca

SEQ ID NO: 3563180 - RNA, 15 nt, Pseudomonas putida KT2440
acaugcggaagcaac

SEQ ID NO: 3563181 - RNA, 13 nt, Pseudomonas putida KT2440
acauggaucagcu

SEQ ID NO: 3563182 - RNA, 14 nt, Pseudomonas putida KT2440
acauggaucagcuc

SEQ ID NO: 3563183 - RNA, 18 nt, Pseudomonas putida KT2440
acauucaccagccaggca

SEQ ID NO: 3563184 - RNA, 12 nt, Pseudomonas putida KT2440
acauucaccgcc

SEQ ID NO: 3563185 - RNA, 15 nt, Pseudomonas putida KT2440
acauucaggaugcuu

SEQ ID NO: 3563186 - RNA, 23 nt, Pseudomonas putida KT2440
acauucuccaguuguugggcagc

SEQ ID NO: 3563187 - RNA, 21 nt, Pseudomonas putida KT2440
acauugaagaagcccccggau

SEQ ID NO: 3563188 - RNA, 14 nt, Pseudomonas putida KT2440
acauugcuaauuuc

SEQ ID NO: 3563189 - RNA, 17 nt, Pseudomonas putida KT2440
acauugcuaauuucagg

SEQ ID NO: 3563190 - RNA, 12 nt, Pseudomonas putida KT2440
acauuguaggcg

SEQ ID NO: 3563191 - RNA, 19 nt, Pseudomonas putida KT2440
accaaagucagccagccgg

SEQ ID NO: 3563192 - RNA, 18 nt, Pseudomonas putida KT2440
accaacagcaccggccag

SEQ ID NO: 3563193 - RNA, 22 nt, Pseudomonas putida KT2440
accaacaggcucuccauugcgc

SEQ ID NO: 3563194 - RNA, 16 nt, Pseudomonas putida KT2440
accagcaacaucggug

SEQ ID NO: 3563195 - RNA, 14 nt, Pseudomonas putida KT2440
accagcaccagcuc

SEQ ID NO: 3563196 - RNA, 23 nt, Pseudomonas putida KT2440
accagcaccaucagagcgccagc

SEQ ID NO: 3563197 - RNA, 13 nt, Pseudomonas putida KT2440
accagcaccccga

SEQ ID NO: 3563198 - RNA, 19 nt, Pseudomonas putida KT2440
accagcaccccgaacgcgg

SEQ ID NO: 3563199 - RNA, 13 nt, Pseudomonas putida KT2440
accagcaccugca

SEQ ID NO: 3563200 - RNA, 21 nt, Pseudomonas putida KT2440
accagcaccugcagguacagc

SEQ ID NO: 3563201 - RNA, 22 nt, Pseudomonas putida KT2440
accagcaccugcagguacagca

SEQ ID NO: 3563202 - RNA, 23 nt, Pseudomonas putida KT2440
accagcaccugcagguacagcag

SEQ ID NO: 3563203 - RNA, 19 nt, Pseudomonas putida KT2440
accagcacugccuugcccu

SEQ ID NO: 3563204 - RNA, 13 nt, Pseudomonas putida KT2440
accagcagcagug

SEQ ID NO: 3563205 - RNA, 22 nt, Pseudomonas putida KT2440
accagcagcaguggcaagccga

SEQ ID NO: 3563206 - RNA, 16 nt, Pseudomonas putida KT2440
accagcagcgccugca

SEQ ID NO: 3563207 - RNA, 17 nt, Pseudomonas putida KT2440
accagcagcuucuucac

SEQ ID NO: 3563208 - RNA, 14 nt, Pseudomonas putida KT2440
accagcagggccau

SEQ ID NO: 3563209 - RNA, 20 nt, Pseudomonas putida KT2440
accagcaugcgaagccgcca

SEQ ID NO: 3563210 - RNA, 23 nt, Pseudomonas putida KT2440
accagcaugcgaagccgccagcg

SEQ ID NO: 3563211 - RNA, 21 nt, Pseudomonas putida KT2440
accagcauguccugcugcagg

SEQ ID NO: 3563212 - RNA, 22 nt, Pseudomonas putida KT2440
accagcauguccugcugcaggc

SEQ ID NO: 3563213 - RNA, 12 nt, Pseudomonas putida KT2440
accagccagcca

SEQ ID NO: 3563214 - RNA, 13 nt, Pseudomonas putida KT2440
accagccagccac

SEQ ID NO: 3563215 - RNA, 14 nt, Pseudomonas putida KT2440
accagccaggcaca

SEQ ID NO: 3563216 - RNA, 18 nt, Pseudomonas putida KT2440
accagccccucaggcaca

SEQ ID NO: 3563217 - RNA, 12 nt, Pseudomonas putida KT2440
accagcccggcc

SEQ ID NO: 3563218 - RNA, 13 nt, Pseudomonas putida KT2440
accagcccggcuc

SEQ ID NO: 3563219 - RNA, 18 nt, Pseudomonas putida KT2440
accagccgccuuugcccc

SEQ ID NO: 3563220 - RNA, 22 nt, Pseudomonas putida KT2440
accagccggcaauuuccugcgc

SEQ ID NO: 3563221 - RNA, 13 nt, Pseudomonas putida KT2440
accagcgccagcc

SEQ ID NO: 3563222 - RNA, 15 nt, Pseudomonas putida KT2440
accagcgcccuucac

SEQ ID NO: 3563223 - RNA, 13 nt, Pseudomonas putida KT2440
accagcggaucac

SEQ ID NO: 3563224 - RNA, 14 nt, Pseudomonas putida KT2440
accagcggcagcaa

SEQ ID NO: 3563225 - RNA, 15 nt, Pseudomonas putida KT2440
accagcggcagcaag

SEQ ID NO: 3563226 - RNA, 13 nt, Pseudomonas putida KT2440
accagcggcgcga

SEQ ID NO: 3563227 - RNA, 22 nt, Pseudomonas putida KT2440
accagcggucugcugcgucagc

SEQ ID NO: 3563228 - RNA, 19 nt, Pseudomonas putida KT2440
accagcguugucccgcccu

SEQ ID NO: 3563229 - RNA, 13 nt, Pseudomonas putida KT2440
accagcucaucca

SEQ ID NO: 3563230 - RNA, 14 nt, Pseudomonas putida KT2440
accagcugcaccac

SEQ ID NO: 3563231 - RNA, 20 nt, Pseudomonas putida KT2440
accagcugccauacagccag

SEQ ID NO: 3563232 - RNA, 15 nt, Pseudomonas putida KT2440
accagcuugugcagc

SEQ ID NO: 3563233 - RNA, 15 nt, Pseudomonas putida KT2440
accaggacaagccga

SEQ ID NO: 3563234 - RNA, 21 nt, Pseudomonas putida KT2440
accaggacuucccggcaccgc

SEQ ID NO: 3563235 - RNA, 22 nt, Pseudomonas putida KT2440
accaggacuucccggcaccgcu

SEQ ID NO: 3563236 - RNA, 17 nt, Pseudomonas putida KT2440
accaggaucagguaauc

SEQ ID NO: 3563237 - RNA, 14 nt, Pseudomonas putida KT2440
accaggaucuucuc

SEQ ID NO: 3563238 - RNA, 21 nt, Pseudomonas putida KT2440
accaggauugccgggcuacgc

SEQ ID NO: 3563239 - RNA, 18 nt, Pseudomonas putida KT2440
accaggauuggccgcaac

SEQ ID NO: 3563240 - RNA, 20 nt, Pseudomonas putida KT2440
accaggcauuguugcaacgc

SEQ ID NO: 3563241 - RNA, 17 nt, Pseudomonas putida KT2440
accaggcccaacagcgc

SEQ ID NO: 3563242 - RNA, 16 nt, Pseudomonas putida KT2440
accaggcccagcaggu

SEQ ID NO: 3563243 - RNA, 20 nt, Pseudomonas putida KT2440
accaggcccgcuauccucga

SEQ ID NO: 3563244 - RNA, 18 nt, Pseudomonas putida KT2440
accaggccgaucaccagc

SEQ ID NO: 3563245 - RNA, 20 nt, Pseudomonas putida KT2440
accaggccuuugacuucguc

SEQ ID NO: 3563246 - RNA, 14 nt, Pseudomonas putida KT2440
accaggcgcagcag

SEQ ID NO: 3563247 - RNA, 16 nt, Pseudomonas putida KT2440
accaggcgcagcagcu

SEQ ID NO: 3563248 - RNA, 16 nt, Pseudomonas putida KT2440
accaggcggucggcca

SEQ ID NO: 3563249 - RNA, 21 nt, Pseudomonas putida KT2440
accaggcuggccaccaccauc

SEQ ID NO: 3563250 - RNA, 19 nt, Pseudomonas putida KT2440
accagggacgaacccuuga

SEQ ID NO: 3563251 - RNA, 16 nt, Pseudomonas putida KT2440
accagggcaucggcgc

SEQ ID NO: 3563252 - RNA, 16 nt, Pseudomonas putida KT2440
accagggcgcgcuggc

SEQ ID NO: 3563253 - RNA, 20 nt, Pseudomonas putida KT2440
accagggcuggcagcgggua

SEQ ID NO: 3563254 - RNA, 18 nt, Pseudomonas putida KT2440
accaggguggcgauccac

SEQ ID NO: 3563255 - RNA, 18 nt, Pseudomonas putida KT2440
accagguaaauggucccc

SEQ ID NO: 3563256 - RNA, 20 nt, Pseudomonas putida KT2440
accagguaaaugguccccgc

SEQ ID NO: 3563257 - RNA, 17 nt, Pseudomonas putida KT2440
accaggucauaguucug

SEQ ID NO: 3563258 - RNA, 22 nt, Pseudomonas putida KT2440
accagguccaccagcaggcugc

SEQ ID NO: 3563259 - RNA, 15 nt, Pseudomonas putida KT2440
accaggucgccagca

SEQ ID NO: 3563260 - RNA, 23 nt, Pseudomonas putida KT2440
accaggucgccagcaccaucagg

SEQ ID NO: 3563261 - RNA, 20 nt, Pseudomonas putida KT2440
accaggugguaacuggccag

SEQ ID NO: 3563262 - RNA, 21 nt, Pseudomonas putida KT2440
accaggugguaacuggccagu

SEQ ID NO: 3563263 - RNA, 19 nt, Pseudomonas putida KT2440
accagguuggccgccgcca

SEQ ID NO: 3563264 - RNA, 20 nt, Pseudomonas putida KT2440
accaguaaugcagccggccc

SEQ ID NO: 3563265 - RNA, 23 nt, Pseudomonas putida KT2440
accaguacgaacuacgcgccagc

SEQ ID NO: 3563266 - RNA, 17 nt, Pseudomonas putida KT2440
accaguaguucucgaca

SEQ ID NO: 3563267 - RNA, 21 nt, Pseudomonas putida KT2440
accaguccaaccgcaagcggc

SEQ ID NO: 3563268 - RNA, 14 nt, Pseudomonas putida KT2440
accagucugcucag

SEQ ID NO: 3563269 - RNA, 15 nt, Pseudomonas putida KT2440
accagucugcucagc

SEQ ID NO: 3563270 - RNA, 14 nt, Pseudomonas putida KT2440
accaguuccagggc

SEQ ID NO: 3563271 - RNA, 17 nt, Pseudomonas putida KT2440
accaguuccagggcggc

SEQ ID NO: 3563272 - RNA, 15 nt, Pseudomonas putida KT2440
accaguuccuugagc

SEQ ID NO: 3563273 - RNA, 21 nt, Pseudomonas putida KT2440
accaguucguccucgacccac

SEQ ID NO: 3563274 - RNA, 15 nt, Pseudomonas putida KT2440
accaguugguaaaac

SEQ ID NO: 3563275 - RNA, 23 nt, Pseudomonas putida KT2440
accauaagcggugugggcgaagu

SEQ ID NO: 3563276 - RNA, 21 nt, Pseudomonas putida KT2440
accaucaaaaagccccgguuc

SEQ ID NO: 3563277 - RNA, 22 nt, Pseudomonas putida KT2440
accaucaauacgcuggaucacc

SEQ ID NO: 3563278 - RNA, 14 nt, Pseudomonas putida KT2440
accaucaccgccag

SEQ ID NO: 3563279 - RNA, 15 nt, Pseudomonas putida KT2440
accaucaccgccagc

SEQ ID NO: 3563280 - RNA, 16 nt, Pseudomonas putida KT2440
accaucaccgccagca

SEQ ID NO: 3563281 - RNA, 20 nt, Pseudomonas putida KT2440
accaucaccgccagcauggc

SEQ ID NO: 3563282 - RNA, 16 nt, Pseudomonas putida KT2440
accaucagagcgccag

SEQ ID NO: 3563283 - RNA, 19 nt, Pseudomonas putida KT2440
accaucagagcgccagcaa

SEQ ID NO: 3563284 - RNA, 14 nt, Pseudomonas putida KT2440
accaucagguauug

SEQ ID NO: 3563285 - RNA, 11 nt, Pseudomonas putida KT2440
accauccauca

SEQ ID NO: 3563286 - RNA, 13 nt, Pseudomonas putida KT2440
accauccaucacc

SEQ ID NO: 3563287 - RNA, 15 nt, Pseudomonas putida KT2440
accauccgccaggua

SEQ ID NO: 3563288 - RNA, 14 nt, Pseudomonas putida KT2440
accaucggccggcu

SEQ ID NO: 3563289 - RNA, 19 nt, Pseudomonas putida KT2440
accaucggccggcucgaac

SEQ ID NO: 3563290 - RNA, 17 nt, Pseudomonas putida KT2440
accaucuccagcucgcc

SEQ ID NO: 3563291 - RNA, 18 nt, Pseudomonas putida KT2440
accaugaaaaacaacaac

SEQ ID NO: 3563292 - RNA, 14 nt, Pseudomonas putida KT2440
accaugaacagcac

SEQ ID NO: 3563293 - RNA, 19 nt, Pseudomonas putida KT2440
accaugaacucuuccccgc

SEQ ID NO: 3563294 - RNA, 20 nt, Pseudomonas putida KT2440
accaugcgaugguacagcuc

SEQ ID NO: 3563295 - RNA, 23 nt, Pseudomonas putida KT2440
accaugcgaugguacagcucacu

SEQ ID NO: 3563296 - RNA, 14 nt, Pseudomonas putida KT2440
accaugcucaccgc

SEQ ID NO: 3563297 - RNA, 15 nt, Pseudomonas putida KT2440
accaugcucaggaac

SEQ ID NO: 3563298 - RNA, 16 nt, Pseudomonas putida KT2440
accaugcucggccagc

SEQ ID NO: 3563299 - RNA, 17 nt, Pseudomonas putida KT2440
accccgaugcgcugauc

SEQ ID NO: 3563300 - RNA, 18 nt, Pseudomonas putida KT2440
accccgccccugcuugac

SEQ ID NO: 3563301 - RNA, 19 nt, Pseudomonas putida KT2440
accccgccccugcuugacc

SEQ ID NO: 3563302 - RNA, 15 nt, Pseudomonas putida KT2440
accccggcguucagc

SEQ ID NO: 3563303 - RNA, 16 nt, Pseudomonas putida KT2440
accccgggcacaugca

SEQ ID NO: 3563304 - RNA, 15 nt, Pseudomonas putida KT2440
accccguacacccgc

SEQ ID NO: 3563305 - RNA, 18 nt, Pseudomonas putida KT2440
accccguagcgcuucagc

SEQ ID NO: 3563306 - RNA, 22 nt, Pseudomonas putida KT2440
accccguauugguagccacgug

SEQ ID NO: 3563307 - RNA, 14 nt, Pseudomonas putida KT2440
accccguccagccc

SEQ ID NO: 3563308 - RNA, 17 nt, Pseudomonas putida KT2440
accccgucgccucaccu

SEQ ID NO: 3563309 - RNA, 21 nt, Pseudomonas putida KT2440
accccguggccccgggccaug

SEQ ID NO: 3563310 - RNA, 18 nt, Pseudomonas putida KT2440
accccguucgcccugcgc

SEQ ID NO: 3563311 - RNA, 22 nt, Pseudomonas putida KT2440
accccguugcgcagcagcaggc

SEQ ID NO: 3563312 - RNA, 14 nt, Pseudomonas putida KT2440
accccucgcugccc

SEQ ID NO: 3563313 - RNA, 15 nt, Pseudomonas putida KT2440
accccucgcugccca

SEQ ID NO: 3563314 - RNA, 21 nt, Pseudomonas putida KT2440
accccucgcugcccaacgccu

SEQ ID NO: 3563315 - RNA, 19 nt, Pseudomonas putida KT2440
accccugcaaggccagcgg

SEQ ID NO: 3563316 - RNA, 19 nt, Pseudomonas putida KT2440
accccugcagagcucagcg

SEQ ID NO: 3563317 - RNA, 16 nt, Pseudomonas putida KT2440
accccugccaccaguu

SEQ ID NO: 3563318 - RNA, 13 nt, Pseudomonas putida KT2440
accccugcgccug

SEQ ID NO: 3563319 - RNA, 19 nt, Pseudomonas putida KT2440
accccuguaggagcggguu

SEQ ID NO: 3563320 - RNA, 12 nt, Pseudomonas putida KT2440
accccuugcggg

SEQ ID NO: 3563321 - RNA, 23 nt, Pseudomonas putida KT2440
accccuugcgggaacacccaguc

SEQ ID NO: 3563322 - RNA, 16 nt, Pseudomonas putida KT2440
accccuuuacuggcca

SEQ ID NO: 3563323 - RNA, 18 nt, Pseudomonas putida KT2440
acccgauuccuugcagcg

SEQ ID NO: 3563324 - RNA, 19 nt, Pseudomonas putida KT2440
acccgauuccuugcagcgc

SEQ ID NO: 3563325 - RNA, 18 nt, Pseudomonas putida KT2440
acccgauuucgcuggggc

SEQ ID NO: 3563326 - RNA, 15 nt, Pseudomonas putida KT2440
acccgcaagcgccga

SEQ ID NO: 3563327 - RNA, 22 nt, Pseudomonas putida KT2440
acccgcaagcgggcagugcaau

SEQ ID NO: 3563328 - RNA, 20 nt, Pseudomonas putida KT2440
acccgcaauacauccgcguc

SEQ ID NO: 3563329 - RNA, 22 nt, Pseudomonas putida KT2440
acccgcacgaacagcggcaauu

SEQ ID NO: 3563330 - RNA, 22 nt, Pseudomonas putida KT2440
acccgcaggacggauacaccag

SEQ ID NO: 3563331 - RNA, 21 nt, Pseudomonas putida KT2440
acccgcaggcgacgagccagu

SEQ ID NO: 3563332 - RNA, 17 nt, Pseudomonas putida KT2440
acccgcauaaccaccac

SEQ ID NO: 3563333 - RNA, 22 nt, Pseudomonas putida KT2440
acccgcauaaccaccaccgacc

SEQ ID NO: 3563334 - RNA, 17 nt, Pseudomonas putida KT2440
acccgcaucaucacgcg

SEQ ID NO: 3563335 - RNA, 18 nt, Pseudomonas putida KT2440
acccgcaucaucacgcgc

SEQ ID NO: 3563336 - RNA, 17 nt, Pseudomonas putida KT2440
acccgcauuccuucugc

SEQ ID NO: 3563337 - RNA, 14 nt, Pseudomonas putida KT2440
acccgccaccccag

SEQ ID NO: 3563338 - RNA, 11 nt, Pseudomonas putida KT2440
acccgccagca

SEQ ID NO: 3563339 - RNA, 23 nt, Pseudomonas putida KT2440
acccgcccaauuuggccagcuuc

SEQ ID NO: 3563340 - RNA, 13 nt, Pseudomonas putida KT2440
acccgcccaucgc

SEQ ID NO: 3563341 - RNA, 17 nt, Pseudomonas putida KT2440
acccgccccacgcccga

SEQ ID NO: 3563342 - RNA, 22 nt, Pseudomonas putida KT2440
acccgccgguugcgcagccggc

SEQ ID NO: 3563343 - RNA, 18 nt, Pseudomonas putida KT2440
acccgccuccggcgcuuu

SEQ ID NO: 3563344 - RNA, 17 nt, Pseudomonas putida KT2440
acccgcgaaagggccag

SEQ ID NO: 3563345 - RNA, 18 nt, Pseudomonas putida KT2440
acccgcgaaagggccagu

SEQ ID NO: 3563346 - RNA, 16 nt, Pseudomonas putida KT2440
acccgcgaaagggccg

SEQ ID NO: 3563347 - RNA, 19 nt, Pseudomonas putida KT2440
acccgcgaaagggccggcc

SEQ ID NO: 3563348 - RNA, 19 nt, Pseudomonas putida KT2440
acccgcgaagaagacaccg

SEQ ID NO: 3563349 - RNA, 14 nt, Pseudomonas putida KT2440
acccgcgaagaagc

SEQ ID NO: 3563350 - RNA, 15 nt, Pseudomonas putida KT2440
acccgcgaagaagcc

SEQ ID NO: 3563351 - RNA, 18 nt, Pseudomonas putida KT2440
acccgcgaagaagccacc

SEQ ID NO: 3563352 - RNA, 20 nt, Pseudomonas putida KT2440
acccgcgaagaagccaccgc

SEQ ID NO: 3563353 - RNA, 23 nt, Pseudomonas putida KT2440
acccgcgaagaagccggcaucgc

SEQ ID NO: 3563354 - RNA, 13 nt, Pseudomonas putida KT2440
acccgcgaagagg

SEQ ID NO: 3563355 - RNA, 17 nt, Pseudomonas putida KT2440
acccgcgaagaggccag

SEQ ID NO: 3563356 - RNA, 18 nt, Pseudomonas putida KT2440
acccgcgaagaggccagu

SEQ ID NO: 3563357 - RNA, 17 nt, Pseudomonas putida KT2440
acccgcgaagaggcccg

SEQ ID NO: 3563358 - RNA, 22 nt, Pseudomonas putida KT2440
acccgcgaagaggcccucaagg

SEQ ID NO: 3563359 - RNA, 17 nt, Pseudomonas putida KT2440
acccgcgaagaggccgg

SEQ ID NO: 3563360 - RNA, 20 nt, Pseudomonas putida KT2440
acccgcgaagaggccggcac

SEQ ID NO: 3563361 - RNA, 21 nt, Pseudomonas putida KT2440
acccgcgaaggggccggcccu

SEQ ID NO: 3563362 - RNA, 20 nt, Pseudomonas putida KT2440
acccgcgaccacaggcgcuu

SEQ ID NO: 3563363 - RNA, 15 nt, Pseudomonas putida KT2440
acccgcgacgugacc

SEQ ID NO: 3563364 - RNA, 18 nt, Pseudomonas putida KT2440
acccgcgccaccagcccc

SEQ ID NO: 3563365 - RNA, 14 nt, Pseudomonas putida KT2440
acccgcgccagggu

SEQ ID NO: 3563366 - RNA, 20 nt, Pseudomonas putida KT2440
acccgcgccuacagcggccu

SEQ ID NO: 3563367 - RNA, 20 nt, Pseudomonas putida KT2440
acccgcgccuacaggcaacc

SEQ ID NO: 3563368 - RNA, 20 nt, Pseudomonas putida KT2440
acccgcgccuacgacggccu

SEQ ID NO: 3563369 - RNA, 13 nt, Pseudomonas putida KT2440
acccgcgccucga

SEQ ID NO: 3563370 - RNA, 16 nt, Pseudomonas putida KT2440
acccgcgcgcccgcgg

SEQ ID NO: 3563371 - RNA, 13 nt, Pseudomonas putida KT2440
acccgcgucagcu

SEQ ID NO: 3563372 - RNA, 19 nt, Pseudomonas putida KT2440
acccgcgucagcucaagcg

SEQ ID NO: 3563373 - RNA, 13 nt, Pseudomonas putida KT2440
acccgcgugugcu

SEQ ID NO: 3563374 - RNA, 22 nt, Pseudomonas putida KT2440
acccgcgugugcucgaggaagc

SEQ ID NO: 3563375 - RNA, 16 nt, Pseudomonas putida KT2440
acccgcuaacgcguug

SEQ ID NO: 3563376 - RNA, 20 nt, Pseudomonas putida KT2440
acccgcuacaccggccugga

SEQ ID NO: 3563377 - RNA, 17 nt, Pseudomonas putida KT2440
acccgcucaaagcgcaa

SEQ ID NO: 3563378 - RNA, 13 nt, Pseudomonas putida KT2440
acccgcuccuaca

SEQ ID NO: 3563379 - RNA, 18 nt, Pseudomonas putida KT2440
acccgcuccuacaaggua

SEQ ID NO: 3563380 - RNA, 14 nt, Pseudomonas putida KT2440
acccgcuccuacag

SEQ ID NO: 3563381 - RNA, 16 nt, Pseudomonas putida KT2440
acccgcuccuacagga

SEQ ID NO: 3563382 - RNA, 18 nt, Pseudomonas putida KT2440
acccgcuccuacaggaug

SEQ ID NO: 3563383 - RNA, 19 nt, Pseudomonas putida KT2440
acccgcuccuacaggccgc

SEQ ID NO: 3563384 - RNA, 20 nt, Pseudomonas putida KT2440
acccgcuccuacaggccgcc

SEQ ID NO: 3563385 - RNA, 20 nt, Pseudomonas putida KT2440
acccgcuccuacgggcaacc

SEQ ID NO: 3563386 - RNA, 16 nt, Pseudomonas putida KT2440
acccgcucggccuugu

SEQ ID NO: 3563387 - RNA, 22 nt, Pseudomonas putida KT2440
acccgcucuguuuucaaggcgu

SEQ ID NO: 3563388 - RNA, 13 nt, Pseudomonas putida KT2440
acccgcuggccgg

SEQ ID NO: 3563389 - RNA, 19 nt, Pseudomonas putida KT2440
acccgcuggccggacgacg

SEQ ID NO: 3563390 - RNA, 18 nt, Pseudomonas putida KT2440
acccgcuggcgaccggcg

SEQ ID NO: 3563391 - RNA, 19 nt, Pseudomonas putida KT2440
acccgcuggcgaccggcgu

SEQ ID NO: 3563392 - RNA, 17 nt, Pseudomonas putida KT2440
acccgcuggcgaucagg

SEQ ID NO: 3563393 - RNA, 18 nt, Pseudomonas putida KT2440
acccgcuggcgaucaggc

SEQ ID NO: 3563394 - RNA, 13 nt, Pseudomonas putida KT2440
acccgcugggcuu

SEQ ID NO: 3563395 - RNA, 13 nt, Pseudomonas putida KT2440
acccgcuugccac

SEQ ID NO: 3563396 - RNA, 14 nt, Pseudomonas putida KT2440
acccgcuugccacg

SEQ ID NO: 3563397 - RNA, 16 nt, Pseudomonas putida KT2440
acccgcuuggccacca

SEQ ID NO: 3563398 - RNA, 13 nt, Pseudomonas putida KT2440
acccggaccagcg

SEQ ID NO: 3563399 - RNA, 14 nt, Pseudomonas putida KT2440
acccggaccagcgc

SEQ ID NO: 3563400 - RNA, 16 nt, Pseudomonas putida KT2440
acccggaccagcgccg

SEQ ID NO: 3563401 - RNA, 20 nt, Pseudomonas putida KT2440
acccggcagaaucagguuca

SEQ ID NO: 3563402 - RNA, 15 nt, Pseudomonas putida KT2440
acccggcagccaccg

SEQ ID NO: 3563403 - RNA, 21 nt, Pseudomonas putida KT2440
acccggccaacgacaggucgg

SEQ ID NO: 3563404 - RNA, 16 nt, Pseudomonas putida KT2440
accgagguaccaccgg

SEQ ID NO: 3563405 - RNA, 18 nt, Pseudomonas putida KT2440
accgauagcgugaagcgg

SEQ ID NO: 3563406 - RNA, 17 nt, Pseudomonas putida KT2440
accgaucucgccagccu

SEQ ID NO: 3563407 - RNA, 16 nt, Pseudomonas putida KT2440
accgaugccgccguug

SEQ ID NO: 3563408 - RNA, 13 nt, Pseudomonas putida KT2440
accgaugcugugc

SEQ ID NO: 3563409 - RNA, 16 nt, Pseudomonas putida KT2440
accgauucgcgcaggu

SEQ ID NO: 3563410 - RNA, 23 nt, Pseudomonas putida KT2440
accgcaaaucacugacccgcuuc

SEQ ID NO: 3563411 - RNA, 15 nt, Pseudomonas putida KT2440
accgcaacaccugcc

SEQ ID NO: 3563412 - RNA, 20 nt, Pseudomonas putida KT2440
accgcaacaccugccgcagc

SEQ ID NO: 3563413 - RNA, 17 nt, Pseudomonas putida KT2440
accgcaacaguuuucaa

SEQ ID NO: 3563414 - RNA, 23 nt, Pseudomonas putida KT2440
accgcaacaguuuucaaugcugc

SEQ ID NO: 3563415 - RNA, 15 nt, Pseudomonas putida KT2440
accgcaacccagccc

SEQ ID NO: 3563416 - RNA, 12 nt, Pseudomonas putida KT2440
accgcaacuggc

SEQ ID NO: 3563417 - RNA, 22 nt, Pseudomonas putida KT2440
accgcaacuggcccgcgccagg

SEQ ID NO: 3563418 - RNA, 20 nt, Pseudomonas putida KT2440
accgcaagcggcucucgaag

SEQ ID NO: 3563419 - RNA, 15 nt, Pseudomonas putida KT2440
accgcaagcugcacc

SEQ ID NO: 3563420 - RNA, 16 nt, Pseudomonas putida KT2440
accgcacagcaucacc

SEQ ID NO: 3563421 - RNA, 13 nt, Pseudomonas putida KT2440
accgcacccaggu

SEQ ID NO: 3563422 - RNA, 24 nt, Pseudomonas putida KT2440
accgcacccgcaagcgccgaugcu

SEQ ID NO: 3563423 - RNA, 17 nt, Pseudomonas putida KT2440
accgcacccggcgguga

SEQ ID NO: 3563424 - RNA, 23 nt, Pseudomonas putida KT2440
accgcacccggcuaccaaucugu

SEQ ID NO: 3563425 - RNA, 21 nt, Pseudomonas putida KT2440
accgcacuccccaucagcagc

SEQ ID NO: 3563426 - RNA, 22 nt, Pseudomonas putida KT2440
accgcacuccccaucagcagcu

SEQ ID NO: 3563427 - RNA, 19 nt, Pseudomonas putida KT2440
accgcacucugcugcucug

SEQ ID NO: 3563428 - RNA, 22 nt, Pseudomonas putida KT2440
accgcacugugcuggggccagc

SEQ ID NO: 3563429 - RNA, 20 nt, Pseudomonas putida KT2440
accgcacuuacuaucacgcc

SEQ ID NO: 3563430 - RNA, 15 nt, Pseudomonas putida KT2440
accgcagcccagcgc

SEQ ID NO: 3563431 - RNA, 14 nt, Pseudomonas putida KT2440
accgcaggugcagg

SEQ ID NO: 3563432 - RNA, 19 nt, Pseudomonas putida KT2440
accgcaggugcaggcucgg

SEQ ID NO: 3563433 - RNA, 19 nt, Pseudomonas putida KT2440
accgcauccgcaccccaag

SEQ ID NO: 3563434 - RNA, 20 nt, Pseudomonas putida KT2440
accgcaucuccaaaaggugc

SEQ ID NO: 3563435 - RNA, 14 nt, Pseudomonas putida KT2440
accgccaacccgau

SEQ ID NO: 3563436 - RNA, 16 nt, Pseudomonas putida KT2440
accgccaacgaaucag

SEQ ID NO: 3563437 - RNA, 13 nt, Pseudomonas putida KT2440
accgccaccaucg

SEQ ID NO: 3563438 - RNA, 21 nt, Pseudomonas putida KT2440
accgccaccuuguucgagcgc

SEQ ID NO: 3563439 - RNA, 21 nt, Pseudomonas putida KT2440
accgccacugaccagcccggc

SEQ ID NO: 3563440 - RNA, 23 nt, Pseudomonas putida KT2440
accgccacugaccagcccggcuc

SEQ ID NO: 3563441 - RNA, 21 nt, Pseudomonas putida KT2440
accgccagccaaccgcgugcu

SEQ ID NO: 3563442 - RNA, 12 nt, Pseudomonas putida KT2440
accgccagcccg

SEQ ID NO: 3563443 - RNA, 14 nt, Pseudomonas putida KT2440
accgccagcggcaa

SEQ ID NO: 3563444 - RNA, 15 nt, Pseudomonas putida KT2440
accgccagcggcaag

SEQ ID NO: 3563445 - RNA, 16 nt, Pseudomonas putida KT2440
accgccagcggcaagc

SEQ ID NO: 3563446 - RNA, 20 nt, Pseudomonas putida KT2440
accgccaggguuaccugcgc

SEQ ID NO: 3563447 - RNA, 23 nt, Pseudomonas putida KT2440
accgccaugagcaauacauccag

SEQ ID NO: 3563448 - RNA, 13 nt, Pseudomonas putida KT2440
accgccauucguc

SEQ ID NO: 3563449 - RNA, 23 nt, Pseudomonas putida KT2440
accgccauugacuaccagguagc

SEQ ID NO: 3563450 - RNA, 21 nt, Pseudomonas putida KT2440
accgcccagcgucgucugcgu

SEQ ID NO: 3563451 - RNA, 13 nt, Pseudomonas putida KT2440
accgccccaagcg

SEQ ID NO: 3563452 - RNA, 16 nt, Pseudomonas putida KT2440
accgccccaagcgccu

SEQ ID NO: 3563453 - RNA, 19 nt, Pseudomonas putida KT2440
accgccccagcgcgccagc

SEQ ID NO: 3563454 - RNA, 13 nt, Pseudomonas putida KT2440
accgccccugcgu

SEQ ID NO: 3563455 - RNA, 23 nt, Pseudomonas putida KT2440
accgcccgcgccgcccagcucuu

SEQ ID NO: 3563456 - RNA, 13 nt, Pseudomonas putida KT2440
accgccgccacca

SEQ ID NO: 3563457 - RNA, 13 nt, Pseudomonas putida KT2440
accgccgcccacg

SEQ ID NO: 3563458 - RNA, 17 nt, Pseudomonas putida KT2440
accgccgcccacgccgg

SEQ ID NO: 3563459 - RNA, 19 nt, Pseudomonas putida KT2440
accgccgcccacgccggca

SEQ ID NO: 3563460 - RNA, 15 nt, Pseudomonas putida KT2440
accgccgcccagguc

SEQ ID NO: 3563461 - RNA, 21 nt, Pseudomonas putida KT2440
accgccgcccaggucaugauc

SEQ ID NO: 3563462 - RNA, 14 nt, Pseudomonas putida KT2440
accgccgccuggcu

SEQ ID NO: 3563463 - RNA, 15 nt, Pseudomonas putida KT2440
accgccgcgaugaug

SEQ ID NO: 3563464 - RNA, 19 nt, Pseudomonas putida KT2440
accgccggcucgucacugc

SEQ ID NO: 3563465 - RNA, 21 nt, Pseudomonas putida KT2440
accgccggcucgucacugccg

SEQ ID NO: 3563466 - RNA, 19 nt, Pseudomonas putida KT2440
accgccgggugggugaaga

SEQ ID NO: 3563467 - RNA, 16 nt, Pseudomonas putida KT2440
accgccgucaacucgc

SEQ ID NO: 3563468 - RNA, 15 nt, Pseudomonas putida KT2440
accgccguccaccau

SEQ ID NO: 3563469 - RNA, 20 nt, Pseudomonas putida KT2440
accgccuaugaaaccgagcg

SEQ ID NO: 3563470 - RNA, 17 nt, Pseudomonas putida KT2440
accgccucgaccuggcc

SEQ ID NO: 3563471 - RNA, 18 nt, Pseudomonas putida KT2440
accgccucgaccuggccc

SEQ ID NO: 3563472 - RNA, 18 nt, Pseudomonas putida KT2440
accgccucgaucgucgac

SEQ ID NO: 3563473 - RNA, 12 nt, Pseudomonas putida KT2440
accgccucggua

SEQ ID NO: 3563474 - RNA, 13 nt, Pseudomonas putida KT2440
accgccugcgcac

SEQ ID NO: 3563475 - RNA, 17 nt, Pseudomonas putida KT2440
accgcgaaacacagcag

SEQ ID NO: 3563476 - RNA, 21 nt, Pseudomonas putida KT2440
accgcgaaacacagcaggcca

SEQ ID NO: 3563477 - RNA, 13 nt, Pseudomonas putida KT2440
accgcgaagcagg

SEQ ID NO: 3563478 - RNA, 16 nt, Pseudomonas putida KT2440
accgcgaagcaggcug

SEQ ID NO: 3563479 - RNA, 19 nt, Pseudomonas putida KT2440
accgcgauaucagcgccag

SEQ ID NO: 3563480 - RNA, 18 nt, Pseudomonas putida KT2440
accgcgauggauggcacc

SEQ ID NO: 3563481 - RNA, 18 nt, Pseudomonas putida KT2440
accgcgcaacgcgccaug

SEQ ID NO: 3563482 - RNA, 15 nt, Pseudomonas putida KT2440
accgcgcaccuccug

SEQ ID NO: 3563483 - RNA, 20 nt, Pseudomonas putida KT2440
accgcgcaccuccugcggca

SEQ ID NO: 3563484 - RNA, 16 nt, Pseudomonas putida KT2440
accgcgcaccucgacc

SEQ ID NO: 3563485 - RNA, 19 nt, Pseudomonas putida KT2440
accgcgcacgcaucugcac

SEQ ID NO: 3563486 - RNA, 13 nt, Pseudomonas putida KT2440
accgcgccagccu

SEQ ID NO: 3563487 - RNA, 18 nt, Pseudomonas putida KT2440
accgcgccagccugggcu

SEQ ID NO: 3563488 - RNA, 13 nt, Pseudomonas putida KT2440
accgcgccagcuc

SEQ ID NO: 3563489 - RNA, 21 nt, Pseudomonas putida KT2440
accgcgccagcuccacacucg

SEQ ID NO: 3563490 - RNA, 18 nt, Pseudomonas putida KT2440
accgcgccaucaaggccg

SEQ ID NO: 3563491 - RNA, 22 nt, Pseudomonas putida KT2440
accgcgcccaaggucagccaga

SEQ ID NO: 3563492 - RNA, 18 nt, Pseudomonas putida KT2440
accgcgcccggcuugccc

SEQ ID NO: 3563493 - RNA, 14 nt, Pseudomonas putida KT2440
accgcgcgccaguu

SEQ ID NO: 3563494 - RNA, 17 nt, Pseudomonas putida KT2440
accgcgcgccaguucgc

SEQ ID NO: 3563495 - RNA, 23 nt, Pseudomonas putida KT2440
accgcgcuuugugugcccaccag

SEQ ID NO: 3563496 - RNA, 19 nt, Pseudomonas putida KT2440
accgcggaaugaaccgcga

SEQ ID NO: 3563497 - RNA, 16 nt, Pseudomonas putida KT2440
accgcggaugcgccug

SEQ ID NO: 3563498 - RNA, 14 nt, Pseudomonas putida KT2440
accgcggcugacga

SEQ ID NO: 3563499 - RNA, 23 nt, Pseudomonas putida KT2440
accgcggcugacgaagcgccugg

SEQ ID NO: 3563500 - RNA, 17 nt, Pseudomonas putida KT2440
accgcgguuucugcaac

SEQ ID NO: 3563501 - RNA, 15 nt, Pseudomonas putida KT2440
accgcgucacaucgg

SEQ ID NO: 3563502 - RNA, 23 nt, Pseudomonas putida KT2440
accgcgucauacucuucgcgggc

SEQ ID NO: 3563503 - RNA, 19 nt, Pseudomonas putida KT2440
accgcgucgauacgcugcu

SEQ ID NO: 3563504 - RNA, 15 nt, Pseudomonas putida KT2440
accgcgucgccaauc

SEQ ID NO: 3563505 - RNA, 16 nt, Pseudomonas putida KT2440
accgcgugcuucaucg

SEQ ID NO: 3563506 - RNA, 20 nt, Pseudomonas putida KT2440
accgcguuggacaccagguu

SEQ ID NO: 3563507 - RNA, 12 nt, Pseudomonas putida KT2440
accgcucaaccu

SEQ ID NO: 3563508 - RNA, 14 nt, Pseudomonas putida KT2440
accgcucagugccg

SEQ ID NO: 3563509 - RNA, 16 nt, Pseudomonas putida KT2440
accggucgccuguagg

SEQ ID NO: 3563510 - RNA, 20 nt, Pseudomonas putida KT2440
accggugccccgguccagca

SEQ ID NO: 3563511 - RNA, 21 nt, Pseudomonas putida KT2440
accggugccccgguccagcac

SEQ ID NO: 3563512 - RNA, 22 nt, Pseudomonas putida KT2440
accggugcguacucgaccacug

SEQ ID NO: 3563513 - RNA, 15 nt, Pseudomonas putida KT2440
accgguggccugagc

SEQ ID NO: 3563514 - RNA, 14 nt, Pseudomonas putida KT2440
accgguugcaggcg

SEQ ID NO: 3563515 - RNA, 17 nt, Pseudomonas putida KT2440
accgguugcaggcgagc

SEQ ID NO: 3563516 - RNA, 18 nt, Pseudomonas putida KT2440
accgguuuucuguugccu

SEQ ID NO: 3563517 - RNA, 18 nt, Pseudomonas putida KT2440
accguaaggaaaaucagc

SEQ ID NO: 3563518 - RNA, 14 nt, Pseudomonas putida KT2440
accguacaaggcac

SEQ ID NO: 3563519 - RNA, 23 nt, Pseudomonas putida KT2440
accguacugcuucaucugcgccu

SEQ ID NO: 3563520 - RNA, 20 nt, Pseudomonas putida KT2440
accguacugguaaugcucuc

SEQ ID NO: 3563521 - RNA, 14 nt, Pseudomonas putida KT2440
accguacuugcugc

SEQ ID NO: 3563522 - RNA, 16 nt, Pseudomonas putida KT2440
accguacuugcugcag

SEQ ID NO: 3563523 - RNA, 18 nt, Pseudomonas putida KT2440
accgucaggcucagcagg

SEQ ID NO: 3563524 - RNA, 17 nt, Pseudomonas putida KT2440
accgucgaugucggcgu

SEQ ID NO: 3563525 - RNA, 15 nt, Pseudomonas putida KT2440
accgucggcacgagc

SEQ ID NO: 3563526 - RNA, 22 nt, Pseudomonas putida KT2440
accgugaucacgggcaggcccc

SEQ ID NO: 3563527 - RNA, 15 nt, Pseudomonas putida KT2440
accgugcaccagcac

SEQ ID NO: 3563528 - RNA, 17 nt, Pseudomonas putida KT2440
accgugcauacacccgg

SEQ ID NO: 3563529 - RNA, 23 nt, Pseudomonas putida KT2440
accguggcgaucccuguaggagc

SEQ ID NO: 3563530 - RNA, 18 nt, Pseudomonas putida KT2440
accgugguucuugccgag

SEQ ID NO: 3563531 - RNA, 17 nt, Pseudomonas putida KT2440
accguguaccccaucug

SEQ ID NO: 3563532 - RNA, 18 nt, Pseudomonas putida KT2440
accguguugcagcggguu

SEQ ID NO: 3563533 - RNA, 18 nt, Pseudomonas putida KT2440
accguucuugauccagcu

SEQ ID NO: 3563534 - RNA, 16 nt, Pseudomonas putida KT2440
accguuggcaucugcu

SEQ ID NO: 3563535 - RNA, 14 nt, Pseudomonas putida KT2440
accuaccccuccug

SEQ ID NO: 3563536 - RNA, 21 nt, Pseudomonas putida KT2440
accuacgaccaauugguuaaa

SEQ ID NO: 3563537 - RNA, 19 nt, Pseudomonas putida KT2440
accuacugccgucuuuucc

SEQ ID NO: 3563538 - RNA, 21 nt, Pseudomonas putida KT2440
accucaaaugcgcccugcugc

SEQ ID NO: 3563539 - RNA, 15 nt, Pseudomonas putida KT2440
accucaacgccauca

SEQ ID NO: 3563540 - RNA, 16 nt, Pseudomonas putida KT2440
accucaaguucccgau

SEQ ID NO: 3563541 - RNA, 12 nt, Pseudomonas putida KT2440
accucaccgccg

SEQ ID NO: 3563542 - RNA, 13 nt, Pseudomonas putida KT2440
accucagccgugg

SEQ ID NO: 3563543 - RNA, 16 nt, Pseudomonas putida KT2440
accucaggccugcacu

SEQ ID NO: 3563544 - RNA, 18 nt, Pseudomonas putida KT2440
accucaggccugcacugc

SEQ ID NO: 3563545 - RNA, 22 nt, Pseudomonas putida KT2440
accucaggccugcacugcaccc

SEQ ID NO: 3563546 - RNA, 14 nt, Pseudomonas putida KT2440
accucaucacgcga

SEQ ID NO: 3563547 - RNA, 21 nt, Pseudomonas putida KT2440
accucaucccccggcccagcc

SEQ ID NO: 3563548 - RNA, 16 nt, Pseudomonas putida KT2440
accucaucgacccugg

SEQ ID NO: 3563549 - RNA, 16 nt, Pseudomonas putida KT2440
accucaucggcauugc

SEQ ID NO: 3563550 - RNA, 17 nt, Pseudomonas putida KT2440
accuccaccccgcaggc

SEQ ID NO: 3563551 - RNA, 12 nt, Pseudomonas putida KT2440
accuccaccuuc

SEQ ID NO: 3563552 - RNA, 15 nt, Pseudomonas putida KT2440
accuccacgccaccg

SEQ ID NO: 3563553 - RNA, 12 nt, Pseudomonas putida KT2440
accuccagcccg

SEQ ID NO: 3563554 - RNA, 20 nt, Pseudomonas putida KT2440
accuccagcccggcuucaca

SEQ ID NO: 3563555 - RNA, 19 nt, Pseudomonas putida KT2440
accucccgcacauuucaca

SEQ ID NO: 3563556 - RNA, 22 nt, Pseudomonas putida KT2440
accucccgcacugcugccgccc

SEQ ID NO: 3563557 - RNA, 23 nt, Pseudomonas putida KT2440
accuccggcaucauccugcuggc

SEQ ID NO: 3563558 - RNA, 21 nt, Pseudomonas putida KT2440
accuccguugcugcggggugc

SEQ ID NO: 3563559 - RNA, 14 nt, Pseudomonas putida KT2440
accucgaacuugcc

SEQ ID NO: 3563560 - RNA, 13 nt, Pseudomonas putida KT2440
accucgacccgcc

SEQ ID NO: 3563561 - RNA, 15 nt, Pseudomonas putida KT2440
accucgacccgcccg

SEQ ID NO: 3563562 - RNA, 22 nt, Pseudomonas putida KT2440
accucgaucucgaagcugccac

SEQ ID NO: 3563563 - RNA, 17 nt, Pseudomonas putida KT2440
accucgaugcccuccag

SEQ ID NO: 3563564 - RNA, 19 nt, Pseudomonas putida KT2440
accucgauuuccaccggcu

SEQ ID NO: 3563565 - RNA, 17 nt, Pseudomonas putida KT2440
accucgcucagcuugaa

SEQ ID NO: 3563566 - RNA, 13 nt, Pseudomonas putida KT2440
accucggccgcau

SEQ ID NO: 3563567 - RNA, 17 nt, Pseudomonas putida KT2440
accucggccgcauccug

SEQ ID NO: 3563568 - RNA, 15 nt, Pseudomonas putida KT2440
accucggcgaucagc

SEQ ID NO: 3563569 - RNA, 20 nt, Pseudomonas putida KT2440
accucgggcuuggcacgcug

SEQ ID NO: 3563570 - RNA, 16 nt, Pseudomonas putida KT2440
accucgucaugcagcg

SEQ ID NO: 3563571 - RNA, 19 nt, Pseudomonas putida KT2440
accucgucaugcagcgcca

SEQ ID NO: 3563572 - RNA, 11 nt, Pseudomonas putida KT2440
accucugcaug

SEQ ID NO: 3563573 - RNA, 17 nt, Pseudomonas putida KT2440
accucugcggccuucaa

SEQ ID NO: 3563574 - RNA, 14 nt, Pseudomonas putida KT2440
accucuuagcgggc

SEQ ID NO: 3563575 - RNA, 15 nt, Pseudomonas putida KT2440
accucuuagcgggca

SEQ ID NO: 3563576 - RNA, 19 nt, Pseudomonas putida KT2440
accucuucgcggguaaacc

SEQ ID NO: 3563577 - RNA, 13 nt, Pseudomonas putida KT2440
accugacaagcga

SEQ ID NO: 3563578 - RNA, 13 nt, Pseudomonas putida KT2440
accugaccaucag

SEQ ID NO: 3563579 - RNA, 16 nt, Pseudomonas putida KT2440
accugaccauuggcca

SEQ ID NO: 3563580 - RNA, 15 nt, Pseudomonas putida KT2440
accugagucaggcgc

SEQ ID NO: 3563581 - RNA, 17 nt, Pseudomonas putida KT2440
accugauacacccgcuc

SEQ ID NO: 3563582 - RNA, 14 nt, Pseudomonas putida KT2440
accugaugcaccag

SEQ ID NO: 3563583 - RNA, 20 nt, Pseudomonas putida KT2440
accugaugcgagcuaccuga

SEQ ID NO: 3563584 - RNA, 17 nt, Pseudomonas putida KT2440
accugcaggcgcggugc

SEQ ID NO: 3563585 - RNA, 17 nt, Pseudomonas putida KT2440
accugcagggucaggcg

SEQ ID NO: 3563586 - RNA, 21 nt, Pseudomonas putida KT2440
accugcagguaaugcgccgca

SEQ ID NO: 3563587 - RNA, 13 nt, Pseudomonas putida KT2440
accugcauugcgc

SEQ ID NO: 3563588 - RNA, 17 nt, Pseudomonas putida KT2440
accugcauugcgcguca

SEQ ID NO: 3563589 - RNA, 16 nt, Pseudomonas putida KT2440
accugccaacgcaccg

SEQ ID NO: 3563590 - RNA, 13 nt, Pseudomonas putida KT2440
accugccagcccc

SEQ ID NO: 3563591 - RNA, 12 nt, Pseudomonas putida KT2440
accugccaggcc

SEQ ID NO: 3563592 - RNA, 16 nt, Pseudomonas putida KT2440
accugcccaccgauca

SEQ ID NO: 3563593 - RNA, 13 nt, Pseudomonas putida KT2440
accugccccagcg

SEQ ID NO: 3563594 - RNA, 12 nt, Pseudomonas putida KT2440
accugcccggcg

SEQ ID NO: 3563595 - RNA, 18 nt, Pseudomonas putida KT2440
accugcccggcguucagg

SEQ ID NO: 3563596 - RNA, 13 nt, Pseudomonas putida KT2440
accugcccgggaa

SEQ ID NO: 3563597 - RNA, 21 nt, Pseudomonas putida KT2440
accugccgaucuucgcccugg

SEQ ID NO: 3563598 - RNA, 16 nt, Pseudomonas putida KT2440
accugccgcagcgauc

SEQ ID NO: 3563599 - RNA, 22 nt, Pseudomonas putida KT2440
accugccgcagcuggcgcaaau

SEQ ID NO: 3563600 - RNA, 13 nt, Pseudomonas putida KT2440
accugccgggcau

SEQ ID NO: 3563601 - RNA, 18 nt, Pseudomonas putida KT2440
accugccgggcaucgauc

SEQ ID NO: 3563602 - RNA, 22 nt, Pseudomonas putida KT2440
accugccgggcaucgaucacua

SEQ ID NO: 3563603 - RNA, 17 nt, Pseudomonas putida KT2440
accugcgaccacacugc

SEQ ID NO: 3563604 - RNA, 14 nt, Pseudomonas putida KT2440
accugcgccuugcu

SEQ ID NO: 3563605 - RNA, 16 nt, Pseudomonas putida KT2440
accugcgccuugcuug

SEQ ID NO: 3563606 - RNA, 23 nt, Pseudomonas putida KT2440
accugcggcuguccagcaagggc

SEQ ID NO: 3563607 - RNA, 13 nt, Pseudomonas putida KT2440
accugcgucagga

SEQ ID NO: 3563608 - RNA, 14 nt, Pseudomonas putida KT2440
accugcguugcccc

SEQ ID NO: 3563609 - RNA, 23 nt, Pseudomonas putida KT2440
accugcguugcccccagccgguc

SEQ ID NO: 3563610 - RNA, 20 nt, Pseudomonas putida KT2440
accugcuccugguccugcgc

SEQ ID NO: 3563611 - RNA, 19 nt, Pseudomonas putida KT2440
accugcucgcucaggcucu

SEQ ID NO: 3563612 - RNA, 20 nt, Pseudomonas putida KT2440
accugcucgcucaggcucuu

SEQ ID NO: 3563613 - RNA, 23 nt, Pseudomonas putida KT2440
accugcucuggcccgaacagcac

SEQ ID NO: 3563614 - RNA, 12 nt, Pseudomonas putida KT2440
accugcugggca

SEQ ID NO: 3563615 - RNA, 18 nt, Pseudomonas putida KT2440
acgaauacgcucgaccag

SEQ ID NO: 3563616 - RNA, 14 nt, Pseudomonas putida KT2440
acgaauaucgccga

SEQ ID NO: 3563617 - RNA, 20 nt, Pseudomonas putida KT2440
acgaauaucgccgaacgggc

SEQ ID NO: 3563618 - RNA, 14 nt, Pseudomonas putida KT2440
acgaaucagccagc

SEQ ID NO: 3563619 - RNA, 15 nt, Pseudomonas putida KT2440
acgaauggguggcag

SEQ ID NO: 3563620 - RNA, 16 nt, Pseudomonas putida KT2440
acgaauggguggcagc

SEQ ID NO: 3563621 - RNA, 22 nt, Pseudomonas putida KT2440
acgacaagguagcggccagccc

SEQ ID NO: 3563622 - RNA, 20 nt, Pseudomonas putida KT2440
acgacaccgggauacugcgc

SEQ ID NO: 3563623 - RNA, 18 nt, Pseudomonas putida KT2440
acgacagcuuguugccag

SEQ ID NO: 3563624 - RNA, 21 nt, Pseudomonas putida KT2440
acgacccggauaccgacccua

SEQ ID NO: 3563625 - RNA, 22 nt, Pseudomonas putida KT2440
acgaccgauaaagagaagcugc

SEQ ID NO: 3563626 - RNA, 23 nt, Pseudomonas putida KT2440
acgaccggcucaacagcaggugc

SEQ ID NO: 3563627 - RNA, 19 nt, Pseudomonas putida KT2440
acgacgauggccaccagca

SEQ ID NO: 3563628 - RNA, 14 nt, Pseudomonas putida KT2440
acgacggaagccga

SEQ ID NO: 3563629 - RNA, 21 nt, Pseudomonas putida KT2440
acgacggccugcgcccaauca

SEQ ID NO: 3563630 - RNA, 17 nt, Pseudomonas putida KT2440
acgacgugucagugguc

SEQ ID NO: 3563631 - RNA, 22 nt, Pseudomonas putida KT2440
acgacugacguaguccuugugc

SEQ ID NO: 3563632 - RNA, 19 nt, Pseudomonas putida KT2440
acgacuuauccgcuggcuu

SEQ ID NO: 3563633 - RNA, 21 nt, Pseudomonas putida KT2440
acgagauguacagaaugcgcu

SEQ ID NO: 3563634 - RNA, 12 nt, Pseudomonas putida KT2440
acgagggcagga

SEQ ID NO: 3563635 - RNA, 16 nt, Pseudomonas putida KT2440
acgaguuuaccuccau

SEQ ID NO: 3563636 - RNA, 13 nt, Pseudomonas putida KT2440
acgauaauuaccg

SEQ ID NO: 3563637 - RNA, 21 nt, Pseudomonas putida KT2440
acgauacccagcgcgcgcaga

SEQ ID NO: 3563638 - RNA, 15 nt, Pseudomonas putida KT2440
acgauagcgucagca

SEQ ID NO: 3563639 - RNA, 18 nt, Pseudomonas putida KT2440
acgaucacgcccgggcca

SEQ ID NO: 3563640 - RNA, 14 nt, Pseudomonas putida KT2440
acgaucagcgccga

SEQ ID NO: 3563641 - RNA, 23 nt, Pseudomonas putida KT2440
acgaucaguaccggcuugcgccc

SEQ ID NO: 3563642 - RNA, 22 nt, Pseudomonas putida KT2440
acgaucaugcuggccaggaugc

SEQ ID NO: 3563643 - RNA, 17 nt, Pseudomonas putida KT2440
acgauccccaccagcau

SEQ ID NO: 3563644 - RNA, 13 nt, Pseudomonas putida KT2440
acgaucgccagcc

SEQ ID NO: 3563645 - RNA, 14 nt, Pseudomonas putida KT2440
acgaucgccagccc

SEQ ID NO: 3563646 - RNA, 19 nt, Pseudomonas putida KT2440
acgaucuuggccagggccu

SEQ ID NO: 3563647 - RNA, 17 nt, Pseudomonas putida KT2440
acgaugaggcgaugcag

SEQ ID NO: 3563648 - RNA, 18 nt, Pseudomonas putida KT2440
acgaugaggcgaugcagg

SEQ ID NO: 3563649 - RNA, 19 nt, Pseudomonas putida KT2440
acgaugcccgggccuucaa

SEQ ID NO: 3563650 - RNA, 24 nt, Pseudomonas putida KT2440
acgaugccguacaccaugcucagg

SEQ ID NO: 3563651 - RNA, 21 nt, Pseudomonas putida KT2440
acgauggacagcccaaggccu

SEQ ID NO: 3563652 - RNA, 17 nt, Pseudomonas putida KT2440
acgauggccaccagcac

SEQ ID NO: 3563653 - RNA, 21 nt, Pseudomonas putida KT2440
acgauggcggucgaacccagc

SEQ ID NO: 3563654 - RNA, 14 nt, Pseudomonas putida KT2440
acgauucugccagc

SEQ ID NO: 3563655 - RNA, 17 nt, Pseudomonas putida KT2440
acgcaaauccuccugcg

SEQ ID NO: 3563656 - RNA, 20 nt, Pseudomonas putida KT2440
acgcaaccucguugcuggug

SEQ ID NO: 3563657 - RNA, 12 nt, Pseudomonas putida KT2440
acgcaacugcgg

SEQ ID NO: 3563658 - RNA, 15 nt, Pseudomonas putida KT2440
acgcaagaaggcugc

SEQ ID NO: 3563659 - RNA, 21 nt, Pseudomonas putida KT2440
acgcaaugggcacaauugugc

SEQ ID NO: 3563660 - RNA, 21 nt, Pseudomonas putida KT2440
acgcacaaccgcuuucacuuc

SEQ ID NO: 3563661 - RNA, 17 nt, Pseudomonas putida KT2440
acgcacacgaccuugga

SEQ ID NO: 3563662 - RNA, 13 nt, Pseudomonas putida KT2440
acgcacacucccc

SEQ ID NO: 3563663 - RNA, 13 nt, Pseudomonas putida KT2440
acgcacaguggug

SEQ ID NO: 3563664 - RNA, 21 nt, Pseudomonas putida KT2440
acgcacagugguguacagcaa

SEQ ID NO: 3563665 - RNA, 20 nt, Pseudomonas putida KT2440
acgcaccaacuggucggccu

SEQ ID NO: 3563666 - RNA, 16 nt, Pseudomonas putida KT2440
acgcaccagggcuggc

SEQ ID NO: 3563667 - RNA, 18 nt, Pseudomonas putida KT2440
acgcaccagggcuggcag

SEQ ID NO: 3563668 - RNA, 23 nt, Pseudomonas putida KT2440
acgcaccagggcuggcagcgggu

SEQ ID NO: 3563669 - RNA, 22 nt, Pseudomonas putida KT2440
acgcaccaggucgcggugcagc

SEQ ID NO: 3563670 - RNA, 18 nt, Pseudomonas putida KT2440
acgcacggccuucccgcc

SEQ ID NO: 3563671 - RNA, 23 nt, Pseudomonas putida KT2440
acgcacgugggucgggaacagcu

SEQ ID NO: 3563672 - RNA, 21 nt, Pseudomonas putida KT2440
acgcagagcauggucaugcca

SEQ ID NO: 3563673 - RNA, 15 nt, Pseudomonas putida KT2440
acgcagcacccgguc

SEQ ID NO: 3563674 - RNA, 12 nt, Pseudomonas putida KT2440
acgcagcccuuu

SEQ ID NO: 3563675 - RNA, 18 nt, Pseudomonas putida KT2440
acgcagccggcaccgcca

SEQ ID NO: 3563676 - RNA, 19 nt, Pseudomonas putida KT2440
acgcagccggcaccgccau

SEQ ID NO: 3563677 - RNA, 23 nt, Pseudomonas putida KT2440
acgcagcucggugaacagguugc

SEQ ID NO: 3563678 - RNA, 20 nt, Pseudomonas putida KT2440
acgcagcuuccgccaccacg

SEQ ID NO: 3563679 - RNA, 14 nt, Pseudomonas putida KT2440
acgcaggcaccgca

SEQ ID NO: 3563680 - RNA, 17 nt, Pseudomonas putida KT2440
acgcaggccagcgcaca

SEQ ID NO: 3563681 - RNA, 12 nt, Pseudomonas putida KT2440
acgcaggcgcag

SEQ ID NO: 3563682 - RNA, 14 nt, Pseudomonas putida KT2440
acgcaggcucugcg

SEQ ID NO: 3563683 - RNA, 16 nt, Pseudomonas putida KT2440
acgcagguacucgccg

SEQ ID NO: 3563684 - RNA, 21 nt, Pseudomonas putida KT2440
acgcaggucuugcccacuucc

SEQ ID NO: 3563685 - RNA, 19 nt, Pseudomonas putida KT2440
acgcaggugcgcacgcugc

SEQ ID NO: 3563686 - RNA, 15 nt, Pseudomonas putida KT2440
acgcagucagccaca

SEQ ID NO: 3563687 - RNA, 13 nt, Pseudomonas putida KT2440
acgcagugcagcc

SEQ ID NO: 3563688 - RNA, 13 nt, Pseudomonas putida KT2440
acgcauauccgca

SEQ ID NO: 3563689 - RNA, 14 nt, Pseudomonas putida KT2440
acgcaucugcaccg

SEQ ID NO: 3563690 - RNA, 18 nt, Pseudomonas putida KT2440
acgcaucugcaccggcag

SEQ ID NO: 3563691 - RNA, 15 nt, Pseudomonas putida KT2440
acgcaucugcaccug

SEQ ID NO: 3563692 - RNA, 21 nt, Pseudomonas putida KT2440
acgcaucugcacuuucacccc

SEQ ID NO: 3563693 - RNA, 22 nt, Pseudomonas putida KT2440
acgcaucugcacuuucaccccu

SEQ ID NO: 3563694 - RNA, 13 nt, Pseudomonas putida KT2440
acgcaucugcgcu

SEQ ID NO: 3563695 - RNA, 20 nt, Pseudomonas putida KT2440
acgcaugccuaucucuucca

SEQ ID NO: 3563696 - RNA, 17 nt, Pseudomonas putida KT2440
acgcaugcgcgacagca

SEQ ID NO: 3563697 - RNA, 23 nt, Pseudomonas putida KT2440
acgcaugcgcgacagcaucauca

SEQ ID NO: 3563698 - RNA, 14 nt, Pseudomonas putida KT2440
acgcauggucacgu

SEQ ID NO: 3563699 - RNA, 16 nt, Pseudomonas putida KT2440
acgcauguccuuggcc

SEQ ID NO: 3563700 - RNA, 18 nt, Pseudomonas putida KT2440
acgccacacugucccggc

SEQ ID NO: 3563701 - RNA, 19 nt, Pseudomonas putida KT2440
acgccaccaugcucggcca

SEQ ID NO: 3563702 - RNA, 22 nt, Pseudomonas putida KT2440
acgccaccccggugcagguugg

SEQ ID NO: 3563703 - RNA, 15 nt, Pseudomonas putida KT2440
acgccacggcggcau

SEQ ID NO: 3563704 - RNA, 13 nt, Pseudomonas putida KT2440
acgccagcagcgc

SEQ ID NO: 3563705 - RNA, 14 nt, Pseudomonas putida KT2440
acgccagcagcgca

SEQ ID NO: 3563706 - RNA, 14 nt, Pseudomonas putida KT2440
acgccagcaucacc

SEQ ID NO: 3563707 - RNA, 21 nt, Pseudomonas putida KT2440
acgccagcaucacccucacga

SEQ ID NO: 3563708 - RNA, 20 nt, Pseudomonas putida KT2440
acgccaggaaggucaccagu

SEQ ID NO: 3563709 - RNA, 19 nt, Pseudomonas putida KT2440
acgccagggcaaucgccaa

SEQ ID NO: 3563710 - RNA, 12 nt, Pseudomonas putida KT2440
acgccaggugau

SEQ ID NO: 3563711 - RNA, 17 nt, Pseudomonas putida KT2440
acgccaucaggcagcuc

SEQ ID NO: 3563712 - RNA, 17 nt, Pseudomonas putida KT2440
acgccaucagugccccc

SEQ ID NO: 3563713 - RNA, 20 nt, Pseudomonas putida KT2440
acgccaucagugcccccgcc

SEQ ID NO: 3563714 - RNA, 13 nt, Pseudomonas putida KT2440
acgccaucccccc

SEQ ID NO: 3563715 - RNA, 21 nt, Pseudomonas putida KT2440
acgccauccccccagcccuug

SEQ ID NO: 3563716 - RNA, 14 nt, Pseudomonas putida KT2440
acgccaucggccuc

SEQ ID NO: 3563717 - RNA, 16 nt, Pseudomonas putida KT2440
acgccaugugcgcccg

SEQ ID NO: 3563718 - RNA, 17 nt, Pseudomonas putida KT2440
acgcccaacccagccag

SEQ ID NO: 3563719 - RNA, 15 nt, Pseudomonas putida KT2440
acgcccagcaacugc

SEQ ID NO: 3563720 - RNA, 19 nt, Pseudomonas putida KT2440
acgcucuguaucgaacagg

SEQ ID NO: 3563721 - RNA, 23 nt, Pseudomonas putida KT2440
acgcucuguaucgaacaggcaga

SEQ ID NO: 3563722 - RNA, 23 nt, Pseudomonas putida KT2440
acgcugagcgaugcgcuggcaca

SEQ ID NO: 3563723 - RNA, 19 nt, Pseudomonas putida KT2440
acgcugccgcaccugccug

SEQ ID NO: 3563724 - RNA, 17 nt, Pseudomonas putida KT2440
acgcugccugcaggcug

SEQ ID NO: 3563725 - RNA, 18 nt, Pseudomonas putida KT2440
acgcugccugcaggcugc

SEQ ID NO: 3563726 - RNA, 19 nt, Pseudomonas putida KT2440
acgcugccuugcccagcuc

SEQ ID NO: 3563727 - RNA, 23 nt, Pseudomonas putida KT2440
acgcugcgacucgcggccgguca

SEQ ID NO: 3563728 - RNA, 22 nt, Pseudomonas putida KT2440
acgcugcgcggguucugguugc

SEQ ID NO: 3563729 - RNA, 18 nt, Pseudomonas putida KT2440
acgcugcucggccucgac

SEQ ID NO: 3563730 - RNA, 19 nt, Pseudomonas putida KT2440
acgcugcucggccucgacc

SEQ ID NO: 3563731 - RNA, 13 nt, Pseudomonas putida KT2440
acgcuggcaccca

SEQ ID NO: 3563732 - RNA, 18 nt, Pseudomonas putida KT2440
acgcuggcagcuuggcca

SEQ ID NO: 3563733 - RNA, 18 nt, Pseudomonas putida KT2440
acgcugggcgugccaggc

SEQ ID NO: 3563734 - RNA, 20 nt, Pseudomonas putida KT2440
acgcugggcgugccaggcuu

SEQ ID NO: 3563735 - RNA, 15 nt, Pseudomonas putida KT2440
acgcuugcccggcuc

SEQ ID NO: 3563736 - RNA, 22 nt, Pseudomonas putida KT2440
acgcuuggccagacucagcugc

SEQ ID NO: 3563737 - RNA, 17 nt, Pseudomonas putida KT2440
acggaaggucuucagcu

SEQ ID NO: 3563738 - RNA, 18 nt, Pseudomonas putida KT2440
acggaaucugcaccgccu

SEQ ID NO: 3563739 - RNA, 19 nt, Pseudomonas putida KT2440
acggaaucugcaccgccuu

SEQ ID NO: 3563740 - RNA, 14 nt, Pseudomonas putida KT2440
acggaccuccgagu

SEQ ID NO: 3563741 - RNA, 15 nt, Pseudomonas putida KT2440
acggacgucccagca

SEQ ID NO: 3563742 - RNA, 17 nt, Pseudomonas putida KT2440
acggacgucgcgcuggc

SEQ ID NO: 3563743 - RNA, 19 nt, Pseudomonas putida KT2440
acggacucauagcucagcu

SEQ ID NO: 3563744 - RNA, 15 nt, Pseudomonas putida KT2440
acggauacaccagaa

SEQ ID NO: 3563745 - RNA, 12 nt, Pseudomonas putida KT2440
acggaucaccug

SEQ ID NO: 3563746 - RNA, 17 nt, Pseudomonas putida KT2440
acggaucaccuggccgu

SEQ ID NO: 3563747 - RNA, 21 nt, Pseudomonas putida KT2440
acggaucacgcuuaagucuuc

SEQ ID NO: 3563748 - RNA, 12 nt, Pseudomonas putida KT2440
acggauuuuguu

SEQ ID NO: 3563749 - RNA, 18 nt, Pseudomonas putida KT2440
acggcaaaguccagcauc

SEQ ID NO: 3563750 - RNA, 16 nt, Pseudomonas putida KT2440
acggcaacgccagcaa

SEQ ID NO: 3563751 - RNA, 19 nt, Pseudomonas putida KT2440
acggcaacgccagcaaugc

SEQ ID NO: 3563752 - RNA, 14 nt, Pseudomonas putida KT2440
acggcaagccacgc

SEQ ID NO: 3563753 - RNA, 17 nt, Pseudomonas putida KT2440
acggcaagccacgccag

SEQ ID NO: 3563754 - RNA, 16 nt, Pseudomonas putida KT2440
acggcaaucaggcuga

SEQ ID NO: 3563755 - RNA, 17 nt, Pseudomonas putida KT2440
acggcaauggcccgcuc

SEQ ID NO: 3563756 - RNA, 21 nt, Pseudomonas putida KT2440
acggcaauggcccgcuccagu

SEQ ID NO: 3563757 - RNA, 21 nt, Pseudomonas putida KT2440
acggcaauucgccggcagcaa

SEQ ID NO: 3563758 - RNA, 20 nt, Pseudomonas putida KT2440
acggcaauugccaccggcgc

SEQ ID NO: 3563759 - RNA, 18 nt, Pseudomonas putida KT2440
acggcacacgcaccaccc

SEQ ID NO: 3563760 - RNA, 21 nt, Pseudomonas putida KT2440
acggcacacgcaccaccccgg

SEQ ID NO: 3563761 - RNA, 13 nt, Pseudomonas putida KT2440
acggcaccagcac

SEQ ID NO: 3563762 - RNA, 18 nt, Pseudomonas putida KT2440
acggcaccuuugcaggug

SEQ ID NO: 3563763 - RNA, 18 nt, Pseudomonas putida KT2440
acggcacucgaagcacuc

SEQ ID NO: 3563764 - RNA, 17 nt, Pseudomonas putida KT2440
acggcagcaaucgccgc

SEQ ID NO: 3563765 - RNA, 18 nt, Pseudomonas putida KT2440
acggcagcaaucgccgcc

SEQ ID NO: 3563766 - RNA, 19 nt, Pseudomonas putida KT2440
acggcagcaaucgccgccu

SEQ ID NO: 3563767 - RNA, 22 nt, Pseudomonas putida KT2440
acggcagccaucaucagguacg

SEQ ID NO: 3563768 - RNA, 13 nt, Pseudomonas putida KT2440
acggcagccguuc

SEQ ID NO: 3563769 - RNA, 17 nt, Pseudomonas putida KT2440
acggcagcgacagcugc

SEQ ID NO: 3563770 - RNA, 22 nt, Pseudomonas putida KT2440
acggcagcgacagcugcggcau

SEQ ID NO: 3563771 - RNA, 18 nt, Pseudomonas putida KT2440
acggcaucacgcuggcca

SEQ ID NO: 3563772 - RNA, 22 nt, Pseudomonas putida KT2440
acggcaucggccgagccggucg

SEQ ID NO: 3563773 - RNA, 18 nt, Pseudomonas putida KT2440
acggcauggccgaagcgg

SEQ ID NO: 3563774 - RNA, 15 nt, Pseudomonas putida KT2440
acggcauuuccagcg

SEQ ID NO: 3563775 - RNA, 17 nt, Pseudomonas putida KT2440
acggcauuuccagcguc

SEQ ID NO: 3563776 - RNA, 13 nt, Pseudomonas putida KT2440
acggccacgcugc

SEQ ID NO: 3563777 - RNA, 14 nt, Pseudomonas putida KT2440
acggccacgcugcg

SEQ ID NO: 3563778 - RNA, 19 nt, Pseudomonas putida KT2440
acggccacgguagccaguc

SEQ ID NO: 3563779 - RNA, 22 nt, Pseudomonas putida KT2440
acggccagccagcagcguaccc

SEQ ID NO: 3563780 - RNA, 13 nt, Pseudomonas putida KT2440
acggccaucagca

SEQ ID NO: 3563781 - RNA, 15 nt, Pseudomonas putida KT2440
acggcccaggggcag

SEQ ID NO: 3563782 - RNA, 18 nt, Pseudomonas putida KT2440
acggcccaugucgaucag

SEQ ID NO: 3563783 - RNA, 19 nt, Pseudomonas putida KT2440
acggcccaugucgaucagc

SEQ ID NO: 3563784 - RNA, 16 nt, Pseudomonas putida KT2440
acggccggggccuguu

SEQ ID NO: 3563785 - RNA, 23 nt, Pseudomonas putida KT2440
acggccggugguaauuggccggc

SEQ ID NO: 3563786 - RNA, 11 nt, Pseudomonas putida KT2440
acggccgugcg

SEQ ID NO: 3563787 - RNA, 19 nt, Pseudomonas putida KT2440
acggccgugcgccugaccg

SEQ ID NO: 3563788 - RNA, 18 nt, Pseudomonas putida KT2440
acggccugcgaugcacgc

SEQ ID NO: 3563789 - RNA, 20 nt, Pseudomonas putida KT2440
acggccugcgcccgaucacc

SEQ ID NO: 3563790 - RNA, 11 nt, Pseudomonas putida KT2440
acggccuggcc

SEQ ID NO: 3563791 - RNA, 18 nt, Pseudomonas putida KT2440
acggccuggccugcaugc

SEQ ID NO: 3563792 - RNA, 19 nt, Pseudomonas putida KT2440
acggcgaagucacaccauc

SEQ ID NO: 3563793 - RNA, 21 nt, Pseudomonas putida KT2440
acggcgauggcgucgacucga

SEQ ID NO: 3563794 - RNA, 21 nt, Pseudomonas putida KT2440
acggcgauggucugcuccagu

SEQ ID NO: 3563795 - RNA, 22 nt, Pseudomonas putida KT2440
acggcgcaauccgugagccagg

SEQ ID NO: 3563796 - RNA, 23 nt, Pseudomonas putida KT2440
acggcgcaauccgugagccagga

SEQ ID NO: 3563797 - RNA, 16 nt, Pseudomonas putida KT2440
acggcgcacucucguc

SEQ ID NO: 3563798 - RNA, 23 nt, Pseudomonas putida KT2440
acggcgcaggccgacaacagcau

SEQ ID NO: 3563799 - RNA, 16 nt, Pseudomonas putida KT2440
acggcgccagcagugc

SEQ ID NO: 3563800 - RNA, 17 nt, Pseudomonas putida KT2440
acggcgccagcagugca

SEQ ID NO: 3563801 - RNA, 19 nt, Pseudomonas putida KT2440
acggcgccgaccgaaccgg

SEQ ID NO: 3563802 - RNA, 15 nt, Pseudomonas putida KT2440
acggcgcugcuggcc

SEQ ID NO: 3563803 - RNA, 22 nt, Pseudomonas putida KT2440
acggcggcagauacaaccccag

SEQ ID NO: 3563804 - RNA, 14 nt, Pseudomonas putida KT2440
acggcggcgaucag

SEQ ID NO: 3563805 - RNA, 14 nt, Pseudomonas putida KT2440
acggcgggcggaga

SEQ ID NO: 3563806 - RNA, 22 nt, Pseudomonas putida KT2440
acggcggguggaaauuggccag

SEQ ID NO: 3563807 - RNA, 14 nt, Pseudomonas putida KT2440
acggcggguggaga

SEQ ID NO: 3563808 - RNA, 16 nt, Pseudomonas putida KT2440
acggcgguucugcgca

SEQ ID NO: 3563809 - RNA, 15 nt, Pseudomonas putida KT2440
acggcgucgacaccg

SEQ ID NO: 3563810 - RNA, 14 nt, Pseudomonas putida KT2440
acggcgucgagcag

SEQ ID NO: 3563811 - RNA, 17 nt, Pseudomonas putida KT2440
acggcuaaagccgcacc

SEQ ID NO: 3563812 - RNA, 14 nt, Pseudomonas putida KT2440
acggcuaccagcag

SEQ ID NO: 3563813 - RNA, 12 nt, Pseudomonas putida KT2440
acggcuaccccg

SEQ ID NO: 3563814 - RNA, 15 nt, Pseudomonas putida KT2440
acggcugaagaagcu

SEQ ID NO: 3563815 - RNA, 21 nt, Pseudomonas putida KT2440
acggcugaugguggucggcag

SEQ ID NO: 3563816 - RNA, 22 nt, Pseudomonas putida KT2440
acggcugaugguggucggcagc

SEQ ID NO: 3563817 - RNA, 16 nt, Pseudomonas putida KT2440
acggcugccgacaggc

SEQ ID NO: 3563818 - RNA, 13 nt, Pseudomonas putida KT2440
acggcuggcgcau

SEQ ID NO: 3563819 - RNA, 16 nt, Pseudomonas putida KT2440
acggcugucagugguc

SEQ ID NO: 3563820 - RNA, 20 nt, Pseudomonas putida KT2440
acggcuucgcgcauuucguc

SEQ ID NO: 3563821 - RNA, 22 nt, Pseudomonas putida KT2440
acggcuucgcgcauuucgucca

SEQ ID NO: 3563822 - RNA, 18 nt, Pseudomonas putida KT2440
acggcuugauauccagca

SEQ ID NO: 3563823 - RNA, 19 nt, Pseudomonas putida KT2440
acggcuugauauccagcac

SEQ ID NO: 3563824 - RNA, 15 nt, Pseudomonas putida KT2440
acggcuugccggcaa

SEQ ID NO: 3563825 - RNA, 23 nt, Pseudomonas putida KT2440
acguucccgccauguugcgcagc

SEQ ID NO: 3563826 - RNA, 21 nt, Pseudomonas putida KT2440
acguucgccauaggccgccug

SEQ ID NO: 3563827 - RNA, 14 nt, Pseudomonas putida KT2440
acguugcccgacac

SEQ ID NO: 3563828 - RNA, 19 nt, Pseudomonas putida KT2440
acguugcgcuugagcaggu

SEQ ID NO: 3563829 - RNA, 17 nt, Pseudomonas putida KT2440
acguugcugccugugcc

SEQ ID NO: 3563830 - RNA, 13 nt, Pseudomonas putida KT2440
acguuggccgcca

SEQ ID NO: 3563831 - RNA, 15 nt, Pseudomonas putida KT2440
acguugguagcggug

SEQ ID NO: 3563832 - RNA, 16 nt, Pseudomonas putida KT2440
acguuguagcccacca

SEQ ID NO: 3563833 - RNA, 15 nt, Pseudomonas putida KT2440
acguuucgucaucca

SEQ ID NO: 3563834 - RNA, 21 nt, Pseudomonas putida KT2440
acguuucgucauccaccgccc

SEQ ID NO: 3563835 - RNA, 16 nt, Pseudomonas putida KT2440
acguuuggcagugcca

SEQ ID NO: 3563836 - RNA, 21 nt, Pseudomonas putida KT2440
acuaagaagcaaccgcugcau

SEQ ID NO: 3563837 - RNA, 15 nt, Pseudomonas putida KT2440
acuaauauuugaaca

SEQ ID NO: 3563838 - RNA, 16 nt, Pseudomonas putida KT2440
acuaccgcaaaugcug

SEQ ID NO: 3563839 - RNA, 17 nt, Pseudomonas putida KT2440
acuaccgcaaaugcugc

SEQ ID NO: 3563840 - RNA, 21 nt, Pseudomonas putida KT2440
acuaucaggggagugucaguu

SEQ ID NO: 3563841 - RNA, 23 nt, Pseudomonas putida KT2440
acuaucugcguuucgcuggccug

SEQ ID NO: 3563842 - RNA, 16 nt, Pseudomonas putida KT2440
acucaaccaccgcuca

SEQ ID NO: 3563843 - RNA, 22 nt, Pseudomonas putida KT2440
acucaacgcaacugcggccccu

SEQ ID NO: 3563844 - RNA, 23 nt, Pseudomonas putida KT2440
acucaacgcaacugcggccccug

SEQ ID NO: 3563845 - RNA, 23 nt, Pseudomonas putida KT2440
acucaauuucccccaaaugcccg

SEQ ID NO: 3563846 - RNA, 14 nt, Pseudomonas putida KT2440
acucaccacaucgg

SEQ ID NO: 3563847 - RNA, 22 nt, Pseudomonas putida KT2440
acucaccacaucggcggcaaug

SEQ ID NO: 3563848 - RNA, 18 nt, Pseudomonas putida KT2440
acucacccgcaccucaca

SEQ ID NO: 3563849 - RNA, 12 nt, Pseudomonas putida KT2440
acucaccgcaca

SEQ ID NO: 3563850 - RNA, 19 nt, Pseudomonas putida KT2440
acucaccggcaucgaaggu

SEQ ID NO: 3563851 - RNA, 24 nt, Pseudomonas putida KT2440
acucacgcucguuguccagcagca

SEQ ID NO: 3563852 - RNA, 15 nt, Pseudomonas putida KT2440
acucacuuucagcgc

SEQ ID NO: 3563853 - RNA, 12 nt, Pseudomonas putida KT2440
acucagcggguc

SEQ ID NO: 3563854 - RNA, 14 nt, Pseudomonas putida KT2440
acucagcugcugcu

SEQ ID NO: 3563855 - RNA, 19 nt, Pseudomonas putida KT2440
acucaggcugagcagacca

SEQ ID NO: 3563856 - RNA, 23 nt, Pseudomonas putida KT2440
acucaggcugagcagaccagccg

SEQ ID NO: 3563857 - RNA, 16 nt, Pseudomonas putida KT2440
acucaggggcauugcg

SEQ ID NO: 3563858 - RNA, 15 nt, Pseudomonas putida KT2440
acucaguuaaucagc

SEQ ID NO: 3563859 - RNA, 20 nt, Pseudomonas putida KT2440
acucaguuaaucagcaacgc

SEQ ID NO: 3563860 - RNA, 12 nt, Pseudomonas putida KT2440
acucauagcuca

SEQ ID NO: 3563861 - RNA, 13 nt, Pseudomonas putida KT2440
acucaugccuucg

SEQ ID NO: 3563862 - RNA, 14 nt, Pseudomonas putida KT2440
acucauuuuguaaa

SEQ ID NO: 3563863 - RNA, 18 nt, Pseudomonas putida KT2440
acucauuuuguaaaaccg

SEQ ID NO: 3563864 - RNA, 20 nt, Pseudomonas putida KT2440
acuccaacgcgccgauugcu

SEQ ID NO: 3563865 - RNA, 22 nt, Pseudomonas putida KT2440
acuccaccaucaagucauccgc

SEQ ID NO: 3563866 - RNA, 13 nt, Pseudomonas putida KT2440
acuccaccgccag

SEQ ID NO: 3563867 - RNA, 17 nt, Pseudomonas putida KT2440
acuccacgacaaaucga

SEQ ID NO: 3563868 - RNA, 14 nt, Pseudomonas putida KT2440
acuccacgcggaac

SEQ ID NO: 3563869 - RNA, 21 nt, Pseudomonas putida KT2440
acuccacugugcccgccaggc

SEQ ID NO: 3563870 - RNA, 17 nt, Pseudomonas putida KT2440
acuccacuuccagcagc

SEQ ID NO: 3563871 - RNA, 15 nt, Pseudomonas putida KT2440
acuccccaccaggca

SEQ ID NO: 3563872 - RNA, 12 nt, Pseudomonas putida KT2440
acuccccaucag

SEQ ID NO: 3563873 - RNA, 15 nt, Pseudomonas putida KT2440
acucccgcugcugcg

SEQ ID NO: 3563874 - RNA, 18 nt, Pseudomonas putida KT2440
acucccgggaucaccgca

SEQ ID NO: 3563875 - RNA, 12 nt, Pseudomonas putida KT2440
acuccgccccaa

SEQ ID NO: 3563876 - RNA, 17 nt, Pseudomonas putida KT2440
acuccgccccaaaccag

SEQ ID NO: 3563877 - RNA, 15 nt, Pseudomonas putida KT2440
acuccgcgagggcau

SEQ ID NO: 3563878 - RNA, 22 nt, Pseudomonas putida KT2440
acuccgcgagggcaucagcgca

SEQ ID NO: 3563879 - RNA, 20 nt, Pseudomonas putida KT2440
acuccgcucauuggaaaaug

SEQ ID NO: 3563880 - RNA, 22 nt, Pseudomonas putida KT2440
acuccgcuucaucaggucgccu

SEQ ID NO: 3563881 - RNA, 15 nt, Pseudomonas putida KT2440
acuccggcaaccccg

SEQ ID NO: 3563882 - RNA, 21 nt, Pseudomonas putida KT2440
acuccggccggggcucacagc

SEQ ID NO: 3563883 - RNA, 21 nt, Pseudomonas putida KT2440
acuccgggugaucauucaggc

SEQ ID NO: 3563884 - RNA, 15 nt, Pseudomonas putida KT2440
acuccuccagccgac

SEQ ID NO: 3563885 - RNA, 21 nt, Pseudomonas putida KT2440
acuccucgaucaccugcggcc

SEQ ID NO: 3563886 - RNA, 23 nt, Pseudomonas putida KT2440
acuccucgaucaccugcggccug

SEQ ID NO: 3563887 - RNA, 16 nt, Pseudomonas putida KT2440
acuccugguuggccag

SEQ ID NO: 3563888 - RNA, 21 nt, Pseudomonas putida KT2440
acuccuugcgcaucaagcggc

SEQ ID NO: 3563889 - RNA, 14 nt, Pseudomonas putida KT2440
acucgaacagcuug

SEQ ID NO: 3563890 - RNA, 15 nt, Pseudomonas putida KT2440
acucgaauucagccc

SEQ ID NO: 3563891 - RNA, 16 nt, Pseudomonas putida KT2440
acucgacgccccggcc

SEQ ID NO: 3563892 - RNA, 21 nt, Pseudomonas putida KT2440
acucgacgccccggccugcac

SEQ ID NO: 3563893 - RNA, 14 nt, Pseudomonas putida KT2440
acucgcaagcucca

SEQ ID NO: 3563894 - RNA, 22 nt, Pseudomonas putida KT2440
acucgcagcgcaaaaaacgccg

SEQ ID NO: 3563895 - RNA, 20 nt, Pseudomonas putida KT2440
acucgcccccaucgcagggu

SEQ ID NO: 3563896 - RNA, 15 nt, Pseudomonas putida KT2440
acucgcccgccaggu

SEQ ID NO: 3563897 - RNA, 19 nt, Pseudomonas putida KT2440
acucgccgagaaauggcag

SEQ ID NO: 3563898 - RNA, 13 nt, Pseudomonas putida KT2440
acucgcgcagcac

SEQ ID NO: 3563899 - RNA, 14 nt, Pseudomonas putida KT2440
acucgcgcagcaca

SEQ ID NO: 3563900 - RNA, 17 nt, Pseudomonas putida KT2440
acucgcgcagcacauca

SEQ ID NO: 3563901 - RNA, 18 nt, Pseudomonas putida KT2440
acucgcgcauccagccag

SEQ ID NO: 3563902 - RNA, 15 nt, Pseudomonas putida KT2440
acucggacuucagcu

SEQ ID NO: 3563903 - RNA, 22 nt, Pseudomonas putida KT2440
acucggcaaucagcaucagugc

SEQ ID NO: 3563904 - RNA, 15 nt, Pseudomonas putida KT2440
acucggcaggaaaca

SEQ ID NO: 3563905 - RNA, 19 nt, Pseudomonas putida KT2440
acucggcaggaaacaccag

SEQ ID NO: 3563906 - RNA, 20 nt, Pseudomonas putida KT2440
acucggccagguacucgcgc

SEQ ID NO: 3563907 - RNA, 22 nt, Pseudomonas putida KT2440
acucggccgggcguagcaggau

SEQ ID NO: 3563908 - RNA, 16 nt, Pseudomonas putida KT2440
acucggcguagcaggu

SEQ ID NO: 3563909 - RNA, 19 nt, Pseudomonas putida KT2440
acucggcguagcagguacg

SEQ ID NO: 3563910 - RNA, 17 nt, Pseudomonas putida KT2440
acucggucggcuggcac

SEQ ID NO: 3563911 - RNA, 15 nt, Pseudomonas putida KT2440
acucgucacccucca

SEQ ID NO: 3563912 - RNA, 13 nt, Pseudomonas putida KT2440
acucguucagugc

SEQ ID NO: 3563913 - RNA, 21 nt, Pseudomonas putida KT2440
acucguuggcaaagcugaauu

SEQ ID NO: 3563914 - RNA, 14 nt, Pseudomonas putida KT2440
acucuccuugcguu

SEQ ID NO: 3563915 - RNA, 16 nt, Pseudomonas putida KT2440
acucuccuugcguugc

SEQ ID NO: 3563916 - RNA, 13 nt, Pseudomonas putida KT2440
acucugcugcucu

SEQ ID NO: 3563917 - RNA, 14 nt, Pseudomonas putida KT2440
acucugucacccgc

SEQ ID NO: 3563918 - RNA, 21 nt, Pseudomonas putida KT2440
acucugucacccgcugcacgu

SEQ ID NO: 3563919 - RNA, 12 nt, Pseudomonas putida KT2440
acucuucaccag

SEQ ID NO: 3563920 - RNA, 16 nt, Pseudomonas putida KT2440
acucuucaccagcucg

SEQ ID NO: 3563921 - RNA, 14 nt, Pseudomonas putida KT2440
acucuucccaccac

SEQ ID NO: 3563922 - RNA, 18 nt, Pseudomonas putida KT2440
acucuucgacggucggca

SEQ ID NO: 3563923 - RNA, 14 nt, Pseudomonas putida KT2440
acucuucgcgggcu

SEQ ID NO: 3563924 - RNA, 17 nt, Pseudomonas putida KT2440
acucuugagcuggccgu

SEQ ID NO: 3563925 - RNA, 13 nt, Pseudomonas putida KT2440
acucuugcgccag

SEQ ID NO: 3563926 - RNA, 22 nt, Pseudomonas putida KT2440
acucuuguguugccacccggcu

SEQ ID NO: 3563927 - RNA, 18 nt, Pseudomonas putida KT2440
acugaacaccugccagcc

SEQ ID NO: 3563928 - RNA, 14 nt, Pseudomonas putida KT2440
acugaacagcgccu

SEQ ID NO: 3563929 - RNA, 15 nt, Pseudomonas putida KT2440
acugaauuggccggc

SEQ ID NO: 3563930 - RNA, 22 nt, Pseudomonas putida KT2440
acuguucagguguuccagcacg

SEQ ID NO: 3563931 - RNA, 13 nt, Pseudomonas putida KT2440
acuguugcagcgc

SEQ ID NO: 3563932 - RNA, 14 nt, Pseudomonas putida KT2440
acuguugucggcca

SEQ ID NO: 3563933 - RNA, 11 nt, Pseudomonas putida KT2440
acuguuugagc

SEQ ID NO: 3563934 - RNA, 18 nt, Pseudomonas putida KT2440
acuguuugagccggcgcu

SEQ ID NO: 3563935 - RNA, 13 nt, Pseudomonas putida KT2440
acuguuuugagag

SEQ ID NO: 3563936 - RNA, 17 nt, Pseudomonas putida KT2440
acuuacuaucacgccuu

SEQ ID NO: 3563937 - RNA, 20 nt, Pseudomonas putida KT2440
acuuauaagcagcaagccug

SEQ ID NO: 3563938 - RNA, 13 nt, Pseudomonas putida KT2440
acuucaaccgcac

SEQ ID NO: 3563939 - RNA, 21 nt, Pseudomonas putida KT2440
acuucaaguucguuggcgaac

SEQ ID NO: 3563940 - RNA, 14 nt, Pseudomonas putida KT2440
acuucaaugcccag

SEQ ID NO: 3563941 - RNA, 22 nt, Pseudomonas putida KT2440
acuucaggcugcgccgccucca

SEQ ID NO: 3563942 - RNA, 23 nt, Pseudomonas putida KT2440
acuucauggucgaccgcuauggc

SEQ ID NO: 3563943 - RNA, 12 nt, Pseudomonas putida KT2440
acuuccacaccc

SEQ ID NO: 3563944 - RNA, 16 nt, Pseudomonas putida KT2440
acuuccagcagcuuca

SEQ ID NO: 3563945 - RNA, 17 nt, Pseudomonas putida KT2440
acuuccagcaucgcccc

SEQ ID NO: 3563946 - RNA, 15 nt, Pseudomonas putida KT2440
acuuccagcuugccg

SEQ ID NO: 3563947 - RNA, 13 nt, Pseudomonas putida KT2440
acuuccaggccca

SEQ ID NO: 3563948 - RNA, 17 nt, Pseudomonas putida KT2440
acuuccaggcccauuuc

SEQ ID NO: 3563949 - RNA, 19 nt, Pseudomonas putida KT2440
acuuccaguccgccucguc

SEQ ID NO: 3563950 - RNA, 15 nt, Pseudomonas putida KT2440
acuuccccggcgccg

SEQ ID NO: 3563951 - RNA, 17 nt, Pseudomonas putida KT2440
acuuccccggcgccgcc

SEQ ID NO: 3563952 - RNA, 20 nt, Pseudomonas putida KT2440
acuucccgcaagccagccuc

SEQ ID NO: 3563953 - RNA, 13 nt, Pseudomonas putida KT2440
acuucccguucgc

SEQ ID NO: 3563954 - RNA, 15 nt, Pseudomonas putida KT2440
acuucccucugccug

SEQ ID NO: 3563955 - RNA, 16 nt, Pseudomonas putida KT2440
acuuccggcugcagca

SEQ ID NO: 3563956 - RNA, 13 nt, Pseudomonas putida KT2440
acuuccuggccgc

SEQ ID NO: 3563957 - RNA, 18 nt, Pseudomonas putida KT2440
acuuccuugaccauuucc

SEQ ID NO: 3563958 - RNA, 19 nt, Pseudomonas putida KT2440
acuucgccguacuggcugc

SEQ ID NO: 3563959 - RNA, 21 nt, Pseudomonas putida KT2440
acuucgccguacuggcugcac

SEQ ID NO: 3563960 - RNA, 21 nt, Pseudomonas putida KT2440
acuucgcugucuuccagggca

SEQ ID NO: 3563961 - RNA, 23 nt, Pseudomonas putida KT2440
acuucgcugucuuccagggcaau

SEQ ID NO: 3563962 - RNA, 23 nt, Pseudomonas putida KT2440
acuucgggcuguccucaaucaca

SEQ ID NO: 3563963 - RNA, 16 nt, Pseudomonas putida KT2440
acuucugcggccaggg

SEQ ID NO: 3563964 - RNA, 21 nt, Pseudomonas putida KT2440
acuugacguccagcucaacgc

SEQ ID NO: 3563965 - RNA, 23 nt, Pseudomonas putida KT2440
acuugaucgcguuacccaccaga

SEQ ID NO: 3563966 - RNA, 20 nt, Pseudomonas putida KT2440
acuugauugggcuuggcagc

SEQ ID NO: 3563967 - RNA, 12 nt, Pseudomonas putida KT2440
acuugcagcucg

SEQ ID NO: 3563968 - RNA, 15 nt, Pseudomonas putida KT2440
acuugcaggugcagg

SEQ ID NO: 3563969 - RNA, 15 nt, Pseudomonas putida KT2440
acuugccgcccuccg

SEQ ID NO: 3563970 - RNA, 20 nt, Pseudomonas putida KT2440
acuugccugucauggcaguc

SEQ ID NO: 3563971 - RNA, 15 nt, Pseudomonas putida KT2440
acuugcgcagcuugu

SEQ ID NO: 3563972 - RNA, 18 nt, Pseudomonas putida KT2440
acuugcgcaguaacaggc

SEQ ID NO: 3563973 - RNA, 21 nt, Pseudomonas putida KT2440
acuugcgccccucaucaaacc

SEQ ID NO: 3563974 - RNA, 17 nt, Pseudomonas putida KT2440
acuugcgggucagcagc

SEQ ID NO: 3563975 - RNA, 12 nt, Pseudomonas putida KT2440
acuugcguucgc

SEQ ID NO: 3563976 - RNA, 20 nt, Pseudomonas putida KT2440
acuugcucggugcugcugcc

SEQ ID NO: 3563977 - RNA, 18 nt, Pseudomonas putida KT2440
acuugcuggguaccgugc

SEQ ID NO: 3563978 - RNA, 16 nt, Pseudomonas putida KT2440
acuuggaaaacagcgc

SEQ ID NO: 3563979 - RNA, 17 nt, Pseudomonas putida KT2440
acuuggccugcugauua

SEQ ID NO: 3563980 - RNA, 14 nt, Pseudomonas putida KT2440
acuugugcauccug

SEQ ID NO: 3563981 - RNA, 16 nt, Pseudomonas putida KT2440
acuugugcauccugca

SEQ ID NO: 3563982 - RNA, 17 nt, Pseudomonas putida KT2440
acuuguuggccaccauc

SEQ ID NO: 3563983 - RNA, 21 nt, Pseudomonas putida KT2440
acuuuaaaacuaauauuugaa

SEQ ID NO: 3563984 - RNA, 23 nt, Pseudomonas putida KT2440
acuuucaccccuuuacuggccau

SEQ ID NO: 3563985 - RNA, 12 nt, Pseudomonas putida KT2440
acuuucuugaaa

SEQ ID NO: 3563986 - RNA, 14 nt, Pseudomonas putida KT2440
acuuucuugaaauu

SEQ ID NO: 3563987 - RNA, 16 nt, Pseudomonas putida KT2440
acuuuuagguggacac

SEQ ID NO: 3563988 - RNA, 20 nt, Pseudomonas putida KT2440
acuuuugccacccgaacaaa

SEQ ID NO: 3563989 - RNA, 21 nt, Pseudomonas putida KT2440
acuuuugcuggcuguaccggc

SEQ ID NO: 3563990 - RNA, 24 nt, Pseudomonas putida KT2440
acuuuugcuggcuguaccggccuc

SEQ ID NO: 3563991 - RNA, 13 nt, Pseudomonas putida KT2440
acuuuuucagguu

SEQ ID NO: 3563992 - RNA, 14 nt, Pseudomonas putida KT2440
agaaaaaacagugc

SEQ ID NO: 3563993 - RNA, 16 nt, Pseudomonas putida KT2440
agaaaagcaucaacuc

SEQ ID NO: 3563994 - RNA, 21 nt, Pseudomonas putida KT2440
agaaaagcccgcacugcaaug

SEQ ID NO: 3563995 - RNA, 15 nt, Pseudomonas putida KT2440
agaaacaccaggccu

SEQ ID NO: 3563996 - RNA, 19 nt, Pseudomonas putida KT2440
agaaacucacgcauggccg

SEQ ID NO: 3563997 - RNA, 15 nt, Pseudomonas putida KT2440
agaaagaauggaaag

SEQ ID NO: 3563998 - RNA, 20 nt, Pseudomonas putida KT2440
agaaagcgauugcccagcgu

SEQ ID NO: 3563999 - RNA, 14 nt, Pseudomonas putida KT2440
agaaaguccaucug

SEQ ID NO: 3564000 - RNA, 17 nt, Pseudomonas putida KT2440
agaaaguuugguuuuuu

SEQ ID NO: 3564001 - RNA, 13 nt, Pseudomonas putida KT2440
agaacaacacggc

SEQ ID NO: 3564002 - RNA, 21 nt, Pseudomonas putida KT2440
agaacaaccggggcuccggcg

SEQ ID NO: 3564003 - RNA, 20 nt, Pseudomonas putida KT2440
agaacaagccccuccuaagg

SEQ ID NO: 3564004 - RNA, 21 nt, Pseudomonas putida KT2440
agaacaagucgcgcaccaccu

SEQ ID NO: 3564005 - RNA, 20 nt, Pseudomonas putida KT2440
agaacacggugacaaaggcc

SEQ ID NO: 3564006 - RNA, 17 nt, Pseudomonas putida KT2440
agaacagccacagcugc

SEQ ID NO: 3564007 - RNA, 22 nt, Pseudomonas putida KT2440
agaacagcgucaugcgguacag

SEQ ID NO: 3564008 - RNA, 16 nt, Pseudomonas putida KT2440
agaacagcgugccaug

SEQ ID NO: 3564009 - RNA, 19 nt, Pseudomonas putida KT2440
agaacagcgugccaugcag

SEQ ID NO: 3564010 - RNA, 15 nt, Pseudomonas putida KT2440
agaacagcuggaugg

SEQ ID NO: 3564011 - RNA, 18 nt, Pseudomonas putida KT2440
agaacaggcggcccggca

SEQ ID NO: 3564012 - RNA, 15 nt, Pseudomonas putida KT2440
agaacaucacgaagg

SEQ ID NO: 3564013 - RNA, 17 nt, Pseudomonas putida KT2440
agaacaucacgaaggug

SEQ ID NO: 3564014 - RNA, 19 nt, Pseudomonas putida KT2440
agaaccccacucuccauau

SEQ ID NO: 3564015 - RNA, 15 nt, Pseudomonas putida KT2440
agaaccgccagcacc

SEQ ID NO: 3564016 - RNA, 23 nt, Pseudomonas putida KT2440
agaaccguuucaguacagccguu

SEQ ID NO: 3564017 - RNA, 12 nt, Pseudomonas putida KT2440
agaaccugggac

SEQ ID NO: 3564018 - RNA, 14 nt, Pseudomonas putida KT2440
agaacggcagcagg

SEQ ID NO: 3564019 - RNA, 20 nt, Pseudomonas putida KT2440
agaacggcagcaggccaaug

SEQ ID NO: 3564020 - RNA, 19 nt, Pseudomonas putida KT2440
agaacgggucauugcugau

SEQ ID NO: 3564021 - RNA, 19 nt, Pseudomonas putida KT2440
agaacuccaccagcccacc

SEQ ID NO: 3564022 - RNA, 12 nt, Pseudomonas putida KT2440
agaacuggcgca

SEQ ID NO: 3564023 - RNA, 22 nt, Pseudomonas putida KT2440
agaacuggcgcagcagguccag

SEQ ID NO: 3564024 - RNA, 19 nt, Pseudomonas putida KT2440
agaacuugguccagaaaau

SEQ ID NO: 3564025 - RNA, 17 nt, Pseudomonas putida KT2440
agaagaaggagagccuc

SEQ ID NO: 3564026 - RNA, 16 nt, Pseudomonas putida KT2440
agaagcagaacaucag

SEQ ID NO: 3564027 - RNA, 16 nt, Pseudomonas putida KT2440
agaagcagaucaucau

SEQ ID NO: 3564028 - RNA, 16 nt, Pseudomonas putida KT2440
agaagcauuacuucuu

SEQ ID NO: 3564029 - RNA, 14 nt, Pseudomonas putida KT2440
agaagccaccgcga

SEQ ID NO: 3564030 - RNA, 15 nt, Pseudomonas putida KT2440
agaagccacuggccu

SEQ ID NO: 3564031 - RNA, 23 nt, Pseudomonas putida KT2440
agaagccggcaucgccaacagag

SEQ ID NO: 3564032 - RNA, 16 nt, Pseudomonas putida KT2440
agaagccucaccgccg

SEQ ID NO: 3564033 - RNA, 14 nt, Pseudomonas putida KT2440
agaagccuuggccu

SEQ ID NO: 3564034 - RNA, 19 nt, Pseudomonas putida KT2440
agaagccuuggccuuggca

SEQ ID NO: 3564035 - RNA, 17 nt, Pseudomonas putida KT2440
agacgcaaaaaacccgg

SEQ ID NO: 3564036 - RNA, 21 nt, Pseudomonas putida KT2440
agacgccgcagugacacggcg

SEQ ID NO: 3564037 - RNA, 17 nt, Pseudomonas putida KT2440
agacgcucgacagcaac

SEQ ID NO: 3564038 - RNA, 21 nt, Pseudomonas putida KT2440
agacgcuugcgcauggccgcc

SEQ ID NO: 3564039 - RNA, 20 nt, Pseudomonas putida KT2440
agacggccuucgaagaacac

SEQ ID NO: 3564040 - RNA, 21 nt, Pseudomonas putida KT2440
agacgggcgacggaucggcac

SEQ ID NO: 3564041 - RNA, 18 nt, Pseudomonas putida KT2440
agacggucuccccuuccc

SEQ ID NO: 3564042 - RNA, 14 nt, Pseudomonas putida KT2440
agacgguggcugcc

SEQ ID NO: 3564043 - RNA, 18 nt, Pseudomonas putida KT2440
agacuaccaacaccggcg

SEQ ID NO: 3564044 - RNA, 17 nt, Pseudomonas putida KT2440
agacuagcagucccauc

SEQ ID NO: 3564045 - RNA, 17 nt, Pseudomonas putida KT2440
agacucaaucaggcagc

SEQ ID NO: 3564046 - RNA, 19 nt, Pseudomonas putida KT2440
agacuucgaagugccacgc

SEQ ID NO: 3564047 - RNA, 22 nt, Pseudomonas putida KT2440
agacuucgcugucuuccagggc

SEQ ID NO: 3564048 - RNA, 23 nt, Pseudomonas putida KT2440
agacuuucccacauguaaugaaa

SEQ ID NO: 3564049 - RNA, 16 nt, Pseudomonas putida KT2440
agacuuuccugaaacc

SEQ ID NO: 3564050 - RNA, 22 nt, Pseudomonas putida KT2440
agacuuuccugaaaccccgccc

SEQ ID NO: 3564051 - RNA, 13 nt, Pseudomonas putida KT2440
agagaagcugcag

SEQ ID NO: 3564052 - RNA, 16 nt, Pseudomonas putida KT2440
agagaccgauuucaac

SEQ ID NO: 3564053 - RNA, 18 nt, Pseudomonas putida KT2440
agagauaucgcauuucua

SEQ ID NO: 3564054 - RNA, 18 nt, Pseudomonas putida KT2440
agagcaguuccuucagca

SEQ ID NO: 3564055 - RNA, 22 nt, Pseudomonas putida KT2440
agagcauggccagccggcagca

SEQ ID NO: 3564056 - RNA, 23 nt, Pseudomonas putida KT2440
agagcauggccagccggcagcaa

SEQ ID NO: 3564057 - RNA, 12 nt, Pseudomonas putida KT2440
agagcccggcgc

SEQ ID NO: 3564058 - RNA, 16 nt, Pseudomonas putida KT2440
agagccggugccaucc

SEQ ID NO: 3564059 - RNA, 16 nt, Pseudomonas putida KT2440
agagcgacuggugugg

SEQ ID NO: 3564060 - RNA, 18 nt, Pseudomonas putida KT2440
agagcgcgccacgcacca

SEQ ID NO: 3564061 - RNA, 13 nt, Pseudomonas putida KT2440
agagcggccccaa

SEQ ID NO: 3564062 - RNA, 21 nt, Pseudomonas putida KT2440
agagcggccccaagcuucacc

SEQ ID NO: 3564063 - RNA, 15 nt, Pseudomonas putida KT2440
agagcggcuucuacc

SEQ ID NO: 3564064 - RNA, 15 nt, Pseudomonas putida KT2440
agaggacucgcggug

SEQ ID NO: 3564065 - RNA, 14 nt, Pseudomonas putida KT2440
agaggcagcgaaag

SEQ ID NO: 3564066 - RNA, 20 nt, Pseudomonas putida KT2440
agaggccaguaccagcagca

SEQ ID NO: 3564067 - RNA, 16 nt, Pseudomonas putida KT2440
agaggccagugagccu

SEQ ID NO: 3564068 - RNA, 21 nt, Pseudomonas putida KT2440
agaggccggcacagacaccac

SEQ ID NO: 3564069 - RNA, 18 nt, Pseudomonas putida KT2440
agaggccggcacaggaag

SEQ ID NO: 3564070 - RNA, 20 nt, Pseudomonas putida KT2440
agaggccggcacaggaaggc

SEQ ID NO: 3564071 - RNA, 18 nt, Pseudomonas putida KT2440
agaggccgguacaggcuu

SEQ ID NO: 3564072 - RNA, 17 nt, Pseudomonas putida KT2440
agaggccucaaucacug

SEQ ID NO: 3564073 - RNA, 19 nt, Pseudomonas putida KT2440
agaggcgggucagguggcu

SEQ ID NO: 3564074 - RNA, 15 nt, Pseudomonas putida KT2440
agagguacaccccca

SEQ ID NO: 3564075 - RNA, 22 nt, Pseudomonas putida KT2440
agaguaacugaauggcugguga

SEQ ID NO: 3564076 - RNA, 19 nt, Pseudomonas putida KT2440
agaguccagugcgguggau

SEQ ID NO: 3564077 - RNA, 16 nt, Pseudomonas putida KT2440
agaguccgaagcgaac

SEQ ID NO: 3564078 - RNA, 17 nt, Pseudomonas putida KT2440
agaguccgaagcgaaca

SEQ ID NO: 3564079 - RNA, 14 nt, Pseudomonas putida KT2440
agauaacacccccc

SEQ ID NO: 3564080 - RNA, 19 nt, Pseudomonas putida KT2440
agauacaggcuguuccauu

SEQ ID NO: 3564081 - RNA, 22 nt, Pseudomonas putida KT2440
agauacgcgaggcauccacacc

SEQ ID NO: 3564082 - RNA, 18 nt, Pseudomonas putida KT2440
agauauugguccagccac

SEQ ID NO: 3564083 - RNA, 21 nt, Pseudomonas putida KT2440
agaucaacgccgccagcggcu

SEQ ID NO: 3564084 - RNA, 13 nt, Pseudomonas putida KT2440
agaucaagccccu

SEQ ID NO: 3564085 - RNA, 14 nt, Pseudomonas putida KT2440
agaucaagccccug

SEQ ID NO: 3564086 - RNA, 13 nt, Pseudomonas putida KT2440
agaucaccagcuc

SEQ ID NO: 3564087 - RNA, 18 nt, Pseudomonas putida KT2440
agaucacccuuggccacc

SEQ ID NO: 3564088 - RNA, 21 nt, Pseudomonas putida KT2440
agaucagcaaccugcugggca

SEQ ID NO: 3564089 - RNA, 22 nt, Pseudomonas putida KT2440
agaucaggcaaucacgaucacu

SEQ ID NO: 3564090 - RNA, 12 nt, Pseudomonas putida KT2440
agaucaucagcg

SEQ ID NO: 3564091 - RNA, 19 nt, Pseudomonas putida KT2440
agaucauuaccugcaggcg

SEQ ID NO: 3564092 - RNA, 11 nt, Pseudomonas putida KT2440
agauccaugua

SEQ ID NO: 3564093 - RNA, 14 nt, Pseudomonas putida KT2440
agaucccgcuccuc

SEQ ID NO: 3564094 - RNA, 13 nt, Pseudomonas putida KT2440
agauccugcagcc

SEQ ID NO: 3564095 - RNA, 22 nt, Pseudomonas putida KT2440
agauccugcagccgcaccugcc

SEQ ID NO: 3564096 - RNA, 15 nt, Pseudomonas putida KT2440
agaucgagcgccgcc

SEQ ID NO: 3564097 - RNA, 14 nt, Pseudomonas putida KT2440
agcaccgcugccag

SEQ ID NO: 3564098 - RNA, 19 nt, Pseudomonas putida KT2440
agcaccgcugccagcugcg

SEQ ID NO: 3564099 - RNA, 17 nt, Pseudomonas putida KT2440
agcaccgcuucacccuc

SEQ ID NO: 3564100 - RNA, 14 nt, Pseudomonas putida KT2440
agcaccggcagguu

SEQ ID NO: 3564101 - RNA, 15 nt, Pseudomonas putida KT2440
agcaccggcaguaca

SEQ ID NO: 3564102 - RNA, 14 nt, Pseudomonas putida KT2440
agcaccgggcgggu

SEQ ID NO: 3564103 - RNA, 19 nt, Pseudomonas putida KT2440
agcaccgguaccgcucugc

SEQ ID NO: 3564104 - RNA, 23 nt, Pseudomonas putida KT2440
agcaccgguaccgcucugcgcca

SEQ ID NO: 3564105 - RNA, 16 nt, Pseudomonas putida KT2440
agcaccuccugcacau

SEQ ID NO: 3564106 - RNA, 19 nt, Pseudomonas putida KT2440
agcaccuccugcacauaca

SEQ ID NO: 3564107 - RNA, 21 nt, Pseudomonas putida KT2440
agcaccucgcucagcuugaac

SEQ ID NO: 3564108 - RNA, 21 nt, Pseudomonas putida KT2440
agcaccugcagguacagcagc

SEQ ID NO: 3564109 - RNA, 17 nt, Pseudomonas putida KT2440
agcaccugccagccgca

SEQ ID NO: 3564110 - RNA, 12 nt, Pseudomonas putida KT2440
agcaccuggcgg

SEQ ID NO: 3564111 - RNA, 15 nt, Pseudomonas putida KT2440
agcaccugggcguca

SEQ ID NO: 3564112 - RNA, 13 nt, Pseudomonas putida KT2440
agcaccuucuugc

SEQ ID NO: 3564113 - RNA, 16 nt, Pseudomonas putida KT2440
agcaccuucuugccca

SEQ ID NO: 3564114 - RNA, 17 nt, Pseudomonas putida KT2440
agcacgaaacugcgcug

SEQ ID NO: 3564115 - RNA, 23 nt, Pseudomonas putida KT2440
agcacgaaacugcgcugguacag

SEQ ID NO: 3564116 - RNA, 14 nt, Pseudomonas putida KT2440
agcacgaacagcaa

SEQ ID NO: 3564117 - RNA, 14 nt, Pseudomonas putida KT2440
agcacgaaggccag

SEQ ID NO: 3564118 - RNA, 16 nt, Pseudomonas putida KT2440
agcacgaaggccagca

SEQ ID NO: 3564119 - RNA, 14 nt, Pseudomonas putida KT2440
agcacgaucagcgc

SEQ ID NO: 3564120 - RNA, 17 nt, Pseudomonas putida KT2440
agcacgaucagcgcggc

SEQ ID NO: 3564121 - RNA, 17 nt, Pseudomonas putida KT2440
agcacgauggcggucga

SEQ ID NO: 3564122 - RNA, 14 nt, Pseudomonas putida KT2440
agcacgcaggccag

SEQ ID NO: 3564123 - RNA, 14 nt, Pseudomonas putida KT2440
agcacgcccaucag

SEQ ID NO: 3564124 - RNA, 16 nt, Pseudomonas putida KT2440
agcacgcccaucagcg

SEQ ID NO: 3564125 - RNA, 23 nt, Pseudomonas putida KT2440
agcacgcuggccagaguauugaa

SEQ ID NO: 3564126 - RNA, 13 nt, Pseudomonas putida KT2440
agcacggaaucac

SEQ ID NO: 3564127 - RNA, 15 nt, Pseudomonas putida KT2440
agcacggccagcacc

SEQ ID NO: 3564128 - RNA, 19 nt, Pseudomonas putida KT2440
agcacggccuucuucggug

SEQ ID NO: 3564129 - RNA, 19 nt, Pseudomonas putida KT2440
agcacgggcacacuggcca

SEQ ID NO: 3564130 - RNA, 20 nt, Pseudomonas putida KT2440
agcacgggcacacuggccac

SEQ ID NO: 3564131 - RNA, 22 nt, Pseudomonas putida KT2440
agcacgucgcgauugaucagcg

SEQ ID NO: 3564132 - RNA, 13 nt, Pseudomonas putida KT2440
agcacucggcggc

SEQ ID NO: 3564133 - RNA, 16 nt, Pseudomonas putida KT2440
agcacugcauuggcca

SEQ ID NO: 3564134 - RNA, 21 nt, Pseudomonas putida KT2440
agcacugccagcccggcggcc

SEQ ID NO: 3564135 - RNA, 23 nt, Pseudomonas putida KT2440
agcacugccugcaugcgugccuu

SEQ ID NO: 3564136 - RNA, 15 nt, Pseudomonas putida KT2440
agcacugccuggcca

SEQ ID NO: 3564137 - RNA, 16 nt, Pseudomonas putida KT2440
agcacugccuggccac

SEQ ID NO: 3564138 - RNA, 17 nt, Pseudomonas putida KT2440
agcacugccuggccacu

SEQ ID NO: 3564139 - RNA, 21 nt, Pseudomonas putida KT2440
agcacugccuggccacuguug

SEQ ID NO: 3564140 - RNA, 17 nt, Pseudomonas putida KT2440
agcacugccuugcccug

SEQ ID NO: 3564141 - RNA, 18 nt, Pseudomonas putida KT2440
agcacugccuugcccugc

SEQ ID NO: 3564142 - RNA, 16 nt, Pseudomonas putida KT2440
agcacugcugcgcagu

SEQ ID NO: 3564143 - RNA, 23 nt, Pseudomonas putida KT2440
agcacugcugcgcaguacaggcu

SEQ ID NO: 3564144 - RNA, 20 nt, Pseudomonas putida KT2440
agcacuugcuugacagcguu

SEQ ID NO: 3564145 - RNA, 16 nt, Pseudomonas putida KT2440
agcacuuuugccacca

SEQ ID NO: 3564146 - RNA, 17 nt, Pseudomonas putida KT2440
agcacuuuugccaccac

SEQ ID NO: 3564147 - RNA, 19 nt, Pseudomonas putida KT2440
agcacuuuugccaccaccc

SEQ ID NO: 3564148 - RNA, 13 nt, Pseudomonas putida KT2440
agcagaacagaaa

SEQ ID NO: 3564149 - RNA, 14 nt, Pseudomonas putida KT2440
agcagaaugguguu

SEQ ID NO: 3564150 - RNA, 14 nt, Pseudomonas putida KT2440
agcagacaacgcgg

SEQ ID NO: 3564151 - RNA, 16 nt, Pseudomonas putida KT2440
agcagaucacaaaguu

SEQ ID NO: 3564152 - RNA, 15 nt, Pseudomonas putida KT2440
agcagcaacgcaucg

SEQ ID NO: 3564153 - RNA, 15 nt, Pseudomonas putida KT2440
agcagcaagccugcu

SEQ ID NO: 3564154 - RNA, 18 nt, Pseudomonas putida KT2440
agcagcaaugccgaacag

SEQ ID NO: 3564155 - RNA, 21 nt, Pseudomonas putida KT2440
agcagcacaucccgucagccg

SEQ ID NO: 3564156 - RNA, 22 nt, Pseudomonas putida KT2440
agcagcacaucccgucagccga

SEQ ID NO: 3564157 - RNA, 14 nt, Pseudomonas putida KT2440
agcagcaccgauca

SEQ ID NO: 3564158 - RNA, 19 nt, Pseudomonas putida KT2440
agcagcaccgccaccaugc

SEQ ID NO: 3564159 - RNA, 13 nt, Pseudomonas putida KT2440
agcagcagagaga

SEQ ID NO: 3564160 - RNA, 22 nt, Pseudomonas putida KT2440
agcagcagagagauugagagga

SEQ ID NO: 3564161 - RNA, 16 nt, Pseudomonas putida KT2440
agcagcagccccagcg

SEQ ID NO: 3564162 - RNA, 13 nt, Pseudomonas putida KT2440
agcagcagcccuu

SEQ ID NO: 3564163 - RNA, 15 nt, Pseudomonas putida KT2440
agcagcagcgcaccg

SEQ ID NO: 3564164 - RNA, 17 nt, Pseudomonas putida KT2440
agcagcagcuugcagcg

SEQ ID NO: 3564165 - RNA, 13 nt, Pseudomonas putida KT2440
agcagcaggcccg

SEQ ID NO: 3564166 - RNA, 22 nt, Pseudomonas putida KT2440
agcagcaggcccgccaccgccu

SEQ ID NO: 3564167 - RNA, 22 nt, Pseudomonas putida KT2440
agcagcaguucggcaacauuca

SEQ ID NO: 3564168 - RNA, 18 nt, Pseudomonas putida KT2440
agcagccaacgccccagg

SEQ ID NO: 3564169 - RNA, 11 nt, Pseudomonas putida KT2440
agcagccacca

SEQ ID NO: 3564170 - RNA, 12 nt, Pseudomonas putida KT2440
agcagccacccu

SEQ ID NO: 3564171 - RNA, 18 nt, Pseudomonas putida KT2440
agcagccccacgcccagg

SEQ ID NO: 3564172 - RNA, 23 nt, Pseudomonas putida KT2440
agcagcccccaacccucacucgc

SEQ ID NO: 3564173 - RNA, 17 nt, Pseudomonas putida KT2440
agcagccgccgccuguc

SEQ ID NO: 3564174 - RNA, 14 nt, Pseudomonas putida KT2440
agcagccucggccu

SEQ ID NO: 3564175 - RNA, 15 nt, Pseudomonas putida KT2440
agcagccucggccuc

SEQ ID NO: 3564176 - RNA, 16 nt, Pseudomonas putida KT2440
agcagcgaagggcuca

SEQ ID NO: 3564177 - RNA, 23 nt, Pseudomonas putida KT2440
agcagcgacaacgcgaaagcgaa

SEQ ID NO: 3564178 - RNA, 16 nt, Pseudomonas putida KT2440
agcagcgacaccagcg

SEQ ID NO: 3564179 - RNA, 18 nt, Pseudomonas putida KT2440
agcagcgacaccagcgca

SEQ ID NO: 3564180 - RNA, 19 nt, Pseudomonas putida KT2440
agcagcgacaccagcgcac

SEQ ID NO: 3564181 - RNA, 12 nt, Pseudomonas putida KT2440
agcagcgacacu

SEQ ID NO: 3564182 - RNA, 17 nt, Pseudomonas putida KT2440
agcagcgcauccaccuc

SEQ ID NO: 3564183 - RNA, 21 nt, Pseudomonas putida KT2440
agcagcgccgccaggcccacc

SEQ ID NO: 3564184 - RNA, 15 nt, Pseudomonas putida KT2440
agcagcgcgccgaac

SEQ ID NO: 3564185 - RNA, 14 nt, Pseudomonas putida KT2440
agcagcgcuaugcc

SEQ ID NO: 3564186 - RNA, 14 nt, Pseudomonas putida KT2440
agcagcgcuccgcc

SEQ ID NO: 3564187 - RNA, 15 nt, Pseudomonas putida KT2440
agcagcgcuccgcca

SEQ ID NO: 3564188 - RNA, 11 nt, Pseudomonas putida KT2440
agcagcgggca

SEQ ID NO: 3564189 - RNA, 23 nt, Pseudomonas putida KT2440
agcagcgggcacaggccgcgcau

SEQ ID NO: 3564190 - RNA, 19 nt, Pseudomonas putida KT2440
agcagcggguuccccagca

SEQ ID NO: 3564191 - RNA, 17 nt, Pseudomonas putida KT2440
agcagcguacccagcuc

SEQ ID NO: 3564192 - RNA, 13 nt, Pseudomonas putida KT2440
agcagcuccagcg

SEQ ID NO: 3564193 - RNA, 15 nt, Pseudomonas putida KT2440
agcagcuccagcguu

SEQ ID NO: 3564194 - RNA, 13 nt, Pseudomonas putida KT2440
agcagcuccauac

SEQ ID NO: 3564195 - RNA, 17 nt, Pseudomonas putida KT2440
agcagcucccgagccag

SEQ ID NO: 3564196 - RNA, 16 nt, Pseudomonas putida KT2440
agcagcugggugauca

SEQ ID NO: 3564197 - RNA, 20 nt, Pseudomonas putida KT2440
agcagcuuauugcgcagggu

SEQ ID NO: 3564198 - RNA, 14 nt, Pseudomonas putida KT2440
agcagcuucagcca

SEQ ID NO: 3564199 - RNA, 20 nt, Pseudomonas putida KT2440
agcagcuugaacaacggcgc

SEQ ID NO: 3564200 - RNA, 14 nt, Pseudomonas putida KT2440
agcagcuugcagcg

SEQ ID NO: 3564201 - RNA, 21 nt, Pseudomonas putida KT2440
agcagcuugcgcgccuugcgc

SEQ ID NO: 3564202 - RNA, 21 nt, Pseudomonas putida KT2440
agcaggaaauacgccgccacc

SEQ ID NO: 3564203 - RNA, 17 nt, Pseudomonas putida KT2440
agcaggaacagcggcag

SEQ ID NO: 3564204 - RNA, 22 nt, Pseudomonas putida KT2440
agcaggaacgguguaucggcca

SEQ ID NO: 3564205 - RNA, 15 nt, Pseudomonas putida KT2440
agcaggaagcuguac

SEQ ID NO: 3564206 - RNA, 16 nt, Pseudomonas putida KT2440
agcaggaagcuguaca

SEQ ID NO: 3564207 - RNA, 13 nt, Pseudomonas putida KT2440
agcaggagcugaa

SEQ ID NO: 3564208 - RNA, 21 nt, Pseudomonas putida KT2440
agcaggaucugcugcagcaug

SEQ ID NO: 3564209 - RNA, 23 nt, Pseudomonas putida KT2440
agcaggaucugcugcagcauggc

SEQ ID NO: 3564210 - RNA, 14 nt, Pseudomonas putida KT2440
agcaggauggccau

SEQ ID NO: 3564211 - RNA, 20 nt, Pseudomonas putida KT2440
agcaggauggugacugccag

SEQ ID NO: 3564212 - RNA, 22 nt, Pseudomonas putida KT2440
agcaggauggugacugccagca

SEQ ID NO: 3564213 - RNA, 16 nt, Pseudomonas putida KT2440
agcaggcaagcccgcu

SEQ ID NO: 3564214 - RNA, 13 nt, Pseudomonas putida KT2440
agcaggccaaugc

SEQ ID NO: 3564215 - RNA, 20 nt, Pseudomonas putida KT2440
agcaggccaaugcccaugcc

SEQ ID NO: 3564216 - RNA, 15 nt, Pseudomonas putida KT2440
agcaggccaccggca

SEQ ID NO: 3564217 - RNA, 22 nt, Pseudomonas putida KT2440
agcaggccauacagggccuggc

SEQ ID NO: 3564218 - RNA, 22 nt, Pseudomonas putida KT2440
agcaggccauauugcugagcca

SEQ ID NO: 3564219 - RNA, 20 nt, Pseudomonas putida KT2440
agcaggcccggcccauucgc

SEQ ID NO: 3564220 - RNA, 23 nt, Pseudomonas putida KT2440
agcaggcccggcccauucgcggg

SEQ ID NO: 3564221 - RNA, 15 nt, Pseudomonas putida KT2440
agcaggcccggcccu

SEQ ID NO: 3564222 - RNA, 15 nt, Pseudomonas putida KT2440
agcaggccgccgacg

SEQ ID NO: 3564223 - RNA, 15 nt, Pseudomonas putida KT2440
agcaggcgcggcgug

SEQ ID NO: 3564224 - RNA, 14 nt, Pseudomonas putida KT2440
agcaggcugcgcuu

SEQ ID NO: 3564225 - RNA, 19 nt, Pseudomonas putida KT2440
agcaggcugcgugccugcu

SEQ ID NO: 3564226 - RNA, 17 nt, Pseudomonas putida KT2440
agcaggcuugccagcuu

SEQ ID NO: 3564227 - RNA, 16 nt, Pseudomonas putida KT2440
agcagggccaucaucu

SEQ ID NO: 3564228 - RNA, 21 nt, Pseudomonas putida KT2440
agcagggccgcgcuuggcggc

SEQ ID NO: 3564229 - RNA, 20 nt, Pseudomonas putida KT2440
agcagggcugcgcgcccagg

SEQ ID NO: 3564230 - RNA, 15 nt, Pseudomonas putida KT2440
agcaggggcuggacu

SEQ ID NO: 3564231 - RNA, 20 nt, Pseudomonas putida KT2440
agcagggugccuucaggggc

SEQ ID NO: 3564232 - RNA, 22 nt, Pseudomonas putida KT2440
agcagggugccuucaggggccc

SEQ ID NO: 3564233 - RNA, 21 nt, Pseudomonas putida KT2440
agcaggguggccagcaaggca

SEQ ID NO: 3564234 - RNA, 24 nt, Pseudomonas putida KT2440
agcagguaaccgcugccauagcgc

SEQ ID NO: 3564235 - RNA, 15 nt, Pseudomonas putida KT2440
agcagguacaccgcc

SEQ ID NO: 3564236 - RNA, 15 nt, Pseudomonas putida KT2440
agcagguacgcgcag

SEQ ID NO: 3564237 - RNA, 18 nt, Pseudomonas putida KT2440
agcagguacgcgcaggca

SEQ ID NO: 3564238 - RNA, 21 nt, Pseudomonas putida KT2440
agcagguaguucauguaggca

SEQ ID NO: 3564239 - RNA, 18 nt, Pseudomonas putida KT2440
agcaggucaugcagguca

SEQ ID NO: 3564240 - RNA, 13 nt, Pseudomonas putida KT2440
agcagguccagcu

SEQ ID NO: 3564241 - RNA, 13 nt, Pseudomonas putida KT2440
agcaggucggcac

SEQ ID NO: 3564242 - RNA, 13 nt, Pseudomonas putida KT2440
agcaggucggcgu

SEQ ID NO: 3564243 - RNA, 19 nt, Pseudomonas putida KT2440
agcaggucggcgucagcgu

SEQ ID NO: 3564244 - RNA, 13 nt, Pseudomonas putida KT2440
agcagguucaggc

SEQ ID NO: 3564245 - RNA, 17 nt, Pseudomonas putida KT2440
agcagguucaggcgcag

SEQ ID NO: 3564246 - RNA, 19 nt, Pseudomonas putida KT2440
agcagguugaacagcagcg

SEQ ID NO: 3564247 - RNA, 22 nt, Pseudomonas putida KT2440
agcagguugcugguggucacgu

SEQ ID NO: 3564248 - RNA, 21 nt, Pseudomonas putida KT2440
agcagguuuuccagcccguca

SEQ ID NO: 3564249 - RNA, 16 nt, Pseudomonas putida KT2440
agcagucuugugcugc

SEQ ID NO: 3564250 - RNA, 15 nt, Pseudomonas putida KT2440
agcagugaucaucac

SEQ ID NO: 3564251 - RNA, 18 nt, Pseudomonas putida KT2440
agcagugcaucgaagcag

SEQ ID NO: 3564252 - RNA, 15 nt, Pseudomonas putida KT2440
agcagugccagcaac

SEQ ID NO: 3564253 - RNA, 22 nt, Pseudomonas putida KT2440
agcagugcggcaaccaccaaca

SEQ ID NO: 3564254 - RNA, 20 nt, Pseudomonas putida KT2440
agcaguggcaagccgagcau

SEQ ID NO: 3564255 - RNA, 17 nt, Pseudomonas putida KT2440
agcaguggugcucagcg

SEQ ID NO: 3564256 - RNA, 23 nt, Pseudomonas putida KT2440
agcaguggugcucagcggcaccu

SEQ ID NO: 3564257 - RNA, 18 nt, Pseudomonas putida KT2440
agcaguuccuucagcagu

SEQ ID NO: 3564258 - RNA, 13 nt, Pseudomonas putida KT2440
agcaguugcugcu

SEQ ID NO: 3564259 - RNA, 14 nt, Pseudomonas putida KT2440
agcaguuugcugcg

SEQ ID NO: 3564260 - RNA, 18 nt, Pseudomonas putida KT2440
agcaucaacgcugccaug

SEQ ID NO: 3564261 - RNA, 19 nt, Pseudomonas putida KT2440
agcaucaaucgcuccaggc

SEQ ID NO: 3564262 - RNA, 23 nt, Pseudomonas putida KT2440
agcaucaaucgcuccaggcggcc

SEQ ID NO: 3564263 - RNA, 13 nt, Pseudomonas putida KT2440
agcaucacccgcg

SEQ ID NO: 3564264 - RNA, 17 nt, Pseudomonas putida KT2440
agcaucacccgcgaaug

SEQ ID NO: 3564265 - RNA, 15 nt, Pseudomonas putida KT2440
agcaucaccgcgucg

SEQ ID NO: 3564266 - RNA, 17 nt, Pseudomonas putida KT2440
agcaucagcacacccag

SEQ ID NO: 3564267 - RNA, 18 nt, Pseudomonas putida KT2440
agcaucagccaugggcag

SEQ ID NO: 3564268 - RNA, 16 nt, Pseudomonas putida KT2440
agcaucagugcaggug

SEQ ID NO: 3564269 - RNA, 21 nt, Pseudomonas putida KT2440
agcauccagccauuccaggcu

SEQ ID NO: 3564270 - RNA, 14 nt, Pseudomonas putida KT2440
agcaucggcguugc

SEQ ID NO: 3564271 - RNA, 19 nt, Pseudomonas putida KT2440
agcaucucggucgacaggg

SEQ ID NO: 3564272 - RNA, 15 nt, Pseudomonas putida KT2440
agcaucugcugcggc

SEQ ID NO: 3564273 - RNA, 20 nt, Pseudomonas putida KT2440
agcaucugcugcggcaggcu

SEQ ID NO: 3564274 - RNA, 17 nt, Pseudomonas putida KT2440
agcaucugggucuugau

SEQ ID NO: 3564275 - RNA, 22 nt, Pseudomonas putida KT2440
agcaucugggucuugaucuugg

SEQ ID NO: 3564276 - RNA, 21 nt, Pseudomonas putida KT2440
agcaucuuccagccugcagca

SEQ ID NO: 3564277 - RNA, 14 nt, Pseudomonas putida KT2440
agcaucuuccugcc

SEQ ID NO: 3564278 - RNA, 14 nt, Pseudomonas putida KT2440
agcaucuucuuccc

SEQ ID NO: 3564279 - RNA, 17 nt, Pseudomonas putida KT2440
agcaugaacagcgcugc

SEQ ID NO: 3564280 - RNA, 10 nt, Pseudomonas putida KT2440
agcaugaacg

SEQ ID NO: 3564281 - RNA, 21 nt, Pseudomonas putida KT2440
agcaugacccuaugcgugaaa

SEQ ID NO: 3564282 - RNA, 14 nt, Pseudomonas putida KT2440
agcaugaucaccgc

SEQ ID NO: 3564283 - RNA, 23 nt, Pseudomonas putida KT2440
agcaugaugauguccgcgccagc

SEQ ID NO: 3564284 - RNA, 21 nt, Pseudomonas putida KT2440
agcaugcccagcgccaccggc

SEQ ID NO: 3564285 - RNA, 21 nt, Pseudomonas putida KT2440
agcaugccccgggugcagccg

SEQ ID NO: 3564286 - RNA, 23 nt, Pseudomonas putida KT2440
agcaugccccgggugcagccgca

SEQ ID NO: 3564287 - RNA, 19 nt, Pseudomonas putida KT2440
agcaugcgggggccccacc

SEQ ID NO: 3564288 - RNA, 21 nt, Pseudomonas putida KT2440
agcaugcgggggccccaccag

SEQ ID NO: 3564289 - RNA, 17 nt, Pseudomonas putida KT2440
agcauggcaaacagcac

SEQ ID NO: 3564290 - RNA, 22 nt, Pseudomonas putida KT2440
agcauggcaaacagcaccagcc

SEQ ID NO: 3564291 - RNA, 12 nt, Pseudomonas putida KT2440
agcauggccgaa

SEQ ID NO: 3564292 - RNA, 22 nt, Pseudomonas putida KT2440
agcauggccgaaaccagccccu

SEQ ID NO: 3564293 - RNA, 19 nt, Pseudomonas putida KT2440
agcauggcgaucaacgaaa

SEQ ID NO: 3564294 - RNA, 17 nt, Pseudomonas putida KT2440
agcauggcgaucucuuc

SEQ ID NO: 3564295 - RNA, 14 nt, Pseudomonas putida KT2440
agcaugucccgggu

SEQ ID NO: 3564296 - RNA, 19 nt, Pseudomonas putida KT2440
agcauguccugcugcaggc

SEQ ID NO: 3564297 - RNA, 20 nt, Pseudomonas putida KT2440
agcauguccugcugcaggcu

SEQ ID NO: 3564298 - RNA, 22 nt, Pseudomonas putida KT2440
agccaaacaaaaaagccgcuca

SEQ ID NO: 3564299 - RNA, 13 nt, Pseudomonas putida KT2440
agccaaaguccug

SEQ ID NO: 3564300 - RNA, 15 nt, Pseudomonas putida KT2440
agccaaaguccugca

SEQ ID NO: 3564301 - RNA, 20 nt, Pseudomonas putida KT2440
agccaaaguccugcaaaggc

SEQ ID NO: 3564302 - RNA, 14 nt, Pseudomonas putida KT2440
agccaaccgcuuca

SEQ ID NO: 3564303 - RNA, 17 nt, Pseudomonas putida KT2440
agccaaccgcuucaccg

SEQ ID NO: 3564304 - RNA, 14 nt, Pseudomonas putida KT2440
agccaacgccccac

SEQ ID NO: 3564305 - RNA, 15 nt, Pseudomonas putida KT2440
agccaacgccccacc

SEQ ID NO: 3564306 - RNA, 20 nt, Pseudomonas putida KT2440
agccaacgccccacccgcuc

SEQ ID NO: 3564307 - RNA, 21 nt, Pseudomonas putida KT2440
agccaacgccccacccgcuca

SEQ ID NO: 3564308 - RNA, 21 nt, Pseudomonas putida KT2440
agccaacugcucuaccaacug

SEQ ID NO: 3564309 - RNA, 23 nt, Pseudomonas putida KT2440
agccaaugcagaugguccggcau

SEQ ID NO: 3564310 - RNA, 16 nt, Pseudomonas putida KT2440
agccaauggcaaacau

SEQ ID NO: 3564311 - RNA, 19 nt, Pseudomonas putida KT2440
agccaaugguauugcccga

SEQ ID NO: 3564312 - RNA, 15 nt, Pseudomonas putida KT2440
agccacagcugcugc

SEQ ID NO: 3564313 - RNA, 23 nt, Pseudomonas putida KT2440
agccacauccucugcccgcaagg

SEQ ID NO: 3564314 - RNA, 20 nt, Pseudomonas putida KT2440
agccaccacgucacgcacca

SEQ ID NO: 3564315 - RNA, 18 nt, Pseudomonas putida KT2440
agccacccuccgcacagg

SEQ ID NO: 3564316 - RNA, 16 nt, Pseudomonas putida KT2440
agccaccgcacucugc

SEQ ID NO: 3564317 - RNA, 22 nt, Pseudomonas putida KT2440
agccaccgccaccaucggccag

SEQ ID NO: 3564318 - RNA, 21 nt, Pseudomonas putida KT2440
agccaccgcgauggauggcac

SEQ ID NO: 3564319 - RNA, 22 nt, Pseudomonas putida KT2440
agccaccggacagaaucgcggu

SEQ ID NO: 3564320 - RNA, 23 nt, Pseudomonas putida KT2440
agccaccggacagaaucgcgguc

SEQ ID NO: 3564321 - RNA, 12 nt, Pseudomonas putida KT2440
agccaccggcau

SEQ ID NO: 3564322 - RNA, 19 nt, Pseudomonas putida KT2440
agccacgauagcgucagca

SEQ ID NO: 3564323 - RNA, 15 nt, Pseudomonas putida KT2440
agccacgaugaucug

SEQ ID NO: 3564324 - RNA, 18 nt, Pseudomonas putida KT2440
agccacgcaucugcaccu

SEQ ID NO: 3564325 - RNA, 19 nt, Pseudomonas putida KT2440
agccacgcaucugcaccug

SEQ ID NO: 3564326 - RNA, 13 nt, Pseudomonas putida KT2440
agccacgccagaa

SEQ ID NO: 3564327 - RNA, 14 nt, Pseudomonas putida KT2440
agccacgcuccagu

SEQ ID NO: 3564328 - RNA, 19 nt, Pseudomonas putida KT2440
agccacgcucgugcaggcu

SEQ ID NO: 3564329 - RNA, 17 nt, Pseudomonas putida KT2440
agccacgcugccaggac

SEQ ID NO: 3564330 - RNA, 19 nt, Pseudomonas putida KT2440
agccacgcugccaggaccg

SEQ ID NO: 3564331 - RNA, 12 nt, Pseudomonas putida KT2440
agccacgcuggc

SEQ ID NO: 3564332 - RNA, 14 nt, Pseudomonas putida KT2440
agccacgcuggcac

SEQ ID NO: 3564333 - RNA, 20 nt, Pseudomonas putida KT2440
agccacggaucaccuggccg

SEQ ID NO: 3564334 - RNA, 23 nt, Pseudomonas putida KT2440
agccacgggugcgggcuccacug

SEQ ID NO: 3564335 - RNA, 16 nt, Pseudomonas putida KT2440
agccacuccgccucgu

SEQ ID NO: 3564336 - RNA, 12 nt, Pseudomonas putida KT2440
agccacucggca

SEQ ID NO: 3564337 - RNA, 14 nt, Pseudomonas putida KT2440
agccacucggcaau

SEQ ID NO: 3564338 - RNA, 18 nt, Pseudomonas putida KT2440
agccacucggcaaucugc

SEQ ID NO: 3564339 - RNA, 18 nt, Pseudomonas putida KT2440
agccacuggccagcagau

SEQ ID NO: 3564340 - RNA, 15 nt, Pseudomonas putida KT2440
agccacuggccucuu

SEQ ID NO: 3564341 - RNA, 16 nt, Pseudomonas putida KT2440
agccacuucgucgagg

SEQ ID NO: 3564342 - RNA, 19 nt, Pseudomonas putida KT2440
agccagacauugaagaagc

SEQ ID NO: 3564343 - RNA, 16 nt, Pseudomonas putida KT2440
agccagacgaccagca

SEQ ID NO: 3564344 - RNA, 18 nt, Pseudomonas putida KT2440
agccagacgaccagcaug

SEQ ID NO: 3564345 - RNA, 16 nt, Pseudomonas putida KT2440
agccagauauggaagc

SEQ ID NO: 3564346 - RNA, 11 nt, Pseudomonas putida KT2440
agccagcagau

SEQ ID NO: 3564347 - RNA, 20 nt, Pseudomonas putida KT2440
agccagccaccaccaugcga

SEQ ID NO: 3564348 - RNA, 13 nt, Pseudomonas putida KT2440
agccagcccggua

SEQ ID NO: 3564349 - RNA, 22 nt, Pseudomonas putida KT2440
agccagccuucgccaacugcac

SEQ ID NO: 3564350 - RNA, 14 nt, Pseudomonas putida KT2440
agccagcgacagca

SEQ ID NO: 3564351 - RNA, 18 nt, Pseudomonas putida KT2440
agccagcgcuaaaccugu

SEQ ID NO: 3564352 - RNA, 15 nt, Pseudomonas putida KT2440
agccagcgugggccg

SEQ ID NO: 3564353 - RNA, 16 nt, Pseudomonas putida KT2440
agccagcuggccaccu

SEQ ID NO: 3564354 - RNA, 15 nt, Pseudomonas putida KT2440
agccaggauuuucag

SEQ ID NO: 3564355 - RNA, 19 nt, Pseudomonas putida KT2440
agccaggcugagcccggca

SEQ ID NO: 3564356 - RNA, 23 nt, Pseudomonas putida KT2440
agccaggguuucggugacgaccu

SEQ ID NO: 3564357 - RNA, 15 nt, Pseudomonas putida KT2440
agccagguauggcca

SEQ ID NO: 3564358 - RNA, 19 nt, Pseudomonas putida KT2440
agccagguauggccagagc

SEQ ID NO: 3564359 - RNA, 23 nt, Pseudomonas putida KT2440
agccagguucggaucagcaauga

SEQ ID NO: 3564360 - RNA, 13 nt, Pseudomonas putida KT2440
agccagguuuuug

SEQ ID NO: 3564361 - RNA, 19 nt, Pseudomonas putida KT2440
agccagucugcuccaccgc

SEQ ID NO: 3564362 - RNA, 13 nt, Pseudomonas putida KT2440
agccauaccgcau

SEQ ID NO: 3564363 - RNA, 15 nt, Pseudomonas putida KT2440
agccauaccgcaucc

SEQ ID NO: 3564364 - RNA, 16 nt, Pseudomonas putida KT2440
agccauccaccagccc

SEQ ID NO: 3564365 - RNA, 13 nt, Pseudomonas putida KT2440
agccaucgagcac

SEQ ID NO: 3564366 - RNA, 18 nt, Pseudomonas putida KT2440
agccaugaaaaagcccgg

SEQ ID NO: 3564367 - RNA, 19 nt, Pseudomonas putida KT2440
agccaugagcgagcucaac

SEQ ID NO: 3564368 - RNA, 14 nt, Pseudomonas putida KT2440
agccaugaucagcg

SEQ ID NO: 3564369 - RNA, 15 nt, Pseudomonas putida KT2440
agccaugcaccgucu

SEQ ID NO: 3564370 - RNA, 14 nt, Pseudomonas putida KT2440
agccaugcgcaggc

SEQ ID NO: 3564371 - RNA, 21 nt, Pseudomonas putida KT2440
agccaugcgcaggcagcgaug

SEQ ID NO: 3564372 - RNA, 20 nt, Pseudomonas putida KT2440
agccaugggcaggucgaccc

SEQ ID NO: 3564373 - RNA, 14 nt, Pseudomonas putida KT2440
agccaugugccugg

SEQ ID NO: 3564374 - RNA, 14 nt, Pseudomonas putida KT2440
agccauugcggcug

SEQ ID NO: 3564375 - RNA, 18 nt, Pseudomonas putida KT2440
agcccaaccucugaugug

SEQ ID NO: 3564376 - RNA, 23 nt, Pseudomonas putida KT2440
agcccaaggaagaugaagaaacc

SEQ ID NO: 3564377 - RNA, 15 nt, Pseudomonas putida KT2440
agcccaaggccugca

SEQ ID NO: 3564378 - RNA, 17 nt, Pseudomonas putida KT2440
agcccaaggcuggccag

SEQ ID NO: 3564379 - RNA, 18 nt, Pseudomonas putida KT2440
agcccacacaccgcaacc

SEQ ID NO: 3564380 - RNA, 14 nt, Pseudomonas putida KT2440
agcccaccagguca

SEQ ID NO: 3564381 - RNA, 20 nt, Pseudomonas putida KT2440
agcccaccgucaggcucagc

SEQ ID NO: 3564382 - RNA, 21 nt, Pseudomonas putida KT2440
agcccaccgucaggcucagca

SEQ ID NO: 3564383 - RNA, 14 nt, Pseudomonas putida KT2440
agcccagcgccagu

SEQ ID NO: 3564384 - RNA, 19 nt, Pseudomonas putida KT2440
agcccauaaaccccagccu

SEQ ID NO: 3564385 - RNA, 23 nt, Pseudomonas putida KT2440
agcccauaaaccccagccuucag

SEQ ID NO: 3564386 - RNA, 15 nt, Pseudomonas putida KT2440
agcccauagcgccau

SEQ ID NO: 3564387 - RNA, 15 nt, Pseudomonas putida KT2440
agcccauccagggcu

SEQ ID NO: 3564388 - RNA, 16 nt, Pseudomonas putida KT2440
agcccauccagggcuu

SEQ ID NO: 3564389 - RNA, 16 nt, Pseudomonas putida KT2440
agcccauggcgcugac

SEQ ID NO: 3564390 - RNA, 22 nt, Pseudomonas putida KT2440
agcccauggcgcugaccgggac

SEQ ID NO: 3564391 - RNA, 14 nt, Pseudomonas putida KT2440
agcccauggcuggc

SEQ ID NO: 3564392 - RNA, 15 nt, Pseudomonas putida KT2440
agcccauuucaccug

SEQ ID NO: 3564393 - RNA, 16 nt, Pseudomonas putida KT2440
agcccauuucaccugc

SEQ ID NO: 3564394 - RNA, 11 nt, Pseudomonas putida KT2440
agcccauuucg

SEQ ID NO: 3564395 - RNA, 21 nt, Pseudomonas putida KT2440
agcccauuucgugggucacgc

SEQ ID NO: 3564396 - RNA, 13 nt, Pseudomonas putida KT2440
agccccaaugguu

SEQ ID NO: 3564397 - RNA, 16 nt, Pseudomonas putida KT2440
agccccaccaggaagc

SEQ ID NO: 3564398 - RNA, 11 nt, Pseudomonas putida KT2440
agccccagccg

SEQ ID NO: 3564399 - RNA, 21 nt, Pseudomonas putida KT2440
agccccagggcccucaacccu

SEQ ID NO: 3564400 - RNA, 17 nt, Pseudomonas putida KT2440
agccccaugcgaccagu

SEQ ID NO: 3564401 - RNA, 13 nt, Pseudomonas putida KT2440
agcccccagcaca

SEQ ID NO: 3564402 - RNA, 13 nt, Pseudomonas putida KT2440
agcccccccagca

SEQ ID NO: 3564403 - RNA, 20 nt, Pseudomonas putida KT2440
agcccccccagcaacggguu

SEQ ID NO: 3564404 - RNA, 13 nt, Pseudomonas putida KT2440
agccccccugccg

SEQ ID NO: 3564405 - RNA, 21 nt, Pseudomonas putida KT2440
agccccccuguaggagcgggu

SEQ ID NO: 3564406 - RNA, 22 nt, Pseudomonas putida KT2440
agcccccggaugcgcaagcaac

SEQ ID NO: 3564407 - RNA, 22 nt, Pseudomonas putida KT2440
agccccgcaugcucgcugcugc

SEQ ID NO: 3564408 - RNA, 23 nt, Pseudomonas putida KT2440
agccccgccaacaacaagcgcug

SEQ ID NO: 3564409 - RNA, 14 nt, Pseudomonas putida KT2440
agccccgcuggucg

SEQ ID NO: 3564410 - RNA, 15 nt, Pseudomonas putida KT2440
agccccgcuggucgc

SEQ ID NO: 3564411 - RNA, 13 nt, Pseudomonas putida KT2440
agccccgguucgc

SEQ ID NO: 3564412 - RNA, 16 nt, Pseudomonas putida KT2440
agccccuagcgcaucc

SEQ ID NO: 3564413 - RNA, 20 nt, Pseudomonas putida KT2440
agccccucauucaaagccug

SEQ ID NO: 3564414 - RNA, 11 nt, Pseudomonas putida KT2440
agccccuccua

SEQ ID NO: 3564415 - RNA, 17 nt, Pseudomonas putida KT2440
agccccucgcaucgagg

SEQ ID NO: 3564416 - RNA, 17 nt, Pseudomonas putida KT2440
agccccugcaauuucuu

SEQ ID NO: 3564417 - RNA, 14 nt, Pseudomonas putida KT2440
agccccugcauccg

SEQ ID NO: 3564418 - RNA, 15 nt, Pseudomonas putida KT2440
agccccugcggcugc

SEQ ID NO: 3564419 - RNA, 21 nt, Pseudomonas putida KT2440
agcccgaagcuaucgccagca

SEQ ID NO: 3564420 - RNA, 16 nt, Pseudomonas putida KT2440
agcccgcacugcaaug

SEQ ID NO: 3564421 - RNA, 16 nt, Pseudomonas putida KT2440
agcccgccagcaggcc

SEQ ID NO: 3564422 - RNA, 20 nt, Pseudomonas putida KT2440
agcccgccagcaggccaccg

SEQ ID NO: 3564423 - RNA, 12 nt, Pseudomonas putida KT2440
agcccgccgcca

SEQ ID NO: 3564424 - RNA, 14 nt, Pseudomonas putida KT2440
agcccgccugcuca

SEQ ID NO: 3564425 - RNA, 20 nt, Pseudomonas putida KT2440
agcccgcgaagaggccagca

SEQ ID NO: 3564426 - RNA, 22 nt, Pseudomonas putida KT2440
agcccgcgaagaggccaggaca

SEQ ID NO: 3564427 - RNA, 20 nt, Pseudomonas putida KT2440
agcccgcuaccagaaauggu

SEQ ID NO: 3564428 - RNA, 17 nt, Pseudomonas putida KT2440
agcccgcucgccacaca

SEQ ID NO: 3564429 - RNA, 15 nt, Pseudomonas putida KT2440
agcccgcucggucag

SEQ ID NO: 3564430 - RNA, 17 nt, Pseudomonas putida KT2440
agcccggcaaacuccac

SEQ ID NO: 3564431 - RNA, 13 nt, Pseudomonas putida KT2440
agcccggcaccug

SEQ ID NO: 3564432 - RNA, 13 nt, Pseudomonas putida KT2440
agcccggccaggu

SEQ ID NO: 3564433 - RNA, 22 nt, Pseudomonas putida KT2440
agcccggccaggugccgggcuu

SEQ ID NO: 3564434 - RNA, 15 nt, Pseudomonas putida KT2440
agcccggcgcagccg

SEQ ID NO: 3564435 - RNA, 13 nt, Pseudomonas putida KT2440
agcccggcgccua

SEQ ID NO: 3564436 - RNA, 16 nt, Pseudomonas putida KT2440
agcccggcgccuaucc

SEQ ID NO: 3564437 - RNA, 16 nt, Pseudomonas putida KT2440
agcccggcuugcacca

SEQ ID NO: 3564438 - RNA, 15 nt, Pseudomonas putida KT2440
agcccgggcagccga

SEQ ID NO: 3564439 - RNA, 12 nt, Pseudomonas putida KT2440
agcccgggcaug

SEQ ID NO: 3564440 - RNA, 18 nt, Pseudomonas putida KT2440
agcccggugaagucaccg

SEQ ID NO: 3564441 - RNA, 19 nt, Pseudomonas putida KT2440
agcccggugaagucaccga

SEQ ID NO: 3564442 - RNA, 15 nt, Pseudomonas putida KT2440
agcccgucacgugcc

SEQ ID NO: 3564443 - RNA, 20 nt, Pseudomonas putida KT2440
agcccgucacgugccuucac

SEQ ID NO: 3564444 - RNA, 23 nt, Pseudomonas putida KT2440
agcccguggcccucagcccagua

SEQ ID NO: 3564445 - RNA, 13 nt, Pseudomonas putida KT2440
agcccucaaggga

SEQ ID NO: 3564446 - RNA, 16 nt, Pseudomonas putida KT2440
agcccucagugcgaaa

SEQ ID NO: 3564447 - RNA, 12 nt, Pseudomonas putida KT2440
agcccugcccua

SEQ ID NO: 3564448 - RNA, 15 nt, Pseudomonas putida KT2440
agcccugccucagcu

SEQ ID NO: 3564449 - RNA, 19 nt, Pseudomonas putida KT2440
agcccugugggagcgggca

SEQ ID NO: 3564450 - RNA, 19 nt, Pseudomonas putida KT2440
agcccuucgaugcuccuau

SEQ ID NO: 3564451 - RNA, 18 nt, Pseudomonas putida KT2440
agcccuucgccggcacgc

SEQ ID NO: 3564452 - RNA, 15 nt, Pseudomonas putida KT2440
agcccuucgcgggca

SEQ ID NO: 3564453 - RNA, 12 nt, Pseudomonas putida KT2440
agcccuucugaa

SEQ ID NO: 3564454 - RNA, 22 nt, Pseudomonas putida KT2440
agcccuugccagugauccggcg

SEQ ID NO: 3564455 - RNA, 13 nt, Pseudomonas putida KT2440
agcccuugcucgg

SEQ ID NO: 3564456 - RNA, 16 nt, Pseudomonas putida KT2440
agcccuugcucggcca

SEQ ID NO: 3564457 - RNA, 18 nt, Pseudomonas putida KT2440
agcccuugcugcagcagg

SEQ ID NO: 3564458 - RNA, 19 nt, Pseudomonas putida KT2440
agcccuugcugcagcaggc

SEQ ID NO: 3564459 - RNA, 20 nt, Pseudomonas putida KT2440
agcccuugcugcagcaggcu

SEQ ID NO: 3564460 - RNA, 16 nt, Pseudomonas putida KT2440
agcccuugucgaacag

SEQ ID NO: 3564461 - RNA, 17 nt, Pseudomonas putida KT2440
agcccuugucgaacagc

SEQ ID NO: 3564462 - RNA, 14 nt, Pseudomonas putida KT2440
agccgaacagcagg

SEQ ID NO: 3564463 - RNA, 16 nt, Pseudomonas putida KT2440
agccgaacagcaggca

SEQ ID NO: 3564464 - RNA, 13 nt, Pseudomonas putida KT2440
agccgaacuuguc

SEQ ID NO: 3564465 - RNA, 15 nt, Pseudomonas putida KT2440
agccgaacuugucug

SEQ ID NO: 3564466 - RNA, 16 nt, Pseudomonas putida KT2440
agccgacaaaaacaac

SEQ ID NO: 3564467 - RNA, 19 nt, Pseudomonas putida KT2440
agccgacccgggccagcca

SEQ ID NO: 3564468 - RNA, 21 nt, Pseudomonas putida KT2440
agccgacccgggccagccacu

SEQ ID NO: 3564469 - RNA, 23 nt, Pseudomonas putida KT2440
agccgagcaucuuccagccugca

SEQ ID NO: 3564470 - RNA, 16 nt, Pseudomonas putida KT2440
agccgagccaagcgac

SEQ ID NO: 3564471 - RNA, 19 nt, Pseudomonas putida KT2440
agccgauacggugccaaua

SEQ ID NO: 3564472 - RNA, 20 nt, Pseudomonas putida KT2440
agccgaucacuuccuggccg

SEQ ID NO: 3564473 - RNA, 23 nt, Pseudomonas putida KT2440
agccgaucacuuccuggccgccu

SEQ ID NO: 3564474 - RNA, 21 nt, Pseudomonas putida KT2440
agccgcaaccgggucggcgcc

SEQ ID NO: 3564475 - RNA, 14 nt, Pseudomonas putida KT2440
agccgcacccaggc

SEQ ID NO: 3564476 - RNA, 19 nt, Pseudomonas putida KT2440
agccgcacccaggccacga

SEQ ID NO: 3564477 - RNA, 17 nt, Pseudomonas putida KT2440
agccgcaccugcccgcc

SEQ ID NO: 3564478 - RNA, 18 nt, Pseudomonas putida KT2440
agccgcaccugcccgccc

SEQ ID NO: 3564479 - RNA, 19 nt, Pseudomonas putida KT2440
agccgcaggccaaugcagc

SEQ ID NO: 3564480 - RNA, 20 nt, Pseudomonas putida KT2440
agccgcaggccaaugcagcu

SEQ ID NO: 3564481 - RNA, 23 nt, Pseudomonas putida KT2440
agccgcaggcgcccccugggcgu

SEQ ID NO: 3564482 - RNA, 15 nt, Pseudomonas putida KT2440
agccgcauuggccgg

SEQ ID NO: 3564483 - RNA, 14 nt, Pseudomonas putida KT2440
agccgccacaugcc

SEQ ID NO: 3564484 - RNA, 13 nt, Pseudomonas putida KT2440
agccgccagacuu

SEQ ID NO: 3564485 - RNA, 14 nt, Pseudomonas putida KT2440
agccgccagcauca

SEQ ID NO: 3564486 - RNA, 15 nt, Pseudomonas putida KT2440
agccgccagcaucac

SEQ ID NO: 3564487 - RNA, 19 nt, Pseudomonas putida KT2440
agccgccagcaucacgccg

SEQ ID NO: 3564488 - RNA, 19 nt, Pseudomonas putida KT2440
agccgccauugcccagccu

SEQ ID NO: 3564489 - RNA, 16 nt, Pseudomonas putida KT2440
agccgcccgcccgccu

SEQ ID NO: 3564490 - RNA, 17 nt, Pseudomonas putida KT2440
agccgcgaacgccccga

SEQ ID NO: 3564491 - RNA, 13 nt, Pseudomonas putida KT2440
agccgcgccaggu

SEQ ID NO: 3564492 - RNA, 15 nt, Pseudomonas putida KT2440
agccgcgccaggucg

SEQ ID NO: 3564493 - RNA, 19 nt, Pseudomonas putida KT2440
agccgcgcccucuuccgca

SEQ ID NO: 3564494 - RNA, 14 nt, Pseudomonas putida KT2440
agccgcggcaccca

SEQ ID NO: 3564495 - RNA, 22 nt, Pseudomonas putida KT2440
agccgcgggcucguuauccgcg

SEQ ID NO: 3564496 - RNA, 23 nt, Pseudomonas putida KT2440
agccgcgggcucguuauccgcga

SEQ ID NO: 3564497 - RNA, 19 nt, Pseudomonas putida KT2440
agccgcgguagugcggccg

SEQ ID NO: 3564498 - RNA, 14 nt, Pseudomonas putida KT2440
agccgcguccuuga

SEQ ID NO: 3564499 - RNA, 19 nt, Pseudomonas putida KT2440
agccgcucgagaaacgcca

SEQ ID NO: 3564500 - RNA, 21 nt, Pseudomonas putida KT2440
agccgcugccacagguacugc

SEQ ID NO: 3564501 - RNA, 14 nt, Pseudomonas putida KT2440
agccgcugcgccug

SEQ ID NO: 3564502 - RNA, 20 nt, Pseudomonas putida KT2440
agccgcugcgccugccgggc

SEQ ID NO: 3564503 - RNA, 21 nt, Pseudomonas putida KT2440
agccgcugcgccugccgggcc

SEQ ID NO: 3564504 - RNA, 16 nt, Pseudomonas putida KT2440
agccgcugcugcaguu

SEQ ID NO: 3564505 - RNA, 12 nt, Pseudomonas putida KT2440
agccgcuggccc

SEQ ID NO: 3564506 - RNA, 13 nt, Pseudomonas putida KT2440
agccgcuggcccu

SEQ ID NO: 3564507 - RNA, 19 nt, Pseudomonas putida KT2440
agccgcugucgguaaaaca

SEQ ID NO: 3564508 - RNA, 18 nt, Pseudomonas putida KT2440
agccgcuucacuguccug

SEQ ID NO: 3564509 - RNA, 14 nt, Pseudomonas putida KT2440
agccggcagcaagg

SEQ ID NO: 3564510 - RNA, 22 nt, Pseudomonas putida KT2440
agccggcaucgccaacagaggc

SEQ ID NO: 3564511 - RNA, 14 nt, Pseudomonas putida KT2440
agccggccccugcu

SEQ ID NO: 3564512 - RNA, 17 nt, Pseudomonas putida KT2440
agccggcccggcuggcc

SEQ ID NO: 3564513 - RNA, 19 nt, Pseudomonas putida KT2440
agccggcccggcuggccac

SEQ ID NO: 3564514 - RNA, 19 nt, Pseudomonas putida KT2440
agccggccgguagcucgcu

SEQ ID NO: 3564515 - RNA, 20 nt, Pseudomonas putida KT2440
agccggccucagcagcgaca

SEQ ID NO: 3564516 - RNA, 13 nt, Pseudomonas putida KT2440
agccggccuugcu

SEQ ID NO: 3564517 - RNA, 18 nt, Pseudomonas putida KT2440
agccggccuugcuccagu

SEQ ID NO: 3564518 - RNA, 15 nt, Pseudomonas putida KT2440
agccggcgaacagca

SEQ ID NO: 3564519 - RNA, 22 nt, Pseudomonas putida KT2440
agccggcgaacagcacugccag

SEQ ID NO: 3564520 - RNA, 21 nt, Pseudomonas putida KT2440
agccggcgcuggacagcggca

SEQ ID NO: 3564521 - RNA, 15 nt, Pseudomonas putida KT2440
agccggcgcugggcu

SEQ ID NO: 3564522 - RNA, 19 nt, Pseudomonas putida KT2440
agccggcuaucggccagca

SEQ ID NO: 3564523 - RNA, 14 nt, Pseudomonas putida KT2440
agccggcuguggca

SEQ ID NO: 3564524 - RNA, 18 nt, Pseudomonas putida KT2440
agccggcuuccagcgaug

SEQ ID NO: 3564525 - RNA, 22 nt, Pseudomonas putida KT2440
agccggcuuugcgucaucauca

SEQ ID NO: 3564526 - RNA, 23 nt, Pseudomonas putida KT2440
agccgggcgguugucgaccuggc

SEQ ID NO: 3564527 - RNA, 21 nt, Pseudomonas putida KT2440
agccgggcugcaaagcgggca

SEQ ID NO: 3564528 - RNA, 15 nt, Pseudomonas putida KT2440
agccggguccacccg

SEQ ID NO: 3564529 - RNA, 13 nt, Pseudomonas putida KT2440
agccggucaccga

SEQ ID NO: 3564530 - RNA, 22 nt, Pseudomonas putida KT2440
agccggucaucacgcucacgca

SEQ ID NO: 3564531 - RNA, 19 nt, Pseudomonas putida KT2440
agccggucauccagcagcu

SEQ ID NO: 3564532 - RNA, 17 nt, Pseudomonas putida KT2440
agccggucguugagcac

SEQ ID NO: 3564533 - RNA, 20 nt, Pseudomonas putida KT2440
agccgguuucguaagcgcug

SEQ ID NO: 3564534 - RNA, 17 nt, Pseudomonas putida KT2440
agccguaggagcgggcu

SEQ ID NO: 3564535 - RNA, 19 nt, Pseudomonas putida KT2440
agccguccaggaacgcugc

SEQ ID NO: 3564536 - RNA, 18 nt, Pseudomonas putida KT2440
agccgugaagaggccagu

SEQ ID NO: 3564537 - RNA, 22 nt, Pseudomonas putida KT2440
agccgugaagaggccagugagc

SEQ ID NO: 3564538 - RNA, 19 nt, Pseudomonas putida KT2440
agccguggcaacgccacac

SEQ ID NO: 3564539 - RNA, 19 nt, Pseudomonas putida KT2440
agccguucccgggcagguu

SEQ ID NO: 3564540 - RNA, 16 nt, Pseudomonas putida KT2440
agccguugaccagguu

SEQ ID NO: 3564541 - RNA, 14 nt, Pseudomonas putida KT2440
agccguugcugggc

SEQ ID NO: 3564542 - RNA, 14 nt, Pseudomonas putida KT2440
agccuaaaggcaug

SEQ ID NO: 3564543 - RNA, 15 nt, Pseudomonas putida KT2440
agccuaaaggcaugc

SEQ ID NO: 3564544 - RNA, 15 nt, Pseudomonas putida KT2440
agccuaccaacgcag

SEQ ID NO: 3564545 - RNA, 16 nt, Pseudomonas putida KT2440
agccuaccaacgcagc

SEQ ID NO: 3564546 - RNA, 20 nt, Pseudomonas putida KT2440
agccuaccaacgcagcaugc

SEQ ID NO: 3564547 - RNA, 18 nt, Pseudomonas putida KT2440
agccuacgcccccagccu

SEQ ID NO: 3564548 - RNA, 19 nt, Pseudomonas putida KT2440
agccuacgcccccagccuu

SEQ ID NO: 3564549 - RNA, 16 nt, Pseudomonas putida KT2440
agccucaaggccggca

SEQ ID NO: 3564550 - RNA, 22 nt, Pseudomonas putida KT2440
agccucaaugggcuuccccagc

SEQ ID NO: 3564551 - RNA, 13 nt, Pseudomonas putida KT2440
agccucagcgccc

SEQ ID NO: 3564552 - RNA, 22 nt, Pseudomonas putida KT2440
agccucagcgcccgcugcgccg

SEQ ID NO: 3564553 - RNA, 20 nt, Pseudomonas putida KT2440
agccucaucagagcgugaag

SEQ ID NO: 3564554 - RNA, 20 nt, Pseudomonas putida KT2440
agccuccaguugcuccaccu

SEQ ID NO: 3564555 - RNA, 16 nt, Pseudomonas putida KT2440
agccuccggcccaucc

SEQ ID NO: 3564556 - RNA, 13 nt, Pseudomonas putida KT2440
agccucgagcgcu

SEQ ID NO: 3564557 - RNA, 21 nt, Pseudomonas putida KT2440
agccucgagcgcuuucagccg

SEQ ID NO: 3564558 - RNA, 15 nt, Pseudomonas putida KT2440
agccucgcgcaacac

SEQ ID NO: 3564559 - RNA, 11 nt, Pseudomonas putida KT2440
agccucggcuc

SEQ ID NO: 3564560 - RNA, 17 nt, Pseudomonas putida KT2440
agccucggucagguacu

SEQ ID NO: 3564561 - RNA, 20 nt, Pseudomonas putida KT2440
agccucguccaucuugcugc

SEQ ID NO: 3564562 - RNA, 21 nt, Pseudomonas putida KT2440
agccucguccaucuugcugcu

SEQ ID NO: 3564563 - RNA, 15 nt, Pseudomonas putida KT2440
agccugcacccagcg

SEQ ID NO: 3564564 - RNA, 22 nt, Pseudomonas putida KT2440
agccugcacgcucagugugggg

SEQ ID NO: 3564565 - RNA, 13 nt, Pseudomonas putida KT2440
agccugcagcacc

SEQ ID NO: 3564566 - RNA, 14 nt, Pseudomonas putida KT2440
agccugcagggccu

SEQ ID NO: 3564567 - RNA, 13 nt, Pseudomonas putida KT2440
agccugccagguc

SEQ ID NO: 3564568 - RNA, 14 nt, Pseudomonas putida KT2440
agccugcgcaggcg

SEQ ID NO: 3564569 - RNA, 14 nt, Pseudomonas putida KT2440
agccugcugacgca

SEQ ID NO: 3564570 - RNA, 17 nt, Pseudomonas putida KT2440
agccugcugacgcaggg

SEQ ID NO: 3564571 - RNA, 12 nt, Pseudomonas putida KT2440
agccugcugcuc

SEQ ID NO: 3564572 - RNA, 16 nt, Pseudomonas putida KT2440
agccugggcgugaaag

SEQ ID NO: 3564573 - RNA, 20 nt, Pseudomonas putida KT2440
agccugggucacggcauccc

SEQ ID NO: 3564574 - RNA, 17 nt, Pseudomonas putida KT2440
agccuguggggcaacug

SEQ ID NO: 3564575 - RNA, 19 nt, Pseudomonas putida KT2440
agccuucacggauggcagc

SEQ ID NO: 3564576 - RNA, 18 nt, Pseudomonas putida KT2440
agccuucagcggccgcgc

SEQ ID NO: 3564577 - RNA, 21 nt, Pseudomonas putida KT2440
agccuucagcggccgcgcaau

SEQ ID NO: 3564578 - RNA, 23 nt, Pseudomonas putida KT2440
agccuuccagcuccuucuucacc

SEQ ID NO: 3564579 - RNA, 19 nt, Pseudomonas putida KT2440
agccuucccccuccugaac

SEQ ID NO: 3564580 - RNA, 15 nt, Pseudomonas putida KT2440
agccuuccgggcacu

SEQ ID NO: 3564581 - RNA, 14 nt, Pseudomonas putida KT2440
agccuucggccaug

SEQ ID NO: 3564582 - RNA, 18 nt, Pseudomonas putida KT2440
agccuucgucgcuggcca

SEQ ID NO: 3564583 - RNA, 16 nt, Pseudomonas putida KT2440
agccuuggccagcguc

SEQ ID NO: 3564584 - RNA, 14 nt, Pseudomonas putida KT2440
agccuuggguaacc

SEQ ID NO: 3564585 - RNA, 19 nt, Pseudomonas putida KT2440
agccuugucucugaacaca

SEQ ID NO: 3564586 - RNA, 17 nt, Pseudomonas putida KT2440
agccuuguucgcgcagg

SEQ ID NO: 3564587 - RNA, 18 nt, Pseudomonas putida KT2440
agccuuguucgcgcagga

SEQ ID NO: 3564588 - RNA, 23 nt, Pseudomonas putida KT2440
agccuuucgagagccgggcaaug

SEQ ID NO: 3564589 - RNA, 16 nt, Pseudomonas putida KT2440
agccuuuggcuggacu

SEQ ID NO: 3564590 - RNA, 13 nt, Pseudomonas putida KT2440
agccuuuuccagc

SEQ ID NO: 3564591 - RNA, 17 nt, Pseudomonas putida KT2440
agccuuuuuucgggcug

SEQ ID NO: 3564592 - RNA, 20 nt, Pseudomonas putida KT2440
agccuuuuuucgggcugcug

SEQ ID NO: 3564593 - RNA, 23 nt, Pseudomonas putida KT2440
agccuuuuuucgggcugcugccg

SEQ ID NO: 3564594 - RNA, 19 nt, Pseudomonas putida KT2440
agcgaaacaccagcaacau

SEQ ID NO: 3564595 - RNA, 14 nt, Pseudomonas putida KT2440
agcgaaaugggccg

SEQ ID NO: 3564596 - RNA, 14 nt, Pseudomonas putida KT2440
agcgaagggcucaa

SEQ ID NO: 3564597 - RNA, 15 nt, Pseudomonas putida KT2440
agcgaauagcaacac

SEQ ID NO: 3564598 - RNA, 20 nt, Pseudomonas putida KT2440
agcgaauaguagaagcagau

SEQ ID NO: 3564599 - RNA, 22 nt, Pseudomonas putida KT2440
agcgacaacgcgaaagcgaaga

SEQ ID NO: 3564600 - RNA, 13 nt, Pseudomonas putida KT2440
agcgacaccagcg

SEQ ID NO: 3564601 - RNA, 22 nt, Pseudomonas putida KT2440
agcgacaccgccaacuccuugc

SEQ ID NO: 3564602 - RNA, 13 nt, Pseudomonas putida KT2440
agcgacagcaucg

SEQ ID NO: 3564603 - RNA, 16 nt, Pseudomonas putida KT2440
agcgacagcaucggca

SEQ ID NO: 3564604 - RNA, 17 nt, Pseudomonas putida KT2440
agcgacagcaucugcac

SEQ ID NO: 3564605 - RNA, 19 nt, Pseudomonas putida KT2440
agcgacagcugcggcauga

SEQ ID NO: 3564606 - RNA, 18 nt, Pseudomonas putida KT2440
agcgacauaaaaaagccc

SEQ ID NO: 3564607 - RNA, 17 nt, Pseudomonas putida KT2440
agcgacaucggaacgaa

SEQ ID NO: 3564608 - RNA, 18 nt, Pseudomonas putida KT2440
agcgacaugccggccacc

SEQ ID NO: 3564609 - RNA, 21 nt, Pseudomonas putida KT2440
agcgacaugccggccaccaca

SEQ ID NO: 3564610 - RNA, 17 nt, Pseudomonas putida KT2440
agcgacccugagucugg

SEQ ID NO: 3564611 - RNA, 14 nt, Pseudomonas putida KT2440
agcgaccuauaaug

SEQ ID NO: 3564612 - RNA, 22 nt, Pseudomonas putida KT2440
agcgacgugcaaggaucaccaa

SEQ ID NO: 3564613 - RNA, 15 nt, Pseudomonas putida KT2440
agcgacugccaaugc

SEQ ID NO: 3564614 - RNA, 15 nt, Pseudomonas putida KT2440
agcgagagcuucaga

SEQ ID NO: 3564615 - RNA, 14 nt, Pseudomonas putida KT2440
agcgagcaccggca

SEQ ID NO: 3564616 - RNA, 15 nt, Pseudomonas putida KT2440
agcgagcaccggcag

SEQ ID NO: 3564617 - RNA, 14 nt, Pseudomonas putida KT2440
agcgagcagccugg

SEQ ID NO: 3564618 - RNA, 13 nt, Pseudomonas putida KT2440
agcgagcauggcg

SEQ ID NO: 3564619 - RNA, 19 nt, Pseudomonas putida KT2440
agcgaggcaaucagggcau

SEQ ID NO: 3564620 - RNA, 18 nt, Pseudomonas putida KT2440
agcgaggcgggccgcagg

SEQ ID NO: 3564621 - RNA, 16 nt, Pseudomonas putida KT2440
agcgagugaccuuggc

SEQ ID NO: 3564622 - RNA, 19 nt, Pseudomonas putida KT2440
agcgaguugaacuuggcga

SEQ ID NO: 3564623 - RNA, 17 nt, Pseudomonas putida KT2440
agcgauaaaccagcagc

SEQ ID NO: 3564624 - RNA, 19 nt, Pseudomonas putida KT2440
agcgauaaaccagcagcgc

SEQ ID NO: 3564625 - RNA, 18 nt, Pseudomonas putida KT2440
agcgauaaggcuugcccu

SEQ ID NO: 3564626 - RNA, 22 nt, Pseudomonas putida KT2440
agcgauaauugugcccuugaac

SEQ ID NO: 3564627 - RNA, 21 nt, Pseudomonas putida KT2440
agcgaugcacgccagcaucac

SEQ ID NO: 3564628 - RNA, 15 nt, Pseudomonas putida KT2440
agcgauggcggauca

SEQ ID NO: 3564629 - RNA, 18 nt, Pseudomonas putida KT2440
agcgauggcggaucagcg

SEQ ID NO: 3564630 - RNA, 24 nt, Pseudomonas putida KT2440
agcgauggcggaucagcgcgucca

SEQ ID NO: 3564631 - RNA, 15 nt, Pseudomonas putida KT2440
agcgauuccaagugc

SEQ ID NO: 3564632 - RNA, 16 nt, Pseudomonas putida KT2440
agcgauuccaagugcc

SEQ ID NO: 3564633 - RNA, 17 nt, Pseudomonas putida KT2440
agcgauugcccagcguu

SEQ ID NO: 3564634 - RNA, 23 nt, Pseudomonas putida KT2440
agcgauugcccagcguucggguc

SEQ ID NO: 3564635 - RNA, 23 nt, Pseudomonas putida KT2440
agcgauugcggccuagcaaggcc

SEQ ID NO: 3564636 - RNA, 18 nt, Pseudomonas putida KT2440
agcgcaaaaccaccagcc

SEQ ID NO: 3564637 - RNA, 20 nt, Pseudomonas putida KT2440
agcgcaaaaccaccagccgu

SEQ ID NO: 3564638 - RNA, 21 nt, Pseudomonas putida KT2440
agcgcaccgaugcggugcagc

SEQ ID NO: 3564639 - RNA, 17 nt, Pseudomonas putida KT2440
agcgcaccgugcaccag

SEQ ID NO: 3564640 - RNA, 19 nt, Pseudomonas putida KT2440
agcgcaccgugcaccagca

SEQ ID NO: 3564641 - RNA, 22 nt, Pseudomonas putida KT2440
agcgcaccuggauguugugcga

SEQ ID NO: 3564642 - RNA, 20 nt, Pseudomonas putida KT2440
agcgcacgucucgggaauug

SEQ ID NO: 3564643 - RNA, 21 nt, Pseudomonas putida KT2440
agcgcacugaacagcgccuug

SEQ ID NO: 3564644 - RNA, 17 nt, Pseudomonas putida KT2440
agcgcacugagcaacgc

SEQ ID NO: 3564645 - RNA, 17 nt, Pseudomonas putida KT2440
agcgcacuuggccugcu

SEQ ID NO: 3564646 - RNA, 16 nt, Pseudomonas putida KT2440
agcgcagacuggguga

SEQ ID NO: 3564647 - RNA, 16 nt, Pseudomonas putida KT2440
agcgcagaucccgcuc

SEQ ID NO: 3564648 - RNA, 17 nt, Pseudomonas putida KT2440
agcgcagaucccgcucg

SEQ ID NO: 3564649 - RNA, 16 nt, Pseudomonas putida KT2440
agcgcagcaauacgca

SEQ ID NO: 3564650 - RNA, 22 nt, Pseudomonas putida KT2440
agcgcagcaucuuccugccacu

SEQ ID NO: 3564651 - RNA, 13 nt, Pseudomonas putida KT2440
agcgcagccacca

SEQ ID NO: 3564652 - RNA, 15 nt, Pseudomonas putida KT2440
agcgcagccaccagc

SEQ ID NO: 3564653 - RNA, 17 nt, Pseudomonas putida KT2440
agcgcagccaccagcuu

SEQ ID NO: 3564654 - RNA, 21 nt, Pseudomonas putida KT2440
agcgcagccuugucucugaac

SEQ ID NO: 3564655 - RNA, 19 nt, Pseudomonas putida KT2440
agcgcagccuugugcugcg

SEQ ID NO: 3564656 - RNA, 12 nt, Pseudomonas putida KT2440
agcgcagcgacg

SEQ ID NO: 3564657 - RNA, 20 nt, Pseudomonas putida KT2440
agcgcagcgacgaccugcac

SEQ ID NO: 3564658 - RNA, 22 nt, Pseudomonas putida KT2440
agcgcagcguaauagcugguga

SEQ ID NO: 3564659 - RNA, 18 nt, Pseudomonas putida KT2440
agcgcagcuucucaagca

SEQ ID NO: 3564660 - RNA, 18 nt, Pseudomonas putida KT2440
agcgcagggaagguggcc

SEQ ID NO: 3564661 - RNA, 20 nt, Pseudomonas putida KT2440
agcgcagucaccacacggca

SEQ ID NO: 3564662 - RNA, 17 nt, Pseudomonas putida KT2440
agcgcauaggccaaggu

SEQ ID NO: 3564663 - RNA, 14 nt, Pseudomonas putida KT2440
agcgcauccaccuc

SEQ ID NO: 3564664 - RNA, 14 nt, Pseudomonas putida KT2440
agcgcaucggccac

SEQ ID NO: 3564665 - RNA, 18 nt, Pseudomonas putida KT2440
agcgcaugcucgcgggcc

SEQ ID NO: 3564666 - RNA, 18 nt, Pseudomonas putida KT2440
agcgcauugaucgccgcc

SEQ ID NO: 3564667 - RNA, 16 nt, Pseudomonas putida KT2440
agcgcauugcccgcga

SEQ ID NO: 3564668 - RNA, 20 nt, Pseudomonas putida KT2440
agcgcauuggcguugagccg

SEQ ID NO: 3564669 - RNA, 21 nt, Pseudomonas putida KT2440
agcgccaacgcccccgccacc

SEQ ID NO: 3564670 - RNA, 15 nt, Pseudomonas putida KT2440
agcgccaauaccgcg

SEQ ID NO: 3564671 - RNA, 17 nt, Pseudomonas putida KT2440
agcgccaauaccgcgca

SEQ ID NO: 3564672 - RNA, 20 nt, Pseudomonas putida KT2440
agcgccaauaccgcgcauca

SEQ ID NO: 3564673 - RNA, 14 nt, Pseudomonas putida KT2440
agcgccaccggcag

SEQ ID NO: 3564674 - RNA, 15 nt, Pseudomonas putida KT2440
agcgccacgccugca

SEQ ID NO: 3564675 - RNA, 14 nt, Pseudomonas putida KT2440
agcgccagcaacgc

SEQ ID NO: 3564676 - RNA, 23 nt, Pseudomonas putida KT2440
agcgccagcaacgcagccaggau

SEQ ID NO: 3564677 - RNA, 20 nt, Pseudomonas putida KT2440
agcgccagcacgcaggccag

SEQ ID NO: 3564678 - RNA, 13 nt, Pseudomonas putida KT2440
agcgccagcagcc

SEQ ID NO: 3564679 - RNA, 15 nt, Pseudomonas putida KT2440
agcgccagcagccgg

SEQ ID NO: 3564680 - RNA, 16 nt, Pseudomonas putida KT2440
agcgccagcaucgagg

SEQ ID NO: 3564681 - RNA, 13 nt, Pseudomonas putida KT2440
agcgccagggcau

SEQ ID NO: 3564682 - RNA, 18 nt, Pseudomonas putida KT2440
agcgccaugagugcaggc

SEQ ID NO: 3564683 - RNA, 21 nt, Pseudomonas putida KT2440
agcgccaugagugcaggcaua

SEQ ID NO: 3564684 - RNA, 18 nt, Pseudomonas putida KT2440
agcgcccacgcaaaaccu

SEQ ID NO: 3564685 - RNA, 12 nt, Pseudomonas putida KT2440
agcgcccagaac

SEQ ID NO: 3564686 - RNA, 19 nt, Pseudomonas putida KT2440
agcgcccagaucagcagca

SEQ ID NO: 3564687 - RNA, 23 nt, Pseudomonas putida KT2440
agcgcccagaucagcagcaccga

SEQ ID NO: 3564688 - RNA, 14 nt, Pseudomonas putida KT2440
agcgcccgcugcgc

SEQ ID NO: 3564689 - RNA, 17 nt, Pseudomonas putida KT2440
agcgcccgucuggcugc

SEQ ID NO: 3564690 - RNA, 16 nt, Pseudomonas putida KT2440
agcgcccuucacgcuc

SEQ ID NO: 3564691 - RNA, 22 nt, Pseudomonas putida KT2440
agcgccgaugcucgucagcccc

SEQ ID NO: 3564692 - RNA, 12 nt, Pseudomonas putida KT2440
agcgccgcaacg

SEQ ID NO: 3564693 - RNA, 17 nt, Pseudomonas putida KT2440
agcgccgcauccagcac

SEQ ID NO: 3564694 - RNA, 16 nt, Pseudomonas putida KT2440
agcgccgccaacucgc

SEQ ID NO: 3564695 - RNA, 14 nt, Pseudomonas putida KT2440
agcgccgccaggcc

SEQ ID NO: 3564696 - RNA, 15 nt, Pseudomonas putida KT2440
agcgccgcgcccaug

SEQ ID NO: 3564697 - RNA, 20 nt, Pseudomonas putida KT2440
agcgccgcgcgggcggcgcu

SEQ ID NO: 3564698 - RNA, 23 nt, Pseudomonas putida KT2440
agcgccgcgcgggcggcgcucgg

SEQ ID NO: 3564699 - RNA, 22 nt, Pseudomonas putida KT2440
agcgccgcggccaacauucacg

SEQ ID NO: 3564700 - RNA, 14 nt, Pseudomonas putida KT2440
agcgccgcuucagc

SEQ ID NO: 3564701 - RNA, 19 nt, Pseudomonas putida KT2440
agcgccggcaguugcuccu

SEQ ID NO: 3564702 - RNA, 20 nt, Pseudomonas putida KT2440
agcgccggcaguugcuccuu

SEQ ID NO: 3564703 - RNA, 17 nt, Pseudomonas putida KT2440
agcgccgugcucggccu

SEQ ID NO: 3564704 - RNA, 20 nt, Pseudomonas putida KT2440
agcgccgugcucggccuugc

SEQ ID NO: 3564705 - RNA, 11 nt, Pseudomonas putida KT2440
agcgccuccac

SEQ ID NO: 3564706 - RNA, 13 nt, Pseudomonas putida KT2440
agcgccugacgca

SEQ ID NO: 3564707 - RNA, 17 nt, Pseudomonas putida KT2440
agcgccugauuacccug

SEQ ID NO: 3564708 - RNA, 19 nt, Pseudomonas putida KT2440
agcgccugauuacccugcg

SEQ ID NO: 3564709 - RNA, 22 nt, Pseudomonas putida KT2440
agcgccugauuacccugcgcca

SEQ ID NO: 3564710 - RNA, 15 nt, Pseudomonas putida KT2440
agcgccugcaggccc

SEQ ID NO: 3564711 - RNA, 12 nt, Pseudomonas putida KT2440
agcgccuggcga

SEQ ID NO: 3564712 - RNA, 22 nt, Pseudomonas putida KT2440
agcgccuggcgcaguucgucca

SEQ ID NO: 3564713 - RNA, 20 nt, Pseudomonas putida KT2440
agcgccugugagaucgagcg

SEQ ID NO: 3564714 - RNA, 17 nt, Pseudomonas putida KT2440
agcgccuugaucgucau

SEQ ID NO: 3564715 - RNA, 20 nt, Pseudomonas putida KT2440
agcgccuugaucgucauggu

SEQ ID NO: 3564716 - RNA, 23 nt, Pseudomonas putida KT2440
agcgccuuggccugcucacccga

SEQ ID NO: 3564717 - RNA, 24 nt, Pseudomonas putida KT2440
agcgccuuggccugcucacccgac

SEQ ID NO: 3564718 - RNA, 16 nt, Pseudomonas putida KT2440
agcgccuugucggcac

SEQ ID NO: 3564719 - RNA, 21 nt, Pseudomonas putida KT2440
agcgcgaagcccagcuugccc

SEQ ID NO: 3564720 - RNA, 13 nt, Pseudomonas putida KT2440
agcgcgacgcagc

SEQ ID NO: 3564721 - RNA, 15 nt, Pseudomonas putida KT2440
agcgcgacuggugcu

SEQ ID NO: 3564722 - RNA, 20 nt, Pseudomonas putida KT2440
agcgcgacuggugcucugca

SEQ ID NO: 3564723 - RNA, 12 nt, Pseudomonas putida KT2440
agcgcgagcugg

SEQ ID NO: 3564724 - RNA, 16 nt, Pseudomonas putida KT2440
agcgcgauaccgacgu

SEQ ID NO: 3564725 - RNA, 14 nt, Pseudomonas putida KT2440
agcgcgaucaccag

SEQ ID NO: 3564726 - RNA, 16 nt, Pseudomonas putida KT2440
agcgcgaucaccagcc

SEQ ID NO: 3564727 - RNA, 15 nt, Pseudomonas putida KT2440
agcgcgccacgcacc

SEQ ID NO: 3564728 - RNA, 16 nt, Pseudomonas putida KT2440
agcgcgccacgcacca

SEQ ID NO: 3564729 - RNA, 18 nt, Pseudomonas putida KT2440
agcgcgccacgcaccagg

SEQ ID NO: 3564730 - RNA, 14 nt, Pseudomonas putida KT2440
agcgcgccagcagg

SEQ ID NO: 3564731 - RNA, 22 nt, Pseudomonas putida KT2440
agcgcgccgccgauagcagcac

SEQ ID NO: 3564732 - RNA, 13 nt, Pseudomonas putida KT2440
agcgcgccuccag

SEQ ID NO: 3564733 - RNA, 22 nt, Pseudomonas putida KT2440
agcgcgccuggucgccgccacc

SEQ ID NO: 3564734 - RNA, 20 nt, Pseudomonas putida KT2440
agcgcggaaauguccgaaua

SEQ ID NO: 3564735 - RNA, 22 nt, Pseudomonas putida KT2440
agcgcggcaaagguggcaccgc

SEQ ID NO: 3564736 - RNA, 15 nt, Pseudomonas putida KT2440
agcgcggcaaccugc

SEQ ID NO: 3564737 - RNA, 23 nt, Pseudomonas putida KT2440
agcgcggccgggucgaaggcaau

SEQ ID NO: 3564738 - RNA, 14 nt, Pseudomonas putida KT2440
agcgcggucugcgg

SEQ ID NO: 3564739 - RNA, 12 nt, Pseudomonas putida KT2440
agcgcguacagc

SEQ ID NO: 3564740 - RNA, 16 nt, Pseudomonas putida KT2440
agcgcgucauccgcca

SEQ ID NO: 3564741 - RNA, 23 nt, Pseudomonas putida KT2440
agcgcgucauccgccaacaccac

SEQ ID NO: 3564742 - RNA, 17 nt, Pseudomonas putida KT2440
agcgcguccagcaacag

SEQ ID NO: 3564743 - RNA, 20 nt, Pseudomonas putida KT2440
agcgcgucugauagccaggg

SEQ ID NO: 3564744 - RNA, 21 nt, Pseudomonas putida KT2440
agcgcgugcuugcaccgacaa

SEQ ID NO: 3564745 - RNA, 22 nt, Pseudomonas putida KT2440
agcgcuaucucggacacgucac

SEQ ID NO: 3564746 - RNA, 15 nt, Pseudomonas putida KT2440
agcgcucaaaaaaau

SEQ ID NO: 3564747 - RNA, 18 nt, Pseudomonas putida KT2440
agcgcucgacauccagcg

SEQ ID NO: 3564748 - RNA, 22 nt, Pseudomonas putida KT2440
agcgcucgacauccagcgccgc

SEQ ID NO: 3564749 - RNA, 22 nt, Pseudomonas putida KT2440
agcgcucgagaaaugccucggc

SEQ ID NO: 3564750 - RNA, 17 nt, Pseudomonas putida KT2440
agcgcucguaggcuuca

SEQ ID NO: 3564751 - RNA, 15 nt, Pseudomonas putida KT2440
agcgcugacugccag

SEQ ID NO: 3564752 - RNA, 18 nt, Pseudomonas putida KT2440
agcgcugacugccaggcc

SEQ ID NO: 3564753 - RNA, 12 nt, Pseudomonas putida KT2440
agcgcugagugg

SEQ ID NO: 3564754 - RNA, 20 nt, Pseudomonas putida KT2440
agcgcugcaccgaaggccgc

SEQ ID NO: 3564755 - RNA, 19 nt, Pseudomonas putida KT2440
agcgcugcgaggccccaga

SEQ ID NO: 3564756 - RNA, 17 nt, Pseudomonas putida KT2440
agcgcugcgcagguaua

SEQ ID NO: 3564757 - RNA, 21 nt, Pseudomonas putida KT2440
agcgcugggcgguacccacca

SEQ ID NO: 3564758 - RNA, 22 nt, Pseudomonas putida KT2440
agcgcuuaaaucaagagcccgg

SEQ ID NO: 3564759 - RNA, 13 nt, Pseudomonas putida KT2440
agcgcuucagcuc

SEQ ID NO: 3564760 - RNA, 19 nt, Pseudomonas putida KT2440
agcgcuuccaagugcugua

SEQ ID NO: 3564761 - RNA, 19 nt, Pseudomonas putida KT2440
agcgcuucgaucgccggca

SEQ ID NO: 3564762 - RNA, 11 nt, Pseudomonas putida KT2440
agcgcuugaag

SEQ ID NO: 3564763 - RNA, 15 nt, Pseudomonas putida KT2440
agcgcuugccgcugc

SEQ ID NO: 3564764 - RNA, 13 nt, Pseudomonas putida KT2440
agcgcuuucuggu

SEQ ID NO: 3564765 - RNA, 17 nt, Pseudomonas putida KT2440
agcggaaucaccgguac

SEQ ID NO: 3564766 - RNA, 15 nt, Pseudomonas putida KT2440
agcggagcugguggu

SEQ ID NO: 3564767 - RNA, 23 nt, Pseudomonas putida KT2440
agcggaugagccuucacugugca

SEQ ID NO: 3564768 - RNA, 17 nt, Pseudomonas putida KT2440
agcggcaacaccagcag

SEQ ID NO: 3564769 - RNA, 18 nt, Pseudomonas putida KT2440
agcggcaacaccagcagc

SEQ ID NO: 3564770 - RNA, 19 nt, Pseudomonas putida KT2440
agcggcaaccugacccgcg

SEQ ID NO: 3564771 - RNA, 17 nt, Pseudomonas putida KT2440
agcggcaauucggccgg

SEQ ID NO: 3564772 - RNA, 21 nt, Pseudomonas putida KT2440
agcggcaauucggccggccag

SEQ ID NO: 3564773 - RNA, 15 nt, Pseudomonas putida KT2440
agcggcagacacagg

SEQ ID NO: 3564774 - RNA, 17 nt, Pseudomonas putida KT2440
agcggcagacacaggcg

SEQ ID NO: 3564775 - RNA, 17 nt, Pseudomonas putida KT2440
agcggcagaucacgcaa

SEQ ID NO: 3564776 - RNA, 20 nt, Pseudomonas putida KT2440
agcggcagcaucgaccugcc

SEQ ID NO: 3564777 - RNA, 17 nt, Pseudomonas putida KT2440
agcggcaguugcaggcg

SEQ ID NO: 3564778 - RNA, 14 nt, Pseudomonas putida KT2440
agcggccacagcgc

SEQ ID NO: 3564779 - RNA, 17 nt, Pseudomonas putida KT2440
agcggccaccugcccca

SEQ ID NO: 3564780 - RNA, 15 nt, Pseudomonas putida KT2440
agcggccccaucacc

SEQ ID NO: 3564781 - RNA, 17 nt, Pseudomonas putida KT2440
agcggccccaucacccc

SEQ ID NO: 3564782 - RNA, 22 nt, Pseudomonas putida KT2440
agcggccccaucacccccgaau

SEQ ID NO: 3564783 - RNA, 16 nt, Pseudomonas putida KT2440
agcggcccccacgccg

SEQ ID NO: 3564784 - RNA, 22 nt, Pseudomonas putida KT2440
agcggccccuucgauucaggcc

SEQ ID NO: 3564785 - RNA, 14 nt, Pseudomonas putida KT2440
agcggcccugagcc

SEQ ID NO: 3564786 - RNA, 15 nt, Pseudomonas putida KT2440
agcggcccugagccu

SEQ ID NO: 3564787 - RNA, 16 nt, Pseudomonas putida KT2440
agcggccggccccccc

SEQ ID NO: 3564788 - RNA, 21 nt, Pseudomonas putida KT2440
agcggccggcccccccaucau

SEQ ID NO: 3564789 - RNA, 19 nt, Pseudomonas putida KT2440
agcggccuugcgucgcgaa

SEQ ID NO: 3564790 - RNA, 20 nt, Pseudomonas putida KT2440
agcggccuugcgucgcgaug

SEQ ID NO: 3564791 - RNA, 19 nt, Pseudomonas putida KT2440
agcggccuugucgcgaaag

SEQ ID NO: 3564792 - RNA, 20 nt, Pseudomonas putida KT2440
agcggccuugugucgcgaua

SEQ ID NO: 3564793 - RNA, 20 nt, Pseudomonas putida KT2440
agcggccuugugucucgaug

SEQ ID NO: 3564794 - RNA, 20 nt, Pseudomonas putida KT2440
agcggcgaaggauggaccga

SEQ ID NO: 3564795 - RNA, 21 nt, Pseudomonas putida KT2440
agcggcgagucgaucggcagu

SEQ ID NO: 3564796 - RNA, 21 nt, Pseudomonas putida KT2440
agcggcgauagggaacagggc

SEQ ID NO: 3564797 - RNA, 23 nt, Pseudomonas putida KT2440
agcggcgauagggaacagggcag

SEQ ID NO: 3564798 - RNA, 12 nt, Pseudomonas putida KT2440
agcggcggcaau

SEQ ID NO: 3564799 - RNA, 22 nt, Pseudomonas putida KT2440
agcggcguguaguagcuccagc

SEQ ID NO: 3564800 - RNA, 23 nt, Pseudomonas putida KT2440
agcggcucgauuuuccaguauuc

SEQ ID NO: 3564801 - RNA, 17 nt, Pseudomonas putida KT2440
agcggcucgcucaggcg

SEQ ID NO: 3564802 - RNA, 15 nt, Pseudomonas putida KT2440
agcggcucucgaagu

SEQ ID NO: 3564803 - RNA, 23 nt, Pseudomonas putida KT2440
agcggcugccuacccaggcaacg

SEQ ID NO: 3564804 - RNA, 24 nt, Pseudomonas putida KT2440
agcggcugccuacccaggcaacga

SEQ ID NO: 3564805 - RNA, 13 nt, Pseudomonas putida KT2440
agcggcuggcgcu

SEQ ID NO: 3564806 - RNA, 16 nt, Pseudomonas putida KT2440
agcggcuggcgcucgu

SEQ ID NO: 3564807 - RNA, 12 nt, Pseudomonas putida KT2440
agcggcuucuac

SEQ ID NO: 3564808 - RNA, 18 nt, Pseudomonas putida KT2440
agcggcuuggccgcgaag

SEQ ID NO: 3564809 - RNA, 21 nt, Pseudomonas putida KT2440
agcggcuuugcgucccgaaag

SEQ ID NO: 3564810 - RNA, 17 nt, Pseudomonas putida KT2440
agcgggcaacugcgccu

SEQ ID NO: 3564811 - RNA, 18 nt, Pseudomonas putida KT2440
agcgggcaacugcgccug

SEQ ID NO: 3564812 - RNA, 22 nt, Pseudomonas putida KT2440
agcgggcagugcaauaccagcc

SEQ ID NO: 3564813 - RNA, 11 nt, Pseudomonas putida KT2440
agcgggcaugc

SEQ ID NO: 3564814 - RNA, 20 nt, Pseudomonas putida KT2440
agcgggcaugcccgcgaagg

SEQ ID NO: 3564815 - RNA, 21 nt, Pseudomonas putida KT2440
agcgggcaugcccgcgaaggc

SEQ ID NO: 3564816 - RNA, 20 nt, Pseudomonas putida KT2440
agcgggcgcgcccgcgaaga

SEQ ID NO: 3564817 - RNA, 13 nt, Pseudomonas putida KT2440
agcgggcguaccu

SEQ ID NO: 3564818 - RNA, 16 nt, Pseudomonas putida KT2440
agcgggcgugcccgcg

SEQ ID NO: 3564819 - RNA, 20 nt, Pseudomonas putida KT2440
agcgggcgugcccgcgaaca

SEQ ID NO: 3564820 - RNA, 19 nt, Pseudomonas putida KT2440
agcgggcgugcccgcgaag

SEQ ID NO: 3564821 - RNA, 20 nt, Pseudomonas putida KT2440
agcgggcgugccugcgaaug

SEQ ID NO: 3564822 - RNA, 17 nt, Pseudomonas putida KT2440
agcgggcuacacgcgcc

SEQ ID NO: 3564823 - RNA, 15 nt, Pseudomonas putida KT2440
agcgggcucgcccac

SEQ ID NO: 3564824 - RNA, 16 nt, Pseudomonas putida KT2440
agcgggcuuacccgcg

SEQ ID NO: 3564825 - RNA, 13 nt, Pseudomonas putida KT2440
agcgggcuugccc

SEQ ID NO: 3564826 - RNA, 14 nt, Pseudomonas putida KT2440
agcgggcuugcccg

SEQ ID NO: 3564827 - RNA, 16 nt, Pseudomonas putida KT2440
agcgggcuugcccgcg

SEQ ID NO: 3564828 - RNA, 19 nt, Pseudomonas putida KT2440
agcgggcuugcccgcgaag

SEQ ID NO: 3564829 - RNA, 20 nt, Pseudomonas putida KT2440
agcgggcuugcccgcgaaga

SEQ ID NO: 3564830 - RNA, 20 nt, Pseudomonas putida KT2440
agcgggcuugcccgcgaagg

SEQ ID NO: 3564831 - RNA, 21 nt, Pseudomonas putida KT2440
agcggggauucaacagcgcga

SEQ ID NO: 3564832 - RNA, 20 nt, Pseudomonas putida KT2440
agcgggggcgcgucagccgu

SEQ ID NO: 3564833 - RNA, 20 nt, Pseudomonas putida KT2440
agcgggucacugcgcgccgu

SEQ ID NO: 3564834 - RNA, 22 nt, Pseudomonas putida KT2440
agcgggucacugcgcgccguug

SEQ ID NO: 3564835 - RNA, 15 nt, Pseudomonas putida KT2440
agcggguccucgaaa

SEQ ID NO: 3564836 - RNA, 19 nt, Pseudomonas putida KT2440
agcgggucgucgcccaggc

SEQ ID NO: 3564837 - RNA, 19 nt, Pseudomonas putida KT2440
agcgggugccgcagcaccg

SEQ ID NO: 3564838 - RNA, 20 nt, Pseudomonas putida KT2440
agcggguucacccgcgaaga

SEQ ID NO: 3564839 - RNA, 19 nt, Pseudomonas putida KT2440
agcggguucacccgcgaau

SEQ ID NO: 3564840 - RNA, 20 nt, Pseudomonas putida KT2440
agcggguucacccgcgaaua

SEQ ID NO: 3564841 - RNA, 21 nt, Pseudomonas putida KT2440
agcggguucacccgcgaaugc

SEQ ID NO: 3564842 - RNA, 16 nt, Pseudomonas putida KT2440
agcggguuuacccgcg

SEQ ID NO: 3564843 - RNA, 17 nt, Pseudomonas putida KT2440
agcggguuuacccgcga

SEQ ID NO: 3564844 - RNA, 19 nt, Pseudomonas putida KT2440
agcggguuuacccgcgaaa

SEQ ID NO: 3564845 - RNA, 20 nt, Pseudomonas putida KT2440
agcggguuuacccgcgaaag

SEQ ID NO: 3564846 - RNA, 19 nt, Pseudomonas putida KT2440
agcggguuuacccgcgaac

SEQ ID NO: 3564847 - RNA, 20 nt, Pseudomonas putida KT2440
agcggguuuacccgcgaaca

SEQ ID NO: 3564848 - RNA, 20 nt, Pseudomonas putida KT2440
agcggguuuacccgcgaagc

SEQ ID NO: 3564849 - RNA, 19 nt, Pseudomonas putida KT2440
agcggguuuacccgcgaau

SEQ ID NO: 3564850 - RNA, 20 nt, Pseudomonas putida KT2440
agcggguuuacccgcgaaug

SEQ ID NO: 3564851 - RNA, 20 nt, Pseudomonas putida KT2440
agcggguuuucucgcgaaug

SEQ ID NO: 3564852 - RNA, 21 nt, Pseudomonas putida KT2440
agcgguagauguagcggguca

SEQ ID NO: 3564853 - RNA, 14 nt, Pseudomonas putida KT2440
agcggucgcagguu

SEQ ID NO: 3564854 - RNA, 18 nt, Pseudomonas putida KT2440
agcggucugcugcgucag

SEQ ID NO: 3564855 - RNA, 21 nt, Pseudomonas putida KT2440
agcggucugcugcgucagcau

SEQ ID NO: 3564856 - RNA, 17 nt, Pseudomonas putida KT2440
agcggugugggcgaagu

SEQ ID NO: 3564857 - RNA, 16 nt, Pseudomonas putida KT2440
agcgguugaccgccgc

SEQ ID NO: 3564858 - RNA, 14 nt, Pseudomonas putida KT2440
agcgguugcccgcu

SEQ ID NO: 3564859 - RNA, 16 nt, Pseudomonas putida KT2440
agcgguugcccgcugc

SEQ ID NO: 3564860 - RNA, 13 nt, Pseudomonas putida KT2440
agcguacacugca

SEQ ID NO: 3564861 - RNA, 17 nt, Pseudomonas putida KT2440
agcguacacugcaggag

SEQ ID NO: 3564862 - RNA, 12 nt, Pseudomonas putida KT2440
agcguaggggcg

SEQ ID NO: 3564863 - RNA, 15 nt, Pseudomonas putida KT2440
agcgucaaccaggcg

SEQ ID NO: 3564864 - RNA, 18 nt, Pseudomonas putida KT2440
agcgucaaccaggcgcag

SEQ ID NO: 3564865 - RNA, 22 nt, Pseudomonas putida KT2440
agcgucacccguggcagccccc

SEQ ID NO: 3564866 - RNA, 12 nt, Pseudomonas putida KT2440
agcgucagcagg

SEQ ID NO: 3564867 - RNA, 17 nt, Pseudomonas putida KT2440
agcgucagcagggccaa

SEQ ID NO: 3564868 - RNA, 20 nt, Pseudomonas putida KT2440
agcgucagggucucgcggcu

SEQ ID NO: 3564869 - RNA, 19 nt, Pseudomonas putida KT2440
agcgucaugaacucaguua

SEQ ID NO: 3564870 - RNA, 22 nt, Pseudomonas putida KT2440
agcgucaugcgguacagcacug

SEQ ID NO: 3564871 - RNA, 22 nt, Pseudomonas putida KT2440
agcgucccugcccgaucgccuc

SEQ ID NO: 3564872 - RNA, 17 nt, Pseudomonas putida KT2440
agcgucgaugcggccac

SEQ ID NO: 3564873 - RNA, 16 nt, Pseudomonas putida KT2440
agcgucgcccgcgaaa

SEQ ID NO: 3564874 - RNA, 17 nt, Pseudomonas putida KT2440
agcgucgcccgcgaaau

SEQ ID NO: 3564875 - RNA, 19 nt, Pseudomonas putida KT2440
agcgucgcgcgcccaggcc

SEQ ID NO: 3564876 - RNA, 21 nt, Pseudomonas putida KT2440
agcgucgcgcgcccaggccca

SEQ ID NO: 3564877 - RNA, 16 nt, Pseudomonas putida KT2440
agcgucggcagagcgc

SEQ ID NO: 3564878 - RNA, 19 nt, Pseudomonas putida KT2440
agcgucggcagagcgccag

SEQ ID NO: 3564879 - RNA, 13 nt, Pseudomonas putida KT2440
agcgucggccacc

SEQ ID NO: 3564880 - RNA, 14 nt, Pseudomonas putida KT2440
agcgucggccaccu

SEQ ID NO: 3564881 - RNA, 17 nt, Pseudomonas putida KT2440
agcgucucgccaaacug

SEQ ID NO: 3564882 - RNA, 18 nt, Pseudomonas putida KT2440
agcgugaaauaagaaccg

SEQ ID NO: 3564883 - RNA, 15 nt, Pseudomonas putida KT2440
agcgugaagcggaca

SEQ ID NO: 3564884 - RNA, 17 nt, Pseudomonas putida KT2440
agcgugacgauggccac

SEQ ID NO: 3564885 - RNA, 14 nt, Pseudomonas putida KT2440
agcgugcgaaguug

SEQ ID NO: 3564886 - RNA, 20 nt, Pseudomonas putida KT2440
agcguggcaaacccggccag

SEQ ID NO: 3564887 - RNA, 21 nt, Pseudomonas putida KT2440
agcguggcaaacccggccagc

SEQ ID NO: 3564888 - RNA, 17 nt, Pseudomonas putida KT2440
agcguggccgccaacag

SEQ ID NO: 3564889 - RNA, 15 nt, Pseudomonas putida KT2440
agcgugggccgugca

SEQ ID NO: 3564890 - RNA, 21 nt, Pseudomonas putida KT2440
agcgugggccgugcaggcggc

SEQ ID NO: 3564891 - RNA, 14 nt, Pseudomonas putida KT2440
agcguuaccaacag

SEQ ID NO: 3564892 - RNA, 14 nt, Pseudomonas putida KT2440
agcguucgaugcgc

SEQ ID NO: 3564893 - RNA, 17 nt, Pseudomonas putida KT2440
agcguucggccagcacu

SEQ ID NO: 3564894 - RNA, 13 nt, Pseudomonas putida KT2440
agcguugcaggcg

SEQ ID NO: 3564895 - RNA, 14 nt, Pseudomonas putida KT2440
agcguugcauucca

SEQ ID NO: 3564896 - RNA, 21 nt, Pseudomonas putida KT2440
agcguuggcacgacgcucgga

SEQ ID NO: 3564897 - RNA, 23 nt, Pseudomonas putida KT2440
agcguugucgacugcacugccag

SEQ ID NO: 3564898 - RNA, 16 nt, Pseudomonas putida KT2440
agcguuuuauaaagag

SEQ ID NO: 3564899 - RNA, 17 nt, Pseudomonas putida KT2440
agcguuuuauaaagaga

SEQ ID NO: 3564900 - RNA, 23 nt, Pseudomonas putida KT2440
agcguuuuucucgaugaugcugg

SEQ ID NO: 3564901 - RNA, 14 nt, Pseudomonas putida KT2440
agcuacagccccuu

SEQ ID NO: 3564902 - RNA, 22 nt, Pseudomonas putida KT2440
agcuacagccccuuccccaggc

SEQ ID NO: 3564903 - RNA, 23 nt, Pseudomonas putida KT2440
agcuaccaccccaagcauagcca

SEQ ID NO: 3564904 - RNA, 12 nt, Pseudomonas putida KT2440
agcuaucgccag

SEQ ID NO: 3564905 - RNA, 17 nt, Pseudomonas putida KT2440
agcuaucucccagccug

SEQ ID NO: 3564906 - RNA, 18 nt, Pseudomonas putida KT2440
agcucaaaugcuggcaau

SEQ ID NO: 3564907 - RNA, 14 nt, Pseudomonas putida KT2440
agcucaaccagcug

SEQ ID NO: 3564908 - RNA, 15 nt, Pseudomonas putida KT2440
agcucaaccagcugc

SEQ ID NO: 3564909 - RNA, 22 nt, Pseudomonas putida KT2440
agcucaauuggauagagcaucc

SEQ ID NO: 3564910 - RNA, 22 nt, Pseudomonas putida KT2440
agcucaccggcaaucgacucaa

SEQ ID NO: 3564911 - RNA, 20 nt, Pseudomonas putida KT2440
agcucacguuugggcggcgu

SEQ ID NO: 3564912 - RNA, 22 nt, Pseudomonas putida KT2440
agcucacguuugggcggcguga

SEQ ID NO: 3564913 - RNA, 21 nt, Pseudomonas putida KT2440
agcucacugaacgcaauaugc

SEQ ID NO: 3564914 - RNA, 14 nt, Pseudomonas putida KT2440
agcucacuggccaa

SEQ ID NO: 3564915 - RNA, 17 nt, Pseudomonas putida KT2440
agcucacuggccaacuc

SEQ ID NO: 3564916 - RNA, 13 nt, Pseudomonas putida KT2440
agcucagccagca

SEQ ID NO: 3564917 - RNA, 20 nt, Pseudomonas putida KT2440
agcucagcgugacgauggcc

SEQ ID NO: 3564918 - RNA, 21 nt, Pseudomonas putida KT2440
agcucagcgugacgauggcca

SEQ ID NO: 3564919 - RNA, 22 nt, Pseudomonas putida KT2440
agcucagguuacgcaccagcuc

SEQ ID NO: 3564920 - RNA, 20 nt, Pseudomonas putida KT2440
agcucagucgguagagcaaa

SEQ ID NO: 3564921 - RNA, 21 nt, Pseudomonas putida KT2440
agcucagucgguagagcaaau

SEQ ID NO: 3564922 - RNA, 18 nt, Pseudomonas putida KT2440
agcucaucaccaggcccg

SEQ ID NO: 3564923 - RNA, 13 nt, Pseudomonas putida KT2440
agcucauccagcc

SEQ ID NO: 3564924 - RNA, 16 nt, Pseudomonas putida KT2440
agcucauccagccgcg

SEQ ID NO: 3564925 - RNA, 15 nt, Pseudomonas putida KT2440
agcucauccaggcug

SEQ ID NO: 3564926 - RNA, 20 nt, Pseudomonas putida KT2440
agcucauccaggcugcacug

SEQ ID NO: 3564927 - RNA, 15 nt, Pseudomonas putida KT2440
agcucauccaucacc

SEQ ID NO: 3564928 - RNA, 18 nt, Pseudomonas putida KT2440
agcucauccaucaccugc

SEQ ID NO: 3564929 - RNA, 19 nt, Pseudomonas putida KT2440
agcucaugggcuucgagca

SEQ ID NO: 3564930 - RNA, 17 nt, Pseudomonas putida KT2440
agcuccacaucuugccc

SEQ ID NO: 3564931 - RNA, 21 nt, Pseudomonas putida KT2440
agcuccaccaguugguaaaac

SEQ ID NO: 3564932 - RNA, 14 nt, Pseudomonas putida KT2440
agcuccaccuucca

SEQ ID NO: 3564933 - RNA, 15 nt, Pseudomonas putida KT2440
agcuccaccuuccac

SEQ ID NO: 3564934 - RNA, 19 nt, Pseudomonas putida KT2440
agcuccagcaacugcgccg

SEQ ID NO: 3564935 - RNA, 14 nt, Pseudomonas putida KT2440
agcuccagcccagc

SEQ ID NO: 3564936 - RNA, 15 nt, Pseudomonas putida KT2440
agcuccagcguuugc

SEQ ID NO: 3564937 - RNA, 17 nt, Pseudomonas putida KT2440
agcuccaugcggcuacc

SEQ ID NO: 3564938 - RNA, 17 nt, Pseudomonas putida KT2440
agcuccccagcaacgga

SEQ ID NO: 3564939 - RNA, 14 nt, Pseudomonas putida KT2440
agcucccgagccag

SEQ ID NO: 3564940 - RNA, 15 nt, Pseudomonas putida KT2440
agcucccucguagga

SEQ ID NO: 3564941 - RNA, 20 nt, Pseudomonas putida KT2440
agcucccucguaggagcggg

SEQ ID NO: 3564942 - RNA, 21 nt, Pseudomonas putida KT2440
agcucccucguaggagcgggu

SEQ ID NO: 3564943 - RNA, 22 nt, Pseudomonas putida KT2440
agcucccucguaggagcggguu

SEQ ID NO: 3564944 - RNA, 13 nt, Pseudomonas putida KT2440
agcuccgacaggc

SEQ ID NO: 3564945 - RNA, 21 nt, Pseudomonas putida KT2440
agcuccgguguuuccacaggu

SEQ ID NO: 3564946 - RNA, 17 nt, Pseudomonas putida KT2440
agcuccucugccgacaa

SEQ ID NO: 3564947 - RNA, 16 nt, Pseudomonas putida KT2440
agcucgaaaccggccu

SEQ ID NO: 3564948 - RNA, 17 nt, Pseudomonas putida KT2440
agcucgacaacccgcgc

SEQ ID NO: 3564949 - RNA, 14 nt, Pseudomonas putida KT2440
agcucgaucagugc

SEQ ID NO: 3564950 - RNA, 16 nt, Pseudomonas putida KT2440
agcucgaucugccugc

SEQ ID NO: 3564951 - RNA, 22 nt, Pseudomonas putida KT2440
agcucgaucuugccuucggcca

SEQ ID NO: 3564952 - RNA, 16 nt, Pseudomonas putida KT2440
agcucgcacgcauguc

SEQ ID NO: 3564953 - RNA, 20 nt, Pseudomonas putida KT2440
agcucgcagguauccggguc

SEQ ID NO: 3564954 - RNA, 15 nt, Pseudomonas putida KT2440
agcucgccaacaccg

SEQ ID NO: 3564955 - RNA, 17 nt, Pseudomonas putida KT2440
agcucgccaacaccgcc

SEQ ID NO: 3564956 - RNA, 14 nt, Pseudomonas putida KT2440
agcucgcccggcac

SEQ ID NO: 3564957 - RNA, 22 nt, Pseudomonas putida KT2440
agcucgcuuuccaaaccugcga

SEQ ID NO: 3564958 - RNA, 14 nt, Pseudomonas putida KT2440
agcucggcaaacag

SEQ ID NO: 3564959 - RNA, 17 nt, Pseudomonas putida KT2440
agcucggcacuguaggc

SEQ ID NO: 3564960 - RNA, 13 nt, Pseudomonas putida KT2440
agcucggcagugg

SEQ ID NO: 3564961 - RNA, 16 nt, Pseudomonas putida KT2440
agcucggcaguggcgg

SEQ ID NO: 3564962 - RNA, 21 nt, Pseudomonas putida KT2440
agcucggccacccgcguuugc

SEQ ID NO: 3564963 - RNA, 20 nt, Pseudomonas putida KT2440
agcucgggaacauucucugc

SEQ ID NO: 3564964 - RNA, 17 nt, Pseudomonas putida KT2440
agcucguacauggugua

SEQ ID NO: 3564965 - RNA, 20 nt, Pseudomonas putida KT2440
agcucgucagccaccaccag

SEQ ID NO: 3564966 - RNA, 15 nt, Pseudomonas putida KT2440
agcucguccugcagg

SEQ ID NO: 3564967 - RNA, 23 nt, Pseudomonas putida KT2440
agcucguccugcagggcgagcac

SEQ ID NO: 3564968 - RNA, 14 nt, Pseudomonas putida KT2440
agcucgucgagcaa

SEQ ID NO: 3564969 - RNA, 12 nt, Pseudomonas putida KT2440
agcucuccagca

SEQ ID NO: 3564970 - RNA, 15 nt, Pseudomonas putida KT2440
agcucuggcagcagu

SEQ ID NO: 3564971 - RNA, 16 nt, Pseudomonas putida KT2440
agcucuggucaccuuc

SEQ ID NO: 3564972 - RNA, 13 nt, Pseudomonas putida KT2440
agcucuuccuuga

SEQ ID NO: 3564973 - RNA, 17 nt, Pseudomonas putida KT2440
agcucuucgaucucuuc

SEQ ID NO: 3564974 - RNA, 15 nt, Pseudomonas putida KT2440
agcugaacugcucuc

SEQ ID NO: 3564975 - RNA, 21 nt, Pseudomonas putida KT2440
agcugaauccauuuguggacg

SEQ ID NO: 3564976 - RNA, 20 nt, Pseudomonas putida KT2440
agcugaaugaaaaagccccg

SEQ ID NO: 3564977 - RNA, 23 nt, Pseudomonas putida KT2440
agcugaucgccgucgaccaggca

SEQ ID NO: 3564978 - RNA, 23 nt, Pseudomonas putida KT2440
agcugaugagguuugccaaggca

SEQ ID NO: 3564979 - RNA, 14 nt, Pseudomonas putida KT2440
agcugaugcucaag

SEQ ID NO: 3564980 - RNA, 21 nt, Pseudomonas putida KT2440
agcugaugcucaagcgccagg

SEQ ID NO: 3564981 - RNA, 24 nt, Pseudomonas putida KT2440
agcugaugcucaagcgccagggca

SEQ ID NO: 3564982 - RNA, 12 nt, Pseudomonas putida KT2440
agcugcaacagc

SEQ ID NO: 3564983 - RNA, 21 nt, Pseudomonas putida KT2440
agcugcaccaccugcuccugg

SEQ ID NO: 3564984 - RNA, 20 nt, Pseudomonas putida KT2440
agcugcaccgaccgugcaua

SEQ ID NO: 3564985 - RNA, 13 nt, Pseudomonas putida KT2440
agcugcaccgccg

SEQ ID NO: 3564986 - RNA, 12 nt, Pseudomonas putida KT2440
agcugcagcagc

SEQ ID NO: 3564987 - RNA, 13 nt, Pseudomonas putida KT2440
agcugcagcagcu

SEQ ID NO: 3564988 - RNA, 14 nt, Pseudomonas putida KT2440
agcugcagcagcuu

SEQ ID NO: 3564989 - RNA, 23 nt, Pseudomonas putida KT2440
agcugcaucagguagcugggccc

SEQ ID NO: 3564990 - RNA, 23 nt, Pseudomonas putida KT2440
agcugcauuggcggcaggcgcag

SEQ ID NO: 3564991 - RNA, 15 nt, Pseudomonas putida KT2440
agcugccacugcgcg

SEQ ID NO: 3564992 - RNA, 16 nt, Pseudomonas putida KT2440
agcugccauccagguu

SEQ ID NO: 3564993 - RNA, 21 nt, Pseudomonas putida KT2440
agcugccauuucuucagcagg

SEQ ID NO: 3564994 - RNA, 23 nt, Pseudomonas putida KT2440
agcugccauuucuucagcaggaa

SEQ ID NO: 3564995 - RNA, 19 nt, Pseudomonas putida KT2440
agcugccgcguucacaucg

SEQ ID NO: 3564996 - RNA, 22 nt, Pseudomonas putida KT2440
agcugccggaacguuuccagca

SEQ ID NO: 3564997 - RNA, 11 nt, Pseudomonas putida KT2440
agcugccgggc

SEQ ID NO: 3564998 - RNA, 18 nt, Pseudomonas putida KT2440
agcugccgggccgggcac

SEQ ID NO: 3564999 - RNA, 15 nt, Pseudomonas putida KT2440
agcugcgcacgcagg

SEQ ID NO: 3565000 - RNA, 14 nt, Pseudomonas putida KT2440
agcugcgcagguug

SEQ ID NO: 3565001 - RNA, 15 nt, Pseudomonas putida KT2440
agcugcgcgcgagag

SEQ ID NO: 3565002 - RNA, 16 nt, Pseudomonas putida KT2440
agcugcgcgcgagagc

SEQ ID NO: 3565003 - RNA, 13 nt, Pseudomonas putida KT2440
agcugcgcugccu

SEQ ID NO: 3565004 - RNA, 15 nt, Pseudomonas putida KT2440
agcugcgcugccugc

SEQ ID NO: 3565005 - RNA, 17 nt, Pseudomonas putida KT2440
agcugcggcaugaaggc

SEQ ID NO: 3565006 - RNA, 17 nt, Pseudomonas putida KT2440
agcugcguggcauccuu

SEQ ID NO: 3565007 - RNA, 16 nt, Pseudomonas putida KT2440
agcugcugucgagcau

SEQ ID NO: 3565008 - RNA, 17 nt, Pseudomonas putida KT2440
agcugcuuaccagcuug

SEQ ID NO: 3565009 - RNA, 19 nt, Pseudomonas putida KT2440
agcugcuuaccagcuuggc

SEQ ID NO: 3565010 - RNA, 16 nt, Pseudomonas putida KT2440
agcuggaacgcuuggc

SEQ ID NO: 3565011 - RNA, 20 nt, Pseudomonas putida KT2440
agcuggagaucuugucgacc

SEQ ID NO: 3565012 - RNA, 15 nt, Pseudomonas putida KT2440
agcuggagccggauc

SEQ ID NO: 3565013 - RNA, 16 nt, Pseudomonas putida KT2440
agcuggauagaguacu

SEQ ID NO: 3565014 - RNA, 17 nt, Pseudomonas putida KT2440
agcuggcaaugcaacuc

SEQ ID NO: 3565015 - RNA, 14 nt, Pseudomonas putida KT2440
agcuggccagccgc

SEQ ID NO: 3565016 - RNA, 20 nt, Pseudomonas putida KT2440
agcuggccagccgcuguucu

SEQ ID NO: 3565017 - RNA, 18 nt, Pseudomonas putida KT2440
agcuggccaucgacccgc

SEQ ID NO: 3565018 - RNA, 17 nt, Pseudomonas putida KT2440
agcuggccguccagcug

SEQ ID NO: 3565019 - RNA, 13 nt, Pseudomonas putida KT2440
agcuggccuugcg

SEQ ID NO: 3565020 - RNA, 22 nt, Pseudomonas putida KT2440
agcuggcgcaaauugcccggcc

SEQ ID NO: 3565021 - RNA, 22 nt, Pseudomonas putida KT2440
agcuggcgcaugacuuccaggu

SEQ ID NO: 3565022 - RNA, 10 nt, Pseudomonas putida KT2440
agcuggcgcg

SEQ ID NO: 3565023 - RNA, 14 nt, Pseudomonas putida KT2440
agcuggcgcgaucc

SEQ ID NO: 3565024 - RNA, 21 nt, Pseudomonas putida KT2440
agcuggcuacccgcucggccu

SEQ ID NO: 3565025 - RNA, 22 nt, Pseudomonas putida KT2440
agcuggcucaucugccggcgaa

SEQ ID NO: 3565026 - RNA, 19 nt, Pseudomonas putida KT2440
agcugggcccgcccagcug

SEQ ID NO: 3565027 - RNA, 16 nt, Pseudomonas putida KT2440
agcugggcuugaaacc

SEQ ID NO: 3565028 - RNA, 14 nt, Pseudomonas putida KT2440
agcugggugaucag

SEQ ID NO: 3565029 - RNA, 18 nt, Pseudomonas putida KT2440
agcuggugggcgaugauc

SEQ ID NO: 3565030 - RNA, 19 nt, Pseudomonas putida KT2440
agcuguacagcgcauaggc

SEQ ID NO: 3565031 - RNA, 17 nt, Pseudomonas putida KT2440
agcuguacgcuggccaa

SEQ ID NO: 3565032 - RNA, 22 nt, Pseudomonas putida KT2440
agcugucacccuuggucaggau

SEQ ID NO: 3565033 - RNA, 23 nt, Pseudomonas putida KT2440
agcugucauuacccggcagaauc

SEQ ID NO: 3565034 - RNA, 19 nt, Pseudomonas putida KT2440
agcugucgcuacgcgccau

SEQ ID NO: 3565035 - RNA, 20 nt, Pseudomonas putida KT2440
agcugucggucagccagaug

SEQ ID NO: 3565036 - RNA, 14 nt, Pseudomonas putida KT2440
agcuguugcgcugg

SEQ ID NO: 3565037 - RNA, 18 nt, Pseudomonas putida KT2440
agcuuaacgcuuggccag

SEQ ID NO: 3565038 - RNA, 13 nt, Pseudomonas putida KT2440
agcuucaacgcga

SEQ ID NO: 3565039 - RNA, 16 nt, Pseudomonas putida KT2440
agcuucaacuccacca

SEQ ID NO: 3565040 - RNA, 15 nt, Pseudomonas putida KT2440
agcuucaacugcugc

SEQ ID NO: 3565041 - RNA, 15 nt, Pseudomonas putida KT2440
agcuucaccucagaa

SEQ ID NO: 3565042 - RNA, 15 nt, Pseudomonas putida KT2440
agcuucagccagggc

SEQ ID NO: 3565043 - RNA, 18 nt, Pseudomonas putida KT2440
agcuucagguucugccgg

SEQ ID NO: 3565044 - RNA, 21 nt, Pseudomonas putida KT2440
agcuucaugaaaaacccggcc

SEQ ID NO: 3565045 - RNA, 17 nt, Pseudomonas putida KT2440
agcuucauggcgccgau

SEQ ID NO: 3565046 - RNA, 23 nt, Pseudomonas putida KT2440
agcuuccaguuggccggcauggc

SEQ ID NO: 3565047 - RNA, 21 nt, Pseudomonas putida KT2440
agcuucccggccuggcgcagg

SEQ ID NO: 3565048 - RNA, 23 nt, Pseudomonas putida KT2440
agcuucccggccuggcgcaggua

SEQ ID NO: 3565049 - RNA, 14 nt, Pseudomonas putida KT2440
agcuucuagcaaug

SEQ ID NO: 3565050 - RNA, 19 nt, Pseudomonas putida KT2440
agcuucuagcaaugccagc

SEQ ID NO: 3565051 - RNA, 21 nt, Pseudomonas putida KT2440
agcuucuagcaaugccagccg

SEQ ID NO: 3565052 - RNA, 18 nt, Pseudomonas putida KT2440
agcuucucgagcggccug

SEQ ID NO: 3565053 - RNA, 17 nt, Pseudomonas putida KT2440
agcuucucgcgcuuggc

SEQ ID NO: 3565054 - RNA, 20 nt, Pseudomonas putida KT2440
agcuucucgcgcuuggccag

SEQ ID NO: 3565055 - RNA, 13 nt, Pseudomonas putida KT2440
agcuucugcaacu

SEQ ID NO: 3565056 - RNA, 22 nt, Pseudomonas putida KT2440
agcuucuucacaccggccuugg

SEQ ID NO: 3565057 - RNA, 16 nt, Pseudomonas putida KT2440
agcuucuugcaccgcu

SEQ ID NO: 3565058 - RNA, 19 nt, Pseudomonas putida KT2440
agcuugaacaacggcgcug

SEQ ID NO: 3565059 - RNA, 21 nt, Pseudomonas putida KT2440
agcuugaacaacggcgcuguc

SEQ ID NO: 3565060 - RNA, 18 nt, Pseudomonas putida KT2440
agcuugacuuccagcuug

SEQ ID NO: 3565061 - RNA, 13 nt, Pseudomonas putida KT2440
agcuugagcucga

SEQ ID NO: 3565062 - RNA, 19 nt, Pseudomonas putida KT2440
agcuugagcucgaucuugc

SEQ ID NO: 3565063 - RNA, 13 nt, Pseudomonas putida KT2440
agcuugaggccca

SEQ ID NO: 3565064 - RNA, 19 nt, Pseudomonas putida KT2440
agcuugccauccuugaagu

SEQ ID NO: 3565065 - RNA, 21 nt, Pseudomonas putida KT2440
agcuugccauccuugaaguag

SEQ ID NO: 3565066 - RNA, 15 nt, Pseudomonas putida KT2440
agcuugccauucuug

SEQ ID NO: 3565067 - RNA, 18 nt, Pseudomonas putida KT2440
agcuugccauucuugucc

SEQ ID NO: 3565068 - RNA, 15 nt, Pseudomonas putida KT2440
agcuugcccagcugc

SEQ ID NO: 3565069 - RNA, 16 nt, Pseudomonas putida KT2440
agcuugcccagcugcg

SEQ ID NO: 3565070 - RNA, 13 nt, Pseudomonas putida KT2440
agcuugcccauca

SEQ ID NO: 3565071 - RNA, 13 nt, Pseudomonas putida KT2440
agcuugccgauca

SEQ ID NO: 3565072 - RNA, 18 nt, Pseudomonas putida KT2440
agcuugccgcgugcgaug

SEQ ID NO: 3565073 - RNA, 19 nt, Pseudomonas putida KT2440
agcuugccuuccgggaaga

SEQ ID NO: 3565074 - RNA, 14 nt, Pseudomonas putida KT2440
agcuugcgcgccuu

SEQ ID NO: 3565075 - RNA, 22 nt, Pseudomonas putida KT2440
agcuugcgcgccuugcgccagg

SEQ ID NO: 3565076 - RNA, 20 nt, Pseudomonas putida KT2440
agcuugcucgcgaugcgccg

SEQ ID NO: 3565077 - RNA, 16 nt, Pseudomonas putida KT2440
agcuuggacaggcccc

SEQ ID NO: 3565078 - RNA, 18 nt, Pseudomonas putida KT2440
agcuuggacaggccccag

SEQ ID NO: 3565079 - RNA, 15 nt, Pseudomonas putida KT2440
agcuuggucagggca

SEQ ID NO: 3565080 - RNA, 18 nt, Pseudomonas putida KT2440
agcuugugaucccgcgag

SEQ ID NO: 3565081 - RNA, 23 nt, Pseudomonas putida KT2440
agcuugugcagcgacggcgaagu

SEQ ID NO: 3565082 - RNA, 19 nt, Pseudomonas putida KT2440
agcuuucaggcgcagcaca

SEQ ID NO: 3565083 - RNA, 15 nt, Pseudomonas putida KT2440
agcuuuggcugcagg

SEQ ID NO: 3565084 - RNA, 16 nt, Pseudomonas putida KT2440
agcuuuggcugcaggu

SEQ ID NO: 3565085 - RNA, 23 nt, Pseudomonas putida KT2440
agcuuuguauugccugugcuggc

SEQ ID NO: 3565086 - RNA, 19 nt, Pseudomonas putida KT2440
aggaaaaucagcuauugag

SEQ ID NO: 3565087 - RNA, 13 nt, Pseudomonas putida KT2440
aggaaacccgcgc

SEQ ID NO: 3565088 - RNA, 14 nt, Pseudomonas putida KT2440
aggaacagcgccac

SEQ ID NO: 3565089 - RNA, 14 nt, Pseudomonas putida KT2440
aggaacagcggcag

SEQ ID NO: 3565090 - RNA, 20 nt, Pseudomonas putida KT2440
aggaacaggcugaugcgcug

SEQ ID NO: 3565091 - RNA, 23 nt, Pseudomonas putida KT2440
aggaacaucgccgucaucaccac

SEQ ID NO: 3565092 - RNA, 15 nt, Pseudomonas putida KT2440
aggaaccgcucccag

SEQ ID NO: 3565093 - RNA, 19 nt, Pseudomonas putida KT2440
aggaaccuccguugcugcg

SEQ ID NO: 3565094 - RNA, 13 nt, Pseudomonas putida KT2440
aggaacgcugccu

SEQ ID NO: 3565095 - RNA, 19 nt, Pseudomonas putida KT2440
aggaacgcugccuccacac

SEQ ID NO: 3565096 - RNA, 19 nt, Pseudomonas putida KT2440
aggaacgguguaucggcca

SEQ ID NO: 3565097 - RNA, 18 nt, Pseudomonas putida KT2440
aggaagaaggcauccagg

SEQ ID NO: 3565098 - RNA, 19 nt, Pseudomonas putida KT2440
aggaagaaggcauccaggg

SEQ ID NO: 3565099 - RNA, 18 nt, Pseudomonas putida KT2440
aggaagaugaagaaacca

SEQ ID NO: 3565100 - RNA, 14 nt, Pseudomonas putida KT2440
aggaagauguguug

SEQ ID NO: 3565101 - RNA, 18 nt, Pseudomonas putida KT2440
aggaagcucgcacgcaug

SEQ ID NO: 3565102 - RNA, 12 nt, Pseudomonas putida KT2440
aggaagcuggga

SEQ ID NO: 3565103 - RNA, 13 nt, Pseudomonas putida KT2440
aucgguacgccgc

SEQ ID NO: 3565104 - RNA, 16 nt, Pseudomonas putida KT2440
aucgguacgccgcaaa

SEQ ID NO: 3565105 - RNA, 16 nt, Pseudomonas putida KT2440
aucggucuuacgggcu

SEQ ID NO: 3565106 - RNA, 20 nt, Pseudomonas putida KT2440
aucggugcguaggagcgggu

SEQ ID NO: 3565107 - RNA, 16 nt, Pseudomonas putida KT2440
aucggugcuuucugcu

SEQ ID NO: 3565108 - RNA, 16 nt, Pseudomonas putida KT2440
aucgguuggguuggca

SEQ ID NO: 3565109 - RNA, 17 nt, Pseudomonas putida KT2440
aucguagccugaggggu

SEQ ID NO: 3565110 - RNA, 17 nt, Pseudomonas putida KT2440
aucguauugccccggcc

SEQ ID NO: 3565111 - RNA, 19 nt, Pseudomonas putida KT2440
aucgucacguuuuuuggga

SEQ ID NO: 3565112 - RNA, 23 nt, Pseudomonas putida KT2440
aucgucccggcgucccggccagc

SEQ ID NO: 3565113 - RNA, 21 nt, Pseudomonas putida KT2440
aucguccuggaaaagcaaggc

SEQ ID NO: 3565114 - RNA, 16 nt, Pseudomonas putida KT2440
aucgucgacaacgcac

SEQ ID NO: 3565115 - RNA, 16 nt, Pseudomonas putida KT2440
aucgucggccccggcc

SEQ ID NO: 3565116 - RNA, 19 nt, Pseudomonas putida KT2440
aucgucggccccggcccca

SEQ ID NO: 3565117 - RNA, 14 nt, Pseudomonas putida KT2440
aucgucugcaucau

SEQ ID NO: 3565118 - RNA, 16 nt, Pseudomonas putida KT2440
aucgugaagcaccgcc

SEQ ID NO: 3565119 - RNA, 17 nt, Pseudomonas putida KT2440
aucgugaucauccccag

SEQ ID NO: 3565120 - RNA, 20 nt, Pseudomonas putida KT2440
aucgugaucauccccagcau

SEQ ID NO: 3565121 - RNA, 14 nt, Pseudomonas putida KT2440
aucguugcgcgcca

SEQ ID NO: 3565122 - RNA, 20 nt, Pseudomonas putida KT2440
aucguugcgggucagcucga

SEQ ID NO: 3565123 - RNA, 15 nt, Pseudomonas putida KT2440
aucguuguaagccau

SEQ ID NO: 3565124 - RNA, 15 nt, Pseudomonas putida KT2440
aucguuucgaugaua

SEQ ID NO: 3565125 - RNA, 16 nt, Pseudomonas putida KT2440
aucuaccagcuugccg

SEQ ID NO: 3565126 - RNA, 16 nt, Pseudomonas putida KT2440
aucuagcaggugcuca

SEQ ID NO: 3565127 - RNA, 14 nt, Pseudomonas putida KT2440
aucuaugcccggcu

SEQ ID NO: 3565128 - RNA, 16 nt, Pseudomonas putida KT2440
aucucaaggcuuucca

SEQ ID NO: 3565129 - RNA, 15 nt, Pseudomonas putida KT2440
aucucacgcgccaca

SEQ ID NO: 3565130 - RNA, 16 nt, Pseudomonas putida KT2440
aucucaggcccaccag

SEQ ID NO: 3565131 - RNA, 20 nt, Pseudomonas putida KT2440
aucucaggcccaccagucug

SEQ ID NO: 3565132 - RNA, 18 nt, Pseudomonas putida KT2440
aucuccauagguuaucca

SEQ ID NO: 3565133 - RNA, 13 nt, Pseudomonas putida KT2440
aucucccagccug

SEQ ID NO: 3565134 - RNA, 18 nt, Pseudomonas putida KT2440
aucucccgcgaacgcccg

SEQ ID NO: 3565135 - RNA, 22 nt, Pseudomonas putida KT2440
aucuccuguaguacacgaggau

SEQ ID NO: 3565136 - RNA, 13 nt, Pseudomonas putida KT2440
aucucgcacuuga

SEQ ID NO: 3565137 - RNA, 23 nt, Pseudomonas putida KT2440
aucucgccaaucaaccgcuuggc

SEQ ID NO: 3565138 - RNA, 18 nt, Pseudomonas putida KT2440
aucucgccagccugcagc

SEQ ID NO: 3565139 - RNA, 15 nt, Pseudomonas putida KT2440
aucucggccagcagg

SEQ ID NO: 3565140 - RNA, 19 nt, Pseudomonas putida KT2440
aucucggucgacaggggca

SEQ ID NO: 3565141 - RNA, 23 nt, Pseudomonas putida KT2440
aucucugguacaacaacaaaaaa

SEQ ID NO: 3565142 - RNA, 19 nt, Pseudomonas putida KT2440
aucucugugggagcgggcg

SEQ ID NO: 3565143 - RNA, 18 nt, Pseudomonas putida KT2440
aucucuucgucaccgugc

SEQ ID NO: 3565144 - RNA, 17 nt, Pseudomonas putida KT2440
aucugaaaguucagcgc

SEQ ID NO: 3565145 - RNA, 20 nt, Pseudomonas putida KT2440
aucugaaaguucagcgccuc

SEQ ID NO: 3565146 - RNA, 13 nt, Pseudomonas putida KT2440
aucugacggcgcu

SEQ ID NO: 3565147 - RNA, 17 nt, Pseudomonas putida KT2440
aucugaggcccgaaggu

SEQ ID NO: 3565148 - RNA, 16 nt, Pseudomonas putida KT2440
aucugcacacugcgcu

SEQ ID NO: 3565149 - RNA, 17 nt, Pseudomonas putida KT2440
aucugcacacugcgcuu

SEQ ID NO: 3565150 - RNA, 15 nt, Pseudomonas putida KT2440
aucugcaccggcagc

SEQ ID NO: 3565151 - RNA, 15 nt, Pseudomonas putida KT2440
aucugcaccugguaa

SEQ ID NO: 3565152 - RNA, 17 nt, Pseudomonas putida KT2440
aucugcacuuucacccc

SEQ ID NO: 3565153 - RNA, 13 nt, Pseudomonas putida KT2440
aucugcagcagca

SEQ ID NO: 3565154 - RNA, 19 nt, Pseudomonas putida KT2440
aucugccaggcaccacaag

SEQ ID NO: 3565155 - RNA, 16 nt, Pseudomonas putida KT2440
aucugccccucgauca

SEQ ID NO: 3565156 - RNA, 22 nt, Pseudomonas putida KT2440
aucugccggcagggcuuucuuc

SEQ ID NO: 3565157 - RNA, 18 nt, Pseudomonas putida KT2440
aucugccggcgccuccag

SEQ ID NO: 3565158 - RNA, 23 nt, Pseudomonas putida KT2440
aucugccguuguucggcaaaggc

SEQ ID NO: 3565159 - RNA, 13 nt, Pseudomonas putida KT2440
aucugccugcugc

SEQ ID NO: 3565160 - RNA, 18 nt, Pseudomonas putida KT2440
aucugccugcugcaacag

SEQ ID NO: 3565161 - RNA, 15 nt, Pseudomonas putida KT2440
aucugcgcacggaag

SEQ ID NO: 3565162 - RNA, 15 nt, Pseudomonas putida KT2440
aucugcgccugugca

SEQ ID NO: 3565163 - RNA, 15 nt, Pseudomonas putida KT2440
aucugcguggcaguu

SEQ ID NO: 3565164 - RNA, 17 nt, Pseudomonas putida KT2440
aucugcguuucgcuggc

SEQ ID NO: 3565165 - RNA, 20 nt, Pseudomonas putida KT2440
aucugcguuucgcuggccug

SEQ ID NO: 3565166 - RNA, 13 nt, Pseudomonas putida KT2440
aucugcucgacga

SEQ ID NO: 3565167 - RNA, 14 nt, Pseudomonas putida KT2440
aucugcucuucgcc

SEQ ID NO: 3565168 - RNA, 13 nt, Pseudomonas putida KT2440
aucugcugcagca

SEQ ID NO: 3565169 - RNA, 17 nt, Pseudomonas putida KT2440
aucugcugcagcauggc

SEQ ID NO: 3565170 - RNA, 19 nt, Pseudomonas putida KT2440
aucugcugcggcaggcugg

SEQ ID NO: 3565171 - RNA, 23 nt, Pseudomonas putida KT2440
aucugcugcggcaggcuggcacg

SEQ ID NO: 3565172 - RNA, 20 nt, Pseudomonas putida KT2440
aucugcuggauacccagcgc

SEQ ID NO: 3565173 - RNA, 13 nt, Pseudomonas putida KT2440
aucugcugggugc

SEQ ID NO: 3565174 - RNA, 14 nt, Pseudomonas putida KT2440
aucuggaccccgcc

SEQ ID NO: 3565175 - RNA, 20 nt, Pseudomonas putida KT2440
aucuggcggaaugucggcgu

SEQ ID NO: 3565176 - RNA, 13 nt, Pseudomonas putida KT2440
aucuggcucugca

SEQ ID NO: 3565177 - RNA, 14 nt, Pseudomonas putida KT2440
aucuggcucugcag

SEQ ID NO: 3565178 - RNA, 23 nt, Pseudomonas putida KT2440
aucugggucuugaucuugguggu

SEQ ID NO: 3565179 - RNA, 15 nt, Pseudomonas putida KT2440
aucugguaggccggc

SEQ ID NO: 3565180 - RNA, 21 nt, Pseudomonas putida KT2440
aucuggucagucgagucgaca

SEQ ID NO: 3565181 - RNA, 20 nt, Pseudomonas putida KT2440
aucugguugccgccagcccc

SEQ ID NO: 3565182 - RNA, 20 nt, Pseudomonas putida KT2440
aucugguugcuggcgccagc

SEQ ID NO: 3565183 - RNA, 14 nt, Pseudomonas putida KT2440
aucuguccuccugc

SEQ ID NO: 3565184 - RNA, 19 nt, Pseudomonas putida KT2440
aucugugaggccagcggga

SEQ ID NO: 3565185 - RNA, 15 nt, Pseudomonas putida KT2440
aucuguugcugcagg

SEQ ID NO: 3565186 - RNA, 20 nt, Pseudomonas putida KT2440
aucuguugcugcagguucug

SEQ ID NO: 3565187 - RNA, 14 nt, Pseudomonas putida KT2440
aucuuccagccugc

SEQ ID NO: 3565188 - RNA, 15 nt, Pseudomonas putida KT2440
aucuuccagccugca

SEQ ID NO: 3565189 - RNA, 23 nt, Pseudomonas putida KT2440
aucuucccgggaaaagccugcca

SEQ ID NO: 3565190 - RNA, 13 nt, Pseudomonas putida KT2440
aucuuccgcaugc

SEQ ID NO: 3565191 - RNA, 13 nt, Pseudomonas putida KT2440
aucuuccugccac

SEQ ID NO: 3565192 - RNA, 16 nt, Pseudomonas putida KT2440
aucuucgacaguucaa

SEQ ID NO: 3565193 - RNA, 20 nt, Pseudomonas putida KT2440
aucuucgcccugggcgagca

SEQ ID NO: 3565194 - RNA, 12 nt, Pseudomonas putida KT2440
aucuucgccggc

SEQ ID NO: 3565195 - RNA, 20 nt, Pseudomonas putida KT2440
aucuucgccggcaucgccuc

SEQ ID NO: 3565196 - RNA, 20 nt, Pseudomonas putida KT2440
aucuucggguuguaguucuu

SEQ ID NO: 3565197 - RNA, 18 nt, Pseudomonas putida KT2440
aucuucucuuccaccgua

SEQ ID NO: 3565198 - RNA, 15 nt, Pseudomonas putida KT2440
aucuucuucaucacu

SEQ ID NO: 3565199 - RNA, 19 nt, Pseudomonas putida KT2440
aucuugccggccuugaccu

SEQ ID NO: 3565200 - RNA, 19 nt, Pseudomonas putida KT2440
aucuugcgcgccagcgcau

SEQ ID NO: 3565201 - RNA, 22 nt, Pseudomonas putida KT2440
aucuugcgugcaugggccaggg

SEQ ID NO: 3565202 - RNA, 22 nt, Pseudomonas putida KT2440
aucuugcugaacagccggcccu

SEQ ID NO: 3565203 - RNA, 15 nt, Pseudomonas putida KT2440
aucuugcugcucugc

SEQ ID NO: 3565204 - RNA, 16 nt, Pseudomonas putida KT2440
aucuugcugcucugca

SEQ ID NO: 3565205 - RNA, 17 nt, Pseudomonas putida KT2440
aucuugcugcucugcaa

SEQ ID NO: 3565206 - RNA, 20 nt, Pseudomonas putida KT2440
aucuuggugaugcuggcuuc

SEQ ID NO: 3565207 - RNA, 12 nt, Pseudomonas putida KT2440
aucuuguaggcg

SEQ ID NO: 3565208 - RNA, 23 nt, Pseudomonas putida KT2440
aucuuguguuuugccuccagcuu

SEQ ID NO: 3565209 - RNA, 15 nt, Pseudomonas putida KT2440
augaaaaagccccgc

SEQ ID NO: 3565210 - RNA, 21 nt, Pseudomonas putida KT2440
augaaaaagccccgccagugc

SEQ ID NO: 3565211 - RNA, 16 nt, Pseudomonas putida KT2440
augaaaaggcccugca

SEQ ID NO: 3565212 - RNA, 22 nt, Pseudomonas putida KT2440
augaaacgcguuucggcggccu

SEQ ID NO: 3565213 - RNA, 13 nt, Pseudomonas putida KT2440
augaacagcaagu

SEQ ID NO: 3565214 - RNA, 11 nt, Pseudomonas putida KT2440
augaacagcac

SEQ ID NO: 3565215 - RNA, 14 nt, Pseudomonas putida KT2440
augaacagcgcugc

SEQ ID NO: 3565216 - RNA, 13 nt, Pseudomonas putida KT2440
augaacccggcaa

SEQ ID NO: 3565217 - RNA, 22 nt, Pseudomonas putida KT2440
augaacggcuguuccucgccau

SEQ ID NO: 3565218 - RNA, 18 nt, Pseudomonas putida KT2440
augaacuggaugauccag

SEQ ID NO: 3565219 - RNA, 20 nt, Pseudomonas putida KT2440
augaagacgcucgacagcaa

SEQ ID NO: 3565220 - RNA, 13 nt, Pseudomonas putida KT2440
augaagcaggccg

SEQ ID NO: 3565221 - RNA, 17 nt, Pseudomonas putida KT2440
augaagcuaagcaggga

SEQ ID NO: 3565222 - RNA, 12 nt, Pseudomonas putida KT2440
augaagcuucaa

SEQ ID NO: 3565223 - RNA, 13 nt, Pseudomonas putida KT2440
augaagcuucaaa

SEQ ID NO: 3565224 - RNA, 15 nt, Pseudomonas putida KT2440
augaaguugcaggca

SEQ ID NO: 3565225 - RNA, 17 nt, Pseudomonas putida KT2440
augaauaaugcuccagc

SEQ ID NO: 3565226 - RNA, 19 nt, Pseudomonas putida KT2440
augacaaacgccagcaugc

SEQ ID NO: 3565227 - RNA, 17 nt, Pseudomonas putida KT2440
augacccuuccagcccg

SEQ ID NO: 3565228 - RNA, 22 nt, Pseudomonas putida KT2440
augaccggccgggcuucaacca

SEQ ID NO: 3565229 - RNA, 16 nt, Pseudomonas putida KT2440
augacuguuaaucauu

SEQ ID NO: 3565230 - RNA, 18 nt, Pseudomonas putida KT2440
augagcaagacgggauca

SEQ ID NO: 3565231 - RNA, 15 nt, Pseudomonas putida KT2440
augagccgcccaggu

SEQ ID NO: 3565232 - RNA, 17 nt, Pseudomonas putida KT2440
augagcgagcucaacca

SEQ ID NO: 3565233 - RNA, 19 nt, Pseudomonas putida KT2440
augagggugaccuuuucua

SEQ ID NO: 3565234 - RNA, 15 nt, Pseudomonas putida KT2440
augagguagaucaca

SEQ ID NO: 3565235 - RNA, 14 nt, Pseudomonas putida KT2440
augagguuugccaa

SEQ ID NO: 3565236 - RNA, 19 nt, Pseudomonas putida KT2440
augauauuugccacucagg

SEQ ID NO: 3565237 - RNA, 20 nt, Pseudomonas putida KT2440
augaucaagaaguccuccca

SEQ ID NO: 3565238 - RNA, 15 nt, Pseudomonas putida KT2440
augauccuguugcga

SEQ ID NO: 3565239 - RNA, 16 nt, Pseudomonas putida KT2440
augaucgaaagcgguu

SEQ ID NO: 3565240 - RNA, 21 nt, Pseudomonas putida KT2440
augaucgagccgaucaggaag

SEQ ID NO: 3565241 - RNA, 19 nt, Pseudomonas putida KT2440
augaucgagcgcaccugga

SEQ ID NO: 3565242 - RNA, 14 nt, Pseudomonas putida KT2440
augaucgccgccgc

SEQ ID NO: 3565243 - RNA, 17 nt, Pseudomonas putida KT2440
augaucgccuggccggc

SEQ ID NO: 3565244 - RNA, 14 nt, Pseudomonas putida KT2440
augaucgcggcaau

SEQ ID NO: 3565245 - RNA, 22 nt, Pseudomonas putida KT2440
augaucgcggcguugucagccu

SEQ ID NO: 3565246 - RNA, 16 nt, Pseudomonas putida KT2440
augaucucgcccauga

SEQ ID NO: 3565247 - RNA, 19 nt, Pseudomonas putida KT2440
augaucugcaagcgcagcc

SEQ ID NO: 3565248 - RNA, 19 nt, Pseudomonas putida KT2440
augaugaaguggcgcaggc

SEQ ID NO: 3565249 - RNA, 21 nt, Pseudomonas putida KT2440
augaugaauaaugcuccagcg

SEQ ID NO: 3565250 - RNA, 17 nt, Pseudomonas putida KT2440
augaugaccaccaggaa

SEQ ID NO: 3565251 - RNA, 18 nt, Pseudomonas putida KT2440
augaugcuggucggcuau

SEQ ID NO: 3565252 - RNA, 15 nt, Pseudomonas putida KT2440
augauggcaaucacg

SEQ ID NO: 3565253 - RNA, 18 nt, Pseudomonas putida KT2440
augaugguugacagcgcu

SEQ ID NO: 3565254 - RNA, 23 nt, Pseudomonas putida KT2440
augauugcgggcuuucugguucu

SEQ ID NO: 3565255 - RNA, 13 nt, Pseudomonas putida KT2440
augcaacggcaca

SEQ ID NO: 3565256 - RNA, 21 nt, Pseudomonas putida KT2440
augcaaguaaucuggggcgcu

SEQ ID NO: 3565257 - RNA, 19 nt, Pseudomonas putida KT2440
augcaauccgccacaaacg

SEQ ID NO: 3565258 - RNA, 13 nt, Pseudomonas putida KT2440
augcacagcgagc

SEQ ID NO: 3565259 - RNA, 17 nt, Pseudomonas putida KT2440
augcacagcgagcagcc

SEQ ID NO: 3565260 - RNA, 21 nt, Pseudomonas putida KT2440
augcacagcgagcagccuggc

SEQ ID NO: 3565261 - RNA, 21 nt, Pseudomonas putida KT2440
augcacagcucgcgcugccag

SEQ ID NO: 3565262 - RNA, 13 nt, Pseudomonas putida KT2440
augcacaggccgu

SEQ ID NO: 3565263 - RNA, 21 nt, Pseudomonas putida KT2440
augcacauuccgcacgucaga

SEQ ID NO: 3565264 - RNA, 13 nt, Pseudomonas putida KT2440
augcacgcagcaa

SEQ ID NO: 3565265 - RNA, 22 nt, Pseudomonas putida KT2440
augcagauggggggauuugagg

SEQ ID NO: 3565266 - RNA, 20 nt, Pseudomonas putida KT2440
augcagaugguccggcauca

SEQ ID NO: 3565267 - RNA, 17 nt, Pseudomonas putida KT2440
augcagcaagcuggcac

SEQ ID NO: 3565268 - RNA, 18 nt, Pseudomonas putida KT2440
augcagcagugccagcaa

SEQ ID NO: 3565269 - RNA, 20 nt, Pseudomonas putida KT2440
augcagcagugccagcaaca

SEQ ID NO: 3565270 - RNA, 16 nt, Pseudomonas putida KT2440
augcagccagccucuu

SEQ ID NO: 3565271 - RNA, 23 nt, Pseudomonas putida KT2440
augcagcgggucgcacucggcaa

SEQ ID NO: 3565272 - RNA, 12 nt, Pseudomonas putida KT2440
augcagcucgac

SEQ ID NO: 3565273 - RNA, 17 nt, Pseudomonas putida KT2440
augcagcuuugaggcuc

SEQ ID NO: 3565274 - RNA, 13 nt, Pseudomonas putida KT2440
augcagggccuuu

SEQ ID NO: 3565275 - RNA, 20 nt, Pseudomonas putida KT2440
augcaggucgaccugccagu

SEQ ID NO: 3565276 - RNA, 18 nt, Pseudomonas putida KT2440
augcagguucgaccagaa

SEQ ID NO: 3565277 - RNA, 20 nt, Pseudomonas putida KT2440
augcagguucgaccagaaca

SEQ ID NO: 3565278 - RNA, 23 nt, Pseudomonas putida KT2440
augcaguagccaucgaggaagug

SEQ ID NO: 3565279 - RNA, 22 nt, Pseudomonas putida KT2440
augcaguagcuuaaucccgcaa

SEQ ID NO: 3565280 - RNA, 15 nt, Pseudomonas putida KT2440
augcagugcccgcga

SEQ ID NO: 3565281 - RNA, 18 nt, Pseudomonas putida KT2440
augcaguucuaccagcag

SEQ ID NO: 3565282 - RNA, 17 nt, Pseudomonas putida KT2440
augcaguugagcccucg

SEQ ID NO: 3565283 - RNA, 15 nt, Pseudomonas putida KT2440
augcaguugucugcu

SEQ ID NO: 3565284 - RNA, 13 nt, Pseudomonas putida KT2440
augccaccgccac

SEQ ID NO: 3565285 - RNA, 16 nt, Pseudomonas putida KT2440
augccacgcugaacac

SEQ ID NO: 3565286 - RNA, 19 nt, Pseudomonas putida KT2440
augccacguacagagauac

SEQ ID NO: 3565287 - RNA, 20 nt, Pseudomonas putida KT2440
augccagcaaaugcccacug

SEQ ID NO: 3565288 - RNA, 20 nt, Pseudomonas putida KT2440
augccagcuaucucccagcc

SEQ ID NO: 3565289 - RNA, 16 nt, Pseudomonas putida KT2440
augccaguagaagccc

SEQ ID NO: 3565290 - RNA, 15 nt, Pseudomonas putida KT2440
augccaguugaucac

SEQ ID NO: 3565291 - RNA, 20 nt, Pseudomonas putida KT2440
augccauccucggccaggcc

SEQ ID NO: 3565292 - RNA, 18 nt, Pseudomonas putida KT2440
augcccaaagcccgugcc

SEQ ID NO: 3565293 - RNA, 23 nt, Pseudomonas putida KT2440
augcccaccgcauugcaggccag

SEQ ID NO: 3565294 - RNA, 17 nt, Pseudomonas putida KT2440
augcccaccgcugcaau

SEQ ID NO: 3565295 - RNA, 14 nt, Pseudomonas putida KT2440
augcccagcgccac

SEQ ID NO: 3565296 - RNA, 20 nt, Pseudomonas putida KT2440
augcccagcgccaccggcag

SEQ ID NO: 3565297 - RNA, 13 nt, Pseudomonas putida KT2440
augcccaggcccg

SEQ ID NO: 3565298 - RNA, 13 nt, Pseudomonas putida KT2440
augcccagguauc

SEQ ID NO: 3565299 - RNA, 17 nt, Pseudomonas putida KT2440
augcccagguaucgcac

SEQ ID NO: 3565300 - RNA, 23 nt, Pseudomonas putida KT2440
augcccaguucgcgugccaccuc

SEQ ID NO: 3565301 - RNA, 14 nt, Pseudomonas putida KT2440
augcccauggccag

SEQ ID NO: 3565302 - RNA, 17 nt, Pseudomonas putida KT2440
augcccauggccaggcu

SEQ ID NO: 3565303 - RNA, 20 nt, Pseudomonas putida KT2440
augcccauggcgcagcucca

SEQ ID NO: 3565304 - RNA, 15 nt, Pseudomonas putida KT2440
augcccauuccugaa

SEQ ID NO: 3565305 - RNA, 19 nt, Pseudomonas putida KT2440
augccccucaaugcugccu

SEQ ID NO: 3565306 - RNA, 20 nt, Pseudomonas putida KT2440
augccccucgaacagcgccg

SEQ ID NO: 3565307 - RNA, 17 nt, Pseudomonas putida KT2440
augcccgcaggugcggc

SEQ ID NO: 3565308 - RNA, 18 nt, Pseudomonas putida KT2440
augcccgcgucugccgca

SEQ ID NO: 3565309 - RNA, 13 nt, Pseudomonas putida KT2440
augcccgcuccca

SEQ ID NO: 3565310 - RNA, 17 nt, Pseudomonas putida KT2440
augcccgcucccacagg

SEQ ID NO: 3565311 - RNA, 19 nt, Pseudomonas putida KT2440
augcccgcucccacaggga

SEQ ID NO: 3565312 - RNA, 17 nt, Pseudomonas putida KT2440
augcccgcucucacagg

SEQ ID NO: 3565313 - RNA, 20 nt, Pseudomonas putida KT2440
augcccggcucaccgcagcc

SEQ ID NO: 3565314 - RNA, 18 nt, Pseudomonas putida KT2440
augcccgggccuucaacc

SEQ ID NO: 3565315 - RNA, 13 nt, Pseudomonas putida KT2440
augcccuccagcc

SEQ ID NO: 3565316 - RNA, 21 nt, Pseudomonas putida KT2440
augccgaacgauucugccagc

SEQ ID NO: 3565317 - RNA, 16 nt, Pseudomonas putida KT2440
augccgaaggccuuca

SEQ ID NO: 3565318 - RNA, 19 nt, Pseudomonas putida KT2440
augccgacagccaccgcga

SEQ ID NO: 3565319 - RNA, 19 nt, Pseudomonas putida KT2440
augccgaugucggcgugca

SEQ ID NO: 3565320 - RNA, 20 nt, Pseudomonas putida KT2440
augccgcccaucaccggcac

SEQ ID NO: 3565321 - RNA, 22 nt, Pseudomonas putida KT2440
augccgcccaugccacccaugc

SEQ ID NO: 3565322 - RNA, 15 nt, Pseudomonas putida KT2440
augccgccuugcaga

SEQ ID NO: 3565323 - RNA, 12 nt, Pseudomonas putida KT2440
augccgcgcacu

SEQ ID NO: 3565324 - RNA, 17 nt, Pseudomonas putida KT2440
augccgcgcgcccgcug

SEQ ID NO: 3565325 - RNA, 19 nt, Pseudomonas putida KT2440
augccgcguuccuuucuca

SEQ ID NO: 3565326 - RNA, 17 nt, Pseudomonas putida KT2440
augccggaguggucgaa

SEQ ID NO: 3565327 - RNA, 19 nt, Pseudomonas putida KT2440
augccggcacagcccagcu

SEQ ID NO: 3565328 - RNA, 12 nt, Pseudomonas putida KT2440
augccggccacc

SEQ ID NO: 3565329 - RNA, 16 nt, Pseudomonas putida KT2440
augccggccaccacac

SEQ ID NO: 3565330 - RNA, 14 nt, Pseudomonas putida KT2440
augccgggaaggug

SEQ ID NO: 3565331 - RNA, 15 nt, Pseudomonas putida KT2440
augccggucagcagc

SEQ ID NO: 3565332 - RNA, 16 nt, Pseudomonas putida KT2440
augccggucagcagca

SEQ ID NO: 3565333 - RNA, 16 nt, Pseudomonas putida KT2440
augccgguguccuggc

SEQ ID NO: 3565334 - RNA, 14 nt, Pseudomonas putida KT2440
augccguaguagcc

SEQ ID NO: 3565335 - RNA, 15 nt, Pseudomonas putida KT2440
augccguaguagccu

SEQ ID NO: 3565336 - RNA, 20 nt, Pseudomonas putida KT2440
augccuacugcuggcgcgac

SEQ ID NO: 3565337 - RNA, 15 nt, Pseudomonas putida KT2440
augccucggcaaagc

SEQ ID NO: 3565338 - RNA, 13 nt, Pseudomonas putida KT2440
augccugcacugg

SEQ ID NO: 3565339 - RNA, 18 nt, Pseudomonas putida KT2440
augccuggaaaauccgcu

SEQ ID NO: 3565340 - RNA, 14 nt, Pseudomonas putida KT2440
augccugugucgaa

SEQ ID NO: 3565341 - RNA, 21 nt, Pseudomonas putida KT2440
augccuuccaggcgacggaac

SEQ ID NO: 3565342 - RNA, 12 nt, Pseudomonas putida KT2440
augccuucggug

SEQ ID NO: 3565343 - RNA, 17 nt, Pseudomonas putida KT2440
augccuucuucgaugua

SEQ ID NO: 3565344 - RNA, 13 nt, Pseudomonas putida KT2440
augcgaacugcag

SEQ ID NO: 3565345 - RNA, 17 nt, Pseudomonas putida KT2440
augcgaagcaagcgcau

SEQ ID NO: 3565346 - RNA, 13 nt, Pseudomonas putida KT2440
augcgacugagca

SEQ ID NO: 3565347 - RNA, 16 nt, Pseudomonas putida KT2440
augcgcacaccgcugg

SEQ ID NO: 3565348 - RNA, 15 nt, Pseudomonas putida KT2440
augcgcaggcagcga

SEQ ID NO: 3565349 - RNA, 17 nt, Pseudomonas putida KT2440
augcgccacacccgcua

SEQ ID NO: 3565350 - RNA, 23 nt, Pseudomonas putida KT2440
augcgccagggcugauugagcag

SEQ ID NO: 3565351 - RNA, 15 nt, Pseudomonas putida KT2440
augcgcccaucucag

SEQ ID NO: 3565352 - RNA, 16 nt, Pseudomonas putida KT2440
augcgccccacuucca

SEQ ID NO: 3565353 - RNA, 19 nt, Pseudomonas putida KT2440
augcgccccacuuccagcg

SEQ ID NO: 3565354 - RNA, 18 nt, Pseudomonas putida KT2440
augcgccccguccacagc

SEQ ID NO: 3565355 - RNA, 22 nt, Pseudomonas putida KT2440
augcgcccggccaggucacggu

SEQ ID NO: 3565356 - RNA, 21 nt, Pseudomonas putida KT2440
augcgcccuggcggccacggc

SEQ ID NO: 3565357 - RNA, 18 nt, Pseudomonas putida KT2440
augcgccgcaccaaagaa

SEQ ID NO: 3565358 - RNA, 18 nt, Pseudomonas putida KT2440
augcgccgggacagcacc

SEQ ID NO: 3565359 - RNA, 20 nt, Pseudomonas putida KT2440
augcgccgucgccucccccu

SEQ ID NO: 3565360 - RNA, 16 nt, Pseudomonas putida KT2440
augcgccuggcccgca

SEQ ID NO: 3565361 - RNA, 16 nt, Pseudomonas putida KT2440
augcgcgacagcauca

SEQ ID NO: 3565362 - RNA, 17 nt, Pseudomonas putida KT2440
augcgcgaggucugcgc

SEQ ID NO: 3565363 - RNA, 15 nt, Pseudomonas putida KT2440
augcgcgcagcgaac

SEQ ID NO: 3565364 - RNA, 16 nt, Pseudomonas putida KT2440
augcgcgcagcgaacg

SEQ ID NO: 3565365 - RNA, 19 nt, Pseudomonas putida KT2440
augcgcggcucgcugcgcu

SEQ ID NO: 3565366 - RNA, 22 nt, Pseudomonas putida KT2440
augcgcggcucgcugcgcuggc

SEQ ID NO: 3565367 - RNA, 19 nt, Pseudomonas putida KT2440
augcgcucguagagcuugg

SEQ ID NO: 3565368 - RNA, 17 nt, Pseudomonas putida KT2440
augcgcuucauccagcg

SEQ ID NO: 3565369 - RNA, 22 nt, Pseudomonas putida KT2440
augcgcuucauccagcgggaug

SEQ ID NO: 3565370 - RNA, 16 nt, Pseudomonas putida KT2440
augcgcuugaggcuuu

SEQ ID NO: 3565371 - RNA, 17 nt, Pseudomonas putida KT2440
augcgcuugccagcgug

SEQ ID NO: 3565372 - RNA, 13 nt, Pseudomonas putida KT2440
augcggacccagc

SEQ ID NO: 3565373 - RNA, 18 nt, Pseudomonas putida KT2440
augcggacccagcgguca

SEQ ID NO: 3565374 - RNA, 20 nt, Pseudomonas putida KT2440
augcggauauaaccccauac

SEQ ID NO: 3565375 - RNA, 13 nt, Pseudomonas putida KT2440
augcggccacagc

SEQ ID NO: 3565376 - RNA, 21 nt, Pseudomonas putida KT2440
augcggcuacccagccgggca

SEQ ID NO: 3565377 - RNA, 21 nt, Pseudomonas putida KT2440
augcgggggccccaccaggca

SEQ ID NO: 3565378 - RNA, 17 nt, Pseudomonas putida KT2440
augcgguagugcaggcg

SEQ ID NO: 3565379 - RNA, 16 nt, Pseudomonas putida KT2440
augcggucuuccagcg

SEQ ID NO: 3565380 - RNA, 18 nt, Pseudomonas putida KT2440
augcggugguugucgcac

SEQ ID NO: 3565381 - RNA, 15 nt, Pseudomonas putida KT2440
augcgugaaacgcag

SEQ ID NO: 3565382 - RNA, 23 nt, Pseudomonas putida KT2440
augcgugcauguccugaagcagg

SEQ ID NO: 3565383 - RNA, 13 nt, Pseudomonas putida KT2440
augcguucggcau

SEQ ID NO: 3565384 - RNA, 24 nt, Pseudomonas putida KT2440
augcguucggcaucugccgggucg

SEQ ID NO: 3565385 - RNA, 18 nt, Pseudomonas putida KT2440
augcucaagcgccagggc

SEQ ID NO: 3565386 - RNA, 19 nt, Pseudomonas putida KT2440
augcucaagcgccagggca

SEQ ID NO: 3565387 - RNA, 13 nt, Pseudomonas putida KT2440
augcucaggaaca

SEQ ID NO: 3565388 - RNA, 14 nt, Pseudomonas putida KT2440
augcucaggaacau

SEQ ID NO: 3565389 - RNA, 19 nt, Pseudomonas putida KT2440
augcuccaaccccagcgca

SEQ ID NO: 3565390 - RNA, 19 nt, Pseudomonas putida KT2440
augcuccggcgacagcuca

SEQ ID NO: 3565391 - RNA, 15 nt, Pseudomonas putida KT2440
augcuccugcgccac

SEQ ID NO: 3565392 - RNA, 22 nt, Pseudomonas putida KT2440
augcuccugcgccaccucggcg

SEQ ID NO: 3565393 - RNA, 19 nt, Pseudomonas putida KT2440
augcucgauaccguacugg

SEQ ID NO: 3565394 - RNA, 12 nt, Pseudomonas putida KT2440
augcucggccag

SEQ ID NO: 3565395 - RNA, 13 nt, Pseudomonas putida KT2440
augcucggccagc

SEQ ID NO: 3565396 - RNA, 15 nt, Pseudomonas putida KT2440
augcucggccagcuc

SEQ ID NO: 3565397 - RNA, 13 nt, Pseudomonas putida KT2440
augcucgucacca

SEQ ID NO: 3565398 - RNA, 22 nt, Pseudomonas putida KT2440
augcucugcgcaaaggcuuugg

SEQ ID NO: 3565399 - RNA, 19 nt, Pseudomonas putida KT2440
augcugaagcucuccagca

SEQ ID NO: 3565400 - RNA, 19 nt, Pseudomonas putida KT2440
augcugaugcgguagugca

SEQ ID NO: 3565401 - RNA, 23 nt, Pseudomonas putida KT2440
augcugcagaaccgccagcacca

SEQ ID NO: 3565402 - RNA, 20 nt, Pseudomonas putida KT2440
augcugcagauugcaucacu

SEQ ID NO: 3565403 - RNA, 13 nt, Pseudomonas putida KT2440
augcugccaggca

SEQ ID NO: 3565404 - RNA, 15 nt, Pseudomonas putida KT2440
augcugccaggcaaa

SEQ ID NO: 3565405 - RNA, 19 nt, Pseudomonas putida KT2440
augcugccaugcaaggcaa

SEQ ID NO: 3565406 - RNA, 16 nt, Pseudomonas putida KT2440
augcugcugcagugcc

SEQ ID NO: 3565407 - RNA, 13 nt, Pseudomonas putida KT2440
augcuggccagga

SEQ ID NO: 3565408 - RNA, 15 nt, Pseudomonas putida KT2440
augcuggccaucccg

SEQ ID NO: 3565409 - RNA, 15 nt, Pseudomonas putida KT2440
augcuggucgaacaa

SEQ ID NO: 3565410 - RNA, 23 nt, Pseudomonas putida KT2440
augcuggucgccgugcagcaccg

SEQ ID NO: 3565411 - RNA, 18 nt, Pseudomonas putida KT2440
augcugguguguugaagu

SEQ ID NO: 3565412 - RNA, 13 nt, Pseudomonas putida KT2440
augcugugcccug

SEQ ID NO: 3565413 - RNA, 15 nt, Pseudomonas putida KT2440
augcuguugugcgau

SEQ ID NO: 3565414 - RNA, 14 nt, Pseudomonas putida KT2440
augcuuucaguuga

SEQ ID NO: 3565415 - RNA, 19 nt, Pseudomonas putida KT2440
auggaaauggaauuuggug

SEQ ID NO: 3565416 - RNA, 17 nt, Pseudomonas putida KT2440
auggaaggcaaagauuu

SEQ ID NO: 3565417 - RNA, 17 nt, Pseudomonas putida KT2440
auggacgccacguccuu

SEQ ID NO: 3565418 - RNA, 13 nt, Pseudomonas putida KT2440
auggauagcaaag

SEQ ID NO: 3565419 - RNA, 17 nt, Pseudomonas putida KT2440
auggauggcaccggcuu

SEQ ID NO: 3565420 - RNA, 14 nt, Pseudomonas putida KT2440
auggcaaacagcac

SEQ ID NO: 3565421 - RNA, 15 nt, Pseudomonas putida KT2440
auggcaaacagcacc

SEQ ID NO: 3565422 - RNA, 17 nt, Pseudomonas putida KT2440
auggcaaacagcaccag

SEQ ID NO: 3565423 - RNA, 21 nt, Pseudomonas putida KT2440
auggcaaacagcaccagcccg

SEQ ID NO: 3565424 - RNA, 21 nt, Pseudomonas putida KT2440
auggcaaucacgaacagccag

SEQ ID NO: 3565425 - RNA, 22 nt, Pseudomonas putida KT2440
auggcaaucagcgacaacggcu

SEQ ID NO: 3565426 - RNA, 23 nt, Pseudomonas putida KT2440
auggcaaucccccgcucaugguu

SEQ ID NO: 3565427 - RNA, 18 nt, Pseudomonas putida KT2440
auggcaaucgccuggcgc

SEQ ID NO: 3565428 - RNA, 17 nt, Pseudomonas putida KT2440
auggcaccgaucaccug

SEQ ID NO: 3565429 - RNA, 23 nt, Pseudomonas putida KT2440
auggcagacaaguccuucaucug

SEQ ID NO: 3565430 - RNA, 16 nt, Pseudomonas putida KT2440
auggcaguguggcaag

SEQ ID NO: 3565431 - RNA, 20 nt, Pseudomonas putida KT2440
auggccacacgcugcugcug

SEQ ID NO: 3565432 - RNA, 13 nt, Pseudomonas putida KT2440
auggccaccagca

SEQ ID NO: 3565433 - RNA, 15 nt, Pseudomonas putida KT2440
auggccaccagcacc

SEQ ID NO: 3565434 - RNA, 22 nt, Pseudomonas putida KT2440
auggccacggugucggacaggu

SEQ ID NO: 3565435 - RNA, 15 nt, Pseudomonas putida KT2440
auggccagagcgcgc

SEQ ID NO: 3565436 - RNA, 17 nt, Pseudomonas putida KT2440
auggccagccggcagca

SEQ ID NO: 3565437 - RNA, 16 nt, Pseudomonas putida KT2440
auggccccgcccaggu

SEQ ID NO: 3565438 - RNA, 19 nt, Pseudomonas putida KT2440
auggccccgcccagguuac

SEQ ID NO: 3565439 - RNA, 18 nt, Pseudomonas putida KT2440
auggccgaaaccagcccc

SEQ ID NO: 3565440 - RNA, 15 nt, Pseudomonas putida KT2440
auggccgagcaggag

SEQ ID NO: 3565441 - RNA, 15 nt, Pseudomonas putida KT2440
auggccgcaggccca

SEQ ID NO: 3565442 - RNA, 17 nt, Pseudomonas putida KT2440
auggccggcugugcaga

SEQ ID NO: 3565443 - RNA, 12 nt, Pseudomonas putida KT2440
auggccgugcaa

SEQ ID NO: 3565444 - RNA, 18 nt, Pseudomonas putida KT2440
auggccucgucgcggucc

SEQ ID NO: 3565445 - RNA, 15 nt, Pseudomonas putida KT2440
auggccuuucugcuu

SEQ ID NO: 3565446 - RNA, 22 nt, Pseudomonas putida KT2440
auggccuuucugcuuccacucg

SEQ ID NO: 3565447 - RNA, 20 nt, Pseudomonas putida KT2440
auggcgaagaccgccgccca

SEQ ID NO: 3565448 - RNA, 17 nt, Pseudomonas putida KT2440
auggcgaaucagcaugc

SEQ ID NO: 3565449 - RNA, 22 nt, Pseudomonas putida KT2440
auggcgaaucagcaugcccagc

SEQ ID NO: 3565450 - RNA, 23 nt, Pseudomonas putida KT2440
auggcgaaucagcaugcccagcg

SEQ ID NO: 3565451 - RNA, 13 nt, Pseudomonas putida KT2440
auggcgcaaaccc

SEQ ID NO: 3565452 - RNA, 22 nt, Pseudomonas putida KT2440
auggcgcaaacccucggccaca

SEQ ID NO: 3565453 - RNA, 13 nt, Pseudomonas putida KT2440
auggcggcaccga

SEQ ID NO: 3565454 - RNA, 19 nt, Pseudomonas putida KT2440
auggcguauccacauacug

SEQ ID NO: 3565455 - RNA, 21 nt, Pseudomonas putida KT2440
auggcguauccacauacugcu

SEQ ID NO: 3565456 - RNA, 22 nt, Pseudomonas putida KT2440
auggcgucugcguaagguagua

SEQ ID NO: 3565457 - RNA, 19 nt, Pseudomonas putida KT2440
auggcgucuucgccaggug

SEQ ID NO: 3565458 - RNA, 16 nt, Pseudomonas putida KT2440
auggcgugcccggcaa

SEQ ID NO: 3565459 - RNA, 17 nt, Pseudomonas putida KT2440
auggcguuguccagcag

SEQ ID NO: 3565460 - RNA, 21 nt, Pseudomonas putida KT2440
auggcuaagccaagccggcuu

SEQ ID NO: 3565461 - RNA, 23 nt, Pseudomonas putida KT2440
auggcuagggucguccuggguaa

SEQ ID NO: 3565462 - RNA, 17 nt, Pseudomonas putida KT2440
auggcucaacuggcagg

SEQ ID NO: 3565463 - RNA, 18 nt, Pseudomonas putida KT2440
auggcucacacccaggcu

SEQ ID NO: 3565464 - RNA, 19 nt, Pseudomonas putida KT2440
auggcucacacccaggcuc

SEQ ID NO: 3565465 - RNA, 18 nt, Pseudomonas putida KT2440
auggcucagugucagcgg

SEQ ID NO: 3565466 - RNA, 19 nt, Pseudomonas putida KT2440
auggcuccaccacagcugc

SEQ ID NO: 3565467 - RNA, 18 nt, Pseudomonas putida KT2440
auggcugcggcagguagg

SEQ ID NO: 3565468 - RNA, 22 nt, Pseudomonas putida KT2440
auggcuggcagcacgaucagcg

SEQ ID NO: 3565469 - RNA, 19 nt, Pseudomonas putida KT2440
auggcuggugaagcccuuc

SEQ ID NO: 3565470 - RNA, 22 nt, Pseudomonas putida KT2440
augggaccgcuguuaccagaga

SEQ ID NO: 3565471 - RNA, 22 nt, Pseudomonas putida KT2440
augggcaccggccaccaggcgc

SEQ ID NO: 3565472 - RNA, 15 nt, Pseudomonas putida KT2440
augggcacuggccac

SEQ ID NO: 3565473 - RNA, 12 nt, Pseudomonas putida KT2440
augggcaggcca

SEQ ID NO: 3565474 - RNA, 22 nt, Pseudomonas putida KT2440
augggcaggccauucaccuguu

SEQ ID NO: 3565475 - RNA, 16 nt, Pseudomonas putida KT2440
augggcaggcccaggu

SEQ ID NO: 3565476 - RNA, 17 nt, Pseudomonas putida KT2440
augggccacuucgccgu

SEQ ID NO: 3565477 - RNA, 11 nt, Pseudomonas putida KT2440
augggccaggg

SEQ ID NO: 3565478 - RNA, 16 nt, Pseudomonas putida KT2440
augggccaugcccacc

SEQ ID NO: 3565479 - RNA, 15 nt, Pseudomonas putida KT2440
augggccgcagagcg

SEQ ID NO: 3565480 - RNA, 21 nt, Pseudomonas putida KT2440
augggcgucgccugcaugucu

SEQ ID NO: 3565481 - RNA, 14 nt, Pseudomonas putida KT2440
augggcugcaaagc

SEQ ID NO: 3565482 - RNA, 15 nt, Pseudomonas putida KT2440
augggcugcaaagca

SEQ ID NO: 3565483 - RNA, 21 nt, Pseudomonas putida KT2440
augggcuuccccagccuucaa

SEQ ID NO: 3565484 - RNA, 14 nt, Pseudomonas putida KT2440
augggcuucgagca

SEQ ID NO: 3565485 - RNA, 23 nt, Pseudomonas putida KT2440
augggcuuuucguuggccagcuu

SEQ ID NO: 3565486 - RNA, 17 nt, Pseudomonas putida KT2440
augggucacucccggga

SEQ ID NO: 3565487 - RNA, 17 nt, Pseudomonas putida KT2440
augggugagcacggcuu

SEQ ID NO: 3565488 - RNA, 17 nt, Pseudomonas putida KT2440
auggucacgccaucccc

SEQ ID NO: 3565489 - RNA, 18 nt, Pseudomonas putida KT2440
auggucacguagaacagg

SEQ ID NO: 3565490 - RNA, 22 nt, Pseudomonas putida KT2440
auggucacguagaacaggccug

SEQ ID NO: 3565491 - RNA, 19 nt, Pseudomonas putida KT2440
auggucagccggcagucac

SEQ ID NO: 3565492 - RNA, 14 nt, Pseudomonas putida KT2440
augguccggcauca

SEQ ID NO: 3565493 - RNA, 18 nt, Pseudomonas putida KT2440
auggucgcguuguucagc

SEQ ID NO: 3565494 - RNA, 21 nt, Pseudomonas putida KT2440
auggucggggugaggggauuc

SEQ ID NO: 3565495 - RNA, 19 nt, Pseudomonas putida KT2440
auggugaaggccaggaaca

SEQ ID NO: 3565496 - RNA, 15 nt, Pseudomonas putida KT2440
auggugacugccagc

SEQ ID NO: 3565497 - RNA, 19 nt, Pseudomonas putida KT2440
auggugaugccccugcgcc

SEQ ID NO: 3565498 - RNA, 17 nt, Pseudomonas putida KT2440
auggugcacgccagcca

SEQ ID NO: 3565499 - RNA, 20 nt, Pseudomonas putida KT2440
augguguagucggugguguc

SEQ ID NO: 3565500 - RNA, 15 nt, Pseudomonas putida KT2440
augguguccggcaug

SEQ ID NO: 3565501 - RNA, 17 nt, Pseudomonas putida KT2440
augguguucaugcccac

SEQ ID NO: 3565502 - RNA, 23 nt, Pseudomonas putida KT2440
augguguucaugcccaccgcugc

SEQ ID NO: 3565503 - RNA, 14 nt, Pseudomonas putida KT2440
augguuauuugauc

SEQ ID NO: 3565504 - RNA, 12 nt, Pseudomonas putida KT2440
augguugaagau

SEQ ID NO: 3565505 - RNA, 15 nt, Pseudomonas putida KT2440
augguugacagcgcu

SEQ ID NO: 3565506 - RNA, 16 nt, Pseudomonas putida KT2440
augguugacagcgcuu

SEQ ID NO: 3565507 - RNA, 16 nt, Pseudomonas putida KT2440
augguugucgaacagc

SEQ ID NO: 3565508 - RNA, 18 nt, Pseudomonas putida KT2440
augguuuaaaccgcgaag

SEQ ID NO: 3565509 - RNA, 19 nt, Pseudomonas putida KT2440
augguuuaaaccgcgaagc

SEQ ID NO: 3565510 - RNA, 19 nt, Pseudomonas putida KT2440
auguaaugaaaaucgccuu

SEQ ID NO: 3565511 - RNA, 14 nt, Pseudomonas putida KT2440
auguacaaugcacu

SEQ ID NO: 3565512 - RNA, 13 nt, Pseudomonas putida KT2440
auguacaccccga

SEQ ID NO: 3565513 - RNA, 17 nt, Pseudomonas putida KT2440
auguacagaaugcgcuc

SEQ ID NO: 3565514 - RNA, 20 nt, Pseudomonas putida KT2440
auguaccgggcggccaccgg

SEQ ID NO: 3565515 - RNA, 17 nt, Pseudomonas putida KT2440
auguagaccaccagcgu

SEQ ID NO: 3565516 - RNA, 15 nt, Pseudomonas putida KT2440
auguagcgccuggcc

SEQ ID NO: 3565517 - RNA, 15 nt, Pseudomonas putida KT2440
auguaggagcggguu

SEQ ID NO: 3565518 - RNA, 18 nt, Pseudomonas putida KT2440
auguaucagcgccuccag

SEQ ID NO: 3565519 - RNA, 23 nt, Pseudomonas putida KT2440
auguaucggauuggcgcggcugg

SEQ ID NO: 3565520 - RNA, 16 nt, Pseudomonas putida KT2440
augucaucugaggccc

SEQ ID NO: 3565521 - RNA, 21 nt, Pseudomonas putida KT2440
auguccaaauugggcugggcg

SEQ ID NO: 3565522 - RNA, 14 nt, Pseudomonas putida KT2440
auguccagauccuc

SEQ ID NO: 3565523 - RNA, 12 nt, Pseudomonas putida KT2440
auguccagcccg

SEQ ID NO: 3565524 - RNA, 17 nt, Pseudomonas putida KT2440
auguccagcgaggguuc

SEQ ID NO: 3565525 - RNA, 14 nt, Pseudomonas putida KT2440
auguccaggucacc

SEQ ID NO: 3565526 - RNA, 19 nt, Pseudomonas putida KT2440
auguccauugagcacucaa

SEQ ID NO: 3565527 - RNA, 19 nt, Pseudomonas putida KT2440
auguccgcgccagcggcca

SEQ ID NO: 3565528 - RNA, 18 nt, Pseudomonas putida KT2440
auguccggggucaucagg

SEQ ID NO: 3565529 - RNA, 12 nt, Pseudomonas putida KT2440
auguccucggcg

SEQ ID NO: 3565530 - RNA, 16 nt, Pseudomonas putida KT2440
auguccuugcuggcca

SEQ ID NO: 3565531 - RNA, 20 nt, Pseudomonas putida KT2440
augucgaaccacaucggcgc

SEQ ID NO: 3565532 - RNA, 21 nt, Pseudomonas putida KT2440
augucgaaccacaucggcgcg

SEQ ID NO: 3565533 - RNA, 19 nt, Pseudomonas putida KT2440
augucgaauacaccgccgc

SEQ ID NO: 3565534 - RNA, 20 nt, Pseudomonas putida KT2440
augucgagcaugaucaccgc

SEQ ID NO: 3565535 - RNA, 22 nt, Pseudomonas putida KT2440
augucgcugccgccaaccagcu

SEQ ID NO: 3565536 - RNA, 20 nt, Pseudomonas putida KT2440
augucggcagucuugcugau

SEQ ID NO: 3565537 - RNA, 18 nt, Pseudomonas putida KT2440
augucggcguggaugauc

SEQ ID NO: 3565538 - RNA, 22 nt, Pseudomonas putida KT2440
augucguaguaacggcggaugu

SEQ ID NO: 3565539 - RNA, 22 nt, Pseudomonas putida KT2440
augucgugcugccggucggccu

SEQ ID NO: 3565540 - RNA, 21 nt, Pseudomonas putida KT2440
augucuuccagaccagacagc

SEQ ID NO: 3565541 - RNA, 13 nt, Pseudomonas putida KT2440
augugcacacgca

SEQ ID NO: 3565542 - RNA, 16 nt, Pseudomonas putida KT2440
augugcacuggcaggc

SEQ ID NO: 3565543 - RNA, 16 nt, Pseudomonas putida KT2440
augugccggcuggaca

SEQ ID NO: 3565544 - RNA, 19 nt, Pseudomonas putida KT2440
augugcgagcccuugucca

SEQ ID NO: 3565545 - RNA, 22 nt, Pseudomonas putida KT2440
augugcgagcccuuguccaggu

SEQ ID NO: 3565546 - RNA, 15 nt, Pseudomonas putida KT2440
augugcgugaacacu

SEQ ID NO: 3565547 - RNA, 20 nt, Pseudomonas putida KT2440
augugcucggccugggcagg

SEQ ID NO: 3565548 - RNA, 17 nt, Pseudomonas putida KT2440
auguggcgcagcaccgu

SEQ ID NO: 3565549 - RNA, 18 nt, Pseudomonas putida KT2440
auguggggcgugcucggc

SEQ ID NO: 3565550 - RNA, 22 nt, Pseudomonas putida KT2440
auguguccgccacaacccuugc

SEQ ID NO: 3565551 - RNA, 16 nt, Pseudomonas putida KT2440
auguguuggccggacg

SEQ ID NO: 3565552 - RNA, 14 nt, Pseudomonas putida KT2440
auguucaacagccg

SEQ ID NO: 3565553 - RNA, 14 nt, Pseudomonas putida KT2440
auguucaucaccgg

SEQ ID NO: 3565554 - RNA, 21 nt, Pseudomonas putida KT2440
auguucaucaccggccagcac

SEQ ID NO: 3565555 - RNA, 21 nt, Pseudomonas putida KT2440
auguucggugcucaggcucag

SEQ ID NO: 3565556 - RNA, 13 nt, Pseudomonas putida KT2440
auguucuugaccu

SEQ ID NO: 3565557 - RNA, 12 nt, Pseudomonas putida KT2440
auguugaucagg

SEQ ID NO: 3565558 - RNA, 18 nt, Pseudomonas putida KT2440
auguugaugccacgggca

SEQ ID NO: 3565559 - RNA, 19 nt, Pseudomonas putida KT2440
auguugcaaggaucauuug

SEQ ID NO: 3565560 - RNA, 19 nt, Pseudomonas putida KT2440
auguuggccgagucggugg

SEQ ID NO: 3565561 - RNA, 15 nt, Pseudomonas putida KT2440
auguuggucaccacg

SEQ ID NO: 3565562 - RNA, 23 nt, Pseudomonas putida KT2440
auguugugggcaaugauggcaau

SEQ ID NO: 3565563 - RNA, 17 nt, Pseudomonas putida KT2440
auguuuggguugacggu

SEQ ID NO: 3565564 - RNA, 22 nt, Pseudomonas putida KT2440
auuacaaacggcuuggcugccg

SEQ ID NO: 3565565 - RNA, 16 nt, Pseudomonas putida KT2440
auuacaggcagaucga

SEQ ID NO: 3565566 - RNA, 19 nt, Pseudomonas putida KT2440
auuaccauccaucaccaug

SEQ ID NO: 3565567 - RNA, 16 nt, Pseudomonas putida KT2440
auuacccuucaucgcc

SEQ ID NO: 3565568 - RNA, 18 nt, Pseudomonas putida KT2440
auuacccuucaucgccgg

SEQ ID NO: 3565569 - RNA, 16 nt, Pseudomonas putida KT2440
auuacgcaggcuccaa

SEQ ID NO: 3565570 - RNA, 23 nt, Pseudomonas putida KT2440
auuacgcggcagcagcagcccca

SEQ ID NO: 3565571 - RNA, 12 nt, Pseudomonas putida KT2440
auuacuccagaa

SEQ ID NO: 3565572 - RNA, 14 nt, Pseudomonas putida KT2440
auuagcagguaaac

SEQ ID NO: 3565573 - RNA, 16 nt, Pseudomonas putida KT2440
auuauccaccaggccg

SEQ ID NO: 3565574 - RNA, 20 nt, Pseudomonas putida KT2440
auuaucgagcuacagccccu

SEQ ID NO: 3565575 - RNA, 20 nt, Pseudomonas putida KT2440
auuaucugugggagcggccu

SEQ ID NO: 3565576 - RNA, 21 nt, Pseudomonas putida KT2440
auucaaagccugcuccagcac

SEQ ID NO: 3565577 - RNA, 15 nt, Pseudomonas putida KT2440
auucaccagccaggc

SEQ ID NO: 3565578 - RNA, 15 nt, Pseudomonas putida KT2440
auucaccagcuucag

SEQ ID NO: 3565579 - RNA, 17 nt, Pseudomonas putida KT2440
auucacggaucagccgc

SEQ ID NO: 3565580 - RNA, 17 nt, Pseudomonas putida KT2440
auucagaaguccacgcu

SEQ ID NO: 3565581 - RNA, 15 nt, Pseudomonas putida KT2440
auucaggcacggcac

SEQ ID NO: 3565582 - RNA, 21 nt, Pseudomonas putida KT2440
auucaggcuuugcugcagguc

SEQ ID NO: 3565583 - RNA, 17 nt, Pseudomonas putida KT2440
auucagugcgcagguac

SEQ ID NO: 3565584 - RNA, 18 nt, Pseudomonas putida KT2440
auuccaaugagaauaauu

SEQ ID NO: 3565585 - RNA, 24 nt, Pseudomonas putida KT2440
auuccagaaucugcacacugcgcu

SEQ ID NO: 3565586 - RNA, 23 nt, Pseudomonas putida KT2440
auuccaggcuagccggucaccga

SEQ ID NO: 3565587 - RNA, 21 nt, Pseudomonas putida KT2440
auuccauucggugcagcggca

SEQ ID NO: 3565588 - RNA, 22 nt, Pseudomonas putida KT2440
auuccauucggugcagcggcag

SEQ ID NO: 3565589 - RNA, 23 nt, Pseudomonas putida KT2440
auuccgcacgucagacuuuccug

SEQ ID NO: 3565590 - RNA, 17 nt, Pseudomonas putida KT2440
auuccggcugcagcuug

SEQ ID NO: 3565591 - RNA, 15 nt, Pseudomonas putida KT2440
auuccgggcugcugc

SEQ ID NO: 3565592 - RNA, 13 nt, Pseudomonas putida KT2440
auuccguaccagu

SEQ ID NO: 3565593 - RNA, 13 nt, Pseudomonas putida KT2440
auuccuugcagcg

SEQ ID NO: 3565594 - RNA, 12 nt, Pseudomonas putida KT2440
auucgaccagca

SEQ ID NO: 3565595 - RNA, 21 nt, Pseudomonas putida KT2440
auucgagaaugugcuucuggc

SEQ ID NO: 3565596 - RNA, 15 nt, Pseudomonas putida KT2440
auucgaggaucagcg

SEQ ID NO: 3565597 - RNA, 23 nt, Pseudomonas putida KT2440
auucgauagccugcaaacgccgc

SEQ ID NO: 3565598 - RNA, 24 nt, Pseudomonas putida KT2440
auucgauagccugcaaacgccgcu

SEQ ID NO: 3565599 - RNA, 18 nt, Pseudomonas putida KT2440
auucgcccgcaccgccgc

SEQ ID NO: 3565600 - RNA, 23 nt, Pseudomonas putida KT2440
auucgccgggccuugaccagcaa

SEQ ID NO: 3565601 - RNA, 18 nt, Pseudomonas putida KT2440
auucgcgcccgcagugca

SEQ ID NO: 3565602 - RNA, 20 nt, Pseudomonas putida KT2440
auucgcggguaaacccauuc

SEQ ID NO: 3565603 - RNA, 22 nt, Pseudomonas putida KT2440
auucgcggguaaacccauuccu

SEQ ID NO: 3565604 - RNA, 20 nt, Pseudomonas putida KT2440
auucgcggguaaacccgcgc

SEQ ID NO: 3565605 - RNA, 20 nt, Pseudomonas putida KT2440
auucgcgggugaacccgcuc

SEQ ID NO: 3565606 - RNA, 21 nt, Pseudomonas putida KT2440
auucgcugcgcaucacccgcc

SEQ ID NO: 3565607 - RNA, 15 nt, Pseudomonas putida KT2440
auucggccggccaga

SEQ ID NO: 3565608 - RNA, 18 nt, Pseudomonas putida KT2440
auucuccccgcugaacag

SEQ ID NO: 3565609 - RNA, 15 nt, Pseudomonas putida KT2440
auucucggcugccug

SEQ ID NO: 3565610 - RNA, 15 nt, Pseudomonas putida KT2440
auucugccagcuccu

SEQ ID NO: 3565611 - RNA, 18 nt, Pseudomonas putida KT2440
auucuucuggcuuucugg

SEQ ID NO: 3565612 - RNA, 19 nt, Pseudomonas putida KT2440
auugaccagcgacgguggc

SEQ ID NO: 3565613 - RNA, 15 nt, Pseudomonas putida KT2440
auugacccgacggcu

SEQ ID NO: 3565614 - RNA, 19 nt, Pseudomonas putida KT2440
auugacccgacggcucuug

SEQ ID NO: 3565615 - RNA, 16 nt, Pseudomonas putida KT2440
auugacggucagugaa

SEQ ID NO: 3565616 - RNA, 18 nt, Pseudomonas putida KT2440
auugagagcagaugacuc

SEQ ID NO: 3565617 - RNA, 18 nt, Pseudomonas putida KT2440
auugagguaaaggucaca

SEQ ID NO: 3565618 - RNA, 22 nt, Pseudomonas putida KT2440
auugagguugacggugugcgga

SEQ ID NO: 3565619 - RNA, 21 nt, Pseudomonas putida KT2440
auugagguuggcgcggugaug

SEQ ID NO: 3565620 - RNA, 22 nt, Pseudomonas putida KT2440
auugaguuggugagguguugaa

SEQ ID NO: 3565621 - RNA, 14 nt, Pseudomonas putida KT2440
auugauagcggcag

SEQ ID NO: 3565622 - RNA, 12 nt, Pseudomonas putida KT2440
auugaucgccgc

SEQ ID NO: 3565623 - RNA, 22 nt, Pseudomonas putida KT2440
auugaucugcuggauacccagc

SEQ ID NO: 3565624 - RNA, 13 nt, Pseudomonas putida KT2440
auugcacccgcgg

SEQ ID NO: 3565625 - RNA, 12 nt, Pseudomonas putida KT2440
auugcagcccca

SEQ ID NO: 3565626 - RNA, 15 nt, Pseudomonas putida KT2440
auugcagggcggccu

SEQ ID NO: 3565627 - RNA, 18 nt, Pseudomonas putida KT2440
auugcaguugaaugccgc

SEQ ID NO: 3565628 - RNA, 23 nt, Pseudomonas putida KT2440
auugccaacuucgugcucggcac

SEQ ID NO: 3565629 - RNA, 22 nt, Pseudomonas putida KT2440
auugccaccggcgcugcguugg

SEQ ID NO: 3565630 - RNA, 20 nt, Pseudomonas putida KT2440
auugccagggugccagacca

SEQ ID NO: 3565631 - RNA, 19 nt, Pseudomonas putida KT2440
auugcccaacucugccgga

SEQ ID NO: 3565632 - RNA, 16 nt, Pseudomonas putida KT2440
auugcccagccugccc

SEQ ID NO: 3565633 - RNA, 15 nt, Pseudomonas putida KT2440
auugcccgacaagcc

SEQ ID NO: 3565634 - RNA, 15 nt, Pseudomonas putida KT2440
auugccgcagcugcg

SEQ ID NO: 3565635 - RNA, 20 nt, Pseudomonas putida KT2440
auugccugcaaucagcucac

SEQ ID NO: 3565636 - RNA, 21 nt, Pseudomonas putida KT2440
auugccugggcgagccacucg

SEQ ID NO: 3565637 - RNA, 14 nt, Pseudomonas putida KT2440
auugcgcaccccuu

SEQ ID NO: 3565638 - RNA, 16 nt, Pseudomonas putida KT2440
auugcgccagccgcuc

SEQ ID NO: 3565639 - RNA, 22 nt, Pseudomonas putida KT2440
auugcgccagccgcucagccac

SEQ ID NO: 3565640 - RNA, 22 nt, Pseudomonas putida KT2440
auugcgccaucagaggcgaugg

SEQ ID NO: 3565641 - RNA, 14 nt, Pseudomonas putida KT2440
auugcggacucaua

SEQ ID NO: 3565642 - RNA, 17 nt, Pseudomonas putida KT2440
auugcgggcuuucuggu

SEQ ID NO: 3565643 - RNA, 18 nt, Pseudomonas putida KT2440
auugcgggcuuucugguu

SEQ ID NO: 3565644 - RNA, 17 nt, Pseudomonas putida KT2440
auugcguaccccaccgc

SEQ ID NO: 3565645 - RNA, 23 nt, Pseudomonas putida KT2440
auugcucgauuagcuccaccagc

SEQ ID NO: 3565646 - RNA, 23 nt, Pseudomonas putida KT2440
auugcugccggaccugccgcagc

SEQ ID NO: 3565647 - RNA, 21 nt, Pseudomonas putida KT2440
auugcuugacuauuucuagua

SEQ ID NO: 3565648 - RNA, 14 nt, Pseudomonas putida KT2440
auuggaaaauguua

SEQ ID NO: 3565649 - RNA, 17 nt, Pseudomonas putida KT2440
auuggagcguugcaggc

SEQ ID NO: 3565650 - RNA, 22 nt, Pseudomonas putida KT2440
auuggagcugaaacugaucagc

SEQ ID NO: 3565651 - RNA, 15 nt, Pseudomonas putida KT2440
auuggaguacgggca

SEQ ID NO: 3565652 - RNA, 17 nt, Pseudomonas putida KT2440
auuggcaaacgccuguu

SEQ ID NO: 3565653 - RNA, 20 nt, Pseudomonas putida KT2440
auuggccaaccagccggcaa

SEQ ID NO: 3565654 - RNA, 16 nt, Pseudomonas putida KT2440
auuggccagcaggccc

SEQ ID NO: 3565655 - RNA, 19 nt, Pseudomonas putida KT2440
auuggccagcaggcccggc

SEQ ID NO: 3565656 - RNA, 19 nt, Pseudomonas putida KT2440
auuggccagcagggccggc

SEQ ID NO: 3565657 - RNA, 16 nt, Pseudomonas putida KT2440
auuggcccacgcucug

SEQ ID NO: 3565658 - RNA, 17 nt, Pseudomonas putida KT2440
auuggccggcgcugagc

SEQ ID NO: 3565659 - RNA, 15 nt, Pseudomonas putida KT2440
auuggcgagcaggcc

SEQ ID NO: 3565660 - RNA, 18 nt, Pseudomonas putida KT2440
auuggcgccaucgcccac

SEQ ID NO: 3565661 - RNA, 13 nt, Pseudomonas putida KT2440
auuggcggcaggc

SEQ ID NO: 3565662 - RNA, 18 nt, Pseudomonas putida KT2440
auugguggugcugggcau

SEQ ID NO: 3565663 - RNA, 15 nt, Pseudomonas putida KT2440
auuguaggcggcaag

SEQ ID NO: 3565664 - RNA, 20 nt, Pseudomonas putida KT2440
auuguagguacggcgcugag

SEQ ID NO: 3565665 - RNA, 16 nt, Pseudomonas putida KT2440
auugucauccacauca

SEQ ID NO: 3565666 - RNA, 16 nt, Pseudomonas putida KT2440
auugucgguaaagcgc

SEQ ID NO: 3565667 - RNA, 19 nt, Pseudomonas putida KT2440
auugugcccuugaacggcc

SEQ ID NO: 3565668 - RNA, 21 nt, Pseudomonas putida KT2440
auugugcgccccccuguagga

SEQ ID NO: 3565669 - RNA, 14 nt, Pseudomonas putida KT2440
auuguggccggcgc

SEQ ID NO: 3565670 - RNA, 16 nt, Pseudomonas putida KT2440
auuguucgccucgucg

SEQ ID NO: 3565671 - RNA, 21 nt, Pseudomonas putida KT2440
auuguucgccucgucggcgcg

SEQ ID NO: 3565672 - RNA, 19 nt, Pseudomonas putida KT2440
auuuaacguagaaaggaga

SEQ ID NO: 3565673 - RNA, 11 nt, Pseudomonas putida KT2440
auuuacagcca

SEQ ID NO: 3565674 - RNA, 21 nt, Pseudomonas putida KT2440
auuuaugccgcguuccuuucu

SEQ ID NO: 3565675 - RNA, 14 nt, Pseudomonas putida KT2440
auuucaaagaucuc

SEQ ID NO: 3565676 - RNA, 15 nt, Pseudomonas putida KT2440
auuucacagcaaaaa

SEQ ID NO: 3565677 - RNA, 16 nt, Pseudomonas putida KT2440
auuucaccggcuucua

SEQ ID NO: 3565678 - RNA, 17 nt, Pseudomonas putida KT2440
auuucacgcacggccuu

SEQ ID NO: 3565679 - RNA, 16 nt, Pseudomonas putida KT2440
auuucagguuucgggc

SEQ ID NO: 3565680 - RNA, 18 nt, Pseudomonas putida KT2440
auuuccaccggcuugccc

SEQ ID NO: 3565681 - RNA, 22 nt, Pseudomonas putida KT2440
auuuccauacgugcaccggccu

SEQ ID NO: 3565682 - RNA, 13 nt, Pseudomonas putida KT2440
auuuccgggcaau

SEQ ID NO: 3565683 - RNA, 16 nt, Pseudomonas putida KT2440
auuuccgggcaaugca

SEQ ID NO: 3565684 - RNA, 14 nt, Pseudomonas putida KT2440
auuuccucuucacc

SEQ ID NO: 3565685 - RNA, 16 nt, Pseudomonas putida KT2440
auuuccugcgcggccu

SEQ ID NO: 3565686 - RNA, 20 nt, Pseudomonas putida KT2440
auuuccuucuuguuguucau

SEQ ID NO: 3565687 - RNA, 16 nt, Pseudomonas putida KT2440
auuucgacgcagaggu

SEQ ID NO: 3565688 - RNA, 13 nt, Pseudomonas putida KT2440
auuucguccaggc

SEQ ID NO: 3565689 - RNA, 17 nt, Pseudomonas putida KT2440
auuucguccaggcucag

SEQ ID NO: 3565690 - RNA, 18 nt, Pseudomonas putida KT2440
auuucuaguacuuuuuca

SEQ ID NO: 3565691 - RNA, 14 nt, Pseudomonas putida KT2440
auuucuccccagca

SEQ ID NO: 3565692 - RNA, 14 nt, Pseudomonas putida KT2440
auuucugcaccuug

SEQ ID NO: 3565693 - RNA, 11 nt, Pseudomonas putida KT2440
auuucugcaug

SEQ ID NO: 3565694 - RNA, 24 nt, Pseudomonas putida KT2440
auuucugcauguccagcccguucu

SEQ ID NO: 3565695 - RNA, 20 nt, Pseudomonas putida KT2440
auuucuugaggcacaaaaaa

SEQ ID NO: 3565696 - RNA, 20 nt, Pseudomonas putida KT2440
auuugaggaagugauuugau

SEQ ID NO: 3565697 - RNA, 12 nt, Pseudomonas putida KT2440
auuugcagcaca

SEQ ID NO: 3565698 - RNA, 17 nt, Pseudomonas putida KT2440
auuugccuuggaaugca

SEQ ID NO: 3565699 - RNA, 13 nt, Pseudomonas putida KT2440
auuugucaacaaa

SEQ ID NO: 3565700 - RNA, 11 nt, Pseudomonas putida KT2440
auuuucaucaa

SEQ ID NO: 3565701 - RNA, 13 nt, Pseudomonas putida KT2440
auuuuggauuuuu

SEQ ID NO: 3565702 - RNA, 17 nt, Pseudomonas putida KT2440
auuuuucuggugccggc

SEQ ID NO: 3565703 - RNA, 15 nt, Pseudomonas putida KT2440
caaaaaaucggguaa

SEQ ID NO: 3565704 - RNA, 12 nt, Pseudomonas putida KT2440
caaaaacaacaa

SEQ ID NO: 3565705 - RNA, 18 nt, Pseudomonas putida KT2440
caaaaacggugcagaccu

SEQ ID NO: 3565706 - RNA, 22 nt, Pseudomonas putida KT2440
caaaacaaaaagcgcagcgcag

SEQ ID NO: 3565707 - RNA, 18 nt, Pseudomonas putida KT2440
caaaaccaccagccgugg

SEQ ID NO: 3565708 - RNA, 16 nt, Pseudomonas putida KT2440
caaaacccuucucuuc

SEQ ID NO: 3565709 - RNA, 17 nt, Pseudomonas putida KT2440
caaaaccuuccaugcgc

SEQ ID NO: 3565710 - RNA, 23 nt, Pseudomonas putida KT2440
caaaacgguuguuucagccuugg

SEQ ID NO: 3565711 - RNA, 16 nt, Pseudomonas putida KT2440
caaaacugagcaagaa

SEQ ID NO: 3565712 - RNA, 19 nt, Pseudomonas putida KT2440
caaaagaaaaagggcaucu

SEQ ID NO: 3565713 - RNA, 13 nt, Pseudomonas putida KT2440
caaaagcugaaag

SEQ ID NO: 3565714 - RNA, 16 nt, Pseudomonas putida KT2440
caaaagggugaugccc

SEQ ID NO: 3565715 - RNA, 19 nt, Pseudomonas putida KT2440
caaaaguugcucaaaccau

SEQ ID NO: 3565716 - RNA, 16 nt, Pseudomonas putida KT2440
caaaauagucgaaggc

SEQ ID NO: 3565717 - RNA, 15 nt, Pseudomonas putida KT2440
caaaaucacaggcca

SEQ ID NO: 3565718 - RNA, 16 nt, Pseudomonas putida KT2440
caaaaucacaggccau

SEQ ID NO: 3565719 - RNA, 17 nt, Pseudomonas putida KT2440
caaaaucgaccagggcc

SEQ ID NO: 3565720 - RNA, 16 nt, Pseudomonas putida KT2440
caaaauucuccccgcu

SEQ ID NO: 3565721 - RNA, 18 nt, Pseudomonas putida KT2440
caaacaaaaaagccgcuc

SEQ ID NO: 3565722 - RNA, 20 nt, Pseudomonas putida KT2440
caaacaaaaagcaccucuug

SEQ ID NO: 3565723 - RNA, 17 nt, Pseudomonas putida KT2440
caaacaaugcacagcgc

SEQ ID NO: 3565724 - RNA, 23 nt, Pseudomonas putida KT2440
caaacacccagcucgccaacacc

SEQ ID NO: 3565725 - RNA, 19 nt, Pseudomonas putida KT2440
caaacaccggccccccagc

SEQ ID NO: 3565726 - RNA, 22 nt, Pseudomonas putida KT2440
caaacaccuugccccgcaggcc

SEQ ID NO: 3565727 - RNA, 20 nt, Pseudomonas putida KT2440
caaacacuucaucucgcuca

SEQ ID NO: 3565728 - RNA, 18 nt, Pseudomonas putida KT2440
caaacagacggugcgccu

SEQ ID NO: 3565729 - RNA, 13 nt, Pseudomonas putida KT2440
caaacagcaccag

SEQ ID NO: 3565730 - RNA, 16 nt, Pseudomonas putida KT2440
caaacagcaccagccc

SEQ ID NO: 3565731 - RNA, 20 nt, Pseudomonas putida KT2440
caaacagcaucaaugcagga

SEQ ID NO: 3565732 - RNA, 17 nt, Pseudomonas putida KT2440
caaacagccgcccaguu

SEQ ID NO: 3565733 - RNA, 19 nt, Pseudomonas putida KT2440
caaacagccgcccaguucc

SEQ ID NO: 3565734 - RNA, 21 nt, Pseudomonas putida KT2440
caaacagcucgacaacccgcg

SEQ ID NO: 3565735 - RNA, 15 nt, Pseudomonas putida KT2440
caaacaggaucuccu

SEQ ID NO: 3565736 - RNA, 21 nt, Pseudomonas putida KT2440
caaacauugugcgccccccug

SEQ ID NO: 3565737 - RNA, 15 nt, Pseudomonas putida KT2440
caaaccacagcggcc

SEQ ID NO: 3565738 - RNA, 17 nt, Pseudomonas putida KT2440
caaaccagcggucugcu

SEQ ID NO: 3565739 - RNA, 18 nt, Pseudomonas putida KT2440
caaaccagcggucugcug

SEQ ID NO: 3565740 - RNA, 18 nt, Pseudomonas putida KT2440
caaaccauggcgucaggc

SEQ ID NO: 3565741 - RNA, 22 nt, Pseudomonas putida KT2440
caaaccauuggugaaagcgcaa

SEQ ID NO: 3565742 - RNA, 22 nt, Pseudomonas putida KT2440
caaaccccccaugcucaccagc

SEQ ID NO: 3565743 - RNA, 23 nt, Pseudomonas putida KT2440
caaaccccccaugcucaccagcu

SEQ ID NO: 3565744 - RNA, 14 nt, Pseudomonas putida KT2440
caaacccgacaaca

SEQ ID NO: 3565745 - RNA, 22 nt, Pseudomonas putida KT2440
caaacccgcgccuacaggcaac

SEQ ID NO: 3565746 - RNA, 24 nt, Pseudomonas putida KT2440
caaacccgcgccuacaggcaaccg

SEQ ID NO: 3565747 - RNA, 15 nt, Pseudomonas putida KT2440
caaaccgaccaggca

SEQ ID NO: 3565748 - RNA, 17 nt, Pseudomonas putida KT2440
caaaccgacccugcugc

SEQ ID NO: 3565749 - RNA, 19 nt, Pseudomonas putida KT2440
caaaccgacccugcugcug

SEQ ID NO: 3565750 - RNA, 14 nt, Pseudomonas putida KT2440
caaaccgcugccca

SEQ ID NO: 3565751 - RNA, 14 nt, Pseudomonas putida KT2440
caaaccggaucggg

SEQ ID NO: 3565752 - RNA, 15 nt, Pseudomonas putida KT2440
caaaccggcaccggc

SEQ ID NO: 3565753 - RNA, 22 nt, Pseudomonas putida KT2440
caaaccggcaccggcgaacagc

SEQ ID NO: 3565754 - RNA, 22 nt, Pseudomonas putida KT2440
caaaccucaaaugcgcccugcu

SEQ ID NO: 3565755 - RNA, 19 nt, Pseudomonas putida KT2440
caaaccugcgaccacacug

SEQ ID NO: 3565756 - RNA, 16 nt, Pseudomonas putida KT2440
caaacgaaaucugccu

SEQ ID NO: 3565757 - RNA, 19 nt, Pseudomonas putida KT2440
caaacgaaaucugccugcu

SEQ ID NO: 3565758 - RNA, 21 nt, Pseudomonas putida KT2440
caaacgaaaucugccugcugc

SEQ ID NO: 3565759 - RNA, 22 nt, Pseudomonas putida KT2440
caaacgaaaucugccugcugca

SEQ ID NO: 3565760 - RNA, 23 nt, Pseudomonas putida KT2440
caaacgaugcgggcuuucucauc

SEQ ID NO: 3565761 - RNA, 16 nt, Pseudomonas putida KT2440
caaacgcccgcgcagc

SEQ ID NO: 3565762 - RNA, 19 nt, Pseudomonas putida KT2440
caaacggcuagccaucgca

SEQ ID NO: 3565763 - RNA, 14 nt, Pseudomonas putida KT2440
caaacuccacugug

SEQ ID NO: 3565764 - RNA, 20 nt, Pseudomonas putida KT2440
caaacucuccuugcguugca

SEQ ID NO: 3565765 - RNA, 14 nt, Pseudomonas putida KT2440
caaagaaacaccag

SEQ ID NO: 3565766 - RNA, 19 nt, Pseudomonas putida KT2440
caaagaagcgccgcagguc

SEQ ID NO: 3565767 - RNA, 18 nt, Pseudomonas putida KT2440
caaagauaccccugcgcc

SEQ ID NO: 3565768 - RNA, 17 nt, Pseudomonas putida KT2440
caaagcagacagcugug

SEQ ID NO: 3565769 - RNA, 14 nt, Pseudomonas putida KT2440
caaagcagacccag

SEQ ID NO: 3565770 - RNA, 21 nt, Pseudomonas putida KT2440
caaagccaauuugccagcgug

SEQ ID NO: 3565771 - RNA, 16 nt, Pseudomonas putida KT2440
caaagcccaagggcuc

SEQ ID NO: 3565772 - RNA, 16 nt, Pseudomonas putida KT2440
caaagcccgugccgca

SEQ ID NO: 3565773 - RNA, 17 nt, Pseudomonas putida KT2440
caaagcccgugccgcau

SEQ ID NO: 3565774 - RNA, 15 nt, Pseudomonas putida KT2440
caaagcccugccuca

SEQ ID NO: 3565775 - RNA, 19 nt, Pseudomonas putida KT2440
caaagcccugccucagcuc

SEQ ID NO: 3565776 - RNA, 23 nt, Pseudomonas putida KT2440
caaagccuuuuuucgggcugcug

SEQ ID NO: 3565777 - RNA, 16 nt, Pseudomonas putida KT2440
caaagcgagcauggcg

SEQ ID NO: 3565778 - RNA, 22 nt, Pseudomonas putida KT2440
caaagcggccccaggugccaac

SEQ ID NO: 3565779 - RNA, 17 nt, Pseudomonas putida KT2440
caaagcggcccccagca

SEQ ID NO: 3565780 - RNA, 17 nt, Pseudomonas putida KT2440
caaagcggccccuucga

SEQ ID NO: 3565781 - RNA, 17 nt, Pseudomonas putida KT2440
caaagcggcgcggcccu

SEQ ID NO: 3565782 - RNA, 19 nt, Pseudomonas putida KT2440
caaagcgggcaacugcgcc

SEQ ID NO: 3565783 - RNA, 22 nt, Pseudomonas putida KT2440
caaagcguucgguguccuugca

SEQ ID NO: 3565784 - RNA, 14 nt, Pseudomonas putida KT2440
caaagcucaaaugc

SEQ ID NO: 3565785 - RNA, 17 nt, Pseudomonas putida KT2440
caaagcucaaaugcugg

SEQ ID NO: 3565786 - RNA, 14 nt, Pseudomonas putida KT2440
caaagcuguugaag

SEQ ID NO: 3565787 - RNA, 16 nt, Pseudomonas putida KT2440
caaagcuguugaaggc

SEQ ID NO: 3565788 - RNA, 22 nt, Pseudomonas putida KT2440
caaagcuguugaaggcguuuuc

SEQ ID NO: 3565789 - RNA, 16 nt, Pseudomonas putida KT2440
caaaggcaugggccag

SEQ ID NO: 3565790 - RNA, 12 nt, Pseudomonas putida KT2440
caaaggccucuu

SEQ ID NO: 3565791 - RNA, 17 nt, Pseudomonas putida KT2440
caaaggcgucgcuguuc

SEQ ID NO: 3565792 - RNA, 21 nt, Pseudomonas putida KT2440
caaaggcuugucaugccuugg

SEQ ID NO: 3565793 - RNA, 15 nt, Pseudomonas putida KT2440
caaagguggcaccgc

SEQ ID NO: 3565794 - RNA, 17 nt, Pseudomonas putida KT2440
caaagguggcaccgccg

SEQ ID NO: 3565795 - RNA, 19 nt, Pseudomonas putida KT2440
caaaguccggcgaagcacu

SEQ ID NO: 3565796 - RNA, 21 nt, Pseudomonas putida KT2440
caaaguccugcaaaggcccuu

SEQ ID NO: 3565797 - RNA, 18 nt, Pseudomonas putida KT2440
caaagucuucagccaagg

SEQ ID NO: 3565798 - RNA, 20 nt, Pseudomonas putida KT2440
caaagugauaacgcgccgcu

SEQ ID NO: 3565799 - RNA, 14 nt, Pseudomonas putida KT2440
caaauaccccaggc

SEQ ID NO: 3565800 - RNA, 18 nt, Pseudomonas putida KT2440
caaauacgguugcagcac

SEQ ID NO: 3565801 - RNA, 17 nt, Pseudomonas putida KT2440
caaaucaguaaguugaa

SEQ ID NO: 3565802 - RNA, 20 nt, Pseudomonas putida KT2440
caaaucgaaaaugcagaugc

SEQ ID NO: 3565803 - RNA, 13 nt, Pseudomonas putida KT2440
caaaucggcagaa

SEQ ID NO: 3565804 - RNA, 14 nt, Pseudomonas putida KT2440
caaaucggccuugc

SEQ ID NO: 3565805 - RNA, 17 nt, Pseudomonas putida KT2440
caaaugcaccacgcgca

SEQ ID NO: 3565806 - RNA, 23 nt, Pseudomonas putida KT2440
caaaugcaccacgcgcaaaugcu

SEQ ID NO: 3565807 - RNA, 18 nt, Pseudomonas putida KT2440
caaaugcccccggcuguc

SEQ ID NO: 3565808 - RNA, 15 nt, Pseudomonas putida KT2440
caaaugccccgggca

SEQ ID NO: 3565809 - RNA, 20 nt, Pseudomonas putida KT2440
caaaugccccgggcaggcca

SEQ ID NO: 3565810 - RNA, 23 nt, Pseudomonas putida KT2440
caaaugccgguuugcggccuucg

SEQ ID NO: 3565811 - RNA, 21 nt, Pseudomonas putida KT2440
caaaugcgcccugcugccgca

SEQ ID NO: 3565812 - RNA, 16 nt, Pseudomonas putida KT2440
caaaugcuugcccgcc

SEQ ID NO: 3565813 - RNA, 21 nt, Pseudomonas putida KT2440
caaauguccauugagcacuca

SEQ ID NO: 3565814 - RNA, 17 nt, Pseudomonas putida KT2440
caaauucgaccagcagu

SEQ ID NO: 3565815 - RNA, 19 nt, Pseudomonas putida KT2440
caaauucgaccagcagugu

SEQ ID NO: 3565816 - RNA, 20 nt, Pseudomonas putida KT2440
caacaaaaaacgaagauggc

SEQ ID NO: 3565817 - RNA, 16 nt, Pseudomonas putida KT2440
caacaaaccgacccug

SEQ ID NO: 3565818 - RNA, 21 nt, Pseudomonas putida KT2440
caacaaaccgacccugcugcu

SEQ ID NO: 3565819 - RNA, 14 nt, Pseudomonas putida KT2440
caacaaaucggccu

SEQ ID NO: 3565820 - RNA, 13 nt, Pseudomonas putida KT2440
caacaacaaaaaa

SEQ ID NO: 3565821 - RNA, 16 nt, Pseudomonas putida KT2440
caacaacaaaaaaaac

SEQ ID NO: 3565822 - RNA, 19 nt, Pseudomonas putida KT2440
caacaacagucaacaauca

SEQ ID NO: 3565823 - RNA, 19 nt, Pseudomonas putida KT2440
caacaacccgcccaauuug

SEQ ID NO: 3565824 - RNA, 23 nt, Pseudomonas putida KT2440
caacaacgacuggucauacucca

SEQ ID NO: 3565825 - RNA, 22 nt, Pseudomonas putida KT2440
caacaacuggaucuucucuucc

SEQ ID NO: 3565826 - RNA, 15 nt, Pseudomonas putida KT2440
caacaaggacugccu

SEQ ID NO: 3565827 - RNA, 17 nt, Pseudomonas putida KT2440
caacaaggacugccuga

SEQ ID NO: 3565828 - RNA, 18 nt, Pseudomonas putida KT2440
caacaaggacugccugau

SEQ ID NO: 3565829 - RNA, 22 nt, Pseudomonas putida KT2440
caacaaggacugccugaucacc

SEQ ID NO: 3565830 - RNA, 19 nt, Pseudomonas putida KT2440
caacaaggccaaccacgcc

SEQ ID NO: 3565831 - RNA, 19 nt, Pseudomonas putida KT2440
caacaagucuuccccuugg

SEQ ID NO: 3565832 - RNA, 13 nt, Pseudomonas putida KT2440
caacaaucgcguc

SEQ ID NO: 3565833 - RNA, 20 nt, Pseudomonas putida KT2440
caacaaucgcgucagcaccg

SEQ ID NO: 3565834 - RNA, 17 nt, Pseudomonas putida KT2440
caacaauuuucgaccaa

SEQ ID NO: 3565835 - RNA, 21 nt, Pseudomonas putida KT2440
caacaauuuucgaccaaggcu

SEQ ID NO: 3565836 - RNA, 15 nt, Pseudomonas putida KT2440
caacacauuauccac

SEQ ID NO: 3565837 - RNA, 16 nt, Pseudomonas putida KT2440
caacaccaacuugcca

SEQ ID NO: 3565838 - RNA, 19 nt, Pseudomonas putida KT2440
caacaccagacucagcgcu

SEQ ID NO: 3565839 - RNA, 13 nt, Pseudomonas putida KT2440
caacaccagcaug

SEQ ID NO: 3565840 - RNA, 14 nt, Pseudomonas putida KT2440
caacaccaucuuca

SEQ ID NO: 3565841 - RNA, 15 nt, Pseudomonas putida KT2440
caacaccgccagcgg

SEQ ID NO: 3565842 - RNA, 22 nt, Pseudomonas putida KT2440
caacaccgcccccaaaccgcug

SEQ ID NO: 3565843 - RNA, 22 nt, Pseudomonas putida KT2440
caacaccguugguaucgaucag

SEQ ID NO: 3565844 - RNA, 14 nt, Pseudomonas putida KT2440
caacaccugccgca

SEQ ID NO: 3565845 - RNA, 16 nt, Pseudomonas putida KT2440
caacaccuucucggcc

SEQ ID NO: 3565846 - RNA, 23 nt, Pseudomonas putida KT2440
caacacugucccgaucagguuca

SEQ ID NO: 3565847 - RNA, 20 nt, Pseudomonas putida KT2440
caacacuuccagcaucgccc

SEQ ID NO: 3565848 - RNA, 13 nt, Pseudomonas putida KT2440
caacagaccaccu

SEQ ID NO: 3565849 - RNA, 14 nt, Pseudomonas putida KT2440
caacagaccaccug

SEQ ID NO: 3565850 - RNA, 18 nt, Pseudomonas putida KT2440
caacagaccaccugccaa

SEQ ID NO: 3565851 - RNA, 19 nt, Pseudomonas putida KT2440
caacagcaccggccaggcu

SEQ ID NO: 3565852 - RNA, 15 nt, Pseudomonas putida KT2440
caacagcauccaaag

SEQ ID NO: 3565853 - RNA, 17 nt, Pseudomonas putida KT2440
caacagccacgcccguc

SEQ ID NO: 3565854 - RNA, 20 nt, Pseudomonas putida KT2440
caacagccccaucaccagcc

SEQ ID NO: 3565855 - RNA, 23 nt, Pseudomonas putida KT2440
caacagccccaucaccagcccga

SEQ ID NO: 3565856 - RNA, 16 nt, Pseudomonas putida KT2440
caacagcccggugaag

SEQ ID NO: 3565857 - RNA, 12 nt, Pseudomonas putida KT2440
caacagccgcgg

SEQ ID NO: 3565858 - RNA, 23 nt, Pseudomonas putida KT2440
caacagcgcgacgcagcagcgcg

SEQ ID NO: 3565859 - RNA, 13 nt, Pseudomonas putida KT2440
caacagcucaucc

SEQ ID NO: 3565860 - RNA, 21 nt, Pseudomonas putida KT2440
caacagcucauccaggcugca

SEQ ID NO: 3565861 - RNA, 14 nt, Pseudomonas putida KT2440
caacagcuccagca

SEQ ID NO: 3565862 - RNA, 22 nt, Pseudomonas putida KT2440
caacagcuccagcaacugcgcc

SEQ ID NO: 3565863 - RNA, 17 nt, Pseudomonas putida KT2440
caacagcuccagcagug

SEQ ID NO: 3565864 - RNA, 15 nt, Pseudomonas putida KT2440
caacagcuggcuggu

SEQ ID NO: 3565865 - RNA, 23 nt, Pseudomonas putida KT2440
caacagcuggcuggugacaacgc

SEQ ID NO: 3565866 - RNA, 13 nt, Pseudomonas putida KT2440
caacaggaacagc

SEQ ID NO: 3565867 - RNA, 14 nt, Pseudomonas putida KT2440
caacaggaacagcg

SEQ ID NO: 3565868 - RNA, 13 nt, Pseudomonas putida KT2440
caacaggcucucc

SEQ ID NO: 3565869 - RNA, 15 nt, Pseudomonas putida KT2440
caacaggcucuccau

SEQ ID NO: 3565870 - RNA, 15 nt, Pseudomonas putida KT2440
caacaggcuggccga

SEQ ID NO: 3565871 - RNA, 14 nt, Pseudomonas putida KT2440
caacagguucgaca

SEQ ID NO: 3565872 - RNA, 13 nt, Pseudomonas putida KT2440
caacaguuuucaa

SEQ ID NO: 3565873 - RNA, 16 nt, Pseudomonas putida KT2440
caacaguuuucaaugc

SEQ ID NO: 3565874 - RNA, 17 nt, Pseudomonas putida KT2440
caacauaaggugcaaag

SEQ ID NO: 3565875 - RNA, 18 nt, Pseudomonas putida KT2440
caacaugccggcccaagg

SEQ ID NO: 3565876 - RNA, 20 nt, Pseudomonas putida KT2440
caacauggucacaugucgag

SEQ ID NO: 3565877 - RNA, 15 nt, Pseudomonas putida KT2440
caacauucaccagcc

SEQ ID NO: 3565878 - RNA, 16 nt, Pseudomonas putida KT2440
caaccaagcgaacuau

SEQ ID NO: 3565879 - RNA, 15 nt, Pseudomonas putida KT2440
caaccaauccccccu

SEQ ID NO: 3565880 - RNA, 18 nt, Pseudomonas putida KT2440
caaccaccaacagcaccg

SEQ ID NO: 3565881 - RNA, 17 nt, Pseudomonas putida KT2440
caaccaccgaccugugu

SEQ ID NO: 3565882 - RNA, 14 nt, Pseudomonas putida KT2440
caaccaccucuauc

SEQ ID NO: 3565883 - RNA, 12 nt, Pseudomonas putida KT2440
caaccacgaccg

SEQ ID NO: 3565884 - RNA, 23 nt, Pseudomonas putida KT2440
caaccacgaccggcucaacagca

SEQ ID NO: 3565885 - RNA, 20 nt, Pseudomonas putida KT2440
caaccacgguggugguuugu

SEQ ID NO: 3565886 - RNA, 12 nt, Pseudomonas putida KT2440
caaccacugcaa

SEQ ID NO: 3565887 - RNA, 17 nt, Pseudomonas putida KT2440
caaccagcccgccgcca

SEQ ID NO: 3565888 - RNA, 17 nt, Pseudomonas putida KT2440
caaccagccgccuuugc

SEQ ID NO: 3565889 - RNA, 13 nt, Pseudomonas putida KT2440
caaccagccggca

SEQ ID NO: 3565890 - RNA, 22 nt, Pseudomonas putida KT2440
caaccagccggcaauuuccugc

SEQ ID NO: 3565891 - RNA, 17 nt, Pseudomonas putida KT2440
caaccaggugugccacu

SEQ ID NO: 3565892 - RNA, 17 nt, Pseudomonas putida KT2440
caaccaguucagcgccc

SEQ ID NO: 3565893 - RNA, 19 nt, Pseudomonas putida KT2440
caaccaguucagcgcccgc

SEQ ID NO: 3565894 - RNA, 15 nt, Pseudomonas putida KT2440
caaccaugcuggcca

SEQ ID NO: 3565895 - RNA, 21 nt, Pseudomonas putida KT2440
caacccaccagcacugcugcg

SEQ ID NO: 3565896 - RNA, 14 nt, Pseudomonas putida KT2440
caacccagccagcg

SEQ ID NO: 3565897 - RNA, 21 nt, Pseudomonas putida KT2440
caacccagccagcgacagcau

SEQ ID NO: 3565898 - RNA, 15 nt, Pseudomonas putida KT2440
caaccccaacccggu

SEQ ID NO: 3565899 - RNA, 14 nt, Pseudomonas putida KT2440
caaccccagcccga

SEQ ID NO: 3565900 - RNA, 14 nt, Pseudomonas putida KT2440
caaccccaucaccu

SEQ ID NO: 3565901 - RNA, 15 nt, Pseudomonas putida KT2440
caacccccacagggc

SEQ ID NO: 3565902 - RNA, 18 nt, Pseudomonas putida KT2440
caaccccgcagacagcuc

SEQ ID NO: 3565903 - RNA, 20 nt, Pseudomonas putida KT2440
caaccccgcagacagcucga

SEQ ID NO: 3565904 - RNA, 14 nt, Pseudomonas putida KT2440
caaccccgucgccu

SEQ ID NO: 3565905 - RNA, 17 nt, Pseudomonas putida KT2440
caaccccuggaaacccu

SEQ ID NO: 3565906 - RNA, 16 nt, Pseudomonas putida KT2440
caaccccuugcucaac

SEQ ID NO: 3565907 - RNA, 22 nt, Pseudomonas putida KT2440
caacccgauuccuugcagcgcc

SEQ ID NO: 3565908 - RNA, 22 nt, Pseudomonas putida KT2440
caacccgauuucgcuggggcug

SEQ ID NO: 3565909 - RNA, 20 nt, Pseudomonas putida KT2440
caacccggccaggccgugcu

SEQ ID NO: 3565910 - RNA, 19 nt, Pseudomonas putida KT2440
caacccggccuuggccgcu

SEQ ID NO: 3565911 - RNA, 21 nt, Pseudomonas putida KT2440
caacccgggguaaccgccuga

SEQ ID NO: 3565912 - RNA, 16 nt, Pseudomonas putida KT2440
caacccgucagugcuc

SEQ ID NO: 3565913 - RNA, 17 nt, Pseudomonas putida KT2440
caacccgucagugcucg

SEQ ID NO: 3565914 - RNA, 14 nt, Pseudomonas putida KT2440
caacccguggucug

SEQ ID NO: 3565915 - RNA, 21 nt, Pseudomonas putida KT2440
caacccucgaccucgaucucg

SEQ ID NO: 3565916 - RNA, 16 nt, Pseudomonas putida KT2440
caacccugcgcccagu

SEQ ID NO: 3565917 - RNA, 18 nt, Pseudomonas putida KT2440
caacccuugcagcgccug

SEQ ID NO: 3565918 - RNA, 24 nt, Pseudomonas putida KT2440
caacccuugcagcgccugugagau

SEQ ID NO: 3565919 - RNA, 22 nt, Pseudomonas putida KT2440
caaccgaaaaggccaaccaccc

SEQ ID NO: 3565920 - RNA, 23 nt, Pseudomonas putida KT2440
caaccgaaaaggccaaccacccg

SEQ ID NO: 3565921 - RNA, 15 nt, Pseudomonas putida KT2440
caaccgaacccgcug

SEQ ID NO: 3565922 - RNA, 22 nt, Pseudomonas putida KT2440
caaccgaacccgcugccaccca

SEQ ID NO: 3565923 - RNA, 21 nt, Pseudomonas putida KT2440
caaccgaacccgcuggcgauc

SEQ ID NO: 3565924 - RNA, 18 nt, Pseudomonas putida KT2440
caaccgaugcccaggccc

SEQ ID NO: 3565925 - RNA, 16 nt, Pseudomonas putida KT2440
caaccgcaagcggcuc

SEQ ID NO: 3565926 - RNA, 16 nt, Pseudomonas putida KT2440
caaccgccccacccau

SEQ ID NO: 3565927 - RNA, 17 nt, Pseudomonas putida KT2440
caaccgccgcgccucgc

SEQ ID NO: 3565928 - RNA, 23 nt, Pseudomonas putida KT2440
caaccgccgcgccucgcggugca

SEQ ID NO: 3565929 - RNA, 16 nt, Pseudomonas putida KT2440
caaccgccuccacggu

SEQ ID NO: 3565930 - RNA, 21 nt, Pseudomonas putida KT2440
caaccgccuccacggucagca

SEQ ID NO: 3565931 - RNA, 15 nt, Pseudomonas putida KT2440
caaccgcgccagcuc

SEQ ID NO: 3565932 - RNA, 17 nt, Pseudomonas putida KT2440
caaccgcgugacgcgga

SEQ ID NO: 3565933 - RNA, 16 nt, Pseudomonas putida KT2440
caaccgcucucgauca

SEQ ID NO: 3565934 - RNA, 23 nt, Pseudomonas putida KT2440
caaccgcugcauggccuggcaaa

SEQ ID NO: 3565935 - RNA, 16 nt, Pseudomonas putida KT2440
caaccggaaucugcuc

SEQ ID NO: 3565936 - RNA, 21 nt, Pseudomonas putida KT2440
caaccggagcgacuucgacca

SEQ ID NO: 3565937 - RNA, 22 nt, Pseudomonas putida KT2440
caaccggcuuguagccggcagu

SEQ ID NO: 3565938 - RNA, 22 nt, Pseudomonas putida KT2440
caaccgggucggcgccaggccu

SEQ ID NO: 3565939 - RNA, 18 nt, Pseudomonas putida KT2440
caaccggugcaacugcca

SEQ ID NO: 3565940 - RNA, 20 nt, Pseudomonas putida KT2440
caaccguacccuuccuggag

SEQ ID NO: 3565941 - RNA, 18 nt, Pseudomonas putida KT2440
caaccgugguucuugccg

SEQ ID NO: 3565942 - RNA, 15 nt, Pseudomonas putida KT2440
caaccguuccugcag

SEQ ID NO: 3565943 - RNA, 13 nt, Pseudomonas putida KT2440
caaccucacuggc

SEQ ID NO: 3565944 - RNA, 21 nt, Pseudomonas putida KT2440
caaccucaggccugcacugca

SEQ ID NO: 3565945 - RNA, 12 nt, Pseudomonas putida KT2440
caaccugccgau

SEQ ID NO: 3565946 - RNA, 21 nt, Pseudomonas putida KT2440
caaccugcucgcucaggcucu

SEQ ID NO: 3565947 - RNA, 21 nt, Pseudomonas putida KT2440
caaccugcugggcaagggccu

SEQ ID NO: 3565948 - RNA, 17 nt, Pseudomonas putida KT2440
caaccuguaacucagcu

SEQ ID NO: 3565949 - RNA, 13 nt, Pseudomonas putida KT2440
caaccuuccagca

SEQ ID NO: 3565950 - RNA, 13 nt, Pseudomonas putida KT2440
caaccuugaccac

SEQ ID NO: 3565951 - RNA, 18 nt, Pseudomonas putida KT2440
caaccuugaccaccaggg

SEQ ID NO: 3565952 - RNA, 14 nt, Pseudomonas putida KT2440
caaccuuugcggca

SEQ ID NO: 3565953 - RNA, 12 nt, Pseudomonas putida KT2440
caacgaaaucau

SEQ ID NO: 3565954 - RNA, 14 nt, Pseudomonas putida KT2440
caacgaaucagcca

SEQ ID NO: 3565955 - RNA, 18 nt, Pseudomonas putida KT2440
caacgaaucagccagccu

SEQ ID NO: 3565956 - RNA, 17 nt, Pseudomonas putida KT2440
caacgaucugcguacac

SEQ ID NO: 3565957 - RNA, 19 nt, Pseudomonas putida KT2440
caacgauuggcaguccuga

SEQ ID NO: 3565958 - RNA, 22 nt, Pseudomonas putida KT2440
caacgauuggcaguccugaaug

SEQ ID NO: 3565959 - RNA, 18 nt, Pseudomonas putida KT2440
caacgcaaauccuccugc

SEQ ID NO: 3565960 - RNA, 16 nt, Pseudomonas putida KT2440
caacgcaacaaccccg

SEQ ID NO: 3565961 - RNA, 14 nt, Pseudomonas putida KT2440
caacgcaaugggca

SEQ ID NO: 3565962 - RNA, 15 nt, Pseudomonas putida KT2440
caacgcacccgccuc

SEQ ID NO: 3565963 - RNA, 14 nt, Pseudomonas putida KT2440
caacgcagccagga

SEQ ID NO: 3565964 - RNA, 17 nt, Pseudomonas putida KT2440
caacgcagccggcaccg

SEQ ID NO: 3565965 - RNA, 17 nt, Pseudomonas putida KT2440
caacgcauuuucaucaa

SEQ ID NO: 3565966 - RNA, 13 nt, Pseudomonas putida KT2440
caacgccacacug

SEQ ID NO: 3565967 - RNA, 16 nt, Pseudomonas putida KT2440
caacgccaccgaaggc

SEQ ID NO: 3565968 - RNA, 18 nt, Pseudomonas putida KT2440
caacgccagggcaaucgc

SEQ ID NO: 3565969 - RNA, 17 nt, Pseudomonas putida KT2440
caacgccccacccgcuc

SEQ ID NO: 3565970 - RNA, 21 nt, Pseudomonas putida KT2440
caacgccccaggguguuguuc

SEQ ID NO: 3565971 - RNA, 15 nt, Pseudomonas putida KT2440
caacgcccgccguca

SEQ ID NO: 3565972 - RNA, 18 nt, Pseudomonas putida KT2440
caacgcccgcgcauagca

SEQ ID NO: 3565973 - RNA, 18 nt, Pseudomonas putida KT2440
caacgccgccagcggcuc

SEQ ID NO: 3565974 - RNA, 17 nt, Pseudomonas putida KT2440
caacgccguacggccca

SEQ ID NO: 3565975 - RNA, 22 nt, Pseudomonas putida KT2440
caacgccucgggcgcucgcggu

SEQ ID NO: 3565976 - RNA, 19 nt, Pseudomonas putida KT2440
caacgccuucaggcgaagc

SEQ ID NO: 3565977 - RNA, 17 nt, Pseudomonas putida KT2440
caacgccuugcgcucga

SEQ ID NO: 3565978 - RNA, 18 nt, Pseudomonas putida KT2440
caacgccuugcgcucgac

SEQ ID NO: 3565979 - RNA, 20 nt, Pseudomonas putida KT2440
caacgccuuggccugcggga

SEQ ID NO: 3565980 - RNA, 19 nt, Pseudomonas putida KT2440
caacgcgacgguugacagc

SEQ ID NO: 3565981 - RNA, 22 nt, Pseudomonas putida KT2440
caacgcgacgguugacagcacg

SEQ ID NO: 3565982 - RNA, 12 nt, Pseudomonas putida KT2440
caacgcgccgau

SEQ ID NO: 3565983 - RNA, 14 nt, Pseudomonas putida KT2440
caacgcggcccugg

SEQ ID NO: 3565984 - RNA, 15 nt, Pseudomonas putida KT2440
caacgcggcccuggg

SEQ ID NO: 3565985 - RNA, 20 nt, Pseudomonas putida KT2440
caacgcgguggcuggcaccg

SEQ ID NO: 3565986 - RNA, 22 nt, Pseudomonas putida KT2440
caacgcugccuugcccagcucc

SEQ ID NO: 3565987 - RNA, 21 nt, Pseudomonas putida KT2440
caacgcugcucggccucgacc

SEQ ID NO: 3565988 - RNA, 16 nt, Pseudomonas putida KT2440
caacggacgucccagc

SEQ ID NO: 3565989 - RNA, 18 nt, Pseudomonas putida KT2440
caacggacgucccagcag

SEQ ID NO: 3565990 - RNA, 17 nt, Pseudomonas putida KT2440
caacggcacacgcacca

SEQ ID NO: 3565991 - RNA, 15 nt, Pseudomonas putida KT2440
caacggcagcgacag

SEQ ID NO: 3565992 - RNA, 13 nt, Pseudomonas putida KT2440
caacggccacgcu

SEQ ID NO: 3565993 - RNA, 18 nt, Pseudomonas putida KT2440
caacggccgcgccgcgcc

SEQ ID NO: 3565994 - RNA, 20 nt, Pseudomonas putida KT2440
caacggccgcgccgcgccca

SEQ ID NO: 3565995 - RNA, 16 nt, Pseudomonas putida KT2440
caacggcgcccgggcc

SEQ ID NO: 3565996 - RNA, 14 nt, Pseudomonas putida KT2440
caacggcuggcgga

SEQ ID NO: 3565997 - RNA, 13 nt, Pseudomonas putida KT2440
caacggcugugcc

SEQ ID NO: 3565998 - RNA, 14 nt, Pseudomonas putida KT2440
caacggcugugccg

SEQ ID NO: 3565999 - RNA, 17 nt, Pseudomonas putida KT2440
caacgggcggaacuggc

SEQ ID NO: 3566000 - RNA, 23 nt, Pseudomonas putida KT2440
caacggguucagguacagcagcu

SEQ ID NO: 3566001 - RNA, 19 nt, Pseudomonas putida KT2440
caacgguggccagcagcuc

SEQ ID NO: 3566002 - RNA, 17 nt, Pseudomonas putida KT2440
caacgguuuaccgccgu

SEQ ID NO: 3566003 - RNA, 20 nt, Pseudomonas putida KT2440
caacgucucgaacggcgcca

SEQ ID NO: 3566004 - RNA, 23 nt, Pseudomonas putida KT2440
caacgucucgaacggcgccagca

SEQ ID NO: 3566005 - RNA, 21 nt, Pseudomonas putida KT2440
caacuaucgagcauggcgauc

SEQ ID NO: 3566006 - RNA, 14 nt, Pseudomonas putida KT2440
caacucaauuuccc

SEQ ID NO: 3566007 - RNA, 22 nt, Pseudomonas putida KT2440
caacucaucacucuugcgccag

SEQ ID NO: 3566008 - RNA, 17 nt, Pseudomonas putida KT2440
caacuccaccccuucca

SEQ ID NO: 3566009 - RNA, 23 nt, Pseudomonas putida KT2440
caacuccacuguggucgaauagc

SEQ ID NO: 3566010 - RNA, 23 nt, Pseudomonas putida KT2440
caacuccaugucggaagccugca

SEQ ID NO: 3566011 - RNA, 14 nt, Pseudomonas putida KT2440
caacuccccaccca

SEQ ID NO: 3566012 - RNA, 19 nt, Pseudomonas putida KT2440
caacuccucgaucaccugc

SEQ ID NO: 3566013 - RNA, 20 nt, Pseudomonas putida KT2440
caacucgccaaaccauggcg

SEQ ID NO: 3566014 - RNA, 16 nt, Pseudomonas putida KT2440
caacucgcgcauccag

SEQ ID NO: 3566015 - RNA, 18 nt, Pseudomonas putida KT2440
caacucggccuuguccgu

SEQ ID NO: 3566016 - RNA, 19 nt, Pseudomonas putida KT2440
caacugagcuaacgaccca

SEQ ID NO: 3566017 - RNA, 19 nt, Pseudomonas putida KT2440
caacugaugggucuugccg

SEQ ID NO: 3566018 - RNA, 20 nt, Pseudomonas putida KT2440
caacugaugggucuugccgg

SEQ ID NO: 3566019 - RNA, 14 nt, Pseudomonas putida KT2440
caacugcacccgcc

SEQ ID NO: 3566020 - RNA, 16 nt, Pseudomonas putida KT2440
caacugcacccgccag

SEQ ID NO: 3566021 - RNA, 21 nt, Pseudomonas putida KT2440
caacugcacccgccagccguu

SEQ ID NO: 3566022 - RNA, 11 nt, Pseudomonas putida KT2440
caacugcagca

SEQ ID NO: 3566023 - RNA, 16 nt, Pseudomonas putida KT2440
caacugcauccgcccc

SEQ ID NO: 3566024 - RNA, 20 nt, Pseudomonas putida KT2440
caacugccaggcuggcgcua

SEQ ID NO: 3566025 - RNA, 23 nt, Pseudomonas putida KT2440
caacugcccaggaucacuggccu

SEQ ID NO: 3566026 - RNA, 17 nt, Pseudomonas putida KT2440
caacugcgcccgccccu

SEQ ID NO: 3566027 - RNA, 15 nt, Pseudomonas putida KT2440
caacugcgccuggga

SEQ ID NO: 3566028 - RNA, 17 nt, Pseudomonas putida KT2440
caacugcgcgauagccu

SEQ ID NO: 3566029 - RNA, 16 nt, Pseudomonas putida KT2440
caacugcggccccugg

SEQ ID NO: 3566030 - RNA, 17 nt, Pseudomonas putida KT2440
caacugcggccccugga

SEQ ID NO: 3566031 - RNA, 17 nt, Pseudomonas putida KT2440
caacugcuccaggcagc

SEQ ID NO: 3566032 - RNA, 24 nt, Pseudomonas putida KT2440
caacugcuccaggcagccugccag

SEQ ID NO: 3566033 - RNA, 14 nt, Pseudomonas putida KT2440
caacuggaucuucu

SEQ ID NO: 3566034 - RNA, 23 nt, Pseudomonas putida KT2440
caacuggaucuucucuuccaccg

SEQ ID NO: 3566035 - RNA, 21 nt, Pseudomonas putida KT2440
caacuggcaggguucgcuguc

SEQ ID NO: 3566036 - RNA, 22 nt, Pseudomonas putida KT2440
caacuggcaucggucaccgggu

SEQ ID NO: 3566037 - RNA, 18 nt, Pseudomonas putida KT2440
caacuggcgcaggccgcu

SEQ ID NO: 3566038 - RNA, 21 nt, Pseudomonas putida KT2440
caacuggucggccuugccgcu

SEQ ID NO: 3566039 - RNA, 21 nt, Pseudomonas putida KT2440
caacuguuucugcucuucugc

SEQ ID NO: 3566040 - RNA, 22 nt, Pseudomonas putida KT2440
caacuguuucugcucuucugcc

SEQ ID NO: 3566041 - RNA, 15 nt, Pseudomonas putida KT2440
caacuuacaaaucag

SEQ ID NO: 3566042 - RNA, 22 nt, Pseudomonas putida KT2440
caacuucccucugccugcccau

SEQ ID NO: 3566043 - RNA, 15 nt, Pseudomonas putida KT2440
caacuucgccgaggc

SEQ ID NO: 3566044 - RNA, 19 nt, Pseudomonas putida KT2440
caacuucgguggcucacau

SEQ ID NO: 3566045 - RNA, 22 nt, Pseudomonas putida KT2440
caacuucgugcucggcacugcu

SEQ ID NO: 3566046 - RNA, 18 nt, Pseudomonas putida KT2440
caacuugauuggaguuuu

SEQ ID NO: 3566047 - RNA, 13 nt, Pseudomonas putida KT2440
caacuuggcaccg

SEQ ID NO: 3566048 - RNA, 16 nt, Pseudomonas putida KT2440
caacuugugcaucaag

SEQ ID NO: 3566049 - RNA, 14 nt, Pseudomonas putida KT2440
caagaaugcccggg

SEQ ID NO: 3566050 - RNA, 23 nt, Pseudomonas putida KT2440
caagaauuucuaccaaccugcca

SEQ ID NO: 3566051 - RNA, 22 nt, Pseudomonas putida KT2440
caagacacggacucauagcuca

SEQ ID NO: 3566052 - RNA, 15 nt, Pseudomonas putida KT2440
caagaccagaaaccc

SEQ ID NO: 3566053 - RNA, 22 nt, Pseudomonas putida KT2440
caagacugcuguggaacagccu

SEQ ID NO: 3566054 - RNA, 16 nt, Pseudomonas putida KT2440
caagagcgacuggugu

SEQ ID NO: 3566055 - RNA, 19 nt, Pseudomonas putida KT2440
caagauaacaccccccagc

SEQ ID NO: 3566056 - RNA, 13 nt, Pseudomonas putida KT2440
caagcacaaggcc

SEQ ID NO: 3566057 - RNA, 15 nt, Pseudomonas putida KT2440
caagcaccgcgcaca

SEQ ID NO: 3566058 - RNA, 14 nt, Pseudomonas putida KT2440
caagcagccacccu

SEQ ID NO: 3566059 - RNA, 21 nt, Pseudomonas putida KT2440
caagcagcgaaugcagcucga

SEQ ID NO: 3566060 - RNA, 16 nt, Pseudomonas putida KT2440
caagcagguaaccgcu

SEQ ID NO: 3566061 - RNA, 15 nt, Pseudomonas putida KT2440
caagcagucccagca

SEQ ID NO: 3566062 - RNA, 18 nt, Pseudomonas putida KT2440
caagcagucccagcaccg

SEQ ID NO: 3566063 - RNA, 17 nt, Pseudomonas putida KT2440
caagcauagccaaacuu

SEQ ID NO: 3566064 - RNA, 22 nt, Pseudomonas putida KT2440
caagcauucgcauuaccagcac

SEQ ID NO: 3566065 - RNA, 21 nt, Pseudomonas putida KT2440
caagccaaugguauugcccga

SEQ ID NO: 3566066 - RNA, 23 nt, Pseudomonas putida KT2440
caagccaaugguauugcccgaca

SEQ ID NO: 3566067 - RNA, 14 nt, Pseudomonas putida KT2440
caagccacgcaccu

SEQ ID NO: 3566068 - RNA, 15 nt, Pseudomonas putida KT2440
caagccacgcaccuc

SEQ ID NO: 3566069 - RNA, 14 nt, Pseudomonas putida KT2440
caagccacgccaga

SEQ ID NO: 3566070 - RNA, 13 nt, Pseudomonas putida KT2440
caagccagccucc

SEQ ID NO: 3566071 - RNA, 23 nt, Pseudomonas putida KT2440
caagccagccuccggcccauccc

SEQ ID NO: 3566072 - RNA, 17 nt, Pseudomonas putida KT2440
caagccauauucagcuu

SEQ ID NO: 3566073 - RNA, 22 nt, Pseudomonas putida KT2440
caagccauccaccagccccagc

SEQ ID NO: 3566074 - RNA, 14 nt, Pseudomonas putida KT2440
caagcccacacacc

SEQ ID NO: 3566075 - RNA, 12 nt, Pseudomonas putida KT2440
caagccccuccu

SEQ ID NO: 3566076 - RNA, 15 nt, Pseudomonas putida KT2440
caagcccgccuucgc

SEQ ID NO: 3566077 - RNA, 19 nt, Pseudomonas putida KT2440
caagcccgcgaagaggcca

SEQ ID NO: 3566078 - RNA, 12 nt, Pseudomonas putida KT2440
caagcccgcucc

SEQ ID NO: 3566079 - RNA, 17 nt, Pseudomonas putida KT2440
caagcccgcucccacag

SEQ ID NO: 3566080 - RNA, 23 nt, Pseudomonas putida KT2440
caagcccgcuccuacaacgaucu

SEQ ID NO: 3566081 - RNA, 19 nt, Pseudomonas putida KT2440
caagcccgcuccuacaggg

SEQ ID NO: 3566082 - RNA, 20 nt, Pseudomonas putida KT2440
caagcccgcuccuacagguu

SEQ ID NO: 3566083 - RNA, 15 nt, Pseudomonas putida KT2440
caagcccgcucgcca

SEQ ID NO: 3566084 - RNA, 17 nt, Pseudomonas putida KT2440
caagcccgcuugcugug

SEQ ID NO: 3566085 - RNA, 14 nt, Pseudomonas putida KT2440
caagcccggcgccu

SEQ ID NO: 3566086 - RNA, 17 nt, Pseudomonas putida KT2440
caagccgagcaucuucc

SEQ ID NO: 3566087 - RNA, 14 nt, Pseudomonas putida KT2440
caagccgccgacca

SEQ ID NO: 3566088 - RNA, 15 nt, Pseudomonas putida KT2440
caagccgccgaccag

SEQ ID NO: 3566089 - RNA, 18 nt, Pseudomonas putida KT2440
caagccgccgaccaggug

SEQ ID NO: 3566090 - RNA, 15 nt, Pseudomonas putida KT2440
caagccgcugccaca

SEQ ID NO: 3566091 - RNA, 18 nt, Pseudomonas putida KT2440
caagccgcugccacaggu

SEQ ID NO: 3566092 - RNA, 20 nt, Pseudomonas putida KT2440
caagccgcuucacuguccug

SEQ ID NO: 3566093 - RNA, 17 nt, Pseudomonas putida KT2440
caagccggcgaacagca

SEQ ID NO: 3566094 - RNA, 22 nt, Pseudomonas putida KT2440
caagccggguuuuuugugccug

SEQ ID NO: 3566095 - RNA, 20 nt, Pseudomonas putida KT2440
caagccuacgcccccagccu

SEQ ID NO: 3566096 - RNA, 18 nt, Pseudomonas putida KT2440
caagccucuacccgccgc

SEQ ID NO: 3566097 - RNA, 19 nt, Pseudomonas putida KT2440
caagccugacucagcccug

SEQ ID NO: 3566098 - RNA, 21 nt, Pseudomonas putida KT2440
caagccugaggcugcgccgau

SEQ ID NO: 3566099 - RNA, 18 nt, Pseudomonas putida KT2440
caagccugccaaaucccu

SEQ ID NO: 3566100 - RNA, 14 nt, Pseudomonas putida KT2440
caagccuugcugau

SEQ ID NO: 3566101 - RNA, 16 nt, Pseudomonas putida KT2440
caagcgaacuauccua

SEQ ID NO: 3566102 - RNA, 22 nt, Pseudomonas putida KT2440
caagcgacgugcaaggaucacc

SEQ ID NO: 3566103 - RNA, 19 nt, Pseudomonas putida KT2440
caagcgagguaggccguca

SEQ ID NO: 3566104 - RNA, 23 nt, Pseudomonas putida KT2440
caagcgaugcacgccagcaucac

SEQ ID NO: 3566105 - RNA, 17 nt, Pseudomonas putida KT2440
caagcgcagcccccacc

SEQ ID NO: 3566106 - RNA, 24 nt, Pseudomonas putida KT2440
caagcgcaggcgguuggccauguu

SEQ ID NO: 3566107 - RNA, 15 nt, Pseudomonas putida KT2440
caagcgcauaggcaa

SEQ ID NO: 3566108 - RNA, 14 nt, Pseudomonas putida KT2440
caagcgccagggca

SEQ ID NO: 3566109 - RNA, 16 nt, Pseudomonas putida KT2440
caagcgccgaugcucg

SEQ ID NO: 3566110 - RNA, 15 nt, Pseudomonas putida KT2440
caagcgcuccccggu

SEQ ID NO: 3566111 - RNA, 16 nt, Pseudomonas putida KT2440
caagcggcacuaccag

SEQ ID NO: 3566112 - RNA, 14 nt, Pseudomonas putida KT2440
caagcggccccaga

SEQ ID NO: 3566113 - RNA, 12 nt, Pseudomonas putida KT2440
caagcggccucg

SEQ ID NO: 3566114 - RNA, 15 nt, Pseudomonas putida KT2440
caagcggccucgacc

SEQ ID NO: 3566115 - RNA, 17 nt, Pseudomonas putida KT2440
caagcgggcagugcaau

SEQ ID NO: 3566116 - RNA, 20 nt, Pseudomonas putida KT2440
caagcggguaaugucccgca

SEQ ID NO: 3566117 - RNA, 17 nt, Pseudomonas putida KT2440
caagcucaucaccaggc

SEQ ID NO: 3566118 - RNA, 22 nt, Pseudomonas putida KT2440
caagcucaucaccaggcccgca

SEQ ID NO: 3566119 - RNA, 16 nt, Pseudomonas putida KT2440
caagcuccccagcaac

SEQ ID NO: 3566120 - RNA, 17 nt, Pseudomonas putida KT2440
caagcuggcaccggcgc

SEQ ID NO: 3566121 - RNA, 19 nt, Pseudomonas putida KT2440
caagcuggcaccggcgcca

SEQ ID NO: 3566122 - RNA, 18 nt, Pseudomonas putida KT2440
caagcuggcgcaagccgu

SEQ ID NO: 3566123 - RNA, 23 nt, Pseudomonas putida KT2440
caagcuggcgcaaucuugccacg

SEQ ID NO: 3566124 - RNA, 15 nt, Pseudomonas putida KT2440
caagcuggucaggug

SEQ ID NO: 3566125 - RNA, 17 nt, Pseudomonas putida KT2440
caagcuggucaggugca

SEQ ID NO: 3566126 - RNA, 20 nt, Pseudomonas putida KT2440
caagcuguacaacgcagccg

SEQ ID NO: 3566127 - RNA, 20 nt, Pseudomonas putida KT2440
caaggaacugcgcugcccca

SEQ ID NO: 3566128 - RNA, 19 nt, Pseudomonas putida KT2440
caaggaagaugaagaaacc

SEQ ID NO: 3566129 - RNA, 16 nt, Pseudomonas putida KT2440
caaggaucaccaaggc

SEQ ID NO: 3566130 - RNA, 18 nt, Pseudomonas putida KT2440
caaggaugucggucaugg

SEQ ID NO: 3566131 - RNA, 22 nt, Pseudomonas putida KT2440
caaggcaaagaagucgccacac

SEQ ID NO: 3566132 - RNA, 17 nt, Pseudomonas putida KT2440
caaggcaaaggucugcu

SEQ ID NO: 3566133 - RNA, 18 nt, Pseudomonas putida KT2440
caaggcaaaggucugcug

SEQ ID NO: 3566134 - RNA, 15 nt, Pseudomonas putida KT2440
caaggcaccaacugc

SEQ ID NO: 3566135 - RNA, 24 nt, Pseudomonas putida KT2440
caaggcagccccugcacaucacgc

SEQ ID NO: 3566136 - RNA, 20 nt, Pseudomonas putida KT2440
caaggcauaaaaaagggccc

SEQ ID NO: 3566137 - RNA, 22 nt, Pseudomonas putida KT2440
caaggcaucggcgccuucgccc

SEQ ID NO: 3566138 - RNA, 19 nt, Pseudomonas putida KT2440
caaggcaucgggaucgauu

SEQ ID NO: 3566139 - RNA, 13 nt, Pseudomonas putida KT2440
caaggccaacugc

SEQ ID NO: 3566140 - RNA, 16 nt, Pseudomonas putida KT2440
caaggccaacugcgcc

SEQ ID NO: 3566141 - RNA, 23 nt, Pseudomonas putida KT2440
caaggccacuggcgucggucgcu

SEQ ID NO: 3566142 - RNA, 16 nt, Pseudomonas putida KT2440
caaggccagcccaugg

SEQ ID NO: 3566143 - RNA, 18 nt, Pseudomonas putida KT2440
caaggccagcccauggcg

SEQ ID NO: 3566144 - RNA, 20 nt, Pseudomonas putida KT2440
caaggccagcccauggcgcu

SEQ ID NO: 3566145 - RNA, 14 nt, Pseudomonas putida KT2440
caaggccagugccg

SEQ ID NO: 3566146 - RNA, 16 nt, Pseudomonas putida KT2440
caaggccagugccgca

SEQ ID NO: 3566147 - RNA, 19 nt, Pseudomonas putida KT2440
caaggccagugccgcaagc

SEQ ID NO: 3566148 - RNA, 20 nt, Pseudomonas putida KT2440
caaggccagugccgcaagca

SEQ ID NO: 3566149 - RNA, 18 nt, Pseudomonas putida KT2440
caaggcccaguucggaca

SEQ ID NO: 3566150 - RNA, 19 nt, Pseudomonas putida KT2440
caaggcccaguucggacag

SEQ ID NO: 3566151 - RNA, 19 nt, Pseudomonas putida KT2440
caaggcccgcgccgacagc

SEQ ID NO: 3566152 - RNA, 14 nt, Pseudomonas putida KT2440
caaggccgcccagu

SEQ ID NO: 3566153 - RNA, 21 nt, Pseudomonas putida KT2440
caaggccgcccaguucagcuc

SEQ ID NO: 3566154 - RNA, 14 nt, Pseudomonas putida KT2440
caaggccgcuccca

SEQ ID NO: 3566155 - RNA, 15 nt, Pseudomonas putida KT2440
caaggccgcucccac

SEQ ID NO: 3566156 - RNA, 19 nt, Pseudomonas putida KT2440
caaggccgcucccacaggu

SEQ ID NO: 3566157 - RNA, 15 nt, Pseudomonas putida KT2440
caaggccggcagcca

SEQ ID NO: 3566158 - RNA, 21 nt, Pseudomonas putida KT2440
caaggccguugcuuucagcuc

SEQ ID NO: 3566159 - RNA, 14 nt, Pseudomonas putida KT2440
caaggccuccaggu

SEQ ID NO: 3566160 - RNA, 17 nt, Pseudomonas putida KT2440
caaggccucgaacagca

SEQ ID NO: 3566161 - RNA, 21 nt, Pseudomonas putida KT2440
caaggccucuaccgcugcucc

SEQ ID NO: 3566162 - RNA, 14 nt, Pseudomonas putida KT2440
caaggccugcacca

SEQ ID NO: 3566163 - RNA, 13 nt, Pseudomonas putida KT2440
caaggcgaacgau

SEQ ID NO: 3566164 - RNA, 17 nt, Pseudomonas putida KT2440
caaggcgaccugccagc

SEQ ID NO: 3566165 - RNA, 15 nt, Pseudomonas putida KT2440
caaggcgcagccaau

SEQ ID NO: 3566166 - RNA, 14 nt, Pseudomonas putida KT2440
caaggcggcccaac

SEQ ID NO: 3566167 - RNA, 22 nt, Pseudomonas putida KT2440
caaggcggcucuugcagcgagu

SEQ ID NO: 3566168 - RNA, 19 nt, Pseudomonas putida KT2440
caaggcguaccugcccccc

SEQ ID NO: 3566169 - RNA, 18 nt, Pseudomonas putida KT2440
caaggcucaagcgcagcc

SEQ ID NO: 3566170 - RNA, 18 nt, Pseudomonas putida KT2440
caaggcugcucuccuggg

SEQ ID NO: 3566171 - RNA, 16 nt, Pseudomonas putida KT2440
caaggcuggcaacccg

SEQ ID NO: 3566172 - RNA, 15 nt, Pseudomonas putida KT2440
caaggcuggccagac

SEQ ID NO: 3566173 - RNA, 17 nt, Pseudomonas putida KT2440
caaggcuggccagacga

SEQ ID NO: 3566174 - RNA, 18 nt, Pseudomonas putida KT2440
caaggcuguuccacagca

SEQ ID NO: 3566175 - RNA, 18 nt, Pseudomonas putida KT2440
caaggcuuuccaccuggc

SEQ ID NO: 3566176 - RNA, 22 nt, Pseudomonas putida KT2440
caaggcuuuccaccuggccacc

SEQ ID NO: 3566177 - RNA, 20 nt, Pseudomonas putida KT2440
caagggauaucaggcccugg

SEQ ID NO: 3566178 - RNA, 19 nt, Pseudomonas putida KT2440
caagggccguuacucccac

SEQ ID NO: 3566179 - RNA, 19 nt, Pseudomonas putida KT2440
caagggccugcaggcagca

SEQ ID NO: 3566180 - RNA, 17 nt, Pseudomonas putida KT2440
caagggcgcugaucaag

SEQ ID NO: 3566181 - RNA, 14 nt, Pseudomonas putida KT2440
caagggggcaaaga

SEQ ID NO: 3566182 - RNA, 21 nt, Pseudomonas putida KT2440
caaggggguguagggugcaau

SEQ ID NO: 3566183 - RNA, 13 nt, Pseudomonas putida KT2440
caagggucgacac

SEQ ID NO: 3566184 - RNA, 17 nt, Pseudomonas putida KT2440
caagguaaucuggcugu

SEQ ID NO: 3566185 - RNA, 16 nt, Pseudomonas putida KT2440
caagguacugaucccu

SEQ ID NO: 3566186 - RNA, 19 nt, Pseudomonas putida KT2440
caagguagccugcugacgc

SEQ ID NO: 3566187 - RNA, 20 nt, Pseudomonas putida KT2440
caagguagccugcugacgca

SEQ ID NO: 3566188 - RNA, 19 nt, Pseudomonas putida KT2440
caagguagcggcggcaaug

SEQ ID NO: 3566189 - RNA, 20 nt, Pseudomonas putida KT2440
caagguagcggcggcaaugg

SEQ ID NO: 3566190 - RNA, 14 nt, Pseudomonas putida KT2440
caaggucagcaagc

SEQ ID NO: 3566191 - RNA, 20 nt, Pseudomonas putida KT2440
caaggucagcuucuggguau

SEQ ID NO: 3566192 - RNA, 16 nt, Pseudomonas putida KT2440
caagguccagccacga

SEQ ID NO: 3566193 - RNA, 15 nt, Pseudomonas putida KT2440
caaggucgccaggcg

SEQ ID NO: 3566194 - RNA, 18 nt, Pseudomonas putida KT2440
caaggugccaacaggcag

SEQ ID NO: 3566195 - RNA, 21 nt, Pseudomonas putida KT2440
caaggugccaacaggcagcau

SEQ ID NO: 3566196 - RNA, 20 nt, Pseudomonas putida KT2440
caagguggcauuggcgugcu

SEQ ID NO: 3566197 - RNA, 18 nt, Pseudomonas putida KT2440
caaggugggguugaccag

SEQ ID NO: 3566198 - RNA, 17 nt, Pseudomonas putida KT2440
caagguugccaccagca

SEQ ID NO: 3566199 - RNA, 21 nt, Pseudomonas putida KT2440
caagguugccaccagcaucaa

SEQ ID NO: 3566200 - RNA, 23 nt, Pseudomonas putida KT2440
caagguugcgcaagccucaggca

SEQ ID NO: 3566201 - RNA, 18 nt, Pseudomonas putida KT2440
caagguuggggccaggcu

SEQ ID NO: 3566202 - RNA, 18 nt, Pseudomonas putida KT2440
caaguacaacugccaccc

SEQ ID NO: 3566203 - RNA, 16 nt, Pseudomonas putida KT2440
caaguacaccggcagc

SEQ ID NO: 3566204 - RNA, 17 nt, Pseudomonas putida KT2440
caaguacaccggcagca

SEQ ID NO: 3566205 - RNA, 15 nt, Pseudomonas putida KT2440
caaguacggccagca

SEQ ID NO: 3566206 - RNA, 13 nt, Pseudomonas putida KT2440
caaguaggcacga

SEQ ID NO: 3566207 - RNA, 20 nt, Pseudomonas putida KT2440
caagucccccaucggcaccc

SEQ ID NO: 3566208 - RNA, 17 nt, Pseudomonas putida KT2440
caaguccgaacucccca

SEQ ID NO: 3566209 - RNA, 23 nt, Pseudomonas putida KT2440
caagucgugccggaacaaccccu

SEQ ID NO: 3566210 - RNA, 15 nt, Pseudomonas putida KT2440
caagugccccuggcu

SEQ ID NO: 3566211 - RNA, 23 nt, Pseudomonas putida KT2440
caagugccucgucaucgaacagu

SEQ ID NO: 3566212 - RNA, 16 nt, Pseudomonas putida KT2440
caaguguuugaagcua

SEQ ID NO: 3566213 - RNA, 14 nt, Pseudomonas putida KT2440
caaguucaagguca

SEQ ID NO: 3566214 - RNA, 16 nt, Pseudomonas putida KT2440
caaguugacccugaau

SEQ ID NO: 3566215 - RNA, 23 nt, Pseudomonas putida KT2440
caaguugacccugaaucagcaaa

SEQ ID NO: 3566216 - RNA, 19 nt, Pseudomonas putida KT2440
caauaacaaguucaagguc

SEQ ID NO: 3566217 - RNA, 19 nt, Pseudomonas putida KT2440
caauaaccggcacaagcgu

SEQ ID NO: 3566218 - RNA, 19 nt, Pseudomonas putida KT2440
caauaacucgcagcgcaaa

SEQ ID NO: 3566219 - RNA, 18 nt, Pseudomonas putida KT2440
caauacacccacaccucg

SEQ ID NO: 3566220 - RNA, 17 nt, Pseudomonas putida KT2440
caauacauacaccaacg

SEQ ID NO: 3566221 - RNA, 16 nt, Pseudomonas putida KT2440
caauacauccaggccc

SEQ ID NO: 3566222 - RNA, 13 nt, Pseudomonas putida KT2440
caauaccagccug

SEQ ID NO: 3566223 - RNA, 23 nt, Pseudomonas putida KT2440
caauaccagccuggccccaccca

SEQ ID NO: 3566224 - RNA, 19 nt, Pseudomonas putida KT2440
caauacccaacagcaucca

SEQ ID NO: 3566225 - RNA, 15 nt, Pseudomonas putida KT2440
caauaccggugcccc

SEQ ID NO: 3566226 - RNA, 13 nt, Pseudomonas putida KT2440
caauagcccaccg

SEQ ID NO: 3566227 - RNA, 24 nt, Pseudomonas putida KT2440
caauagccccgcaaucgucgacca

SEQ ID NO: 3566228 - RNA, 18 nt, Pseudomonas putida KT2440
caauaucaucacugccac

SEQ ID NO: 3566229 - RNA, 13 nt, Pseudomonas putida KT2440
caauaugcaccuu

SEQ ID NO: 3566230 - RNA, 14 nt, Pseudomonas putida KT2440
caaucaaagcagac

SEQ ID NO: 3566231 - RNA, 21 nt, Pseudomonas putida KT2440
caaucaccgccagguccaggc

SEQ ID NO: 3566232 - RNA, 18 nt, Pseudomonas putida KT2440
caaucagcacugugcucg

SEQ ID NO: 3566233 - RNA, 21 nt, Pseudomonas putida KT2440
caaucagcacugugcucgccc

SEQ ID NO: 3566234 - RNA, 18 nt, Pseudomonas putida KT2440
caaucagcgguucgacca

SEQ ID NO: 3566235 - RNA, 16 nt, Pseudomonas putida KT2440
caaucagcucacaggc

SEQ ID NO: 3566236 - RNA, 19 nt, Pseudomonas putida KT2440
caaucagcucacaggcuca

SEQ ID NO: 3566237 - RNA, 21 nt, Pseudomonas putida KT2440
caaucagcucgucagccacca

SEQ ID NO: 3566238 - RNA, 15 nt, Pseudomonas putida KT2440
caaucagcucuucga

SEQ ID NO: 3566239 - RNA, 21 nt, Pseudomonas putida KT2440
caaucaggcugaucaccgccg

SEQ ID NO: 3566240 - RNA, 18 nt, Pseudomonas putida KT2440
caaucaggucaucgaaga

SEQ ID NO: 3566241 - RNA, 18 nt, Pseudomonas putida KT2440
caaucaggucucccgccc

SEQ ID NO: 3566242 - RNA, 21 nt, Pseudomonas putida KT2440
caaucaggucucccgcccccu

SEQ ID NO: 3566243 - RNA, 14 nt, Pseudomonas putida KT2440
caaucaucuugcca

SEQ ID NO: 3566244 - RNA, 13 nt, Pseudomonas putida KT2440
caaucccgcccca

SEQ ID NO: 3566245 - RNA, 22 nt, Pseudomonas putida KT2440
caauccgccacaaacgccgggc

SEQ ID NO: 3566246 - RNA, 18 nt, Pseudomonas putida KT2440
caauccgugagccaggag

SEQ ID NO: 3566247 - RNA, 13 nt, Pseudomonas putida KT2440
caauccucugccc

SEQ ID NO: 3566248 - RNA, 16 nt, Pseudomonas putida KT2440
caauccucugcccgca

SEQ ID NO: 3566249 - RNA, 20 nt, Pseudomonas putida KT2440
caaucgccgggcgcaccaca

SEQ ID NO: 3566250 - RNA, 17 nt, Pseudomonas putida KT2440
caaucgcgucagcaccg

SEQ ID NO: 3566251 - RNA, 17 nt, Pseudomonas putida KT2440
caaucgcugugcaacag

SEQ ID NO: 3566252 - RNA, 18 nt, Pseudomonas putida KT2440
caaucggcucaacagcca

SEQ ID NO: 3566253 - RNA, 20 nt, Pseudomonas putida KT2440
caaucgggauggcaccggca

SEQ ID NO: 3566254 - RNA, 14 nt, Pseudomonas putida KT2440
caaucgggccggcg

SEQ ID NO: 3566255 - RNA, 22 nt, Pseudomonas putida KT2440
caaucgguucgcccgguuccag

SEQ ID NO: 3566256 - RNA, 20 nt, Pseudomonas putida KT2440
caaucucacuuucugcgcug

SEQ ID NO: 3566257 - RNA, 14 nt, Pseudomonas putida KT2440
caaucugcagcagc

SEQ ID NO: 3566258 - RNA, 15 nt, Pseudomonas putida KT2440
caaucugcagcagca

SEQ ID NO: 3566259 - RNA, 13 nt, Pseudomonas putida KT2440
caaucugguuacc

SEQ ID NO: 3566260 - RNA, 23 nt, Pseudomonas putida KT2440
caaucugguuacccaacagacca

SEQ ID NO: 3566261 - RNA, 13 nt, Pseudomonas putida KT2440
caaucuucuucau

SEQ ID NO: 3566262 - RNA, 14 nt, Pseudomonas putida KT2440
caaucuucuucauc

SEQ ID NO: 3566263 - RNA, 16 nt, Pseudomonas putida KT2440
caaucuucuucaucac

SEQ ID NO: 3566264 - RNA, 22 nt, Pseudomonas putida KT2440
caaucuucuucaucacuagauc

SEQ ID NO: 3566265 - RNA, 13 nt, Pseudomonas putida KT2440
caaucuucuugcc

SEQ ID NO: 3566266 - RNA, 24 nt, Pseudomonas putida KT2440
caaugacaauugucgguacuggcu

SEQ ID NO: 3566267 - RNA, 17 nt, Pseudomonas putida KT2440
caaugauccgguccagu

SEQ ID NO: 3566268 - RNA, 22 nt, Pseudomonas putida KT2440
caaugaucgggcagacgacccg

SEQ ID NO: 3566269 - RNA, 16 nt, Pseudomonas putida KT2440
caaugaugaaagcagg

SEQ ID NO: 3566270 - RNA, 17 nt, Pseudomonas putida KT2440
caaugaugauguugccg

SEQ ID NO: 3566271 - RNA, 21 nt, Pseudomonas putida KT2440
caaugaugcguacggccuugg

SEQ ID NO: 3566272 - RNA, 11 nt, Pseudomonas putida KT2440
caaugauggca

SEQ ID NO: 3566273 - RNA, 24 nt, Pseudomonas putida KT2440
caaugcacuucugcuaaucgcugc

SEQ ID NO: 3566274 - RNA, 15 nt, Pseudomonas putida KT2440
caaugcagccccuuc

SEQ ID NO: 3566275 - RNA, 18 nt, Pseudomonas putida KT2440
caaugcagccgcccgccc

SEQ ID NO: 3566276 - RNA, 20 nt, Pseudomonas putida KT2440
caaugcagcuuugaggcuca

SEQ ID NO: 3566277 - RNA, 18 nt, Pseudomonas putida KT2440
caaugcaggcaguaggcc

SEQ ID NO: 3566278 - RNA, 20 nt, Pseudomonas putida KT2440
caaugcaggcaguaggccac

SEQ ID NO: 3566279 - RNA, 22 nt, Pseudomonas putida KT2440
caaugcaggcaguaggccaccg

SEQ ID NO: 3566280 - RNA, 23 nt, Pseudomonas putida KT2440
caaugcaggcaguaggccaccgu

SEQ ID NO: 3566281 - RNA, 15 nt, Pseudomonas putida KT2440
caaugccaguugauc

SEQ ID NO: 3566282 - RNA, 11 nt, Pseudomonas putida KT2440
caaugcccagc

SEQ ID NO: 3566283 - RNA, 15 nt, Pseudomonas putida KT2440
caaugcccagcgcgc

SEQ ID NO: 3566284 - RNA, 20 nt, Pseudomonas putida KT2440
caaugccccgaccaccgccu

SEQ ID NO: 3566285 - RNA, 14 nt, Pseudomonas putida KT2440
caaugccgccuugc

SEQ ID NO: 3566286 - RNA, 19 nt, Pseudomonas putida KT2440
caaugccggcacagcccag

SEQ ID NO: 3566287 - RNA, 16 nt, Pseudomonas putida KT2440
caaugccuuggcccuc

SEQ ID NO: 3566288 - RNA, 18 nt, Pseudomonas putida KT2440
caaugcgagacgccacca

SEQ ID NO: 3566289 - RNA, 19 nt, Pseudomonas putida KT2440
caaugcgccggucgcguuc

SEQ ID NO: 3566290 - RNA, 17 nt, Pseudomonas putida KT2440
caaugcgcgcgaaggcc

SEQ ID NO: 3566291 - RNA, 15 nt, Pseudomonas putida KT2440
caaugcucgccugcu

SEQ ID NO: 3566292 - RNA, 18 nt, Pseudomonas putida KT2440
caaugcugccuuuuccug

SEQ ID NO: 3566293 - RNA, 23 nt, Pseudomonas putida KT2440
caaugcugccuuuuccugcugca

SEQ ID NO: 3566294 - RNA, 15 nt, Pseudomonas putida KT2440
caaugcugcucgccc

SEQ ID NO: 3566295 - RNA, 18 nt, Pseudomonas putida KT2440
caaugcuuucaguugagg

SEQ ID NO: 3566296 - RNA, 18 nt, Pseudomonas putida KT2440
caauggcaaucgccuggc

SEQ ID NO: 3566297 - RNA, 21 nt, Pseudomonas putida KT2440
caauggccacacgcugcugcu

SEQ ID NO: 3566298 - RNA, 18 nt, Pseudomonas putida KT2440
caauggcgaugaacacgc

SEQ ID NO: 3566299 - RNA, 21 nt, Pseudomonas putida KT2440
caauggcgccauuggugcccu

SEQ ID NO: 3566300 - RNA, 16 nt, Pseudomonas putida KT2440
caaugggccgaucacg

SEQ ID NO: 3566301 - RNA, 13 nt, Pseudomonas putida KT2440
caaugggcuuccc

SEQ ID NO: 3566302 - RNA, 19 nt, Pseudomonas putida KT2440
caaugggcuuccccagccu

SEQ ID NO: 3566303 - RNA, 19 nt, Pseudomonas putida KT2440
caauggucauugaaggcca

SEQ ID NO: 3566304 - RNA, 22 nt, Pseudomonas putida KT2440
caauggucauugaaggccagug

SEQ ID NO: 3566305 - RNA, 20 nt, Pseudomonas putida KT2440
caaugguuuaguccugcagc

SEQ ID NO: 3566306 - RNA, 20 nt, Pseudomonas putida KT2440
caaugucgacguacagcagc

SEQ ID NO: 3566307 - RNA, 18 nt, Pseudomonas putida KT2440
caaugucuaaaagcuggc

SEQ ID NO: 3566308 - RNA, 14 nt, Pseudomonas putida KT2440
caauguugaagaug

SEQ ID NO: 3566309 - RNA, 13 nt, Pseudomonas putida KT2440
caauuacuuggcc

SEQ ID NO: 3566310 - RNA, 20 nt, Pseudomonas putida KT2440
caauuacuuugucgccuacc

SEQ ID NO: 3566311 - RNA, 12 nt, Pseudomonas putida KT2440
caauuccaauga

SEQ ID NO: 3566312 - RNA, 14 nt, Pseudomonas putida KT2440
caauuccaaugaga

SEQ ID NO: 3566313 - RNA, 17 nt, Pseudomonas putida KT2440
caauucugaaggugcug

SEQ ID NO: 3566314 - RNA, 15 nt, Pseudomonas putida KT2440
caauugccaccggcg

SEQ ID NO: 3566315 - RNA, 19 nt, Pseudomonas putida KT2440
caauugccaccggcgcugc

SEQ ID NO: 3566316 - RNA, 17 nt, Pseudomonas putida KT2440
caauugcgccagccgcu

SEQ ID NO: 3566317 - RNA, 21 nt, Pseudomonas putida KT2440
caauugcggacucauagcuca

SEQ ID NO: 3566318 - RNA, 17 nt, Pseudomonas putida KT2440
caauugcggguguggcc

SEQ ID NO: 3566319 - RNA, 19 nt, Pseudomonas putida KT2440
caauugcggguguggccac

SEQ ID NO: 3566320 - RNA, 16 nt, Pseudomonas putida KT2440
caauugcucuuguucc

SEQ ID NO: 3566321 - RNA, 15 nt, Pseudomonas putida KT2440
caauugguuaaaagc

SEQ ID NO: 3566322 - RNA, 17 nt, Pseudomonas putida KT2440
caauugguuaaaagcca

SEQ ID NO: 3566323 - RNA, 18 nt, Pseudomonas putida KT2440
caauugguuaaaagccaa

SEQ ID NO: 3566324 - RNA, 18 nt, Pseudomonas putida KT2440
caauugucgguacuggcu

SEQ ID NO: 3566325 - RNA, 20 nt, Pseudomonas putida KT2440
caauuucccccaaaugcccg

SEQ ID NO: 3566326 - RNA, 20 nt, Pseudomonas putida KT2440
cacaaaaaagcagggccgcg

SEQ ID NO: 3566327 - RNA, 23 nt, Pseudomonas putida KT2440
cacaaaaccucaguuuuucuccg

SEQ ID NO: 3566328 - RNA, 13 nt, Pseudomonas putida KT2440
cacaaaaccuucc

SEQ ID NO: 3566329 - RNA, 16 nt, Pseudomonas putida KT2440
cacaaaaucacaggcc

SEQ ID NO: 3566330 - RNA, 19 nt, Pseudomonas putida KT2440
cacaaacaccggcccccca

SEQ ID NO: 3566331 - RNA, 21 nt, Pseudomonas putida KT2440
cacaaacaccggccccccagc

SEQ ID NO: 3566332 - RNA, 16 nt, Pseudomonas putida KT2440
cacaaaccacagcggc

SEQ ID NO: 3566333 - RNA, 22 nt, Pseudomonas putida KT2440
cacaaacgccgggcacaucacc

SEQ ID NO: 3566334 - RNA, 13 nt, Pseudomonas putida KT2440
cacaaagcccaag

SEQ ID NO: 3566335 - RNA, 18 nt, Pseudomonas putida KT2440
cacaacccaucacggccu

SEQ ID NO: 3566336 - RNA, 18 nt, Pseudomonas putida KT2440
cacaaccccugcaaggcc

SEQ ID NO: 3566337 - RNA, 22 nt, Pseudomonas putida KT2440
cacaacccggggaaagguuugu

SEQ ID NO: 3566338 - RNA, 17 nt, Pseudomonas putida KT2440
cacaaccgaacccgcug

SEQ ID NO: 3566339 - RNA, 23 nt, Pseudomonas putida KT2440
cacaaccgaacccgcugccaccc

SEQ ID NO: 3566340 - RNA, 15 nt, Pseudomonas putida KT2440
cacaacgcgcauccc

SEQ ID NO: 3566341 - RNA, 22 nt, Pseudomonas putida KT2440
cacaacgcgccaccgccgugcc

SEQ ID NO: 3566342 - RNA, 19 nt, Pseudomonas putida KT2440
cacaacggcgcgcccggcg

SEQ ID NO: 3566343 - RNA, 21 nt, Pseudomonas putida KT2440
cacaacggcgcgcccggcgca

SEQ ID NO: 3566344 - RNA, 23 nt, Pseudomonas putida KT2440
cacaacggcgcgcccggcgcauu

SEQ ID NO: 3566345 - RNA, 19 nt, Pseudomonas putida KT2440
cacaagcgucccugcccga

SEQ ID NO: 3566346 - RNA, 19 nt, Pseudomonas putida KT2440
cacaaggccgcucccacag

SEQ ID NO: 3566347 - RNA, 20 nt, Pseudomonas putida KT2440
cacaaggcucaagcgcagcc

SEQ ID NO: 3566348 - RNA, 15 nt, Pseudomonas putida KT2440
cacaaggcuguucca

SEQ ID NO: 3566349 - RNA, 20 nt, Pseudomonas putida KT2440
cacaaggcuguuccacagca

SEQ ID NO: 3566350 - RNA, 21 nt, Pseudomonas putida KT2440
cacaaggugcuacggaacugc

SEQ ID NO: 3566351 - RNA, 16 nt, Pseudomonas putida KT2440
cacaaguccgaacucc

SEQ ID NO: 3566352 - RNA, 12 nt, Pseudomonas putida KT2440
cacaaguuucaa

SEQ ID NO: 3566353 - RNA, 19 nt, Pseudomonas putida KT2440
cacaauaagaugcggcgcc

SEQ ID NO: 3566354 - RNA, 22 nt, Pseudomonas putida KT2440
cacaauaagaugcggcgccguc

SEQ ID NO: 3566355 - RNA, 17 nt, Pseudomonas putida KT2440
cacaauggcgcacaggg

SEQ ID NO: 3566356 - RNA, 16 nt, Pseudomonas putida KT2440
cacacaaacaccggcc

SEQ ID NO: 3566357 - RNA, 15 nt, Pseudomonas putida KT2440
cacacaagccccccu

SEQ ID NO: 3566358 - RNA, 22 nt, Pseudomonas putida KT2440
cacacaagccccccuguaggag

SEQ ID NO: 3566359 - RNA, 17 nt, Pseudomonas putida KT2440
cacacaccgcaacccag

SEQ ID NO: 3566360 - RNA, 20 nt, Pseudomonas putida KT2440
cacacaccgcaacccagccc

SEQ ID NO: 3566361 - RNA, 20 nt, Pseudomonas putida KT2440
cacacacucuuccugccgca

SEQ ID NO: 3566362 - RNA, 14 nt, Pseudomonas putida KT2440
cacaccaauggcca

SEQ ID NO: 3566363 - RNA, 13 nt, Pseudomonas putida KT2440
cacaccacagcug

SEQ ID NO: 3566364 - RNA, 16 nt, Pseudomonas putida KT2440
cacaccacgccaaccu

SEQ ID NO: 3566365 - RNA, 17 nt, Pseudomonas putida KT2440
cacacccagcgcggcaa

SEQ ID NO: 3566366 - RNA, 22 nt, Pseudomonas putida KT2440
cacacccucgccccgcgcaagc

SEQ ID NO: 3566367 - RNA, 12 nt, Pseudomonas putida KT2440
cacacccugcga

SEQ ID NO: 3566368 - RNA, 20 nt, Pseudomonas putida KT2440
cacaccgagccauugacccg

SEQ ID NO: 3566369 - RNA, 13 nt, Pseudomonas putida KT2440
cacaccgaucacu

SEQ ID NO: 3566370 - RNA, 13 nt, Pseudomonas putida KT2440
cacaccgcgcacc

SEQ ID NO: 3566371 - RNA, 13 nt, Pseudomonas putida KT2440
cacaccggcaauc

SEQ ID NO: 3566372 - RNA, 16 nt, Pseudomonas putida KT2440
cacaccggccgccagg

SEQ ID NO: 3566373 - RNA, 18 nt, Pseudomonas putida KT2440
cacaccguacugcuucau

SEQ ID NO: 3566374 - RNA, 19 nt, Pseudomonas putida KT2440
cacaccugccaggccaaac

SEQ ID NO: 3566375 - RNA, 17 nt, Pseudomonas putida KT2440
cacaccuggugcgccuu

SEQ ID NO: 3566376 - RNA, 13 nt, Pseudomonas putida KT2440
cacacgcaccacc

SEQ ID NO: 3566377 - RNA, 14 nt, Pseudomonas putida KT2440
cacacgcaccaccc

SEQ ID NO: 3566378 - RNA, 17 nt, Pseudomonas putida KT2440
cacacggcagccccaac

SEQ ID NO: 3566379 - RNA, 14 nt, Pseudomonas putida KT2440
cacacgggcguuca

SEQ ID NO: 3566380 - RNA, 20 nt, Pseudomonas putida KT2440
cacacgguaggcgucuucca

SEQ ID NO: 3566381 - RNA, 17 nt, Pseudomonas putida KT2440
cacacgucgccugggca

SEQ ID NO: 3566382 - RNA, 17 nt, Pseudomonas putida KT2440
cacacuacacgaucacu

SEQ ID NO: 3566383 - RNA, 22 nt, Pseudomonas putida KT2440
cacacuacacgaucacuccugg

SEQ ID NO: 3566384 - RNA, 15 nt, Pseudomonas putida KT2440
cacacucagccgcug

SEQ ID NO: 3566385 - RNA, 19 nt, Pseudomonas putida KT2440
cacacucagccgcugcgcc

SEQ ID NO: 3566386 - RNA, 23 nt, Pseudomonas putida KT2440
cacacucagccgcugcgccugcc

SEQ ID NO: 3566387 - RNA, 13 nt, Pseudomonas putida KT2440
cacacucgccccc

SEQ ID NO: 3566388 - RNA, 14 nt, Pseudomonas putida KT2440
cacacucgccccca

SEQ ID NO: 3566389 - RNA, 14 nt, Pseudomonas putida KT2440
cacacugcccagca

SEQ ID NO: 3566390 - RNA, 21 nt, Pseudomonas putida KT2440
cacacugcucagugcuggcgu

SEQ ID NO: 3566391 - RNA, 22 nt, Pseudomonas putida KT2440
cacacugcucgucaaaccggca

SEQ ID NO: 3566392 - RNA, 16 nt, Pseudomonas putida KT2440
cacacuggucacgcuc

SEQ ID NO: 3566393 - RNA, 21 nt, Pseudomonas putida KT2440
cacagaacaauaaaacuaccu

SEQ ID NO: 3566394 - RNA, 15 nt, Pseudomonas putida KT2440
cacagacaccacaaa

SEQ ID NO: 3566395 - RNA, 17 nt, Pseudomonas putida KT2440
cacagaccgcaacaguu

SEQ ID NO: 3566396 - RNA, 22 nt, Pseudomonas putida KT2440
cacagauaaaccugccacccau

SEQ ID NO: 3566397 - RNA, 16 nt, Pseudomonas putida KT2440
cacagauacuggcgcu

SEQ ID NO: 3566398 - RNA, 16 nt, Pseudomonas putida KT2440
cacagauauugcaccg

SEQ ID NO: 3566399 - RNA, 18 nt, Pseudomonas putida KT2440
cacagaucaacgccgcca

SEQ ID NO: 3566400 - RNA, 14 nt, Pseudomonas putida KT2440
cacagaugccgccg

SEQ ID NO: 3566401 - RNA, 22 nt, Pseudomonas putida KT2440
cacagaugccgccgcugccagc

SEQ ID NO: 3566402 - RNA, 14 nt, Pseudomonas putida KT2440
cacagcaaaaaauc

SEQ ID NO: 3566403 - RNA, 23 nt, Pseudomonas putida KT2440
cacagcacucguugaagcgguug

SEQ ID NO: 3566404 - RNA, 15 nt, Pseudomonas putida KT2440
cacagcagaucacaa

SEQ ID NO: 3566405 - RNA, 19 nt, Pseudomonas putida KT2440
cacagcagaucacaaaguu

SEQ ID NO: 3566406 - RNA, 16 nt, Pseudomonas putida KT2440
cacagcaggccaagga

SEQ ID NO: 3566407 - RNA, 17 nt, Pseudomonas putida KT2440
cacagcaucacccgcga

SEQ ID NO: 3566408 - RNA, 18 nt, Pseudomonas putida KT2440
cacagcaucagcacacgc

SEQ ID NO: 3566409 - RNA, 19 nt, Pseudomonas putida KT2440
cacagcaucagcacacgcc

SEQ ID NO: 3566410 - RNA, 20 nt, Pseudomonas putida KT2440
cacagcauuacgcggcagca

SEQ ID NO: 3566411 - RNA, 12 nt, Pseudomonas putida KT2440
cacagccaagcc

SEQ ID NO: 3566412 - RNA, 12 nt, Pseudomonas putida KT2440
cacagccaugcc

SEQ ID NO: 3566413 - RNA, 18 nt, Pseudomonas putida KT2440
cacagccaugccggcaac

SEQ ID NO: 3566414 - RNA, 19 nt, Pseudomonas putida KT2440
cacagccauuggcccacgc

SEQ ID NO: 3566415 - RNA, 15 nt, Pseudomonas putida KT2440
cacagcccaaagggc

SEQ ID NO: 3566416 - RNA, 21 nt, Pseudomonas putida KT2440
cacagcccaaggcuggccaga

SEQ ID NO: 3566417 - RNA, 12 nt, Pseudomonas putida KT2440
cacagcccagcu

SEQ ID NO: 3566418 - RNA, 14 nt, Pseudomonas putida KT2440
cacagccgagggca

SEQ ID NO: 3566419 - RNA, 20 nt, Pseudomonas putida KT2440
cacagccuccaguugcucca

SEQ ID NO: 3566420 - RNA, 14 nt, Pseudomonas putida KT2440
cacagcgagcagcc

SEQ ID NO: 3566421 - RNA, 16 nt, Pseudomonas putida KT2440
cacagcgccgcggcca

SEQ ID NO: 3566422 - RNA, 22 nt, Pseudomonas putida KT2440
cacagcgcggaacacacgcucc

SEQ ID NO: 3566423 - RNA, 17 nt, Pseudomonas putida KT2440
cacagcggcagacacag

SEQ ID NO: 3566424 - RNA, 18 nt, Pseudomonas putida KT2440
cacagcggcagacacagg

SEQ ID NO: 3566425 - RNA, 15 nt, Pseudomonas putida KT2440
cacagcggccacagc

SEQ ID NO: 3566426 - RNA, 19 nt, Pseudomonas putida KT2440
cacagcggccuugaccacu

SEQ ID NO: 3566427 - RNA, 17 nt, Pseudomonas putida KT2440
cacagcucgcgcugcca

SEQ ID NO: 3566428 - RNA, 18 nt, Pseudomonas putida KT2440
cacagcucgcgcugccag

SEQ ID NO: 3566429 - RNA, 19 nt, Pseudomonas putida KT2440
cacagcucgcgcugccagg

SEQ ID NO: 3566430 - RNA, 18 nt, Pseudomonas putida KT2440
cacagcugcacaucucca

SEQ ID NO: 3566431 - RNA, 18 nt, Pseudomonas putida KT2440
cacaggaaucaccagacc

SEQ ID NO: 3566432 - RNA, 13 nt, Pseudomonas putida KT2440
cacaggaauggca

SEQ ID NO: 3566433 - RNA, 16 nt, Pseudomonas putida KT2440
cacaggaauggcacca

SEQ ID NO: 3566434 - RNA, 15 nt, Pseudomonas putida KT2440
cacaggcacaggccc

SEQ ID NO: 3566435 - RNA, 17 nt, Pseudomonas putida KT2440
cacaggcacaggcccag

SEQ ID NO: 3566436 - RNA, 23 nt, Pseudomonas putida KT2440
cacaggccagccagguauggcca

SEQ ID NO: 3566437 - RNA, 16 nt, Pseudomonas putida KT2440
cacaggccagccccag

SEQ ID NO: 3566438 - RNA, 17 nt, Pseudomonas putida KT2440
cacaggccagccccagc

SEQ ID NO: 3566439 - RNA, 16 nt, Pseudomonas putida KT2440
cacaggcgcacacgcu

SEQ ID NO: 3566440 - RNA, 16 nt, Pseudomonas putida KT2440
cacaggcgcagcagcu

SEQ ID NO: 3566441 - RNA, 15 nt, Pseudomonas putida KT2440
cacaggcgccccggc

SEQ ID NO: 3566442 - RNA, 15 nt, Pseudomonas putida KT2440
cacaggcgcugaaac

SEQ ID NO: 3566443 - RNA, 17 nt, Pseudomonas putida KT2440
cacaggcgcugaaacug

SEQ ID NO: 3566444 - RNA, 17 nt, Pseudomonas putida KT2440
cacaggcgcuugaagaa

SEQ ID NO: 3566445 - RNA, 22 nt, Pseudomonas putida KT2440
cacaggcggauguucuugaccu

SEQ ID NO: 3566446 - RNA, 16 nt, Pseudomonas putida KT2440
cacaggcuacgcagca

SEQ ID NO: 3566447 - RNA, 19 nt, Pseudomonas putida KT2440
cacaggcuacgcagcaccc

SEQ ID NO: 3566448 - RNA, 20 nt, Pseudomonas putida KT2440
cacaggcuuacaacugcucc

SEQ ID NO: 3566449 - RNA, 23 nt, Pseudomonas putida KT2440
cacagggcaaacaccuugccccg

SEQ ID NO: 3566450 - RNA, 13 nt, Pseudomonas putida KT2440
cacagggcggcca

SEQ ID NO: 3566451 - RNA, 17 nt, Pseudomonas putida KT2440
cacagggcggccaaggc

SEQ ID NO: 3566452 - RNA, 23 nt, Pseudomonas putida KT2440
cacagggcggccaaggcguggcu

SEQ ID NO: 3566453 - RNA, 19 nt, Pseudomonas putida KT2440
cacaggggaucgcgcaagc

SEQ ID NO: 3566454 - RNA, 19 nt, Pseudomonas putida KT2440
cacaggggccgcgcagccu

SEQ ID NO: 3566455 - RNA, 23 nt, Pseudomonas putida KT2440
cacaggggcuguauagcccugcc

SEQ ID NO: 3566456 - RNA, 21 nt, Pseudomonas putida KT2440
cacagguaagucacaggcuuc

SEQ ID NO: 3566457 - RNA, 17 nt, Pseudomonas putida KT2440
cacagguaccaggcugc

SEQ ID NO: 3566458 - RNA, 18 nt, Pseudomonas putida KT2440
cacagguacucgcaagcu

SEQ ID NO: 3566459 - RNA, 15 nt, Pseudomonas putida KT2440
cacagguacugcgca

SEQ ID NO: 3566460 - RNA, 22 nt, Pseudomonas putida KT2440
cacagguagguuuucggcugga

SEQ ID NO: 3566461 - RNA, 17 nt, Pseudomonas putida KT2440
cacagguaucgccgccc

SEQ ID NO: 3566462 - RNA, 15 nt, Pseudomonas putida KT2440
cacaggucauuugca

SEQ ID NO: 3566463 - RNA, 20 nt, Pseudomonas putida KT2440
cacaggucucgaacgcugug

SEQ ID NO: 3566464 - RNA, 22 nt, Pseudomonas putida KT2440
cacaggucucgaacgcugugcc

SEQ ID NO: 3566465 - RNA, 15 nt, Pseudomonas putida KT2440
cacaggugacaagcu

SEQ ID NO: 3566466 - RNA, 16 nt, Pseudomonas putida KT2440
cacaggugacaagcug

SEQ ID NO: 3566467 - RNA, 19 nt, Pseudomonas putida KT2440
cacaggugcagcacagguc

SEQ ID NO: 3566468 - RNA, 18 nt, Pseudomonas putida KT2440
cacagugguguacagcaa

SEQ ID NO: 3566469 - RNA, 22 nt, Pseudomonas putida KT2440
cacagugguguacagcaacacc

SEQ ID NO: 3566470 - RNA, 15 nt, Pseudomonas putida KT2440
cacagugucccggcc

SEQ ID NO: 3566471 - RNA, 22 nt, Pseudomonas putida KT2440
cacaguucgaaaaccugcugac

SEQ ID NO: 3566472 - RNA, 13 nt, Pseudomonas putida KT2440
cacauaaggcagc

SEQ ID NO: 3566473 - RNA, 18 nt, Pseudomonas putida KT2440
cacauaccucaucaguuc

SEQ ID NO: 3566474 - RNA, 23 nt, Pseudomonas putida KT2440
cacauacugcuucugccguucac

SEQ ID NO: 3566475 - RNA, 14 nt, Pseudomonas putida KT2440
cacauagaacaggu

SEQ ID NO: 3566476 - RNA, 20 nt, Pseudomonas putida KT2440
cacauagcgcacuugcacuu

SEQ ID NO: 3566477 - RNA, 14 nt, Pseudomonas putida KT2440
cacauaggccagcu

SEQ ID NO: 3566478 - RNA, 17 nt, Pseudomonas putida KT2440
cacauagucgauaccca

SEQ ID NO: 3566479 - RNA, 20 nt, Pseudomonas putida KT2440
cacauagucgauacccaggc

SEQ ID NO: 3566480 - RNA, 22 nt, Pseudomonas putida KT2440
cacaucaaaagggugaugcccg

SEQ ID NO: 3566481 - RNA, 14 nt, Pseudomonas putida KT2440
cacaucacacagcg

SEQ ID NO: 3566482 - RNA, 23 nt, Pseudomonas putida KT2440
cacaucacacagcggcagacaca

SEQ ID NO: 3566483 - RNA, 17 nt, Pseudomonas putida KT2440
cacaucaccugcuuuca

SEQ ID NO: 3566484 - RNA, 15 nt, Pseudomonas putida KT2440
cacaucacgcgaccu

SEQ ID NO: 3566485 - RNA, 22 nt, Pseudomonas putida KT2440
cacaucacguuuggcagugcca

SEQ ID NO: 3566486 - RNA, 14 nt, Pseudomonas putida KT2440
cacaucacugcugu

SEQ ID NO: 3566487 - RNA, 14 nt, Pseudomonas putida KT2440
cacaucaucgcccu

SEQ ID NO: 3566488 - RNA, 14 nt, Pseudomonas putida KT2440
cacauccacagccu

SEQ ID NO: 3566489 - RNA, 18 nt, Pseudomonas putida KT2440
cacauccacagccuccag

SEQ ID NO: 3566490 - RNA, 14 nt, Pseudomonas putida KT2440
cacauccaccgcuc

SEQ ID NO: 3566491 - RNA, 13 nt, Pseudomonas putida KT2440
cacauccagcgcc

SEQ ID NO: 3566492 - RNA, 14 nt, Pseudomonas putida KT2440
cacauccagcgccg

SEQ ID NO: 3566493 - RNA, 17 nt, Pseudomonas putida KT2440
cacauccagcgccgcgc

SEQ ID NO: 3566494 - RNA, 23 nt, Pseudomonas putida KT2440
cacauccagcgccgcgccaccga

SEQ ID NO: 3566495 - RNA, 15 nt, Pseudomonas putida KT2440
cacauccagcgccuc

SEQ ID NO: 3566496 - RNA, 15 nt, Pseudomonas putida KT2440
cacauccgaccccag

SEQ ID NO: 3566497 - RNA, 15 nt, Pseudomonas putida KT2440
cacauccucaaaggc

SEQ ID NO: 3566498 - RNA, 16 nt, Pseudomonas putida KT2440
cacauccucaaaggca

SEQ ID NO: 3566499 - RNA, 16 nt, Pseudomonas putida KT2440
cacauccucugcccgc

SEQ ID NO: 3566500 - RNA, 15 nt, Pseudomonas putida KT2440
cacauccugcucguc

SEQ ID NO: 3566501 - RNA, 19 nt, Pseudomonas putida KT2440
cacaucgaucaggucgaca

SEQ ID NO: 3566502 - RNA, 20 nt, Pseudomonas putida KT2440
cacaucgcuucugcacuccc

SEQ ID NO: 3566503 - RNA, 23 nt, Pseudomonas putida KT2440
cacaucgcuucugcacucccgcu

SEQ ID NO: 3566504 - RNA, 15 nt, Pseudomonas putida KT2440
cacaucggcaaucgc

SEQ ID NO: 3566505 - RNA, 15 nt, Pseudomonas putida KT2440
cacaucggcgcgccc

SEQ ID NO: 3566506 - RNA, 17 nt, Pseudomonas putida KT2440
cacaucggcgcgcccuc

SEQ ID NO: 3566507 - RNA, 13 nt, Pseudomonas putida KT2440
cacaucggcggca

SEQ ID NO: 3566508 - RNA, 15 nt, Pseudomonas putida KT2440
cacaucggcggcaau

SEQ ID NO: 3566509 - RNA, 23 nt, Pseudomonas putida KT2440
cacaucggcggcaaugucgucca

SEQ ID NO: 3566510 - RNA, 16 nt, Pseudomonas putida KT2440
cacaucggucggcccc

SEQ ID NO: 3566511 - RNA, 16 nt, Pseudomonas putida KT2440
cacaucguccgccgcg

SEQ ID NO: 3566512 - RNA, 22 nt, Pseudomonas putida KT2440
cacaucuccacugcgccaaacc

SEQ ID NO: 3566513 - RNA, 23 nt, Pseudomonas putida KT2440
cacaucugggguuggacccaggc

SEQ ID NO: 3566514 - RNA, 15 nt, Pseudomonas putida KT2440
cacaugaagccgcgc

SEQ ID NO: 3566515 - RNA, 12 nt, Pseudomonas putida KT2440
cacaugcagguu

SEQ ID NO: 3566516 - RNA, 13 nt, Pseudomonas putida KT2440
cacaugccauacc

SEQ ID NO: 3566517 - RNA, 14 nt, Pseudomonas putida KT2440
cacaugcccgcggc

SEQ ID NO: 3566518 - RNA, 20 nt, Pseudomonas putida KT2440
cacaugcccgcggcucaccc

SEQ ID NO: 3566519 - RNA, 23 nt, Pseudomonas putida KT2440
cacaugcccgcggcucacccacc

SEQ ID NO: 3566520 - RNA, 16 nt, Pseudomonas putida KT2440
cacaugcgagccgcug

SEQ ID NO: 3566521 - RNA, 19 nt, Pseudomonas putida KT2440
cacaugcgagccgcugcca

SEQ ID NO: 3566522 - RNA, 13 nt, Pseudomonas putida KT2440
cacaugcgccaca

SEQ ID NO: 3566523 - RNA, 15 nt, Pseudomonas putida KT2440
cacaugcgccacacc

SEQ ID NO: 3566524 - RNA, 16 nt, Pseudomonas putida KT2440
cacaugcugcgcccca

SEQ ID NO: 3566525 - RNA, 18 nt, Pseudomonas putida KT2440
cacauguaggcgccgauc

SEQ ID NO: 3566526 - RNA, 22 nt, Pseudomonas putida KT2440
cacauuccgcacgucagacuuu

SEQ ID NO: 3566527 - RNA, 13 nt, Pseudomonas putida KT2440
cacauucuccagu

SEQ ID NO: 3566528 - RNA, 15 nt, Pseudomonas putida KT2440
cacauugcgauguau

SEQ ID NO: 3566529 - RNA, 14 nt, Pseudomonas putida KT2440
cacauuucacagca

SEQ ID NO: 3566530 - RNA, 20 nt, Pseudomonas putida KT2440
cacauuucacagcaaaaaau

SEQ ID NO: 3566531 - RNA, 17 nt, Pseudomonas putida KT2440
caccaacagcaccggcc

SEQ ID NO: 3566532 - RNA, 17 nt, Pseudomonas putida KT2440
caccaacccacggcaau

SEQ ID NO: 3566533 - RNA, 19 nt, Pseudomonas putida KT2440
caccaacgcauuuucauca

SEQ ID NO: 3566534 - RNA, 21 nt, Pseudomonas putida KT2440
caccaacgcauuuucaucaaa

SEQ ID NO: 3566535 - RNA, 15 nt, Pseudomonas putida KT2440
caccaacggcuucac

SEQ ID NO: 3566536 - RNA, 13 nt, Pseudomonas putida KT2440
caccaacugccug

SEQ ID NO: 3566537 - RNA, 21 nt, Pseudomonas putida KT2440
caccaagcccuucucgcucag

SEQ ID NO: 3566538 - RNA, 14 nt, Pseudomonas putida KT2440
caccaaucugugua

SEQ ID NO: 3566539 - RNA, 18 nt, Pseudomonas putida KT2440
caccaaugacuccgcccc

SEQ ID NO: 3566540 - RNA, 22 nt, Pseudomonas putida KT2440
caccaauguguauccaccccca

SEQ ID NO: 3566541 - RNA, 15 nt, Pseudomonas putida KT2440
caccacaaaccacag

SEQ ID NO: 3566542 - RNA, 16 nt, Pseudomonas putida KT2440
caccacaaaccacagc

SEQ ID NO: 3566543 - RNA, 20 nt, Pseudomonas putida KT2440
caccacaaaccacagcggcc

SEQ ID NO: 3566544 - RNA, 16 nt, Pseudomonas putida KT2440
caccacaacgcggcgc

SEQ ID NO: 3566545 - RNA, 15 nt, Pseudomonas putida KT2440
caccacaagaacugc

SEQ ID NO: 3566546 - RNA, 15 nt, Pseudomonas putida KT2440
caccacagcugcaca

SEQ ID NO: 3566547 - RNA, 16 nt, Pseudomonas putida KT2440
caccacagcugcacau

SEQ ID NO: 3566548 - RNA, 16 nt, Pseudomonas putida KT2440
caccacagcugcgcca

SEQ ID NO: 3566549 - RNA, 15 nt, Pseudomonas putida KT2440
caccacauacggcgc

SEQ ID NO: 3566550 - RNA, 17 nt, Pseudomonas putida KT2440
caccacauacggcgcac

SEQ ID NO: 3566551 - RNA, 15 nt, Pseudomonas putida KT2440
caccacaucggcggc

SEQ ID NO: 3566552 - RNA, 13 nt, Pseudomonas putida KT2440
caccaccagcccg

SEQ ID NO: 3566553 - RNA, 15 nt, Pseudomonas putida KT2440
caccaccagcgcccu

SEQ ID NO: 3566554 - RNA, 10 nt, Pseudomonas putida KT2440
caccaccagg

SEQ ID NO: 3566555 - RNA, 15 nt, Pseudomonas putida KT2440
caccacccaccagca

SEQ ID NO: 3566556 - RNA, 21 nt, Pseudomonas putida KT2440
caccacccaccagcagugccc

SEQ ID NO: 3566557 - RNA, 13 nt, Pseudomonas putida KT2440
caccacccccagc

SEQ ID NO: 3566558 - RNA, 21 nt, Pseudomonas putida KT2440
caccacccccagcgaccagcu

SEQ ID NO: 3566559 - RNA, 20 nt, Pseudomonas putida KT2440
caccacccggucggccagcu

SEQ ID NO: 3566560 - RNA, 22 nt, Pseudomonas putida KT2440
caccaccgagugcggcaggccg

SEQ ID NO: 3566561 - RNA, 21 nt, Pseudomonas putida KT2440
caccaccggacgcuugccacc

SEQ ID NO: 3566562 - RNA, 17 nt, Pseudomonas putida KT2440
caccaccggccgacccg

SEQ ID NO: 3566563 - RNA, 13 nt, Pseudomonas putida KT2440
caccacgaacagu

SEQ ID NO: 3566564 - RNA, 15 nt, Pseudomonas putida KT2440
caccacgaacagugg

SEQ ID NO: 3566565 - RNA, 20 nt, Pseudomonas putida KT2440
caccacgaacaguggcccga

SEQ ID NO: 3566566 - RNA, 18 nt, Pseudomonas putida KT2440
caccacgaacgcccccag

SEQ ID NO: 3566567 - RNA, 20 nt, Pseudomonas putida KT2440
caccacgaacgcccccagcc

SEQ ID NO: 3566568 - RNA, 21 nt, Pseudomonas putida KT2440
caccacgaacgcccccagccc

SEQ ID NO: 3566569 - RNA, 15 nt, Pseudomonas putida KT2440
caccacgaagcgcgg

SEQ ID NO: 3566570 - RNA, 21 nt, Pseudomonas putida KT2440
caccacgaagcgcggcaaggu

SEQ ID NO: 3566571 - RNA, 14 nt, Pseudomonas putida KT2440
caccacgaucacgc

SEQ ID NO: 3566572 - RNA, 15 nt, Pseudomonas putida KT2440
caccacgaucacgcc

SEQ ID NO: 3566573 - RNA, 16 nt, Pseudomonas putida KT2440
caccacgaucacgccc

SEQ ID NO: 3566574 - RNA, 17 nt, Pseudomonas putida KT2440
caccacgaucacgcccg

SEQ ID NO: 3566575 - RNA, 19 nt, Pseudomonas putida KT2440
caccacgaucacgcccggg

SEQ ID NO: 3566576 - RNA, 16 nt, Pseudomonas putida KT2440
caccacgaugccuggg

SEQ ID NO: 3566577 - RNA, 17 nt, Pseudomonas putida KT2440
caccacgccaccaugcu

SEQ ID NO: 3566578 - RNA, 17 nt, Pseudomonas putida KT2440
caccacgcccgccggca

SEQ ID NO: 3566579 - RNA, 14 nt, Pseudomonas putida KT2440
caccacgcccugca

SEQ ID NO: 3566580 - RNA, 19 nt, Pseudomonas putida KT2440
caccacgcccuggcccgcc

SEQ ID NO: 3566581 - RNA, 15 nt, Pseudomonas putida KT2440
caccacggaaggcca

SEQ ID NO: 3566582 - RNA, 23 nt, Pseudomonas putida KT2440
caccacggcaguggccgaguugg

SEQ ID NO: 3566583 - RNA, 21 nt, Pseudomonas putida KT2440
caccacggccuggccugcaug

SEQ ID NO: 3566584 - RNA, 22 nt, Pseudomonas putida KT2440
caccacggcggcgaucagcgcg

SEQ ID NO: 3566585 - RNA, 24 nt, Pseudomonas putida KT2440
caccacggcggcgaucagcgcggu

SEQ ID NO: 3566586 - RNA, 15 nt, Pseudomonas putida KT2440
caccacggucggccu

SEQ ID NO: 3566587 - RNA, 17 nt, Pseudomonas putida KT2440
caccacggucggccugc

SEQ ID NO: 3566588 - RNA, 20 nt, Pseudomonas putida KT2440
caccacggucggccugcgcu

SEQ ID NO: 3566589 - RNA, 22 nt, Pseudomonas putida KT2440
caccacgguggcugccacgggc

SEQ ID NO: 3566590 - RNA, 17 nt, Pseudomonas putida KT2440
caccacgucacgcacca

SEQ ID NO: 3566591 - RNA, 17 nt, Pseudomonas putida KT2440
caccacguccggccagc

SEQ ID NO: 3566592 - RNA, 21 nt, Pseudomonas putida KT2440
caccacguccggccagcaaca

SEQ ID NO: 3566593 - RNA, 16 nt, Pseudomonas putida KT2440
caccacgucuuccugg

SEQ ID NO: 3566594 - RNA, 15 nt, Pseudomonas putida KT2440
caccacguucgggca

SEQ ID NO: 3566595 - RNA, 20 nt, Pseudomonas putida KT2440
caccacugucagccagcggu

SEQ ID NO: 3566596 - RNA, 17 nt, Pseudomonas putida KT2440
caccacuguucaggugu

SEQ ID NO: 3566597 - RNA, 15 nt, Pseudomonas putida KT2440
caccacuucuggcug

SEQ ID NO: 3566598 - RNA, 13 nt, Pseudomonas putida KT2440
caccagaccagca

SEQ ID NO: 3566599 - RNA, 15 nt, Pseudomonas putida KT2440
caccagaccagcagc

SEQ ID NO: 3566600 - RNA, 16 nt, Pseudomonas putida KT2440
caccagaccagcagca

SEQ ID NO: 3566601 - RNA, 17 nt, Pseudomonas putida KT2440
caccagaccagcagcag

SEQ ID NO: 3566602 - RNA, 22 nt, Pseudomonas putida KT2440
caccagaccagcagcaguggca

SEQ ID NO: 3566603 - RNA, 14 nt, Pseudomonas putida KT2440
caccagacgggcau

SEQ ID NO: 3566604 - RNA, 14 nt, Pseudomonas putida KT2440
caccagaugaccaa

SEQ ID NO: 3566605 - RNA, 17 nt, Pseudomonas putida KT2440
caccagauucaagcccg

SEQ ID NO: 3566606 - RNA, 13 nt, Pseudomonas putida KT2440
caccagcaccacc

SEQ ID NO: 3566607 - RNA, 14 nt, Pseudomonas putida KT2440
caccagcaccaccg

SEQ ID NO: 3566608 - RNA, 14 nt, Pseudomonas putida KT2440
caccagcaccagcu

SEQ ID NO: 3566609 - RNA, 17 nt, Pseudomonas putida KT2440
caccagcaccugcaggu

SEQ ID NO: 3566610 - RNA, 20 nt, Pseudomonas putida KT2440
caccagcaccugcagguaca

SEQ ID NO: 3566611 - RNA, 10 nt, Pseudomonas putida KT2440
caccagcacg

SEQ ID NO: 3566612 - RNA, 16 nt, Pseudomonas putida KT2440
caccagcacgucaccc

SEQ ID NO: 3566613 - RNA, 23 nt, Pseudomonas putida KT2440
caccagcacgucacccacuucaa

SEQ ID NO: 3566614 - RNA, 14 nt, Pseudomonas putida KT2440
caccagcacugccu

SEQ ID NO: 3566615 - RNA, 18 nt, Pseudomonas putida KT2440
caccagcacugccuugcc

SEQ ID NO: 3566616 - RNA, 19 nt, Pseudomonas putida KT2440
caccagcacugccuugccc

SEQ ID NO: 3566617 - RNA, 21 nt, Pseudomonas putida KT2440
caccagcacugccuugcccug

SEQ ID NO: 3566618 - RNA, 15 nt, Pseudomonas putida KT2440
caccagcagccacgg

SEQ ID NO: 3566619 - RNA, 14 nt, Pseudomonas putida KT2440
caccagcagcuucu

SEQ ID NO: 3566620 - RNA, 19 nt, Pseudomonas putida KT2440
caccagcagcuucuucaca

SEQ ID NO: 3566621 - RNA, 22 nt, Pseudomonas putida KT2440
caccagcaggucggcacgcacc

SEQ ID NO: 3566622 - RNA, 23 nt, Pseudomonas putida KT2440
caccagcaggucggcacgcaccu

SEQ ID NO: 3566623 - RNA, 15 nt, Pseudomonas putida KT2440
caccagcagugcccc

SEQ ID NO: 3566624 - RNA, 14 nt, Pseudomonas putida KT2440
caccagcauaugga

SEQ ID NO: 3566625 - RNA, 15 nt, Pseudomonas putida KT2440
caccagcaucaacag

SEQ ID NO: 3566626 - RNA, 21 nt, Pseudomonas putida KT2440
caccagcauguccugcugcag

SEQ ID NO: 3566627 - RNA, 22 nt, Pseudomonas putida KT2440
caccagccaaacccggccgcgg

SEQ ID NO: 3566628 - RNA, 13 nt, Pseudomonas putida KT2440
caccagccccaau

SEQ ID NO: 3566629 - RNA, 13 nt, Pseudomonas putida KT2440
caccagccccagc

SEQ ID NO: 3566630 - RNA, 16 nt, Pseudomonas putida KT2440
caccagccccagcgcc

SEQ ID NO: 3566631 - RNA, 15 nt, Pseudomonas putida KT2440
caccagccccccuuc

SEQ ID NO: 3566632 - RNA, 20 nt, Pseudomonas putida KT2440
caccagccccucaggcacau

SEQ ID NO: 3566633 - RNA, 22 nt, Pseudomonas putida KT2440
caccagcccgaagcgcaggucc

SEQ ID NO: 3566634 - RNA, 12 nt, Pseudomonas putida KT2440
caccagcccguc

SEQ ID NO: 3566635 - RNA, 19 nt, Pseudomonas putida KT2440
caccagcccuucggcaucg

SEQ ID NO: 3566636 - RNA, 15 nt, Pseudomonas putida KT2440
caccagcgcaccacu

SEQ ID NO: 3566637 - RNA, 14 nt, Pseudomonas putida KT2440
caccagcgcccuuc

SEQ ID NO: 3566638 - RNA, 19 nt, Pseudomonas putida KT2440
caccagcgcccuucacgcu

SEQ ID NO: 3566639 - RNA, 18 nt, Pseudomonas putida KT2440
caccagcgcgaucaccag

SEQ ID NO: 3566640 - RNA, 20 nt, Pseudomonas putida KT2440
caccagcgcgaucaccagcc

SEQ ID NO: 3566641 - RNA, 14 nt, Pseudomonas putida KT2440
caccagcgcugccg

SEQ ID NO: 3566642 - RNA, 14 nt, Pseudomonas putida KT2440
caccagcggcgcga

SEQ ID NO: 3566643 - RNA, 18 nt, Pseudomonas putida KT2440
caccagcgggcccagcag

SEQ ID NO: 3566644 - RNA, 16 nt, Pseudomonas putida KT2440
caccagcgucaccccu

SEQ ID NO: 3566645 - RNA, 16 nt, Pseudomonas putida KT2440
caccagcguugucccg

SEQ ID NO: 3566646 - RNA, 19 nt, Pseudomonas putida KT2440
caccagcguugucccgccc

SEQ ID NO: 3566647 - RNA, 20 nt, Pseudomonas putida KT2440
caccagcguugucccgcccu

SEQ ID NO: 3566648 - RNA, 21 nt, Pseudomonas putida KT2440
caccagcguugucccgcccug

SEQ ID NO: 3566649 - RNA, 21 nt, Pseudomonas putida KT2440
caccagcucacgcaagcggcc

SEQ ID NO: 3566650 - RNA, 14 nt, Pseudomonas putida KT2440
caccagcuccaaca

SEQ ID NO: 3566651 - RNA, 16 nt, Pseudomonas putida KT2440
caccagcuccauggca

SEQ ID NO: 3566652 - RNA, 17 nt, Pseudomonas putida KT2440
caccagcuccauggcaa

SEQ ID NO: 3566653 - RNA, 24 nt, Pseudomonas putida KT2440
caccagcuccuggccgcccgccuc

SEQ ID NO: 3566654 - RNA, 23 nt, Pseudomonas putida KT2440
caccagcucgcccggcacggcgu

SEQ ID NO: 3566655 - RNA, 19 nt, Pseudomonas putida KT2440
caccagcugcaccaccugc

SEQ ID NO: 3566656 - RNA, 16 nt, Pseudomonas putida KT2440
caccagcuugaugcug

SEQ ID NO: 3566657 - RNA, 14 nt, Pseudomonas putida KT2440
caccaggaagcugg

SEQ ID NO: 3566658 - RNA, 16 nt, Pseudomonas putida KT2440
caccaggacaagccga

SEQ ID NO: 3566659 - RNA, 16 nt, Pseudomonas putida KT2440
caccaggaucagguaa

SEQ ID NO: 3566660 - RNA, 23 nt, Pseudomonas putida KT2440
caccaggauugccgggcuacgca

SEQ ID NO: 3566661 - RNA, 17 nt, Pseudomonas putida KT2440
caccaggauuggccgca

SEQ ID NO: 3566662 - RNA, 23 nt, Pseudomonas putida KT2440
caccaggcaauugugccgcgcca

SEQ ID NO: 3566663 - RNA, 18 nt, Pseudomonas putida KT2440
caccaggcaccgaguacc

SEQ ID NO: 3566664 - RNA, 21 nt, Pseudomonas putida KT2440
caccaggcaccgaguaccguc

SEQ ID NO: 3566665 - RNA, 14 nt, Pseudomonas putida KT2440
caccaggcccagcc

SEQ ID NO: 3566666 - RNA, 14 nt, Pseudomonas putida KT2440
caccaggcccgcaa

SEQ ID NO: 3566667 - RNA, 14 nt, Pseudomonas putida KT2440
caccaggccgauca

SEQ ID NO: 3566668 - RNA, 18 nt, Pseudomonas putida KT2440
caccaggccgaucaccag

SEQ ID NO: 3566669 - RNA, 23 nt, Pseudomonas putida KT2440
caccaggccgaucaccagcaccc

SEQ ID NO: 3566670 - RNA, 21 nt, Pseudomonas putida KT2440
caccaggccuucugcgcgagu

SEQ ID NO: 3566671 - RNA, 14 nt, Pseudomonas putida KT2440
caccaggccuuuga

SEQ ID NO: 3566672 - RNA, 14 nt, Pseudomonas putida KT2440
caccaggcgcggca

SEQ ID NO: 3566673 - RNA, 21 nt, Pseudomonas putida KT2440
caccaggcggucggccagcgg

SEQ ID NO: 3566674 - RNA, 22 nt, Pseudomonas putida KT2440
caccaggcggucggccagcggc

SEQ ID NO: 3566675 - RNA, 23 nt, Pseudomonas putida KT2440
caccaggcuggccaccaccaucu

SEQ ID NO: 3566676 - RNA, 23 nt, Pseudomonas putida KT2440
caccaggguggcgauccacagcg

SEQ ID NO: 3566677 - RNA, 17 nt, Pseudomonas putida KT2440
caccagguccaccagca

SEQ ID NO: 3566678 - RNA, 14 nt, Pseudomonas putida KT2440
caccaggucgcggu

SEQ ID NO: 3566679 - RNA, 22 nt, Pseudomonas putida KT2440
caccagguugcguugaccugcu

SEQ ID NO: 3566680 - RNA, 18 nt, Pseudomonas putida KT2440
caccagguuggccgccgc

SEQ ID NO: 3566681 - RNA, 20 nt, Pseudomonas putida KT2440
caccagguuggccgccgcca

SEQ ID NO: 3566682 - RNA, 21 nt, Pseudomonas putida KT2440
caccagguuggccgccgccag

SEQ ID NO: 3566683 - RNA, 20 nt, Pseudomonas putida KT2440
caccagguuguggcccauga

SEQ ID NO: 3566684 - RNA, 17 nt, Pseudomonas putida KT2440
caccagguuugcugccu

SEQ ID NO: 3566685 - RNA, 23 nt, Pseudomonas putida KT2440
caccagguuugcugccuucucug

SEQ ID NO: 3566686 - RNA, 23 nt, Pseudomonas putida KT2440
caccagugaggucgggaauugca

SEQ ID NO: 3566687 - RNA, 20 nt, Pseudomonas putida KT2440
caccaguguagugaacaggc

SEQ ID NO: 3566688 - RNA, 22 nt, Pseudomonas putida KT2440
caccaguguagugaacaggcgu

SEQ ID NO: 3566689 - RNA, 18 nt, Pseudomonas putida KT2440
caccaguuccaccggcaa

SEQ ID NO: 3566690 - RNA, 22 nt, Pseudomonas putida KT2440
caccaguucguccucgacccac

SEQ ID NO: 3566691 - RNA, 22 nt, Pseudomonas putida KT2440
caccaucagagcgccagcaagc

SEQ ID NO: 3566692 - RNA, 14 nt, Pseudomonas putida KT2440
caccaucagccgcg

SEQ ID NO: 3566693 - RNA, 15 nt, Pseudomonas putida KT2440
caccaucaggcacag

SEQ ID NO: 3566694 - RNA, 18 nt, Pseudomonas putida KT2440
caccaucaggcacaggcc

SEQ ID NO: 3566695 - RNA, 14 nt, Pseudomonas putida KT2440
caccaucgaccugg

SEQ ID NO: 3566696 - RNA, 15 nt, Pseudomonas putida KT2440
caccaucgaccuggc

SEQ ID NO: 3566697 - RNA, 19 nt, Pseudomonas putida KT2440
caccaucgaccuggcccga

SEQ ID NO: 3566698 - RNA, 18 nt, Pseudomonas putida KT2440
caccaucgccaggccuuc

SEQ ID NO: 3566699 - RNA, 17 nt, Pseudomonas putida KT2440
caccaucggcuccagcg

SEQ ID NO: 3566700 - RNA, 23 nt, Pseudomonas putida KT2440
caccaucggugcggcccccuggu

SEQ ID NO: 3566701 - RNA, 14 nt, Pseudomonas putida KT2440
caccaucuccagcu

SEQ ID NO: 3566702 - RNA, 15 nt, Pseudomonas putida KT2440
caccaucuccagcuc

SEQ ID NO: 3566703 - RNA, 13 nt, Pseudomonas putida KT2440
caccaucuugccc

SEQ ID NO: 3566704 - RNA, 15 nt, Pseudomonas putida KT2440
caccaucuugcccag

SEQ ID NO: 3566705 - RNA, 13 nt, Pseudomonas putida KT2440
caccaugaacagc

SEQ ID NO: 3566706 - RNA, 16 nt, Pseudomonas putida KT2440
caccaugaacagcacg

SEQ ID NO: 3566707 - RNA, 17 nt, Pseudomonas putida KT2440
caccaugaacagcacgc

SEQ ID NO: 3566708 - RNA, 18 nt, Pseudomonas putida KT2440
caccaugaacagcacgcc

SEQ ID NO: 3566709 - RNA, 21 nt, Pseudomonas putida KT2440
caccaugaacucuuccccgcc

SEQ ID NO: 3566710 - RNA, 22 nt, Pseudomonas putida KT2440
caccaugaacucuuccccgccc

SEQ ID NO: 3566711 - RNA, 19 nt, Pseudomonas putida KT2440
caccaugcccacaggggcu

SEQ ID NO: 3566712 - RNA, 19 nt, Pseudomonas putida KT2440
caccaugcucggccagcuc

SEQ ID NO: 3566713 - RNA, 23 nt, Pseudomonas putida KT2440
caccaugcucggccagcucgcca

SEQ ID NO: 3566714 - RNA, 20 nt, Pseudomonas putida KT2440
caccauggcuaagccaagcc

SEQ ID NO: 3566715 - RNA, 23 nt, Pseudomonas putida KT2440
caccauggcuaagccaagccggc

SEQ ID NO: 3566716 - RNA, 15 nt, Pseudomonas putida KT2440
caccauguacugcag

SEQ ID NO: 3566717 - RNA, 12 nt, Pseudomonas putida KT2440
caccauguucca

SEQ ID NO: 3566718 - RNA, 15 nt, Pseudomonas putida KT2440
cacccaaccgcgcca

SEQ ID NO: 3566719 - RNA, 16 nt, Pseudomonas putida KT2440
cacccaaccugccgau

SEQ ID NO: 3566720 - RNA, 15 nt, Pseudomonas putida KT2440
cacccaaggcaucca

SEQ ID NO: 3566721 - RNA, 17 nt, Pseudomonas putida KT2440
cacccacacccgcgcgu

SEQ ID NO: 3566722 - RNA, 18 nt, Pseudomonas putida KT2440
cacccacagagacaccgc

SEQ ID NO: 3566723 - RNA, 16 nt, Pseudomonas putida KT2440
cacccacagcgccugc

SEQ ID NO: 3566724 - RNA, 20 nt, Pseudomonas putida KT2440
cacccaccacaaaccacagc

SEQ ID NO: 3566725 - RNA, 21 nt, Pseudomonas putida KT2440
cacccaccacggccuggccug

SEQ ID NO: 3566726 - RNA, 15 nt, Pseudomonas putida KT2440
cacccaccagccaaa

SEQ ID NO: 3566727 - RNA, 12 nt, Pseudomonas putida KT2440
cacccacccucg

SEQ ID NO: 3566728 - RNA, 20 nt, Pseudomonas putida KT2440
cacccaccgcaggucacugc

SEQ ID NO: 3566729 - RNA, 13 nt, Pseudomonas putida KT2440
cacccacgcgcuu

SEQ ID NO: 3566730 - RNA, 22 nt, Pseudomonas putida KT2440
cacccacuuggaaaacagcgcg

SEQ ID NO: 3566731 - RNA, 23 nt, Pseudomonas putida KT2440
cacccacuuggaaaacagcgcgc

SEQ ID NO: 3566732 - RNA, 18 nt, Pseudomonas putida KT2440
cacccagaacagccacag

SEQ ID NO: 3566733 - RNA, 19 nt, Pseudomonas putida KT2440
cacccagaacagccacagc

SEQ ID NO: 3566734 - RNA, 22 nt, Pseudomonas putida KT2440
cacccagaacagccacagcugc

SEQ ID NO: 3566735 - RNA, 12 nt, Pseudomonas putida KT2440
cacccagcgcau

SEQ ID NO: 3566736 - RNA, 14 nt, Pseudomonas putida KT2440
cacccagcgcggca

SEQ ID NO: 3566737 - RNA, 20 nt, Pseudomonas putida KT2440
cacccagcguauagccaccg

SEQ ID NO: 3566738 - RNA, 21 nt, Pseudomonas putida KT2440
cacccagcguauagccaccgg

SEQ ID NO: 3566739 - RNA, 17 nt, Pseudomonas putida KT2440
cacccagcucgccaaca

SEQ ID NO: 3566740 - RNA, 23 nt, Pseudomonas putida KT2440
cacccagcucgccaacaccgccc

SEQ ID NO: 3566741 - RNA, 17 nt, Pseudomonas putida KT2440
cacccaggugaucgcca

SEQ ID NO: 3566742 - RNA, 11 nt, Pseudomonas putida KT2440
cacccaggugc

SEQ ID NO: 3566743 - RNA, 19 nt, Pseudomonas putida KT2440
cacccaggugcaacccggc

SEQ ID NO: 3566744 - RNA, 16 nt, Pseudomonas putida KT2440
cacccagucaccuugc

SEQ ID NO: 3566745 - RNA, 23 nt, Pseudomonas putida KT2440
cacccagucaccuugcuccacca

SEQ ID NO: 3566746 - RNA, 14 nt, Pseudomonas putida KT2440
cacccagucgcccc

SEQ ID NO: 3566747 - RNA, 13 nt, Pseudomonas putida KT2440
cacccaguucggc

SEQ ID NO: 3566748 - RNA, 19 nt, Pseudomonas putida KT2440
cacccauucccacaucaaa

SEQ ID NO: 3566749 - RNA, 16 nt, Pseudomonas putida KT2440
caccccaaggcugcca

SEQ ID NO: 3566750 - RNA, 18 nt, Pseudomonas putida KT2440
caccccagaacggcacgc

SEQ ID NO: 3566751 - RNA, 20 nt, Pseudomonas putida KT2440
caccccagcaccacccacca

SEQ ID NO: 3566752 - RNA, 22 nt, Pseudomonas putida KT2440
caccccagcaccacccaccagc

SEQ ID NO: 3566753 - RNA, 20 nt, Pseudomonas putida KT2440
caccccagccgcucgagaaa

SEQ ID NO: 3566754 - RNA, 17 nt, Pseudomonas putida KT2440
caccccaggccacuggu

SEQ ID NO: 3566755 - RNA, 13 nt, Pseudomonas putida KT2440
cacccccagcgac

SEQ ID NO: 3566756 - RNA, 19 nt, Pseudomonas putida KT2440
cacccccagcgaccagcug

SEQ ID NO: 3566757 - RNA, 15 nt, Pseudomonas putida KT2440
cacccccagcgccuc

SEQ ID NO: 3566758 - RNA, 22 nt, Pseudomonas putida KT2440
cacccccagguuauccacaggg

SEQ ID NO: 3566759 - RNA, 19 nt, Pseudomonas putida KT2440
caccccccagcagcgggca

SEQ ID NO: 3566760 - RNA, 20 nt, Pseudomonas putida KT2440
caccccccagcagcgggcac

SEQ ID NO: 3566761 - RNA, 15 nt, Pseudomonas putida KT2440
cacccccgucucggc

SEQ ID NO: 3566762 - RNA, 18 nt, Pseudomonas putida KT2440
caccccgaccaaggccaa

SEQ ID NO: 3566763 - RNA, 22 nt, Pseudomonas putida KT2440
caccccgcaaagcccugccuca

SEQ ID NO: 3566764 - RNA, 18 nt, Pseudomonas putida KT2440
caccccgcaggccgcagc

SEQ ID NO: 3566765 - RNA, 22 nt, Pseudomonas putida KT2440
caccccgcaggccgcagccucu

SEQ ID NO: 3566766 - RNA, 12 nt, Pseudomonas putida KT2440
caccccgcgcau

SEQ ID NO: 3566767 - RNA, 20 nt, Pseudomonas putida KT2440
caccccggcguucagccgau

SEQ ID NO: 3566768 - RNA, 15 nt, Pseudomonas putida KT2440
caccccguggccccg

SEQ ID NO: 3566769 - RNA, 22 nt, Pseudomonas putida KT2440
caccccguucgcccugcgccug

SEQ ID NO: 3566770 - RNA, 21 nt, Pseudomonas putida KT2440
caccccucggcucacgccccg

SEQ ID NO: 3566771 - RNA, 23 nt, Pseudomonas putida KT2440
caccccucggcucacgccccgug

SEQ ID NO: 3566772 - RNA, 13 nt, Pseudomonas putida KT2440
caccccugccacc

SEQ ID NO: 3566773 - RNA, 12 nt, Pseudomonas putida KT2440
caccccuuccag

SEQ ID NO: 3566774 - RNA, 11 nt, Pseudomonas putida KT2440
caccccuucgu

SEQ ID NO: 3566775 - RNA, 17 nt, Pseudomonas putida KT2440
caccccuuuacuggcca

SEQ ID NO: 3566776 - RNA, 23 nt, Pseudomonas putida KT2440
caccccuuuacuggccauccagu

SEQ ID NO: 3566777 - RNA, 16 nt, Pseudomonas putida KT2440
cacccgaacaaaaccc

SEQ ID NO: 3566778 - RNA, 18 nt, Pseudomonas putida KT2440
cacccgaacaaaacccuu

SEQ ID NO: 3566779 - RNA, 22 nt, Pseudomonas putida KT2440
cacccgaccagaucaggccgcu

SEQ ID NO: 3566780 - RNA, 14 nt, Pseudomonas putida KT2440
cacccgacgccacc

SEQ ID NO: 3566781 - RNA, 18 nt, Pseudomonas putida KT2440
cacccgaguaaucgauga

SEQ ID NO: 3566782 - RNA, 17 nt, Pseudomonas putida KT2440
cacccgcaagcgccgau

SEQ ID NO: 3566783 - RNA, 12 nt, Pseudomonas putida KT2440
cacccgcagcaa

SEQ ID NO: 3566784 - RNA, 21 nt, Pseudomonas putida KT2440
cacccgcaggcgacgagccag

SEQ ID NO: 3566785 - RNA, 13 nt, Pseudomonas putida KT2440
cacccgccguuca

SEQ ID NO: 3566786 - RNA, 19 nt, Pseudomonas putida KT2440
cacccgccugcaaccaguc

SEQ ID NO: 3566787 - RNA, 16 nt, Pseudomonas putida KT2440
cacccgcgaagaggcc

SEQ ID NO: 3566788 - RNA, 24 nt, Pseudomonas putida KT2440
cacccgcgaagcaggcgacgcagu

SEQ ID NO: 3566789 - RNA, 23 nt, Pseudomonas putida KT2440
cacccgcgaauacgagggugaac

SEQ ID NO: 3566790 - RNA, 16 nt, Pseudomonas putida KT2440
cacccgcgaaugcucc

SEQ ID NO: 3566791 - RNA, 19 nt, Pseudomonas putida KT2440
cacccgcgaaugcuccggc

SEQ ID NO: 3566792 - RNA, 20 nt, Pseudomonas putida KT2440
cacccgcgaaugcuccggcg

SEQ ID NO: 3566793 - RNA, 13 nt, Pseudomonas putida KT2440
cacccgcgccacc

SEQ ID NO: 3566794 - RNA, 20 nt, Pseudomonas putida KT2440
cacccgcgccaccagcccca

SEQ ID NO: 3566795 - RNA, 18 nt, Pseudomonas putida KT2440
cacccgcgcgcccgcggc

SEQ ID NO: 3566796 - RNA, 17 nt, Pseudomonas putida KT2440
cacccgcgcguugcgga

SEQ ID NO: 3566797 - RNA, 20 nt, Pseudomonas putida KT2440
cacccgcgcguugcggaaca

SEQ ID NO: 3566798 - RNA, 24 nt, Pseudomonas putida KT2440
cacccgcguuugcaacuggcgcag

SEQ ID NO: 3566799 - RNA, 17 nt, Pseudomonas putida KT2440
cacccgcuacaccggcc

SEQ ID NO: 3566800 - RNA, 15 nt, Pseudomonas putida KT2440
cacccgcuugccacg

SEQ ID NO: 3566801 - RNA, 16 nt, Pseudomonas putida KT2440
cacccggaccagcgcc

SEQ ID NO: 3566802 - RNA, 19 nt, Pseudomonas putida KT2440
cacccggaccagcgccgca

SEQ ID NO: 3566803 - RNA, 14 nt, Pseudomonas putida KT2440
cacccggacccugg

SEQ ID NO: 3566804 - RNA, 16 nt, Pseudomonas putida KT2440
cacccggcugcaucca

SEQ ID NO: 3566805 - RNA, 15 nt, Pseudomonas putida KT2440
cacccggcuggucga

SEQ ID NO: 3566806 - RNA, 17 nt, Pseudomonas putida KT2440
cacccgggaacagcagc

SEQ ID NO: 3566807 - RNA, 19 nt, Pseudomonas putida KT2440
cacccgggaacagcagcac

SEQ ID NO: 3566808 - RNA, 20 nt, Pseudomonas putida KT2440
cacccgggaacagcagcacc

SEQ ID NO: 3566809 - RNA, 16 nt, Pseudomonas putida KT2440
cacccgggcagcgggc

SEQ ID NO: 3566810 - RNA, 23 nt, Pseudomonas putida KT2440
cacccggguauuuuuuuugccug

SEQ ID NO: 3566811 - RNA, 18 nt, Pseudomonas putida KT2440
cacccgguagaagcgguc

SEQ ID NO: 3566812 - RNA, 14 nt, Pseudomonas putida KT2440
cacccggugacggc

SEQ ID NO: 3566813 - RNA, 15 nt, Pseudomonas putida KT2440
cacccgugcaggggu

SEQ ID NO: 3566814 - RNA, 14 nt, Pseudomonas putida KT2440
cacccgugccugcc

SEQ ID NO: 3566815 - RNA, 18 nt, Pseudomonas putida KT2440
cacccgugccugccugca

SEQ ID NO: 3566816 - RNA, 19 nt, Pseudomonas putida KT2440
cacccucaccaacugccug

SEQ ID NO: 3566817 - RNA, 16 nt, Pseudomonas putida KT2440
cacccucacgaugacc

SEQ ID NO: 3566818 - RNA, 14 nt, Pseudomonas putida KT2440
cacccucgacguug

SEQ ID NO: 3566819 - RNA, 15 nt, Pseudomonas putida KT2440
cacccucgcaccaca

SEQ ID NO: 3566820 - RNA, 18 nt, Pseudomonas putida KT2440
cacccucgcacuccgccc

SEQ ID NO: 3566821 - RNA, 13 nt, Pseudomonas putida KT2440
cacccucgccccg

SEQ ID NO: 3566822 - RNA, 14 nt, Pseudomonas putida KT2440
cacccucgcgcagc

SEQ ID NO: 3566823 - RNA, 15 nt, Pseudomonas putida KT2440
cacccucgcgcagca

SEQ ID NO: 3566824 - RNA, 21 nt, Pseudomonas putida KT2440
cacccucgcgcagcaucugca

SEQ ID NO: 3566825 - RNA, 18 nt, Pseudomonas putida KT2440
cacccucguccccgcgcu

SEQ ID NO: 3566826 - RNA, 14 nt, Pseudomonas putida KT2440
cacccucugccauc

SEQ ID NO: 3566827 - RNA, 13 nt, Pseudomonas putida KT2440
cacccucuugaau

SEQ ID NO: 3566828 - RNA, 22 nt, Pseudomonas putida KT2440
cacccucuugaauccccuuaua

SEQ ID NO: 3566829 - RNA, 20 nt, Pseudomonas putida KT2440
cacccugacgcugcacuucc

SEQ ID NO: 3566830 - RNA, 21 nt, Pseudomonas putida KT2440
cacccugacgcugcacuucca

SEQ ID NO: 3566831 - RNA, 22 nt, Pseudomonas putida KT2440
cacccugacgcugcacuuccac

SEQ ID NO: 3566832 - RNA, 20 nt, Pseudomonas putida KT2440
cacccugcgaagucagguag

SEQ ID NO: 3566833 - RNA, 15 nt, Pseudomonas putida KT2440
cacccuggcaugccc

SEQ ID NO: 3566834 - RNA, 16 nt, Pseudomonas putida KT2440
cacccuggucacgcag

SEQ ID NO: 3566835 - RNA, 22 nt, Pseudomonas putida KT2440
cacccuggucaugcagcggguc

SEQ ID NO: 3566836 - RNA, 20 nt, Pseudomonas putida KT2440
cacccuuccccccuggccug

SEQ ID NO: 3566837 - RNA, 14 nt, Pseudomonas putida KT2440
cacccuuggccacc

SEQ ID NO: 3566838 - RNA, 15 nt, Pseudomonas putida KT2440
cacccuugggcacca

SEQ ID NO: 3566839 - RNA, 19 nt, Pseudomonas putida KT2440
cacccuugggcaccagcuu

SEQ ID NO: 3566840 - RNA, 12 nt, Pseudomonas putida KT2440
cacccuugggcu

SEQ ID NO: 3566841 - RNA, 21 nt, Pseudomonas putida KT2440
cacccuugggcucagccgcca

SEQ ID NO: 3566842 - RNA, 17 nt, Pseudomonas putida KT2440
cacccuuggucaggauc

SEQ ID NO: 3566843 - RNA, 16 nt, Pseudomonas putida KT2440
cacccuuuaggggcuc

SEQ ID NO: 3566844 - RNA, 19 nt, Pseudomonas putida KT2440
caccgaaaucagcaacgcc

SEQ ID NO: 3566845 - RNA, 13 nt, Pseudomonas putida KT2440
caccgaaccggcg

SEQ ID NO: 3566846 - RNA, 19 nt, Pseudomonas putida KT2440
caccgaaccggcgaucagg

SEQ ID NO: 3566847 - RNA, 15 nt, Pseudomonas putida KT2440
caccgaacucguuga

SEQ ID NO: 3566848 - RNA, 17 nt, Pseudomonas putida KT2440
caccgaagcaccacugg

SEQ ID NO: 3566849 - RNA, 16 nt, Pseudomonas putida KT2440
caccgaagcuugcagu

SEQ ID NO: 3566850 - RNA, 18 nt, Pseudomonas putida KT2440
caccgaaggccgccggca

SEQ ID NO: 3566851 - RNA, 19 nt, Pseudomonas putida KT2440
caccgaaggccgccggcaa

SEQ ID NO: 3566852 - RNA, 16 nt, Pseudomonas putida KT2440
caccgaaggcgucacc

SEQ ID NO: 3566853 - RNA, 20 nt, Pseudomonas putida KT2440
caccgaaggcgucacccgcg

SEQ ID NO: 3566854 - RNA, 24 nt, Pseudomonas putida KT2440
caccgaaguucagcacgggcagcu

SEQ ID NO: 3566855 - RNA, 16 nt, Pseudomonas putida KT2440
caccgacagcaacgcg

SEQ ID NO: 3566856 - RNA, 12 nt, Pseudomonas putida KT2440
caccgacagccc

SEQ ID NO: 3566857 - RNA, 15 nt, Pseudomonas putida KT2440
caccgacauccacgu

SEQ ID NO: 3566858 - RNA, 14 nt, Pseudomonas putida KT2440
caccgaccaucggc

SEQ ID NO: 3566859 - RNA, 15 nt, Pseudomonas putida KT2440
caccgacccacaggc

SEQ ID NO: 3566860 - RNA, 22 nt, Pseudomonas putida KT2440
caccgacccacaggcacaggcc

SEQ ID NO: 3566861 - RNA, 23 nt, Pseudomonas putida KT2440
caccgacccacaggcacaggccc

SEQ ID NO: 3566862 - RNA, 19 nt, Pseudomonas putida KT2440
caccgacccggccgcucca

SEQ ID NO: 3566863 - RNA, 23 nt, Pseudomonas putida KT2440
caccgaccuguguccacccccgc

SEQ ID NO: 3566864 - RNA, 17 nt, Pseudomonas putida KT2440
caccgacgaacagggcc

SEQ ID NO: 3566865 - RNA, 16 nt, Pseudomonas putida KT2440
caccgacgccgaucaa

SEQ ID NO: 3566866 - RNA, 19 nt, Pseudomonas putida KT2440
caccgacgccgaucaaugu

SEQ ID NO: 3566867 - RNA, 20 nt, Pseudomonas putida KT2440
caccgacuccggcaaggcau

SEQ ID NO: 3566868 - RNA, 23 nt, Pseudomonas putida KT2440
caccgacucgguacgcacuguag

SEQ ID NO: 3566869 - RNA, 17 nt, Pseudomonas putida KT2440
caccgagacgaucacca

SEQ ID NO: 3566870 - RNA, 18 nt, Pseudomonas putida KT2440
caccgagccauugacccg

SEQ ID NO: 3566871 - RNA, 20 nt, Pseudomonas putida KT2440
caccgagcugcccaaguaca

SEQ ID NO: 3566872 - RNA, 22 nt, Pseudomonas putida KT2440
caccgaggcgugaucacccggg

SEQ ID NO: 3566873 - RNA, 18 nt, Pseudomonas putida KT2440
caccgaguaccgucggca

SEQ ID NO: 3566874 - RNA, 15 nt, Pseudomonas putida KT2440
caccgagucaugaag

SEQ ID NO: 3566875 - RNA, 17 nt, Pseudomonas putida KT2440
caccgagugcccgcgca

SEQ ID NO: 3566876 - RNA, 21 nt, Pseudomonas putida KT2440
caccgagugcggcaggccgaa

SEQ ID NO: 3566877 - RNA, 15 nt, Pseudomonas putida KT2440
caccgaucaccuggg

SEQ ID NO: 3566878 - RNA, 20 nt, Pseudomonas putida KT2440
caccgaucacggggcgacgc

SEQ ID NO: 3566879 - RNA, 23 nt, Pseudomonas putida KT2440
caccgaucacggggcgacgcauc

SEQ ID NO: 3566880 - RNA, 14 nt, Pseudomonas putida KT2440
caccgaucagcggc

SEQ ID NO: 3566881 - RNA, 18 nt, Pseudomonas putida KT2440
caccgaucagcggcgcca

SEQ ID NO: 3566882 - RNA, 17 nt, Pseudomonas putida KT2440
caccgaucucgccagcc

SEQ ID NO: 3566883 - RNA, 20 nt, Pseudomonas putida KT2440
caccgaucucgccagccugc

SEQ ID NO: 3566884 - RNA, 14 nt, Pseudomonas putida KT2440
caccgaugccugug

SEQ ID NO: 3566885 - RNA, 15 nt, Pseudomonas putida KT2440
caccgaugccugugu

SEQ ID NO: 3566886 - RNA, 15 nt, Pseudomonas putida KT2440
caccgcaaaucacug

SEQ ID NO: 3566887 - RNA, 20 nt, Pseudomonas putida KT2440
caccgcaaaucacugacccg

SEQ ID NO: 3566888 - RNA, 23 nt, Pseudomonas putida KT2440
caccgcaaaucacugacccgcuu

SEQ ID NO: 3566889 - RNA, 18 nt, Pseudomonas putida KT2440
caccgcaagcugcaccgc

SEQ ID NO: 3566890 - RNA, 22 nt, Pseudomonas putida KT2440
caccgcacaggcauaccgcaac

SEQ ID NO: 3566891 - RNA, 13 nt, Pseudomonas putida KT2440
caccgcacccggc

SEQ ID NO: 3566892 - RNA, 14 nt, Pseudomonas putida KT2440
caccgcacccggcg

SEQ ID NO: 3566893 - RNA, 16 nt, Pseudomonas putida KT2440
caccgcacucugcugc

SEQ ID NO: 3566894 - RNA, 17 nt, Pseudomonas putida KT2440
caccgcacucugcugcu

SEQ ID NO: 3566895 - RNA, 20 nt, Pseudomonas putida KT2440
caccgcacucugcugcucug

SEQ ID NO: 3566896 - RNA, 14 nt, Pseudomonas putida KT2440
caccgcacugugcu

SEQ ID NO: 3566897 - RNA, 13 nt, Pseudomonas putida KT2440
caccgcagcccag

SEQ ID NO: 3566898 - RNA, 16 nt, Pseudomonas putida KT2440
caccgcagcccagcgc

SEQ ID NO: 3566899 - RNA, 13 nt, Pseudomonas putida KT2440
caccgcagcccca

SEQ ID NO: 3566900 - RNA, 15 nt, Pseudomonas putida KT2440
caccgcagccccagc

SEQ ID NO: 3566901 - RNA, 18 nt, Pseudomonas putida KT2440
caccgcaggucacugcgu

SEQ ID NO: 3566902 - RNA, 13 nt, Pseudomonas putida KT2440
caccgcaggugca

SEQ ID NO: 3566903 - RNA, 16 nt, Pseudomonas putida KT2440
caccgcauacacaucg

SEQ ID NO: 3566904 - RNA, 14 nt, Pseudomonas putida KT2440
caccgcauccgcac

SEQ ID NO: 3566905 - RNA, 18 nt, Pseudomonas putida KT2440
caccgcauugcaggccag

SEQ ID NO: 3566906 - RNA, 20 nt, Pseudomonas putida KT2440
caccgcauugcaggccagcg

SEQ ID NO: 3566907 - RNA, 21 nt, Pseudomonas putida KT2440
caccgcauugcaggccagcgu

SEQ ID NO: 3566908 - RNA, 13 nt, Pseudomonas putida KT2440
caccgccaaggca

SEQ ID NO: 3566909 - RNA, 17 nt, Pseudomonas putida KT2440
caccgccacaauccgcu

SEQ ID NO: 3566910 - RNA, 14 nt, Pseudomonas putida KT2440
caccgccaccaucg

SEQ ID NO: 3566911 - RNA, 14 nt, Pseudomonas putida KT2440
caccgccaccaugc

SEQ ID NO: 3566912 - RNA, 15 nt, Pseudomonas putida KT2440
caccgccaccccggc

SEQ ID NO: 3566913 - RNA, 17 nt, Pseudomonas putida KT2440
caccgccacugaccagc

SEQ ID NO: 3566914 - RNA, 13 nt, Pseudomonas putida KT2440
caccgccagaaaa

SEQ ID NO: 3566915 - RNA, 21 nt, Pseudomonas putida KT2440
caccgccagaaaauucucccg

SEQ ID NO: 3566916 - RNA, 13 nt, Pseudomonas putida KT2440
caccgccagcagc

SEQ ID NO: 3566917 - RNA, 12 nt, Pseudomonas putida KT2440
caccgccagccc

SEQ ID NO: 3566918 - RNA, 15 nt, Pseudomonas putida KT2440
caccgccagcggcaa

SEQ ID NO: 3566919 - RNA, 14 nt, Pseudomonas putida KT2440
caccgccagcucca

SEQ ID NO: 3566920 - RNA, 18 nt, Pseudomonas putida KT2440
caccgccccagcgcgcca

SEQ ID NO: 3566921 - RNA, 15 nt, Pseudomonas putida KT2440
caccgccccggccag

SEQ ID NO: 3566922 - RNA, 18 nt, Pseudomonas putida KT2440
caccgccgcauucgcggg

SEQ ID NO: 3566923 - RNA, 19 nt, Pseudomonas putida KT2440
caccgccgccaccgacaca

SEQ ID NO: 3566924 - RNA, 19 nt, Pseudomonas putida KT2440
caccgccgcccacgccggc

SEQ ID NO: 3566925 - RNA, 14 nt, Pseudomonas putida KT2440
caccgccgccccgc

SEQ ID NO: 3566926 - RNA, 16 nt, Pseudomonas putida KT2440
caccgccgccccgcac

SEQ ID NO: 3566927 - RNA, 21 nt, Pseudomonas putida KT2440
caccgccggcucgucacugcc

SEQ ID NO: 3566928 - RNA, 15 nt, Pseudomonas putida KT2440
caccgccucgaucgu

SEQ ID NO: 3566929 - RNA, 20 nt, Pseudomonas putida KT2440
caccgccucgaucgucgaca

SEQ ID NO: 3566930 - RNA, 15 nt, Pseudomonas putida KT2440
caccgccucgcccag

SEQ ID NO: 3566931 - RNA, 21 nt, Pseudomonas putida KT2440
caccgccucuaccacgccgcu

SEQ ID NO: 3566932 - RNA, 23 nt, Pseudomonas putida KT2440
caccgccucuaccacgccgcugc

SEQ ID NO: 3566933 - RNA, 22 nt, Pseudomonas putida KT2440
caccgcgaaacacagcaggcca

SEQ ID NO: 3566934 - RNA, 19 nt, Pseudomonas putida KT2440
caccgcgaaugaacggguu

SEQ ID NO: 3566935 - RNA, 16 nt, Pseudomonas putida KT2440
caccgcgacgaccgca

SEQ ID NO: 3566936 - RNA, 14 nt, Pseudomonas putida KT2440
caccgcgcaacgcg

SEQ ID NO: 3566937 - RNA, 14 nt, Pseudomonas putida KT2440
caccgcgcaccucc

SEQ ID NO: 3566938 - RNA, 14 nt, Pseudomonas putida KT2440
caccgcgccagccu

SEQ ID NO: 3566939 - RNA, 16 nt, Pseudomonas putida KT2440
caccgcgccagccugg

SEQ ID NO: 3566940 - RNA, 14 nt, Pseudomonas putida KT2440
caccgcgcgcuuga

SEQ ID NO: 3566941 - RNA, 18 nt, Pseudomonas putida KT2440
caccgcggaugcgccugg

SEQ ID NO: 3566942 - RNA, 18 nt, Pseudomonas putida KT2440
caccgcguacagcugcuc

SEQ ID NO: 3566943 - RNA, 20 nt, Pseudomonas putida KT2440
caccgcguacagcugcucac

SEQ ID NO: 3566944 - RNA, 22 nt, Pseudomonas putida KT2440
caccgcguacagcugcucacca

SEQ ID NO: 3566945 - RNA, 18 nt, Pseudomonas putida KT2440
caccgcguuaugacuggc

SEQ ID NO: 3566946 - RNA, 20 nt, Pseudomonas putida KT2440
caccgcguuggccaggucga

SEQ ID NO: 3566947 - RNA, 17 nt, Pseudomonas putida KT2440
caccgcucaaacccggc

SEQ ID NO: 3566948 - RNA, 22 nt, Pseudomonas putida KT2440
caccgcucaaacccggcagcca

SEQ ID NO: 3566949 - RNA, 12 nt, Pseudomonas putida KT2440
caccgcugacca

SEQ ID NO: 3566950 - RNA, 21 nt, Pseudomonas putida KT2440
caccgcugauggccaauaccg

SEQ ID NO: 3566951 - RNA, 15 nt, Pseudomonas putida KT2440
caccgcugccgggca

SEQ ID NO: 3566952 - RNA, 18 nt, Pseudomonas putida KT2440
caccgcugguggcguggc

SEQ ID NO: 3566953 - RNA, 16 nt, Pseudomonas putida KT2440
caccgcuucacccucg

SEQ ID NO: 3566954 - RNA, 20 nt, Pseudomonas putida KT2440
caccgcuucacccucgcgca

SEQ ID NO: 3566955 - RNA, 21 nt, Pseudomonas putida KT2440
caccgcuucacccucgcgcag

SEQ ID NO: 3566956 - RNA, 22 nt, Pseudomonas putida KT2440
caccgcuucacccucgcgcagc

SEQ ID NO: 3566957 - RNA, 14 nt, Pseudomonas putida KT2440
caccgcuugcgcac

SEQ ID NO: 3566958 - RNA, 16 nt, Pseudomonas putida KT2440
caccggaggacacauc

SEQ ID NO: 3566959 - RNA, 16 nt, Pseudomonas putida KT2440
caccggcaaagcugau

SEQ ID NO: 3566960 - RNA, 23 nt, Pseudomonas putida KT2440
caccggcaacccuucggccagca

SEQ ID NO: 3566961 - RNA, 10 nt, Pseudomonas putida KT2440
caccggcacc

SEQ ID NO: 3566962 - RNA, 16 nt, Pseudomonas putida KT2440
caccggcaccaucuuc

SEQ ID NO: 3566963 - RNA, 20 nt, Pseudomonas putida KT2440
caccggcaccaucuucgaca

SEQ ID NO: 3566964 - RNA, 19 nt, Pseudomonas putida KT2440
caccggcagagccggugcc

SEQ ID NO: 3566965 - RNA, 13 nt, Pseudomonas putida KT2440
caccggcagcacc

SEQ ID NO: 3566966 - RNA, 14 nt, Pseudomonas putida KT2440
caccggcagcaccu

SEQ ID NO: 3566967 - RNA, 14 nt, Pseudomonas putida KT2440
caccggcagcagca

SEQ ID NO: 3566968 - RNA, 19 nt, Pseudomonas putida KT2440
caccggcagcgcaaucacc

SEQ ID NO: 3566969 - RNA, 14 nt, Pseudomonas putida KT2440
caccggccaccagg

SEQ ID NO: 3566970 - RNA, 15 nt, Pseudomonas putida KT2440
caccggccaccgugg

SEQ ID NO: 3566971 - RNA, 16 nt, Pseudomonas putida KT2440
caccggccacgcgcag

SEQ ID NO: 3566972 - RNA, 12 nt, Pseudomonas putida KT2440
caccggccagca

SEQ ID NO: 3566973 - RNA, 16 nt, Pseudomonas putida KT2440
caccggccagcgcgcu

SEQ ID NO: 3566974 - RNA, 12 nt, Pseudomonas putida KT2440
caccggccaggc

SEQ ID NO: 3566975 - RNA, 16 nt, Pseudomonas putida KT2440
caccggccccccagcc

SEQ ID NO: 3566976 - RNA, 20 nt, Pseudomonas putida KT2440
caccggccccccagccagca

SEQ ID NO: 3566977 - RNA, 21 nt, Pseudomonas putida KT2440
caccggccgacccgccuggug

SEQ ID NO: 3566978 - RNA, 13 nt, Pseudomonas putida KT2440
caccggccgccgc

SEQ ID NO: 3566979 - RNA, 17 nt, Pseudomonas putida KT2440
caccggccuccuugaug

SEQ ID NO: 3566980 - RNA, 13 nt, Pseudomonas putida KT2440
caccggccuugcc

SEQ ID NO: 3566981 - RNA, 15 nt, Pseudomonas putida KT2440
caccggccuugcgca

SEQ ID NO: 3566982 - RNA, 21 nt, Pseudomonas putida KT2440
caccggccuugcgcaaggcaa

SEQ ID NO: 3566983 - RNA, 14 nt, Pseudomonas putida KT2440
caccggcgaacagc

SEQ ID NO: 3566984 - RNA, 17 nt, Pseudomonas putida KT2440
caccggcgaacagcaau

SEQ ID NO: 3566985 - RNA, 17 nt, Pseudomonas putida KT2440
caccggcgaagacggca

SEQ ID NO: 3566986 - RNA, 18 nt, Pseudomonas putida KT2440
caccggcgaagacggcag

SEQ ID NO: 3566987 - RNA, 20 nt, Pseudomonas putida KT2440
caccggcgaguccugccuuc

SEQ ID NO: 3566988 - RNA, 22 nt, Pseudomonas putida KT2440
caccggcgaguccugccuucca

SEQ ID NO: 3566989 - RNA, 18 nt, Pseudomonas putida KT2440
caccggcgccaaucaucg

SEQ ID NO: 3566990 - RNA, 18 nt, Pseudomonas putida KT2440
caccggcucugccggugu

SEQ ID NO: 3566991 - RNA, 16 nt, Pseudomonas putida KT2440
caccggcugcgccggu

SEQ ID NO: 3566992 - RNA, 13 nt, Pseudomonas putida KT2440
caccggcuucgcc

SEQ ID NO: 3566993 - RNA, 15 nt, Pseudomonas putida KT2440
caccggcuucgccgg

SEQ ID NO: 3566994 - RNA, 19 nt, Pseudomonas putida KT2440
caccggcuucgccgguguu

SEQ ID NO: 3566995 - RNA, 19 nt, Pseudomonas putida KT2440
caccggcuugcccggcgca

SEQ ID NO: 3566996 - RNA, 19 nt, Pseudomonas putida KT2440
caccggcuuugccgguguu

SEQ ID NO: 3566997 - RNA, 18 nt, Pseudomonas putida KT2440
caccgggauacugcgcac

SEQ ID NO: 3566998 - RNA, 14 nt, Pseudomonas putida KT2440
caccgggaucgaga

SEQ ID NO: 3566999 - RNA, 23 nt, Pseudomonas putida KT2440
caccgggaucgagaucaggugga

SEQ ID NO: 3567000 - RNA, 21 nt, Pseudomonas putida KT2440
caccgggauggcggcgccugc

SEQ ID NO: 3567001 - RNA, 17 nt, Pseudomonas putida KT2440
caccgggcgcgauugcc

SEQ ID NO: 3567002 - RNA, 22 nt, Pseudomonas putida KT2440
caccgguacauugcgcaccccu

SEQ ID NO: 3567003 - RNA, 12 nt, Pseudomonas putida KT2440
caccgguaggac

SEQ ID NO: 3567004 - RNA, 22 nt, Pseudomonas putida KT2440
caccgguaucgaugcacagcuc

SEQ ID NO: 3567005 - RNA, 15 nt, Pseudomonas putida KT2440
caccgguuuguccug

SEQ ID NO: 3567006 - RNA, 21 nt, Pseudomonas putida KT2440
caccguaaggaaaaucagcua

SEQ ID NO: 3567007 - RNA, 13 nt, Pseudomonas putida KT2440
caccgucaccuug

SEQ ID NO: 3567008 - RNA, 17 nt, Pseudomonas putida KT2440
caccgucaccuugcuga

SEQ ID NO: 3567009 - RNA, 14 nt, Pseudomonas putida KT2440
caccgucaggcuca

SEQ ID NO: 3567010 - RNA, 17 nt, Pseudomonas putida KT2440
caccgucaggcucagca

SEQ ID NO: 3567011 - RNA, 23 nt, Pseudomonas putida KT2440
caccgucgaugucggcguggaug

SEQ ID NO: 3567012 - RNA, 14 nt, Pseudomonas putida KT2440
caccgucgccugca

SEQ ID NO: 3567013 - RNA, 20 nt, Pseudomonas putida KT2440
caccgucuggaagucgcgag

SEQ ID NO: 3567014 - RNA, 15 nt, Pseudomonas putida KT2440
caccgugcaccagca

SEQ ID NO: 3567015 - RNA, 16 nt, Pseudomonas putida KT2440
caccgugcaccagcac

SEQ ID NO: 3567016 - RNA, 13 nt, Pseudomonas putida KT2440
caccgugcccacc

SEQ ID NO: 3567017 - RNA, 15 nt, Pseudomonas putida KT2440
caccguggcagcaau

SEQ ID NO: 3567018 - RNA, 23 nt, Pseudomonas putida KT2440
caccguggcguauugcugguaga

SEQ ID NO: 3567019 - RNA, 17 nt, Pseudomonas putida KT2440
caccguguaccccaucu

SEQ ID NO: 3567020 - RNA, 17 nt, Pseudomonas putida KT2440
caccguuaacacaggua

SEQ ID NO: 3567021 - RNA, 19 nt, Pseudomonas putida KT2440
caccguucuugauccagcu

SEQ ID NO: 3567022 - RNA, 20 nt, Pseudomonas putida KT2440
caccguugguaucgaucagg

SEQ ID NO: 3567023 - RNA, 17 nt, Pseudomonas putida KT2440
caccuaucgcugccgcc

SEQ ID NO: 3567024 - RNA, 17 nt, Pseudomonas putida KT2440
caccucagaagucgaag

SEQ ID NO: 3567025 - RNA, 14 nt, Pseudomonas putida KT2440
caccucaucccccg

SEQ ID NO: 3567026 - RNA, 16 nt, Pseudomonas putida KT2440
caccucaucccccggc

SEQ ID NO: 3567027 - RNA, 18 nt, Pseudomonas putida KT2440
caccucaucccccggccc

SEQ ID NO: 3567028 - RNA, 19 nt, Pseudomonas putida KT2440
caccucaucgacccuggca

SEQ ID NO: 3567029 - RNA, 17 nt, Pseudomonas putida KT2440
caccucauucagugccu

SEQ ID NO: 3567030 - RNA, 14 nt, Pseudomonas putida KT2440
caccucccgccacg

SEQ ID NO: 3567031 - RNA, 15 nt, Pseudomonas putida KT2440
caccuccugcacaua

SEQ ID NO: 3567032 - RNA, 14 nt, Pseudomonas putida KT2440
caccucgacccgcc

SEQ ID NO: 3567033 - RNA, 18 nt, Pseudomonas putida KT2440
caccucgaccgcacccgc

SEQ ID NO: 3567034 - RNA, 14 nt, Pseudomonas putida KT2440
caccucggaugcca

SEQ ID NO: 3567035 - RNA, 17 nt, Pseudomonas putida KT2440
caccucggcgaucagcu

SEQ ID NO: 3567036 - RNA, 21 nt, Pseudomonas putida KT2440
caccucgggcuuggcacgcug

SEQ ID NO: 3567037 - RNA, 15 nt, Pseudomonas putida KT2440
caccucgucaugcag

SEQ ID NO: 3567038 - RNA, 13 nt, Pseudomonas putida KT2440
caccucgucgcuc

SEQ ID NO: 3567039 - RNA, 22 nt, Pseudomonas putida KT2440
caccucuaucaccuguuccccc

SEQ ID NO: 3567040 - RNA, 20 nt, Pseudomonas putida KT2440
caccucugcggccuucaagc

SEQ ID NO: 3567041 - RNA, 18 nt, Pseudomonas putida KT2440
caccugacacauaggcag

SEQ ID NO: 3567042 - RNA, 24 nt, Pseudomonas putida KT2440
caccugacacauaggcagccaccu

SEQ ID NO: 3567043 - RNA, 18 nt, Pseudomonas putida KT2440
caccugaccaucagccug

SEQ ID NO: 3567044 - RNA, 16 nt, Pseudomonas putida KT2440
caccugaccauuggcc

SEQ ID NO: 3567045 - RNA, 15 nt, Pseudomonas putida KT2440
caccugaccgaugcc

SEQ ID NO: 3567046 - RNA, 22 nt, Pseudomonas putida KT2440
caccugacgcaagcgcgccgcc

SEQ ID NO: 3567047 - RNA, 14 nt, Pseudomonas putida KT2440
caccugaugcacca

SEQ ID NO: 3567048 - RNA, 19 nt, Pseudomonas putida KT2440
caccugcacaucggccacc

SEQ ID NO: 3567049 - RNA, 15 nt, Pseudomonas putida KT2440
caccugcagcgcguu

SEQ ID NO: 3567050 - RNA, 21 nt, Pseudomonas putida KT2440
caccugcagguaaugcgccgc

SEQ ID NO: 3567051 - RNA, 18 nt, Pseudomonas putida KT2440
caccugcagguacagcag

SEQ ID NO: 3567052 - RNA, 19 nt, Pseudomonas putida KT2440
caccugccacacacccggg

SEQ ID NO: 3567053 - RNA, 15 nt, Pseudomonas putida KT2440
caccugccagccccg

SEQ ID NO: 3567054 - RNA, 15 nt, Pseudomonas putida KT2440
caccugccagccgca

SEQ ID NO: 3567055 - RNA, 14 nt, Pseudomonas putida KT2440
caccugccaggcca

SEQ ID NO: 3567056 - RNA, 15 nt, Pseudomonas putida KT2440
caccugccaggccaa

SEQ ID NO: 3567057 - RNA, 22 nt, Pseudomonas putida KT2440
caccugccgcgauaagcgcgau

SEQ ID NO: 3567058 - RNA, 14 nt, Pseudomonas putida KT2440
caccugcgccuugc

SEQ ID NO: 3567059 - RNA, 15 nt, Pseudomonas putida KT2440
caccugcgccuugcu

SEQ ID NO: 3567060 - RNA, 18 nt, Pseudomonas putida KT2440
caccugcggcaggugggu

SEQ ID NO: 3567061 - RNA, 14 nt, Pseudomonas putida KT2440
caccugcuccagca

SEQ ID NO: 3567062 - RNA, 15 nt, Pseudomonas putida KT2440
caccugcuccagcac

SEQ ID NO: 3567063 - RNA, 17 nt, Pseudomonas putida KT2440
caccugcuccagcaccu

SEQ ID NO: 3567064 - RNA, 17 nt, Pseudomonas putida KT2440
caccugcuccugguccu

SEQ ID NO: 3567065 - RNA, 18 nt, Pseudomonas putida KT2440
caccugcuccugguccug

SEQ ID NO: 3567066 - RNA, 21 nt, Pseudomonas putida KT2440
caccugcuccugguccugcgc

SEQ ID NO: 3567067 - RNA, 18 nt, Pseudomonas putida KT2440
caccugcuucgcgggcac

SEQ ID NO: 3567068 - RNA, 19 nt, Pseudomonas putida KT2440
caccuggauguugugcgaa

SEQ ID NO: 3567069 - RNA, 22 nt, Pseudomonas putida KT2440
caccuggcccugcucacgcagc

SEQ ID NO: 3567070 - RNA, 18 nt, Pseudomonas putida KT2440
caccuggccuuccagcug

SEQ ID NO: 3567071 - RNA, 17 nt, Pseudomonas putida KT2440
caccuggcugagguuca

SEQ ID NO: 3567072 - RNA, 18 nt, Pseudomonas putida KT2440
caccuggcugcgggugcc

SEQ ID NO: 3567073 - RNA, 22 nt, Pseudomonas putida KT2440
caccugggcgcuuugcacccgc

SEQ ID NO: 3567074 - RNA, 22 nt, Pseudomonas putida KT2440
caccugggcgucaucacccggg

SEQ ID NO: 3567075 - RNA, 18 nt, Pseudomonas putida KT2440
caccugguaccccucgac

SEQ ID NO: 3567076 - RNA, 19 nt, Pseudomonas putida KT2440
caccugguaggucacuuca

SEQ ID NO: 3567077 - RNA, 21 nt, Pseudomonas putida KT2440
caccugguaggucacuucagu

SEQ ID NO: 3567078 - RNA, 22 nt, Pseudomonas putida KT2440
caccuggugcgccuuuuccacc

SEQ ID NO: 3567079 - RNA, 14 nt, Pseudomonas putida KT2440
caccugucccagcu

SEQ ID NO: 3567080 - RNA, 18 nt, Pseudomonas putida KT2440
caccugucccagcuggca

SEQ ID NO: 3567081 - RNA, 23 nt, Pseudomonas putida KT2440
caccugucccagcuggcaaugca

SEQ ID NO: 3567082 - RNA, 14 nt, Pseudomonas putida KT2440
caccuguggguugc

SEQ ID NO: 3567083 - RNA, 22 nt, Pseudomonas putida KT2440
caccuguucccccaccggccgc

SEQ ID NO: 3567084 - RNA, 16 nt, Pseudomonas putida KT2440
caccuguugccgcuuc

SEQ ID NO: 3567085 - RNA, 14 nt, Pseudomonas putida KT2440
caccuucaccccgu

SEQ ID NO: 3567086 - RNA, 23 nt, Pseudomonas putida KT2440
caccuucagcgggucgagccagg

SEQ ID NO: 3567087 - RNA, 18 nt, Pseudomonas putida KT2440
caccuucgagccaccggc

SEQ ID NO: 3567088 - RNA, 22 nt, Pseudomonas putida KT2440
caccuucgagccaccggcauag

SEQ ID NO: 3567089 - RNA, 21 nt, Pseudomonas putida KT2440
caccuucgauuagacccagau

SEQ ID NO: 3567090 - RNA, 14 nt, Pseudomonas putida KT2440
caccuucucacuga

SEQ ID NO: 3567091 - RNA, 15 nt, Pseudomonas putida KT2440
caccuugaagugcgc

SEQ ID NO: 3567092 - RNA, 16 nt, Pseudomonas putida KT2440
caccuugaugcgcgag

SEQ ID NO: 3567093 - RNA, 21 nt, Pseudomonas putida KT2440
caccuugaugcgcgagcuggg

SEQ ID NO: 3567094 - RNA, 19 nt, Pseudomonas putida KT2440
caccuugcccaaccguucc

SEQ ID NO: 3567095 - RNA, 13 nt, Pseudomonas putida KT2440
caccuugccuggg

SEQ ID NO: 3567096 - RNA, 22 nt, Pseudomonas putida KT2440
caccuugcugaaauccagccgc

SEQ ID NO: 3567097 - RNA, 17 nt, Pseudomonas putida KT2440
caccuugggagucggcu

SEQ ID NO: 3567098 - RNA, 13 nt, Pseudomonas putida KT2440
caccuugggcgag

SEQ ID NO: 3567099 - RNA, 20 nt, Pseudomonas putida KT2440
caccuuggugcgcgcaucca

SEQ ID NO: 3567100 - RNA, 16 nt, Pseudomonas putida KT2440
caccuuguccagcagg

SEQ ID NO: 3567101 - RNA, 13 nt, Pseudomonas putida KT2440
caccuugugcacg

SEQ ID NO: 3567102 - RNA, 18 nt, Pseudomonas putida KT2440
caccuugugcggcccucg

SEQ ID NO: 3567103 - RNA, 16 nt, Pseudomonas putida KT2440
caccuuguuacccgca

SEQ ID NO: 3567104 - RNA, 18 nt, Pseudomonas putida KT2440
caccuuucuccaggugga

SEQ ID NO: 3567105 - RNA, 13 nt, Pseudomonas putida KT2440
caccuuugaccgu

SEQ ID NO: 3567106 - RNA, 17 nt, Pseudomonas putida KT2440
caccuuuuccacuugca

SEQ ID NO: 3567107 - RNA, 15 nt, Pseudomonas putida KT2440
cacgaaaaagccagc

SEQ ID NO: 3567108 - RNA, 16 nt, Pseudomonas putida KT2440
cacgaacaccagcccc

SEQ ID NO: 3567109 - RNA, 18 nt, Pseudomonas putida KT2440
cacgaacaccagccccag

SEQ ID NO: 3567110 - RNA, 13 nt, Pseudomonas putida KT2440
cacgaacagccag

SEQ ID NO: 3567111 - RNA, 13 nt, Pseudomonas putida KT2440
cacgaacagcggc

SEQ ID NO: 3567112 - RNA, 11 nt, Pseudomonas putida KT2440
cacgaacaggc

SEQ ID NO: 3567113 - RNA, 17 nt, Pseudomonas putida KT2440
cacgaacaucagcagga

SEQ ID NO: 3567114 - RNA, 14 nt, Pseudomonas putida KT2440
cacgaaccugugca

SEQ ID NO: 3567115 - RNA, 18 nt, Pseudomonas putida KT2440
cacgaacgcccccagccc

SEQ ID NO: 3567116 - RNA, 20 nt, Pseudomonas putida KT2440
cacgaacuuguuggccacca

SEQ ID NO: 3567117 - RNA, 14 nt, Pseudomonas putida KT2440
cacgaagcccaguu

SEQ ID NO: 3567118 - RNA, 14 nt, Pseudomonas putida KT2440
cacgaagcgcggca

SEQ ID NO: 3567119 - RNA, 20 nt, Pseudomonas putida KT2440
cacgaaguaacggccacggu

SEQ ID NO: 3567120 - RNA, 21 nt, Pseudomonas putida KT2440
cacgaaguugagcaccggcag

SEQ ID NO: 3567121 - RNA, 21 nt, Pseudomonas putida KT2440
cacgaaucgauaccugggucc

SEQ ID NO: 3567122 - RNA, 17 nt, Pseudomonas putida KT2440
cacgaauggguggcagc

SEQ ID NO: 3567123 - RNA, 19 nt, Pseudomonas putida KT2440
cacgaccggcucaacagca

SEQ ID NO: 3567124 - RNA, 19 nt, Pseudomonas putida KT2440
cacgacgauggccaccagc

SEQ ID NO: 3567125 - RNA, 18 nt, Pseudomonas putida KT2440
cacgacgcucggacagcu

SEQ ID NO: 3567126 - RNA, 19 nt, Pseudomonas putida KT2440
cacgacugacguaguccuu

SEQ ID NO: 3567127 - RNA, 16 nt, Pseudomonas putida KT2440
cacgagacauccgcaa

SEQ ID NO: 3567128 - RNA, 19 nt, Pseudomonas putida KT2440
cacgagacauccgcaacau

SEQ ID NO: 3567129 - RNA, 14 nt, Pseudomonas putida KT2440
cacgagauguacag

SEQ ID NO: 3567130 - RNA, 17 nt, Pseudomonas putida KT2440
cacgagcggccuugucg

SEQ ID NO: 3567131 - RNA, 16 nt, Pseudomonas putida KT2440
cacgauagcgucagca

SEQ ID NO: 3567132 - RNA, 13 nt, Pseudomonas putida KT2440
cacgaucagcagc

SEQ ID NO: 3567133 - RNA, 14 nt, Pseudomonas putida KT2440
cacgaucagcagca

SEQ ID NO: 3567134 - RNA, 18 nt, Pseudomonas putida KT2440
cacgaucagcgcggcaaa

SEQ ID NO: 3567135 - RNA, 12 nt, Pseudomonas putida KT2440
cacgaucaugcu

SEQ ID NO: 3567136 - RNA, 17 nt, Pseudomonas putida KT2440
cacgaucaugcuggcca

SEQ ID NO: 3567137 - RNA, 20 nt, Pseudomonas putida KT2440
cacgaucaugcuggccagga

SEQ ID NO: 3567138 - RNA, 13 nt, Pseudomonas putida KT2440
cacgauccccggc

SEQ ID NO: 3567139 - RNA, 18 nt, Pseudomonas putida KT2440
cacgaucucacgcgccac

SEQ ID NO: 3567140 - RNA, 17 nt, Pseudomonas putida KT2440
cacgaucucgucacugc

SEQ ID NO: 3567141 - RNA, 17 nt, Pseudomonas putida KT2440
cacgaucucuucaccgu

SEQ ID NO: 3567142 - RNA, 18 nt, Pseudomonas putida KT2440
cacgaucucuucaccgua

SEQ ID NO: 3567143 - RNA, 21 nt, Pseudomonas putida KT2440
cacgaugcccauggcgcagcu

SEQ ID NO: 3567144 - RNA, 17 nt, Pseudomonas putida KT2440
cacgaugccugggcggu

SEQ ID NO: 3567145 - RNA, 22 nt, Pseudomonas putida KT2440
cacgcaaaaccugagucaggcg

SEQ ID NO: 3567146 - RNA, 20 nt, Pseudomonas putida KT2440
cacgcaacugaugggucuug

SEQ ID NO: 3567147 - RNA, 14 nt, Pseudomonas putida KT2440
cacgcaagcccccc

SEQ ID NO: 3567148 - RNA, 15 nt, Pseudomonas putida KT2440
cacgcaagcggcccu

SEQ ID NO: 3567149 - RNA, 12 nt, Pseudomonas putida KT2440
cacgcacagugg

SEQ ID NO: 3567150 - RNA, 13 nt, Pseudomonas putida KT2440
cacgcacaguggu

SEQ ID NO: 3567151 - RNA, 13 nt, Pseudomonas putida KT2440
cacgcacaucacg

SEQ ID NO: 3567152 - RNA, 15 nt, Pseudomonas putida KT2440
cacgcacaucggcaa

SEQ ID NO: 3567153 - RNA, 19 nt, Pseudomonas putida KT2440
cacgcacauucaggaugcu

SEQ ID NO: 3567154 - RNA, 18 nt, Pseudomonas putida KT2440
cacgcaccaccccggggc

SEQ ID NO: 3567155 - RNA, 14 nt, Pseudomonas putida KT2440
cacgcaccucggcc

SEQ ID NO: 3567156 - RNA, 21 nt, Pseudomonas putida KT2440
cacgcacgaucucccggcuca

SEQ ID NO: 3567157 - RNA, 15 nt, Pseudomonas putida KT2440
cacgcagagcauggu

SEQ ID NO: 3567158 - RNA, 17 nt, Pseudomonas putida KT2440
cacgcagccaguucgac

SEQ ID NO: 3567159 - RNA, 12 nt, Pseudomonas putida KT2440
cacgcaggccag

SEQ ID NO: 3567160 - RNA, 17 nt, Pseudomonas putida KT2440
cacgcaggccagcgcac

SEQ ID NO: 3567161 - RNA, 12 nt, Pseudomonas putida KT2440
cacgcaggccca

SEQ ID NO: 3567162 - RNA, 15 nt, Pseudomonas putida KT2440
cacgcaucugcaccg

SEQ ID NO: 3567163 - RNA, 18 nt, Pseudomonas putida KT2440
cacgcaucugcaccuggu

SEQ ID NO: 3567164 - RNA, 18 nt, Pseudomonas putida KT2440
cacgcaucugcgcuaccu

SEQ ID NO: 3567165 - RNA, 17 nt, Pseudomonas putida KT2440
cacgcaugcgcgacagc

SEQ ID NO: 3567166 - RNA, 15 nt, Pseudomonas putida KT2440
cacgcauggccgagg

SEQ ID NO: 3567167 - RNA, 15 nt, Pseudomonas putida KT2440
cacgcaugucagggg

SEQ ID NO: 3567168 - RNA, 20 nt, Pseudomonas putida KT2440
cacgcauguccuuggcccag

SEQ ID NO: 3567169 - RNA, 14 nt, Pseudomonas putida KT2440
cacgccaccaugcu

SEQ ID NO: 3567170 - RNA, 20 nt, Pseudomonas putida KT2440
cacgccaccaugcucggcca

SEQ ID NO: 3567171 - RNA, 23 nt, Pseudomonas putida KT2440
cacgccaccaugcucggccagcu

SEQ ID NO: 3567172 - RNA, 15 nt, Pseudomonas putida KT2440
cacgccaccgcgcgc

SEQ ID NO: 3567173 - RNA, 16 nt, Pseudomonas putida KT2440
cacgccacggaacauc

SEQ ID NO: 3567174 - RNA, 20 nt, Pseudomonas putida KT2440
cacgccacggaacaucgagg

SEQ ID NO: 3567175 - RNA, 16 nt, Pseudomonas putida KT2440
cacgccagaaccugac

SEQ ID NO: 3567176 - RNA, 18 nt, Pseudomonas putida KT2440
cacgccagccaguacggc

SEQ ID NO: 3567177 - RNA, 23 nt, Pseudomonas putida KT2440
cacgccagccaguacggcagcca

SEQ ID NO: 3567178 - RNA, 13 nt, Pseudomonas putida KT2440
cacgccagccguu

SEQ ID NO: 3567179 - RNA, 19 nt, Pseudomonas putida KT2440
cacgccauccccccagccc

SEQ ID NO: 3567180 - RNA, 21 nt, Pseudomonas putida KT2440
cacgccauuguucgccucguc

SEQ ID NO: 3567181 - RNA, 14 nt, Pseudomonas putida KT2440
cacgcccaacccag

SEQ ID NO: 3567182 - RNA, 12 nt, Pseudomonas putida KT2440
cacgcccaggcg

SEQ ID NO: 3567183 - RNA, 16 nt, Pseudomonas putida KT2440
cacgcccaucagcgcc

SEQ ID NO: 3567184 - RNA, 19 nt, Pseudomonas putida KT2440
cacgcccaucaggaacagc

SEQ ID NO: 3567185 - RNA, 21 nt, Pseudomonas putida KT2440
cacgcccaucaggaacagcuc

SEQ ID NO: 3567186 - RNA, 19 nt, Pseudomonas putida KT2440
cacgcccauuuccgggcaa

SEQ ID NO: 3567187 - RNA, 23 nt, Pseudomonas putida KT2440
cacgccccuuggcacggccagcc

SEQ ID NO: 3567188 - RNA, 16 nt, Pseudomonas putida KT2440
cacgcccgacuggcug

SEQ ID NO: 3567189 - RNA, 20 nt, Pseudomonas putida KT2440
cacgcccgacuggcuggccu

SEQ ID NO: 3567190 - RNA, 20 nt, Pseudomonas putida KT2440
cacgcccgccggcacuuccu

SEQ ID NO: 3567191 - RNA, 22 nt, Pseudomonas putida KT2440
cacgcccgcgugcuucaagcca

SEQ ID NO: 3567192 - RNA, 12 nt, Pseudomonas putida KT2440
cacgcccgcucc

SEQ ID NO: 3567193 - RNA, 13 nt, Pseudomonas putida KT2440
cacgcccgggcca

SEQ ID NO: 3567194 - RNA, 16 nt, Pseudomonas putida KT2440
cacgcccgggccaggc

SEQ ID NO: 3567195 - RNA, 17 nt, Pseudomonas putida KT2440
cacgcccgugcucacgc

SEQ ID NO: 3567196 - RNA, 19 nt, Pseudomonas putida KT2440
cacgcccgugcucacgcac

SEQ ID NO: 3567197 - RNA, 17 nt, Pseudomonas putida KT2440
cacgcccuagaacaggc

SEQ ID NO: 3567198 - RNA, 13 nt, Pseudomonas putida KT2440
cacgcccuggccc

SEQ ID NO: 3567199 - RNA, 20 nt, Pseudomonas putida KT2440
cacgcccuggcccgccgcca

SEQ ID NO: 3567200 - RNA, 15 nt, Pseudomonas putida KT2440
cacgcccuugcccca

SEQ ID NO: 3567201 - RNA, 20 nt, Pseudomonas putida KT2440
cacgcccuuuuucaccaggc

SEQ ID NO: 3567202 - RNA, 16 nt, Pseudomonas putida KT2440
cacgccgaagcgcgcc

SEQ ID NO: 3567203 - RNA, 20 nt, Pseudomonas putida KT2440
cacgccgaagcgcgccuggu

SEQ ID NO: 3567204 - RNA, 17 nt, Pseudomonas putida KT2440
cacgccgaccgcgcgca

SEQ ID NO: 3567205 - RNA, 18 nt, Pseudomonas putida KT2440
cacgccgaccgcgcgcac

SEQ ID NO: 3567206 - RNA, 22 nt, Pseudomonas putida KT2440
cacgccgccgauaccgaacacc

SEQ ID NO: 3567207 - RNA, 20 nt, Pseudomonas putida KT2440
cacgccgcugcggcugcucg

SEQ ID NO: 3567208 - RNA, 18 nt, Pseudomonas putida KT2440
cacgccgcugguacaggg

SEQ ID NO: 3567209 - RNA, 17 nt, Pseudomonas putida KT2440
cacgccggcaaccccug

SEQ ID NO: 3567210 - RNA, 15 nt, Pseudomonas putida KT2440
cacgccuuaguucac

SEQ ID NO: 3567211 - RNA, 22 nt, Pseudomonas putida KT2440
cacgccuuaguucacccacacc

SEQ ID NO: 3567212 - RNA, 14 nt, Pseudomonas putida KT2440
cacgccuuccaccg

SEQ ID NO: 3567213 - RNA, 11 nt, Pseudomonas putida KT2440
cacgcgacgaa

SEQ ID NO: 3567214 - RNA, 23 nt, Pseudomonas putida KT2440
cacgcgacgaagaugucgaugua

SEQ ID NO: 3567215 - RNA, 20 nt, Pseudomonas putida KT2440
cacgcgacgggaagugcacu

SEQ ID NO: 3567216 - RNA, 13 nt, Pseudomonas putida KT2440
cacgcgaucggca

SEQ ID NO: 3567217 - RNA, 15 nt, Pseudomonas putida KT2440
cacgcgcaaaugcuu

SEQ ID NO: 3567218 - RNA, 13 nt, Pseudomonas putida KT2440
cacgcgcaggcca

SEQ ID NO: 3567219 - RNA, 17 nt, Pseudomonas putida KT2440
cacgcgcaggcgcugca

SEQ ID NO: 3567220 - RNA, 24 nt, Pseudomonas putida KT2440
cacgcgcaguucgauguaggcagc

SEQ ID NO: 3567221 - RNA, 13 nt, Pseudomonas putida KT2440
cacgcgccagcag

SEQ ID NO: 3567222 - RNA, 20 nt, Pseudomonas putida KT2440
cacgcgcccggugcaagcca

SEQ ID NO: 3567223 - RNA, 23 nt, Pseudomonas putida KT2440
cacgcgccucuugcaccuguccc

SEQ ID NO: 3567224 - RNA, 14 nt, Pseudomonas putida KT2440
cacgcgcuuuucca

SEQ ID NO: 3567225 - RNA, 16 nt, Pseudomonas putida KT2440
cacgcgcuuuuccagc

SEQ ID NO: 3567226 - RNA, 23 nt, Pseudomonas putida KT2440
cacgcggcgcuuauggcgccgcg

SEQ ID NO: 3567227 - RNA, 14 nt, Pseudomonas putida KT2440
cacgcggcgucacc

SEQ ID NO: 3567228 - RNA, 16 nt, Pseudomonas putida KT2440
cacgcgguauucgaga

SEQ ID NO: 3567229 - RNA, 23 nt, Pseudomonas putida KT2440
cacgcggugggucgacgaacacg

SEQ ID NO: 3567230 - RNA, 19 nt, Pseudomonas putida KT2440
cacgcguaccccuggcgcu

SEQ ID NO: 3567231 - RNA, 20 nt, Pseudomonas putida KT2440
cacgcguugggggugcuuuu

SEQ ID NO: 3567232 - RNA, 18 nt, Pseudomonas putida KT2440
cacgcuaacccccacgcu

SEQ ID NO: 3567233 - RNA, 16 nt, Pseudomonas putida KT2440
cacgcuaauacccugu

SEQ ID NO: 3567234 - RNA, 23 nt, Pseudomonas putida KT2440
cacgcuaccaccuggcucggugu

SEQ ID NO: 3567235 - RNA, 20 nt, Pseudomonas putida KT2440
cacgcucaaccccaucaccu

SEQ ID NO: 3567236 - RNA, 13 nt, Pseudomonas putida KT2440
cacgcucagugug

SEQ ID NO: 3567237 - RNA, 18 nt, Pseudomonas putida KT2440
cacgcucaugcugguuug

SEQ ID NO: 3567238 - RNA, 13 nt, Pseudomonas putida KT2440
cacgcuccaggua

SEQ ID NO: 3567239 - RNA, 21 nt, Pseudomonas putida KT2440
cacgcuccgggugcggcauca

SEQ ID NO: 3567240 - RNA, 10 nt, Pseudomonas putida KT2440
cacgcuccug

SEQ ID NO: 3567241 - RNA, 23 nt, Pseudomonas putida KT2440
cacgcuccuucgccacgaacagg

SEQ ID NO: 3567242 - RNA, 14 nt, Pseudomonas putida KT2440
cacgcucgcgcagg

SEQ ID NO: 3567243 - RNA, 15 nt, Pseudomonas putida KT2440
cacgcucggccagua

SEQ ID NO: 3567244 - RNA, 21 nt, Pseudomonas putida KT2440
cacgcucuguaucgaacaggc

SEQ ID NO: 3567245 - RNA, 16 nt, Pseudomonas putida KT2440
cacgcugccaggaccg

SEQ ID NO: 3567246 - RNA, 14 nt, Pseudomonas putida KT2440
cacgcugcccaggu

SEQ ID NO: 3567247 - RNA, 21 nt, Pseudomonas putida KT2440
cacgcugcccaggugccaggc

SEQ ID NO: 3567248 - RNA, 23 nt, Pseudomonas putida KT2440
cacgcugcggcgaaagccagcag

SEQ ID NO: 3567249 - RNA, 14 nt, Pseudomonas putida KT2440
cacgcuggcaccca

SEQ ID NO: 3567250 - RNA, 13 nt, Pseudomonas putida KT2440
cacgcuggccauu

SEQ ID NO: 3567251 - RNA, 20 nt, Pseudomonas putida KT2440
cacgcuggccauuucgcggc

SEQ ID NO: 3567252 - RNA, 15 nt, Pseudomonas putida KT2440
cacgcuuacagguag

SEQ ID NO: 3567253 - RNA, 14 nt, Pseudomonas putida KT2440
cacgcuugagcgcg

SEQ ID NO: 3567254 - RNA, 19 nt, Pseudomonas putida KT2440
cacgcuugucuuccagcug

SEQ ID NO: 3567255 - RNA, 20 nt, Pseudomonas putida KT2440
cacgcuugucuuccagcugc

SEQ ID NO: 3567256 - RNA, 22 nt, Pseudomonas putida KT2440
cacgcuuuucagggguucgccc

SEQ ID NO: 3567257 - RNA, 23 nt, Pseudomonas putida KT2440
cacggaagaucaccuggucgacc

SEQ ID NO: 3567258 - RNA, 23 nt, Pseudomonas putida KT2440
cacggagucagugugaccuucaa

SEQ ID NO: 3567259 - RNA, 16 nt, Pseudomonas putida KT2440
cacggcaagccacgcc

SEQ ID NO: 3567260 - RNA, 15 nt, Pseudomonas putida KT2440
cacggcaagccugac

SEQ ID NO: 3567261 - RNA, 21 nt, Pseudomonas putida KT2440
cacggcaauucgccggcagca

SEQ ID NO: 3567262 - RNA, 22 nt, Pseudomonas putida KT2440
cacggcaccagcaccagcuccu

SEQ ID NO: 3567263 - RNA, 20 nt, Pseudomonas putida KT2440
cacggcagcaaucgccgccu

SEQ ID NO: 3567264 - RNA, 20 nt, Pseudomonas putida KT2440
cacggccaauaucuggugca

SEQ ID NO: 3567265 - RNA, 17 nt, Pseudomonas putida KT2440
cacggccaccauguacu

SEQ ID NO: 3567266 - RNA, 16 nt, Pseudomonas putida KT2440
cacggccagccagcag

SEQ ID NO: 3567267 - RNA, 17 nt, Pseudomonas putida KT2440
cacggccauccugcugu

SEQ ID NO: 3567268 - RNA, 15 nt, Pseudomonas putida KT2440
cacggccguuggcca

SEQ ID NO: 3567269 - RNA, 13 nt, Pseudomonas putida KT2440
cacggccuggccu

SEQ ID NO: 3567270 - RNA, 16 nt, Pseudomonas putida KT2440
cacggccuggccugca

SEQ ID NO: 3567271 - RNA, 19 nt, Pseudomonas putida KT2440
cacggccuucccgccuggc

SEQ ID NO: 3567272 - RNA, 22 nt, Pseudomonas putida KT2440
cacggccuucccgccuggcgcc

SEQ ID NO: 3567273 - RNA, 15 nt, Pseudomonas putida KT2440
cacggccuucuucac

SEQ ID NO: 3567274 - RNA, 17 nt, Pseudomonas putida KT2440
cacggccuugucagcag

SEQ ID NO: 3567275 - RNA, 16 nt, Pseudomonas putida KT2440
cacggcgaugcgcccc

SEQ ID NO: 3567276 - RNA, 20 nt, Pseudomonas putida KT2440
cacggcgcaggccgacaaca

SEQ ID NO: 3567277 - RNA, 21 nt, Pseudomonas putida KT2440
cacggcgcaggccgacaacag

SEQ ID NO: 3567278 - RNA, 22 nt, Pseudomonas putida KT2440
cacggcgccgaccgaaccggcg

SEQ ID NO: 3567279 - RNA, 15 nt, Pseudomonas putida KT2440
cacggcgcugaccga

SEQ ID NO: 3567280 - RNA, 19 nt, Pseudomonas putida KT2440
cacggcgguucugcgcacg

SEQ ID NO: 3567281 - RNA, 13 nt, Pseudomonas putida KT2440
cacggcguagggc

SEQ ID NO: 3567282 - RNA, 22 nt, Pseudomonas putida KT2440
cacggcguccaggcccgccaga

SEQ ID NO: 3567283 - RNA, 14 nt, Pseudomonas putida KT2440
cacggcgucgagca

SEQ ID NO: 3567284 - RNA, 20 nt, Pseudomonas putida KT2440
cacggcguugccccuucgac

SEQ ID NO: 3567285 - RNA, 19 nt, Pseudomonas putida KT2440
cacggcuaaagccgcaccu

SEQ ID NO: 3567286 - RNA, 20 nt, Pseudomonas putida KT2440
cacggcugaacuuccagguc

SEQ ID NO: 3567287 - RNA, 13 nt, Pseudomonas putida KT2440
cacggcugaagaa

SEQ ID NO: 3567288 - RNA, 17 nt, Pseudomonas putida KT2440
cacggcugcccugcaug

SEQ ID NO: 3567289 - RNA, 21 nt, Pseudomonas putida KT2440
cacggcugcccugcauggcau

SEQ ID NO: 3567290 - RNA, 22 nt, Pseudomonas putida KT2440
cacggcuucgcagacgucuucc

SEQ ID NO: 3567291 - RNA, 15 nt, Pseudomonas putida KT2440
cacgggaaugaacug

SEQ ID NO: 3567292 - RNA, 17 nt, Pseudomonas putida KT2440
cacgggcaaacaggcug

SEQ ID NO: 3567293 - RNA, 12 nt, Pseudomonas putida KT2440
cacgggccagcg

SEQ ID NO: 3567294 - RNA, 18 nt, Pseudomonas putida KT2440
cacgggucaugccaccgc

SEQ ID NO: 3567295 - RNA, 15 nt, Pseudomonas putida KT2440
cacgguaccggcaau

SEQ ID NO: 3567296 - RNA, 14 nt, Pseudomonas putida KT2440
cacgguacgggcaa

SEQ ID NO: 3567297 - RNA, 19 nt, Pseudomonas putida KT2440
cacgguauagugguaugau

SEQ ID NO: 3567298 - RNA, 17 nt, Pseudomonas putida KT2440
cacgguaugcagguacc

SEQ ID NO: 3567299 - RNA, 18 nt, Pseudomonas putida KT2440
cacgguaugcagguacca

SEQ ID NO: 3567300 - RNA, 18 nt, Pseudomonas putida KT2440
cacggucagcauccagcc

SEQ ID NO: 3567301 - RNA, 16 nt, Pseudomonas putida KT2440
cacgguccaucaggug

SEQ ID NO: 3567302 - RNA, 22 nt, Pseudomonas putida KT2440
cacggucgaaccggucugcacg

SEQ ID NO: 3567303 - RNA, 17 nt, Pseudomonas putida KT2440
cacggucggccugcgcu

SEQ ID NO: 3567304 - RNA, 21 nt, Pseudomonas putida KT2440
cacggugacaaaggccggcac

SEQ ID NO: 3567305 - RNA, 16 nt, Pseudomonas putida KT2440
cacgguguauccagcc

SEQ ID NO: 3567306 - RNA, 19 nt, Pseudomonas putida KT2440
cacgguguauccagcccgg

SEQ ID NO: 3567307 - RNA, 18 nt, Pseudomonas putida KT2440
cacggugucgucgcuguc

SEQ ID NO: 3567308 - RNA, 13 nt, Pseudomonas putida KT2440
cacgguucuggca

SEQ ID NO: 3567309 - RNA, 15 nt, Pseudomonas putida KT2440
cacgguucuggucac

SEQ ID NO: 3567310 - RNA, 23 nt, Pseudomonas putida KT2440
cacgguugcgcccggcgucgaac

SEQ ID NO: 3567311 - RNA, 16 nt, Pseudomonas putida KT2440
cacgguuggcgaucca

SEQ ID NO: 3567312 - RNA, 19 nt, Pseudomonas putida KT2440
cacgguuuuauaccggcuc

SEQ ID NO: 3567313 - RNA, 16 nt, Pseudomonas putida KT2440
cacguaccuggcugca

SEQ ID NO: 3567314 - RNA, 18 nt, Pseudomonas putida KT2440
cacguaccuggcugcagu

SEQ ID NO: 3567315 - RNA, 19 nt, Pseudomonas putida KT2440
cacguaccuggcugcagug

SEQ ID NO: 3567316 - RNA, 14 nt, Pseudomonas putida KT2440
cacguagaacaggc

SEQ ID NO: 3567317 - RNA, 15 nt, Pseudomonas putida KT2440
cacguagaacaggcc

SEQ ID NO: 3567318 - RNA, 22 nt, Pseudomonas putida KT2440
cacguagaacaggccugcggcc

SEQ ID NO: 3567319 - RNA, 15 nt, Pseudomonas putida KT2440
cacguagugcuucug

SEQ ID NO: 3567320 - RNA, 14 nt, Pseudomonas putida KT2440
cacgucacagccaa

SEQ ID NO: 3567321 - RNA, 16 nt, Pseudomonas putida KT2440
cacgucacagccaagc

SEQ ID NO: 3567322 - RNA, 12 nt, Pseudomonas putida KT2440
cacgucacgcac

SEQ ID NO: 3567323 - RNA, 15 nt, Pseudomonas putida KT2440
cacgucacgcaccau

SEQ ID NO: 3567324 - RNA, 22 nt, Pseudomonas putida KT2440
cacgucauaguuguggcaacga

SEQ ID NO: 3567325 - RNA, 19 nt, Pseudomonas putida KT2440
cacguccaaugccgccuug

SEQ ID NO: 3567326 - RNA, 20 nt, Pseudomonas putida KT2440
cacguccacuaccuccagcc

SEQ ID NO: 3567327 - RNA, 16 nt, Pseudomonas putida KT2440
cacguccggccagcaa

SEQ ID NO: 3567328 - RNA, 19 nt, Pseudomonas putida KT2440
cacguccggccagcaacag

SEQ ID NO: 3567329 - RNA, 19 nt, Pseudomonas putida KT2440
cacguccguuccugcaguu

SEQ ID NO: 3567330 - RNA, 19 nt, Pseudomonas putida KT2440
cacguccuggucacggcca

SEQ ID NO: 3567331 - RNA, 17 nt, Pseudomonas putida KT2440
cacgucgccugggcauu

SEQ ID NO: 3567332 - RNA, 18 nt, Pseudomonas putida KT2440
cacgucgcgauugaucag

SEQ ID NO: 3567333 - RNA, 23 nt, Pseudomonas putida KT2440
cacgucgcgauugaucagcgccu

SEQ ID NO: 3567334 - RNA, 14 nt, Pseudomonas putida KT2440
cacgucgcgcaggg

SEQ ID NO: 3567335 - RNA, 17 nt, Pseudomonas putida KT2440
cacgucgcgcagggccu

SEQ ID NO: 3567336 - RNA, 19 nt, Pseudomonas putida KT2440
cacgucgcugucuucugcc

SEQ ID NO: 3567337 - RNA, 17 nt, Pseudomonas putida KT2440
cacgucggcgucagccg

SEQ ID NO: 3567338 - RNA, 20 nt, Pseudomonas putida KT2440
cacgucggcgucagccgcgg

SEQ ID NO: 3567339 - RNA, 14 nt, Pseudomonas putida KT2440
cacgucgguggcga

SEQ ID NO: 3567340 - RNA, 20 nt, Pseudomonas putida KT2440
cacgucuggcaccaguucca

SEQ ID NO: 3567341 - RNA, 13 nt, Pseudomonas putida KT2440
cacgugccuucac

SEQ ID NO: 3567342 - RNA, 14 nt, Pseudomonas putida KT2440
cacguuacgccaga

SEQ ID NO: 3567343 - RNA, 17 nt, Pseudomonas putida KT2440
cacguuauccagcugca

SEQ ID NO: 3567344 - RNA, 13 nt, Pseudomonas putida KT2440
cacguucaacgcc

SEQ ID NO: 3567345 - RNA, 12 nt, Pseudomonas putida KT2440
cacguucugcag

SEQ ID NO: 3567346 - RNA, 15 nt, Pseudomonas putida KT2440
cacguugcugccugu

SEQ ID NO: 3567347 - RNA, 18 nt, Pseudomonas putida KT2440
cacguuguagcccaccac

SEQ ID NO: 3567348 - RNA, 22 nt, Pseudomonas putida KT2440
cacguuugggcggcgugaccag

SEQ ID NO: 3567349 - RNA, 18 nt, Pseudomonas putida KT2440
cacuaagcgaaacaccag

SEQ ID NO: 3567350 - RNA, 15 nt, Pseudomonas putida KT2440
cacuacccaggccaa

SEQ ID NO: 3567351 - RNA, 20 nt, Pseudomonas putida KT2440
cacuaccgcaaaugcugcca

SEQ ID NO: 3567352 - RNA, 14 nt, Pseudomonas putida KT2440
cacuaccuccagcc

SEQ ID NO: 3567353 - RNA, 14 nt, Pseudomonas putida KT2440
cacuacgccggcca

SEQ ID NO: 3567354 - RNA, 18 nt, Pseudomonas putida KT2440
cacuagccccuacgucag

SEQ ID NO: 3567355 - RNA, 20 nt, Pseudomonas putida KT2440
cacucaagaaaucgggucau

SEQ ID NO: 3567356 - RNA, 14 nt, Pseudomonas putida KT2440
cacucaccgcgccc

SEQ ID NO: 3567357 - RNA, 18 nt, Pseudomonas putida KT2440
cacucacgcaacucuacc

SEQ ID NO: 3567358 - RNA, 20 nt, Pseudomonas putida KT2440
cacucagccgcugcgccugc

SEQ ID NO: 3567359 - RNA, 15 nt, Pseudomonas putida KT2440
cacucaggugagcca

SEQ ID NO: 3567360 - RNA, 20 nt, Pseudomonas putida KT2440
cacuccagcgaguggccacg

SEQ ID NO: 3567361 - RNA, 18 nt, Pseudomonas putida KT2440
cacuccagggucugcgcu

SEQ ID NO: 3567362 - RNA, 20 nt, Pseudomonas putida KT2440
cacucccacagauauugcac

SEQ ID NO: 3567363 - RNA, 17 nt, Pseudomonas putida KT2440
cacuccccaucagcagc

SEQ ID NO: 3567364 - RNA, 21 nt, Pseudomonas putida KT2440
cacucccccuuggugcaaugg

SEQ ID NO: 3567365 - RNA, 21 nt, Pseudomonas putida KT2440
cacuccccucgacgacacggc

SEQ ID NO: 3567366 - RNA, 18 nt, Pseudomonas putida KT2440
cacuccgcccguaugcau

SEQ ID NO: 3567367 - RNA, 20 nt, Pseudomonas putida KT2440
cacuccgcuuucagccgagc

SEQ ID NO: 3567368 - RNA, 21 nt, Pseudomonas putida KT2440
cacuccgggugaucauucagg

SEQ ID NO: 3567369 - RNA, 21 nt, Pseudomonas putida KT2440
cacuccggucguacacucacc

SEQ ID NO: 3567370 - RNA, 14 nt, Pseudomonas putida KT2440
cacuccugugcggc

SEQ ID NO: 3567371 - RNA, 19 nt, Pseudomonas putida KT2440
cacucgaauucagcccgcu

SEQ ID NO: 3567372 - RNA, 20 nt, Pseudomonas putida KT2440
cacucgaauucagcccgcuc

SEQ ID NO: 3567373 - RNA, 17 nt, Pseudomonas putida KT2440
cacucggcaaucagcau

SEQ ID NO: 3567374 - RNA, 12 nt, Pseudomonas putida KT2440
cacucgucgauc

SEQ ID NO: 3567375 - RNA, 17 nt, Pseudomonas putida KT2440
cacucucgcggugccuu

SEQ ID NO: 3567376 - RNA, 14 nt, Pseudomonas putida KT2440
cacucugccgcccc

SEQ ID NO: 3567377 - RNA, 16 nt, Pseudomonas putida KT2440
cacucugccgccccuc

SEQ ID NO: 3567378 - RNA, 17 nt, Pseudomonas putida KT2440
cacucugccgccccucc

SEQ ID NO: 3567379 - RNA, 19 nt, Pseudomonas putida KT2440
cacucugccgccccuccac

SEQ ID NO: 3567380 - RNA, 23 nt, Pseudomonas putida KT2440
cacucugccgccccuccacccac

SEQ ID NO: 3567381 - RNA, 16 nt, Pseudomonas putida KT2440
cacugacaaagccugc

SEQ ID NO: 3567382 - RNA, 17 nt, Pseudomonas putida KT2440
cacugacaaagccugca

SEQ ID NO: 3567383 - RNA, 21 nt, Pseudomonas putida KT2440
cacugacaaagccugcaccca

SEQ ID NO: 3567384 - RNA, 15 nt, Pseudomonas putida KT2440
cacugaccaccugga

SEQ ID NO: 3567385 - RNA, 18 nt, Pseudomonas putida KT2440
cacugaccacuucaagca

SEQ ID NO: 3567386 - RNA, 20 nt, Pseudomonas putida KT2440
cacugacccucaagugccgu

SEQ ID NO: 3567387 - RNA, 13 nt, Pseudomonas putida KT2440
cacugagcaccac

SEQ ID NO: 3567388 - RNA, 19 nt, Pseudomonas putida KT2440
cacugaggcguagcacaag

SEQ ID NO: 3567389 - RNA, 20 nt, Pseudomonas putida KT2440
cacugaguaacucaccuggu

SEQ ID NO: 3567390 - RNA, 20 nt, Pseudomonas putida KT2440
cacugagucaaucgauguac

SEQ ID NO: 3567391 - RNA, 14 nt, Pseudomonas putida KT2440
cacugaucgcuugc

SEQ ID NO: 3567392 - RNA, 22 nt, Pseudomonas putida KT2440
cacugaucgggauuacaugaug

SEQ ID NO: 3567393 - RNA, 21 nt, Pseudomonas putida KT2440
cacugcacggcaauugccacc

SEQ ID NO: 3567394 - RNA, 20 nt, Pseudomonas putida KT2440
cacugcagaucaccagcucg

SEQ ID NO: 3567395 - RNA, 23 nt, Pseudomonas putida KT2440
cacugcagaucaccagcucgccc

SEQ ID NO: 3567396 - RNA, 14 nt, Pseudomonas putida KT2440
cacugcaggagcgg

SEQ ID NO: 3567397 - RNA, 17 nt, Pseudomonas putida KT2440
cacugcaggagcgggca

SEQ ID NO: 3567398 - RNA, 18 nt, Pseudomonas putida KT2440
cacugcauuggccacgcc

SEQ ID NO: 3567399 - RNA, 20 nt, Pseudomonas putida KT2440
cacugcauuggccacgccca

SEQ ID NO: 3567400 - RNA, 17 nt, Pseudomonas putida KT2440
cacugccaccgugagca

SEQ ID NO: 3567401 - RNA, 13 nt, Pseudomonas putida KT2440
cacugccagcacc

SEQ ID NO: 3567402 - RNA, 16 nt, Pseudomonas putida KT2440
cacugccagcaccugg

SEQ ID NO: 3567403 - RNA, 21 nt, Pseudomonas putida KT2440
cacugccagcccggcggccag

SEQ ID NO: 3567404 - RNA, 13 nt, Pseudomonas putida KT2440
cacugccagcgcc

SEQ ID NO: 3567405 - RNA, 21 nt, Pseudomonas putida KT2440
cacugcccaagccauccacca

SEQ ID NO: 3567406 - RNA, 12 nt, Pseudomonas putida KT2440
cacugcccggcg

SEQ ID NO: 3567407 - RNA, 13 nt, Pseudomonas putida KT2440
cacugccggcaaa

SEQ ID NO: 3567408 - RNA, 12 nt, Pseudomonas putida KT2440
cacugccugcau

SEQ ID NO: 3567409 - RNA, 22 nt, Pseudomonas putida KT2440
cacugccuggccacuguugcag

SEQ ID NO: 3567410 - RNA, 19 nt, Pseudomonas putida KT2440
cacugccuggcucaggcgc

SEQ ID NO: 3567411 - RNA, 13 nt, Pseudomonas putida KT2440
cacugcgcgccgu

SEQ ID NO: 3567412 - RNA, 22 nt, Pseudomonas putida KT2440
cacugcggguaaagcccgcagu

SEQ ID NO: 3567413 - RNA, 21 nt, Pseudomonas putida KT2440
cacugcguauuuuugcgccag

SEQ ID NO: 3567414 - RNA, 21 nt, Pseudomonas putida KT2440
cacugcguucaucgaacugca

SEQ ID NO: 3567415 - RNA, 23 nt, Pseudomonas putida KT2440
cacugcguucaucgaacugcaag

SEQ ID NO: 3567416 - RNA, 20 nt, Pseudomonas putida KT2440
cacugcucaucggcgccggc

SEQ ID NO: 3567417 - RNA, 16 nt, Pseudomonas putida KT2440
cacugcucaucugcgc

SEQ ID NO: 3567418 - RNA, 19 nt, Pseudomonas putida KT2440
cacugcucaucugcgccag

SEQ ID NO: 3567419 - RNA, 14 nt, Pseudomonas putida KT2440
cacugcugccgccc

SEQ ID NO: 3567420 - RNA, 15 nt, Pseudomonas putida KT2440
cacugcugccgcccu

SEQ ID NO: 3567421 - RNA, 23 nt, Pseudomonas putida KT2440
cacugcugccgcccucuugcugc

SEQ ID NO: 3567422 - RNA, 22 nt, Pseudomonas putida KT2440
cacugcuguaaucggcgcugac

SEQ ID NO: 3567423 - RNA, 13 nt, Pseudomonas putida KT2440
cacuggaacucga

SEQ ID NO: 3567424 - RNA, 22 nt, Pseudomonas putida KT2440
cacuggaacucgaucggcaccc

SEQ ID NO: 3567425 - RNA, 23 nt, Pseudomonas putida KT2440
cacuggaacucgaucggcacccc

SEQ ID NO: 3567426 - RNA, 18 nt, Pseudomonas putida KT2440
cacuggaugacgccgcag

SEQ ID NO: 3567427 - RNA, 21 nt, Pseudomonas putida KT2440
cacuggaugacgccgcagccg

SEQ ID NO: 3567428 - RNA, 17 nt, Pseudomonas putida KT2440
cacuggcaacggguagc

SEQ ID NO: 3567429 - RNA, 14 nt, Pseudomonas putida KT2440
cacuggcaggccuu

SEQ ID NO: 3567430 - RNA, 15 nt, Pseudomonas putida KT2440
cacuggcaggccuug

SEQ ID NO: 3567431 - RNA, 14 nt, Pseudomonas putida KT2440
cacuggcaggcuca

SEQ ID NO: 3567432 - RNA, 20 nt, Pseudomonas putida KT2440
cacuggcaggcucagggcag

SEQ ID NO: 3567433 - RNA, 12 nt, Pseudomonas putida KT2440
cacuggcauccg

SEQ ID NO: 3567434 - RNA, 16 nt, Pseudomonas putida KT2440
cacuggcauccggcag

SEQ ID NO: 3567435 - RNA, 19 nt, Pseudomonas putida KT2440
cacuggccacauggaucag

SEQ ID NO: 3567436 - RNA, 21 nt, Pseudomonas putida KT2440
cacuggccacauggaucagcu

SEQ ID NO: 3567437 - RNA, 13 nt, Pseudomonas putida KT2440
cacuggccacccc

SEQ ID NO: 3567438 - RNA, 14 nt, Pseudomonas putida KT2440
cacuggccaccccc

SEQ ID NO: 3567439 - RNA, 12 nt, Pseudomonas putida KT2440
cacuggccagca

SEQ ID NO: 3567440 - RNA, 23 nt, Pseudomonas putida KT2440
cacuggcugauagccgccagcau

SEQ ID NO: 3567441 - RNA, 23 nt, Pseudomonas putida KT2440
cacuggcugcugcgguuugcucu

SEQ ID NO: 3567442 - RNA, 12 nt, Pseudomonas putida KT2440
cacuggcuuccu

SEQ ID NO: 3567443 - RNA, 18 nt, Pseudomonas putida KT2440
cacuggcuuucccccagc

SEQ ID NO: 3567444 - RNA, 13 nt, Pseudomonas putida KT2440
cacugggcgaagg

SEQ ID NO: 3567445 - RNA, 15 nt, Pseudomonas putida KT2440
cacugguacagcuca

SEQ ID NO: 3567446 - RNA, 15 nt, Pseudomonas putida KT2440
cacugguaguucauc

SEQ ID NO: 3567447 - RNA, 21 nt, Pseudomonas putida KT2440
cacuggucgccucgacgcaga

SEQ ID NO: 3567448 - RNA, 16 nt, Pseudomonas putida KT2440
cacuguagcgcccuug

SEQ ID NO: 3567449 - RNA, 22 nt, Pseudomonas putida KT2440
cacuguaggagauucuauggcc

SEQ ID NO: 3567450 - RNA, 15 nt, Pseudomonas putida KT2440
cacuguaggcaaaca

SEQ ID NO: 3567451 - RNA, 23 nt, Pseudomonas putida KT2440
cacugucaaucuugcgcacgcgc

SEQ ID NO: 3567452 - RNA, 22 nt, Pseudomonas putida KT2440
cacugucggguuggucgccagg

SEQ ID NO: 3567453 - RNA, 13 nt, Pseudomonas putida KT2440
cacugugcagggg

SEQ ID NO: 3567454 - RNA, 16 nt, Pseudomonas putida KT2440
cacugugcaggggagg

SEQ ID NO: 3567455 - RNA, 19 nt, Pseudomonas putida KT2440
cacugugcccgccaggcgc

SEQ ID NO: 3567456 - RNA, 19 nt, Pseudomonas putida KT2440
cacugugcuggggccagcc

SEQ ID NO: 3567457 - RNA, 15 nt, Pseudomonas putida KT2440
cacuguggucaucca

SEQ ID NO: 3567458 - RNA, 21 nt, Pseudomonas putida KT2440
cacuguggucgaauagcgcga

SEQ ID NO: 3567459 - RNA, 13 nt, Pseudomonas putida KT2440
cacuguucaggug

SEQ ID NO: 3567460 - RNA, 15 nt, Pseudomonas putida KT2440
cacuguucagguguu

SEQ ID NO: 3567461 - RNA, 22 nt, Pseudomonas putida KT2440
cacuguugcuggcgacgcugcc

SEQ ID NO: 3567462 - RNA, 20 nt, Pseudomonas putida KT2440
cacuuacaaccccaaccuca

SEQ ID NO: 3567463 - RNA, 15 nt, Pseudomonas putida KT2440
cacuucaagcacgcc

SEQ ID NO: 3567464 - RNA, 15 nt, Pseudomonas putida KT2440
cacuucaaguucguu

SEQ ID NO: 3567465 - RNA, 20 nt, Pseudomonas putida KT2440
cacuucaaguucguuggcga

SEQ ID NO: 3567466 - RNA, 19 nt, Pseudomonas putida KT2440
cacuucaggcugcgccgcc

SEQ ID NO: 3567467 - RNA, 13 nt, Pseudomonas putida KT2440
cacuucauccagc

SEQ ID NO: 3567468 - RNA, 12 nt, Pseudomonas putida KT2440
cacuuccacacc

SEQ ID NO: 3567469 - RNA, 14 nt, Pseudomonas putida KT2440
cacuuccacacccg

SEQ ID NO: 3567470 - RNA, 15 nt, Pseudomonas putida KT2440
cacuuccagcagcuu

SEQ ID NO: 3567471 - RNA, 16 nt, Pseudomonas putida KT2440
cacuuccaggaaggcc

SEQ ID NO: 3567472 - RNA, 19 nt, Pseudomonas putida KT2440
cacuuccaggaaggccucg

SEQ ID NO: 3567473 - RNA, 13 nt, Pseudomonas putida KT2440
cacuuccauggca

SEQ ID NO: 3567474 - RNA, 16 nt, Pseudomonas putida KT2440
cacuuccauggcaucg

SEQ ID NO: 3567475 - RNA, 20 nt, Pseudomonas putida KT2440
cacuucccacguaccuuuca

SEQ ID NO: 3567476 - RNA, 22 nt, Pseudomonas putida KT2440
cacuucccguucgcggucgguc

SEQ ID NO: 3567477 - RNA, 17 nt, Pseudomonas putida KT2440
cacuuccggcugcagca

SEQ ID NO: 3567478 - RNA, 17 nt, Pseudomonas putida KT2440
cacuucgauacccagcc

SEQ ID NO: 3567479 - RNA, 18 nt, Pseudomonas putida KT2440
cacuucgauacccagcca

SEQ ID NO: 3567480 - RNA, 20 nt, Pseudomonas putida KT2440
cacuucgaucaggcagucuu

SEQ ID NO: 3567481 - RNA, 20 nt, Pseudomonas putida KT2440
cacuucgccguacuggcugc

SEQ ID NO: 3567482 - RNA, 15 nt, Pseudomonas putida KT2440
cacuucgccuuccuc

SEQ ID NO: 3567483 - RNA, 23 nt, Pseudomonas putida KT2440
cacuucgcgagcgagcgguugca

SEQ ID NO: 3567484 - RNA, 14 nt, Pseudomonas putida KT2440
cacuucugccggua

SEQ ID NO: 3567485 - RNA, 22 nt, Pseudomonas putida KT2440
cacuucugcggccagggcaucg

SEQ ID NO: 3567486 - RNA, 18 nt, Pseudomonas putida KT2440
cacuucugcuaaucgcug

SEQ ID NO: 3567487 - RNA, 12 nt, Pseudomonas putida KT2440
cacuugaagacc

SEQ ID NO: 3567488 - RNA, 20 nt, Pseudomonas putida KT2440
cacuugcacuuugccgcccg

SEQ ID NO: 3567489 - RNA, 22 nt, Pseudomonas putida KT2440
cacuugcacuuugccgcccgcu

SEQ ID NO: 3567490 - RNA, 15 nt, Pseudomonas putida KT2440
cacuugcagaaacgc

SEQ ID NO: 3567491 - RNA, 20 nt, Pseudomonas putida KT2440
cacuugccagccgcccaagc

SEQ ID NO: 3567492 - RNA, 15 nt, Pseudomonas putida KT2440
cacuugccgcccucc

SEQ ID NO: 3567493 - RNA, 14 nt, Pseudomonas putida KT2440
cacuugcuggguac

SEQ ID NO: 3567494 - RNA, 23 nt, Pseudomonas putida KT2440
cacuuggccccagggaucgaugc

SEQ ID NO: 3567495 - RNA, 15 nt, Pseudomonas putida KT2440
cacuugucccggccc

SEQ ID NO: 3567496 - RNA, 15 nt, Pseudomonas putida KT2440
cacuuguugcgcagg

SEQ ID NO: 3567497 - RNA, 12 nt, Pseudomonas putida KT2440
cacuuucgcggc

SEQ ID NO: 3567498 - RNA, 14 nt, Pseudomonas putida KT2440
cacuuucgcggccc

SEQ ID NO: 3567499 - RNA, 12 nt, Pseudomonas putida KT2440
cacuuucugcgc

SEQ ID NO: 3567500 - RNA, 21 nt, Pseudomonas putida KT2440
cagaaaauucucccgggccac

SEQ ID NO: 3567501 - RNA, 14 nt, Pseudomonas putida KT2440
cagaaacagauucc

SEQ ID NO: 3567502 - RNA, 20 nt, Pseudomonas putida KT2440
cagaaacgccaucagugccc

SEQ ID NO: 3567503 - RNA, 16 nt, Pseudomonas putida KT2440
cagaaacggcggcaga

SEQ ID NO: 3567504 - RNA, 21 nt, Pseudomonas putida KT2440
cagaaacucguuuucgcugau

SEQ ID NO: 3567505 - RNA, 16 nt, Pseudomonas putida KT2440
cagaaagaauggaaag

SEQ ID NO: 3567506 - RNA, 23 nt, Pseudomonas putida KT2440
cagaaagugcguuggcugcugaa

SEQ ID NO: 3567507 - RNA, 19 nt, Pseudomonas putida KT2440
cagaaaguuugguuuuuuc

SEQ ID NO: 3567508 - RNA, 15 nt, Pseudomonas putida KT2440
cagaacaauaaaacu

SEQ ID NO: 3567509 - RNA, 20 nt, Pseudomonas putida KT2440
cagaacacaucgguacgccg

SEQ ID NO: 3567510 - RNA, 15 nt, Pseudomonas putida KT2440
cagaacacggugaca

SEQ ID NO: 3567511 - RNA, 12 nt, Pseudomonas putida KT2440
cagaacagccac

SEQ ID NO: 3567512 - RNA, 15 nt, Pseudomonas putida KT2440
cagaacagccacagc

SEQ ID NO: 3567513 - RNA, 20 nt, Pseudomonas putida KT2440
cagaacaucaggucugccag

SEQ ID NO: 3567514 - RNA, 19 nt, Pseudomonas putida KT2440
cagaacauggccgagcuga

SEQ ID NO: 3567515 - RNA, 23 nt, Pseudomonas putida KT2440
cagaaccccggcccugugccggg

SEQ ID NO: 3567516 - RNA, 16 nt, Pseudomonas putida KT2440
cagaaccgccagcacc

SEQ ID NO: 3567517 - RNA, 15 nt, Pseudomonas putida KT2440
cagaacgccgggagg

SEQ ID NO: 3567518 - RNA, 15 nt, Pseudomonas putida KT2440
cagaacggcacgccc

SEQ ID NO: 3567519 - RNA, 18 nt, Pseudomonas putida KT2440
cagaacguacuggccgcu

SEQ ID NO: 3567520 - RNA, 19 nt, Pseudomonas putida KT2440
cagaagccuguacacagcc

SEQ ID NO: 3567521 - RNA, 20 nt, Pseudomonas putida KT2440
cagaagccuguacacagccc

SEQ ID NO: 3567522 - RNA, 18 nt, Pseudomonas putida KT2440
cagaagccuuggccuugg

SEQ ID NO: 3567523 - RNA, 22 nt, Pseudomonas putida KT2440
cagaagccuuggccuuggcagc

SEQ ID NO: 3567524 - RNA, 15 nt, Pseudomonas putida KT2440
cagaagggcugguag

SEQ ID NO: 3567525 - RNA, 16 nt, Pseudomonas putida KT2440
cagaaucagcuugcca

SEQ ID NO: 3567526 - RNA, 10 nt, Pseudomonas putida KT2440
cagaaucauc

SEQ ID NO: 3567527 - RNA, 17 nt, Pseudomonas putida KT2440
cagaaucaucaacgccg

SEQ ID NO: 3567528 - RNA, 17 nt, Pseudomonas putida KT2440
cagaaucgcggucuugu

SEQ ID NO: 3567529 - RNA, 18 nt, Pseudomonas putida KT2440
cagaaucucaaccaccuc

SEQ ID NO: 3567530 - RNA, 14 nt, Pseudomonas putida KT2440
cagacaacaucaaa

SEQ ID NO: 3567531 - RNA, 17 nt, Pseudomonas putida KT2440
cagacaacuggccaggg

SEQ ID NO: 3567532 - RNA, 20 nt, Pseudomonas putida KT2440
cagacaacuggccaggguac

SEQ ID NO: 3567533 - RNA, 20 nt, Pseudomonas putida KT2440
cagacaaguccuucaucugu

SEQ ID NO: 3567534 - RNA, 17 nt, Pseudomonas putida KT2440
cagacaccacaaaaccu

SEQ ID NO: 3567535 - RNA, 15 nt, Pseudomonas putida KT2440
cagacagaagccugu

SEQ ID NO: 3567536 - RNA, 14 nt, Pseudomonas putida KT2440
cagacagagcuccg

SEQ ID NO: 3567537 - RNA, 15 nt, Pseudomonas putida KT2440
cagacagggccuuga

SEQ ID NO: 3567538 - RNA, 17 nt, Pseudomonas putida KT2440
cagacauugaagaagcc

SEQ ID NO: 3567539 - RNA, 20 nt, Pseudomonas putida KT2440
cagacauugugagucccugu

SEQ ID NO: 3567540 - RNA, 22 nt, Pseudomonas putida KT2440
cagaccaccucaucccccggcc

SEQ ID NO: 3567541 - RNA, 14 nt, Pseudomonas putida KT2440
cagaccaccugcca

SEQ ID NO: 3567542 - RNA, 14 nt, Pseudomonas putida KT2440
cagaccagacagcg

SEQ ID NO: 3567543 - RNA, 14 nt, Pseudomonas putida KT2440
cagaccaucaggua

SEQ ID NO: 3567544 - RNA, 14 nt, Pseudomonas putida KT2440
cagaccgcaacagu

SEQ ID NO: 3567545 - RNA, 14 nt, Pseudomonas putida KT2440
cagaccgccgaucg

SEQ ID NO: 3567546 - RNA, 15 nt, Pseudomonas putida KT2440
cagaccgccgggccc

SEQ ID NO: 3567547 - RNA, 20 nt, Pseudomonas putida KT2440
cagaccugauccaaauugcu

SEQ ID NO: 3567548 - RNA, 13 nt, Pseudomonas putida KT2440
cagaccuggaggu

SEQ ID NO: 3567549 - RNA, 13 nt, Pseudomonas putida KT2440
cagacgaucaggu

SEQ ID NO: 3567550 - RNA, 18 nt, Pseudomonas putida KT2440
cagacgcggaacuggcug

SEQ ID NO: 3567551 - RNA, 22 nt, Pseudomonas putida KT2440
cagacgcggaacuggcugacca

SEQ ID NO: 3567552 - RNA, 17 nt, Pseudomonas putida KT2440
cagacggugcgccugaa

SEQ ID NO: 3567553 - RNA, 19 nt, Pseudomonas putida KT2440
cagacucaaucaggcagcg

SEQ ID NO: 3567554 - RNA, 18 nt, Pseudomonas putida KT2440
cagacucagcugcugcuc

SEQ ID NO: 3567555 - RNA, 18 nt, Pseudomonas putida KT2440
cagacuuucccacaugua

SEQ ID NO: 3567556 - RNA, 12 nt, Pseudomonas putida KT2440
cagagagcugag

SEQ ID NO: 3567557 - RNA, 12 nt, Pseudomonas putida KT2440
cagagcaaccag

SEQ ID NO: 3567558 - RNA, 13 nt, Pseudomonas putida KT2440
cagagcauggcca

SEQ ID NO: 3567559 - RNA, 18 nt, Pseudomonas putida KT2440
cagagcauggccagccgg

SEQ ID NO: 3567560 - RNA, 22 nt, Pseudomonas putida KT2440
cagagccacggguuuacccucg

SEQ ID NO: 3567561 - RNA, 18 nt, Pseudomonas putida KT2440
cagagccugcacccaggc

SEQ ID NO: 3567562 - RNA, 21 nt, Pseudomonas putida KT2440
cagagccugcacccaggcucu

SEQ ID NO: 3567563 - RNA, 17 nt, Pseudomonas putida KT2440
cagagcgaaaugggccg

SEQ ID NO: 3567564 - RNA, 23 nt, Pseudomonas putida KT2440
cagagcgaaaugggccggcgccc

SEQ ID NO: 3567565 - RNA, 13 nt, Pseudomonas putida KT2440
cagagcgccagca

SEQ ID NO: 3567566 - RNA, 16 nt, Pseudomonas putida KT2440
cagagcgccagcaagc

SEQ ID NO: 3567567 - RNA, 14 nt, Pseudomonas putida KT2440
cagagcgccagcau

SEQ ID NO: 3567568 - RNA, 14 nt, Pseudomonas putida KT2440
cagagcgccccggc

SEQ ID NO: 3567569 - RNA, 20 nt, Pseudomonas putida KT2440
cagagcggcccugagccuug

SEQ ID NO: 3567570 - RNA, 20 nt, Pseudomonas putida KT2440
cagagcgucaaccaggcgca

SEQ ID NO: 3567571 - RNA, 23 nt, Pseudomonas putida KT2440
cagagcgucaaccaggcgcagca

SEQ ID NO: 3567572 - RNA, 18 nt, Pseudomonas putida KT2440
cagagcgugaagcggaca

SEQ ID NO: 3567573 - RNA, 19 nt, Pseudomonas putida KT2440
cagagcgugaagcggacag

SEQ ID NO: 3567574 - RNA, 14 nt, Pseudomonas putida KT2440
cagagcucagcgug

SEQ ID NO: 3567575 - RNA, 23 nt, Pseudomonas putida KT2440
cagaggcgauggcauccacacgc

SEQ ID NO: 3567576 - RNA, 12 nt, Pseudomonas putida KT2440
cagaggcgcgua

SEQ ID NO: 3567577 - RNA, 17 nt, Pseudomonas putida KT2440
cagaggcguagcaagca

SEQ ID NO: 3567578 - RNA, 17 nt, Pseudomonas putida KT2440
cagaggugguacaguca

SEQ ID NO: 3567579 - RNA, 18 nt, Pseudomonas putida KT2440
cagaguaaccgcggcuga

SEQ ID NO: 3567580 - RNA, 21 nt, Pseudomonas putida KT2440
cagagugggucaguuugacgg

SEQ ID NO: 3567581 - RNA, 15 nt, Pseudomonas putida KT2440
cagaguugccaccaa

SEQ ID NO: 3567582 - RNA, 20 nt, Pseudomonas putida KT2440
cagauaaaaguaauacguaa

SEQ ID NO: 3567583 - RNA, 21 nt, Pseudomonas putida KT2440
cagauaaaccugccacccauu

SEQ ID NO: 3567584 - RNA, 19 nt, Pseudomonas putida KT2440
cagauaacguccagagggc

SEQ ID NO: 3567585 - RNA, 20 nt, Pseudomonas putida KT2440
cagauacgcuucgaacaccc

SEQ ID NO: 3567586 - RNA, 17 nt, Pseudomonas putida KT2440
cagauaggcgccgugcu

SEQ ID NO: 3567587 - RNA, 19 nt, Pseudomonas putida KT2440
cagaucaccagcucgcccg

SEQ ID NO: 3567588 - RNA, 18 nt, Pseudomonas putida KT2440
cagaucacccuuggccac

SEQ ID NO: 3567589 - RNA, 15 nt, Pseudomonas putida KT2440
cagaucacgcaaccu

SEQ ID NO: 3567590 - RNA, 13 nt, Pseudomonas putida KT2440
cagaucacuucca

SEQ ID NO: 3567591 - RNA, 13 nt, Pseudomonas putida KT2440
cagaucagcagca

SEQ ID NO: 3567592 - RNA, 15 nt, Pseudomonas putida KT2440
cagaucagcagcacc

SEQ ID NO: 3567593 - RNA, 13 nt, Pseudomonas putida KT2440
cagaucaggcaau

SEQ ID NO: 3567594 - RNA, 15 nt, Pseudomonas putida KT2440
cagaucaucaucggc

SEQ ID NO: 3567595 - RNA, 16 nt, Pseudomonas putida KT2440
cagaucaucaucggca

SEQ ID NO: 3567596 - RNA, 17 nt, Pseudomonas putida KT2440
cagaucaucaugcccaa

SEQ ID NO: 3567597 - RNA, 19 nt, Pseudomonas putida KT2440
cagaucaucaugcccaaug

SEQ ID NO: 3567598 - RNA, 12 nt, Pseudomonas putida KT2440
cagauccaugua

SEQ ID NO: 3567599 - RNA, 19 nt, Pseudomonas putida KT2440
cagaucccgcuccucggcc

SEQ ID NO: 3567600 - RNA, 15 nt, Pseudomonas putida KT2440
cagauccgcaggguc

SEQ ID NO: 3567601 - RNA, 14 nt, Pseudomonas putida KT2440
cagauccugcagcc

SEQ ID NO: 3567602 - RNA, 17 nt, Pseudomonas putida KT2440
cagauccugcagccgca

SEQ ID NO: 3567603 - RNA, 20 nt, Pseudomonas putida KT2440
cagauccugcagccgcaccu

SEQ ID NO: 3567604 - RNA, 22 nt, Pseudomonas putida KT2440
cagaucgagcgcccacgcaaaa

SEQ ID NO: 3567605 - RNA, 14 nt, Pseudomonas putida KT2440
cagaucgagcgccg

SEQ ID NO: 3567606 - RNA, 15 nt, Pseudomonas putida KT2440
cagaucgagcgccgc

SEQ ID NO: 3567607 - RNA, 22 nt, Pseudomonas putida KT2440
cagaucguuguaggagcgggcu

SEQ ID NO: 3567608 - RNA, 23 nt, Pseudomonas putida KT2440
cagaucucgcgcuuuucaucuuc

SEQ ID NO: 3567609 - RNA, 18 nt, Pseudomonas putida KT2440
cagaugaguuccguugcu

SEQ ID NO: 3567610 - RNA, 19 nt, Pseudomonas putida KT2440
cagaugccgccgcugccag

SEQ ID NO: 3567611 - RNA, 20 nt, Pseudomonas putida KT2440
cagaugccgccgcugccagc

SEQ ID NO: 3567612 - RNA, 23 nt, Pseudomonas putida KT2440
cagaugccgccgcugccagcagg

SEQ ID NO: 3567613 - RNA, 12 nt, Pseudomonas putida KT2440
cagaugcgcgcu

SEQ ID NO: 3567614 - RNA, 21 nt, Pseudomonas putida KT2440
cagaugcuccaaccccagcgc

SEQ ID NO: 3567615 - RNA, 15 nt, Pseudomonas putida KT2440
cagaugcugcugcag

SEQ ID NO: 3567616 - RNA, 17 nt, Pseudomonas putida KT2440
cagaugcugcugcagug

SEQ ID NO: 3567617 - RNA, 16 nt, Pseudomonas putida KT2440
cagauggcccgguccc

SEQ ID NO: 3567618 - RNA, 18 nt, Pseudomonas putida KT2440
cagauggggggauuugag

SEQ ID NO: 3567619 - RNA, 14 nt, Pseudomonas putida KT2440
cagauggugaugcc

SEQ ID NO: 3567620 - RNA, 18 nt, Pseudomonas putida KT2440
cagauggugaugccccug

SEQ ID NO: 3567621 - RNA, 22 nt, Pseudomonas putida KT2440
cagaugucuggcaucaaugcaa

SEQ ID NO: 3567622 - RNA, 16 nt, Pseudomonas putida KT2440
cagauucgccaaggcc

SEQ ID NO: 3567623 - RNA, 14 nt, Pseudomonas putida KT2440
cagauugcaucacu

SEQ ID NO: 3567624 - RNA, 15 nt, Pseudomonas putida KT2440
cagauugcuuauucu

SEQ ID NO: 3567625 - RNA, 19 nt, Pseudomonas putida KT2440
cagcaaaccgaccaggcag

SEQ ID NO: 3567626 - RNA, 19 nt, Pseudomonas putida KT2440
cagcaaagguuugucgccc

SEQ ID NO: 3567627 - RNA, 15 nt, Pseudomonas putida KT2440
cagcaaagucuucag

SEQ ID NO: 3567628 - RNA, 16 nt, Pseudomonas putida KT2440
cagcaaaugcccacug

SEQ ID NO: 3567629 - RNA, 18 nt, Pseudomonas putida KT2440
cagcaaaugcccacugcg

SEQ ID NO: 3567630 - RNA, 20 nt, Pseudomonas putida KT2440
cagcaacaccguagcgagca

SEQ ID NO: 3567631 - RNA, 13 nt, Pseudomonas putida KT2440
cagcaacacgacg

SEQ ID NO: 3567632 - RNA, 19 nt, Pseudomonas putida KT2440
cagcaacacgacgauggcc

SEQ ID NO: 3567633 - RNA, 12 nt, Pseudomonas putida KT2440
cagcaacagccc

SEQ ID NO: 3567634 - RNA, 21 nt, Pseudomonas putida KT2440
cagcaacagccccaucaccag

SEQ ID NO: 3567635 - RNA, 23 nt, Pseudomonas putida KT2440
cagcaacagccccaucaccagcc

SEQ ID NO: 3567636 - RNA, 14 nt, Pseudomonas putida KT2440
cagcaacagcugcc

SEQ ID NO: 3567637 - RNA, 15 nt, Pseudomonas putida KT2440
cagcaacagcugccg

SEQ ID NO: 3567638 - RNA, 16 nt, Pseudomonas putida KT2440
cagcaacagguacaug

SEQ ID NO: 3567639 - RNA, 23 nt, Pseudomonas putida KT2440
cagcaacagguacauguugguca

SEQ ID NO: 3567640 - RNA, 19 nt, Pseudomonas putida KT2440
cagcaacaucgcccccgcu

SEQ ID NO: 3567641 - RNA, 22 nt, Pseudomonas putida KT2440
cagcaacaucgcccccgcugca

SEQ ID NO: 3567642 - RNA, 20 nt, Pseudomonas putida KT2440
cagcaacaugccggcccaag

SEQ ID NO: 3567643 - RNA, 22 nt, Pseudomonas putida KT2440
cagcaacaugccggcccaaggc

SEQ ID NO: 3567644 - RNA, 18 nt, Pseudomonas putida KT2440
cagcaaccacgcuuggcu

SEQ ID NO: 3567645 - RNA, 17 nt, Pseudomonas putida KT2440
cagcaacccggccaggc

SEQ ID NO: 3567646 - RNA, 13 nt, Pseudomonas putida KT2440
cagcaaccucgag

SEQ ID NO: 3567647 - RNA, 23 nt, Pseudomonas putida KT2440
cagcaacgcgauauucagugcgc

SEQ ID NO: 3567648 - RNA, 19 nt, Pseudomonas putida KT2440
cagcaacggguucagguac

SEQ ID NO: 3567649 - RNA, 21 nt, Pseudomonas putida KT2440
cagcaacggguucagguacag

SEQ ID NO: 3567650 - RNA, 14 nt, Pseudomonas putida KT2440
cagcaacggugaac

SEQ ID NO: 3567651 - RNA, 14 nt, Pseudomonas putida KT2440
cagcaacugcgccc

SEQ ID NO: 3567652 - RNA, 15 nt, Pseudomonas putida KT2440
cagcaacugcgccca

SEQ ID NO: 3567653 - RNA, 21 nt, Pseudomonas putida KT2440
cagcaacugcgcccaaugcag

SEQ ID NO: 3567654 - RNA, 21 nt, Pseudomonas putida KT2440
cagcaacuggugaaucagccc

SEQ ID NO: 3567655 - RNA, 22 nt, Pseudomonas putida KT2440
cagcaacuggugaaucagcccc

SEQ ID NO: 3567656 - RNA, 15 nt, Pseudomonas putida KT2440
cagcaagaccagaaa

SEQ ID NO: 3567657 - RNA, 16 nt, Pseudomonas putida KT2440
cagcaagccgccgacc

SEQ ID NO: 3567658 - RNA, 13 nt, Pseudomonas putida KT2440
cccacucccacag

SEQ ID NO: 3567659 - RNA, 23 nt, Pseudomonas putida KT2440
cccacuccgggugaucauucagg

SEQ ID NO: 3567660 - RNA, 16 nt, Pseudomonas putida KT2440
cccacucgcgcagcac

SEQ ID NO: 3567661 - RNA, 20 nt, Pseudomonas putida KT2440
cccacugucaaucuugcgca

SEQ ID NO: 3567662 - RNA, 12 nt, Pseudomonas putida KT2440
cccacuucugcc

SEQ ID NO: 3567663 - RNA, 14 nt, Pseudomonas putida KT2440
cccagaaaggccgc

SEQ ID NO: 3567664 - RNA, 15 nt, Pseudomonas putida KT2440
cccagaaaggccgcu

SEQ ID NO: 3567665 - RNA, 21 nt, Pseudomonas putida KT2440
cccagaacagccacagcugcu

SEQ ID NO: 3567666 - RNA, 15 nt, Pseudomonas putida KT2440
cccagaacggcacgc

SEQ ID NO: 3567667 - RNA, 16 nt, Pseudomonas putida KT2440
cccagaacggcacgcc

SEQ ID NO: 3567668 - RNA, 13 nt, Pseudomonas putida KT2440
cccagaaucauca

SEQ ID NO: 3567669 - RNA, 19 nt, Pseudomonas putida KT2440
cccagaaucucaaccaccu

SEQ ID NO: 3567670 - RNA, 15 nt, Pseudomonas putida KT2440
cccagaucacuucca

SEQ ID NO: 3567671 - RNA, 16 nt, Pseudomonas putida KT2440
cccagaugcgggcccu

SEQ ID NO: 3567672 - RNA, 16 nt, Pseudomonas putida KT2440
cccagcaacagcccca

SEQ ID NO: 3567673 - RNA, 18 nt, Pseudomonas putida KT2440
cccagcaacagccccauc

SEQ ID NO: 3567674 - RNA, 22 nt, Pseudomonas putida KT2440
cccagcaccgcgacgaccgcac

SEQ ID NO: 3567675 - RNA, 16 nt, Pseudomonas putida KT2440
cccagcacgaaggcca

SEQ ID NO: 3567676 - RNA, 19 nt, Pseudomonas putida KT2440
cccagcacgaaggccagca

SEQ ID NO: 3567677 - RNA, 18 nt, Pseudomonas putida KT2440
cccagcacuucguccagg

SEQ ID NO: 3567678 - RNA, 20 nt, Pseudomonas putida KT2440
cccagcagccaacgccccag

SEQ ID NO: 3567679 - RNA, 14 nt, Pseudomonas putida KT2440
cccagcagccccac

SEQ ID NO: 3567680 - RNA, 19 nt, Pseudomonas putida KT2440
cccagcagccccacgccca

SEQ ID NO: 3567681 - RNA, 21 nt, Pseudomonas putida KT2440
cccagcagcgggcacaggccg

SEQ ID NO: 3567682 - RNA, 12 nt, Pseudomonas putida KT2440
cccagcaggccg

SEQ ID NO: 3567683 - RNA, 14 nt, Pseudomonas putida KT2440
cccagcaggccgaa

SEQ ID NO: 3567684 - RNA, 17 nt, Pseudomonas putida KT2440
cccagcagguacaccgc

SEQ ID NO: 3567685 - RNA, 18 nt, Pseudomonas putida KT2440
cccagcaggugcccaagc

SEQ ID NO: 3567686 - RNA, 20 nt, Pseudomonas putida KT2440
cccagcaguucgcgcaccau

SEQ ID NO: 3567687 - RNA, 17 nt, Pseudomonas putida KT2440
cccagcaugaacgcagc

SEQ ID NO: 3567688 - RNA, 23 nt, Pseudomonas putida KT2440
cccagcaugaacgcagcuuccgc

SEQ ID NO: 3567689 - RNA, 15 nt, Pseudomonas putida KT2440
cccagcauggccgaa

SEQ ID NO: 3567690 - RNA, 14 nt, Pseudomonas putida KT2440
cccagccaacgccc

SEQ ID NO: 3567691 - RNA, 19 nt, Pseudomonas putida KT2440
cccagccacccggcgcgca

SEQ ID NO: 3567692 - RNA, 22 nt, Pseudomonas putida KT2440
cccagccagccacggaucaccu

SEQ ID NO: 3567693 - RNA, 22 nt, Pseudomonas putida KT2440
cccagccagcgauucaguucaa

SEQ ID NO: 3567694 - RNA, 17 nt, Pseudomonas putida KT2440
cccagccagucgcgcaa

SEQ ID NO: 3567695 - RNA, 22 nt, Pseudomonas putida KT2440
cccagccagucgcgcaacugcc

SEQ ID NO: 3567696 - RNA, 12 nt, Pseudomonas putida KT2440
cccagccaucga

SEQ ID NO: 3567697 - RNA, 14 nt, Pseudomonas putida KT2440
cccagccaucgagc

SEQ ID NO: 3567698 - RNA, 23 nt, Pseudomonas putida KT2440
cccagcccaguagaucgcgccag

SEQ ID NO: 3567699 - RNA, 14 nt, Pseudomonas putida KT2440
cccagccccgagca

SEQ ID NO: 3567700 - RNA, 15 nt, Pseudomonas putida KT2440
cccagccccgagcaa

SEQ ID NO: 3567701 - RNA, 21 nt, Pseudomonas putida KT2440
cccagccccgagcaaagcccg

SEQ ID NO: 3567702 - RNA, 18 nt, Pseudomonas putida KT2440
cccagccccgcaugcucg

SEQ ID NO: 3567703 - RNA, 23 nt, Pseudomonas putida KT2440
cccagccccgcaugcucgcugcu

SEQ ID NO: 3567704 - RNA, 15 nt, Pseudomonas putida KT2440
cccagcccgaagccg

SEQ ID NO: 3567705 - RNA, 20 nt, Pseudomonas putida KT2440
cccagcccggacugcaccag

SEQ ID NO: 3567706 - RNA, 15 nt, Pseudomonas putida KT2440
cccagcccggcgccg

SEQ ID NO: 3567707 - RNA, 22 nt, Pseudomonas putida KT2440
cccagccgggcaugcaggucga

SEQ ID NO: 3567708 - RNA, 19 nt, Pseudomonas putida KT2440
cccagccggucauccagca

SEQ ID NO: 3567709 - RNA, 21 nt, Pseudomonas putida KT2440
cccagccggucauccagcagc

SEQ ID NO: 3567710 - RNA, 23 nt, Pseudomonas putida KT2440
cccagccggucauccagcagcuc

SEQ ID NO: 3567711 - RNA, 16 nt, Pseudomonas putida KT2440
cccagccucagcuggc

SEQ ID NO: 3567712 - RNA, 12 nt, Pseudomonas putida KT2440
cccagccuucag

SEQ ID NO: 3567713 - RNA, 13 nt, Pseudomonas putida KT2440
cccagcgaccagc

SEQ ID NO: 3567714 - RNA, 18 nt, Pseudomonas putida KT2440
cccagcgaccagcugcca

SEQ ID NO: 3567715 - RNA, 12 nt, Pseudomonas putida KT2440
cccagcgaggcc

SEQ ID NO: 3567716 - RNA, 16 nt, Pseudomonas putida KT2440
cccagcgcauugcccg

SEQ ID NO: 3567717 - RNA, 13 nt, Pseudomonas putida KT2440
cccagcgccucca

SEQ ID NO: 3567718 - RNA, 17 nt, Pseudomonas putida KT2440
cccagcgccuuggccug

SEQ ID NO: 3567719 - RNA, 21 nt, Pseudomonas putida KT2440
cccagcgccuuggccugcuca

SEQ ID NO: 3567720 - RNA, 23 nt, Pseudomonas putida KT2440
cccagcgccuuggccugcucacc

SEQ ID NO: 3567721 - RNA, 17 nt, Pseudomonas putida KT2440
cccagcgcgaagcccag

SEQ ID NO: 3567722 - RNA, 14 nt, Pseudomonas putida KT2440
cccagcgcgccagc

SEQ ID NO: 3567723 - RNA, 15 nt, Pseudomonas putida KT2440
cccagcgcgccagca

SEQ ID NO: 3567724 - RNA, 14 nt, Pseudomonas putida KT2440
cccagcgcgcgcag

SEQ ID NO: 3567725 - RNA, 16 nt, Pseudomonas putida KT2440
cccagcgcgcgcagac

SEQ ID NO: 3567726 - RNA, 17 nt, Pseudomonas putida KT2440
cccagcgcgcgcagacg

SEQ ID NO: 3567727 - RNA, 22 nt, Pseudomonas putida KT2440
cccagcgcucguaggcuucacg

SEQ ID NO: 3567728 - RNA, 21 nt, Pseudomonas putida KT2440
cccagcgcugucccccagccc

SEQ ID NO: 3567729 - RNA, 22 nt, Pseudomonas putida KT2440
cccagcgcugucccccagcccu

SEQ ID NO: 3567730 - RNA, 14 nt, Pseudomonas putida KT2440
cccagcggcaaccu

SEQ ID NO: 3567731 - RNA, 23 nt, Pseudomonas putida KT2440
cccagcguauagccaccgggcga

SEQ ID NO: 3567732 - RNA, 15 nt, Pseudomonas putida KT2440
cccagcuacgcgagc

SEQ ID NO: 3567733 - RNA, 17 nt, Pseudomonas putida KT2440
cccagcuacgcgagcca

SEQ ID NO: 3567734 - RNA, 13 nt, Pseudomonas putida KT2440
cccagcuccagca

SEQ ID NO: 3567735 - RNA, 16 nt, Pseudomonas putida KT2440
cccagcucgaucagcu

SEQ ID NO: 3567736 - RNA, 18 nt, Pseudomonas putida KT2440
cccagcucgaucagcugg

SEQ ID NO: 3567737 - RNA, 22 nt, Pseudomonas putida KT2440
cccagcucgcuggccaccagca

SEQ ID NO: 3567738 - RNA, 23 nt, Pseudomonas putida KT2440
cccagcugaagugccaaggcuuu

SEQ ID NO: 3567739 - RNA, 22 nt, Pseudomonas putida KT2440
cccagcuucuccagcaagcgcu

SEQ ID NO: 3567740 - RNA, 12 nt, Pseudomonas putida KT2440
cccagcuugccc

SEQ ID NO: 3567741 - RNA, 16 nt, Pseudomonas putida KT2440
cccagcuugcccagca

SEQ ID NO: 3567742 - RNA, 13 nt, Pseudomonas putida KT2440
cccaggagggcug

SEQ ID NO: 3567743 - RNA, 13 nt, Pseudomonas putida KT2440
cccaggaucacug

SEQ ID NO: 3567744 - RNA, 16 nt, Pseudomonas putida KT2440
cccaggaucacuggcc

SEQ ID NO: 3567745 - RNA, 17 nt, Pseudomonas putida KT2440
cccaggaucacuggccu

SEQ ID NO: 3567746 - RNA, 13 nt, Pseudomonas putida KT2440
cccaggauuaccg

SEQ ID NO: 3567747 - RNA, 12 nt, Pseudomonas putida KT2440
cccaggcagccu

SEQ ID NO: 3567748 - RNA, 17 nt, Pseudomonas putida KT2440
cccaggcauugcaaggu

SEQ ID NO: 3567749 - RNA, 20 nt, Pseudomonas putida KT2440
cccaggccaucagcagcugu

SEQ ID NO: 3567750 - RNA, 17 nt, Pseudomonas putida KT2440
cccaggccauccagcgg

SEQ ID NO: 3567751 - RNA, 16 nt, Pseudomonas putida KT2440
cccaggcccaacgggc

SEQ ID NO: 3567752 - RNA, 13 nt, Pseudomonas putida KT2440
cccaggccgccca

SEQ ID NO: 3567753 - RNA, 21 nt, Pseudomonas putida KT2440
cccaggccgccgaugaucgaa

SEQ ID NO: 3567754 - RNA, 11 nt, Pseudomonas putida KT2440
cccaggccgcg

SEQ ID NO: 3567755 - RNA, 13 nt, Pseudomonas putida KT2440
cccaggccgcggc

SEQ ID NO: 3567756 - RNA, 17 nt, Pseudomonas putida KT2440
cccaggccgcggccgaa

SEQ ID NO: 3567757 - RNA, 13 nt, Pseudomonas putida KT2440
cccaggcgcgccu

SEQ ID NO: 3567758 - RNA, 16 nt, Pseudomonas putida KT2440
cccaggcgcuugagcu

SEQ ID NO: 3567759 - RNA, 15 nt, Pseudomonas putida KT2440
cccaggcggugagug

SEQ ID NO: 3567760 - RNA, 14 nt, Pseudomonas putida KT2440
cccaggcggugcac

SEQ ID NO: 3567761 - RNA, 16 nt, Pseudomonas putida KT2440
cccaggcggugcacgg

SEQ ID NO: 3567762 - RNA, 20 nt, Pseudomonas putida KT2440
cccaggcucucagcccauuu

SEQ ID NO: 3567763 - RNA, 13 nt, Pseudomonas putida KT2440
cccaggcugccaa

SEQ ID NO: 3567764 - RNA, 14 nt, Pseudomonas putida KT2440
cccagggcaguugc

SEQ ID NO: 3567765 - RNA, 20 nt, Pseudomonas putida KT2440
cccagggcaucgaucccugg

SEQ ID NO: 3567766 - RNA, 20 nt, Pseudomonas putida KT2440
cccagggcccucaacccucg

SEQ ID NO: 3567767 - RNA, 15 nt, Pseudomonas putida KT2440
cccagggcucuaccc

SEQ ID NO: 3567768 - RNA, 12 nt, Pseudomonas putida KT2440
cccagggcugcu

SEQ ID NO: 3567769 - RNA, 15 nt, Pseudomonas putida KT2440
cccagggcugcuuca

SEQ ID NO: 3567770 - RNA, 16 nt, Pseudomonas putida KT2440
cccagggcugcuucac

SEQ ID NO: 3567771 - RNA, 16 nt, Pseudomonas putida KT2440
cccagggggcagcugc

SEQ ID NO: 3567772 - RNA, 22 nt, Pseudomonas putida KT2440
cccagguaacugccgaccuugg

SEQ ID NO: 3567773 - RNA, 16 nt, Pseudomonas putida KT2440
cccaggugaucgccac

SEQ ID NO: 3567774 - RNA, 15 nt, Pseudomonas putida KT2440
cccaggugcugaugc

SEQ ID NO: 3567775 - RNA, 16 nt, Pseudomonas putida KT2440
cccaggugcugaugcc

SEQ ID NO: 3567776 - RNA, 21 nt, Pseudomonas putida KT2440
cccagguguuguugcaaccag

SEQ ID NO: 3567777 - RNA, 19 nt, Pseudomonas putida KT2440
cccagguugcaccucggau

SEQ ID NO: 3567778 - RNA, 22 nt, Pseudomonas putida KT2440
cccagguugcaccucggaugcc

SEQ ID NO: 3567779 - RNA, 15 nt, Pseudomonas putida KT2440
cccaguacgccaccc

SEQ ID NO: 3567780 - RNA, 16 nt, Pseudomonas putida KT2440
cccaguacgccaccca

SEQ ID NO: 3567781 - RNA, 18 nt, Pseudomonas putida KT2440
cccaguagaucgcgccag

SEQ ID NO: 3567782 - RNA, 16 nt, Pseudomonas putida KT2440
cccagucaccuugcuc

SEQ ID NO: 3567783 - RNA, 17 nt, Pseudomonas putida KT2440
cccaguccgucucuuca

SEQ ID NO: 3567784 - RNA, 15 nt, Pseudomonas putida KT2440
cccagucgaaaccga

SEQ ID NO: 3567785 - RNA, 17 nt, Pseudomonas putida KT2440
cccagucgccccgccag

SEQ ID NO: 3567786 - RNA, 14 nt, Pseudomonas putida KT2440
cccagucgccuucg

SEQ ID NO: 3567787 - RNA, 20 nt, Pseudomonas putida KT2440
cccagucuucguacaugcgc

SEQ ID NO: 3567788 - RNA, 15 nt, Pseudomonas putida KT2440
cccagucuuggcucg

SEQ ID NO: 3567789 - RNA, 17 nt, Pseudomonas putida KT2440
cccagugcgcgcaacag

SEQ ID NO: 3567790 - RNA, 16 nt, Pseudomonas putida KT2440
cccaguggcacaccau

SEQ ID NO: 3567791 - RNA, 18 nt, Pseudomonas putida KT2440
cccaguggcuuacagcgu

SEQ ID NO: 3567792 - RNA, 19 nt, Pseudomonas putida KT2440
cccaguucacgcaggcgca

SEQ ID NO: 3567793 - RNA, 15 nt, Pseudomonas putida KT2440
cccaguuccaugucg

SEQ ID NO: 3567794 - RNA, 21 nt, Pseudomonas putida KT2440
cccaguucgcggaucugcugc

SEQ ID NO: 3567795 - RNA, 13 nt, Pseudomonas putida KT2440
cccaguucggcgu

SEQ ID NO: 3567796 - RNA, 15 nt, Pseudomonas putida KT2440
cccaguuucgccagu

SEQ ID NO: 3567797 - RNA, 12 nt, Pseudomonas putida KT2440
cccauagccugc

SEQ ID NO: 3567798 - RNA, 16 nt, Pseudomonas putida KT2440
cccauagccugcugcu

SEQ ID NO: 3567799 - RNA, 20 nt, Pseudomonas putida KT2440
cccauagcuuuccagcaugu

SEQ ID NO: 3567800 - RNA, 17 nt, Pseudomonas putida KT2440
cccauagggccagcggc

SEQ ID NO: 3567801 - RNA, 14 nt, Pseudomonas putida KT2440
cccaucaccagccc

SEQ ID NO: 3567802 - RNA, 17 nt, Pseudomonas putida KT2440
cccaucaccuuggccgc

SEQ ID NO: 3567803 - RNA, 13 nt, Pseudomonas putida KT2440
cccaucacgcggu

SEQ ID NO: 3567804 - RNA, 19 nt, Pseudomonas putida KT2440
cccaucacgcgguauucga

SEQ ID NO: 3567805 - RNA, 14 nt, Pseudomonas putida KT2440
cccaucagcagcug

SEQ ID NO: 3567806 - RNA, 15 nt, Pseudomonas putida KT2440
cccaucagcagcugc

SEQ ID NO: 3567807 - RNA, 16 nt, Pseudomonas putida KT2440
cccaucaggaacagcu

SEQ ID NO: 3567808 - RNA, 19 nt, Pseudomonas putida KT2440
cccaucaguugcagcaacg

SEQ ID NO: 3567809 - RNA, 16 nt, Pseudomonas putida KT2440
cccaucauucgauagc

SEQ ID NO: 3567810 - RNA, 18 nt, Pseudomonas putida KT2440
cccaucauucgauagccu

SEQ ID NO: 3567811 - RNA, 13 nt, Pseudomonas putida KT2440
cccauccaacgca

SEQ ID NO: 3567812 - RNA, 18 nt, Pseudomonas putida KT2440
cccauccaacgcauccag

SEQ ID NO: 3567813 - RNA, 21 nt, Pseudomonas putida KT2440
cccauccaacgcauccaggcg

SEQ ID NO: 3567814 - RNA, 14 nt, Pseudomonas putida KT2440
cccauccacaucgc

SEQ ID NO: 3567815 - RNA, 19 nt, Pseudomonas putida KT2440
cccaucccgcuucgccagc

SEQ ID NO: 3567816 - RNA, 18 nt, Pseudomonas putida KT2440
cccaucgcacacccuguc

SEQ ID NO: 3567817 - RNA, 12 nt, Pseudomonas putida KT2440
cccaucugcucg

SEQ ID NO: 3567818 - RNA, 14 nt, Pseudomonas putida KT2440
cccaucugcucgcc

SEQ ID NO: 3567819 - RNA, 19 nt, Pseudomonas putida KT2440
cccaucugcucgccaucug

SEQ ID NO: 3567820 - RNA, 22 nt, Pseudomonas putida KT2440
cccaucugcucggcguacucca

SEQ ID NO: 3567821 - RNA, 13 nt, Pseudomonas putida KT2440
cccaucugguugg

SEQ ID NO: 3567822 - RNA, 16 nt, Pseudomonas putida KT2440
cccaugaugaccacca

SEQ ID NO: 3567823 - RNA, 13 nt, Pseudomonas putida KT2440
cccaugcacagcg

SEQ ID NO: 3567824 - RNA, 16 nt, Pseudomonas putida KT2440
cccaugcccagcucgc

SEQ ID NO: 3567825 - RNA, 23 nt, Pseudomonas putida KT2440
cccaugcgaacugcagagccugc

SEQ ID NO: 3567826 - RNA, 16 nt, Pseudomonas putida KT2440
cccaugcucaccagcu

SEQ ID NO: 3567827 - RNA, 21 nt, Pseudomonas putida KT2440
cccaugcucugcgcaaaggcu

SEQ ID NO: 3567828 - RNA, 12 nt, Pseudomonas putida KT2440
cccauggccagc

SEQ ID NO: 3567829 - RNA, 22 nt, Pseudomonas putida KT2440
cccauggccagcguggccgcca

SEQ ID NO: 3567830 - RNA, 20 nt, Pseudomonas putida KT2440
cccauggcgguauucacacc

SEQ ID NO: 3567831 - RNA, 22 nt, Pseudomonas putida KT2440
cccauggcgguauucacaccug

SEQ ID NO: 3567832 - RNA, 18 nt, Pseudomonas putida KT2440
cccauguagaccaccagc

SEQ ID NO: 3567833 - RNA, 21 nt, Pseudomonas putida KT2440
cccauguagaccaccagcguu

SEQ ID NO: 3567834 - RNA, 15 nt, Pseudomonas putida KT2440
cccaugucgaucagc

SEQ ID NO: 3567835 - RNA, 15 nt, Pseudomonas putida KT2440
cccauguggcgcagc

SEQ ID NO: 3567836 - RNA, 20 nt, Pseudomonas putida KT2440
cccauguugucacccagcac

SEQ ID NO: 3567837 - RNA, 14 nt, Pseudomonas putida KT2440
cccauucccacauc

SEQ ID NO: 3567838 - RNA, 18 nt, Pseudomonas putida KT2440
cccauucgcgggcaagcc

SEQ ID NO: 3567839 - RNA, 20 nt, Pseudomonas putida KT2440
cccauuucugcauguccagc

SEQ ID NO: 3567840 - RNA, 22 nt, Pseudomonas putida KT2440
ccccaaaccgcugcccagcgaa

SEQ ID NO: 3567841 - RNA, 13 nt, Pseudomonas putida KT2440
ccccaaagccgcc

SEQ ID NO: 3567842 - RNA, 16 nt, Pseudomonas putida KT2440
ccccaaaugcccgcca

SEQ ID NO: 3567843 - RNA, 11 nt, Pseudomonas putida KT2440
ccccaacaaca

SEQ ID NO: 3567844 - RNA, 13 nt, Pseudomonas putida KT2440
ccccaaccaugcu

SEQ ID NO: 3567845 - RNA, 21 nt, Pseudomonas putida KT2440
ccccaacccggucccgcccuc

SEQ ID NO: 3567846 - RNA, 16 nt, Pseudomonas putida KT2440
ccccaaccuuccagca

SEQ ID NO: 3567847 - RNA, 17 nt, Pseudomonas putida KT2440
ccccaacugcauccgcc

SEQ ID NO: 3567848 - RNA, 20 nt, Pseudomonas putida KT2440
ccccaacugcauccgcccca

SEQ ID NO: 3567849 - RNA, 21 nt, Pseudomonas putida KT2440
ccccaaggcgagggcuucgcc

SEQ ID NO: 3567850 - RNA, 21 nt, Pseudomonas putida KT2440
ccccaagguggaaaucgccug

SEQ ID NO: 3567851 - RNA, 19 nt, Pseudomonas putida KT2440
ccccaauaaaaaaccggcc

SEQ ID NO: 3567852 - RNA, 20 nt, Pseudomonas putida KT2440
ccccaauaaaaaaccggcca

SEQ ID NO: 3567853 - RNA, 17 nt, Pseudomonas putida KT2440
ccccaaucuccagcccg

SEQ ID NO: 3567854 - RNA, 19 nt, Pseudomonas putida KT2440
ccccaaucuccagcccgaa

SEQ ID NO: 3567855 - RNA, 19 nt, Pseudomonas putida KT2440
ccccaaugaaucagagcga

SEQ ID NO: 3567856 - RNA, 22 nt, Pseudomonas putida KT2440
ccccaaugggcaccggccacca

SEQ ID NO: 3567857 - RNA, 22 nt, Pseudomonas putida KT2440
ccccaauugcuucaaccguggu

SEQ ID NO: 3567858 - RNA, 21 nt, Pseudomonas putida KT2440
ccccacaaccccugcaaggcc

SEQ ID NO: 3567859 - RNA, 17 nt, Pseudomonas putida KT2440
ccccacaacggccgcaa

SEQ ID NO: 3567860 - RNA, 18 nt, Pseudomonas putida KT2440
ccccacagagccgcaaag

SEQ ID NO: 3567861 - RNA, 23 nt, Pseudomonas putida KT2440
ccccacagagccgcaaagcggcc

SEQ ID NO: 3567862 - RNA, 13 nt, Pseudomonas putida KT2440
ccccacagggcaa

SEQ ID NO: 3567863 - RNA, 20 nt, Pseudomonas putida KT2440
ccccaccagcacugccuugc

SEQ ID NO: 3567864 - RNA, 19 nt, Pseudomonas putida KT2440
ccccaccaggaagcuggcc

SEQ ID NO: 3567865 - RNA, 18 nt, Pseudomonas putida KT2440
ccccacccgcucaaagcg

SEQ ID NO: 3567866 - RNA, 22 nt, Pseudomonas putida KT2440
ccccaccgcgguuucucacagc

SEQ ID NO: 3567867 - RNA, 19 nt, Pseudomonas putida KT2440
ccccaccggccuggaaccg

SEQ ID NO: 3567868 - RNA, 23 nt, Pseudomonas putida KT2440
ccccaccucggcgaucagcuuca

SEQ ID NO: 3567869 - RNA, 13 nt, Pseudomonas putida KT2440
ccccaccucuuca

SEQ ID NO: 3567870 - RNA, 14 nt, Pseudomonas putida KT2440
ccccacgcccaggc

SEQ ID NO: 3567871 - RNA, 17 nt, Pseudomonas putida KT2440
ccccacuccugugcggc

SEQ ID NO: 3567872 - RNA, 14 nt, Pseudomonas putida KT2440
ccccacucgcgcag

SEQ ID NO: 3567873 - RNA, 19 nt, Pseudomonas putida KT2440
ccccacucgcgcagcacau

SEQ ID NO: 3567874 - RNA, 18 nt, Pseudomonas putida KT2440
ccccagaacggcacgccc

SEQ ID NO: 3567875 - RNA, 11 nt, Pseudomonas putida KT2440
ccccagcaacg

SEQ ID NO: 3567876 - RNA, 13 nt, Pseudomonas putida KT2440
ccccagcaaggca

SEQ ID NO: 3567877 - RNA, 22 nt, Pseudomonas putida KT2440
ccccagcaaggcaaucgugauc

SEQ ID NO: 3567878 - RNA, 18 nt, Pseudomonas putida KT2440
ccccagcaguucgcgcac

SEQ ID NO: 3567879 - RNA, 21 nt, Pseudomonas putida KT2440
ccccagcauuggauacugccc

SEQ ID NO: 3567880 - RNA, 13 nt, Pseudomonas putida KT2440
ccccagccaacgc

SEQ ID NO: 3567881 - RNA, 15 nt, Pseudomonas putida KT2440
ccccagccagcagau

SEQ ID NO: 3567882 - RNA, 23 nt, Pseudomonas putida KT2440
ccccagcccgcccacaugcgagc

SEQ ID NO: 3567883 - RNA, 18 nt, Pseudomonas putida KT2440
ccccagccggucaucacg

SEQ ID NO: 3567884 - RNA, 23 nt, Pseudomonas putida KT2440
ccccagccggucauccagcagcu

SEQ ID NO: 3567885 - RNA, 12 nt, Pseudomonas putida KT2440
ccccagccuuca

SEQ ID NO: 3567886 - RNA, 12 nt, Pseudomonas putida KT2440
ccccagcgccuc

SEQ ID NO: 3567887 - RNA, 12 nt, Pseudomonas putida KT2440
ccccagcgccuu

SEQ ID NO: 3567888 - RNA, 23 nt, Pseudomonas putida KT2440
ccccagcgccuuggccugcucac

SEQ ID NO: 3567889 - RNA, 19 nt, Pseudomonas putida KT2440
ccccagcgcgccagcaggu

SEQ ID NO: 3567890 - RNA, 18 nt, Pseudomonas putida KT2440
ccccagcguuccugggcg

SEQ ID NO: 3567891 - RNA, 13 nt, Pseudomonas putida KT2440
ccccaggccgccc

SEQ ID NO: 3567892 - RNA, 11 nt, Pseudomonas putida KT2440
ccccaggcggu

SEQ ID NO: 3567893 - RNA, 19 nt, Pseudomonas putida KT2440
ccccaggcggugcacggcc

SEQ ID NO: 3567894 - RNA, 18 nt, Pseudomonas putida KT2440
ccccagggcccucaaccc

SEQ ID NO: 3567895 - RNA, 17 nt, Pseudomonas putida KT2440
ccccagggcgcaacgcc

SEQ ID NO: 3567896 - RNA, 17 nt, Pseudomonas putida KT2440
ccccagggcucuacccc

SEQ ID NO: 3567897 - RNA, 17 nt, Pseudomonas putida KT2440
ccccaggguuaccuuga

SEQ ID NO: 3567898 - RNA, 14 nt, Pseudomonas putida KT2440
ccccaggugccaac

SEQ ID NO: 3567899 - RNA, 14 nt, Pseudomonas putida KT2440
ccccagguuaucca

SEQ ID NO: 3567900 - RNA, 19 nt, Pseudomonas putida KT2440
ccccagguugcaccucgga

SEQ ID NO: 3567901 - RNA, 15 nt, Pseudomonas putida KT2440
ccccagucauccggg

SEQ ID NO: 3567902 - RNA, 19 nt, Pseudomonas putida KT2440
ccccaguccgucucuucag

SEQ ID NO: 3567903 - RNA, 20 nt, Pseudomonas putida KT2440
ccccagucuuggcucgacgc

SEQ ID NO: 3567904 - RNA, 17 nt, Pseudomonas putida KT2440
ccccagugugcaaacac

SEQ ID NO: 3567905 - RNA, 23 nt, Pseudomonas putida KT2440
ccccauaaaaaaacccgcugauc

SEQ ID NO: 3567906 - RNA, 16 nt, Pseudomonas putida KT2440
ccccauagccugcugc

SEQ ID NO: 3567907 - RNA, 19 nt, Pseudomonas putida KT2440
ccccauagggccagcggcu

SEQ ID NO: 3567908 - RNA, 20 nt, Pseudomonas putida KT2440
ccccaucaccuuggccgccc

SEQ ID NO: 3567909 - RNA, 14 nt, Pseudomonas putida KT2440
ccccaucagcagcu

SEQ ID NO: 3567910 - RNA, 14 nt, Pseudomonas putida KT2440
ccccaucaguugca

SEQ ID NO: 3567911 - RNA, 21 nt, Pseudomonas putida KT2440
ccccaucaguugcagcaacgc

SEQ ID NO: 3567912 - RNA, 22 nt, Pseudomonas putida KT2440
ccccaucaguugcagcaacgcc

SEQ ID NO: 3567913 - RNA, 13 nt, Pseudomonas putida KT2440
ccccaucggcacc

SEQ ID NO: 3567914 - RNA, 18 nt, Pseudomonas putida KT2440
ccccaugaugaccaccag

SEQ ID NO: 3567915 - RNA, 15 nt, Pseudomonas putida KT2440
ccccaugcucaccag

SEQ ID NO: 3567916 - RNA, 15 nt, Pseudomonas putida KT2440
ccccauguggcgcag

SEQ ID NO: 3567917 - RNA, 20 nt, Pseudomonas putida KT2440
ccccauucgcugcgucaggc

SEQ ID NO: 3567918 - RNA, 11 nt, Pseudomonas putida KT2440
cccccaaucag

SEQ ID NO: 3567919 - RNA, 23 nt, Pseudomonas putida KT2440
cccccaaucgccgcaaccgccgc

SEQ ID NO: 3567920 - RNA, 14 nt, Pseudomonas putida KT2440
cccccaccggccgc

SEQ ID NO: 3567921 - RNA, 12 nt, Pseudomonas putida KT2440
cccccagcacag

SEQ ID NO: 3567922 - RNA, 12 nt, Pseudomonas putida KT2440
cccccagcagcg

SEQ ID NO: 3567923 - RNA, 18 nt, Pseudomonas putida KT2440
cccccagccaacgcccca

SEQ ID NO: 3567924 - RNA, 23 nt, Pseudomonas putida KT2440
cccccagccaacgccccacccgc

SEQ ID NO: 3567925 - RNA, 21 nt, Pseudomonas putida KT2440
cccccagccggucauccagca

SEQ ID NO: 3567926 - RNA, 16 nt, Pseudomonas putida KT2440
cccccagccuugaggc

SEQ ID NO: 3567927 - RNA, 20 nt, Pseudomonas putida KT2440
cccccagcgaccagcugcca

SEQ ID NO: 3567928 - RNA, 15 nt, Pseudomonas putida KT2440
cccccagcgccucca

SEQ ID NO: 3567929 - RNA, 23 nt, Pseudomonas putida KT2440
cccccaggcugccaaaccgcccc

SEQ ID NO: 3567930 - RNA, 18 nt, Pseudomonas putida KT2440
cccccagguuauccacag

SEQ ID NO: 3567931 - RNA, 15 nt, Pseudomonas putida KT2440
cccccaucagcgggc

SEQ ID NO: 3567932 - RNA, 17 nt, Pseudomonas putida KT2440
cccccaugagccgccca

SEQ ID NO: 3567933 - RNA, 18 nt, Pseudomonas putida KT2440
cccccaugaugaccacca

SEQ ID NO: 3567934 - RNA, 12 nt, Pseudomonas putida KT2440
ccccccagcagc

SEQ ID NO: 3567935 - RNA, 13 nt, Pseudomonas putida KT2440
ccccccggcucca

SEQ ID NO: 3567936 - RNA, 12 nt, Pseudomonas putida KT2440
ccccccuccuca

SEQ ID NO: 3567937 - RNA, 21 nt, Pseudomonas putida KT2440
cccccgaaucagugcaccggc

SEQ ID NO: 3567938 - RNA, 22 nt, Pseudomonas putida KT2440
cccccgaaucagugcaccggca

SEQ ID NO: 3567939 - RNA, 13 nt, Pseudomonas putida KT2440
cccccgccacccc

SEQ ID NO: 3567940 - RNA, 15 nt, Pseudomonas putida KT2440
cccccgccacccccg

SEQ ID NO: 3567941 - RNA, 18 nt, Pseudomonas putida KT2440
cccccggaugcgcaagca

SEQ ID NO: 3567942 - RNA, 21 nt, Pseudomonas putida KT2440
cccccggauggugugcagcaa

SEQ ID NO: 3567943 - RNA, 14 nt, Pseudomonas putida KT2440
cccccggcggcggc

SEQ ID NO: 3567944 - RNA, 12 nt, Pseudomonas putida KT2440
cccccgguacca

SEQ ID NO: 3567945 - RNA, 19 nt, Pseudomonas putida KT2440
cccccgguaccagcaggcc

SEQ ID NO: 3567946 - RNA, 15 nt, Pseudomonas putida KT2440
cccccggugccggcc

SEQ ID NO: 3567947 - RNA, 17 nt, Pseudomonas putida KT2440
cccccguaggagcgggu

SEQ ID NO: 3567948 - RNA, 18 nt, Pseudomonas putida KT2440
cccccgucucggcaauca

SEQ ID NO: 3567949 - RNA, 14 nt, Pseudomonas putida KT2440
cccccuccuccagc

SEQ ID NO: 3567950 - RNA, 12 nt, Pseudomonas putida KT2440
cccccuccugau

SEQ ID NO: 3567951 - RNA, 12 nt, Pseudomonas putida KT2440
cccccugcacca

SEQ ID NO: 3567952 - RNA, 18 nt, Pseudomonas putida KT2440
cccccuguaggagcgggu

SEQ ID NO: 3567953 - RNA, 19 nt, Pseudomonas putida KT2440
cccccuucaaugccgggaa

SEQ ID NO: 3567954 - RNA, 17 nt, Pseudomonas putida KT2440
ccccgaaccuacccggu

SEQ ID NO: 3567955 - RNA, 15 nt, Pseudomonas putida KT2440
ccccgaacgcgguaa

SEQ ID NO: 3567956 - RNA, 19 nt, Pseudomonas putida KT2440
ccccgaacgcgguaagcac

SEQ ID NO: 3567957 - RNA, 18 nt, Pseudomonas putida KT2440
ccccgaagcagccgccgc

SEQ ID NO: 3567958 - RNA, 15 nt, Pseudomonas putida KT2440
ccccgaccacccggu

SEQ ID NO: 3567959 - RNA, 14 nt, Pseudomonas putida KT2440
ccccgacugacgcu

SEQ ID NO: 3567960 - RNA, 18 nt, Pseudomonas putida KT2440
ccccgagcaaagcccgcc

SEQ ID NO: 3567961 - RNA, 16 nt, Pseudomonas putida KT2440
ccccgaguaacccugg

SEQ ID NO: 3567962 - RNA, 12 nt, Pseudomonas putida KT2440
ccccgaugcgcu

SEQ ID NO: 3567963 - RNA, 15 nt, Pseudomonas putida KT2440
ccccgcaccagacca

SEQ ID NO: 3567964 - RNA, 12 nt, Pseudomonas putida KT2440
ccccgcaccgcg

SEQ ID NO: 3567965 - RNA, 17 nt, Pseudomonas putida KT2440
ccccgcaccuccuuggc

SEQ ID NO: 3567966 - RNA, 13 nt, Pseudomonas putida KT2440
ccccgccaacccc

SEQ ID NO: 3567967 - RNA, 15 nt, Pseudomonas putida KT2440
ccccgccaaccccuc

SEQ ID NO: 3567968 - RNA, 12 nt, Pseudomonas putida KT2440
ccccgccacccc

SEQ ID NO: 3567969 - RNA, 15 nt, Pseudomonas putida KT2440
ccccgccacccccgc

SEQ ID NO: 3567970 - RNA, 12 nt, Pseudomonas putida KT2440
ccccgcccaagc

SEQ ID NO: 3567971 - RNA, 12 nt, Pseudomonas putida KT2440
ccccgccccacc

SEQ ID NO: 3567972 - RNA, 13 nt, Pseudomonas putida KT2440
ccccgcccuagcg

SEQ ID NO: 3567973 - RNA, 12 nt, Pseudomonas putida KT2440
ccccgccgcccc

SEQ ID NO: 3567974 - RNA, 11 nt, Pseudomonas putida KT2440
ccccgccgcug

SEQ ID NO: 3567975 - RNA, 12 nt, Pseudomonas putida KT2440
ccccgccgugca

SEQ ID NO: 3567976 - RNA, 13 nt, Pseudomonas putida KT2440
ccccgccgugcag

SEQ ID NO: 3567977 - RNA, 14 nt, Pseudomonas putida KT2440
ccccgccgugcagu

SEQ ID NO: 3567978 - RNA, 19 nt, Pseudomonas putida KT2440
ccccgccugcuggccgcgc

SEQ ID NO: 3567979 - RNA, 13 nt, Pseudomonas putida KT2440
ccccgcgcaagcg

SEQ ID NO: 3567980 - RNA, 21 nt, Pseudomonas putida KT2440
ccccgcgccgccgacgaugcc

SEQ ID NO: 3567981 - RNA, 17 nt, Pseudomonas putida KT2440
ccccgcggucuggcaca

SEQ ID NO: 3567982 - RNA, 12 nt, Pseudomonas putida KT2440
ccccgcucaugg

SEQ ID NO: 3567983 - RNA, 11 nt, Pseudomonas putida KT2440
ccccgcuccua

SEQ ID NO: 3567984 - RNA, 23 nt, Pseudomonas putida KT2440
ccccgcugcacaggccagcccca

SEQ ID NO: 3567985 - RNA, 13 nt, Pseudomonas putida KT2440
ccccggaugcgca

SEQ ID NO: 3567986 - RNA, 19 nt, Pseudomonas putida KT2440
ccccggauggugugcagca

SEQ ID NO: 3567987 - RNA, 20 nt, Pseudomonas putida KT2440
ccccggcaauaccgauuauc

SEQ ID NO: 3567988 - RNA, 19 nt, Pseudomonas putida KT2440
ccccggcccagccccgagc

SEQ ID NO: 3567989 - RNA, 14 nt, Pseudomonas putida KT2440
ccccggccugcaca

SEQ ID NO: 3567990 - RNA, 15 nt, Pseudomonas putida KT2440
ccccggcgacggcga

SEQ ID NO: 3567991 - RNA, 19 nt, Pseudomonas putida KT2440
ccccggcuaucucaggcca

SEQ ID NO: 3567992 - RNA, 11 nt, Pseudomonas putida KT2440
ccccggcuguc

SEQ ID NO: 3567993 - RNA, 14 nt, Pseudomonas putida KT2440
ccccgggcaggcca

SEQ ID NO: 3567994 - RNA, 15 nt, Pseudomonas putida KT2440
ccccgguaaugcugg

SEQ ID NO: 3567995 - RNA, 21 nt, Pseudomonas putida KT2440
ccccgguaaugcugguggugg

SEQ ID NO: 3567996 - RNA, 18 nt, Pseudomonas putida KT2440
ccccggucagcauggcca

SEQ ID NO: 3567997 - RNA, 12 nt, Pseudomonas putida KT2440
ccccgguccagc

SEQ ID NO: 3567998 - RNA, 19 nt, Pseudomonas putida KT2440
ccccguaggagcggguuua

SEQ ID NO: 3567999 - RNA, 12 nt, Pseudomonas putida KT2440
ccccguccagcc

SEQ ID NO: 3568000 - RNA, 12 nt, Pseudomonas putida KT2440
ccccgucuuccu

SEQ ID NO: 3568001 - RNA, 19 nt, Pseudomonas putida KT2440
ccccguguacgacugccgc

SEQ ID NO: 3568002 - RNA, 14 nt, Pseudomonas putida KT2440
ccccguucgcccug

SEQ ID NO: 3568003 - RNA, 14 nt, Pseudomonas putida KT2440
ccccguugcgcagc

SEQ ID NO: 3568004 - RNA, 14 nt, Pseudomonas putida KT2440
ccccuaccgccaac

SEQ ID NO: 3568005 - RNA, 19 nt, Pseudomonas putida KT2440
ccccuacgucagcuugcaa

SEQ ID NO: 3568006 - RNA, 22 nt, Pseudomonas putida KT2440
ccccuauacacaugcacaggcc

SEQ ID NO: 3568007 - RNA, 23 nt, Pseudomonas putida KT2440
ccccucauucaaagccugcucca

SEQ ID NO: 3568008 - RNA, 14 nt, Pseudomonas putida KT2440
ccccuccacccggu

SEQ ID NO: 3568009 - RNA, 23 nt, Pseudomonas putida KT2440
ccccuccacccggucccgcccgg

SEQ ID NO: 3568010 - RNA, 12 nt, Pseudomonas putida KT2440
ccccuccagcac

SEQ ID NO: 3568011 - RNA, 19 nt, Pseudomonas putida KT2440
ccccuccagcacaccgcgc

SEQ ID NO: 3568012 - RNA, 14 nt, Pseudomonas putida KT2440
ccccuccggccccg

SEQ ID NO: 3568013 - RNA, 13 nt, Pseudomonas putida KT2440
ccccucgaucaac

SEQ ID NO: 3568014 - RNA, 13 nt, Pseudomonas putida KT2440
ccccucgcugccc

SEQ ID NO: 3568015 - RNA, 21 nt, Pseudomonas putida KT2440
ccccugauaggacugcuucag

SEQ ID NO: 3568016 - RNA, 13 nt, Pseudomonas putida KT2440
ccccugauguggc

SEQ ID NO: 3568017 - RNA, 21 nt, Pseudomonas putida KT2440
ccccugcaaggccagcggaau

SEQ ID NO: 3568018 - RNA, 15 nt, Pseudomonas putida KT2440
ccccugcacaucacg

SEQ ID NO: 3568019 - RNA, 14 nt, Pseudomonas putida KT2440
ccccugcgccgcca

SEQ ID NO: 3568020 - RNA, 17 nt, Pseudomonas putida KT2440
ccccugcgccgccaccu

SEQ ID NO: 3568021 - RNA, 18 nt, Pseudomonas putida KT2440
ccccugcgccgccaccug

SEQ ID NO: 3568022 - RNA, 20 nt, Pseudomonas putida KT2440
ccccugcuugaccauggcga

SEQ ID NO: 3568023 - RNA, 17 nt, Pseudomonas putida KT2440
ccccuggcgcuuuccag

SEQ ID NO: 3568024 - RNA, 22 nt, Pseudomonas putida KT2440
ccccugguuuuccaccggcacg

SEQ ID NO: 3568025 - RNA, 20 nt, Pseudomonas putida KT2440
ccccuguaggagcggguuua

SEQ ID NO: 3568026 - RNA, 18 nt, Pseudomonas putida KT2440
ccccuguaggaucggguu

SEQ ID NO: 3568027 - RNA, 17 nt, Pseudomonas putida KT2440
ccccugugggagcgggg

SEQ ID NO: 3568028 - RNA, 14 nt, Pseudomonas putida KT2440
ccccuucaaggggc

SEQ ID NO: 3568029 - RNA, 15 nt, Pseudomonas putida KT2440
ccccuucaaggggcc

SEQ ID NO: 3568030 - RNA, 23 nt, Pseudomonas putida KT2440
ccccuucacugaucgggauuaca

SEQ ID NO: 3568031 - RNA, 18 nt, Pseudomonas putida KT2440
ccccuucaucacccaguu

SEQ ID NO: 3568032 - RNA, 18 nt, Pseudomonas putida KT2440
ccccuuccccaggccgcc

SEQ ID NO: 3568033 - RNA, 16 nt, Pseudomonas putida KT2440
ccccuucgacgcucaa

SEQ ID NO: 3568034 - RNA, 21 nt, Pseudomonas putida KT2440
ccccuucgucgauguccagcg

SEQ ID NO: 3568035 - RNA, 20 nt, Pseudomonas putida KT2440
ccccuugcaguaucgccccg

SEQ ID NO: 3568036 - RNA, 10 nt, Pseudomonas putida KT2440
ccccuuggcc

SEQ ID NO: 3568037 - RNA, 16 nt, Pseudomonas putida KT2440
ccccuuggccaacggc

SEQ ID NO: 3568038 - RNA, 18 nt, Pseudomonas putida KT2440
ccccuuggcgacgugccc

SEQ ID NO: 3568039 - RNA, 21 nt, Pseudomonas putida KT2440
ccccuuuacuggccauccagu

SEQ ID NO: 3568040 - RNA, 16 nt, Pseudomonas putida KT2440
ccccuuucgcgacaca

SEQ ID NO: 3568041 - RNA, 19 nt, Pseudomonas putida KT2440
ccccuuucuccagcaacaa

SEQ ID NO: 3568042 - RNA, 21 nt, Pseudomonas putida KT2440
ccccuuuggccuaccgcccgc

SEQ ID NO: 3568043 - RNA, 19 nt, Pseudomonas putida KT2440
ccccuuuuuuuugccuggg

SEQ ID NO: 3568044 - RNA, 17 nt, Pseudomonas putida KT2440
cccgaaaccaugcaggu

SEQ ID NO: 3568045 - RNA, 21 nt, Pseudomonas putida KT2440
cccgaaacugcgcucaaccag

SEQ ID NO: 3568046 - RNA, 15 nt, Pseudomonas putida KT2440
cccgaagcagccgcc

SEQ ID NO: 3568047 - RNA, 14 nt, Pseudomonas putida KT2440
cccgaagcgcaggu

SEQ ID NO: 3568048 - RNA, 17 nt, Pseudomonas putida KT2440
cccgaagcgcaggucca

SEQ ID NO: 3568049 - RNA, 17 nt, Pseudomonas putida KT2440
cccgaagcuaucgccag

SEQ ID NO: 3568050 - RNA, 22 nt, Pseudomonas putida KT2440
cccgaagcuaucgccagcaggc

SEQ ID NO: 3568051 - RNA, 17 nt, Pseudomonas putida KT2440
cccgacaaagaagcgcc

SEQ ID NO: 3568052 - RNA, 17 nt, Pseudomonas putida KT2440
cccgacaaaguggaagg

SEQ ID NO: 3568053 - RNA, 16 nt, Pseudomonas putida KT2440
cccgacaacagcugca

SEQ ID NO: 3568054 - RNA, 20 nt, Pseudomonas putida KT2440
cccgacaccggccuugcgca

SEQ ID NO: 3568055 - RNA, 12 nt, Pseudomonas putida KT2440
cccgacagcaau

SEQ ID NO: 3568056 - RNA, 19 nt, Pseudomonas putida KT2440
cccgaccaaggccaacugc

SEQ ID NO: 3568057 - RNA, 17 nt, Pseudomonas putida KT2440
cccgaccgccagcccgc

SEQ ID NO: 3568058 - RNA, 19 nt, Pseudomonas putida KT2440
cccgaccgccagcccgcca

SEQ ID NO: 3568059 - RNA, 14 nt, Pseudomonas putida KT2440
cccgaccucacgca

SEQ ID NO: 3568060 - RNA, 21 nt, Pseudomonas putida KT2440
cccgaccucacgcagguacuc

SEQ ID NO: 3568061 - RNA, 14 nt, Pseudomonas putida KT2440
cccgacggcucuug

SEQ ID NO: 3568062 - RNA, 13 nt, Pseudomonas putida KT2440
cccgagcaaagcc

SEQ ID NO: 3568063 - RNA, 18 nt, Pseudomonas putida KT2440
cccgagcaaagcccgccc

SEQ ID NO: 3568064 - RNA, 19 nt, Pseudomonas putida KT2440
cccgagcaaagcccgcccc

SEQ ID NO: 3568065 - RNA, 18 nt, Pseudomonas putida KT2440
cccgagcaaggcgcagcc

SEQ ID NO: 3568066 - RNA, 23 nt, Pseudomonas putida KT2440
cccgagcccccgcugcucgagga

SEQ ID NO: 3568067 - RNA, 20 nt, Pseudomonas putida KT2440
cccgagcguucgaugcgcag

SEQ ID NO: 3568068 - RNA, 22 nt, Pseudomonas putida KT2440
cccgaggaaguacgccggcgca

SEQ ID NO: 3568069 - RNA, 14 nt, Pseudomonas putida KT2440
cccgaggcaaucag

SEQ ID NO: 3568070 - RNA, 18 nt, Pseudomonas putida KT2440
cccgaggcaaucagcggu

SEQ ID NO: 3568071 - RNA, 15 nt, Pseudomonas putida KT2440
cccgaggucagcagu

SEQ ID NO: 3568072 - RNA, 21 nt, Pseudomonas putida KT2440
cccgaguaaucgaugaaauuc

SEQ ID NO: 3568073 - RNA, 19 nt, Pseudomonas putida KT2440
cccgauacagcgcgccgcc

SEQ ID NO: 3568074 - RNA, 22 nt, Pseudomonas putida KT2440
cccgauccucaucguccaccgc

SEQ ID NO: 3568075 - RNA, 17 nt, Pseudomonas putida KT2440
cccgaucuccccaccau

SEQ ID NO: 3568076 - RNA, 22 nt, Pseudomonas putida KT2440
cccgaugcgcugaucgugcacc

SEQ ID NO: 3568077 - RNA, 22 nt, Pseudomonas putida KT2440
cccgaugcgcuugaggcuuuca

SEQ ID NO: 3568078 - RNA, 18 nt, Pseudomonas putida KT2440
cccgauuccaagguauca

SEQ ID NO: 3568079 - RNA, 15 nt, Pseudomonas putida KT2440
cccgcaaagcccugc

SEQ ID NO: 3568080 - RNA, 17 nt, Pseudomonas putida KT2440
cccgcaaagcccugccu

SEQ ID NO: 3568081 - RNA, 13 nt, Pseudomonas putida KT2440
cccgcaacaaccu

SEQ ID NO: 3568082 - RNA, 15 nt, Pseudomonas putida KT2440
cccgcaacaccagga

SEQ ID NO: 3568083 - RNA, 16 nt, Pseudomonas putida KT2440
cccgcaacaccaggac

SEQ ID NO: 3568084 - RNA, 23 nt, Pseudomonas putida KT2440
cccgcaacauaaggugcaaagcg

SEQ ID NO: 3568085 - RNA, 13 nt, Pseudomonas putida KT2440
cccgcaagccagc

SEQ ID NO: 3568086 - RNA, 15 nt, Pseudomonas putida KT2440
cccgcaagccagccu

SEQ ID NO: 3568087 - RNA, 16 nt, Pseudomonas putida KT2440
cccgcaagccagccuc

SEQ ID NO: 3568088 - RNA, 15 nt, Pseudomonas putida KT2440
cccgcaagcgccgau

SEQ ID NO: 3568089 - RNA, 14 nt, Pseudomonas putida KT2440
cccgcaagggucug

SEQ ID NO: 3568090 - RNA, 18 nt, Pseudomonas putida KT2440
cccgcaaucgucgaccac

SEQ ID NO: 3568091 - RNA, 19 nt, Pseudomonas putida KT2440
cccgcacagcacguucagc

SEQ ID NO: 3568092 - RNA, 23 nt, Pseudomonas putida KT2440
cccgcacaucacggcgcaggccg

SEQ ID NO: 3568093 - RNA, 18 nt, Pseudomonas putida KT2440
cccgcacauuucacagca

SEQ ID NO: 3568094 - RNA, 14 nt, Pseudomonas putida KT2440
cccgcacccggcgg

SEQ ID NO: 3568095 - RNA, 21 nt, Pseudomonas putida KT2440
cccgcaccgcggaugcgccug

SEQ ID NO: 3568096 - RNA, 18 nt, Pseudomonas putida KT2440
cccgcaccuccuuggccg

SEQ ID NO: 3568097 - RNA, 17 nt, Pseudomonas putida KT2440
cccgcacgaacagcggc

SEQ ID NO: 3568098 - RNA, 12 nt, Pseudomonas putida KT2440
cccgcagcaggu

SEQ ID NO: 3568099 - RNA, 22 nt, Pseudomonas putida KT2440
cccgcaggaauaacuggcccga

SEQ ID NO: 3568100 - RNA, 15 nt, Pseudomonas putida KT2440
cccgcaggccgcagc

SEQ ID NO: 3568101 - RNA, 16 nt, Pseudomonas putida KT2440
cccgcaggccgcagcc

SEQ ID NO: 3568102 - RNA, 18 nt, Pseudomonas putida KT2440
cccgcaggcuaugccggu

SEQ ID NO: 3568103 - RNA, 14 nt, Pseudomonas putida KT2440
cccgcagggccccc

SEQ ID NO: 3568104 - RNA, 16 nt, Pseudomonas putida KT2440
cccgcaucguuugaug

SEQ ID NO: 3568105 - RNA, 19 nt, Pseudomonas putida KT2440
cccgcaucguuugaugcgg

SEQ ID NO: 3568106 - RNA, 12 nt, Pseudomonas putida KT2440
cccgcaugcaac

SEQ ID NO: 3568107 - RNA, 16 nt, Pseudomonas putida KT2440
cccgcaugcaacccgc

SEQ ID NO: 3568108 - RNA, 21 nt, Pseudomonas putida KT2440
cccgcauuggguggccccggc

SEQ ID NO: 3568109 - RNA, 22 nt, Pseudomonas putida KT2440
cccgcauuggguggccccggcc

SEQ ID NO: 3568110 - RNA, 23 nt, Pseudomonas putida KT2440
cccgccacaggugacaagcugcg

SEQ ID NO: 3568111 - RNA, 18 nt, Pseudomonas putida KT2440
cccgccacccccgccgcc

SEQ ID NO: 3568112 - RNA, 12 nt, Pseudomonas putida KT2440
cccgccagcagg

SEQ ID NO: 3568113 - RNA, 17 nt, Pseudomonas putida KT2440
cccgccagcaggccacc

SEQ ID NO: 3568114 - RNA, 14 nt, Pseudomonas putida KT2440
cccgccaggcaguu

SEQ ID NO: 3568115 - RNA, 16 nt, Pseudomonas putida KT2440
cccgccaggcgcaagc

SEQ ID NO: 3568116 - RNA, 22 nt, Pseudomonas putida KT2440
cccgccaguaggcugcagccuu

SEQ ID NO: 3568117 - RNA, 21 nt, Pseudomonas putida KT2440
cccgccauaucaggauugccg

SEQ ID NO: 3568118 - RNA, 18 nt, Pseudomonas putida KT2440
cccgccauguugcgcagc

SEQ ID NO: 3568119 - RNA, 19 nt, Pseudomonas putida KT2440
cccgccauguugcgcagca

SEQ ID NO: 3568120 - RNA, 22 nt, Pseudomonas putida KT2440
cccgccauugcaccacgccaua

SEQ ID NO: 3568121 - RNA, 20 nt, Pseudomonas putida KT2440
cccgcccaauuuggccagcu

SEQ ID NO: 3568122 - RNA, 21 nt, Pseudomonas putida KT2440
cccgcccaauuuggccagcuu

SEQ ID NO: 3568123 - RNA, 14 nt, Pseudomonas putida KT2440
cccgcccaccacca

SEQ ID NO: 3568124 - RNA, 12 nt, Pseudomonas putida KT2440
cccgcccagcag

SEQ ID NO: 3568125 - RNA, 18 nt, Pseudomonas putida KT2440
cccgcccagcagcaacgc

SEQ ID NO: 3568126 - RNA, 20 nt, Pseudomonas putida KT2440
cccgcccagcccaugaacag

SEQ ID NO: 3568127 - RNA, 14 nt, Pseudomonas putida KT2440
cccgcccagcuggc

SEQ ID NO: 3568128 - RNA, 14 nt, Pseudomonas putida KT2440
cccgccccaaagga

SEQ ID NO: 3568129 - RNA, 16 nt, Pseudomonas putida KT2440
cccgccccccaccugg

SEQ ID NO: 3568130 - RNA, 14 nt, Pseudomonas putida KT2440
cccgccccucuucc

SEQ ID NO: 3568131 - RNA, 13 nt, Pseudomonas putida KT2440
cccgccccugcuu

SEQ ID NO: 3568132 - RNA, 15 nt, Pseudomonas putida KT2440
cccgcccgaagggca

SEQ ID NO: 3568133 - RNA, 13 nt, Pseudomonas putida KT2440
cccgcccgccugc

SEQ ID NO: 3568134 - RNA, 12 nt, Pseudomonas putida KT2440
cccgcccggccu

SEQ ID NO: 3568135 - RNA, 15 nt, Pseudomonas putida KT2440
cccgcccucacucac

SEQ ID NO: 3568136 - RNA, 16 nt, Pseudomonas putida KT2440
cccgccgaagccauga

SEQ ID NO: 3568137 - RNA, 15 nt, Pseudomonas putida KT2440
cccgccgccaccagc

SEQ ID NO: 3568138 - RNA, 18 nt, Pseudomonas putida KT2440
cccgccgccaccagcgcc

SEQ ID NO: 3568139 - RNA, 12 nt, Pseudomonas putida KT2440
cccgccgccccc

SEQ ID NO: 3568140 - RNA, 20 nt, Pseudomonas putida KT2440
cccgccgcccgcggcgaaca

SEQ ID NO: 3568141 - RNA, 13 nt, Pseudomonas putida KT2440
cccgccggcacuu

SEQ ID NO: 3568142 - RNA, 14 nt, Pseudomonas putida KT2440
cccgccugacgccg

SEQ ID NO: 3568143 - RNA, 16 nt, Pseudomonas putida KT2440
cccgccugacgccgcc

SEQ ID NO: 3568144 - RNA, 18 nt, Pseudomonas putida KT2440
cccgccugacgccgccag

SEQ ID NO: 3568145 - RNA, 16 nt, Pseudomonas putida KT2440
cccgccugcuggccgc

SEQ ID NO: 3568146 - RNA, 22 nt, Pseudomonas putida KT2440
cccgccuggcgccugcgccagu

SEQ ID NO: 3568147 - RNA, 19 nt, Pseudomonas putida KT2440
cccgccuggugccagcggc

SEQ ID NO: 3568148 - RNA, 20 nt, Pseudomonas putida KT2440
cccgccuggugccagcggcc

SEQ ID NO: 3568149 - RNA, 20 nt, Pseudomonas putida KT2440
cccgcgaaagggccagcaca

SEQ ID NO: 3568150 - RNA, 20 nt, Pseudomonas putida KT2440
cccgcgaaagggccaguaca

SEQ ID NO: 3568151 - RNA, 20 nt, Pseudomonas putida KT2440
cccgcgaaagggccagucca

SEQ ID NO: 3568152 - RNA, 21 nt, Pseudomonas putida KT2440
cccgcgaaagggccgcaacgc

SEQ ID NO: 3568153 - RNA, 22 nt, Pseudomonas putida KT2440
cccgcgaaagggccgcaacgcg

SEQ ID NO: 3568154 - RNA, 19 nt, Pseudomonas putida KT2440
cccgcgaaagggccggccc

SEQ ID NO: 3568155 - RNA, 20 nt, Pseudomonas putida KT2440
cccgcgaaagggccggcccu

SEQ ID NO: 3568156 - RNA, 16 nt, Pseudomonas putida KT2440
cccgcgaaaugcccaa

SEQ ID NO: 3568157 - RNA, 20 nt, Pseudomonas putida KT2440
cccgcgaaaugcccaaagcc

SEQ ID NO: 3568158 - RNA, 20 nt, Pseudomonas putida KT2440
cccgcgaagaagacaccgcg

SEQ ID NO: 3568159 - RNA, 20 nt, Pseudomonas putida KT2440
cccgcgaagaauucaacgcg

SEQ ID NO: 3568160 - RNA, 17 nt, Pseudomonas putida KT2440
cccgcgaagaggccagc

SEQ ID NO: 3568161 - RNA, 18 nt, Pseudomonas putida KT2440
cccgcgaagaggccagga

SEQ ID NO: 3568162 - RNA, 19 nt, Pseudomonas putida KT2440
cccgcgaagaggccaggac

SEQ ID NO: 3568163 - RNA, 18 nt, Pseudomonas putida KT2440
cccgcgaagaggcccgaa

SEQ ID NO: 3568164 - RNA, 17 nt, Pseudomonas putida KT2440
cccgcgaagagggcgac

SEQ ID NO: 3568165 - RNA, 20 nt, Pseudomonas putida KT2440
cccgcgaagagggcgacacc

SEQ ID NO: 3568166 - RNA, 17 nt, Pseudomonas putida KT2440
cccgcgaagcaggcgac

SEQ ID NO: 3568167 - RNA, 19 nt, Pseudomonas putida KT2440
cccgcgaagcaggcgacgc

SEQ ID NO: 3568168 - RNA, 15 nt, Pseudomonas putida KT2440
cccgcgaagcggcca

SEQ ID NO: 3568169 - RNA, 19 nt, Pseudomonas putida KT2440
cccgcgaagcggccaaccg

SEQ ID NO: 3568170 - RNA, 17 nt, Pseudomonas putida KT2440
cccgcgaagggccgcaa

SEQ ID NO: 3568171 - RNA, 21 nt, Pseudomonas putida KT2440
cccgcgaagggccgcaaagcg

SEQ ID NO: 3568172 - RNA, 21 nt, Pseudomonas putida KT2440
cccgcgaagggccgcaacgcg

SEQ ID NO: 3568173 - RNA, 16 nt, Pseudomonas putida KT2440
cccgcgaagggccgcc

SEQ ID NO: 3568174 - RNA, 21 nt, Pseudomonas putida KT2440
cccgcgaagggccgccaagcg

SEQ ID NO: 3568175 - RNA, 18 nt, Pseudomonas putida KT2440
cccgcgaagggccgcuag

SEQ ID NO: 3568176 - RNA, 19 nt, Pseudomonas putida KT2440
cccgcgaaggggccggccc

SEQ ID NO: 3568177 - RNA, 20 nt, Pseudomonas putida KT2440
cccgcgaauacgguagcggc

SEQ ID NO: 3568178 - RNA, 21 nt, Pseudomonas putida KT2440
cccgcgaauacggucgcggcg

SEQ ID NO: 3568179 - RNA, 21 nt, Pseudomonas putida KT2440
cccgcgaauagccgugaugcg

SEQ ID NO: 3568180 - RNA, 19 nt, Pseudomonas putida KT2440
cccgcgaaucguccuggaa

SEQ ID NO: 3568181 - RNA, 22 nt, Pseudomonas putida KT2440
cccgcgaaugcgguagcggcug

SEQ ID NO: 3568182 - RNA, 18 nt, Pseudomonas putida KT2440
cccgcgaaugcuacagaa

SEQ ID NO: 3568183 - RNA, 24 nt, Pseudomonas putida KT2440
cccgcgaaugcuccggcgacagcu

SEQ ID NO: 3568184 - RNA, 14 nt, Pseudomonas putida KT2440
cccgcgaauggccu

SEQ ID NO: 3568185 - RNA, 22 nt, Pseudomonas putida KT2440
cccgcgaaugggccgcaaagcg

SEQ ID NO: 3568186 - RNA, 19 nt, Pseudomonas putida KT2440
cccgcgaaugggccgccaa

SEQ ID NO: 3568187 - RNA, 22 nt, Pseudomonas putida KT2440
cccgcgaaugggccgccaagcg

SEQ ID NO: 3568188 - RNA, 23 nt, Pseudomonas putida KT2440
cccgcgaaugggccgccaagcgg

SEQ ID NO: 3568189 - RNA, 21 nt, Pseudomonas putida KT2440
cccgcgacgaaacccaguacg

SEQ ID NO: 3568190 - RNA, 15 nt, Pseudomonas putida KT2440
cccgcgacgugaccg

SEQ ID NO: 3568191 - RNA, 15 nt, Pseudomonas putida KT2440
cccgcgaggucaggu

SEQ ID NO: 3568192 - RNA, 19 nt, Pseudomonas putida KT2440
cccgcgcaaaugcaccccu

SEQ ID NO: 3568193 - RNA, 23 nt, Pseudomonas putida KT2440
cccgcgcaggaucaugugcgcca

SEQ ID NO: 3568194 - RNA, 23 nt, Pseudomonas putida KT2440
cccgcgcauccuccgcccugccc

SEQ ID NO: 3568195 - RNA, 17 nt, Pseudomonas putida KT2440
cccgcgcaugaucagcu

SEQ ID NO: 3568196 - RNA, 18 nt, Pseudomonas putida KT2440
cccgcgcaugaucagcug

SEQ ID NO: 3568197 - RNA, 17 nt, Pseudomonas putida KT2440
cccgcgcccuugcggac

SEQ ID NO: 3568198 - RNA, 13 nt, Pseudomonas putida KT2440
cccgcgccgacag

SEQ ID NO: 3568199 - RNA, 12 nt, Pseudomonas putida KT2440
cccgcgccgcca

SEQ ID NO: 3568200 - RNA, 13 nt, Pseudomonas putida KT2440
cccgcgccgccau

SEQ ID NO: 3568201 - RNA, 20 nt, Pseudomonas putida KT2440
cccgcgccuacagcggccug

SEQ ID NO: 3568202 - RNA, 22 nt, Pseudomonas putida KT2440
cccgcgccuacagcggccugug

SEQ ID NO: 3568203 - RNA, 18 nt, Pseudomonas putida KT2440
cccgcgccuacaggcaac

SEQ ID NO: 3568204 - RNA, 20 nt, Pseudomonas putida KT2440
cccgcgccuacaggcaaccg

SEQ ID NO: 3568205 - RNA, 21 nt, Pseudomonas putida KT2440
cccgcgccuacaggcaaccgc

SEQ ID NO: 3568206 - RNA, 19 nt, Pseudomonas putida KT2440
cccgcgcgcccgcggccca

SEQ ID NO: 3568207 - RNA, 18 nt, Pseudomonas putida KT2440
cccgcgcggcgcaucgcg

SEQ ID NO: 3568208 - RNA, 22 nt, Pseudomonas putida KT2440
cccgcgcguccauggcgccgau

SEQ ID NO: 3568209 - RNA, 15 nt, Pseudomonas putida KT2440
cccgcgcuucccggg

SEQ ID NO: 3568210 - RNA, 14 nt, Pseudomonas putida KT2440
cccgcggcgaacac

SEQ ID NO: 3568211 - RNA, 16 nt, Pseudomonas putida KT2440
cccgcggcucacccac

SEQ ID NO: 3568212 - RNA, 17 nt, Pseudomonas putida KT2440
cccgcgucagcucaagc

SEQ ID NO: 3568213 - RNA, 21 nt, Pseudomonas putida KT2440
cccgcgucagcucaagcgcuc

SEQ ID NO: 3568214 - RNA, 13 nt, Pseudomonas putida KT2440
cccgcguccaggg

SEQ ID NO: 3568215 - RNA, 20 nt, Pseudomonas putida KT2440
cccgcguccagggcagguca

SEQ ID NO: 3568216 - RNA, 16 nt, Pseudomonas putida KT2440
cccgcgucguucggca

SEQ ID NO: 3568217 - RNA, 16 nt, Pseudomonas putida KT2440
cccgcgucugccgcag

SEQ ID NO: 3568218 - RNA, 14 nt, Pseudomonas putida KT2440
cccgcguucaugcc

SEQ ID NO: 3568219 - RNA, 22 nt, Pseudomonas putida KT2440
cccgcguucaugccggccccag

SEQ ID NO: 3568220 - RNA, 15 nt, Pseudomonas putida KT2440
cccgcguuugcaacu

SEQ ID NO: 3568221 - RNA, 16 nt, Pseudomonas putida KT2440
cccgcuacaccggccu

SEQ ID NO: 3568222 - RNA, 19 nt, Pseudomonas putida KT2440
cccgcuacaccggccugga

SEQ ID NO: 3568223 - RNA, 22 nt, Pseudomonas putida KT2440
cccgcuacaccggccuggauaa

SEQ ID NO: 3568224 - RNA, 18 nt, Pseudomonas putida KT2440
cccgcuauccucgaucgc

SEQ ID NO: 3568225 - RNA, 21 nt, Pseudomonas putida KT2440
cccgcucaaagcgcaaaacca

SEQ ID NO: 3568226 - RNA, 20 nt, Pseudomonas putida KT2440
cccgcucauguccaggucac

SEQ ID NO: 3568227 - RNA, 12 nt, Pseudomonas putida KT2440
cccgcucccaca

SEQ ID NO: 3568228 - RNA, 19 nt, Pseudomonas putida KT2440
cccgcucccacaggaauca

SEQ ID NO: 3568229 - RNA, 20 nt, Pseudomonas putida KT2440
cccgcucccacaggaaucac

SEQ ID NO: 3568230 - RNA, 18 nt, Pseudomonas putida KT2440
cccgcucccacaggaauu

SEQ ID NO: 3568231 - RNA, 20 nt, Pseudomonas putida KT2440
cccgcucccacaggaauuac

SEQ ID NO: 3568232 - RNA, 15 nt, Pseudomonas putida KT2440
cccgcucccacaggc

SEQ ID NO: 3568233 - RNA, 18 nt, Pseudomonas putida KT2440
cccgcucccacaggccaa

SEQ ID NO: 3568234 - RNA, 16 nt, Pseudomonas putida KT2440
cccgcucccacaggua

SEQ ID NO: 3568235 - RNA, 17 nt, Pseudomonas putida KT2440
cccgcucccacagguaa

SEQ ID NO: 3568236 - RNA, 20 nt, Pseudomonas putida KT2440
cccgcucccacagguaaugc

SEQ ID NO: 3568237 - RNA, 19 nt, Pseudomonas putida KT2440
cccgcucccacagguaugu

SEQ ID NO: 3568238 - RNA, 20 nt, Pseudomonas putida KT2440
cccgcuccuacaaagcggcg

SEQ ID NO: 3568239 - RNA, 20 nt, Pseudomonas putida KT2440
cccgcuccuacaacgaucug

SEQ ID NO: 3568240 - RNA, 19 nt, Pseudomonas putida KT2440
cccgcuccuacacagguca

SEQ ID NO: 3568241 - RNA, 19 nt, Pseudomonas putida KT2440
cccgcuccuacaggauggc

SEQ ID NO: 3568242 - RNA, 20 nt, Pseudomonas putida KT2440
cccgcuccuacaggccgccc

SEQ ID NO: 3568243 - RNA, 20 nt, Pseudomonas putida KT2440
cccgcuccuacgacggucug

SEQ ID NO: 3568244 - RNA, 22 nt, Pseudomonas putida KT2440
cccgcuccuacgcaccgaucug

SEQ ID NO: 3568245 - RNA, 16 nt, Pseudomonas putida KT2440
cccgcuccuacgggca

SEQ ID NO: 3568246 - RNA, 20 nt, Pseudomonas putida KT2440
cccgcuccuacgggcaaccg

SEQ ID NO: 3568247 - RNA, 22 nt, Pseudomonas putida KT2440
cccgcuccuacuacggccugug

SEQ ID NO: 3568248 - RNA, 20 nt, Pseudomonas putida KT2440
cccgcuccugcaggguucgc

SEQ ID NO: 3568249 - RNA, 22 nt, Pseudomonas putida KT2440
cccgcucucacagggaccgugc

SEQ ID NO: 3568250 - RNA, 21 nt, Pseudomonas putida KT2440
cccgcugaaacaucagccggu

SEQ ID NO: 3568251 - RNA, 16 nt, Pseudomonas putida KT2440
cccgcugcacaggcca

SEQ ID NO: 3568252 - RNA, 22 nt, Pseudomonas putida KT2440
cccgcugcacaggccagcccca

SEQ ID NO: 3568253 - RNA, 15 nt, Pseudomonas putida KT2440
cccgcugccacccac

SEQ ID NO: 3568254 - RNA, 17 nt, Pseudomonas putida KT2440
cccgcugccacccacag

SEQ ID NO: 3568255 - RNA, 14 nt, Pseudomonas putida KT2440
cccgcugcgccgcu

SEQ ID NO: 3568256 - RNA, 19 nt, Pseudomonas putida KT2440
cccgcugcugcggcaacga

SEQ ID NO: 3568257 - RNA, 20 nt, Pseudomonas putida KT2440
cccgcuggaccuggcuggcg

SEQ ID NO: 3568258 - RNA, 14 nt, Pseudomonas putida KT2440
cccgcuggccgcac

SEQ ID NO: 3568259 - RNA, 18 nt, Pseudomonas putida KT2440
cccgcuggccgcacccag

SEQ ID NO: 3568260 - RNA, 23 nt, Pseudomonas putida KT2440
cccgcuggccgcacccagcaggc

SEQ ID NO: 3568261 - RNA, 13 nt, Pseudomonas putida KT2440
cccgcuggccgga

SEQ ID NO: 3568262 - RNA, 14 nt, Pseudomonas putida KT2440
cccgcuggcgauca

SEQ ID NO: 3568263 - RNA, 17 nt, Pseudomonas putida KT2440
cccgcuggcgaucaggc

SEQ ID NO: 3568264 - RNA, 16 nt, Pseudomonas putida KT2440
cccgcuucgccgcgcu

SEQ ID NO: 3568265 - RNA, 19 nt, Pseudomonas putida KT2440
cccgcuucgccgcgcugug

SEQ ID NO: 3568266 - RNA, 21 nt, Pseudomonas putida KT2440
cccgcuugccuuccucggcca

SEQ ID NO: 3568267 - RNA, 12 nt, Pseudomonas putida KT2440
cccgcuugcugu

SEQ ID NO: 3568268 - RNA, 19 nt, Pseudomonas putida KT2440
cccggaaugcccgggcgca

SEQ ID NO: 3568269 - RNA, 20 nt, Pseudomonas putida KT2440
cccggacaacuuggcaccga

SEQ ID NO: 3568270 - RNA, 22 nt, Pseudomonas putida KT2440
cccggaccagcgccgcaucgcc

SEQ ID NO: 3568271 - RNA, 15 nt, Pseudomonas putida KT2440
cccggacugcaccag

SEQ ID NO: 3568272 - RNA, 15 nt, Pseudomonas putida KT2440
cccggaugcgcaagc

SEQ ID NO: 3568273 - RNA, 14 nt, Pseudomonas putida KT2440
cccggauggugugc

SEQ ID NO: 3568274 - RNA, 11 nt, Pseudomonas putida KT2440
cccggcaaaca

SEQ ID NO: 3568275 - RNA, 20 nt, Pseudomonas putida KT2440
cccggcaaacuccacugugc

SEQ ID NO: 3568276 - RNA, 17 nt, Pseudomonas putida KT2440
cccggcaauccugggug

SEQ ID NO: 3568277 - RNA, 18 nt, Pseudomonas putida KT2440
cccggcaaucgccaggcg

SEQ ID NO: 3568278 - RNA, 18 nt, Pseudomonas putida KT2440
cccggcaaucgggauggc

SEQ ID NO: 3568279 - RNA, 18 nt, Pseudomonas putida KT2440
cccggcaauuucauccac

SEQ ID NO: 3568280 - RNA, 19 nt, Pseudomonas putida KT2440
cccggcacauagaccauuu

SEQ ID NO: 3568281 - RNA, 18 nt, Pseudomonas putida KT2440
cccggcaccugugcaggc

SEQ ID NO: 3568282 - RNA, 16 nt, Pseudomonas putida KT2440
cccggcagaagcgcug

SEQ ID NO: 3568283 - RNA, 19 nt, Pseudomonas putida KT2440
cccggcagaaucagguuca

SEQ ID NO: 3568284 - RNA, 13 nt, Pseudomonas putida KT2440
cccggcagaucga

SEQ ID NO: 3568285 - RNA, 14 nt, Pseudomonas putida KT2440
cccggcagccaccg

SEQ ID NO: 3568286 - RNA, 16 nt, Pseudomonas putida KT2440
cccggcagccaccgcc

SEQ ID NO: 3568287 - RNA, 21 nt, Pseudomonas putida KT2440
cccggcagguugcuggccuug

SEQ ID NO: 3568288 - RNA, 23 nt, Pseudomonas putida KT2440
cccggcagucagggucucggcca

SEQ ID NO: 3568289 - RNA, 16 nt, Pseudomonas putida KT2440
cccggcauccuguugu

SEQ ID NO: 3568290 - RNA, 20 nt, Pseudomonas putida KT2440
cccggcaucgcucaacuggc

SEQ ID NO: 3568291 - RNA, 16 nt, Pseudomonas putida KT2440
cccggcaugaucagcu

SEQ ID NO: 3568292 - RNA, 16 nt, Pseudomonas putida KT2440
cccggccagcagguca

SEQ ID NO: 3568293 - RNA, 11 nt, Pseudomonas putida KT2440
cccggccagcg

SEQ ID NO: 3568294 - RNA, 15 nt, Pseudomonas putida KT2440
cccggccaggccggc

SEQ ID NO: 3568295 - RNA, 14 nt, Pseudomonas putida KT2440
cccggccagggcug

SEQ ID NO: 3568296 - RNA, 14 nt, Pseudomonas putida KT2440
cccggccaggucac

SEQ ID NO: 3568297 - RNA, 20 nt, Pseudomonas putida KT2440
cccggccagugaagcucgau

SEQ ID NO: 3568298 - RNA, 13 nt, Pseudomonas putida KT2440
cccggcccagccg

SEQ ID NO: 3568299 - RNA, 19 nt, Pseudomonas putida KT2440
cccggccuccucgcgggca

SEQ ID NO: 3568300 - RNA, 21 nt, Pseudomonas putida KT2440
cccggccuccucgcgggcaaa

SEQ ID NO: 3568301 - RNA, 18 nt, Pseudomonas putida KT2440
cccggccucggccggguu

SEQ ID NO: 3568302 - RNA, 16 nt, Pseudomonas putida KT2440
cccggccuuggccgcu

SEQ ID NO: 3568303 - RNA, 21 nt, Pseudomonas putida KT2440
cccggcgaucugucaggugug

SEQ ID NO: 3568304 - RNA, 17 nt, Pseudomonas putida KT2440
cccggcgcagccguucu

SEQ ID NO: 3568305 - RNA, 21 nt, Pseudomonas putida KT2440
cccggcgccaaacgccagggc

SEQ ID NO: 3568306 - RNA, 13 nt, Pseudomonas putida KT2440
cccggcgccaugc

SEQ ID NO: 3568307 - RNA, 20 nt, Pseudomonas putida KT2440
cccggcgccaugccccccgc

SEQ ID NO: 3568308 - RNA, 13 nt, Pseudomonas putida KT2440
cccggcgccgcca

SEQ ID NO: 3568309 - RNA, 14 nt, Pseudomonas putida KT2440
cccggcgccgccag

SEQ ID NO: 3568310 - RNA, 17 nt, Pseudomonas putida KT2440
cccggcgcugaucagcu

SEQ ID NO: 3568311 - RNA, 19 nt, Pseudomonas putida KT2440
cccggcgcugaucagcugg

SEQ ID NO: 3568312 - RNA, 17 nt, Pseudomonas putida KT2440
cccggcgcuggugcagg

SEQ ID NO: 3568313 - RNA, 14 nt, Pseudomonas putida KT2440
cccggcguucagcc

SEQ ID NO: 3568314 - RNA, 18 nt, Pseudomonas putida KT2440
cccggcuaucucaggcca

SEQ ID NO: 3568315 - RNA, 17 nt, Pseudomonas putida KT2440
cccggcucaccgcagcc

SEQ ID NO: 3568316 - RNA, 19 nt, Pseudomonas putida KT2440
cccggcucaccgcagccca

SEQ ID NO: 3568317 - RNA, 21 nt, Pseudomonas putida KT2440
cccggcuccgcgcaagcgguu

SEQ ID NO: 3568318 - RNA, 16 nt, Pseudomonas putida KT2440
cccggcugaaaccgcg

SEQ ID NO: 3568319 - RNA, 12 nt, Pseudomonas putida KT2440
cccggcuucaca

SEQ ID NO: 3568320 - RNA, 20 nt, Pseudomonas putida KT2440
cccggcuuucucaagccugc

SEQ ID NO: 3568321 - RNA, 15 nt, Pseudomonas putida KT2440
cccgggaacagcagc

SEQ ID NO: 3568322 - RNA, 14 nt, Pseudomonas putida KT2440
cccgggaacggcug

SEQ ID NO: 3568323 - RNA, 20 nt, Pseudomonas putida KT2440
cccgggaucaccgcaagcug

SEQ ID NO: 3568324 - RNA, 18 nt, Pseudomonas putida KT2440
cccgggaucuggccgaug

SEQ ID NO: 3568325 - RNA, 12 nt, Pseudomonas putida KT2440
cccgggcagccg

SEQ ID NO: 3568326 - RNA, 19 nt, Pseudomonas putida KT2440
cccgggcagcgggcucgcc

SEQ ID NO: 3568327 - RNA, 22 nt, Pseudomonas putida KT2440
cccgggcagcgggcucgcccac

SEQ ID NO: 3568328 - RNA, 13 nt, Pseudomonas putida KT2440
cccgggcagguuc

SEQ ID NO: 3568329 - RNA, 15 nt, Pseudomonas putida KT2440
cccgggccgcuugcu

SEQ ID NO: 3568330 - RNA, 20 nt, Pseudomonas putida KT2440
cccgggcgcaggggucuuug

SEQ ID NO: 3568331 - RNA, 21 nt, Pseudomonas putida KT2440
cccggggaucuugcuggccgg

SEQ ID NO: 3568332 - RNA, 18 nt, Pseudomonas putida KT2440
cccggggcguggaagugc

SEQ ID NO: 3568333 - RNA, 17 nt, Pseudomonas putida KT2440
cccgggguaaccgccug

SEQ ID NO: 3568334 - RNA, 18 nt, Pseudomonas putida KT2440
cccgggugcagccgcacc

SEQ ID NO: 3568335 - RNA, 17 nt, Pseudomonas putida KT2440
cccggguuucggugcgc

SEQ ID NO: 3568336 - RNA, 19 nt, Pseudomonas putida KT2440
cccgguaacgggccagccg

SEQ ID NO: 3568337 - RNA, 23 nt, Pseudomonas putida KT2440
cccgguaacgggccagccgcgcc

SEQ ID NO: 3568338 - RNA, 16 nt, Pseudomonas putida KT2440
cccgguaccagcaggc

SEQ ID NO: 3568339 - RNA, 18 nt, Pseudomonas putida KT2440
cccgguacgacgcaccag

SEQ ID NO: 3568340 - RNA, 14 nt, Pseudomonas putida KT2440
cccgguacgguacg

SEQ ID NO: 3568341 - RNA, 19 nt, Pseudomonas putida KT2440
cccgguacgguacgugcac

SEQ ID NO: 3568342 - RNA, 23 nt, Pseudomonas putida KT2440
cccgguacgguacgugcacggcc

SEQ ID NO: 3568343 - RNA, 13 nt, Pseudomonas putida KT2440
cccggucaacgcu

SEQ ID NO: 3568344 - RNA, 20 nt, Pseudomonas putida KT2440
cccggucagcauggccaguu

SEQ ID NO: 3568345 - RNA, 11 nt, Pseudomonas putida KT2440
cccggucccgc

SEQ ID NO: 3568346 - RNA, 16 nt, Pseudomonas putida KT2440
cccggucccgcugccg

SEQ ID NO: 3568347 - RNA, 17 nt, Pseudomonas putida KT2440
cccggucggccagcugc

SEQ ID NO: 3568348 - RNA, 20 nt, Pseudomonas putida KT2440
cccggucggccagcugcugc

SEQ ID NO: 3568349 - RNA, 21 nt, Pseudomonas putida KT2440
cccggucggccagcugcugcg

SEQ ID NO: 3568350 - RNA, 13 nt, Pseudomonas putida KT2440
cccggugcaagcc

SEQ ID NO: 3568351 - RNA, 16 nt, Pseudomonas putida KT2440
cccggugccggccaau

SEQ ID NO: 3568352 - RNA, 20 nt, Pseudomonas putida KT2440
cccgguggcgcggccgggcu

SEQ ID NO: 3568353 - RNA, 16 nt, Pseudomonas putida KT2440
cccgguucgccacggu

SEQ ID NO: 3568354 - RNA, 21 nt, Pseudomonas putida KT2440
cccgguugccauaucggcuug

SEQ ID NO: 3568355 - RNA, 14 nt, Pseudomonas putida KT2440
cccguaacggucac

SEQ ID NO: 3568356 - RNA, 17 nt, Pseudomonas putida KT2440
cccguacagaccgccgg

SEQ ID NO: 3568357 - RNA, 17 nt, Pseudomonas putida KT2440
cccguaggagcggguuu

SEQ ID NO: 3568358 - RNA, 16 nt, Pseudomonas putida KT2440
cccguaugcauccgcc

SEQ ID NO: 3568359 - RNA, 19 nt, Pseudomonas putida KT2440
cccgucagugcucggcaac

SEQ ID NO: 3568360 - RNA, 13 nt, Pseudomonas putida KT2440
cccguccacagcg

SEQ ID NO: 3568361 - RNA, 12 nt, Pseudomonas putida KT2440
cccguccagccc

SEQ ID NO: 3568362 - RNA, 16 nt, Pseudomonas putida KT2440
cccguccagccccaag

SEQ ID NO: 3568363 - RNA, 21 nt, Pseudomonas putida KT2440
cccgucugcgugcacccaacc

SEQ ID NO: 3568364 - RNA, 17 nt, Pseudomonas putida KT2440
cccgugcaggggucugu

SEQ ID NO: 3568365 - RNA, 19 nt, Pseudomonas putida KT2440
cccgugcaggggucugugc

SEQ ID NO: 3568366 - RNA, 16 nt, Pseudomonas putida KT2440
cccgugcaucugcucc

SEQ ID NO: 3568367 - RNA, 21 nt, Pseudomonas putida KT2440
cccgugcaucugcucccccag

SEQ ID NO: 3568368 - RNA, 17 nt, Pseudomonas putida KT2440
cccgugccauccaccgc

SEQ ID NO: 3568369 - RNA, 14 nt, Pseudomonas putida KT2440
cccgugcccggcau

SEQ ID NO: 3568370 - RNA, 17 nt, Pseudomonas putida KT2440
cccgugccgcaucagcc

SEQ ID NO: 3568371 - RNA, 16 nt, Pseudomonas putida KT2440
cccgugccugccugca

SEQ ID NO: 3568372 - RNA, 18 nt, Pseudomonas putida KT2440
cccgugcucacgcacgau

SEQ ID NO: 3568373 - RNA, 12 nt, Pseudomonas putida KT2440
cccgugcugcuc

SEQ ID NO: 3568374 - RNA, 16 nt, Pseudomonas putida KT2440
cccgugcugucgguga

SEQ ID NO: 3568375 - RNA, 12 nt, Pseudomonas putida KT2440
cccgugguacac

SEQ ID NO: 3568376 - RNA, 14 nt, Pseudomonas putida KT2440
cccgugguuggagc

SEQ ID NO: 3568377 - RNA, 21 nt, Pseudomonas putida KT2440
cccguguacgacugccgcccu

SEQ ID NO: 3568378 - RNA, 23 nt, Pseudomonas putida KT2440
cccguucaggucauugucaucca

SEQ ID NO: 3568379 - RNA, 22 nt, Pseudomonas putida KT2440
cccguucuggccuuggcgugca

SEQ ID NO: 3568380 - RNA, 20 nt, Pseudomonas putida KT2440
cccguugaggguggcaaugc

SEQ ID NO: 3568381 - RNA, 20 nt, Pseudomonas putida KT2440
cccuacagccuuggguaacc

SEQ ID NO: 3568382 - RNA, 21 nt, Pseudomonas putida KT2440
cccuauacacaugcacaggcc

SEQ ID NO: 3568383 - RNA, 19 nt, Pseudomonas putida KT2440
cccuaucagggcugcgaca

SEQ ID NO: 3568384 - RNA, 16 nt, Pseudomonas putida KT2440
cccuaucucuccgcca

SEQ ID NO: 3568385 - RNA, 20 nt, Pseudomonas putida KT2440
cccuaugcgugaaacgcagc

SEQ ID NO: 3568386 - RNA, 22 nt, Pseudomonas putida KT2440
cccuauggggugagcggcuuuu

SEQ ID NO: 3568387 - RNA, 17 nt, Pseudomonas putida KT2440
cccucaacccucgccca

SEQ ID NO: 3568388 - RNA, 18 nt, Pseudomonas putida KT2440
cccucaacccucgcccag

SEQ ID NO: 3568389 - RNA, 16 nt, Pseudomonas putida KT2440
cccucaagggauuggc

SEQ ID NO: 3568390 - RNA, 17 nt, Pseudomonas putida KT2440
cccucaagggcgcugau

SEQ ID NO: 3568391 - RNA, 17 nt, Pseudomonas putida KT2440
cccucaccaacugccug

SEQ ID NO: 3568392 - RNA, 11 nt, Pseudomonas putida KT2440
cccucacccac

SEQ ID NO: 3568393 - RNA, 15 nt, Pseudomonas putida KT2440
cccucacgcgccagg

SEQ ID NO: 3568394 - RNA, 22 nt, Pseudomonas putida KT2440
cccucacgcgccaggucggaca

SEQ ID NO: 3568395 - RNA, 14 nt, Pseudomonas putida KT2440
cccucacucaccgc

SEQ ID NO: 3568396 - RNA, 15 nt, Pseudomonas putida KT2440
cccucagcccaguac

SEQ ID NO: 3568397 - RNA, 21 nt, Pseudomonas putida KT2440
cccucauucgcccgcaccgcc

SEQ ID NO: 3568398 - RNA, 16 nt, Pseudomonas putida KT2440
cccuccacccaccuug

SEQ ID NO: 3568399 - RNA, 19 nt, Pseudomonas putida KT2440
cccuccacccaccuuggcc

SEQ ID NO: 3568400 - RNA, 14 nt, Pseudomonas putida KT2440
cccuccacccgguc

SEQ ID NO: 3568401 - RNA, 12 nt, Pseudomonas putida KT2440
cccuccggcccc

SEQ ID NO: 3568402 - RNA, 13 nt, Pseudomonas putida KT2440
cccuccggccccg

SEQ ID NO: 3568403 - RNA, 12 nt, Pseudomonas putida KT2440
cccuccuaaggg

SEQ ID NO: 3568404 - RNA, 13 nt, Pseudomonas putida KT2440
cccuccuccagca

SEQ ID NO: 3568405 - RNA, 21 nt, Pseudomonas putida KT2440
cccuccugaacgaugcccggg

SEQ ID NO: 3568406 - RNA, 14 nt, Pseudomonas putida KT2440
cccuccuucaggua

SEQ ID NO: 3568407 - RNA, 20 nt, Pseudomonas putida KT2440
cccucgaacagcgccggcag

SEQ ID NO: 3568408 - RNA, 14 nt, Pseudomonas putida KT2440
cccucgaccacgca

SEQ ID NO: 3568409 - RNA, 22 nt, Pseudomonas putida KT2440
cccucgacgacacggcugccga

SEQ ID NO: 3568410 - RNA, 21 nt, Pseudomonas putida KT2440
cccucgcccagaaucucaacc

SEQ ID NO: 3568411 - RNA, 22 nt, Pseudomonas putida KT2440
cccucgcccagaaucucaacca

SEQ ID NO: 3568412 - RNA, 21 nt, Pseudomonas putida KT2440
cccucgcggcggcuaagcgcc

SEQ ID NO: 3568413 - RNA, 15 nt, Pseudomonas putida KT2440
cccucgcugcccaac

SEQ ID NO: 3568414 - RNA, 16 nt, Pseudomonas putida KT2440
cccucggcaaucugca

SEQ ID NO: 3568415 - RNA, 21 nt, Pseudomonas putida KT2440
cccucggcaaucugcagcagc

SEQ ID NO: 3568416 - RNA, 23 nt, Pseudomonas putida KT2440
cccucggcaaucugcagcagcau

SEQ ID NO: 3568417 - RNA, 16 nt, Pseudomonas putida KT2440
cccucggccaccuggc

SEQ ID NO: 3568418 - RNA, 20 nt, Pseudomonas putida KT2440
cccucggccggggccaggcg

SEQ ID NO: 3568419 - RNA, 13 nt, Pseudomonas putida KT2440
cccucgggacugu

SEQ ID NO: 3568420 - RNA, 18 nt, Pseudomonas putida KT2440
cccucgguuucucacccc

SEQ ID NO: 3568421 - RNA, 22 nt, Pseudomonas putida KT2440
cccucgguuucucaccccgugu

SEQ ID NO: 3568422 - RNA, 19 nt, Pseudomonas putida KT2440
cccucguaacgagccuugg

SEQ ID NO: 3568423 - RNA, 13 nt, Pseudomonas putida KT2440
cccucguaggagc

SEQ ID NO: 3568424 - RNA, 19 nt, Pseudomonas putida KT2440
cccucguaggagcggguuc

SEQ ID NO: 3568425 - RNA, 19 nt, Pseudomonas putida KT2440
cccucguucgcgggcacgc

SEQ ID NO: 3568426 - RNA, 20 nt, Pseudomonas putida KT2440
cccucguucgcgggcacgcc

SEQ ID NO: 3568427 - RNA, 20 nt, Pseudomonas putida KT2440
cccucucgaauccccuuaua

SEQ ID NO: 3568428 - RNA, 17 nt, Pseudomonas putida KT2440
cccucugcgugguaugc

SEQ ID NO: 3568429 - RNA, 24 nt, Pseudomonas putida KT2440
cccucuuccgcacgggucaccuca

SEQ ID NO: 3568430 - RNA, 20 nt, Pseudomonas putida KT2440
cccucuucgcgggcacgccc

SEQ ID NO: 3568431 - RNA, 18 nt, Pseudomonas putida KT2440
cccugaacagggccaggu

SEQ ID NO: 3568432 - RNA, 14 nt, Pseudomonas putida KT2440
cccugaaggccgcu

SEQ ID NO: 3568433 - RNA, 20 nt, Pseudomonas putida KT2440
cccugaaggccgcuccugcg

SEQ ID NO: 3568434 - RNA, 22 nt, Pseudomonas putida KT2440
cccugacucgaccgccgcacag

SEQ ID NO: 3568435 - RNA, 17 nt, Pseudomonas putida KT2440
cccugagggagcgggcu

SEQ ID NO: 3568436 - RNA, 16 nt, Pseudomonas putida KT2440
cccugagucuggcgcc

SEQ ID NO: 3568437 - RNA, 15 nt, Pseudomonas putida KT2440
cccugauaggacugc

SEQ ID NO: 3568438 - RNA, 22 nt, Pseudomonas putida KT2440
cccugauaggacugcuucaggc

SEQ ID NO: 3568439 - RNA, 15 nt, Pseudomonas putida KT2440
cccugaucauccaca

SEQ ID NO: 3568440 - RNA, 20 nt, Pseudomonas putida KT2440
cccugaucgaugagcgagcc

SEQ ID NO: 3568441 - RNA, 23 nt, Pseudomonas putida KT2440
cccugaucgaugagcgagcccgc

SEQ ID NO: 3568442 - RNA, 19 nt, Pseudomonas putida KT2440
cccugaucgccuccaggcg

SEQ ID NO: 3568443 - RNA, 21 nt, Pseudomonas putida KT2440
cccugaugcagcagugccagc

SEQ ID NO: 3568444 - RNA, 23 nt, Pseudomonas putida KT2440
cccugaugcagcagugccagcaa

SEQ ID NO: 3568445 - RNA, 20 nt, Pseudomonas putida KT2440
cccugcaacagggcgcuugc

SEQ ID NO: 3568446 - RNA, 17 nt, Pseudomonas putida KT2440
cccugcaaggccagcgg

SEQ ID NO: 3568447 - RNA, 14 nt, Pseudomonas putida KT2440
cccugcaccacggc

SEQ ID NO: 3568448 - RNA, 15 nt, Pseudomonas putida KT2440
cccugcagagcucag

SEQ ID NO: 3568449 - RNA, 17 nt, Pseudomonas putida KT2440
cccugcagagcucagcg

SEQ ID NO: 3568450 - RNA, 18 nt, Pseudomonas putida KT2440
cccugcagcuucccggcc

SEQ ID NO: 3568451 - RNA, 20 nt, Pseudomonas putida KT2440
cccugcagcuucccggccug

SEQ ID NO: 3568452 - RNA, 21 nt, Pseudomonas putida KT2440
cccugcauggcauucgccacu

SEQ ID NO: 3568453 - RNA, 15 nt, Pseudomonas putida KT2440
cccugccagcaccag

SEQ ID NO: 3568454 - RNA, 14 nt, Pseudomonas putida KT2440
cccugcccgaucgc

SEQ ID NO: 3568455 - RNA, 22 nt, Pseudomonas putida KT2440
cccugcccucgacaaucgccag

SEQ ID NO: 3568456 - RNA, 21 nt, Pseudomonas putida KT2440
cccugccggccucaauuccag

SEQ ID NO: 3568457 - RNA, 17 nt, Pseudomonas putida KT2440
cccugccucagcucuuc

SEQ ID NO: 3568458 - RNA, 20 nt, Pseudomonas putida KT2440
cccugccuuagaacagaucc

SEQ ID NO: 3568459 - RNA, 22 nt, Pseudomonas putida KT2440
cccugcgccaaaaccuguucca

SEQ ID NO: 3568460 - RNA, 13 nt, Pseudomonas putida KT2440
cccugcgccgcca

SEQ ID NO: 3568461 - RNA, 14 nt, Pseudomonas putida KT2440
cccugcgccgccac

SEQ ID NO: 3568462 - RNA, 15 nt, Pseudomonas putida KT2440
cccugcgccgccacc

SEQ ID NO: 3568463 - RNA, 11 nt, Pseudomonas putida KT2440
cccugcggcug

SEQ ID NO: 3568464 - RNA, 18 nt, Pseudomonas putida KT2440
cccugcgggagcgggcgu

SEQ ID NO: 3568465 - RNA, 16 nt, Pseudomonas putida KT2440
cccugcgucuugcgca

SEQ ID NO: 3568466 - RNA, 14 nt, Pseudomonas putida KT2440
cccugcucauccag

SEQ ID NO: 3568467 - RNA, 18 nt, Pseudomonas putida KT2440
cccugcucguccaucacc

SEQ ID NO: 3568468 - RNA, 21 nt, Pseudomonas putida KT2440
cccugcucguccaucaccgcc

SEQ ID NO: 3568469 - RNA, 22 nt, Pseudomonas putida KT2440
cccugcucguccaucaccgcca

SEQ ID NO: 3568470 - RNA, 22 nt, Pseudomonas putida KT2440
cccugcucuucgauccgcgcca

SEQ ID NO: 3568471 - RNA, 23 nt, Pseudomonas putida KT2440
cccugcucuucgauccgcgccau

SEQ ID NO: 3568472 - RNA, 18 nt, Pseudomonas putida KT2440
cccugcugcuggcacgcc

SEQ ID NO: 3568473 - RNA, 19 nt, Pseudomonas putida KT2440
cccugcugcuggcacgccu

SEQ ID NO: 3568474 - RNA, 19 nt, Pseudomonas putida KT2440
cccugcuggccaaucucca

SEQ ID NO: 3568475 - RNA, 14 nt, Pseudomonas putida KT2440
cccuggaaacccuu

SEQ ID NO: 3568476 - RNA, 19 nt, Pseudomonas putida KT2440
cccuggaaccccauccaca

SEQ ID NO: 3568477 - RNA, 17 nt, Pseudomonas putida KT2440
cccuggacaaucucggc

SEQ ID NO: 3568478 - RNA, 13 nt, Pseudomonas putida KT2440
cccuggaugacac

SEQ ID NO: 3568479 - RNA, 17 nt, Pseudomonas putida KT2440
cccuggcaugcugaugc

SEQ ID NO: 3568480 - RNA, 12 nt, Pseudomonas putida KT2440
cccuggcccgcc

SEQ ID NO: 3568481 - RNA, 16 nt, Pseudomonas putida KT2440
cccuggcccgccgcca

SEQ ID NO: 3568482 - RNA, 22 nt, Pseudomonas putida KT2440
cccuggcgguugaccagggcgu

SEQ ID NO: 3568483 - RNA, 13 nt, Pseudomonas putida KT2440
cccugggcgagca

SEQ ID NO: 3568484 - RNA, 12 nt, Pseudomonas putida KT2440
cccuggguuuau

SEQ ID NO: 3568485 - RNA, 22 nt, Pseudomonas putida KT2440
cccuggguuuuuuuaugggcag

SEQ ID NO: 3568486 - RNA, 22 nt, Pseudomonas putida KT2440
cccuguagauaggcuguuggcg

SEQ ID NO: 3568487 - RNA, 17 nt, Pseudomonas putida KT2440
cccuguaggagcgggcu

SEQ ID NO: 3568488 - RNA, 19 nt, Pseudomonas putida KT2440
cccuguaggagcggguuua

SEQ ID NO: 3568489 - RNA, 16 nt, Pseudomonas putida KT2440
cccuguaggaucgggu

SEQ ID NO: 3568490 - RNA, 19 nt, Pseudomonas putida KT2440
cccugucgaucacgggcaa

SEQ ID NO: 3568491 - RNA, 15 nt, Pseudomonas putida KT2440
cccugugccgggguu

SEQ ID NO: 3568492 - RNA, 17 nt, Pseudomonas putida KT2440
cccugugggagcgggcu

SEQ ID NO: 3568493 - RNA, 22 nt, Pseudomonas putida KT2440
cccugugggagcgggcuugccc

SEQ ID NO: 3568494 - RNA, 14 nt, Pseudomonas putida KT2440
cccuguucccucaa

SEQ ID NO: 3568495 - RNA, 15 nt, Pseudomonas putida KT2440
cccuguuucuucaag

SEQ ID NO: 3568496 - RNA, 18 nt, Pseudomonas putida KT2440
cccuucacuguggucauc

SEQ ID NO: 3568497 - RNA, 12 nt, Pseudomonas putida KT2440
cccuucaggccc

SEQ ID NO: 3568498 - RNA, 16 nt, Pseudomonas putida KT2440
cccuucauacagcgcc

SEQ ID NO: 3568499 - RNA, 20 nt, Pseudomonas putida KT2440
cccuucauacagcgccucca

SEQ ID NO: 3568500 - RNA, 22 nt, Pseudomonas putida KT2440
cccuucauacagcgccuccagc

SEQ ID NO: 3568501 - RNA, 17 nt, Pseudomonas putida KT2440
cccuucauccgcggcau

SEQ ID NO: 3568502 - RNA, 23 nt, Pseudomonas putida KT2440
cccuucaucgccggguccaccag

SEQ ID NO: 3568503 - RNA, 20 nt, Pseudomonas putida KT2440
cccuucaugcgcccuggcgg

SEQ ID NO: 3568504 - RNA, 17 nt, Pseudomonas putida KT2440
cccuuccccccuggccu

SEQ ID NO: 3568505 - RNA, 14 nt, Pseudomonas putida KT2440
cccuuccgcgugcc

SEQ ID NO: 3568506 - RNA, 18 nt, Pseudomonas putida KT2440
cccuuccgcgugcccccc

SEQ ID NO: 3568507 - RNA, 13 nt, Pseudomonas putida KT2440
cccuucgacgcuc

SEQ ID NO: 3568508 - RNA, 18 nt, Pseudomonas putida KT2440
cccuucgacuucccgcaa

SEQ ID NO: 3568509 - RNA, 14 nt, Pseudomonas putida KT2440
cccuucgcaggcac

SEQ ID NO: 3568510 - RNA, 20 nt, Pseudomonas putida KT2440
cccuucgcaggcacgcccgc

SEQ ID NO: 3568511 - RNA, 17 nt, Pseudomonas putida KT2440
cccuucgccggcacgcc

SEQ ID NO: 3568512 - RNA, 20 nt, Pseudomonas putida KT2440
cccuucgccggcacgcccgc

SEQ ID NO: 3568513 - RNA, 20 nt, Pseudomonas putida KT2440
cccuucgcggaagcucucca

SEQ ID NO: 3568514 - RNA, 22 nt, Pseudomonas putida KT2440
cccuucgcggaagcucuccagg

SEQ ID NO: 3568515 - RNA, 22 nt, Pseudomonas putida KT2440
cccuucggaaacaguuucuuca

SEQ ID NO: 3568516 - RNA, 19 nt, Pseudomonas putida KT2440
cccuucggcaaucaccgcc

SEQ ID NO: 3568517 - RNA, 20 nt, Pseudomonas putida KT2440
cccuucggcaaucaccgcca

SEQ ID NO: 3568518 - RNA, 16 nt, Pseudomonas putida KT2440
cccuucggccagcagu

SEQ ID NO: 3568519 - RNA, 18 nt, Pseudomonas putida KT2440
cccuucggccagcaguuc

SEQ ID NO: 3568520 - RNA, 21 nt, Pseudomonas putida KT2440
cccuucggccagcaguucguc

SEQ ID NO: 3568521 - RNA, 22 nt, Pseudomonas putida KT2440
cccuucgucgauguccagcgag

SEQ ID NO: 3568522 - RNA, 12 nt, Pseudomonas putida KT2440
cccuucugcugc

SEQ ID NO: 3568523 - RNA, 13 nt, Pseudomonas putida KT2440
cccuucugcugcu

SEQ ID NO: 3568524 - RNA, 17 nt, Pseudomonas putida KT2440
cccuucuggugaaaguc

SEQ ID NO: 3568525 - RNA, 21 nt, Pseudomonas putida KT2440
cccuugaacagaccccagucg

SEQ ID NO: 3568526 - RNA, 13 nt, Pseudomonas putida KT2440
cccuugagcuuca

SEQ ID NO: 3568527 - RNA, 19 nt, Pseudomonas putida KT2440
cccuugccgccccgugccc

SEQ ID NO: 3568528 - RNA, 10 nt, Pseudomonas putida KT2440
cccuuggcca

SEQ ID NO: 3568529 - RNA, 20 nt, Pseudomonas putida KT2440
cccuuggccaccuucacccc

SEQ ID NO: 3568530 - RNA, 13 nt, Pseudomonas putida KT2440
cccuuggcgacgu

SEQ ID NO: 3568531 - RNA, 23 nt, Pseudomonas putida KT2440
cccuuggcgguuuucgcaacgcu

SEQ ID NO: 3568532 - RNA, 23 nt, Pseudomonas putida KT2440
cccuugggcgugcgcugcauggc

SEQ ID NO: 3568533 - RNA, 15 nt, Pseudomonas putida KT2440
cccuugggcucagcc

SEQ ID NO: 3568534 - RNA, 16 nt, Pseudomonas putida KT2440
cccuugggcucagccg

SEQ ID NO: 3568535 - RNA, 21 nt, Pseudomonas putida KT2440
cccuuggucaggaucacccag

SEQ ID NO: 3568536 - RNA, 19 nt, Pseudomonas putida KT2440
cccuugguccgggucugau

SEQ ID NO: 3568537 - RNA, 15 nt, Pseudomonas putida KT2440
cccuugucagccgcc

SEQ ID NO: 3568538 - RNA, 13 nt, Pseudomonas putida KT2440
cccuuuaggcacg

SEQ ID NO: 3568539 - RNA, 20 nt, Pseudomonas putida KT2440
cccuuucgcgggagacccgu

SEQ ID NO: 3568540 - RNA, 19 nt, Pseudomonas putida KT2440
cccuuucgcggguaaaccc

SEQ ID NO: 3568541 - RNA, 23 nt, Pseudomonas putida KT2440
cccuuugcgggugagcaugccga

SEQ ID NO: 3568542 - RNA, 14 nt, Pseudomonas putida KT2440
cccuuugguacugc

SEQ ID NO: 3568543 - RNA, 17 nt, Pseudomonas putida KT2440
cccuuugguacugcgcc

SEQ ID NO: 3568544 - RNA, 20 nt, Pseudomonas putida KT2440
cccuuuguuuuuaucaggug

SEQ ID NO: 3568545 - RNA, 18 nt, Pseudomonas putida KT2440
cccuuuucuacauggugg

SEQ ID NO: 3568546 - RNA, 20 nt, Pseudomonas putida KT2440
cccuuuuuuugugccggacu

SEQ ID NO: 3568547 - RNA, 14 nt, Pseudomonas putida KT2440
ccgaaaccacugcu

SEQ ID NO: 3568548 - RNA, 15 nt, Pseudomonas putida KT2440
ccgaaaccagccccu

SEQ ID NO: 3568549 - RNA, 15 nt, Pseudomonas putida KT2440
ccgaaaccgccagcc

SEQ ID NO: 3568550 - RNA, 15 nt, Pseudomonas putida KT2440
ccgaaacgcgacagg

SEQ ID NO: 3568551 - RNA, 19 nt, Pseudomonas putida KT2440
ccgaaacguagucgaccag

SEQ ID NO: 3568552 - RNA, 22 nt, Pseudomonas putida KT2440
ccgaaacugcgcucaaccagcc

SEQ ID NO: 3568553 - RNA, 15 nt, Pseudomonas putida KT2440
ccgaaaggugcagca

SEQ ID NO: 3568554 - RNA, 19 nt, Pseudomonas putida KT2440
ccgaaauaugcagugcccg

SEQ ID NO: 3568555 - RNA, 19 nt, Pseudomonas putida KT2440
ccgaaaucagcaacgccac

SEQ ID NO: 3568556 - RNA, 16 nt, Pseudomonas putida KT2440
ccgaacaccgccagcc

SEQ ID NO: 3568557 - RNA, 15 nt, Pseudomonas putida KT2440
ccgaacagcaccgcc

SEQ ID NO: 3568558 - RNA, 17 nt, Pseudomonas putida KT2440
ccgaacagcaccgccau

SEQ ID NO: 3568559 - RNA, 23 nt, Pseudomonas putida KT2440
ccgaacagcaccgccauggccag

SEQ ID NO: 3568560 - RNA, 13 nt, Pseudomonas putida KT2440
ccgaacagcaggc

SEQ ID NO: 3568561 - RNA, 20 nt, Pseudomonas putida KT2440
ccgaacaggccggcugcagu

SEQ ID NO: 3568562 - RNA, 22 nt, Pseudomonas putida KT2440
ccgaacagucauccagaaagcg

SEQ ID NO: 3568563 - RNA, 18 nt, Pseudomonas putida KT2440
ccgaaccaccgaugccug

SEQ ID NO: 3568564 - RNA, 13 nt, Pseudomonas putida KT2440
ccgaaccauucaa

SEQ ID NO: 3568565 - RNA, 21 nt, Pseudomonas putida KT2440
ccgaacccgcuggcgaucagg

SEQ ID NO: 3568566 - RNA, 23 nt, Pseudomonas putida KT2440
ccgaacccgcuggcgaucaggca

SEQ ID NO: 3568567 - RNA, 17 nt, Pseudomonas putida KT2440
ccgaaccggcgaucagg

SEQ ID NO: 3568568 - RNA, 21 nt, Pseudomonas putida KT2440
ccgaaccggcgaucagggugu

SEQ ID NO: 3568569 - RNA, 23 nt, Pseudomonas putida KT2440
ccgaaccuugcuugaccuuguca

SEQ ID NO: 3568570 - RNA, 13 nt, Pseudomonas putida KT2440
ccgaacgacacgg

SEQ ID NO: 3568571 - RNA, 15 nt, Pseudomonas putida KT2440
ccgaacgcagcgccg

SEQ ID NO: 3568572 - RNA, 21 nt, Pseudomonas putida KT2440
ccgaacuccccaccaggcaau

SEQ ID NO: 3568573 - RNA, 19 nt, Pseudomonas putida KT2440
ccgaacuggccggucuguu

SEQ ID NO: 3568574 - RNA, 17 nt, Pseudomonas putida KT2440
ccgaacuucccccuccc

SEQ ID NO: 3568575 - RNA, 20 nt, Pseudomonas putida KT2440
ccgaagcaccacuggaugac

SEQ ID NO: 3568576 - RNA, 18 nt, Pseudomonas putida KT2440
ccgaagcuaucgccagca

SEQ ID NO: 3568577 - RNA, 23 nt, Pseudomonas putida KT2440
ccgaagcuugcagucaccuggcc

SEQ ID NO: 3568578 - RNA, 15 nt, Pseudomonas putida KT2440
ccgaaggccgccggc

SEQ ID NO: 3568579 - RNA, 18 nt, Pseudomonas putida KT2440
ccgaaggccuucauggug

SEQ ID NO: 3568580 - RNA, 18 nt, Pseudomonas putida KT2440
ccgaaggcgcuggcgaga

SEQ ID NO: 3568581 - RNA, 14 nt, Pseudomonas putida KT2440
ccgaagggcagggc

SEQ ID NO: 3568582 - RNA, 22 nt, Pseudomonas putida KT2440
ccgaaggggcggguggaggugc

SEQ ID NO: 3568583 - RNA, 15 nt, Pseudomonas putida KT2440
ccgaauccagguuga

SEQ ID NO: 3568584 - RNA, 11 nt, Pseudomonas putida KT2440
ccgacaaaaac

SEQ ID NO: 3568585 - RNA, 13 nt, Pseudomonas putida KT2440
ccgacaaaaacaa

SEQ ID NO: 3568586 - RNA, 17 nt, Pseudomonas putida KT2440
ccgacaaaaacaacaau

SEQ ID NO: 3568587 - RNA, 18 nt, Pseudomonas putida KT2440
ccgacaaaaacaacaaua

SEQ ID NO: 3568588 - RNA, 19 nt, Pseudomonas putida KT2440
ccgacaaaacugagcaaga

SEQ ID NO: 3568589 - RNA, 17 nt, Pseudomonas putida KT2440
ccgacaaagaagcgccg

SEQ ID NO: 3568590 - RNA, 18 nt, Pseudomonas putida KT2440
ccgacaacagcaugcuca

SEQ ID NO: 3568591 - RNA, 12 nt, Pseudomonas putida KT2440
ccgacaacagcu

SEQ ID NO: 3568592 - RNA, 19 nt, Pseudomonas putida KT2440
ccgacaacgguguggccag

SEQ ID NO: 3568593 - RNA, 16 nt, Pseudomonas putida KT2440
ccgacaagccacgcac

SEQ ID NO: 3568594 - RNA, 18 nt, Pseudomonas putida KT2440
ccgacaagccacguucug

SEQ ID NO: 3568595 - RNA, 18 nt, Pseudomonas putida KT2440
ccgacaagggcuacgaaa

SEQ ID NO: 3568596 - RNA, 14 nt, Pseudomonas putida KT2440
ccgacaaguucauu

SEQ ID NO: 3568597 - RNA, 13 nt, Pseudomonas putida KT2440
ccgacaaugccag

SEQ ID NO: 3568598 - RNA, 12 nt, Pseudomonas putida KT2440
ccgacagcaacg

SEQ ID NO: 3568599 - RNA, 17 nt, Pseudomonas putida KT2440
ccgacagcuugcccagc

SEQ ID NO: 3568600 - RNA, 20 nt, Pseudomonas putida KT2440
ccgacaggccgugaaccauc

SEQ ID NO: 3568601 - RNA, 23 nt, Pseudomonas putida KT2440
ccgacaggcuguguggccggcca

SEQ ID NO: 3568602 - RNA, 17 nt, Pseudomonas putida KT2440
ccgacaguguugccggc

SEQ ID NO: 3568603 - RNA, 21 nt, Pseudomonas putida KT2440
ccgacaguucgaaaccacccu

SEQ ID NO: 3568604 - RNA, 19 nt, Pseudomonas putida KT2440
ccgacaucgaagcagugcu

SEQ ID NO: 3568605 - RNA, 19 nt, Pseudomonas putida KT2440
ccgacauugaucggcgucg

SEQ ID NO: 3568606 - RNA, 12 nt, Pseudomonas putida KT2440
ccgaccaaauga

SEQ ID NO: 3568607 - RNA, 14 nt, Pseudomonas putida KT2440
ccgaccaaggccaa

SEQ ID NO: 3568608 - RNA, 15 nt, Pseudomonas putida KT2440
ccgaccaccgccucg

SEQ ID NO: 3568609 - RNA, 23 nt, Pseudomonas putida KT2440
ccgaccacuucgaugguguucug

SEQ ID NO: 3568610 - RNA, 13 nt, Pseudomonas putida KT2440
ccgaccaucggca

SEQ ID NO: 3568611 - RNA, 21 nt, Pseudomonas putida KT2440
ccgacccacaggcacaggccc

SEQ ID NO: 3568612 - RNA, 11 nt, Pseudomonas putida KT2440
ccgacccggcc

SEQ ID NO: 3568613 - RNA, 12 nt, Pseudomonas putida KT2440
ccgacccugcug

SEQ ID NO: 3568614 - RNA, 14 nt, Pseudomonas putida KT2440
ccgacccugcugcu

SEQ ID NO: 3568615 - RNA, 22 nt, Pseudomonas putida KT2440
ccgaccgcaccggccaccgugg

SEQ ID NO: 3568616 - RNA, 14 nt, Pseudomonas putida KT2440
ccgaccgccagccc

SEQ ID NO: 3568617 - RNA, 22 nt, Pseudomonas putida KT2440
ccgaccgguggccugagccggu

SEQ ID NO: 3568618 - RNA, 22 nt, Pseudomonas putida KT2440
ccgaccugcaacgucgccacgc

SEQ ID NO: 3568619 - RNA, 21 nt, Pseudomonas putida KT2440
ccgacgcauucgcgggugaac

SEQ ID NO: 3568620 - RNA, 22 nt, Pseudomonas putida KT2440
ccgacgcauucgcgggugaacc

SEQ ID NO: 3568621 - RNA, 17 nt, Pseudomonas putida KT2440
ccgacgcgacccgucca

SEQ ID NO: 3568622 - RNA, 16 nt, Pseudomonas putida KT2440
ccgacggauuggaaaa

SEQ ID NO: 3568623 - RNA, 14 nt, Pseudomonas putida KT2440
ccgacggcauggcc

SEQ ID NO: 3568624 - RNA, 18 nt, Pseudomonas putida KT2440
ccgacggcauggccgaag

SEQ ID NO: 3568625 - RNA, 19 nt, Pseudomonas putida KT2440
ccgacggcauggccgaagc

SEQ ID NO: 3568626 - RNA, 15 nt, Pseudomonas putida KT2440
ccgacggccaauggc

SEQ ID NO: 3568627 - RNA, 17 nt, Pseudomonas putida KT2440
ccgacggcggugauaug

SEQ ID NO: 3568628 - RNA, 12 nt, Pseudomonas putida KT2440
ccgacgugcagg

SEQ ID NO: 3568629 - RNA, 22 nt, Pseudomonas putida KT2440
ccgacuagauaaccaaccccug

SEQ ID NO: 3568630 - RNA, 23 nt, Pseudomonas putida KT2440
ccgacuagauaaccaaccccugc

SEQ ID NO: 3568631 - RNA, 19 nt, Pseudomonas putida KT2440
ccgacucauguaucggauu

SEQ ID NO: 3568632 - RNA, 14 nt, Pseudomonas putida KT2440
ccgacucgguacgc

SEQ ID NO: 3568633 - RNA, 20 nt, Pseudomonas putida KT2440
ccgacucuacugcccgcagc

SEQ ID NO: 3568634 - RNA, 17 nt, Pseudomonas putida KT2440
ccgacucuucaccagcu

SEQ ID NO: 3568635 - RNA, 13 nt, Pseudomonas putida KT2440
ccgacugacgcua

SEQ ID NO: 3568636 - RNA, 15 nt, Pseudomonas putida KT2440
ccgacuggcgcacca

SEQ ID NO: 3568637 - RNA, 16 nt, Pseudomonas putida KT2440
ccgacuggcgcaccag

SEQ ID NO: 3568638 - RNA, 20 nt, Pseudomonas putida KT2440
ccgacuuccccggcgccgcc

SEQ ID NO: 3568639 - RNA, 20 nt, Pseudomonas putida KT2440
ccgacuugauugccgacucc

SEQ ID NO: 3568640 - RNA, 15 nt, Pseudomonas putida KT2440
ccgagaacaggcggc

SEQ ID NO: 3568641 - RNA, 16 nt, Pseudomonas putida KT2440
ccgagaacaggcggcc

SEQ ID NO: 3568642 - RNA, 21 nt, Pseudomonas putida KT2440
ccgagaagcagaacaucaggu

SEQ ID NO: 3568643 - RNA, 20 nt, Pseudomonas putida KT2440
ccgagagcaguuccuucagc

SEQ ID NO: 3568644 - RNA, 14 nt, Pseudomonas putida KT2440
ccgagaggcgcugc

SEQ ID NO: 3568645 - RNA, 18 nt, Pseudomonas putida KT2440
ccgagaugaucgcggcaa

SEQ ID NO: 3568646 - RNA, 21 nt, Pseudomonas putida KT2440
ccgagcaaggcgcagccaauc

SEQ ID NO: 3568647 - RNA, 22 nt, Pseudomonas putida KT2440
ccgagcauuacaggcagaucga

SEQ ID NO: 3568648 - RNA, 23 nt, Pseudomonas putida KT2440
ccgagccaaccgcuucaccgcgc

SEQ ID NO: 3568649 - RNA, 19 nt, Pseudomonas putida KT2440
ccgagccauugacccgcuu

SEQ ID NO: 3568650 - RNA, 16 nt, Pseudomonas putida KT2440
ccgagcccccgcugcu

SEQ ID NO: 3568651 - RNA, 13 nt, Pseudomonas putida KT2440
ccgagccuuccgg

SEQ ID NO: 3568652 - RNA, 17 nt, Pseudomonas putida KT2440
ccgagcgagugaccuug

SEQ ID NO: 3568653 - RNA, 13 nt, Pseudomonas putida KT2440
ccgagcgcggcgc

SEQ ID NO: 3568654 - RNA, 19 nt, Pseudomonas putida KT2440
ccgagcgcggcgcccagca

SEQ ID NO: 3568655 - RNA, 20 nt, Pseudomonas putida KT2440
ccgagcgcggcgcccagcaa

SEQ ID NO: 3568656 - RNA, 17 nt, Pseudomonas putida KT2440
ccgagcugauccgccug

SEQ ID NO: 3568657 - RNA, 21 nt, Pseudomonas putida KT2440
ccgagcugauccgccuggccc

SEQ ID NO: 3568658 - RNA, 15 nt, Pseudomonas putida KT2440
ccgaggaacggcugg

SEQ ID NO: 3568659 - RNA, 18 nt, Pseudomonas putida KT2440
ccgaggaaguacgccggc

SEQ ID NO: 3568660 - RNA, 20 nt, Pseudomonas putida KT2440
ccgaggaaguacgccggcgc

SEQ ID NO: 3568661 - RNA, 19 nt, Pseudomonas putida KT2440
ccgaggaauugcgccagga

SEQ ID NO: 3568662 - RNA, 23 nt, Pseudomonas putida KT2440
ccgaggacauaccacacacccca

SEQ ID NO: 3568663 - RNA, 15 nt, Pseudomonas putida KT2440
ccgaggaggaggcug

SEQ ID NO: 3568664 - RNA, 15 nt, Pseudomonas putida KT2440
ccgaggccggguuuu

SEQ ID NO: 3568665 - RNA, 22 nt, Pseudomonas putida KT2440
ccgaggccggguuuuucaugaa

SEQ ID NO: 3568666 - RNA, 23 nt, Pseudomonas putida KT2440
ccgaggccggguuuuucaugaag

SEQ ID NO: 3568667 - RNA, 21 nt, Pseudomonas putida KT2440
ccgaggcgaauggcaggugau

SEQ ID NO: 3568668 - RNA, 13 nt, Pseudomonas putida KT2440
ccgaggggccgcu

SEQ ID NO: 3568669 - RNA, 19 nt, Pseudomonas putida KT2440
ccgagggugaggugcugca

SEQ ID NO: 3568670 - RNA, 14 nt, Pseudomonas putida KT2440
ccgaguaaccggcg

SEQ ID NO: 3568671 - RNA, 17 nt, Pseudomonas putida KT2440
ccgaguauccccaccac

SEQ ID NO: 3568672 - RNA, 18 nt, Pseudomonas putida KT2440
ccgagucgguggcgaagg

SEQ ID NO: 3568673 - RNA, 14 nt, Pseudomonas putida KT2440
ccgagucuccgcgc

SEQ ID NO: 3568674 - RNA, 15 nt, Pseudomonas putida KT2440
ccgagucuccgcgcu

SEQ ID NO: 3568675 - RNA, 16 nt, Pseudomonas putida KT2440
ccgagugcccgcgcag

SEQ ID NO: 3568676 - RNA, 22 nt, Pseudomonas putida KT2440
ccgaguguuucaaaaaaaaggg

SEQ ID NO: 3568677 - RNA, 21 nt, Pseudomonas putida KT2440
ccgauaaacacgaacaucagc

SEQ ID NO: 3568678 - RNA, 20 nt, Pseudomonas putida KT2440
ccgauaaagguugcccggcg

SEQ ID NO: 3568679 - RNA, 13 nt, Pseudomonas putida KT2440
ccgauacagcgcg

SEQ ID NO: 3568680 - RNA, 20 nt, Pseudomonas putida KT2440
ccgauacagcgcgccgccga

SEQ ID NO: 3568681 - RNA, 21 nt, Pseudomonas putida KT2440
ccgauacagcgcgccgccgau

SEQ ID NO: 3568682 - RNA, 18 nt, Pseudomonas putida KT2440
ccgauaccgcccacuucu

SEQ ID NO: 3568683 - RNA, 18 nt, Pseudomonas putida KT2440
ccgauagcgugaagcggc

SEQ ID NO: 3568684 - RNA, 19 nt, Pseudomonas putida KT2440
ccgaucaccugggcgauca

SEQ ID NO: 3568685 - RNA, 15 nt, Pseudomonas putida KT2440
ccgaucacucggcag

SEQ ID NO: 3568686 - RNA, 18 nt, Pseudomonas putida KT2440
ccgaucagcacgccgccg

SEQ ID NO: 3568687 - RNA, 19 nt, Pseudomonas putida KT2440
ccgaucagcggcgccaccc

SEQ ID NO: 3568688 - RNA, 20 nt, Pseudomonas putida KT2440
ccgaucagcggcgccaccca

SEQ ID NO: 3568689 - RNA, 22 nt, Pseudomonas putida KT2440
ccgaucagcuuaacgcuuggcc

SEQ ID NO: 3568690 - RNA, 22 nt, Pseudomonas putida KT2440
ccgaucaggaagccccgcgcgu

SEQ ID NO: 3568691 - RNA, 13 nt, Pseudomonas putida KT2440
ccgaucaggugca

SEQ ID NO: 3568692 - RNA, 17 nt, Pseudomonas putida KT2440
ccgaucaugaacaugcc

SEQ ID NO: 3568693 - RNA, 21 nt, Pseudomonas putida KT2440
ccgaucaugaacaugcccauu

SEQ ID NO: 3568694 - RNA, 16 nt, Pseudomonas putida KT2440
ccgaucauugcugcgg

SEQ ID NO: 3568695 - RNA, 23 nt, Pseudomonas putida KT2440
ccgaucauugcugcgguaccggc

SEQ ID NO: 3568696 - RNA, 23 nt, Pseudomonas putida KT2440
ccgauccucugugggagcggccu

SEQ ID NO: 3568697 - RNA, 20 nt, Pseudomonas putida KT2440
ccgauccuuggcgaaggcug

SEQ ID NO: 3568698 - RNA, 18 nt, Pseudomonas putida KT2440
ccgaucgaagcagcagcu

SEQ ID NO: 3568699 - RNA, 17 nt, Pseudomonas putida KT2440
ccgaucgccucgcuggc

SEQ ID NO: 3568700 - RNA, 15 nt, Pseudomonas putida KT2440
ccgaucggguacucc

SEQ ID NO: 3568701 - RNA, 15 nt, Pseudomonas putida KT2440
ccgaucuccccacca

SEQ ID NO: 3568702 - RNA, 17 nt, Pseudomonas putida KT2440
ccgaucucgauccggcc

SEQ ID NO: 3568703 - RNA, 16 nt, Pseudomonas putida KT2440
ccgaucucgccagccu

SEQ ID NO: 3568704 - RNA, 18 nt, Pseudomonas putida KT2440
ccgaucucgccagccugc

SEQ ID NO: 3568705 - RNA, 18 nt, Pseudomonas putida KT2440
ccgaugaagcaggccgag

SEQ ID NO: 3568706 - RNA, 16 nt, Pseudomonas putida KT2440
ccgaugaguugucugc

SEQ ID NO: 3568707 - RNA, 16 nt, Pseudomonas putida KT2440
ccgaugccaagcaccg

SEQ ID NO: 3568708 - RNA, 21 nt, Pseudomonas putida KT2440
ccgaugccagguacacguugg

SEQ ID NO: 3568709 - RNA, 14 nt, Pseudomonas putida KT2440
ccgaugcccaggcc

SEQ ID NO: 3568710 - RNA, 13 nt, Pseudomonas putida KT2440
ccgaugccgucga

SEQ ID NO: 3568711 - RNA, 12 nt, Pseudomonas putida KT2440
ccgaugccugug

SEQ ID NO: 3568712 - RNA, 20 nt, Pseudomonas putida KT2440
ccgaugccuuuuuuugccgc

SEQ ID NO: 3568713 - RNA, 13 nt, Pseudomonas putida KT2440
ccgaugcgcccgc

SEQ ID NO: 3568714 - RNA, 22 nt, Pseudomonas putida KT2440
ccgaugcgcuuccacuuggugg

SEQ ID NO: 3568715 - RNA, 19 nt, Pseudomonas putida KT2440
ccgaugcggugcagcaccu

SEQ ID NO: 3568716 - RNA, 18 nt, Pseudomonas putida KT2440
ccgaugcucgucagcccc

SEQ ID NO: 3568717 - RNA, 17 nt, Pseudomonas putida KT2440
ccgaugcugugccgggc

SEQ ID NO: 3568718 - RNA, 22 nt, Pseudomonas putida KT2440
ccgauggccuugaucaggcccu

SEQ ID NO: 3568719 - RNA, 13 nt, Pseudomonas putida KT2440
ccgaugggcgucg

SEQ ID NO: 3568720 - RNA, 16 nt, Pseudomonas putida KT2440
ccgauguccuugcugg

SEQ ID NO: 3568721 - RNA, 16 nt, Pseudomonas putida KT2440
ccgauguuggucacca

SEQ ID NO: 3568722 - RNA, 20 nt, Pseudomonas putida KT2440
ccgauguuguggcuguucag

SEQ ID NO: 3568723 - RNA, 21 nt, Pseudomonas putida KT2440
ccgauguuguggcuguucagg

SEQ ID NO: 3568724 - RNA, 19 nt, Pseudomonas putida KT2440
ccgauuccuugcagcgccg

SEQ ID NO: 3568725 - RNA, 20 nt, Pseudomonas putida KT2440
ccgauugccucaggccccag

SEQ ID NO: 3568726 - RNA, 15 nt, Pseudomonas putida KT2440
ccgcaaagcccugcc

SEQ ID NO: 3568727 - RNA, 17 nt, Pseudomonas putida KT2440
ccgcaaagcccugccuc

SEQ ID NO: 3568728 - RNA, 10 nt, Pseudomonas putida KT2440
ccgcaaagcg

SEQ ID NO: 3568729 - RNA, 20 nt, Pseudomonas putida KT2440
ccgcaaagcggccccagugg

SEQ ID NO: 3568730 - RNA, 18 nt, Pseudomonas putida KT2440
ccgcaaagcggcccccac

SEQ ID NO: 3568731 - RNA, 20 nt, Pseudomonas putida KT2440
ccgcaaagcggcccccagca

SEQ ID NO: 3568732 - RNA, 21 nt, Pseudomonas putida KT2440
ccgcaaagcggcccccagcaa

SEQ ID NO: 3568733 - RNA, 16 nt, Pseudomonas putida KT2440
ccgcaacaaccuggcc

SEQ ID NO: 3568734 - RNA, 22 nt, Pseudomonas putida KT2440
ccgcaacacauuauccaccagg

SEQ ID NO: 3568735 - RNA, 15 nt, Pseudomonas putida KT2440
ccgcaacaccugccg

SEQ ID NO: 3568736 - RNA, 19 nt, Pseudomonas putida KT2440
ccgcaacaccugccgcagc

SEQ ID NO: 3568737 - RNA, 22 nt, Pseudomonas putida KT2440
ccgcaacaccugccgcagcugg

SEQ ID NO: 3568738 - RNA, 17 nt, Pseudomonas putida KT2440
ccgcaacaugaagccau

SEQ ID NO: 3568739 - RNA, 19 nt, Pseudomonas putida KT2440
ccgcaacaugaagccaugg

SEQ ID NO: 3568740 - RNA, 13 nt, Pseudomonas putida KT2440
ccgcaacccagcc

SEQ ID NO: 3568741 - RNA, 14 nt, Pseudomonas putida KT2440
ccgcaacccagccc

SEQ ID NO: 3568742 - RNA, 17 nt, Pseudomonas putida KT2440
ccgcaacccagccccag

SEQ ID NO: 3568743 - RNA, 23 nt, Pseudomonas putida KT2440
ccgcaacccuuuuaucugguugc

SEQ ID NO: 3568744 - RNA, 22 nt, Pseudomonas putida KT2440
ccgcaaccgaugaacccgcgau

SEQ ID NO: 3568745 - RNA, 18 nt, Pseudomonas putida KT2440
ccgcaaccgggucggcgc

SEQ ID NO: 3568746 - RNA, 14 nt, Pseudomonas putida KT2440
ccgcaaccugggca

SEQ ID NO: 3568747 - RNA, 22 nt, Pseudomonas putida KT2440
ccgcaacgcaucguccuugcag

SEQ ID NO: 3568748 - RNA, 13 nt, Pseudomonas putida KT2440
ccgcaacggccga

SEQ ID NO: 3568749 - RNA, 20 nt, Pseudomonas putida KT2440
ccgcaacuggcccgcgccag

SEQ ID NO: 3568750 - RNA, 19 nt, Pseudomonas putida KT2440
ccgcaagcagucccagcac

SEQ ID NO: 3568751 - RNA, 16 nt, Pseudomonas putida KT2440
ccgcaagccagccucc

SEQ ID NO: 3568752 - RNA, 17 nt, Pseudomonas putida KT2440
ccgcaagccagccuccg

SEQ ID NO: 3568753 - RNA, 15 nt, Pseudomonas putida KT2440
ccgcaagcccgcguu

SEQ ID NO: 3568754 - RNA, 16 nt, Pseudomonas putida KT2440
ccgcaagcugcaccgc

SEQ ID NO: 3568755 - RNA, 13 nt, Pseudomonas putida KT2440
ccgcaaggccgcu

SEQ ID NO: 3568756 - RNA, 14 nt, Pseudomonas putida KT2440
ccgcaaggccgcuc

SEQ ID NO: 3568757 - RNA, 18 nt, Pseudomonas putida KT2440
ccgcaaggccgcucccac

SEQ ID NO: 3568758 - RNA, 13 nt, Pseudomonas putida KT2440
ccgcaaggcggcc

SEQ ID NO: 3568759 - RNA, 13 nt, Pseudomonas putida KT2440
ccgcacaaggccg

SEQ ID NO: 3568760 - RNA, 20 nt, Pseudomonas putida KT2440
ccgcacaaggccgcucccac

SEQ ID NO: 3568761 - RNA, 20 nt, Pseudomonas putida KT2440
ccgcacacagcccaaagggc

SEQ ID NO: 3568762 - RNA, 16 nt, Pseudomonas putida KT2440
ccgcacaggcauaccg

SEQ ID NO: 3568763 - RNA, 21 nt, Pseudomonas putida KT2440
ccgcacaggcauaccgcaaca

SEQ ID NO: 3568764 - RNA, 16 nt, Pseudomonas putida KT2440
ccgcacaggcuggcca

SEQ ID NO: 3568765 - RNA, 22 nt, Pseudomonas putida KT2440
ccgcacaucacggcgcaggccg

SEQ ID NO: 3568766 - RNA, 20 nt, Pseudomonas putida KT2440
ccgcaccacgggcggcucac

SEQ ID NO: 3568767 - RNA, 16 nt, Pseudomonas putida KT2440
ccgcaccagaccagca

SEQ ID NO: 3568768 - RNA, 21 nt, Pseudomonas putida KT2440
ccgcaccagaccagcagcagu

SEQ ID NO: 3568769 - RNA, 12 nt, Pseudomonas putida KT2440
ccgcacccagca

SEQ ID NO: 3568770 - RNA, 16 nt, Pseudomonas putida KT2440
ccgcacccaggccacg

SEQ ID NO: 3568771 - RNA, 15 nt, Pseudomonas putida KT2440
ccgcacccgcaagcg

SEQ ID NO: 3568772 - RNA, 13 nt, Pseudomonas putida KT2440
ccgcacccgcgau

SEQ ID NO: 3568773 - RNA, 12 nt, Pseudomonas putida KT2440
ccgcacccggcg

SEQ ID NO: 3568774 - RNA, 21 nt, Pseudomonas putida KT2440
ccgcacccggcggugacccgu

SEQ ID NO: 3568775 - RNA, 23 nt, Pseudomonas putida KT2440
ccgcacccggcuaccaaucugua

SEQ ID NO: 3568776 - RNA, 11 nt, Pseudomonas putida KT2440
ccgcaccggcc

SEQ ID NO: 3568777 - RNA, 16 nt, Pseudomonas putida KT2440
ccgcaccucacaacgc

SEQ ID NO: 3568778 - RNA, 18 nt, Pseudomonas putida KT2440
ccgcaccucacaacgcgc

SEQ ID NO: 3568779 - RNA, 16 nt, Pseudomonas putida KT2440
ccgcaccugcccgccc

SEQ ID NO: 3568780 - RNA, 17 nt, Pseudomonas putida KT2440
ccgcaccugcccgcccu

SEQ ID NO: 3568781 - RNA, 14 nt, Pseudomonas putida KT2440
ccgcacucagguga

SEQ ID NO: 3568782 - RNA, 13 nt, Pseudomonas putida KT2440
ccgcacuccccau

SEQ ID NO: 3568783 - RNA, 20 nt, Pseudomonas putida KT2440
ccgcacuccccaucagcagc

SEQ ID NO: 3568784 - RNA, 13 nt, Pseudomonas putida KT2440
ccgcacugcugcc

SEQ ID NO: 3568785 - RNA, 21 nt, Pseudomonas putida KT2440
ccgcacugugcuggggccagc

SEQ ID NO: 3568786 - RNA, 19 nt, Pseudomonas putida KT2440
ccgcacuuguugcgcaggu

SEQ ID NO: 3568787 - RNA, 22 nt, Pseudomonas putida KT2440
ccgcacuuguugcgcagguaca

SEQ ID NO: 3568788 - RNA, 13 nt, Pseudomonas putida KT2440
ccgcagagcggcc

SEQ ID NO: 3568789 - RNA, 17 nt, Pseudomonas putida KT2440
ccgcagccaugccgccg

SEQ ID NO: 3568790 - RNA, 14 nt, Pseudomonas putida KT2440
ccgcagcccagcgc

SEQ ID NO: 3568791 - RNA, 15 nt, Pseudomonas putida KT2440
ccgcagcccagcgcc

SEQ ID NO: 3568792 - RNA, 16 nt, Pseudomonas putida KT2440
ccgcagcccagcgccg

SEQ ID NO: 3568793 - RNA, 16 nt, Pseudomonas putida KT2440
ccgcagccccaccucg

SEQ ID NO: 3568794 - RNA, 21 nt, Pseudomonas putida KT2440
ccgcagccccaccucggcgau

SEQ ID NO: 3568795 - RNA, 13 nt, Pseudomonas putida KT2440
ccgcagccccagc

SEQ ID NO: 3568796 - RNA, 13 nt, Pseudomonas putida KT2440
ccgcagccccgcc

SEQ ID NO: 3568797 - RNA, 14 nt, Pseudomonas putida KT2440
ccgcagccccgccg

SEQ ID NO: 3568798 - RNA, 20 nt, Pseudomonas putida KT2440
ccgcagccucuucggccagc

SEQ ID NO: 3568799 - RNA, 21 nt, Pseudomonas putida KT2440
ccgcagccucuucggccagca

SEQ ID NO: 3568800 - RNA, 20 nt, Pseudomonas putida KT2440
ccgcagcgcuucgaucagcg

SEQ ID NO: 3568801 - RNA, 14 nt, Pseudomonas putida KT2440
ccgcagcuggcgca

SEQ ID NO: 3568802 - RNA, 17 nt, Pseudomonas putida KT2440
ccgcagcuucaacucca

SEQ ID NO: 3568803 - RNA, 20 nt, Pseudomonas putida KT2440
ccgcagcuucaacuccacca

SEQ ID NO: 3568804 - RNA, 18 nt, Pseudomonas putida KT2440
ccgcaggaauaacuggcc

SEQ ID NO: 3568805 - RNA, 17 nt, Pseudomonas putida KT2440
ccgcaggccaaugcagc

SEQ ID NO: 3568806 - RNA, 22 nt, Pseudomonas putida KT2440
ccgcaggccaaugcagcuuuga

SEQ ID NO: 3568807 - RNA, 12 nt, Pseudomonas putida KT2440
ccgcaggccgca

SEQ ID NO: 3568808 - RNA, 14 nt, Pseudomonas putida KT2440
ccgcaggccgcagc

SEQ ID NO: 3568809 - RNA, 17 nt, Pseudomonas putida KT2440
ccgcaggcgcccccugg

SEQ ID NO: 3568810 - RNA, 20 nt, Pseudomonas putida KT2440
ccgcaggcgcccccugggcg

SEQ ID NO: 3568811 - RNA, 11 nt, Pseudomonas putida KT2440
ccgcaggucac

SEQ ID NO: 3568812 - RNA, 16 nt, Pseudomonas putida KT2440
ccgcagguccaccugg

SEQ ID NO: 3568813 - RNA, 15 nt, Pseudomonas putida KT2440
ccgcaggugcaggcu

SEQ ID NO: 3568814 - RNA, 19 nt, Pseudomonas putida KT2440
ccgcagguuucagauacug

SEQ ID NO: 3568815 - RNA, 21 nt, Pseudomonas putida KT2440
ccgcaguacuuauaagcagca

SEQ ID NO: 3568816 - RNA, 16 nt, Pseudomonas putida KT2440
ccgcagucccguuggc

SEQ ID NO: 3568817 - RNA, 18 nt, Pseudomonas putida KT2440
ccgcagucccguuggccc

SEQ ID NO: 3568818 - RNA, 21 nt, Pseudomonas putida KT2440
ccgcagucccguuggcccgcc

SEQ ID NO: 3568819 - RNA, 15 nt, Pseudomonas putida KT2440
ccgcagugcacgcgg

SEQ ID NO: 3568820 - RNA, 16 nt, Pseudomonas putida KT2440
ccgcauaaccaccacc

SEQ ID NO: 3568821 - RNA, 20 nt, Pseudomonas putida KT2440
ccgcauagaaauuaagcgcc

SEQ ID NO: 3568822 - RNA, 16 nt, Pseudomonas putida KT2440
ccgcaucaucacgcgc

SEQ ID NO: 3568823 - RNA, 14 nt, Pseudomonas putida KT2440
ccgcauccagcacu

SEQ ID NO: 3568824 - RNA, 19 nt, Pseudomonas putida KT2440
ccgcauccagcacugccug

SEQ ID NO: 3568825 - RNA, 22 nt, Pseudomonas putida KT2440
ccgcaucccaauguggauaguc

SEQ ID NO: 3568826 - RNA, 15 nt, Pseudomonas putida KT2440
ccgcauccccggccu

SEQ ID NO: 3568827 - RNA, 12 nt, Pseudomonas putida KT2440
ccgcauccugcg

SEQ ID NO: 3568828 - RNA, 18 nt, Pseudomonas putida KT2440
ccgcaucguuauccagca

SEQ ID NO: 3568829 - RNA, 19 nt, Pseudomonas putida KT2440
ccgcaucguuauccagcac

SEQ ID NO: 3568830 - RNA, 20 nt, Pseudomonas putida KT2440
ccgcaugcucgcugcugccu

SEQ ID NO: 3568831 - RNA, 21 nt, Pseudomonas putida KT2440
ccgcauucgcgcccgcagugc

SEQ ID NO: 3568832 - RNA, 17 nt, Pseudomonas putida KT2440
ccgcauucuuggccagg

SEQ ID NO: 3568833 - RNA, 18 nt, Pseudomonas putida KT2440
ccgcauugcaggccagcg

SEQ ID NO: 3568834 - RNA, 18 nt, Pseudomonas putida KT2440
ccgcauuggccgggucga

SEQ ID NO: 3568835 - RNA, 14 nt, Pseudomonas putida KT2440
ccgcauuggguggc

SEQ ID NO: 3568836 - RNA, 16 nt, Pseudomonas putida KT2440
ccgccaaaccccagca

SEQ ID NO: 3568837 - RNA, 19 nt, Pseudomonas putida KT2440
ccgccaaaccccagcaagg

SEQ ID NO: 3568838 - RNA, 21 nt, Pseudomonas putida KT2440
ccgccaaaccccagcaaggca

SEQ ID NO: 3568839 - RNA, 19 nt, Pseudomonas putida KT2440
ccgccaacaacaagcgcug

SEQ ID NO: 3568840 - RNA, 17 nt, Pseudomonas putida KT2440
ccgccaacaccaccucc

SEQ ID NO: 3568841 - RNA, 15 nt, Pseudomonas putida KT2440
ccgccaacagcgcag

SEQ ID NO: 3568842 - RNA, 14 nt, Pseudomonas putida KT2440
ccgccaaccccucc

SEQ ID NO: 3568843 - RNA, 20 nt, Pseudomonas putida KT2440
ccgccaacgaaucagccagc

SEQ ID NO: 3568844 - RNA, 17 nt, Pseudomonas putida KT2440
ccgccaacucgccauuc

SEQ ID NO: 3568845 - RNA, 19 nt, Pseudomonas putida KT2440
ccgccaacuguuucugcuc

SEQ ID NO: 3568846 - RNA, 20 nt, Pseudomonas putida KT2440
ccgccaacuguuucugcucu

SEQ ID NO: 3568847 - RNA, 14 nt, Pseudomonas putida KT2440
ccgccaagcacgca

SEQ ID NO: 3568848 - RNA, 16 nt, Pseudomonas putida KT2440
ccgccaagcggcccca

SEQ ID NO: 3568849 - RNA, 17 nt, Pseudomonas putida KT2440
ccgccaagcggccccaa

SEQ ID NO: 3568850 - RNA, 13 nt, Pseudomonas putida KT2440
ccgccaaggcacg

SEQ ID NO: 3568851 - RNA, 15 nt, Pseudomonas putida KT2440
ccgccaaggcgaugc

SEQ ID NO: 3568852 - RNA, 22 nt, Pseudomonas putida KT2440
ccgccaagggucgacaccagga

SEQ ID NO: 3568853 - RNA, 16 nt, Pseudomonas putida KT2440
ccgccaagguaaucug

SEQ ID NO: 3568854 - RNA, 18 nt, Pseudomonas putida KT2440
ccgccaagguaaucuggc

SEQ ID NO: 3568855 - RNA, 20 nt, Pseudomonas putida KT2440
ccgccaagguaaucuggcug

SEQ ID NO: 3568856 - RNA, 15 nt, Pseudomonas putida KT2440
ccgccaauacccacg

SEQ ID NO: 3568857 - RNA, 17 nt, Pseudomonas putida KT2440
ccgccaauugcgccagc

SEQ ID NO: 3568858 - RNA, 18 nt, Pseudomonas putida KT2440
ccgccaauugcgccagcc

SEQ ID NO: 3568859 - RNA, 14 nt, Pseudomonas putida KT2440
ccgccacaccgaag

SEQ ID NO: 3568860 - RNA, 21 nt, Pseudomonas putida KT2440
ccgccacaccugccaggccaa

SEQ ID NO: 3568861 - RNA, 17 nt, Pseudomonas putida KT2440
ccgccaccaucgacuca

SEQ ID NO: 3568862 - RNA, 16 nt, Pseudomonas putida KT2440
ccgccaccaucggcca

SEQ ID NO: 3568863 - RNA, 18 nt, Pseudomonas putida KT2440
ccgccaccaucggccagg

SEQ ID NO: 3568864 - RNA, 12 nt, Pseudomonas putida KT2440
ccgccacccacc

SEQ ID NO: 3568865 - RNA, 15 nt, Pseudomonas putida KT2440
ccgccaccccaggcc

SEQ ID NO: 3568866 - RNA, 18 nt, Pseudomonas putida KT2440
ccgccaccccaggccacu

SEQ ID NO: 3568867 - RNA, 13 nt, Pseudomonas putida KT2440
ccgccacccccgc

SEQ ID NO: 3568868 - RNA, 23 nt, Pseudomonas putida KT2440
ccgccaccuuguucgagcgccau

SEQ ID NO: 3568869 - RNA, 17 nt, Pseudomonas putida KT2440
ccgccacgaucgacaac

SEQ ID NO: 3568870 - RNA, 23 nt, Pseudomonas putida KT2440
ccgccacgaucgacaaccccagc

SEQ ID NO: 3568871 - RNA, 20 nt, Pseudomonas putida KT2440
ccgccacggccaccuugcca

SEQ ID NO: 3568872 - RNA, 14 nt, Pseudomonas putida KT2440
ccgccacggugccg

SEQ ID NO: 3568873 - RNA, 21 nt, Pseudomonas putida KT2440
ccgccacugaccagcccggcu

SEQ ID NO: 3568874 - RNA, 21 nt, Pseudomonas putida KT2440
ccgccagaaaauucucccggg

SEQ ID NO: 3568875 - RNA, 14 nt, Pseudomonas putida KT2440
ccgccagaucaucg

SEQ ID NO: 3568876 - RNA, 22 nt, Pseudomonas putida KT2440
ccgccagaucaucggguagcga

SEQ ID NO: 3568877 - RNA, 15 nt, Pseudomonas putida KT2440
ccgccagcagcuggu

SEQ ID NO: 3568878 - RNA, 14 nt, Pseudomonas putida KT2440
ccgccagcauggcc

SEQ ID NO: 3568879 - RNA, 14 nt, Pseudomonas putida KT2440
ccgccagccaacgc

SEQ ID NO: 3568880 - RNA, 15 nt, Pseudomonas putida KT2440
ccgccagcccgccac

SEQ ID NO: 3568881 - RNA, 16 nt, Pseudomonas putida KT2440
ccgccagcccgccaca

SEQ ID NO: 3568882 - RNA, 22 nt, Pseudomonas putida KT2440
ccgccagcccgccacaccgaag

SEQ ID NO: 3568883 - RNA, 11 nt, Pseudomonas putida KT2440
ccgccagcggc

SEQ ID NO: 3568884 - RNA, 15 nt, Pseudomonas putida KT2440
ccgccagcggcaagc

SEQ ID NO: 3568885 - RNA, 23 nt, Pseudomonas putida KT2440
ccgccagcggcaguugcaggcgc

SEQ ID NO: 3568886 - RNA, 15 nt, Pseudomonas putida KT2440
ccgccagcggcgugu

SEQ ID NO: 3568887 - RNA, 20 nt, Pseudomonas putida KT2440
ccgccagcgugcccgccaca

SEQ ID NO: 3568888 - RNA, 18 nt, Pseudomonas putida KT2440
ccgccaggauggcaccga

SEQ ID NO: 3568889 - RNA, 22 nt, Pseudomonas putida KT2440
ccgccaggauggcaccgaucac

SEQ ID NO: 3568890 - RNA, 17 nt, Pseudomonas putida KT2440
ccgccaggcagcagacu

SEQ ID NO: 3568891 - RNA, 16 nt, Pseudomonas putida KT2440
ccgccaggcccaccac

SEQ ID NO: 3568892 - RNA, 17 nt, Pseudomonas putida KT2440
ccgccaggcggucgccc

SEQ ID NO: 3568893 - RNA, 16 nt, Pseudomonas putida KT2440
ccgccaggcucuccag

SEQ ID NO: 3568894 - RNA, 18 nt, Pseudomonas putida KT2440
ccgccaggcucuccagcc

SEQ ID NO: 3568895 - RNA, 22 nt, Pseudomonas putida KT2440
ccgccagguauucggcaaugcg

SEQ ID NO: 3568896 - RNA, 21 nt, Pseudomonas putida KT2440
ccgccagguccgguaacuggc

SEQ ID NO: 3568897 - RNA, 21 nt, Pseudomonas putida KT2440
ccgccaguagcaaucagguca

SEQ ID NO: 3568898 - RNA, 20 nt, Pseudomonas putida KT2440
ccgccaguaggcugcagccu

SEQ ID NO: 3568899 - RNA, 16 nt, Pseudomonas putida KT2440
ccgccagugaccgcug

SEQ ID NO: 3568900 - RNA, 22 nt, Pseudomonas putida KT2440
ccgccaguuucaccugaccauc

SEQ ID NO: 3568901 - RNA, 23 nt, Pseudomonas putida KT2440
ccgccaguuucaccugaccauca

SEQ ID NO: 3568902 - RNA, 22 nt, Pseudomonas putida KT2440
ccgccaucgaucaggguuucca

SEQ ID NO: 3568903 - RNA, 16 nt, Pseudomonas putida KT2440
ccgccaugaucugccc

SEQ ID NO: 3568904 - RNA, 15 nt, Pseudomonas putida KT2440
ccgccaugcaacugc

SEQ ID NO: 3568905 - RNA, 23 nt, Pseudomonas putida KT2440
ccgccauggucgcguuguucagc

SEQ ID NO: 3568906 - RNA, 18 nt, Pseudomonas putida KT2440
ccgccauucuucuccagg

SEQ ID NO: 3568907 - RNA, 18 nt, Pseudomonas putida KT2440
ccgccauugacuaccagg

SEQ ID NO: 3568908 - RNA, 23 nt, Pseudomonas putida KT2440
ccgccauugaggaaguagaacac

SEQ ID NO: 3568909 - RNA, 18 nt, Pseudomonas putida KT2440
ccgccauugaugccgaag

SEQ ID NO: 3568910 - RNA, 15 nt, Pseudomonas putida KT2440
ccgcccaagcggcag

SEQ ID NO: 3568911 - RNA, 16 nt, Pseudomonas putida KT2440
ccgcccaagcggcaga

SEQ ID NO: 3568912 - RNA, 20 nt, Pseudomonas putida KT2440
ccgcccaauuuggccagcuu

SEQ ID NO: 3568913 - RNA, 21 nt, Pseudomonas putida KT2440
ccgcccaauuuggccagcuuc

SEQ ID NO: 3568914 - RNA, 21 nt, Pseudomonas putida KT2440
ccgcccacaugcgagccgcug

SEQ ID NO: 3568915 - RNA, 17 nt, Pseudomonas putida KT2440
ccgcccaccaccagccc

SEQ ID NO: 3568916 - RNA, 14 nt, Pseudomonas putida KT2440
ccgcccacccacca

SEQ ID NO: 3568917 - RNA, 13 nt, Pseudomonas putida KT2440
ccgcccacgccgc

SEQ ID NO: 3568918 - RNA, 15 nt, Pseudomonas putida KT2440
ccgcccacgccggca

SEQ ID NO: 3568919 - RNA, 22 nt, Pseudomonas putida KT2440
ccgcccacuucugcggccaggg

SEQ ID NO: 3568920 - RNA, 15 nt, Pseudomonas putida KT2440
ccgcccagcuggcuc

SEQ ID NO: 3568921 - RNA, 13 nt, Pseudomonas putida KT2440
ccgcccaggucau

SEQ ID NO: 3568922 - RNA, 14 nt, Pseudomonas putida KT2440
ccgcccaguucagc

SEQ ID NO: 3568923 - RNA, 22 nt, Pseudomonas putida KT2440
ccgcccaucaccggcaccggga

SEQ ID NO: 3568924 - RNA, 16 nt, Pseudomonas putida KT2440
ccgccccaaaccaggc

SEQ ID NO: 3568925 - RNA, 19 nt, Pseudomonas putida KT2440
ccgccccaaaccaggccgu

SEQ ID NO: 3568926 - RNA, 15 nt, Pseudomonas putida KT2440
ccgccccaagcgccu

SEQ ID NO: 3568927 - RNA, 14 nt, Pseudomonas putida KT2440
ccgccccagcgcgc

SEQ ID NO: 3568928 - RNA, 19 nt, Pseudomonas putida KT2440
ccgcccccucggcgccaua

SEQ ID NO: 3568929 - RNA, 13 nt, Pseudomonas putida KT2440
ccgccccgcccga

SEQ ID NO: 3568930 - RNA, 13 nt, Pseudomonas putida KT2440
ccgccccuccacc

SEQ ID NO: 3568931 - RNA, 17 nt, Pseudomonas putida KT2440
ccgcccgcgccgcccag

SEQ ID NO: 3568932 - RNA, 14 nt, Pseudomonas putida KT2440
ccgcccgcucacgc

SEQ ID NO: 3568933 - RNA, 21 nt, Pseudomonas putida KT2440
ccgcccgggcuuuguguugau

SEQ ID NO: 3568934 - RNA, 13 nt, Pseudomonas putida KT2440
ccgcccgguaaua

SEQ ID NO: 3568935 - RNA, 14 nt, Pseudomonas putida KT2440
ccgcccgguaauag

SEQ ID NO: 3568936 - RNA, 17 nt, Pseudomonas putida KT2440
ccgcccuagcgguccgg

SEQ ID NO: 3568937 - RNA, 14 nt, Pseudomonas putida KT2440
ccgcccuccagccg

SEQ ID NO: 3568938 - RNA, 23 nt, Pseudomonas putida KT2440
ccgcccucuucgcgggcaugccc

SEQ ID NO: 3568939 - RNA, 20 nt, Pseudomonas putida KT2440
ccgcccugagccaaggccgc

SEQ ID NO: 3568940 - RNA, 20 nt, Pseudomonas putida KT2440
ccgcccugguccgugagaaa

SEQ ID NO: 3568941 - RNA, 20 nt, Pseudomonas putida KT2440
ccgcccuuggugcaccagcu

SEQ ID NO: 3568942 - RNA, 15 nt, Pseudomonas putida KT2440
ccgccgaacaggccg

SEQ ID NO: 3568943 - RNA, 22 nt, Pseudomonas putida KT2440
ccgccgaacaggccggcugcag

SEQ ID NO: 3568944 - RNA, 20 nt, Pseudomonas putida KT2440
ccgccgaagccaugagcgag

SEQ ID NO: 3568945 - RNA, 14 nt, Pseudomonas putida KT2440
ccgccgaccaggug

SEQ ID NO: 3568946 - RNA, 22 nt, Pseudomonas putida KT2440
ccgccgaccaggugguaacugg

SEQ ID NO: 3568947 - RNA, 19 nt, Pseudomonas putida KT2440
ccgccgauagcagcaccga

SEQ ID NO: 3568948 - RNA, 15 nt, Pseudomonas putida KT2440
ccgccgaucgaagca

SEQ ID NO: 3568949 - RNA, 20 nt, Pseudomonas putida KT2440
ccgccgaucgaagcagcagc

SEQ ID NO: 3568950 - RNA, 18 nt, Pseudomonas putida KT2440
ccgccgaugaucgaaugg

SEQ ID NO: 3568951 - RNA, 17 nt, Pseudomonas putida KT2440
ccgccgaugcgcuucca

SEQ ID NO: 3568952 - RNA, 15 nt, Pseudomonas putida KT2440
ccgccgccaccagcg

SEQ ID NO: 3568953 - RNA, 13 nt, Pseudomonas putida KT2440
ccgccgcccaggu

SEQ ID NO: 3568954 - RNA, 15 nt, Pseudomonas putida KT2440
ccgccgcccagguca

SEQ ID NO: 3568955 - RNA, 15 nt, Pseudomonas putida KT2440
ccgccgccccgcacc

SEQ ID NO: 3568956 - RNA, 14 nt, Pseudomonas putida KT2440
ccgccgcugccagc

SEQ ID NO: 3568957 - RNA, 15 nt, Pseudomonas putida KT2440
ccgccgcuggcggcg

SEQ ID NO: 3568958 - RNA, 19 nt, Pseudomonas putida KT2440
ccgccgcuuuguuugcugg

SEQ ID NO: 3568959 - RNA, 21 nt, Pseudomonas putida KT2440
ccgccggcaacuccuccagcc

SEQ ID NO: 3568960 - RNA, 15 nt, Pseudomonas putida KT2440
ccgccggccauucau

SEQ ID NO: 3568961 - RNA, 20 nt, Pseudomonas putida KT2440
ccgccggcucgucacugccg

SEQ ID NO: 3568962 - RNA, 15 nt, Pseudomonas putida KT2440
ccgccgggaugguaa

SEQ ID NO: 3568963 - RNA, 22 nt, Pseudomonas putida KT2440
ccgccgggguaauggcgcugga

SEQ ID NO: 3568964 - RNA, 15 nt, Pseudomonas putida KT2440
ccgccggguggguga

SEQ ID NO: 3568965 - RNA, 19 nt, Pseudomonas putida KT2440
ccgccgguuucucgcagca

SEQ ID NO: 3568966 - RNA, 23 nt, Pseudomonas putida KT2440
ccgccgguuucucgcagcagcac

SEQ ID NO: 3568967 - RNA, 16 nt, Pseudomonas putida KT2440
ccgccgucaccgccgc

SEQ ID NO: 3568968 - RNA, 18 nt, Pseudomonas putida KT2440
ccgccgucaucgaaccgu

SEQ ID NO: 3568969 - RNA, 16 nt, Pseudomonas putida KT2440
ccgccgucgggugcgc

SEQ ID NO: 3568970 - RNA, 15 nt, Pseudomonas putida KT2440
ccgccgugccgguca

SEQ ID NO: 3568971 - RNA, 20 nt, Pseudomonas putida KT2440
ccgccgugccggucacuggc

SEQ ID NO: 3568972 - RNA, 22 nt, Pseudomonas putida KT2440
ccgccgugccggucacuggcaa

SEQ ID NO: 3568973 - RNA, 17 nt, Pseudomonas putida KT2440
ccgccguguucccagca

SEQ ID NO: 3568974 - RNA, 16 nt, Pseudomonas putida KT2440
ccgccguucaggcgcc

SEQ ID NO: 3568975 - RNA, 20 nt, Pseudomonas putida KT2440
ccgccguucaggcgccugcc

SEQ ID NO: 3568976 - RNA, 20 nt, Pseudomonas putida KT2440
ccgccguugaaagacugcuc

SEQ ID NO: 3568977 - RNA, 21 nt, Pseudomonas putida KT2440
ccgccguugaaagacugcucc

SEQ ID NO: 3568978 - RNA, 22 nt, Pseudomonas putida KT2440
ccgccuaugaaaccgagcgccg

SEQ ID NO: 3568979 - RNA, 17 nt, Pseudomonas putida KT2440
ccgccucauccucgccc

SEQ ID NO: 3568980 - RNA, 16 nt, Pseudomonas putida KT2440
ccgccuccacggucag

SEQ ID NO: 3568981 - RNA, 16 nt, Pseudomonas putida KT2440
ccgccuccugcugcug

SEQ ID NO: 3568982 - RNA, 23 nt, Pseudomonas putida KT2440
ccgccucgaacaccugcgccccg

SEQ ID NO: 3568983 - RNA, 16 nt, Pseudomonas putida KT2440
ccgccucgaccuggcc

SEQ ID NO: 3568984 - RNA, 17 nt, Pseudomonas putida KT2440
ccgccucgaccuggccc

SEQ ID NO: 3568985 - RNA, 20 nt, Pseudomonas putida KT2440
ccgccucgaucgucgacaac

SEQ ID NO: 3568986 - RNA, 21 nt, Pseudomonas putida KT2440
ccgccucggcuacgccgccgc

SEQ ID NO: 3568987 - RNA, 22 nt, Pseudomonas putida KT2440
ccgccucgucgauguagaugcc

SEQ ID NO: 3568988 - RNA, 16 nt, Pseudomonas putida KT2440
ccgccucguugcgaag

SEQ ID NO: 3568989 - RNA, 18 nt, Pseudomonas putida KT2440
ccgccucuaccacgccgc

SEQ ID NO: 3568990 - RNA, 18 nt, Pseudomonas putida KT2440
ccgccugaaucuugcgcg

SEQ ID NO: 3568991 - RNA, 15 nt, Pseudomonas putida KT2440
ccgccugccgccugu

SEQ ID NO: 3568992 - RNA, 14 nt, Pseudomonas putida KT2440
ccgccugcgccagc

SEQ ID NO: 3568993 - RNA, 15 nt, Pseudomonas putida KT2440
ccgccugcgccagcg

SEQ ID NO: 3568994 - RNA, 21 nt, Pseudomonas putida KT2440
ccgccugcggcaccgucgccu

SEQ ID NO: 3568995 - RNA, 21 nt, Pseudomonas putida KT2440
ccgccuggcccgucugcgugc

SEQ ID NO: 3568996 - RNA, 11 nt, Pseudomonas putida KT2440
ccgccuggccg

SEQ ID NO: 3568997 - RNA, 21 nt, Pseudomonas putida KT2440
ccgccuggccgcugcgcccgc

SEQ ID NO: 3568998 - RNA, 16 nt, Pseudomonas putida KT2440
ccgccuggcucaccuu

SEQ ID NO: 3568999 - RNA, 12 nt, Pseudomonas putida KT2440
ccgccuggguca

SEQ ID NO: 3569000 - RNA, 15 nt, Pseudomonas putida KT2440
ccgccugggucaggc

SEQ ID NO: 3569001 - RNA, 17 nt, Pseudomonas putida KT2440
ccgccugggucaggcgu

SEQ ID NO: 3569002 - RNA, 18 nt, Pseudomonas putida KT2440
ccgccugggucaggcgua

SEQ ID NO: 3569003 - RNA, 19 nt, Pseudomonas putida KT2440
ccgccugucgcgacgggcu

SEQ ID NO: 3569004 - RNA, 21 nt, Pseudomonas putida KT2440
ccgccuucgccaagguccagc

SEQ ID NO: 3569005 - RNA, 15 nt, Pseudomonas putida KT2440
ccgccuuggcagccu

SEQ ID NO: 3569006 - RNA, 23 nt, Pseudomonas putida KT2440
ccgccuuggcauagcgcucgcgc

SEQ ID NO: 3569007 - RNA, 23 nt, Pseudomonas putida KT2440
ccgccuuggcuuccugcuggcuc

SEQ ID NO: 3569008 - RNA, 18 nt, Pseudomonas putida KT2440
ccgccuuguuuguacggc

SEQ ID NO: 3569009 - RNA, 18 nt, Pseudomonas putida KT2440
ccgcgaaacacagcaggc

SEQ ID NO: 3569010 - RNA, 21 nt, Pseudomonas putida KT2440
ccgcgaaacacagcaggccaa

SEQ ID NO: 3569011 - RNA, 17 nt, Pseudomonas putida KT2440
ccgcgaaagggccagca

SEQ ID NO: 3569012 - RNA, 17 nt, Pseudomonas putida KT2440
ccgcgaaagggccagua

SEQ ID NO: 3569013 - RNA, 20 nt, Pseudomonas putida KT2440
ccgcgaaagggccaguccag

SEQ ID NO: 3569014 - RNA, 14 nt, Pseudomonas putida KT2440
ccgcgaacaccggc

SEQ ID NO: 3569015 - RNA, 20 nt, Pseudomonas putida KT2440
ccgcgaagaagacaccgcgg

SEQ ID NO: 3569016 - RNA, 12 nt, Pseudomonas putida KT2440
ccgcgaagaggc

SEQ ID NO: 3569017 - RNA, 22 nt, Pseudomonas putida KT2440
ccgcgaagaggccagcacaggc

SEQ ID NO: 3569018 - RNA, 20 nt, Pseudomonas putida KT2440
ccgcgaagaggccaggacag

SEQ ID NO: 3569019 - RNA, 21 nt, Pseudomonas putida KT2440
ccgcgaagaggccaggacagg

SEQ ID NO: 3569020 - RNA, 15 nt, Pseudomonas putida KT2440
ccgcgaagaggcccg

SEQ ID NO: 3569021 - RNA, 16 nt, Pseudomonas putida KT2440
ccgcgaagaggcccga

SEQ ID NO: 3569022 - RNA, 22 nt, Pseudomonas putida KT2440
ccgcgaagaggccggaccugcu

SEQ ID NO: 3569023 - RNA, 17 nt, Pseudomonas putida KT2440
ccgcgaagaggccggca

SEQ ID NO: 3569024 - RNA, 18 nt, Pseudomonas putida KT2440
ccgcgaagaggccggcaa

SEQ ID NO: 3569025 - RNA, 18 nt, Pseudomonas putida KT2440
ccgcgaagaggccggcac

SEQ ID NO: 3569026 - RNA, 19 nt, Pseudomonas putida KT2440
ccgcgaagaggccggcccc

SEQ ID NO: 3569027 - RNA, 17 nt, Pseudomonas putida KT2440
ccgcgaagagggcgaca

SEQ ID NO: 3569028 - RNA, 19 nt, Pseudomonas putida KT2440
ccgcgaagagggcgacacc

SEQ ID NO: 3569029 - RNA, 13 nt, Pseudomonas putida KT2440
ccgcgaagcggcc

SEQ ID NO: 3569030 - RNA, 19 nt, Pseudomonas putida KT2440
ccgcgaaggcuccagcacc

SEQ ID NO: 3569031 - RNA, 15 nt, Pseudomonas putida KT2440
ccgcgaagggccgca

SEQ ID NO: 3569032 - RNA, 15 nt, Pseudomonas putida KT2440
ccgcgaagggccgcg

SEQ ID NO: 3569033 - RNA, 22 nt, Pseudomonas putida KT2440
ccgcgaaggggccggcacaggc

SEQ ID NO: 3569034 - RNA, 20 nt, Pseudomonas putida KT2440
ccgcgaauacgguagcggca

SEQ ID NO: 3569035 - RNA, 22 nt, Pseudomonas putida KT2440
ccgcgaauacgguagcggcagc

SEQ ID NO: 3569036 - RNA, 20 nt, Pseudomonas putida KT2440
ccgcgaauacgguggcggca

SEQ ID NO: 3569037 - RNA, 20 nt, Pseudomonas putida KT2440
ccgcgaaugcuccggcgaca

SEQ ID NO: 3569038 - RNA, 22 nt, Pseudomonas putida KT2440
ccgcgaaugcuccggcgacagc

SEQ ID NO: 3569039 - RNA, 14 nt, Pseudomonas putida KT2440
ccgcgaauggguca

SEQ ID NO: 3569040 - RNA, 20 nt, Pseudomonas putida KT2440
ccgcgacgaugaucagguug

SEQ ID NO: 3569041 - RNA, 15 nt, Pseudomonas putida KT2440
ccgcgacgcggcccc

SEQ ID NO: 3569042 - RNA, 17 nt, Pseudomonas putida KT2440
ccgcgacgcggcccugg

SEQ ID NO: 3569043 - RNA, 12 nt, Pseudomonas putida KT2440
ccgcgagcagcg

SEQ ID NO: 3569044 - RNA, 21 nt, Pseudomonas putida KT2440
ccgcgagcagcguucucggug

SEQ ID NO: 3569045 - RNA, 23 nt, Pseudomonas putida KT2440
ccgcgaguccuccaacucgcgca

SEQ ID NO: 3569046 - RNA, 18 nt, Pseudomonas putida KT2440
ccgcgauacgccgacagc

SEQ ID NO: 3569047 - RNA, 22 nt, Pseudomonas putida KT2440
ccgcgauagcucagucgguaga

SEQ ID NO: 3569048 - RNA, 17 nt, Pseudomonas putida KT2440
ccgcgauaucagcgcca

SEQ ID NO: 3569049 - RNA, 23 nt, Pseudomonas putida KT2440
ccgcgaugaugauaccgaacagc

SEQ ID NO: 3569050 - RNA, 22 nt, Pseudomonas putida KT2440
ccgcgauggauggcaccggcuu

SEQ ID NO: 3569051 - RNA, 18 nt, Pseudomonas putida KT2440
ccgcgcaaaucgccgcau

SEQ ID NO: 3569052 - RNA, 21 nt, Pseudomonas putida KT2440
ccgcgcaaaugcaccccugcc

SEQ ID NO: 3569053 - RNA, 13 nt, Pseudomonas putida KT2440
ccgcgcaacgcgc

SEQ ID NO: 3569054 - RNA, 20 nt, Pseudomonas putida KT2440
ccgcgcaccuccugcggcag

SEQ ID NO: 3569055 - RNA, 22 nt, Pseudomonas putida KT2440
ccgcgcaccuccugcggcagau

SEQ ID NO: 3569056 - RNA, 15 nt, Pseudomonas putida KT2440
ccgcgcacgcaucug

SEQ ID NO: 3569057 - RNA, 13 nt, Pseudomonas putida KT2440
ccgcgcagcggcc

SEQ ID NO: 3569058 - RNA, 12 nt, Pseudomonas putida KT2440
ccgcgcaggaag

SEQ ID NO: 3569059 - RNA, 13 nt, Pseudomonas putida KT2440
ccgcgcaggcggc

SEQ ID NO: 3569060 - RNA, 15 nt, Pseudomonas putida KT2440
ccgcgcaggcggcug

SEQ ID NO: 3569061 - RNA, 17 nt, Pseudomonas putida KT2440
ccgcgcaucauccacca

SEQ ID NO: 3569062 - RNA, 21 nt, Pseudomonas putida KT2440
ccgcgcaucauccaccacccu

SEQ ID NO: 3569063 - RNA, 23 nt, Pseudomonas putida KT2440
ccgcgcaucauccaccacccugg

SEQ ID NO: 3569064 - RNA, 18 nt, Pseudomonas putida KT2440
ccgcgcauccuccgcccu

SEQ ID NO: 3569065 - RNA, 22 nt, Pseudomonas putida KT2440
ccgcgcaugaugaaguggcgca

SEQ ID NO: 3569066 - RNA, 22 nt, Pseudomonas putida KT2440
ccgcgcauuugcuccagggcau

SEQ ID NO: 3569067 - RNA, 15 nt, Pseudomonas putida KT2440
ccgcgccacccgcug

SEQ ID NO: 3569068 - RNA, 17 nt, Pseudomonas putida KT2440
ccgcgccagccugggcu

SEQ ID NO: 3569069 - RNA, 17 nt, Pseudomonas putida KT2440
ccgcgccagcggccagc

SEQ ID NO: 3569070 - RNA, 19 nt, Pseudomonas putida KT2440
ccgcgccagcuccgacagg

SEQ ID NO: 3569071 - RNA, 14 nt, Pseudomonas putida KT2440
ccgcgccauugccc

SEQ ID NO: 3569072 - RNA, 20 nt, Pseudomonas putida KT2440
ccgcgcccgcaaccucggcc

SEQ ID NO: 3569073 - RNA, 12 nt, Pseudomonas putida KT2440
ccgcgcccggcu

SEQ ID NO: 3569074 - RNA, 14 nt, Pseudomonas putida KT2440
ccgcgcccucuucc

SEQ ID NO: 3569075 - RNA, 20 nt, Pseudomonas putida KT2440
ccgcgccgacagccucaagg

SEQ ID NO: 3569076 - RNA, 20 nt, Pseudomonas putida KT2440
ccgcgccgaucacaccggca

SEQ ID NO: 3569077 - RNA, 16 nt, Pseudomonas putida KT2440
ccgcgccggguuaccc

SEQ ID NO: 3569078 - RNA, 14 nt, Pseudomonas putida KT2440
ccgcgccuacagcg

SEQ ID NO: 3569079 - RNA, 18 nt, Pseudomonas putida KT2440
ccgcgccuacagcggccu

SEQ ID NO: 3569080 - RNA, 16 nt, Pseudomonas putida KT2440
ccgcgccuacaggcaa

SEQ ID NO: 3569081 - RNA, 19 nt, Pseudomonas putida KT2440
ccgcgccuacaggcaaccg

SEQ ID NO: 3569082 - RNA, 23 nt, Pseudomonas putida KT2440
ccgcgccuacaggcaaccgcauc

SEQ ID NO: 3569083 - RNA, 18 nt, Pseudomonas putida KT2440
ccgcgccuacaggcccca

SEQ ID NO: 3569084 - RNA, 19 nt, Pseudomonas putida KT2440
ccgcgccuacgacggccug

SEQ ID NO: 3569085 - RNA, 20 nt, Pseudomonas putida KT2440
ccgcgccucgaucccgccgc

SEQ ID NO: 3569086 - RNA, 15 nt, Pseudomonas putida KT2440
ccgcgccugcaaguc

SEQ ID NO: 3569087 - RNA, 14 nt, Pseudomonas putida KT2440
ccgcgccuugcgca

SEQ ID NO: 3569088 - RNA, 21 nt, Pseudomonas putida KT2440
ccgcgcgcgaugcgccgcgcg

SEQ ID NO: 3569089 - RNA, 22 nt, Pseudomonas putida KT2440
ccgcgcggcuugcucgcggcgc

SEQ ID NO: 3569090 - RNA, 23 nt, Pseudomonas putida KT2440
ccgcgcgggugcgagaggcgcuu

SEQ ID NO: 3569091 - RNA, 17 nt, Pseudomonas putida KT2440
ccgcgcgguuaagcgcc

SEQ ID NO: 3569092 - RNA, 14 nt, Pseudomonas putida KT2440
ccgcgcguccaugg

SEQ ID NO: 3569093 - RNA, 20 nt, Pseudomonas putida KT2440
ccgcgcuacggcgucgacac

SEQ ID NO: 3569094 - RNA, 18 nt, Pseudomonas putida KT2440
ccgcgcugaccaaggcaa

SEQ ID NO: 3569095 - RNA, 15 nt, Pseudomonas putida KT2440
ccgcgcugauaucga

SEQ ID NO: 3569096 - RNA, 14 nt, Pseudomonas putida KT2440
ccgcgcuggcgcgc

SEQ ID NO: 3569097 - RNA, 22 nt, Pseudomonas putida KT2440
ccgcgcugguaagccucgagcg

SEQ ID NO: 3569098 - RNA, 19 nt, Pseudomonas putida KT2440
ccgcgcuguggcgcccggc

SEQ ID NO: 3569099 - RNA, 12 nt, Pseudomonas putida KT2440
ccgcggcucacc

SEQ ID NO: 3569100 - RNA, 22 nt, Pseudomonas putida KT2440
ccgcggcucacccaccagccaa

SEQ ID NO: 3569101 - RNA, 19 nt, Pseudomonas putida KT2440
ccgcggcugacgaagcgcc

SEQ ID NO: 3569102 - RNA, 20 nt, Pseudomonas putida KT2440
ccgcgggcgucgcgaucacg

SEQ ID NO: 3569103 - RNA, 17 nt, Pseudomonas putida KT2440
ccgcggguaccaccugg

SEQ ID NO: 3569104 - RNA, 21 nt, Pseudomonas putida KT2440
ccgcggguaccaccugggcgc

SEQ ID NO: 3569105 - RNA, 16 nt, Pseudomonas putida KT2440
ccgcgguagugcggcc

SEQ ID NO: 3569106 - RNA, 12 nt, Pseudomonas putida KT2440
ccgcggucuggc

SEQ ID NO: 3569107 - RNA, 14 nt, Pseudomonas putida KT2440
ccgcgguuucugca

SEQ ID NO: 3569108 - RNA, 19 nt, Pseudomonas putida KT2440
ccgcgguuuggucgcggca

SEQ ID NO: 3569109 - RNA, 13 nt, Pseudomonas putida KT2440
ccgcguacagcug

SEQ ID NO: 3569110 - RNA, 22 nt, Pseudomonas putida KT2440
ccgcguaccagcagggccauca

SEQ ID NO: 3569111 - RNA, 14 nt, Pseudomonas putida KT2440
ccgcguaggugcgc

SEQ ID NO: 3569112 - RNA, 19 nt, Pseudomonas putida KT2440
ccgcgucguucggcaucga

SEQ ID NO: 3569113 - RNA, 16 nt, Pseudomonas putida KT2440
ccgcgucucgccgcug

SEQ ID NO: 3569114 - RNA, 18 nt, Pseudomonas putida KT2440
ccgcgugagauguucacc

SEQ ID NO: 3569115 - RNA, 22 nt, Pseudomonas putida KT2440
ccgcgugcccccccaacaacag

SEQ ID NO: 3569116 - RNA, 15 nt, Pseudomonas putida KT2440
ccgcgugugcucgag

SEQ ID NO: 3569117 - RNA, 18 nt, Pseudomonas putida KT2440
ccgcguuaugacuggccu

SEQ ID NO: 3569118 - RNA, 15 nt, Pseudomonas putida KT2440
ccgcguucaugccgg

SEQ ID NO: 3569119 - RNA, 18 nt, Pseudomonas putida KT2440
ccgcguuggccaggucga

SEQ ID NO: 3569120 - RNA, 22 nt, Pseudomonas putida KT2440
ccgcguuugcaacuggcgcagg

SEQ ID NO: 3569121 - RNA, 16 nt, Pseudomonas putida KT2440
ccgcuacaccggccug

SEQ ID NO: 3569122 - RNA, 13 nt, Pseudomonas putida KT2440
ccgcuauggcgac

SEQ ID NO: 3569123 - RNA, 15 nt, Pseudomonas putida KT2440
ccgcucaaacccggc

SEQ ID NO: 3569124 - RNA, 18 nt, Pseudomonas putida KT2440
ccgcucaaacccggcagc

SEQ ID NO: 3569125 - RNA, 20 nt, Pseudomonas putida KT2440
ccgcucaaccuuugcggcac

SEQ ID NO: 3569126 - RNA, 23 nt, Pseudomonas putida KT2440
ccgcucaaccuuugcggcacauc

SEQ ID NO: 3569127 - RNA, 13 nt, Pseudomonas putida KT2440
ccgcucaccggcc

SEQ ID NO: 3569128 - RNA, 21 nt, Pseudomonas putida KT2440
ccgcuccaaauaaagaucuac

SEQ ID NO: 3569129 - RNA, 12 nt, Pseudomonas putida KT2440
ccgcuccagcuc

SEQ ID NO: 3569130 - RNA, 12 nt, Pseudomonas putida KT2440
ccgcucccacag

SEQ ID NO: 3569131 - RNA, 17 nt, Pseudomonas putida KT2440
ccgcucccacagggacc

SEQ ID NO: 3569132 - RNA, 20 nt, Pseudomonas putida KT2440
ccgcucccacagggaccgca

SEQ ID NO: 3569133 - RNA, 18 nt, Pseudomonas putida KT2440
ccgcucccacagguaaua

SEQ ID NO: 3569134 - RNA, 15 nt, Pseudomonas putida KT2440
ccgcucccacgagga

SEQ ID NO: 3569135 - RNA, 16 nt, Pseudomonas putida KT2440
ccgcucccauagccaa

SEQ ID NO: 3569136 - RNA, 19 nt, Pseudomonas putida KT2440
ccgcuccgacaaaugcacc

SEQ ID NO: 3569137 - RNA, 20 nt, Pseudomonas putida KT2440
ccgcuccuacaaagcggcgc

SEQ ID NO: 3569138 - RNA, 17 nt, Pseudomonas putida KT2440
ccgcuccuacaacggcu

SEQ ID NO: 3569139 - RNA, 21 nt, Pseudomonas putida KT2440
ccgcuccuacagguucugcgc

SEQ ID NO: 3569140 - RNA, 21 nt, Pseudomonas putida KT2440
ccgcuccuacgaaagccgcgu

SEQ ID NO: 3569141 - RNA, 20 nt, Pseudomonas putida KT2440
ccgcuccuacgcggggcagc

SEQ ID NO: 3569142 - RNA, 23 nt, Pseudomonas putida KT2440
ccgcuccuacgcggggcagcgca

SEQ ID NO: 3569143 - RNA, 20 nt, Pseudomonas putida KT2440
ccgcuccuacggaaucugca

SEQ ID NO: 3569144 - RNA, 22 nt, Pseudomonas putida KT2440
ccgcuccuacggaaucugcacc

SEQ ID NO: 3569145 - RNA, 18 nt, Pseudomonas putida KT2440
ccgcuccuacggccgaca

SEQ ID NO: 3569146 - RNA, 24 nt, Pseudomonas putida KT2440
ccgcuccuacgggcgagcgcgcag

SEQ ID NO: 3569147 - RNA, 21 nt, Pseudomonas putida KT2440
ccgcuccuacgggggggcgca

SEQ ID NO: 3569148 - RNA, 19 nt, Pseudomonas putida KT2440
ccgcuccuacuacggccug

SEQ ID NO: 3569149 - RNA, 17 nt, Pseudomonas putida KT2440
ccgcuccugcggucagc

SEQ ID NO: 3569150 - RNA, 18 nt, Pseudomonas putida KT2440
ccgcuccugcggucagcc

SEQ ID NO: 3569151 - RNA, 21 nt, Pseudomonas putida KT2440
ccgcuccugcggucagccugc

SEQ ID NO: 3569152 - RNA, 17 nt, Pseudomonas putida KT2440
ccgcucgaacaagcgcg

SEQ ID NO: 3569153 - RNA, 23 nt, Pseudomonas putida KT2440
ccgcucgacguuuaccugcagcu

SEQ ID NO: 3569154 - RNA, 14 nt, Pseudomonas putida KT2440
ccgcucgcccagca

SEQ ID NO: 3569155 - RNA, 16 nt, Pseudomonas putida KT2440
ccgcucgcccagcagc

SEQ ID NO: 3569156 - RNA, 16 nt, Pseudomonas putida KT2440
ccgcucugcccgcgcc

SEQ ID NO: 3569157 - RNA, 15 nt, Pseudomonas putida KT2440
ccgcucugcgccacg

SEQ ID NO: 3569158 - RNA, 20 nt, Pseudomonas putida KT2440
ccgcugaacaacuccgggug

SEQ ID NO: 3569159 - RNA, 22 nt, Pseudomonas putida KT2440
ccgcugaacaacuccgggugcu

SEQ ID NO: 3569160 - RNA, 17 nt, Pseudomonas putida KT2440
ccgcugaccacgccgaa

SEQ ID NO: 3569161 - RNA, 18 nt, Pseudomonas putida KT2440
ccgcugaccacgccgaag

SEQ ID NO: 3569162 - RNA, 19 nt, Pseudomonas putida KT2440
ccgcugaccacgccgaagc

SEQ ID NO: 3569163 - RNA, 21 nt, Pseudomonas putida KT2440
ccgcugaccgggucgacgcgc

SEQ ID NO: 3569164 - RNA, 23 nt, Pseudomonas putida KT2440
ccgcugauggccaauaccgcugc

SEQ ID NO: 3569165 - RNA, 21 nt, Pseudomonas putida KT2440
ccgcugcaaucgagccgaaca

SEQ ID NO: 3569166 - RNA, 17 nt, Pseudomonas putida KT2440
ccgcugcacaggccagc

SEQ ID NO: 3569167 - RNA, 19 nt, Pseudomonas putida KT2440
ccgcugcacaggccagccc

SEQ ID NO: 3569168 - RNA, 18 nt, Pseudomonas putida KT2440
ccgcugcacgucgcgcag

SEQ ID NO: 3569169 - RNA, 21 nt, Pseudomonas putida KT2440
ccgcugcacgucgcgcagggc

SEQ ID NO: 3569170 - RNA, 16 nt, Pseudomonas putida KT2440
ccgcugcaugcucggc

SEQ ID NO: 3569171 - RNA, 15 nt, Pseudomonas putida KT2440
ccgcugcauggccug

SEQ ID NO: 3569172 - RNA, 23 nt, Pseudomonas putida KT2440
ccgcugccacagguacugcgcaa

SEQ ID NO: 3569173 - RNA, 18 nt, Pseudomonas putida KT2440
ccgcugccacccacaggc

SEQ ID NO: 3569174 - RNA, 22 nt, Pseudomonas putida KT2440
ccgcugccacccacaggcacga

SEQ ID NO: 3569175 - RNA, 16 nt, Pseudomonas putida KT2440
ccgcugccaccuucca

SEQ ID NO: 3569176 - RNA, 14 nt, Pseudomonas putida KT2440
ccgcugccagcagg

SEQ ID NO: 3569177 - RNA, 15 nt, Pseudomonas putida KT2440
ccgcugccagcaggg

SEQ ID NO: 3569178 - RNA, 14 nt, Pseudomonas putida KT2440
ccgcugccagcugc

SEQ ID NO: 3569179 - RNA, 15 nt, Pseudomonas putida KT2440
ccgcugccagcugcg

SEQ ID NO: 3569180 - RNA, 18 nt, Pseudomonas putida KT2440
ccgcugccauagcgcugc

SEQ ID NO: 3569181 - RNA, 15 nt, Pseudomonas putida KT2440
ccgcugccgaucagc

SEQ ID NO: 3569182 - RNA, 20 nt, Pseudomonas putida KT2440
ccgcugccgaucagcacgcc

SEQ ID NO: 3569183 - RNA, 17 nt, Pseudomonas putida KT2440
ccgcugccugggcacca

SEQ ID NO: 3569184 - RNA, 21 nt, Pseudomonas putida KT2440
ccgcugccuuccaaccagcca

SEQ ID NO: 3569185 - RNA, 13 nt, Pseudomonas putida KT2440
ccgcugccuuccg

SEQ ID NO: 3569186 - RNA, 14 nt, Pseudomonas putida KT2440
ccgcugccuuccgc

SEQ ID NO: 3569187 - RNA, 17 nt, Pseudomonas putida KT2440
ccgcugcgaggaucagc

SEQ ID NO: 3569188 - RNA, 21 nt, Pseudomonas putida KT2440
ccgcugcgcaccaaggcggca

SEQ ID NO: 3569189 - RNA, 22 nt, Pseudomonas putida KT2440
ccgcugcgccgagaggcgcugc

SEQ ID NO: 3569190 - RNA, 15 nt, Pseudomonas putida KT2440
ccgcugcgccugccg

SEQ ID NO: 3569191 - RNA, 19 nt, Pseudomonas putida KT2440
ccgcugcgccugccgggcc

SEQ ID NO: 3569192 - RNA, 20 nt, Pseudomonas putida KT2440
ccgcugcgccugccgggcca

SEQ ID NO: 3569193 - RNA, 17 nt, Pseudomonas putida KT2440
ccgcugcgcgguaaacg

SEQ ID NO: 3569194 - RNA, 16 nt, Pseudomonas putida KT2440
ccgcugcuccaugauc

SEQ ID NO: 3569195 - RNA, 14 nt, Pseudomonas putida KT2440
ccgcugcuccgacc

SEQ ID NO: 3569196 - RNA, 14 nt, Pseudomonas putida KT2440
ccgcugcugcgccu

SEQ ID NO: 3569197 - RNA, 14 nt, Pseudomonas putida KT2440
ccgcugcugcggca

SEQ ID NO: 3569198 - RNA, 16 nt, Pseudomonas putida KT2440
ccgcugcugcggcaac

SEQ ID NO: 3569199 - RNA, 20 nt, Pseudomonas putida KT2440
ccgcugcuggcgcuccaugu

SEQ ID NO: 3569200 - RNA, 13 nt, Pseudomonas putida KT2440
ccgcuggaccugg

SEQ ID NO: 3569201 - RNA, 18 nt, Pseudomonas putida KT2440
ccgcuggcauccaccagg

SEQ ID NO: 3569202 - RNA, 23 nt, Pseudomonas putida KT2440
ccgcuggcauccaccaggucggu

SEQ ID NO: 3569203 - RNA, 18 nt, Pseudomonas putida KT2440
ccgcuggcccuucgcgga

SEQ ID NO: 3569204 - RNA, 21 nt, Pseudomonas putida KT2440
ccgcuggccgcacccagcagg

SEQ ID NO: 3569205 - RNA, 12 nt, Pseudomonas putida KT2440
ccgcuggccgga

SEQ ID NO: 3569206 - RNA, 15 nt, Pseudomonas putida KT2440
ccgcuggcgaucagg

SEQ ID NO: 3569207 - RNA, 22 nt, Pseudomonas putida KT2440
ccgcuggcgaucaggcaggcca

SEQ ID NO: 3569208 - RNA, 19 nt, Pseudomonas putida KT2440
ccgcuggcgaugagguaga

SEQ ID NO: 3569209 - RNA, 23 nt, Pseudomonas putida KT2440
ccgcuggcugaucucacggccau

SEQ ID NO: 3569210 - RNA, 21 nt, Pseudomonas putida KT2440
ccgcuggcuuccucacggcag

SEQ ID NO: 3569211 - RNA, 21 nt, Pseudomonas putida KT2440
ccgcugggcuucuucgugcgc

SEQ ID NO: 3569212 - RNA, 19 nt, Pseudomonas putida KT2440
ccgcugguacagggucagg

SEQ ID NO: 3569213 - RNA, 13 nt, Pseudomonas putida KT2440
ccgcuguacacca

SEQ ID NO: 3569214 - RNA, 15 nt, Pseudomonas putida KT2440
ccgcuguacaccagg

SEQ ID NO: 3569215 - RNA, 16 nt, Pseudomonas putida KT2440
ccgcuguacaccagga

SEQ ID NO: 3569216 - RNA, 13 nt, Pseudomonas putida KT2440
ccgcuguucugca

SEQ ID NO: 3569217 - RNA, 15 nt, Pseudomonas putida KT2440
ccgcuguucugcccg

SEQ ID NO: 3569218 - RNA, 17 nt, Pseudomonas putida KT2440
ccgcuguucugcccggc

SEQ ID NO: 3569219 - RNA, 21 nt, Pseudomonas putida KT2440
ccgcuguucugcccggcugga

SEQ ID NO: 3569220 - RNA, 18 nt, Pseudomonas putida KT2440
ccgcuguugagcagcagc

SEQ ID NO: 3569221 - RNA, 14 nt, Pseudomonas putida KT2440
ccgcuucaacagcu

SEQ ID NO: 3569222 - RNA, 15 nt, Pseudomonas putida KT2440
ccgcuucaacagcuu

SEQ ID NO: 3569223 - RNA, 20 nt, Pseudomonas putida KT2440
ccgcuucacccucgcgcagc

SEQ ID NO: 3569224 - RNA, 17 nt, Pseudomonas putida KT2440
ccgcuuccaggaacggc

SEQ ID NO: 3569225 - RNA, 19 nt, Pseudomonas putida KT2440
ccgcuucgccagcgccacc

SEQ ID NO: 3569226 - RNA, 20 nt, Pseudomonas putida KT2440
ccgcuucgccagcgccaccg

SEQ ID NO: 3569227 - RNA, 15 nt, Pseudomonas putida KT2440
ccgcuucgcgaccca

SEQ ID NO: 3569228 - RNA, 18 nt, Pseudomonas putida KT2440
ccgcuucgcggccaagcc

SEQ ID NO: 3569229 - RNA, 22 nt, Pseudomonas putida KT2440
ccgcuucggcgggguuuuuucu

SEQ ID NO: 3569230 - RNA, 16 nt, Pseudomonas putida KT2440
ccgcuucguccaggua

SEQ ID NO: 3569231 - RNA, 18 nt, Pseudomonas putida KT2440
ccgcuucguccagguagu

SEQ ID NO: 3569232 - RNA, 21 nt, Pseudomonas putida KT2440
ccgcuugacgaucgccagccc

SEQ ID NO: 3569233 - RNA, 23 nt, Pseudomonas putida KT2440
ccgcuugacgaucgccagcccca

SEQ ID NO: 3569234 - RNA, 15 nt, Pseudomonas putida KT2440
ccgcuugaugggcca

SEQ ID NO: 3569235 - RNA, 18 nt, Pseudomonas putida KT2440
ccgcuugcacagguaucg

SEQ ID NO: 3569236 - RNA, 20 nt, Pseudomonas putida KT2440
ccgcuugcaguuguccaggc

SEQ ID NO: 3569237 - RNA, 15 nt, Pseudomonas putida KT2440
ccgcuugcugaucaa

SEQ ID NO: 3569238 - RNA, 13 nt, Pseudomonas putida KT2440
ccgcuuggccacc

SEQ ID NO: 3569239 - RNA, 12 nt, Pseudomonas putida KT2440
ccgcuuggcggc

SEQ ID NO: 3569240 - RNA, 20 nt, Pseudomonas putida KT2440
ccgcuuuuggcugugcaccc

SEQ ID NO: 3569241 - RNA, 17 nt, Pseudomonas putida KT2440
ccggaaacucacgcgcc

SEQ ID NO: 3569242 - RNA, 14 nt, Pseudomonas putida KT2440
ccggaacaaccccu

SEQ ID NO: 3569243 - RNA, 20 nt, Pseudomonas putida KT2440
ccggaacaaccccuugcuca

SEQ ID NO: 3569244 - RNA, 16 nt, Pseudomonas putida KT2440
ccggaauagaacacug

SEQ ID NO: 3569245 - RNA, 15 nt, Pseudomonas putida KT2440
ccggaauccgcacac

SEQ ID NO: 3569246 - RNA, 16 nt, Pseudomonas putida KT2440
ccggaauccgcacacg

SEQ ID NO: 3569247 - RNA, 22 nt, Pseudomonas putida KT2440
ccggaauuucugcaccuugccc

SEQ ID NO: 3569248 - RNA, 14 nt, Pseudomonas putida KT2440
ccggaccagcgccg

SEQ ID NO: 3569249 - RNA, 16 nt, Pseudomonas putida KT2440
ccggaccagcgccgca

SEQ ID NO: 3569250 - RNA, 12 nt, Pseudomonas putida KT2440
ccggaccugccg

SEQ ID NO: 3569251 - RNA, 14 nt, Pseudomonas putida KT2440
ccggaccugccgca

SEQ ID NO: 3569252 - RNA, 13 nt, Pseudomonas putida KT2440
ccggacggguuuc

SEQ ID NO: 3569253 - RNA, 16 nt, Pseudomonas putida KT2440
ccggacugcaccaggu

SEQ ID NO: 3569254 - RNA, 17 nt, Pseudomonas putida KT2440
ccggacuucuucaacgc

SEQ ID NO: 3569255 - RNA, 15 nt, Pseudomonas putida KT2440
ccggagaugugcgcg

SEQ ID NO: 3569256 - RNA, 17 nt, Pseudomonas putida KT2440
ccggagaugugcgcggu

SEQ ID NO: 3569257 - RNA, 18 nt, Pseudomonas putida KT2440
ccggagcgacuucgacca

SEQ ID NO: 3569258 - RNA, 16 nt, Pseudomonas putida KT2440
ccggagcuggagccgg

SEQ ID NO: 3569259 - RNA, 12 nt, Pseudomonas putida KT2440
ccggaggacaca

SEQ ID NO: 3569260 - RNA, 18 nt, Pseudomonas putida KT2440
ccggaguccccaccggca

SEQ ID NO: 3569261 - RNA, 22 nt, Pseudomonas putida KT2440
ccggaguccccaccggcaccau

SEQ ID NO: 3569262 - RNA, 17 nt, Pseudomonas putida KT2440
ccggauagagcccggcg

SEQ ID NO: 3569263 - RNA, 19 nt, Pseudomonas putida KT2440
ccggauagagcccggcgca

SEQ ID NO: 3569264 - RNA, 22 nt, Pseudomonas putida KT2440
ccggauagagcccggcgcagcc

SEQ ID NO: 3569265 - RNA, 16 nt, Pseudomonas putida KT2440
ccggaucggugccacc

SEQ ID NO: 3569266 - RNA, 17 nt, Pseudomonas putida KT2440
ccggaucguugcggguc

SEQ ID NO: 3569267 - RNA, 22 nt, Pseudomonas putida KT2440
ccggaucguugcgggucagcuc

SEQ ID NO: 3569268 - RNA, 16 nt, Pseudomonas putida KT2440
ccggauggggcgugca

SEQ ID NO: 3569269 - RNA, 21 nt, Pseudomonas putida KT2440
ccggauuucuuccauggccug

SEQ ID NO: 3569270 - RNA, 19 nt, Pseudomonas putida KT2440
ccggcaaacaaaaagcacc

SEQ ID NO: 3569271 - RNA, 13 nt, Pseudomonas putida KT2440
ccggcaaacacau

SEQ ID NO: 3569272 - RNA, 13 nt, Pseudomonas putida KT2440
ccggcaacccggc

SEQ ID NO: 3569273 - RNA, 22 nt, Pseudomonas putida KT2440
ccggcaacccuucggccagcag

SEQ ID NO: 3569274 - RNA, 12 nt, Pseudomonas putida KT2440
ccggcaacggcc

SEQ ID NO: 3569275 - RNA, 14 nt, Pseudomonas putida KT2440
ccggcaacggccac

SEQ ID NO: 3569276 - RNA, 18 nt, Pseudomonas putida KT2440
ccggcaacggccacgcug

SEQ ID NO: 3569277 - RNA, 17 nt, Pseudomonas putida KT2440
ccggcaacuccuccagc

SEQ ID NO: 3569278 - RNA, 15 nt, Pseudomonas putida KT2440
ccggcaacuggcaca

SEQ ID NO: 3569279 - RNA, 20 nt, Pseudomonas putida KT2440
ccggcaacuggcacaacccg

SEQ ID NO: 3569280 - RNA, 24 nt, Pseudomonas putida KT2440
ccggcaacuggcaucggucaccgg

SEQ ID NO: 3569281 - RNA, 22 nt, Pseudomonas putida KT2440
ccggcaacuugcgggucagcag

SEQ ID NO: 3569282 - RNA, 18 nt, Pseudomonas putida KT2440
ccggcaagcccauggcug

SEQ ID NO: 3569283 - RNA, 22 nt, Pseudomonas putida KT2440
ccggcaagcccauggcuggcag

SEQ ID NO: 3569284 - RNA, 15 nt, Pseudomonas putida KT2440
ccggcaauaccggcc

SEQ ID NO: 3569285 - RNA, 20 nt, Pseudomonas putida KT2440
ccggcaauaccggccacgcg

SEQ ID NO: 3569286 - RNA, 21 nt, Pseudomonas putida KT2440
ccggcaauaccggccacgcgc

SEQ ID NO: 3569287 - RNA, 23 nt, Pseudomonas putida KT2440
ccggcaauaccggccacgcgcgc

SEQ ID NO: 3569288 - RNA, 22 nt, Pseudomonas putida KT2440
ccggcaaucgggauggcaccgg

SEQ ID NO: 3569289 - RNA, 23 nt, Pseudomonas putida KT2440
ccggcaaucgggauggcaccggc

SEQ ID NO: 3569290 - RNA, 16 nt, Pseudomonas putida KT2440
ccggcacagcccagcu

SEQ ID NO: 3569291 - RNA, 12 nt, Pseudomonas putida KT2440
ccggcacaggaa

SEQ ID NO: 3569292 - RNA, 13 nt, Pseudomonas putida KT2440
ccggcaccaucuu

SEQ ID NO: 3569293 - RNA, 21 nt, Pseudomonas putida KT2440
ccggcaccccuuucuccagca

SEQ ID NO: 3569294 - RNA, 14 nt, Pseudomonas putida KT2440
ccggcaccgacagc

SEQ ID NO: 3569295 - RNA, 15 nt, Pseudomonas putida KT2440
ccggcaccgacagca

SEQ ID NO: 3569296 - RNA, 12 nt, Pseudomonas putida KT2440
ccggcaccgcca

SEQ ID NO: 3569297 - RNA, 15 nt, Pseudomonas putida KT2440
ccggcaccgccucua

SEQ ID NO: 3569298 - RNA, 16 nt, Pseudomonas putida KT2440
ccggcaccgcuugcac

SEQ ID NO: 3569299 - RNA, 21 nt, Pseudomonas putida KT2440
ccggcaccgggaugcucugca

SEQ ID NO: 3569300 - RNA, 22 nt, Pseudomonas putida KT2440
ccggcaccgggaugcucugcag

SEQ ID NO: 3569301 - RNA, 21 nt, Pseudomonas putida KT2440
ccggcaccugcuugccgcugg

SEQ ID NO: 3569302 - RNA, 15 nt, Pseudomonas putida KT2440
ccggcacgacuucgc

SEQ ID NO: 3569303 - RNA, 15 nt, Pseudomonas putida KT2440
ccggcacgcccgcuc

SEQ ID NO: 3569304 - RNA, 17 nt, Pseudomonas putida KT2440
ccggcacgcccgcuccc

SEQ ID NO: 3569305 - RNA, 20 nt, Pseudomonas putida KT2440
ccggcacgguugcgcccggc

SEQ ID NO: 3569306 - RNA, 14 nt, Pseudomonas putida KT2440
ccggcacuccagcg

SEQ ID NO: 3569307 - RNA, 17 nt, Pseudomonas putida KT2440
ccggcacuccagcgagu

SEQ ID NO: 3569308 - RNA, 19 nt, Pseudomonas putida KT2440
ccggcacuccagcgagugg

SEQ ID NO: 3569309 - RNA, 14 nt, Pseudomonas putida KT2440
ccggcacugcacag

SEQ ID NO: 3569310 - RNA, 17 nt, Pseudomonas putida KT2440
ccggcacuuccucguga

SEQ ID NO: 3569311 - RNA, 24 nt, Pseudomonas putida KT2440
ccggcagagccggugccauccacc

SEQ ID NO: 3569312 - RNA, 15 nt, Pseudomonas putida KT2440
ccggcagcaaggcau

SEQ ID NO: 3569313 - RNA, 15 nt, Pseudomonas putida KT2440
ccggcagcaccugcc

SEQ ID NO: 3569314 - RNA, 20 nt, Pseudomonas putida KT2440
ccggcagcaccugccagccg

SEQ ID NO: 3569315 - RNA, 23 nt, Pseudomonas putida KT2440
ccggcagcaccugccagccgcaa

SEQ ID NO: 3569316 - RNA, 18 nt, Pseudomonas putida KT2440
ccggcagcacgucggcgc

SEQ ID NO: 3569317 - RNA, 11 nt, Pseudomonas putida KT2440
ccggcagcagc

SEQ ID NO: 3569318 - RNA, 13 nt, Pseudomonas putida KT2440
ccggcagcagcaa

SEQ ID NO: 3569319 - RNA, 19 nt, Pseudomonas putida KT2440
ccggcagguaagucggcuc

SEQ ID NO: 3569320 - RNA, 22 nt, Pseudomonas putida KT2440
ccggcaggucgaugaucgccgc

SEQ ID NO: 3569321 - RNA, 19 nt, Pseudomonas putida KT2440
ccggcaggucggcaaccau

SEQ ID NO: 3569322 - RNA, 21 nt, Pseudomonas putida KT2440
ccggcaguacauagaacagca

SEQ ID NO: 3569323 - RNA, 16 nt, Pseudomonas putida KT2440
ccggcaguagaaaguc

SEQ ID NO: 3569324 - RNA, 18 nt, Pseudomonas putida KT2440
ccggcagugccuggaugc

SEQ ID NO: 3569325 - RNA, 20 nt, Pseudomonas putida KT2440
ccggcagugccuggaugcgg

SEQ ID NO: 3569326 - RNA, 19 nt, Pseudomonas putida KT2440
ccggcauaacggcuggcgc

SEQ ID NO: 3569327 - RNA, 20 nt, Pseudomonas putida KT2440
ccggcauacuugggcgcagu

SEQ ID NO: 3569328 - RNA, 22 nt, Pseudomonas putida KT2440
ccggcaucacuacccaggccaa

SEQ ID NO: 3569329 - RNA, 15 nt, Pseudomonas putida KT2440
ccggcaucgccaaca

SEQ ID NO: 3569330 - RNA, 20 nt, Pseudomonas putida KT2440
ccggcaucgcucaacuggcu

SEQ ID NO: 3569331 - RNA, 22 nt, Pseudomonas putida KT2440
ccggcaugaucagcuugaucug

SEQ ID NO: 3569332 - RNA, 23 nt, Pseudomonas putida KT2440
ccggcaugcgcguauccuugccc

SEQ ID NO: 3569333 - RNA, 13 nt, Pseudomonas putida KT2440
ccggcauggcgug

SEQ ID NO: 3569334 - RNA, 20 nt, Pseudomonas putida KT2440
ccggcauggcgugcccggca

SEQ ID NO: 3569335 - RNA, 14 nt, Pseudomonas putida KT2440
ccggcauucccggc

SEQ ID NO: 3569336 - RNA, 23 nt, Pseudomonas putida KT2440
ccggcauucccggcgccaugccc

SEQ ID NO: 3569337 - RNA, 23 nt, Pseudomonas putida KT2440
ccggcauugcccaacucugccgg

SEQ ID NO: 3569338 - RNA, 17 nt, Pseudomonas putida KT2440
ccggccaacaacgacug

SEQ ID NO: 3569339 - RNA, 15 nt, Pseudomonas putida KT2440
ccggccaaggucagc

SEQ ID NO: 3569340 - RNA, 21 nt, Pseudomonas putida KT2440
ccggccaccaggcgcggcagc

SEQ ID NO: 3569341 - RNA, 22 nt, Pseudomonas putida KT2440
ccggccaccaggcgcggcagca

SEQ ID NO: 3569342 - RNA, 22 nt, Pseudomonas putida KT2440
ccggccaccagugcuuccaggg

SEQ ID NO: 3569343 - RNA, 13 nt, Pseudomonas putida KT2440
ccggccagcaggu

SEQ ID NO: 3569344 - RNA, 15 nt, Pseudomonas putida KT2440
ccggccagcagguca

SEQ ID NO: 3569345 - RNA, 16 nt, Pseudomonas putida KT2440
ccggccagcaggucag

SEQ ID NO: 3569346 - RNA, 17 nt, Pseudomonas putida KT2440
ccggccagcaggucagc

SEQ ID NO: 3569347 - RNA, 18 nt, Pseudomonas putida KT2440
ccggccagcaggucagca

SEQ ID NO: 3569348 - RNA, 13 nt, Pseudomonas putida KT2440
ccggccagcgacc

SEQ ID NO: 3569349 - RNA, 21 nt, Pseudomonas putida KT2440
ccggccagcgauaaaccagca

SEQ ID NO: 3569350 - RNA, 17 nt, Pseudomonas putida KT2440
ccggccagcgccugcag

SEQ ID NO: 3569351 - RNA, 22 nt, Pseudomonas putida KT2440
ccggccagcgccugcaggccca

SEQ ID NO: 3569352 - RNA, 15 nt, Pseudomonas putida KT2440
ccggccagcgcgcug

SEQ ID NO: 3569353 - RNA, 17 nt, Pseudomonas putida KT2440
ccggccaggccggcggu

SEQ ID NO: 3569354 - RNA, 12 nt, Pseudomonas putida KT2440
ccggccagguca

SEQ ID NO: 3569355 - RNA, 18 nt, Pseudomonas putida KT2440
ccggccaggugccgggcu

SEQ ID NO: 3569356 - RNA, 13 nt, Pseudomonas putida KT2440
ccggccagugccu

SEQ ID NO: 3569357 - RNA, 15 nt, Pseudomonas putida KT2440
ccggccagugccuug

SEQ ID NO: 3569358 - RNA, 14 nt, Pseudomonas putida KT2440
ccggccaguggccu

SEQ ID NO: 3569359 - RNA, 19 nt, Pseudomonas putida KT2440
ccggcccaaggcaccaacu

SEQ ID NO: 3569360 - RNA, 14 nt, Pseudomonas putida KT2440
ccggcccaucccgc

SEQ ID NO: 3569361 - RNA, 23 nt, Pseudomonas putida KT2440
ccggcccaucccgcuucgccagc

SEQ ID NO: 3569362 - RNA, 13 nt, Pseudomonas putida KT2440
ccggccccagggu

SEQ ID NO: 3569363 - RNA, 22 nt, Pseudomonas putida KT2440
ccggccccaggguuaccuugau

SEQ ID NO: 3569364 - RNA, 15 nt, Pseudomonas putida KT2440
ccggccccccagcca

SEQ ID NO: 3569365 - RNA, 18 nt, Pseudomonas putida KT2440
ccggccccccagccagca

SEQ ID NO: 3569366 - RNA, 19 nt, Pseudomonas putida KT2440
ccggccccccagccagcag

SEQ ID NO: 3569367 - RNA, 20 nt, Pseudomonas putida KT2440
ccggccccccagccagcaga

SEQ ID NO: 3569368 - RNA, 23 nt, Pseudomonas putida KT2440
ccggccccugcucguugcugagc

SEQ ID NO: 3569369 - RNA, 17 nt, Pseudomonas putida KT2440
ccggcccggcuggccac

SEQ ID NO: 3569370 - RNA, 13 nt, Pseudomonas putida KT2440
ccggcccugaagg

SEQ ID NO: 3569371 - RNA, 19 nt, Pseudomonas putida KT2440
ccggcccugccuaccaccg

SEQ ID NO: 3569372 - RNA, 17 nt, Pseudomonas putida KT2440
ccggcccugcuggccaa

SEQ ID NO: 3569373 - RNA, 17 nt, Pseudomonas putida KT2440
ccggcccuucugcugcu

SEQ ID NO: 3569374 - RNA, 19 nt, Pseudomonas putida KT2440
ccggccgacacaccaaugg

SEQ ID NO: 3569375 - RNA, 23 nt, Pseudomonas putida KT2440
ccggccgacacaccaauggccau

SEQ ID NO: 3569376 - RNA, 15 nt, Pseudomonas putida KT2440
ccggccgcacuucug

SEQ ID NO: 3569377 - RNA, 17 nt, Pseudomonas putida KT2440
ccggccgccaggauggc

SEQ ID NO: 3569378 - RNA, 15 nt, Pseudomonas putida KT2440
ccggccgccgccaga

SEQ ID NO: 3569379 - RNA, 19 nt, Pseudomonas putida KT2440
ccggccgcgccaccgggcg

SEQ ID NO: 3569380 - RNA, 16 nt, Pseudomonas putida KT2440
ccggccgggcucuggg

SEQ ID NO: 3569381 - RNA, 17 nt, Pseudomonas putida KT2440
ccggccguggguccugc

SEQ ID NO: 3569382 - RNA, 18 nt, Pseudomonas putida KT2440
ccggccguguucaggcac

SEQ ID NO: 3569383 - RNA, 18 nt, Pseudomonas putida KT2440
ccggccuauucgcgggua

SEQ ID NO: 3569384 - RNA, 19 nt, Pseudomonas putida KT2440
ccggccucaauuccagucu

SEQ ID NO: 3569385 - RNA, 20 nt, Pseudomonas putida KT2440
ccggccucaauuccagucug

SEQ ID NO: 3569386 - RNA, 23 nt, Pseudomonas putida KT2440
ccggccucuucgcggccuugccc

SEQ ID NO: 3569387 - RNA, 18 nt, Pseudomonas putida KT2440
ccggccucuucgcgggca

SEQ ID NO: 3569388 - RNA, 19 nt, Pseudomonas putida KT2440
ccggccuguugcgcacugc

SEQ ID NO: 3569389 - RNA, 21 nt, Pseudomonas putida KT2440
ccggccuguugcgcacugccg

SEQ ID NO: 3569390 - RNA, 13 nt, Pseudomonas putida KT2440
ccggccuugccgc

SEQ ID NO: 3569391 - RNA, 20 nt, Pseudomonas putida KT2440
ccggccuugccgcuggcgau

SEQ ID NO: 3569392 - RNA, 19 nt, Pseudomonas putida KT2440
ccggccuugcgcaaggcaa

SEQ ID NO: 3569393 - RNA, 20 nt, Pseudomonas putida KT2440
ccggccuugcuccaguucau

SEQ ID NO: 3569394 - RNA, 14 nt, Pseudomonas putida KT2440
ccggccuuggccag

SEQ ID NO: 3569395 - RNA, 15 nt, Pseudomonas putida KT2440
ccggccuuggccagc

SEQ ID NO: 3569396 - RNA, 21 nt, Pseudomonas putida KT2440
ccggccuuucgcgccaguucg

SEQ ID NO: 3569397 - RNA, 13 nt, Pseudomonas putida KT2440
ccggcgaacagca

SEQ ID NO: 3569398 - RNA, 14 nt, Pseudomonas putida KT2440
ccggcgaagcacug

SEQ ID NO: 3569399 - RNA, 22 nt, Pseudomonas putida KT2440
ccggcgaagcacugucgauggc

SEQ ID NO: 3569400 - RNA, 19 nt, Pseudomonas putida KT2440
ccggcgaauccagccggcc

SEQ ID NO: 3569401 - RNA, 16 nt, Pseudomonas putida KT2440
ccggcgaguccugccu

SEQ ID NO: 3569402 - RNA, 17 nt, Pseudomonas putida KT2440
ccggcgaucugucaggu

SEQ ID NO: 3569403 - RNA, 18 nt, Pseudomonas putida KT2440
ccggcgcagaugguggca

SEQ ID NO: 3569404 - RNA, 12 nt, Pseudomonas putida KT2440
ccggcgcagcau

SEQ ID NO: 3569405 - RNA, 21 nt, Pseudomonas putida KT2440
ccggcgcauugauagcggcag

SEQ ID NO: 3569406 - RNA, 23 nt, Pseudomonas putida KT2440
ccggcgccaaucaucgccagcag

SEQ ID NO: 3569407 - RNA, 18 nt, Pseudomonas putida KT2440
ccggcgccaugccccccg

SEQ ID NO: 3569408 - RNA, 23 nt, Pseudomonas putida KT2440
ccggcgccaugccccccgccagc

SEQ ID NO: 3569409 - RNA, 22 nt, Pseudomonas putida KT2440
ccggcgccgccgaacucuggca

SEQ ID NO: 3569410 - RNA, 13 nt, Pseudomonas putida KT2440
ccggcgcgcagcg

SEQ ID NO: 3569411 - RNA, 18 nt, Pseudomonas putida KT2440
ccggcgcgcagcgcacuu

SEQ ID NO: 3569412 - RNA, 19 nt, Pseudomonas putida KT2440
ccggcgcugagcgacagca

SEQ ID NO: 3569413 - RNA, 20 nt, Pseudomonas putida KT2440
ccggcgcugcguuggccauc

SEQ ID NO: 3569414 - RNA, 22 nt, Pseudomonas putida KT2440
ccggcgcugcguuggccaucug

SEQ ID NO: 3569415 - RNA, 19 nt, Pseudomonas putida KT2440
ccggcgcuuugcgcaaccg

SEQ ID NO: 3569416 - RNA, 23 nt, Pseudomonas putida KT2440
ccggcggcgcgaaucagcgccuc

SEQ ID NO: 3569417 - RNA, 15 nt, Pseudomonas putida KT2440
ccggcggcggcguga

SEQ ID NO: 3569418 - RNA, 20 nt, Pseudomonas putida KT2440
ccggcggugaugccauugau

SEQ ID NO: 3569419 - RNA, 13 nt, Pseudomonas putida KT2440
ccggcgucgaaca

SEQ ID NO: 3569420 - RNA, 20 nt, Pseudomonas putida KT2440
ccggcgucgaucugcaggug

SEQ ID NO: 3569421 - RNA, 13 nt, Pseudomonas putida KT2440
ccggcguggcgag

SEQ ID NO: 3569422 - RNA, 16 nt, Pseudomonas putida KT2440
ccggcguggcgagcug

SEQ ID NO: 3569423 - RNA, 17 nt, Pseudomonas putida KT2440
ccggcguguccagcagg

SEQ ID NO: 3569424 - RNA, 22 nt, Pseudomonas putida KT2440
ccggcguuggcuuccacggcgc

SEQ ID NO: 3569425 - RNA, 16 nt, Pseudomonas putida KT2440
ccggcguuucuucgag

SEQ ID NO: 3569426 - RNA, 24 nt, Pseudomonas putida KT2440
ccggcuaggcgaucggcuuucauu

SEQ ID NO: 3569427 - RNA, 15 nt, Pseudomonas putida KT2440
ccggcuaucggacga

SEQ ID NO: 3569428 - RNA, 16 nt, Pseudomonas putida KT2440
ccggcuaucggccagc

SEQ ID NO: 3569429 - RNA, 15 nt, Pseudomonas putida KT2440
ccggcucaccgcagc

SEQ ID NO: 3569430 - RNA, 16 nt, Pseudomonas putida KT2440
ccggcucaccgcagcc

SEQ ID NO: 3569431 - RNA, 21 nt, Pseudomonas putida KT2440
ccggcucaccgcagcccagcg

SEQ ID NO: 3569432 - RNA, 13 nt, Pseudomonas putida KT2440
ccggcuccacacc

SEQ ID NO: 3569433 - RNA, 21 nt, Pseudomonas putida KT2440
ccggcuccacaccccaagcca

SEQ ID NO: 3569434 - RNA, 19 nt, Pseudomonas putida KT2440
ccggcuccaccugcuccag

SEQ ID NO: 3569435 - RNA, 22 nt, Pseudomonas putida KT2440
ccggcuccaccugcuccagcac

SEQ ID NO: 3569436 - RNA, 15 nt, Pseudomonas putida KT2440
ccggcuccagguacu

SEQ ID NO: 3569437 - RNA, 15 nt, Pseudomonas putida KT2440
ccggcucccccucca

SEQ ID NO: 3569438 - RNA, 16 nt, Pseudomonas putida KT2440
ccggcuccgcgcaagc

SEQ ID NO: 3569439 - RNA, 18 nt, Pseudomonas putida KT2440
ccggcucgcaugagccgg

SEQ ID NO: 3569440 - RNA, 14 nt, Pseudomonas putida KT2440
ccggcucgccauug

SEQ ID NO: 3569441 - RNA, 15 nt, Pseudomonas putida KT2440
ccggcucgguccggg

SEQ ID NO: 3569442 - RNA, 18 nt, Pseudomonas putida KT2440
ccggcugaaauggcggcc

SEQ ID NO: 3569443 - RNA, 23 nt, Pseudomonas putida KT2440
ccggcugaaauggcggcccagcc

SEQ ID NO: 3569444 - RNA, 21 nt, Pseudomonas putida KT2440
ccggcugaacuucaaccgcac

SEQ ID NO: 3569445 - RNA, 21 nt, Pseudomonas putida KT2440
ccggcugcagcuugaggccca

SEQ ID NO: 3569446 - RNA, 17 nt, Pseudomonas putida KT2440
ccggcugcggguaaugc

SEQ ID NO: 3569447 - RNA, 22 nt, Pseudomonas putida KT2440
ccggcugcugguucucuucacu

SEQ ID NO: 3569448 - RNA, 21 nt, Pseudomonas putida KT2440
ccggcuggaagcuucgcggau

SEQ ID NO: 3569449 - RNA, 22 nt, Pseudomonas putida KT2440
ccggcuggaagcuucgcggaua

SEQ ID NO: 3569450 - RNA, 14 nt, Pseudomonas putida KT2440
ccggcuggacaccu

SEQ ID NO: 3569451 - RNA, 16 nt, Pseudomonas putida KT2440
ccggcuggacaccucc

SEQ ID NO: 3569452 - RNA, 19 nt, Pseudomonas putida KT2440
ccggcuggacaccucccgc

SEQ ID NO: 3569453 - RNA, 20 nt, Pseudomonas putida KT2440
ccggcuggucgaaccaguac

SEQ ID NO: 3569454 - RNA, 21 nt, Pseudomonas putida KT2440
ccggcuggucgaaccaguacu

SEQ ID NO: 3569455 - RNA, 11 nt, Pseudomonas putida KT2440
ccggcuucgcc

SEQ ID NO: 3569456 - RNA, 22 nt, Pseudomonas putida KT2440
ccggcuucuaccacuggggcuu

SEQ ID NO: 3569457 - RNA, 22 nt, Pseudomonas putida KT2440
ccggcuugaccguuugcagcgu

SEQ ID NO: 3569458 - RNA, 22 nt, Pseudomonas putida KT2440
ccggcuugagcaguucauccgg

SEQ ID NO: 3569459 - RNA, 15 nt, Pseudomonas putida KT2440
ccggcuugccuucaa

SEQ ID NO: 3569460 - RNA, 24 nt, Pseudomonas putida KT2440
ccggcuugcgcccguaacggucac

SEQ ID NO: 3569461 - RNA, 22 nt, Pseudomonas putida KT2440
ccggcuugcuccaagugccgug

SEQ ID NO: 3569462 - RNA, 16 nt, Pseudomonas putida KT2440
ccggcuuggcaccucc

SEQ ID NO: 3569463 - RNA, 14 nt, Pseudomonas putida KT2440
ccggcuuguagccg

SEQ ID NO: 3569464 - RNA, 17 nt, Pseudomonas putida KT2440
ccggcuuugccgguguu

SEQ ID NO: 3569465 - RNA, 16 nt, Pseudomonas putida KT2440
ccgggaaaagccugcc

SEQ ID NO: 3569466 - RNA, 16 nt, Pseudomonas putida KT2440
ccgggaacagcagcac

SEQ ID NO: 3569467 - RNA, 16 nt, Pseudomonas putida KT2440
ccgggaacagccgcgc

SEQ ID NO: 3569468 - RNA, 20 nt, Pseudomonas putida KT2440
ccgggaacaggugcgcgcgc

SEQ ID NO: 3569469 - RNA, 21 nt, Pseudomonas putida KT2440
ccgggaagcgcccgcccacca

SEQ ID NO: 3569470 - RNA, 16 nt, Pseudomonas putida KT2440
ccgggacagcaccaug

SEQ ID NO: 3569471 - RNA, 23 nt, Pseudomonas putida KT2440
ccgggacagcaccaugcgcgggu

SEQ ID NO: 3569472 - RNA, 20 nt, Pseudomonas putida KT2440
ccgggagggcuuugcccucc

SEQ ID NO: 3569473 - RNA, 16 nt, Pseudomonas putida KT2440
ccgggagggugaacga

SEQ ID NO: 3569474 - RNA, 17 nt, Pseudomonas putida KT2440
ccgggaucaccgcaagc

SEQ ID NO: 3569475 - RNA, 20 nt, Pseudomonas putida KT2440
ccgggaucaccgcaagcugc

SEQ ID NO: 3569476 - RNA, 18 nt, Pseudomonas putida KT2440
ccgggaucgagaucaggu

SEQ ID NO: 3569477 - RNA, 21 nt, Pseudomonas putida KT2440
ccgggaucgagaucaggugga

SEQ ID NO: 3569478 - RNA, 19 nt, Pseudomonas putida KT2440
ccgggauggcggcgccugc

SEQ ID NO: 3569479 - RNA, 12 nt, Pseudomonas putida KT2440
ccgggcacauca

SEQ ID NO: 3569480 - RNA, 18 nt, Pseudomonas putida KT2440
ccgggcacaucaccagca

SEQ ID NO: 3569481 - RNA, 11 nt, Pseudomonas putida KT2440
ccgggcacugc

SEQ ID NO: 3569482 - RNA, 13 nt, Pseudomonas putida KT2440
ccgggcacugccc

SEQ ID NO: 3569483 - RNA, 15 nt, Pseudomonas putida KT2440
ccgggcagaccugcu

SEQ ID NO: 3569484 - RNA, 15 nt, Pseudomonas putida KT2440
ccgggcagagucguu

SEQ ID NO: 3569485 - RNA, 20 nt, Pseudomonas putida KT2440
ccgggcagguucgacucccg

SEQ ID NO: 3569486 - RNA, 15 nt, Pseudomonas putida KT2440
ccgggcaugcagguc

SEQ ID NO: 3569487 - RNA, 16 nt, Pseudomonas putida KT2440
ccgggcaugcaggucg

SEQ ID NO: 3569488 - RNA, 17 nt, Pseudomonas putida KT2440
ccgggcaugcaggucga

SEQ ID NO: 3569489 - RNA, 12 nt, Pseudomonas putida KT2440
caggucaugaug

SEQ ID NO: 3569490 - RNA, 20 nt, Pseudomonas putida KT2440
caggucaugaugcccgucgg

SEQ ID NO: 3569491 - RNA, 23 nt, Pseudomonas putida KT2440
caggucaugaugcccgucggcgu

SEQ ID NO: 3569492 - RNA, 16 nt, Pseudomonas putida KT2440
caggucaugcagguca

SEQ ID NO: 3569493 - RNA, 21 nt, Pseudomonas putida KT2440
caggucauguagcgccuggcc

SEQ ID NO: 3569494 - RNA, 23 nt, Pseudomonas putida KT2440
caggucauguagcgccuggccug

SEQ ID NO: 3569495 - RNA, 14 nt, Pseudomonas putida KT2440
cagguccaccuggu

SEQ ID NO: 3569496 - RNA, 12 nt, Pseudomonas putida KT2440
cagguccagcuc

SEQ ID NO: 3569497 - RNA, 14 nt, Pseudomonas putida KT2440
cagguccagcuccg

SEQ ID NO: 3569498 - RNA, 14 nt, Pseudomonas putida KT2440
cagguccaggcgca

SEQ ID NO: 3569499 - RNA, 20 nt, Pseudomonas putida KT2440
cagguccaguucgcgcaagc

SEQ ID NO: 3569500 - RNA, 17 nt, Pseudomonas putida KT2440
cagguccgagugcucga

SEQ ID NO: 3569501 - RNA, 19 nt, Pseudomonas putida KT2440
cagguccggaaacucacgc

SEQ ID NO: 3569502 - RNA, 21 nt, Pseudomonas putida KT2440
cagguccggaaacucacgcgc

SEQ ID NO: 3569503 - RNA, 21 nt, Pseudomonas putida KT2440
cagguccgguaacuggcccac

SEQ ID NO: 3569504 - RNA, 23 nt, Pseudomonas putida KT2440
cagguccgguaacuggcccaccc

SEQ ID NO: 3569505 - RNA, 13 nt, Pseudomonas putida KT2440
cagguccugcucc

SEQ ID NO: 3569506 - RNA, 15 nt, Pseudomonas putida KT2440
cagguccugcuccac

SEQ ID NO: 3569507 - RNA, 18 nt, Pseudomonas putida KT2440
cagguccugcuccacccg

SEQ ID NO: 3569508 - RNA, 15 nt, Pseudomonas putida KT2440
caggucgaacagccc

SEQ ID NO: 3569509 - RNA, 17 nt, Pseudomonas putida KT2440
caggucgaacagccccc

SEQ ID NO: 3569510 - RNA, 15 nt, Pseudomonas putida KT2440
caggucgacacccag

SEQ ID NO: 3569511 - RNA, 18 nt, Pseudomonas putida KT2440
caggucgacacccagcac

SEQ ID NO: 3569512 - RNA, 19 nt, Pseudomonas putida KT2440
caggucgacaugcaccacg

SEQ ID NO: 3569513 - RNA, 14 nt, Pseudomonas putida KT2440
caggucgacccgcg

SEQ ID NO: 3569514 - RNA, 16 nt, Pseudomonas putida KT2440
caggucgacccgcgcc

SEQ ID NO: 3569515 - RNA, 14 nt, Pseudomonas putida KT2440
caggucgaccgaga

SEQ ID NO: 3569516 - RNA, 20 nt, Pseudomonas putida KT2440
caggucgacgauacccagcg

SEQ ID NO: 3569517 - RNA, 21 nt, Pseudomonas putida KT2440
caggucgacgauacccagcgc

SEQ ID NO: 3569518 - RNA, 20 nt, Pseudomonas putida KT2440
caggucgacgaucgccgcca

SEQ ID NO: 3569519 - RNA, 16 nt, Pseudomonas putida KT2440
caggucgaucccgccg

SEQ ID NO: 3569520 - RNA, 17 nt, Pseudomonas putida KT2440
caggucgaucgcaacgu

SEQ ID NO: 3569521 - RNA, 21 nt, Pseudomonas putida KT2440
caggucgaugaucgccgccgc

SEQ ID NO: 3569522 - RNA, 20 nt, Pseudomonas putida KT2440
caggucgaugauggcugcca

SEQ ID NO: 3569523 - RNA, 12 nt, Pseudomonas putida KT2440
caggucgaugcc

SEQ ID NO: 3569524 - RNA, 13 nt, Pseudomonas putida KT2440
caggucgccagca

SEQ ID NO: 3569525 - RNA, 15 nt, Pseudomonas putida KT2440
caggucgccagcacc

SEQ ID NO: 3569526 - RNA, 16 nt, Pseudomonas putida KT2440
caggucgccagcacca

SEQ ID NO: 3569527 - RNA, 19 nt, Pseudomonas putida KT2440
caggucgccagcaccauca

SEQ ID NO: 3569528 - RNA, 16 nt, Pseudomonas putida KT2440
caggucgccaggcuuc

SEQ ID NO: 3569529 - RNA, 13 nt, Pseudomonas putida KT2440
caggucgccgcug

SEQ ID NO: 3569530 - RNA, 22 nt, Pseudomonas putida KT2440
caggucgccggugugcauccag

SEQ ID NO: 3569531 - RNA, 17 nt, Pseudomonas putida KT2440
caggucgccuugaaaag

SEQ ID NO: 3569532 - RNA, 22 nt, Pseudomonas putida KT2440
caggucgcgcugcagcuccuug

SEQ ID NO: 3569533 - RNA, 17 nt, Pseudomonas putida KT2440
caggucgcggagccaau

SEQ ID NO: 3569534 - RNA, 20 nt, Pseudomonas putida KT2440
caggucgcggagccaaucuc

SEQ ID NO: 3569535 - RNA, 17 nt, Pseudomonas putida KT2440
caggucgcggagccaga

SEQ ID NO: 3569536 - RNA, 23 nt, Pseudomonas putida KT2440
caggucgcgguucgacugccgcu

SEQ ID NO: 3569537 - RNA, 18 nt, Pseudomonas putida KT2440
caggucgcuaucggcagg

SEQ ID NO: 3569538 - RNA, 19 nt, Pseudomonas putida KT2440
caggucgcuaucggcaggc

SEQ ID NO: 3569539 - RNA, 19 nt, Pseudomonas putida KT2440
caggucggcaaccauggcu

SEQ ID NO: 3569540 - RNA, 17 nt, Pseudomonas putida KT2440
caggucggcacgcaccu

SEQ ID NO: 3569541 - RNA, 13 nt, Pseudomonas putida KT2440
caggucggccagc

SEQ ID NO: 3569542 - RNA, 15 nt, Pseudomonas putida KT2440
caggucggccagcuc

SEQ ID NO: 3569543 - RNA, 21 nt, Pseudomonas putida KT2440
caggucggcggccucggucca

SEQ ID NO: 3569544 - RNA, 23 nt, Pseudomonas putida KT2440
caggucggcggggcccggacagg

SEQ ID NO: 3569545 - RNA, 16 nt, Pseudomonas putida KT2440
caggucgggcuggcug

SEQ ID NO: 3569546 - RNA, 15 nt, Pseudomonas putida KT2440
caggucggggugauu

SEQ ID NO: 3569547 - RNA, 17 nt, Pseudomonas putida KT2440
caggucguaaucgcccg

SEQ ID NO: 3569548 - RNA, 16 nt, Pseudomonas putida KT2440
caggucucccgccccc

SEQ ID NO: 3569549 - RNA, 17 nt, Pseudomonas putida KT2440
caggucucgaacgcugu

SEQ ID NO: 3569550 - RNA, 18 nt, Pseudomonas putida KT2440
caggucucgaacgcugug

SEQ ID NO: 3569551 - RNA, 23 nt, Pseudomonas putida KT2440
caggucugccagugucaguugcu

SEQ ID NO: 3569552 - RNA, 20 nt, Pseudomonas putida KT2440
caggucuucgcgcuugagca

SEQ ID NO: 3569553 - RNA, 20 nt, Pseudomonas putida KT2440
caggugauagacguggcugu

SEQ ID NO: 3569554 - RNA, 20 nt, Pseudomonas putida KT2440
caggugaucgccacaacggc

SEQ ID NO: 3569555 - RNA, 20 nt, Pseudomonas putida KT2440
caggugaucguugcgcgcca

SEQ ID NO: 3569556 - RNA, 17 nt, Pseudomonas putida KT2440
caggugaugcaggcaau

SEQ ID NO: 3569557 - RNA, 19 nt, Pseudomonas putida KT2440
caggugauuuccucuucac

SEQ ID NO: 3569558 - RNA, 15 nt, Pseudomonas putida KT2440
caggugcaacccggc

SEQ ID NO: 3569559 - RNA, 17 nt, Pseudomonas putida KT2440
caggugcaacccggccu

SEQ ID NO: 3569560 - RNA, 20 nt, Pseudomonas putida KT2440
caggugcaacccggccuugg

SEQ ID NO: 3569561 - RNA, 14 nt, Pseudomonas putida KT2440
caggugcaccaaca

SEQ ID NO: 3569562 - RNA, 17 nt, Pseudomonas putida KT2440
caggugcaccuccgccc

SEQ ID NO: 3569563 - RNA, 13 nt, Pseudomonas putida KT2440
caggugcagccag

SEQ ID NO: 3569564 - RNA, 15 nt, Pseudomonas putida KT2440
caggugcagguucga

SEQ ID NO: 3569565 - RNA, 19 nt, Pseudomonas putida KT2440
caggugcagguucgaccac

SEQ ID NO: 3569566 - RNA, 22 nt, Pseudomonas putida KT2440
caggugccaacggucagacgcg

SEQ ID NO: 3569567 - RNA, 19 nt, Pseudomonas putida KT2440
caggugccaggcucaggcc

SEQ ID NO: 3569568 - RNA, 17 nt, Pseudomonas putida KT2440
caggugccguuccggca

SEQ ID NO: 3569569 - RNA, 19 nt, Pseudomonas putida KT2440
caggugccguuccggcaaa

SEQ ID NO: 3569570 - RNA, 15 nt, Pseudomonas putida KT2440
caggugccucugcug

SEQ ID NO: 3569571 - RNA, 13 nt, Pseudomonas putida KT2440
caggugcgaaucg

SEQ ID NO: 3569572 - RNA, 18 nt, Pseudomonas putida KT2440
caggugcgaaucgacgcg

SEQ ID NO: 3569573 - RNA, 21 nt, Pseudomonas putida KT2440
caggugcgcacgcugcccagg

SEQ ID NO: 3569574 - RNA, 17 nt, Pseudomonas putida KT2440
cagucagccagugcugc

SEQ ID NO: 3569575 - RNA, 12 nt, Pseudomonas putida KT2440
cagucagcgccg

SEQ ID NO: 3569576 - RNA, 16 nt, Pseudomonas putida KT2440
cagucagucggcugcu

SEQ ID NO: 3569577 - RNA, 12 nt, Pseudomonas putida KT2440
cagucauccaga

SEQ ID NO: 3569578 - RNA, 23 nt, Pseudomonas putida KT2440
cagucauccgggccgucaccgcu

SEQ ID NO: 3569579 - RNA, 13 nt, Pseudomonas putida KT2440
cagucauccucag

SEQ ID NO: 3569580 - RNA, 16 nt, Pseudomonas putida KT2440
caguccacuugcguuc

SEQ ID NO: 3569581 - RNA, 22 nt, Pseudomonas putida KT2440
caguccaucaccaccauuugaa

SEQ ID NO: 3569582 - RNA, 16 nt, Pseudomonas putida KT2440
cagucccagcaccgcg

SEQ ID NO: 3569583 - RNA, 17 nt, Pseudomonas putida KT2440
cagucccagcaccgcga

SEQ ID NO: 3569584 - RNA, 21 nt, Pseudomonas putida KT2440
cagucccaguugugacuagag

SEQ ID NO: 3569585 - RNA, 14 nt, Pseudomonas putida KT2440
caguccguuaccac

SEQ ID NO: 3569586 - RNA, 13 nt, Pseudomonas putida KT2440
caguccugcaacu

SEQ ID NO: 3569587 - RNA, 20 nt, Pseudomonas putida KT2440
caguccugcaacucggccuu

SEQ ID NO: 3569588 - RNA, 13 nt, Pseudomonas putida KT2440
cagucgaaaccga

SEQ ID NO: 3569589 - RNA, 19 nt, Pseudomonas putida KT2440
cagucgaaggggaucagca

SEQ ID NO: 3569590 - RNA, 22 nt, Pseudomonas putida KT2440
cagucgaaggggaucagcacgc

SEQ ID NO: 3569591 - RNA, 15 nt, Pseudomonas putida KT2440
cagucgaucagcgac

SEQ ID NO: 3569592 - RNA, 17 nt, Pseudomonas putida KT2440
cagucgaucagcgacac

SEQ ID NO: 3569593 - RNA, 19 nt, Pseudomonas putida KT2440
cagucgaucccgaggucag

SEQ ID NO: 3569594 - RNA, 17 nt, Pseudomonas putida KT2440
cagucgaugucgugguc

SEQ ID NO: 3569595 - RNA, 16 nt, Pseudomonas putida KT2440
cagucgcacaggucca

SEQ ID NO: 3569596 - RNA, 14 nt, Pseudomonas putida KT2440
cagucgccaaccgc

SEQ ID NO: 3569597 - RNA, 22 nt, Pseudomonas putida KT2440
cagucgccccgccagcgccugg

SEQ ID NO: 3569598 - RNA, 23 nt, Pseudomonas putida KT2440
cagucgccccgccagcgccuggc

SEQ ID NO: 3569599 - RNA, 18 nt, Pseudomonas putida KT2440
cagucgccgauacccgca

SEQ ID NO: 3569600 - RNA, 23 nt, Pseudomonas putida KT2440
cagucgccgauacccgcacgaac

SEQ ID NO: 3569601 - RNA, 16 nt, Pseudomonas putida KT2440
cagucgccuucguaca

SEQ ID NO: 3569602 - RNA, 21 nt, Pseudomonas putida KT2440
cagucgcgcaacugcccagga

SEQ ID NO: 3569603 - RNA, 17 nt, Pseudomonas putida KT2440
cagucggcgcuggacag

SEQ ID NO: 3569604 - RNA, 13 nt, Pseudomonas putida KT2440
cagucucuuucaa

SEQ ID NO: 3569605 - RNA, 22 nt, Pseudomonas putida KT2440
cagucucuuucaacagcuggcu

SEQ ID NO: 3569606 - RNA, 20 nt, Pseudomonas putida KT2440
cagucugcucagccaaccgc

SEQ ID NO: 3569607 - RNA, 18 nt, Pseudomonas putida KT2440
cagucuucguacaugcgc

SEQ ID NO: 3569608 - RNA, 14 nt, Pseudomonas putida KT2440
cagugaacaccacu

SEQ ID NO: 3569609 - RNA, 16 nt, Pseudomonas putida KT2440
cagugaacuccaacgc

SEQ ID NO: 3569610 - RNA, 18 nt, Pseudomonas putida KT2440
cagugaacuccaacgccg

SEQ ID NO: 3569611 - RNA, 18 nt, Pseudomonas putida KT2440
cagugaagcucgaucugc

SEQ ID NO: 3569612 - RNA, 20 nt, Pseudomonas putida KT2440
cagugaagcuuccaguuggc

SEQ ID NO: 3569613 - RNA, 22 nt, Pseudomonas putida KT2440
cagugaagcuuccaguuggccg

SEQ ID NO: 3569614 - RNA, 16 nt, Pseudomonas putida KT2440
cagugaauuccuugcu

SEQ ID NO: 3569615 - RNA, 20 nt, Pseudomonas putida KT2440
cagugacaggcagucauggg

SEQ ID NO: 3569616 - RNA, 18 nt, Pseudomonas putida KT2440
cagugagaaugcggaugu

SEQ ID NO: 3569617 - RNA, 22 nt, Pseudomonas putida KT2440
cagugagaaugcggauguaguu

SEQ ID NO: 3569618 - RNA, 21 nt, Pseudomonas putida KT2440
cagugaggucgggaauugcag

SEQ ID NO: 3569619 - RNA, 22 nt, Pseudomonas putida KT2440
cagugaucaucacacucgcccc

SEQ ID NO: 3569620 - RNA, 15 nt, Pseudomonas putida KT2440
cagugaucuggcgca

SEQ ID NO: 3569621 - RNA, 14 nt, Pseudomonas putida KT2440
cagugcaauaccag

SEQ ID NO: 3569622 - RNA, 17 nt, Pseudomonas putida KT2440
cagugcaauaccagccu

SEQ ID NO: 3569623 - RNA, 13 nt, Pseudomonas putida KT2440
cagugcaggucua

SEQ ID NO: 3569624 - RNA, 13 nt, Pseudomonas putida KT2440
cagugcaggugca

SEQ ID NO: 3569625 - RNA, 16 nt, Pseudomonas putida KT2440
cagugcaucgaagcag

SEQ ID NO: 3569626 - RNA, 15 nt, Pseudomonas putida KT2440
cagugccaucgccuc

SEQ ID NO: 3569627 - RNA, 22 nt, Pseudomonas putida KT2440
cagugccaugaacaccaccgcg

SEQ ID NO: 3569628 - RNA, 23 nt, Pseudomonas putida KT2440
cagugccaugaacaccaccgcga

SEQ ID NO: 3569629 - RNA, 14 nt, Pseudomonas putida KT2440
cagugcccagucga

SEQ ID NO: 3569630 - RNA, 22 nt, Pseudomonas putida KT2440
cagugccgcaagcagucccagc

SEQ ID NO: 3569631 - RNA, 17 nt, Pseudomonas putida KT2440
cagugccgcagucccgc

SEQ ID NO: 3569632 - RNA, 18 nt, Pseudomonas putida KT2440
cagugccgugaguggccu

SEQ ID NO: 3569633 - RNA, 13 nt, Pseudomonas putida KT2440
cagugccguggca

SEQ ID NO: 3569634 - RNA, 19 nt, Pseudomonas putida KT2440
cagugccucacgcaugccg

SEQ ID NO: 3569635 - RNA, 14 nt, Pseudomonas putida KT2440
cagugccugaccgg

SEQ ID NO: 3569636 - RNA, 18 nt, Pseudomonas putida KT2440
cagugccugaccggucag

SEQ ID NO: 3569637 - RNA, 13 nt, Pseudomonas putida KT2440
cagugccugcucc

SEQ ID NO: 3569638 - RNA, 18 nt, Pseudomonas putida KT2440
cagugccugggucagcuc

SEQ ID NO: 3569639 - RNA, 20 nt, Pseudomonas putida KT2440
cagugccugggucagcuccu

SEQ ID NO: 3569640 - RNA, 14 nt, Pseudomonas putida KT2440
cagugccugugaga

SEQ ID NO: 3569641 - RNA, 17 nt, Pseudomonas putida KT2440
cagugccuucaggcaca

SEQ ID NO: 3569642 - RNA, 21 nt, Pseudomonas putida KT2440
cagugccuucaggcacaccuc

SEQ ID NO: 3569643 - RNA, 22 nt, Pseudomonas putida KT2440
cagugccuucaggcacaccucg

SEQ ID NO: 3569644 - RNA, 18 nt, Pseudomonas putida KT2440
cagugcgcgcaacagugc

SEQ ID NO: 3569645 - RNA, 13 nt, Pseudomonas putida KT2440
cagugcggcaacc

SEQ ID NO: 3569646 - RNA, 16 nt, Pseudomonas putida KT2440
cagugcggucaggcca

SEQ ID NO: 3569647 - RNA, 23 nt, Pseudomonas putida KT2440
cagugcgguggauggcaccggcu

SEQ ID NO: 3569648 - RNA, 23 nt, Pseudomonas putida KT2440
cagugcgucggccaccaccgggu

SEQ ID NO: 3569649 - RNA, 13 nt, Pseudomonas putida KT2440
cagugcgugcagu

SEQ ID NO: 3569650 - RNA, 22 nt, Pseudomonas putida KT2440
cagugcugggcaugagccuggc

SEQ ID NO: 3569651 - RNA, 21 nt, Pseudomonas putida KT2440
cagugcuucacagcguugcag

SEQ ID NO: 3569652 - RNA, 20 nt, Pseudomonas putida KT2440
cagugcuucacugccggcaa

SEQ ID NO: 3569653 - RNA, 20 nt, Pseudomonas putida KT2440
cagugcuuccagggcgccgu

SEQ ID NO: 3569654 - RNA, 22 nt, Pseudomonas putida KT2440
caguggaaacgacaagguagcg

SEQ ID NO: 3569655 - RNA, 14 nt, Pseudomonas putida KT2440
caguggaccucugg

SEQ ID NO: 3569656 - RNA, 20 nt, Pseudomonas putida KT2440
caguggaccucuggcgugca

SEQ ID NO: 3569657 - RNA, 17 nt, Pseudomonas putida KT2440
caguggcaagccgagca

SEQ ID NO: 3569658 - RNA, 22 nt, Pseudomonas putida KT2440
caguggcacccacagcgccugc

SEQ ID NO: 3569659 - RNA, 16 nt, Pseudomonas putida KT2440
caguggcacuggcgcg

SEQ ID NO: 3569660 - RNA, 20 nt, Pseudomonas putida KT2440
caguggcacuggcgcgaugc

SEQ ID NO: 3569661 - RNA, 17 nt, Pseudomonas putida KT2440
caguggcagguucgacc

SEQ ID NO: 3569662 - RNA, 18 nt, Pseudomonas putida KT2440
caguggcagguucgacca

SEQ ID NO: 3569663 - RNA, 19 nt, Pseudomonas putida KT2440
caguggcagguucgaccac

SEQ ID NO: 3569664 - RNA, 23 nt, Pseudomonas putida KT2440
caguggcccgaugaucaggccgc

SEQ ID NO: 3569665 - RNA, 19 nt, Pseudomonas putida KT2440
caguggccgaguuggcuuc

SEQ ID NO: 3569666 - RNA, 23 nt, Pseudomonas putida KT2440
caguggcuguaccaggucuucaa

SEQ ID NO: 3569667 - RNA, 11 nt, Pseudomonas putida KT2440
cagugggagcg

SEQ ID NO: 3569668 - RNA, 13 nt, Pseudomonas putida KT2440
caguggucuucaa

SEQ ID NO: 3569669 - RNA, 18 nt, Pseudomonas putida KT2440
caguggucuucaaggcca

SEQ ID NO: 3569670 - RNA, 19 nt, Pseudomonas putida KT2440
caguggucuucaaggccac

SEQ ID NO: 3569671 - RNA, 18 nt, Pseudomonas putida KT2440
cagugguguacagcaaca

SEQ ID NO: 3569672 - RNA, 18 nt, Pseudomonas putida KT2440
cagugguugugcuggccc

SEQ ID NO: 3569673 - RNA, 22 nt, Pseudomonas putida KT2440
cagugguugugcuggcccuuuc

SEQ ID NO: 3569674 - RNA, 22 nt, Pseudomonas putida KT2440
caguguaaauagcugccaucca

SEQ ID NO: 3569675 - RNA, 14 nt, Pseudomonas putida KT2440
caguguacauggcc

SEQ ID NO: 3569676 - RNA, 21 nt, Pseudomonas putida KT2440
caguguagacaugaggcccuc

SEQ ID NO: 3569677 - RNA, 13 nt, Pseudomonas putida KT2440
cagugucaccgag

SEQ ID NO: 3569678 - RNA, 16 nt, Pseudomonas putida KT2440
cagugucagcggcgca

SEQ ID NO: 3569679 - RNA, 17 nt, Pseudomonas putida KT2440
cauagcccugcucgucc

SEQ ID NO: 3569680 - RNA, 16 nt, Pseudomonas putida KT2440
cauagcgcugcaccga

SEQ ID NO: 3569681 - RNA, 17 nt, Pseudomonas putida KT2440
cauagcgguacagcacc

SEQ ID NO: 3569682 - RNA, 20 nt, Pseudomonas putida KT2440
cauagcgguacagcacccag

SEQ ID NO: 3569683 - RNA, 16 nt, Pseudomonas putida KT2440
cauagcucagcuggau

SEQ ID NO: 3569684 - RNA, 20 nt, Pseudomonas putida KT2440
cauagcucauggucagccgg

SEQ ID NO: 3569685 - RNA, 19 nt, Pseudomonas putida KT2440
cauagcuggcacugcccaa

SEQ ID NO: 3569686 - RNA, 20 nt, Pseudomonas putida KT2440
cauaggcagccaccucgacc

SEQ ID NO: 3569687 - RNA, 13 nt, Pseudomonas putida KT2440
cauaggcugucac

SEQ ID NO: 3569688 - RNA, 18 nt, Pseudomonas putida KT2440
cauaggggcgguguggca

SEQ ID NO: 3569689 - RNA, 23 nt, Pseudomonas putida KT2440
cauagucgauacccaggcgcgcc

SEQ ID NO: 3569690 - RNA, 17 nt, Pseudomonas putida KT2440
cauagugugcucacggu

SEQ ID NO: 3569691 - RNA, 15 nt, Pseudomonas putida KT2440
cauauaccgcgcacg

SEQ ID NO: 3569692 - RNA, 22 nt, Pseudomonas putida KT2440
cauauaccgcgcacgcaucugc

SEQ ID NO: 3569693 - RNA, 13 nt, Pseudomonas putida KT2440
cauaucagccaac

SEQ ID NO: 3569694 - RNA, 16 nt, Pseudomonas putida KT2440
cauaucaggcaugcca

SEQ ID NO: 3569695 - RNA, 21 nt, Pseudomonas putida KT2440
cauaucaggcaugccagcagc

SEQ ID NO: 3569696 - RNA, 16 nt, Pseudomonas putida KT2440
cauauccgcaccgggc

SEQ ID NO: 3569697 - RNA, 23 nt, Pseudomonas putida KT2440
cauauccuuuguaggagcgggcu

SEQ ID NO: 3569698 - RNA, 20 nt, Pseudomonas putida KT2440
cauaucgcgaaacgcggcaa

SEQ ID NO: 3569699 - RNA, 14 nt, Pseudomonas putida KT2440
cauaugcagggccu

SEQ ID NO: 3569700 - RNA, 20 nt, Pseudomonas putida KT2440
cauauugcugagccaguuca

SEQ ID NO: 3569701 - RNA, 21 nt, Pseudomonas putida KT2440
cauauugcugagccaguucac

SEQ ID NO: 3569702 - RNA, 14 nt, Pseudomonas putida KT2440
caucaaaccagaua

SEQ ID NO: 3569703 - RNA, 22 nt, Pseudomonas putida KT2440
caucaaagacuccgcuucauca

SEQ ID NO: 3569704 - RNA, 23 nt, Pseudomonas putida KT2440
caucaaagacuccgcuucaucag

SEQ ID NO: 3569705 - RNA, 19 nt, Pseudomonas putida KT2440
caucaaauacucagaccaa

SEQ ID NO: 3569706 - RNA, 21 nt, Pseudomonas putida KT2440
caucaacucacuuucagcgcc

SEQ ID NO: 3569707 - RNA, 19 nt, Pseudomonas putida KT2440
caucaagcggcugguauug

SEQ ID NO: 3569708 - RNA, 14 nt, Pseudomonas putida KT2440
caucaagucauccg

SEQ ID NO: 3569709 - RNA, 20 nt, Pseudomonas putida KT2440
caucaauacgcuggaucacc

SEQ ID NO: 3569710 - RNA, 14 nt, Pseudomonas putida KT2440
caucaauauccagc

SEQ ID NO: 3569711 - RNA, 19 nt, Pseudomonas putida KT2440
caucaaugcaauguuuuca

SEQ ID NO: 3569712 - RNA, 17 nt, Pseudomonas putida KT2440
caucacacucgccccca

SEQ ID NO: 3569713 - RNA, 20 nt, Pseudomonas putida KT2440
caucaccacaaaaccuucca

SEQ ID NO: 3569714 - RNA, 15 nt, Pseudomonas putida KT2440
caucaccacccccag

SEQ ID NO: 3569715 - RNA, 17 nt, Pseudomonas putida KT2440
caucaccacgcccuggc

SEQ ID NO: 3569716 - RNA, 13 nt, Pseudomonas putida KT2440
caucaccagcccc

SEQ ID NO: 3569717 - RNA, 14 nt, Pseudomonas putida KT2440
caucaccagccccc

SEQ ID NO: 3569718 - RNA, 11 nt, Pseudomonas putida KT2440
caucacccagu

SEQ ID NO: 3569719 - RNA, 12 nt, Pseudomonas putida KT2440
caucacccgccc

SEQ ID NO: 3569720 - RNA, 16 nt, Pseudomonas putida KT2440
caucacccgcgaaugc

SEQ ID NO: 3569721 - RNA, 17 nt, Pseudomonas putida KT2440
caucacccgcgaaugcu

SEQ ID NO: 3569722 - RNA, 23 nt, Pseudomonas putida KT2440
caucacccgcgaaugcuccggcg

SEQ ID NO: 3569723 - RNA, 22 nt, Pseudomonas putida KT2440
caucacccgggaacagcagcac

SEQ ID NO: 3569724 - RNA, 22 nt, Pseudomonas putida KT2440
caucaccgccagcauggccgga

SEQ ID NO: 3569725 - RNA, 21 nt, Pseudomonas putida KT2440
caucaccgcgucgauacgcug

SEQ ID NO: 3569726 - RNA, 15 nt, Pseudomonas putida KT2440
caucaccggcaggug

SEQ ID NO: 3569727 - RNA, 18 nt, Pseudomonas putida KT2440
caucaccggccagcacuu

SEQ ID NO: 3569728 - RNA, 15 nt, Pseudomonas putida KT2440
caucaccggcguugg

SEQ ID NO: 3569729 - RNA, 19 nt, Pseudomonas putida KT2440
caucaccucgucgcucggg

SEQ ID NO: 3569730 - RNA, 21 nt, Pseudomonas putida KT2440
caucaccugcuuucaggugcu

SEQ ID NO: 3569731 - RNA, 15 nt, Pseudomonas putida KT2440
caucaccuuggccgc

SEQ ID NO: 3569732 - RNA, 19 nt, Pseudomonas putida KT2440
caucaccuuggccgcccgg

SEQ ID NO: 3569733 - RNA, 16 nt, Pseudomonas putida KT2440
caucacgaucaugcug

SEQ ID NO: 3569734 - RNA, 20 nt, Pseudomonas putida KT2440
caucacgaucaugcuggcca

SEQ ID NO: 3569735 - RNA, 14 nt, Pseudomonas putida KT2440
caucacgccgcgcu

SEQ ID NO: 3569736 - RNA, 17 nt, Pseudomonas putida KT2440
caucacgccgcgcuggc

SEQ ID NO: 3569737 - RNA, 21 nt, Pseudomonas putida KT2440
caucacgcgacgggaagugca

SEQ ID NO: 3569738 - RNA, 14 nt, Pseudomonas putida KT2440
caucacgcuggcca

SEQ ID NO: 3569739 - RNA, 16 nt, Pseudomonas putida KT2440
caucacggcgcaggcc

SEQ ID NO: 3569740 - RNA, 13 nt, Pseudomonas putida KT2440
caucacgucacag

SEQ ID NO: 3569741 - RNA, 15 nt, Pseudomonas putida KT2440
caucacgucacagcc

SEQ ID NO: 3569742 - RNA, 20 nt, Pseudomonas putida KT2440
caucacguuuggcagugcca

SEQ ID NO: 3569743 - RNA, 20 nt, Pseudomonas putida KT2440
caucacuagaucucgcuuca

SEQ ID NO: 3569744 - RNA, 23 nt, Pseudomonas putida KT2440
caucacuagaucucgcuucaugg

SEQ ID NO: 3569745 - RNA, 18 nt, Pseudomonas putida KT2440
caucacucuugcgccagu

SEQ ID NO: 3569746 - RNA, 12 nt, Pseudomonas putida KT2440
caucacuuccgg

SEQ ID NO: 3569747 - RNA, 17 nt, Pseudomonas putida KT2440
caucacuuccggcugca

SEQ ID NO: 3569748 - RNA, 22 nt, Pseudomonas putida KT2440
caucacuugcagcucguugugc

SEQ ID NO: 3569749 - RNA, 15 nt, Pseudomonas putida KT2440
caucagaccgccgau

SEQ ID NO: 3569750 - RNA, 14 nt, Pseudomonas putida KT2440
caucagagcgccag

SEQ ID NO: 3569751 - RNA, 21 nt, Pseudomonas putida KT2440
caucagagcgugaagcggaca

SEQ ID NO: 3569752 - RNA, 15 nt, Pseudomonas putida KT2440
caucagcaagccgcc

SEQ ID NO: 3569753 - RNA, 13 nt, Pseudomonas putida KT2440
caucagcacacgc

SEQ ID NO: 3569754 - RNA, 15 nt, Pseudomonas putida KT2440
caucagcacacgccc

SEQ ID NO: 3569755 - RNA, 14 nt, Pseudomonas putida KT2440
caucagcagcugcc

SEQ ID NO: 3569756 - RNA, 17 nt, Pseudomonas putida KT2440
caucagcagcugccgga

SEQ ID NO: 3569757 - RNA, 13 nt, Pseudomonas putida KT2440
caucagcagcugu

SEQ ID NO: 3569758 - RNA, 17 nt, Pseudomonas putida KT2440
caucagccgcgcccucu

SEQ ID NO: 3569759 - RNA, 19 nt, Pseudomonas putida KT2440
caucagccgcgcccucuuc

SEQ ID NO: 3569760 - RNA, 15 nt, Pseudomonas putida KT2440
caucagccgcgggcu

SEQ ID NO: 3569761 - RNA, 17 nt, Pseudomonas putida KT2440
caucagccgcgggcucg

SEQ ID NO: 3569762 - RNA, 22 nt, Pseudomonas putida KT2440
caucagccggucucccagcgcu

SEQ ID NO: 3569763 - RNA, 17 nt, Pseudomonas putida KT2440
caucagcgcacccuuug

SEQ ID NO: 3569764 - RNA, 19 nt, Pseudomonas putida KT2440
caucagcgcagcaucuucc

SEQ ID NO: 3569765 - RNA, 15 nt, Pseudomonas putida KT2440
caucaggaacagcuc

SEQ ID NO: 3569766 - RNA, 17 nt, Pseudomonas putida KT2440
caucaggaacagcucga

SEQ ID NO: 3569767 - RNA, 20 nt, Pseudomonas putida KT2440
caucaggacggucaugcuca

SEQ ID NO: 3569768 - RNA, 13 nt, Pseudomonas putida KT2440
caucaggcacagg

SEQ ID NO: 3569769 - RNA, 21 nt, Pseudomonas putida KT2440
caucaggccgaugccaagcac

SEQ ID NO: 3569770 - RNA, 23 nt, Pseudomonas putida KT2440
caucaggccgaugccaagcaccg

SEQ ID NO: 3569771 - RNA, 21 nt, Pseudomonas putida KT2440
caucagguagcugggcccgcc

SEQ ID NO: 3569772 - RNA, 19 nt, Pseudomonas putida KT2440
caucaggugcagcaacagg

SEQ ID NO: 3569773 - RNA, 16 nt, Pseudomonas putida KT2440
caucagugcccccgcc

SEQ ID NO: 3569774 - RNA, 18 nt, Pseudomonas putida KT2440
caucagugcccccgccac

SEQ ID NO: 3569775 - RNA, 13 nt, Pseudomonas putida KT2440
caucaucaucuuc

SEQ ID NO: 3569776 - RNA, 21 nt, Pseudomonas putida KT2440
caucaucggcaugcagcggcc

SEQ ID NO: 3569777 - RNA, 23 nt, Pseudomonas putida KT2440
caucaugauggucacgcggccgu

SEQ ID NO: 3569778 - RNA, 15 nt, Pseudomonas putida KT2440
caucaugccgcccau

SEQ ID NO: 3569779 - RNA, 17 nt, Pseudomonas putida KT2440
cauccaaagccaauuug

SEQ ID NO: 3569780 - RNA, 14 nt, Pseudomonas putida KT2440
cauccaacccugcg

SEQ ID NO: 3569781 - RNA, 18 nt, Pseudomonas putida KT2440
cauccaacccugcgccca

SEQ ID NO: 3569782 - RNA, 15 nt, Pseudomonas putida KT2440
cauccaacgcaucca

SEQ ID NO: 3569783 - RNA, 19 nt, Pseudomonas putida KT2440
cauccaacgcugccuugcc

SEQ ID NO: 3569784 - RNA, 23 nt, Pseudomonas putida KT2440
caucgauuucgccaucgcccguc

SEQ ID NO: 3569785 - RNA, 16 nt, Pseudomonas putida KT2440
caucgcagcggccgaa

SEQ ID NO: 3569786 - RNA, 19 nt, Pseudomonas putida KT2440
caucgcagggucgcgcccc

SEQ ID NO: 3569787 - RNA, 20 nt, Pseudomonas putida KT2440
caucgcagggucgcgcccca

SEQ ID NO: 3569788 - RNA, 16 nt, Pseudomonas putida KT2440
caucgcauacagcgca

SEQ ID NO: 3569789 - RNA, 16 nt, Pseudomonas putida KT2440
caucgcauaugcccca

SEQ ID NO: 3569790 - RNA, 18 nt, Pseudomonas putida KT2440
caucgccaaagccugagc

SEQ ID NO: 3569791 - RNA, 12 nt, Pseudomonas putida KT2440
caucgccaagcc

SEQ ID NO: 3569792 - RNA, 14 nt, Pseudomonas putida KT2440
caucgccaccggca

SEQ ID NO: 3569793 - RNA, 13 nt, Pseudomonas putida KT2440
caucgccagcagc

SEQ ID NO: 3569794 - RNA, 14 nt, Pseudomonas putida KT2440
caucgccagcagcg

SEQ ID NO: 3569795 - RNA, 16 nt, Pseudomonas putida KT2440
caucgccagcagcgcu

SEQ ID NO: 3569796 - RNA, 17 nt, Pseudomonas putida KT2440
caucgccagcagcgcuc

SEQ ID NO: 3569797 - RNA, 19 nt, Pseudomonas putida KT2440
caucgccaggccuucaucg

SEQ ID NO: 3569798 - RNA, 17 nt, Pseudomonas putida KT2440
caucgccaggugcucag

SEQ ID NO: 3569799 - RNA, 14 nt, Pseudomonas putida KT2440
caucgcccauugcc

SEQ ID NO: 3569800 - RNA, 17 nt, Pseudomonas putida KT2440
caucgcccauugccgga

SEQ ID NO: 3569801 - RNA, 18 nt, Pseudomonas putida KT2440
caucgccccaggagggcu

SEQ ID NO: 3569802 - RNA, 16 nt, Pseudomonas putida KT2440
caucgcccccgcugca

SEQ ID NO: 3569803 - RNA, 18 nt, Pseudomonas putida KT2440
caucgcccccgcugcaca

SEQ ID NO: 3569804 - RNA, 17 nt, Pseudomonas putida KT2440
caucgccccgcgccgcc

SEQ ID NO: 3569805 - RNA, 22 nt, Pseudomonas putida KT2440
caucgccgaggaauugcgccag

SEQ ID NO: 3569806 - RNA, 15 nt, Pseudomonas putida KT2440
caucgccggcacgcu

SEQ ID NO: 3569807 - RNA, 17 nt, Pseudomonas putida KT2440
caucgccggguccacca

SEQ ID NO: 3569808 - RNA, 19 nt, Pseudomonas putida KT2440
caucgccgucaucaccacu

SEQ ID NO: 3569809 - RNA, 13 nt, Pseudomonas putida KT2440
caucgccuccagc

SEQ ID NO: 3569810 - RNA, 20 nt, Pseudomonas putida KT2440
caucgccucggcacugcacg

SEQ ID NO: 3569811 - RNA, 13 nt, Pseudomonas putida KT2440
caucgcggccgaa

SEQ ID NO: 3569812 - RNA, 14 nt, Pseudomonas putida KT2440
caucgcggccgaag

SEQ ID NO: 3569813 - RNA, 22 nt, Pseudomonas putida KT2440
caucgcggccgaaggcgcuggc

SEQ ID NO: 3569814 - RNA, 13 nt, Pseudomonas putida KT2440
caucgcgggccag

SEQ ID NO: 3569815 - RNA, 15 nt, Pseudomonas putida KT2440
caucgcucaacuggc

SEQ ID NO: 3569816 - RNA, 14 nt, Pseudomonas putida KT2440
caucgcugcccggg

SEQ ID NO: 3569817 - RNA, 19 nt, Pseudomonas putida KT2440
caucgcugcggucaucacc

SEQ ID NO: 3569818 - RNA, 21 nt, Pseudomonas putida KT2440
caucgcuguccuuggccaacu

SEQ ID NO: 3569819 - RNA, 14 nt, Pseudomonas putida KT2440
caucggcaaacaca

SEQ ID NO: 3569820 - RNA, 15 nt, Pseudomonas putida KT2440
caucggcaaacacau

SEQ ID NO: 3569821 - RNA, 19 nt, Pseudomonas putida KT2440
caucggcaaacacauccag

SEQ ID NO: 3569822 - RNA, 15 nt, Pseudomonas putida KT2440
caucggcacccgcac

SEQ ID NO: 3569823 - RNA, 16 nt, Pseudomonas putida KT2440
caucggccucucucag

SEQ ID NO: 3569824 - RNA, 11 nt, Pseudomonas putida KT2440
caucggcgccu

SEQ ID NO: 3569825 - RNA, 16 nt, Pseudomonas putida KT2440
caucggcgcgacagcg

SEQ ID NO: 3569826 - RNA, 17 nt, Pseudomonas putida KT2440
caucggcgcgcccuccu

SEQ ID NO: 3569827 - RNA, 15 nt, Pseudomonas putida KT2440
caucggcggcaaugu

SEQ ID NO: 3569828 - RNA, 17 nt, Pseudomonas putida KT2440
caucggcggcaaugucg

SEQ ID NO: 3569829 - RNA, 13 nt, Pseudomonas putida KT2440
caucggcgucgcu

SEQ ID NO: 3569830 - RNA, 17 nt, Pseudomonas putida KT2440
caucggcguugcggugc

SEQ ID NO: 3569831 - RNA, 16 nt, Pseudomonas putida KT2440
caucggcuccagcgca

SEQ ID NO: 3569832 - RNA, 16 nt, Pseudomonas putida KT2440
caucgggaucagcacg

SEQ ID NO: 3569833 - RNA, 18 nt, Pseudomonas putida KT2440
caucgggcgcgucgucau

SEQ ID NO: 3569834 - RNA, 18 nt, Pseudomonas putida KT2440
caucggucaccggguaga

SEQ ID NO: 3569835 - RNA, 15 nt, Pseudomonas putida KT2440
caucggugcuuucug

SEQ ID NO: 3569836 - RNA, 23 nt, Pseudomonas putida KT2440
caucggugguuggacacaggccg

SEQ ID NO: 3569837 - RNA, 20 nt, Pseudomonas putida KT2440
caucguauuacccuucaucg

SEQ ID NO: 3569838 - RNA, 23 nt, Pseudomonas putida KT2440
caucguauuacccuucaucgccg

SEQ ID NO: 3569839 - RNA, 22 nt, Pseudomonas putida KT2440
caucguccuugcagggcaccag

SEQ ID NO: 3569840 - RNA, 12 nt, Pseudomonas putida KT2440
caucuaccagcu

SEQ ID NO: 3569841 - RNA, 18 nt, Pseudomonas putida KT2440
caucucaaggcuuuccac

SEQ ID NO: 3569842 - RNA, 18 nt, Pseudomonas putida KT2440
caucucaaucgcaugcag

SEQ ID NO: 3569843 - RNA, 20 nt, Pseudomonas putida KT2440
caucucaugcgagaugcccu

SEQ ID NO: 3569844 - RNA, 23 nt, Pseudomonas putida KT2440
caucuccaaugcgucaucgacuu

SEQ ID NO: 3569845 - RNA, 19 nt, Pseudomonas putida KT2440
caucuccacugcgccaaac

SEQ ID NO: 3569846 - RNA, 22 nt, Pseudomonas putida KT2440
caucuccagcucgccgcccagu

SEQ ID NO: 3569847 - RNA, 18 nt, Pseudomonas putida KT2440
caucuccauagguuaucc

SEQ ID NO: 3569848 - RNA, 18 nt, Pseudomonas putida KT2440
caucuccaugaaggccgg

SEQ ID NO: 3569849 - RNA, 16 nt, Pseudomonas putida KT2440
caucucgaucaugucg

SEQ ID NO: 3569850 - RNA, 15 nt, Pseudomonas putida KT2440
caucucgcccaugcg

SEQ ID NO: 3569851 - RNA, 20 nt, Pseudomonas putida KT2440
caucucggucgacaggggca

SEQ ID NO: 3569852 - RNA, 15 nt, Pseudomonas putida KT2440
caucugcaccggcag

SEQ ID NO: 3569853 - RNA, 20 nt, Pseudomonas putida KT2440
caucugcaccggcagcgcaa

SEQ ID NO: 3569854 - RNA, 20 nt, Pseudomonas putida KT2440
caucugccgggucggccugc

SEQ ID NO: 3569855 - RNA, 14 nt, Pseudomonas putida KT2440
caucugcgacugca

SEQ ID NO: 3569856 - RNA, 19 nt, Pseudomonas putida KT2440
caucugcgcacggaaggca

SEQ ID NO: 3569857 - RNA, 18 nt, Pseudomonas putida KT2440
caucugcgccaguggguu

SEQ ID NO: 3569858 - RNA, 16 nt, Pseudomonas putida KT2440
caucugcgccccgcuc

SEQ ID NO: 3569859 - RNA, 18 nt, Pseudomonas putida KT2440
caucugcgccccgcucgc

SEQ ID NO: 3569860 - RNA, 21 nt, Pseudomonas putida KT2440
caucugcgccccgcucgccug

SEQ ID NO: 3569861 - RNA, 23 nt, Pseudomonas putida KT2440
caucugcgccccgcucgccuggc

SEQ ID NO: 3569862 - RNA, 15 nt, Pseudomonas putida KT2440
caucugcucgccauc

SEQ ID NO: 3569863 - RNA, 13 nt, Pseudomonas putida KT2440
caucugcugaucu

SEQ ID NO: 3569864 - RNA, 20 nt, Pseudomonas putida KT2440
caucugcugaucuucccggg

SEQ ID NO: 3569865 - RNA, 19 nt, Pseudomonas putida KT2440
caucugcugcggcaggcug

SEQ ID NO: 3569866 - RNA, 20 nt, Pseudomonas putida KT2440
caucugucagcgccagcggc

SEQ ID NO: 3569867 - RNA, 14 nt, Pseudomonas putida KT2440
caucuucaccuugc

SEQ ID NO: 3569868 - RNA, 16 nt, Pseudomonas putida KT2440
caucuucacggcaagc

SEQ ID NO: 3569869 - RNA, 13 nt, Pseudomonas putida KT2440
caucuuccagccu

SEQ ID NO: 3569870 - RNA, 16 nt, Pseudomonas putida KT2440
caucuuccagccugca

SEQ ID NO: 3569871 - RNA, 21 nt, Pseudomonas putida KT2440
caucuuccggcaccccuuucu

SEQ ID NO: 3569872 - RNA, 15 nt, Pseudomonas putida KT2440
caucuuccugccacu

SEQ ID NO: 3569873 - RNA, 16 nt, Pseudomonas putida KT2440
caucuucgacaguuca

SEQ ID NO: 3569874 - RNA, 15 nt, Pseudomonas putida KT2440
caucuucugcagcca

SEQ ID NO: 3569875 - RNA, 16 nt, Pseudomonas putida KT2440
caucuucuuccccguc

SEQ ID NO: 3569876 - RNA, 18 nt, Pseudomonas putida KT2440
caucuucuugcaguucuu

SEQ ID NO: 3569877 - RNA, 20 nt, Pseudomonas putida KT2440
caucuugccauugucggcgc

SEQ ID NO: 3569878 - RNA, 21 nt, Pseudomonas putida KT2440
caucuugcccagggcugcuuc

SEQ ID NO: 3569879 - RNA, 20 nt, Pseudomonas putida KT2440
caucuugccccggugcccau

SEQ ID NO: 3569880 - RNA, 15 nt, Pseudomonas putida KT2440
caucuugcugcucug

SEQ ID NO: 3569881 - RNA, 16 nt, Pseudomonas putida KT2440
caucuugcugcucugc

SEQ ID NO: 3569882 - RNA, 17 nt, Pseudomonas putida KT2440
caucuugcugcucugca

SEQ ID NO: 3569883 - RNA, 18 nt, Pseudomonas putida KT2440
caucuuggugugggcgau

SEQ ID NO: 3569884 - RNA, 22 nt, Pseudomonas putida KT2440
caucuugguuggcggagccagc

SEQ ID NO: 3569885 - RNA, 19 nt, Pseudomonas putida KT2440
caugaaaaacaacaaccaa

SEQ ID NO: 3569886 - RNA, 16 nt, Pseudomonas putida KT2440
caugaaaccgcgugcc

SEQ ID NO: 3569887 - RNA, 18 nt, Pseudomonas putida KT2440
caugaaaccgcgugccga

SEQ ID NO: 3569888 - RNA, 21 nt, Pseudomonas putida KT2440
caugaaaccgcgugccgaauu

SEQ ID NO: 3569889 - RNA, 20 nt, Pseudomonas putida KT2440
caugcggcauagcgugcuuc

SEQ ID NO: 3569890 - RNA, 21 nt, Pseudomonas putida KT2440
caugcggccgugaacacgugg

SEQ ID NO: 3569891 - RNA, 19 nt, Pseudomonas putida KT2440
caugcggcucuguuucugc

SEQ ID NO: 3569892 - RNA, 23 nt, Pseudomonas putida KT2440
caugcggcucuguuucugccccu

SEQ ID NO: 3569893 - RNA, 18 nt, Pseudomonas putida KT2440
caugcgggccggcacgac

SEQ ID NO: 3569894 - RNA, 17 nt, Pseudomonas putida KT2440
caugcgggggccccacc

SEQ ID NO: 3569895 - RNA, 21 nt, Pseudomonas putida KT2440
caugcgggggccccaccaggc

SEQ ID NO: 3569896 - RNA, 22 nt, Pseudomonas putida KT2440
caugcgggggccccaccaggca

SEQ ID NO: 3569897 - RNA, 16 nt, Pseudomonas putida KT2440
caugcgguacagcacu

SEQ ID NO: 3569898 - RNA, 17 nt, Pseudomonas putida KT2440
caugcgguacagcacug

SEQ ID NO: 3569899 - RNA, 13 nt, Pseudomonas putida KT2440
caugcguucgcua

SEQ ID NO: 3569900 - RNA, 15 nt, Pseudomonas putida KT2440
caugcguucgcuacg

SEQ ID NO: 3569901 - RNA, 14 nt, Pseudomonas putida KT2440
caugcucaccagcu

SEQ ID NO: 3569902 - RNA, 12 nt, Pseudomonas putida KT2440
caugcucaccgc

SEQ ID NO: 3569903 - RNA, 15 nt, Pseudomonas putida KT2440
caugcucagcugggc

SEQ ID NO: 3569904 - RNA, 14 nt, Pseudomonas putida KT2440
caugcucaggaaca

SEQ ID NO: 3569905 - RNA, 14 nt, Pseudomonas putida KT2440
caugcuccugcgcc

SEQ ID NO: 3569906 - RNA, 18 nt, Pseudomonas putida KT2440
caugcuccugcgccaccu

SEQ ID NO: 3569907 - RNA, 16 nt, Pseudomonas putida KT2440
caugcucgcgggccug

SEQ ID NO: 3569908 - RNA, 14 nt, Pseudomonas putida KT2440
caugcucggccagc

SEQ ID NO: 3569909 - RNA, 18 nt, Pseudomonas putida KT2440
caugcucggccagcucgc

SEQ ID NO: 3569910 - RNA, 19 nt, Pseudomonas putida KT2440
caugcucggccagcucgcc

SEQ ID NO: 3569911 - RNA, 18 nt, Pseudomonas putida KT2440
caugcucggcggugccug

SEQ ID NO: 3569912 - RNA, 19 nt, Pseudomonas putida KT2440
caugcucugcgcaaaggcu

SEQ ID NO: 3569913 - RNA, 22 nt, Pseudomonas putida KT2440
caugcugaugcgguagugcagg

SEQ ID NO: 3569914 - RNA, 17 nt, Pseudomonas putida KT2440
caugcugcagaaccgcc

SEQ ID NO: 3569915 - RNA, 12 nt, Pseudomonas putida KT2440
caugcugcgaca

SEQ ID NO: 3569916 - RNA, 15 nt, Pseudomonas putida KT2440
caugcugcgacacgc

SEQ ID NO: 3569917 - RNA, 16 nt, Pseudomonas putida KT2440
caugcugcugcagcac

SEQ ID NO: 3569918 - RNA, 22 nt, Pseudomonas putida KT2440
caugcugcugcagcacugccug

SEQ ID NO: 3569919 - RNA, 14 nt, Pseudomonas putida KT2440
caugcuggccagga

SEQ ID NO: 3569920 - RNA, 16 nt, Pseudomonas putida KT2440
caugcuggccaggaug

SEQ ID NO: 3569921 - RNA, 16 nt, Pseudomonas putida KT2440
caugcuuggcgaaggu

SEQ ID NO: 3569922 - RNA, 20 nt, Pseudomonas putida KT2440
cauggaaauaacgcgggcaa

SEQ ID NO: 3569923 - RNA, 13 nt, Pseudomonas putida KT2440
cauggaagggcgg

SEQ ID NO: 3569924 - RNA, 16 nt, Pseudomonas putida KT2440
cauggcaaacagcacc

SEQ ID NO: 3569925 - RNA, 21 nt, Pseudomonas putida KT2440
cauggcaaccaugucgaacca

SEQ ID NO: 3569926 - RNA, 16 nt, Pseudomonas putida KT2440
cauggcaaucagcgac

SEQ ID NO: 3569927 - RNA, 19 nt, Pseudomonas putida KT2440
cauggcaaucagcgacaac

SEQ ID NO: 3569928 - RNA, 22 nt, Pseudomonas putida KT2440
cauggcagucguacgcgggcag

SEQ ID NO: 3569929 - RNA, 21 nt, Pseudomonas putida KT2440
cauggccacggugucggacag

SEQ ID NO: 3569930 - RNA, 13 nt, Pseudomonas putida KT2440
cauggccagcgug

SEQ ID NO: 3569931 - RNA, 21 nt, Pseudomonas putida KT2440
cauggccaggucggucagcac

SEQ ID NO: 3569932 - RNA, 21 nt, Pseudomonas putida KT2440
cauggcccugaucugccccuc

SEQ ID NO: 3569933 - RNA, 20 nt, Pseudomonas putida KT2440
cauggccgaaaccagccccu

SEQ ID NO: 3569934 - RNA, 15 nt, Pseudomonas putida KT2440
cauggcgacaauggc

SEQ ID NO: 3569935 - RNA, 23 nt, Pseudomonas putida KT2440
cauggcgaucucuucccuucugg

SEQ ID NO: 3569936 - RNA, 22 nt, Pseudomonas putida KT2440
cauggcgccgaugccgucgauu

SEQ ID NO: 3569937 - RNA, 13 nt, Pseudomonas putida KT2440
cauggcggcaccg

SEQ ID NO: 3569938 - RNA, 17 nt, Pseudomonas putida KT2440
cauggcgggcgacgaag

SEQ ID NO: 3569939 - RNA, 22 nt, Pseudomonas putida KT2440
cauggcgguauucacaccugcc

SEQ ID NO: 3569940 - RNA, 16 nt, Pseudomonas putida KT2440
cauggcgguccaccgc

SEQ ID NO: 3569941 - RNA, 18 nt, Pseudomonas putida KT2440
cauggcguuguccagcag

SEQ ID NO: 3569942 - RNA, 19 nt, Pseudomonas putida KT2440
cauggcguuguccagcagg

SEQ ID NO: 3569943 - RNA, 18 nt, Pseudomonas putida KT2440
cauggcucaacuggcagg

SEQ ID NO: 3569944 - RNA, 16 nt, Pseudomonas putida KT2440
cauggcucacacccag

SEQ ID NO: 3569945 - RNA, 18 nt, Pseudomonas putida KT2440
cauggcucacacccaggc

SEQ ID NO: 3569946 - RNA, 20 nt, Pseudomonas putida KT2440
cauggcuccacccaacgaac

SEQ ID NO: 3569947 - RNA, 19 nt, Pseudomonas putida KT2440
cauggcuggcagcacgauc

SEQ ID NO: 3569948 - RNA, 23 nt, Pseudomonas putida KT2440
cauggcuucgguggugaucauca

SEQ ID NO: 3569949 - RNA, 19 nt, Pseudomonas putida KT2440
caugggcagaguaaccgcg

SEQ ID NO: 3569950 - RNA, 14 nt, Pseudomonas putida KT2440
caugggcaggccca

SEQ ID NO: 3569951 - RNA, 21 nt, Pseudomonas putida KT2440
caugggccacggucuggcgca

SEQ ID NO: 3569952 - RNA, 15 nt, Pseudomonas putida KT2440
caugggccugcacga

SEQ ID NO: 3569953 - RNA, 23 nt, Pseudomonas putida KT2440
caugggcuuuucguuggccagcu

SEQ ID NO: 3569954 - RNA, 15 nt, Pseudomonas putida KT2440
cauggggacuccggc

SEQ ID NO: 3569955 - RNA, 14 nt, Pseudomonas putida KT2440
cauggggaugccga

SEQ ID NO: 3569956 - RNA, 15 nt, Pseudomonas putida KT2440
caugggucaacagga

SEQ ID NO: 3569957 - RNA, 17 nt, Pseudomonas putida KT2440
caugggucacucccggg

SEQ ID NO: 3569958 - RNA, 16 nt, Pseudomonas putida KT2440
caugguaaaagccgcc

SEQ ID NO: 3569959 - RNA, 15 nt, Pseudomonas putida KT2440
caugguaaagcccga

SEQ ID NO: 3569960 - RNA, 15 nt, Pseudomonas putida KT2440
caugguagauaagag

SEQ ID NO: 3569961 - RNA, 18 nt, Pseudomonas putida KT2440
cauggucaacagcccggu

SEQ ID NO: 3569962 - RNA, 22 nt, Pseudomonas putida KT2440
cauggucaacagcccggugaag

SEQ ID NO: 3569963 - RNA, 15 nt, Pseudomonas putida KT2440
cauggucaccacgcc

SEQ ID NO: 3569964 - RNA, 20 nt, Pseudomonas putida KT2440
cauggucagccggcagucac

SEQ ID NO: 3569965 - RNA, 22 nt, Pseudomonas putida KT2440
cauggucgcguuguucagcagc

SEQ ID NO: 3569966 - RNA, 16 nt, Pseudomonas putida KT2440
cauggugauggucugg

SEQ ID NO: 3569967 - RNA, 16 nt, Pseudomonas putida KT2440
cauggugcagggcguu

SEQ ID NO: 3569968 - RNA, 19 nt, Pseudomonas putida KT2440
cauggugggucguguagga

SEQ ID NO: 3569969 - RNA, 16 nt, Pseudomonas putida KT2440
caugguguucaugccc

SEQ ID NO: 3569970 - RNA, 21 nt, Pseudomonas putida KT2440
caugguguugggcaggguguc

SEQ ID NO: 3569971 - RNA, 14 nt, Pseudomonas putida KT2440
cauguaaagcagaa

SEQ ID NO: 3569972 - RNA, 17 nt, Pseudomonas putida KT2440
cauguaccgggcggcca

SEQ ID NO: 3569973 - RNA, 15 nt, Pseudomonas putida KT2440
cauguacugcagaca

SEQ ID NO: 3569974 - RNA, 16 nt, Pseudomonas putida KT2440
cauguagccaaucauc

SEQ ID NO: 3569975 - RNA, 17 nt, Pseudomonas putida KT2440
cauguagccaaucaucu

SEQ ID NO: 3569976 - RNA, 17 nt, Pseudomonas putida KT2440
cauguaggcgccgauca

SEQ ID NO: 3569977 - RNA, 20 nt, Pseudomonas putida KT2440
cauguccaggucacccuggu

SEQ ID NO: 3569978 - RNA, 16 nt, Pseudomonas putida KT2440
cauguccugaagcagg

SEQ ID NO: 3569979 - RNA, 18 nt, Pseudomonas putida KT2440
cauguccugcugcaggcu

SEQ ID NO: 3569980 - RNA, 20 nt, Pseudomonas putida KT2440
cauguccugcugcaggcucu

SEQ ID NO: 3569981 - RNA, 14 nt, Pseudomonas putida KT2440
cauguccuugcugc

SEQ ID NO: 3569982 - RNA, 15 nt, Pseudomonas putida KT2440
cauguccuugcugcg

SEQ ID NO: 3569983 - RNA, 18 nt, Pseudomonas putida KT2440
cauguccuuggcccagcc

SEQ ID NO: 3569984 - RNA, 23 nt, Pseudomonas putida KT2440
cauguccuuggcccagccaucga

SEQ ID NO: 3569985 - RNA, 17 nt, Pseudomonas putida KT2440
caugucgaaccacaucg

SEQ ID NO: 3569986 - RNA, 16 nt, Pseudomonas putida KT2440
caugucggaagccugc

SEQ ID NO: 3569987 - RNA, 16 nt, Pseudomonas putida KT2440
caugucuucgcccggu

SEQ ID NO: 3569988 - RNA, 22 nt, Pseudomonas putida KT2440
caugugccgcucguacuggucg

SEQ ID NO: 3569989 - RNA, 21 nt, Pseudomonas putida KT2440
caugugcggguucucccccau

SEQ ID NO: 3569990 - RNA, 23 nt, Pseudomonas putida KT2440
caugugcucggguucguacaggu

SEQ ID NO: 3569991 - RNA, 20 nt, Pseudomonas putida KT2440
cauguuacggcccaggggca

SEQ ID NO: 3569992 - RNA, 14 nt, Pseudomonas putida KT2440
cauguucaucaccg

SEQ ID NO: 3569993 - RNA, 20 nt, Pseudomonas putida KT2440
cauguucaucaccggccagc

SEQ ID NO: 3569994 - RNA, 15 nt, Pseudomonas putida KT2440
ccaaaggaggcuguu

SEQ ID NO: 3569995 - RNA, 21 nt, Pseudomonas putida KT2440
ccaaagguuucggcauagcgc

SEQ ID NO: 3569996 - RNA, 17 nt, Pseudomonas putida KT2440
ccaaaguccugcaaagg

SEQ ID NO: 3569997 - RNA, 18 nt, Pseudomonas putida KT2440
ccaaaguccugcaaaggc

SEQ ID NO: 3569998 - RNA, 20 nt, Pseudomonas putida KT2440
ccaaaucccuuugcccgcca

SEQ ID NO: 3569999 - RNA, 14 nt, Pseudomonas putida KT2440
ccaacaacagucaa

SEQ ID NO: 3570000 - RNA, 19 nt, Pseudomonas putida KT2440
ccaacaaucgcgucagcac

SEQ ID NO: 3570001 - RNA, 19 nt, Pseudomonas putida KT2440
ccaacacggugaugcgccc

SEQ ID NO: 3570002 - RNA, 19 nt, Pseudomonas putida KT2440
ccaacagcaccggccaggc

SEQ ID NO: 3570003 - RNA, 20 nt, Pseudomonas putida KT2440
ccaacagcaguugcugcugc

SEQ ID NO: 3570004 - RNA, 20 nt, Pseudomonas putida KT2440
ccaacagcauccaaagccaa

SEQ ID NO: 3570005 - RNA, 12 nt, Pseudomonas putida KT2440
ccaacaggcucu

SEQ ID NO: 3570006 - RNA, 11 nt, Pseudomonas putida KT2440
ccaacaggcug

SEQ ID NO: 3570007 - RNA, 20 nt, Pseudomonas putida KT2440
ccaacaguugaccaaggaac

SEQ ID NO: 3570008 - RNA, 17 nt, Pseudomonas putida KT2440
ccaaccacgccugcgcc

SEQ ID NO: 3570009 - RNA, 18 nt, Pseudomonas putida KT2440
ccaaccacgccugcgccg

SEQ ID NO: 3570010 - RNA, 16 nt, Pseudomonas putida KT2440
ccaaccaugcuggcca

SEQ ID NO: 3570011 - RNA, 17 nt, Pseudomonas putida KT2440
ccaaccaugcuggccaa

SEQ ID NO: 3570012 - RNA, 13 nt, Pseudomonas putida KT2440
ccaacccagccag

SEQ ID NO: 3570013 - RNA, 15 nt, Pseudomonas putida KT2440
ccaaccccagcgcau

SEQ ID NO: 3570014 - RNA, 18 nt, Pseudomonas putida KT2440
ccaacccggucccgcccu

SEQ ID NO: 3570015 - RNA, 21 nt, Pseudomonas putida KT2440
ccaacccggucccgcccucca

SEQ ID NO: 3570016 - RNA, 20 nt, Pseudomonas putida KT2440
ccaacccucacucgcggcca

SEQ ID NO: 3570017 - RNA, 20 nt, Pseudomonas putida KT2440
ccaaccgagucaacacggcu

SEQ ID NO: 3570018 - RNA, 15 nt, Pseudomonas putida KT2440
ccaaccgccccaccc

SEQ ID NO: 3570019 - RNA, 18 nt, Pseudomonas putida KT2440
ccaaccgcgacucguccg

SEQ ID NO: 3570020 - RNA, 22 nt, Pseudomonas putida KT2440
ccaaccgcgugcuucaucgcug

SEQ ID NO: 3570021 - RNA, 17 nt, Pseudomonas putida KT2440
ccaaccgcuucaccgcg

SEQ ID NO: 3570022 - RNA, 18 nt, Pseudomonas putida KT2440
ccaaccgcuucaccgcgc

SEQ ID NO: 3570023 - RNA, 20 nt, Pseudomonas putida KT2440
ccaaccgcuucaccgcgcac

SEQ ID NO: 3570024 - RNA, 16 nt, Pseudomonas putida KT2440
ccaaccggcuuguagc

SEQ ID NO: 3570025 - RNA, 22 nt, Pseudomonas putida KT2440
ccaaccguacccuuccuggaga

SEQ ID NO: 3570026 - RNA, 17 nt, Pseudomonas putida KT2440
ccaaccguuccugcagg

SEQ ID NO: 3570027 - RNA, 16 nt, Pseudomonas putida KT2440
ccaaccuccaggucau

SEQ ID NO: 3570028 - RNA, 16 nt, Pseudomonas putida KT2440
ccaaccugaucauuca

SEQ ID NO: 3570029 - RNA, 17 nt, Pseudomonas putida KT2440
ccaaccugaucauucac

SEQ ID NO: 3570030 - RNA, 14 nt, Pseudomonas putida KT2440
ccaaccugccaugc

SEQ ID NO: 3570031 - RNA, 22 nt, Pseudomonas putida KT2440
ccaaccugccaugcaggucgac

SEQ ID NO: 3570032 - RNA, 13 nt, Pseudomonas putida KT2440
ccaacgauuggca

SEQ ID NO: 3570033 - RNA, 21 nt, Pseudomonas putida KT2440
ccaacgcaaauccuccugcgc

SEQ ID NO: 3570034 - RNA, 12 nt, Pseudomonas putida KT2440
ccaacgcagcau

SEQ ID NO: 3570035 - RNA, 21 nt, Pseudomonas putida KT2440
ccaacgcauccaggcguucau

SEQ ID NO: 3570036 - RNA, 21 nt, Pseudomonas putida KT2440
ccaacgccaguugucgcuggg

SEQ ID NO: 3570037 - RNA, 12 nt, Pseudomonas putida KT2440
ccaacgccccag

SEQ ID NO: 3570038 - RNA, 20 nt, Pseudomonas putida KT2440
ccaacgccgauagccagcug

SEQ ID NO: 3570039 - RNA, 14 nt, Pseudomonas putida KT2440
ccaacgccugaagc

SEQ ID NO: 3570040 - RNA, 19 nt, Pseudomonas putida KT2440
ccaacgcgccgauugcugc

SEQ ID NO: 3570041 - RNA, 22 nt, Pseudomonas putida KT2440
ccaacgggcggaacuggcccug

SEQ ID NO: 3570042 - RNA, 17 nt, Pseudomonas putida KT2440
ccaacgucaaccgugcc

SEQ ID NO: 3570043 - RNA, 13 nt, Pseudomonas putida KT2440
ccaacuccagcgc

SEQ ID NO: 3570044 - RNA, 15 nt, Pseudomonas putida KT2440
ccaacuccccaccca

SEQ ID NO: 3570045 - RNA, 23 nt, Pseudomonas putida KT2440
ccaacuccuucucgcccacgauc

SEQ ID NO: 3570046 - RNA, 23 nt, Pseudomonas putida KT2440
ccaacuccuugcgcaucaagcgg

SEQ ID NO: 3570047 - RNA, 21 nt, Pseudomonas putida KT2440
ccaacucgccauucaccagcu

SEQ ID NO: 3570048 - RNA, 16 nt, Pseudomonas putida KT2440
ccaacucgcgcaucca

SEQ ID NO: 3570049 - RNA, 19 nt, Pseudomonas putida KT2440
ccaacugcacccgccagcc

SEQ ID NO: 3570050 - RNA, 18 nt, Pseudomonas putida KT2440
ccaacugcgcccgccccu

SEQ ID NO: 3570051 - RNA, 13 nt, Pseudomonas putida KT2440
ccaacugcucuac

SEQ ID NO: 3570052 - RNA, 23 nt, Pseudomonas putida KT2440
ccaacugcucuaccaacugagcu

SEQ ID NO: 3570053 - RNA, 20 nt, Pseudomonas putida KT2440
ccaacuggcgaauacgcuca

SEQ ID NO: 3570054 - RNA, 14 nt, Pseudomonas putida KT2440
ccaacuugcgcagu

SEQ ID NO: 3570055 - RNA, 22 nt, Pseudomonas putida KT2440
ccaacuugcgcaguaacaggcg

SEQ ID NO: 3570056 - RNA, 20 nt, Pseudomonas putida KT2440
ccaagccacuggccagcaga

SEQ ID NO: 3570057 - RNA, 17 nt, Pseudomonas putida KT2440
ccaagccauccaccagc

SEQ ID NO: 3570058 - RNA, 13 nt, Pseudomonas putida KT2440
ccaagccggcuuu

SEQ ID NO: 3570059 - RNA, 16 nt, Pseudomonas putida KT2440
ccaagccugaggcugc

SEQ ID NO: 3570060 - RNA, 13 nt, Pseudomonas putida KT2440
ccaagcgucggcc

SEQ ID NO: 3570061 - RNA, 17 nt, Pseudomonas putida KT2440
ccaagcgucggccaccu

SEQ ID NO: 3570062 - RNA, 14 nt, Pseudomonas putida KT2440
ccaaggcaccaacu

SEQ ID NO: 3570063 - RNA, 16 nt, Pseudomonas putida KT2440
ccaaggcaccaacugc

SEQ ID NO: 3570064 - RNA, 12 nt, Pseudomonas putida KT2440
ccaaggcaucca

SEQ ID NO: 3570065 - RNA, 14 nt, Pseudomonas putida KT2440
ccaaggccaacugc

SEQ ID NO: 3570066 - RNA, 17 nt, Pseudomonas putida KT2440
ccaaggccaacugcgcc

SEQ ID NO: 3570067 - RNA, 19 nt, Pseudomonas putida KT2440
ccaaggccaacugcgcccg

SEQ ID NO: 3570068 - RNA, 15 nt, Pseudomonas putida KT2440
ccaaggccgcccagu

SEQ ID NO: 3570069 - RNA, 22 nt, Pseudomonas putida KT2440
ccaaggccucuaccgcugcucc

SEQ ID NO: 3570070 - RNA, 18 nt, Pseudomonas putida KT2440
ccaaggcgagggcuucgc

SEQ ID NO: 3570071 - RNA, 20 nt, Pseudomonas putida KT2440
ccaaggcgguggaguaccug

SEQ ID NO: 3570072 - RNA, 20 nt, Pseudomonas putida KT2440
ccaaggcugacgccaguugg

SEQ ID NO: 3570073 - RNA, 15 nt, Pseudomonas putida KT2440
ccaaggcuggccaga

SEQ ID NO: 3570074 - RNA, 15 nt, Pseudomonas putida KT2440
ccaagggcucgucca

SEQ ID NO: 3570075 - RNA, 18 nt, Pseudomonas putida KT2440
ccaagggucgacaccagg

SEQ ID NO: 3570076 - RNA, 22 nt, Pseudomonas putida KT2440
ccaaggguuugccaggcgcagu

SEQ ID NO: 3570077 - RNA, 16 nt, Pseudomonas putida KT2440
ccaagguaaucuggcu

SEQ ID NO: 3570078 - RNA, 18 nt, Pseudomonas putida KT2440
ccaaggucagcaagccgc

SEQ ID NO: 3570079 - RNA, 17 nt, Pseudomonas putida KT2440
ccaagguccagccacga

SEQ ID NO: 3570080 - RNA, 18 nt, Pseudomonas putida KT2440
ccaaggugcacaccuugg

SEQ ID NO: 3570081 - RNA, 17 nt, Pseudomonas putida KT2440
ccaagguugccaccagc

SEQ ID NO: 3570082 - RNA, 19 nt, Pseudomonas putida KT2440
ccaaguacaacugccaccc

SEQ ID NO: 3570083 - RNA, 19 nt, Pseudomonas putida KT2440
ccaaguacaccggcagcac

SEQ ID NO: 3570084 - RNA, 20 nt, Pseudomonas putida KT2440
ccaaguggcuggacaagcca

SEQ ID NO: 3570085 - RNA, 20 nt, Pseudomonas putida KT2440
ccaaguguuugaagcuaaac

SEQ ID NO: 3570086 - RNA, 18 nt, Pseudomonas putida KT2440
ccaauaaaaaaccggcca

SEQ ID NO: 3570087 - RNA, 17 nt, Pseudomonas putida KT2440
ccaauaaaaacaacagg

SEQ ID NO: 3570088 - RNA, 14 nt, Pseudomonas putida KT2440
ccaauaauaaaaaa

SEQ ID NO: 3570089 - RNA, 13 nt, Pseudomonas putida KT2440
ccaauagcccgcu

SEQ ID NO: 3570090 - RNA, 14 nt, Pseudomonas putida KT2440
ccaaucaccugcac

SEQ ID NO: 3570091 - RNA, 14 nt, Pseudomonas putida KT2440
ccaaucaucgccag

SEQ ID NO: 3570092 - RNA, 17 nt, Pseudomonas putida KT2440
ccaaucaucgccagcag

SEQ ID NO: 3570093 - RNA, 19 nt, Pseudomonas putida KT2440
ccaaucaucgccagcagcg

SEQ ID NO: 3570094 - RNA, 17 nt, Pseudomonas putida KT2440
ccaaucgagauguaguc

SEQ ID NO: 3570095 - RNA, 15 nt, Pseudomonas putida KT2440
ccaaucgaucugcuc

SEQ ID NO: 3570096 - RNA, 23 nt, Pseudomonas putida KT2440
ccaaucgaucugcucgcccaccg

SEQ ID NO: 3570097 - RNA, 14 nt, Pseudomonas putida KT2440
ccaaucgcaugcuc

SEQ ID NO: 3570098 - RNA, 17 nt, Pseudomonas putida KT2440
ccaaucgccgcaaccgc

SEQ ID NO: 3570099 - RNA, 15 nt, Pseudomonas putida KT2440
ccaccagaugaccaa

SEQ ID NO: 3570100 - RNA, 17 nt, Pseudomonas putida KT2440
ccaccagauucgccaag

SEQ ID NO: 3570101 - RNA, 17 nt, Pseudomonas putida KT2440
ccaccagcacugcugcg

SEQ ID NO: 3570102 - RNA, 14 nt, Pseudomonas putida KT2440
ccaccagcaucaac

SEQ ID NO: 3570103 - RNA, 18 nt, Pseudomonas putida KT2440
ccaccagcaucagcgagg

SEQ ID NO: 3570104 - RNA, 15 nt, Pseudomonas putida KT2440
ccaccagcauggcgu

SEQ ID NO: 3570105 - RNA, 12 nt, Pseudomonas putida KT2440
ccaccagcccca

SEQ ID NO: 3570106 - RNA, 14 nt, Pseudomonas putida KT2440
ccaccagccccagc

SEQ ID NO: 3570107 - RNA, 17 nt, Pseudomonas putida KT2440
ccaccagccccagcgcc

SEQ ID NO: 3570108 - RNA, 12 nt, Pseudomonas putida KT2440
ccaccagcccga

SEQ ID NO: 3570109 - RNA, 15 nt, Pseudomonas putida KT2440
ccaccagcccguccg

SEQ ID NO: 3570110 - RNA, 14 nt, Pseudomonas putida KT2440
ccaccagcccuucg

SEQ ID NO: 3570111 - RNA, 16 nt, Pseudomonas putida KT2440
ccaccagcgcccuuca

SEQ ID NO: 3570112 - RNA, 18 nt, Pseudomonas putida KT2440
ccaccagcgcccuucacg

SEQ ID NO: 3570113 - RNA, 19 nt, Pseudomonas putida KT2440
ccaccagcgccgccaaaaa

SEQ ID NO: 3570114 - RNA, 19 nt, Pseudomonas putida KT2440
ccaccagcucacgcaagcg

SEQ ID NO: 3570115 - RNA, 17 nt, Pseudomonas putida KT2440
ccaccaggaacaucgcc

SEQ ID NO: 3570116 - RNA, 13 nt, Pseudomonas putida KT2440
ccaccaggccgau

SEQ ID NO: 3570117 - RNA, 21 nt, Pseudomonas putida KT2440
ccaccaggccgaucaccagca

SEQ ID NO: 3570118 - RNA, 15 nt, Pseudomonas putida KT2440
ccaccaggcuggcca

SEQ ID NO: 3570119 - RNA, 20 nt, Pseudomonas putida KT2440
ccaccaggguggcgauccac

SEQ ID NO: 3570120 - RNA, 23 nt, Pseudomonas putida KT2440
ccaccaggguggcgauccacagc

SEQ ID NO: 3570121 - RNA, 19 nt, Pseudomonas putida KT2440
ccaccaggugcuugcggaa

SEQ ID NO: 3570122 - RNA, 21 nt, Pseudomonas putida KT2440
ccaccaggugcuugcggaaca

SEQ ID NO: 3570123 - RNA, 12 nt, Pseudomonas putida KT2440
ccaccagugcuu

SEQ ID NO: 3570124 - RNA, 13 nt, Pseudomonas putida KT2440
ccaccagugcuuc

SEQ ID NO: 3570125 - RNA, 16 nt, Pseudomonas putida KT2440
ccaccagugcuuccag

SEQ ID NO: 3570126 - RNA, 19 nt, Pseudomonas putida KT2440
ccaccaguugguaaaacac

SEQ ID NO: 3570127 - RNA, 12 nt, Pseudomonas putida KT2440
ccaccaucgacc

SEQ ID NO: 3570128 - RNA, 16 nt, Pseudomonas putida KT2440
ccaccaucgaccuggc

SEQ ID NO: 3570129 - RNA, 17 nt, Pseudomonas putida KT2440
ccaccaucgaccuggcc

SEQ ID NO: 3570130 - RNA, 19 nt, Pseudomonas putida KT2440
ccaccaucggccaggaaaa

SEQ ID NO: 3570131 - RNA, 18 nt, Pseudomonas putida KT2440
ccaccaucucgcccaugc

SEQ ID NO: 3570132 - RNA, 16 nt, Pseudomonas putida KT2440
ccaccaugaacagcac

SEQ ID NO: 3570133 - RNA, 23 nt, Pseudomonas putida KT2440
ccaccaugaacagcacgcccaag

SEQ ID NO: 3570134 - RNA, 20 nt, Pseudomonas putida KT2440
ccaccaugcgaugguacagc

SEQ ID NO: 3570135 - RNA, 16 nt, Pseudomonas putida KT2440
ccaccaugcucggcca

SEQ ID NO: 3570136 - RNA, 21 nt, Pseudomonas putida KT2440
ccaccaugcucggccagcucg

SEQ ID NO: 3570137 - RNA, 18 nt, Pseudomonas putida KT2440
ccaccauguacugcagac

SEQ ID NO: 3570138 - RNA, 15 nt, Pseudomonas putida KT2440
ccaccauucccugca

SEQ ID NO: 3570139 - RNA, 15 nt, Pseudomonas putida KT2440
ccacccaaccgcgcc

SEQ ID NO: 3570140 - RNA, 16 nt, Pseudomonas putida KT2440
ccacccaaccgcgcca

SEQ ID NO: 3570141 - RNA, 18 nt, Pseudomonas putida KT2440
ccacccaacgaacggaac

SEQ ID NO: 3570142 - RNA, 12 nt, Pseudomonas putida KT2440
ccacccaaggca

SEQ ID NO: 3570143 - RNA, 16 nt, Pseudomonas putida KT2440
ccacccaccuuggccc

SEQ ID NO: 3570144 - RNA, 22 nt, Pseudomonas putida KT2440
ccacccagaugcgggcccuggu

SEQ ID NO: 3570145 - RNA, 16 nt, Pseudomonas putida KT2440
ccaccccagcguuccu

SEQ ID NO: 3570146 - RNA, 13 nt, Pseudomonas putida KT2440
ccacccccagcga

SEQ ID NO: 3570147 - RNA, 14 nt, Pseudomonas putida KT2440
ccacccccagcgcc

SEQ ID NO: 3570148 - RNA, 15 nt, Pseudomonas putida KT2440
ccacccccagcgccu

SEQ ID NO: 3570149 - RNA, 15 nt, Pseudomonas putida KT2440
ccacccccgccgcca

SEQ ID NO: 3570150 - RNA, 17 nt, Pseudomonas putida KT2440
ccacccccgcuccuacg

SEQ ID NO: 3570151 - RNA, 12 nt, Pseudomonas putida KT2440
ccacccccgucu

SEQ ID NO: 3570152 - RNA, 21 nt, Pseudomonas putida KT2440
ccaccccgcaaagcccugccu

SEQ ID NO: 3570153 - RNA, 12 nt, Pseudomonas putida KT2440
ccaccccuugca

SEQ ID NO: 3570154 - RNA, 13 nt, Pseudomonas putida KT2440
ccacccgaacaaa

SEQ ID NO: 3570155 - RNA, 21 nt, Pseudomonas putida KT2440
ccacccgaacaaaacccuucu

SEQ ID NO: 3570156 - RNA, 16 nt, Pseudomonas putida KT2440
ccacccgccugcaacc

SEQ ID NO: 3570157 - RNA, 13 nt, Pseudomonas putida KT2440
ccacccgcucaaa

SEQ ID NO: 3570158 - RNA, 17 nt, Pseudomonas putida KT2440
ccacccgcucaaagcgc

SEQ ID NO: 3570159 - RNA, 15 nt, Pseudomonas putida KT2440
ccacccggaccagcg

SEQ ID NO: 3570160 - RNA, 16 nt, Pseudomonas putida KT2440
ccacccggaccagcgc

SEQ ID NO: 3570161 - RNA, 17 nt, Pseudomonas putida KT2440
ccacccggaccagcgcc

SEQ ID NO: 3570162 - RNA, 16 nt, Pseudomonas putida KT2440
ccacccggcgcgcagc

SEQ ID NO: 3570163 - RNA, 15 nt, Pseudomonas putida KT2440
ccacccgguagaagc

SEQ ID NO: 3570164 - RNA, 19 nt, Pseudomonas putida KT2440
ccacccggucggccagcug

SEQ ID NO: 3570165 - RNA, 18 nt, Pseudomonas putida KT2440
ccacccugaugcagcagu

SEQ ID NO: 3570166 - RNA, 22 nt, Pseudomonas putida KT2440
ccacccugaugcagcagugcca

SEQ ID NO: 3570167 - RNA, 22 nt, Pseudomonas putida KT2440
ccacccugucguuauccugcag

SEQ ID NO: 3570168 - RNA, 23 nt, Pseudomonas putida KT2440
ccaccgacauuguaggcggcaag

SEQ ID NO: 3570169 - RNA, 19 nt, Pseudomonas putida KT2440
ccaccgaccgcaccggcca

SEQ ID NO: 3570170 - RNA, 17 nt, Pseudomonas putida KT2440
ccaccgauccgguguag

SEQ ID NO: 3570171 - RNA, 17 nt, Pseudomonas putida KT2440
ccaccgcacucugcugc

SEQ ID NO: 3570172 - RNA, 20 nt, Pseudomonas putida KT2440
ccaccgcacucugcugcucu

SEQ ID NO: 3570173 - RNA, 12 nt, Pseudomonas putida KT2440
ccaccgcaggug

SEQ ID NO: 3570174 - RNA, 14 nt, Pseudomonas putida KT2440
ccaccgcaggugca

SEQ ID NO: 3570175 - RNA, 16 nt, Pseudomonas putida KT2440
ccaccgcaggugcagg

SEQ ID NO: 3570176 - RNA, 13 nt, Pseudomonas putida KT2440
ccaccgccgugcc

SEQ ID NO: 3570177 - RNA, 23 nt, Pseudomonas putida KT2440
ccaccgcgaaacacagcaggcca

SEQ ID NO: 3570178 - RNA, 14 nt, Pseudomonas putida KT2440
ccaccgcgccagcc

SEQ ID NO: 3570179 - RNA, 16 nt, Pseudomonas putida KT2440
ccaccgcgccagccug

SEQ ID NO: 3570180 - RNA, 15 nt, Pseudomonas putida KT2440
ccaccgcgcgccagu

SEQ ID NO: 3570181 - RNA, 21 nt, Pseudomonas putida KT2440
ccaccgcgcgguuaagcgcca

SEQ ID NO: 3570182 - RNA, 20 nt, Pseudomonas putida KT2440
ccaccgcguacagcugcuca

SEQ ID NO: 3570183 - RNA, 19 nt, Pseudomonas putida KT2440
ccaccgcguuggccagguc

SEQ ID NO: 3570184 - RNA, 14 nt, Pseudomonas putida KT2440
ccaccgcucaaacc

SEQ ID NO: 3570185 - RNA, 12 nt, Pseudomonas putida KT2440
ccaccggacaga

SEQ ID NO: 3570186 - RNA, 15 nt, Pseudomonas putida KT2440
ccaccggcagcaccu

SEQ ID NO: 3570187 - RNA, 22 nt, Pseudomonas putida KT2440
ccaccggcagcaccugccagcc

SEQ ID NO: 3570188 - RNA, 24 nt, Pseudomonas putida KT2440
ccaccggcagcaccugccagccgc

SEQ ID NO: 3570189 - RNA, 15 nt, Pseudomonas putida KT2440
ccaccggccacgcgc

SEQ ID NO: 3570190 - RNA, 21 nt, Pseudomonas putida KT2440
ccaccggccgacccgccuggu

SEQ ID NO: 3570191 - RNA, 12 nt, Pseudomonas putida KT2440
ccaccggccgcc

SEQ ID NO: 3570192 - RNA, 14 nt, Pseudomonas putida KT2440
ccaccggcgcugcg

SEQ ID NO: 3570193 - RNA, 14 nt, Pseudomonas putida KT2440
ccaccggcuuccag

SEQ ID NO: 3570194 - RNA, 20 nt, Pseudomonas putida KT2440
ccaccgggaucuuggcguug

SEQ ID NO: 3570195 - RNA, 12 nt, Pseudomonas putida KT2440
ccaccgggcgag

SEQ ID NO: 3570196 - RNA, 18 nt, Pseudomonas putida KT2440
ccaccgucgaagcccgcg

SEQ ID NO: 3570197 - RNA, 23 nt, Pseudomonas putida KT2440
ccaccguugcgcucgagcccgcc

SEQ ID NO: 3570198 - RNA, 16 nt, Pseudomonas putida KT2440
ccaccuaucaggagca

SEQ ID NO: 3570199 - RNA, 19 nt, Pseudomonas putida KT2440
ccaccucaucccccggccc

SEQ ID NO: 3570200 - RNA, 17 nt, Pseudomonas putida KT2440
ccaccuccccaaucacc

SEQ ID NO: 3570201 - RNA, 20 nt, Pseudomonas putida KT2440
ccaccucgucaugcagcgcc

SEQ ID NO: 3570202 - RNA, 19 nt, Pseudomonas putida KT2440
ccaccucuaucaccuguuc

SEQ ID NO: 3570203 - RNA, 13 nt, Pseudomonas putida KT2440
ccaccugacgcgc

SEQ ID NO: 3570204 - RNA, 18 nt, Pseudomonas putida KT2440
ccaccugcagggucaggc

SEQ ID NO: 3570205 - RNA, 22 nt, Pseudomonas putida KT2440
ccacugcuguuccagaagcggc

SEQ ID NO: 3570206 - RNA, 20 nt, Pseudomonas putida KT2440
ccacugcuucugagccagcc

SEQ ID NO: 3570207 - RNA, 22 nt, Pseudomonas putida KT2440
ccacugcuucugagccagccgc

SEQ ID NO: 3570208 - RNA, 19 nt, Pseudomonas putida KT2440
ccacuggaugacgccgcag

SEQ ID NO: 3570209 - RNA, 21 nt, Pseudomonas putida KT2440
ccacuggaugacgccgcagcc

SEQ ID NO: 3570210 - RNA, 12 nt, Pseudomonas putida KT2440
ccacuggccagc

SEQ ID NO: 3570211 - RNA, 18 nt, Pseudomonas putida KT2440
ccacugguacagcucacg

SEQ ID NO: 3570212 - RNA, 16 nt, Pseudomonas putida KT2440
ccacugguaguucauc

SEQ ID NO: 3570213 - RNA, 17 nt, Pseudomonas putida KT2440
ccacuggugccggcacg

SEQ ID NO: 3570214 - RNA, 20 nt, Pseudomonas putida KT2440
ccacuggugccggcacggcc

SEQ ID NO: 3570215 - RNA, 19 nt, Pseudomonas putida KT2440
ccacugucaaucuugcgca

SEQ ID NO: 3570216 - RNA, 16 nt, Pseudomonas putida KT2440
ccacuguugcagcgcc

SEQ ID NO: 3570217 - RNA, 23 nt, Pseudomonas putida KT2440
ccacuucaaguucguuggcgaac

SEQ ID NO: 3570218 - RNA, 17 nt, Pseudomonas putida KT2440
ccacuucaugggccacg

SEQ ID NO: 3570219 - RNA, 13 nt, Pseudomonas putida KT2440
ccacuuccugaag

SEQ ID NO: 3570220 - RNA, 15 nt, Pseudomonas putida KT2440
ccacuucgacauggc

SEQ ID NO: 3570221 - RNA, 23 nt, Pseudomonas putida KT2440
ccacuucgcaacgcuuggcaauc

SEQ ID NO: 3570222 - RNA, 22 nt, Pseudomonas putida KT2440
ccacuucugcggccagggcauc

SEQ ID NO: 3570223 - RNA, 18 nt, Pseudomonas putida KT2440
ccacuugaagaccgccau

SEQ ID NO: 3570224 - RNA, 20 nt, Pseudomonas putida KT2440
ccacuugcagguagcgcccg

SEQ ID NO: 3570225 - RNA, 18 nt, Pseudomonas putida KT2440
ccacuugcguucgccgcu

SEQ ID NO: 3570226 - RNA, 13 nt, Pseudomonas putida KT2440
ccacuugcucggu

SEQ ID NO: 3570227 - RNA, 22 nt, Pseudomonas putida KT2440
ccacuugcucggugcugcugcc

SEQ ID NO: 3570228 - RNA, 20 nt, Pseudomonas putida KT2440
ccacuugguggcguccacga

SEQ ID NO: 3570229 - RNA, 22 nt, Pseudomonas putida KT2440
ccacuugguggcguccacgacc

SEQ ID NO: 3570230 - RNA, 15 nt, Pseudomonas putida KT2440
ccacuugucccggcc

SEQ ID NO: 3570231 - RNA, 19 nt, Pseudomonas putida KT2440
ccagaaaaguuggccaugu

SEQ ID NO: 3570232 - RNA, 20 nt, Pseudomonas putida KT2440
ccagaaaauaugcuguuggc

SEQ ID NO: 3570233 - RNA, 16 nt, Pseudomonas putida KT2440
ccagaaacccagggca

SEQ ID NO: 3570234 - RNA, 17 nt, Pseudomonas putida KT2440
ccagaaacccagggcag

SEQ ID NO: 3570235 - RNA, 16 nt, Pseudomonas putida KT2440
ccagaaacggcggcag

SEQ ID NO: 3570236 - RNA, 14 nt, Pseudomonas putida KT2440
ccagaaagcccgca

SEQ ID NO: 3570237 - RNA, 21 nt, Pseudomonas putida KT2440
ccagaacacggugacaaaggc

SEQ ID NO: 3570238 - RNA, 17 nt, Pseudomonas putida KT2440
ccagaacagccacagcu

SEQ ID NO: 3570239 - RNA, 19 nt, Pseudomonas putida KT2440
ccagaacagcucgaucagu

SEQ ID NO: 3570240 - RNA, 13 nt, Pseudomonas putida KT2440
ccagaaccaggau

SEQ ID NO: 3570241 - RNA, 16 nt, Pseudomonas putida KT2440
ccagaacggcacgccc

SEQ ID NO: 3570242 - RNA, 18 nt, Pseudomonas putida KT2440
ccagaacuucaccccgua

SEQ ID NO: 3570243 - RNA, 19 nt, Pseudomonas putida KT2440
ccagaacuucaccccguac

SEQ ID NO: 3570244 - RNA, 14 nt, Pseudomonas putida KT2440
ccagaaggcucagu

SEQ ID NO: 3570245 - RNA, 16 nt, Pseudomonas putida KT2440
ccagaaucucaaccac

SEQ ID NO: 3570246 - RNA, 18 nt, Pseudomonas putida KT2440
ccagaaucucaaccaccu

SEQ ID NO: 3570247 - RNA, 18 nt, Pseudomonas putida KT2440
ccagaaucuggggccgcg

SEQ ID NO: 3570248 - RNA, 17 nt, Pseudomonas putida KT2440
ccagaauguugcaagga

SEQ ID NO: 3570249 - RNA, 16 nt, Pseudomonas putida KT2440
ccagaccagacagcgc

SEQ ID NO: 3570250 - RNA, 16 nt, Pseudomonas putida KT2440
ccagaccagcagcagu

SEQ ID NO: 3570251 - RNA, 20 nt, Pseudomonas putida KT2440
ccagacccgcuucgccgcgc

SEQ ID NO: 3570252 - RNA, 19 nt, Pseudomonas putida KT2440
ccagacccugacucaugcc

SEQ ID NO: 3570253 - RNA, 22 nt, Pseudomonas putida KT2440
ccagaccgguuacgcaacucca

SEQ ID NO: 3570254 - RNA, 18 nt, Pseudomonas putida KT2440
ccagaccuggaggucaug

SEQ ID NO: 3570255 - RNA, 14 nt, Pseudomonas putida KT2440
ccagaccuugcgca

SEQ ID NO: 3570256 - RNA, 16 nt, Pseudomonas putida KT2440
ccagacgaugauggcc

SEQ ID NO: 3570257 - RNA, 13 nt, Pseudomonas putida KT2440
ccagacgcaggca

SEQ ID NO: 3570258 - RNA, 13 nt, Pseudomonas putida KT2440
ccagacggccuuc

SEQ ID NO: 3570259 - RNA, 14 nt, Pseudomonas putida KT2440
ccagacucagcgcu

SEQ ID NO: 3570260 - RNA, 18 nt, Pseudomonas putida KT2440
ccagacucagcugcugcu

SEQ ID NO: 3570261 - RNA, 16 nt, Pseudomonas putida KT2440
ccagagaaccgcacac

SEQ ID NO: 3570262 - RNA, 16 nt, Pseudomonas putida KT2440
ccagagagcugagauc

SEQ ID NO: 3570263 - RNA, 20 nt, Pseudomonas putida KT2440
ccagagcccgcucggucagg

SEQ ID NO: 3570264 - RNA, 14 nt, Pseudomonas putida KT2440
ccagagcguccucg

SEQ ID NO: 3570265 - RNA, 21 nt, Pseudomonas putida KT2440
ccagagcguccucggcagaaa

SEQ ID NO: 3570266 - RNA, 21 nt, Pseudomonas putida KT2440
ccagagggaagggcgucugcu

SEQ ID NO: 3570267 - RNA, 23 nt, Pseudomonas putida KT2440
ccagagggaagggcgucugcucc

SEQ ID NO: 3570268 - RNA, 15 nt, Pseudomonas putida KT2440
ccagaguugccacca

SEQ ID NO: 3570269 - RNA, 15 nt, Pseudomonas putida KT2440
ccagauacgcuucga

SEQ ID NO: 3570270 - RNA, 22 nt, Pseudomonas putida KT2440
ccagauagccauugcggcugaa

SEQ ID NO: 3570271 - RNA, 15 nt, Pseudomonas putida KT2440
ccagaucagcagcac

SEQ ID NO: 3570272 - RNA, 16 nt, Pseudomonas putida KT2440
ccagaucagcagcacc

SEQ ID NO: 3570273 - RNA, 12 nt, Pseudomonas putida KT2440
ccagauccgcag

SEQ ID NO: 3570274 - RNA, 12 nt, Pseudomonas putida KT2440
ccagaucggcag

SEQ ID NO: 3570275 - RNA, 16 nt, Pseudomonas putida KT2440
ccagaucggcagugcc

SEQ ID NO: 3570276 - RNA, 12 nt, Pseudomonas putida KT2440
ccagaucggcca

SEQ ID NO: 3570277 - RNA, 14 nt, Pseudomonas putida KT2440
ccagaucggccagc

SEQ ID NO: 3570278 - RNA, 23 nt, Pseudomonas putida KT2440
ccagaugcgccgggacagcacca

SEQ ID NO: 3570279 - RNA, 17 nt, Pseudomonas putida KT2440
ccagaugcgggcccugg

SEQ ID NO: 3570280 - RNA, 18 nt, Pseudomonas putida KT2440
ccagauuacaaaagcgcc

SEQ ID NO: 3570281 - RNA, 16 nt, Pseudomonas putida KT2440
ccagauucaagcccgg

SEQ ID NO: 3570282 - RNA, 21 nt, Pseudomonas putida KT2440
ccagauucaagcccggcgccu

SEQ ID NO: 3570283 - RNA, 20 nt, Pseudomonas putida KT2440
ccagauugcaggaacaaccu

SEQ ID NO: 3570284 - RNA, 18 nt, Pseudomonas putida KT2440
ccagcaaaaguuggcuga

SEQ ID NO: 3570285 - RNA, 20 nt, Pseudomonas putida KT2440
ccagcaaacccucggccucg

SEQ ID NO: 3570286 - RNA, 22 nt, Pseudomonas putida KT2440
ccagcaaauacgguugcagcac

SEQ ID NO: 3570287 - RNA, 16 nt, Pseudomonas putida KT2440
ccagcaacaacgccuu

SEQ ID NO: 3570288 - RNA, 18 nt, Pseudomonas putida KT2440
ccagcaacacgcagucga

SEQ ID NO: 3570289 - RNA, 20 nt, Pseudomonas putida KT2440
ccagcaacagccccaucacc

SEQ ID NO: 3570290 - RNA, 17 nt, Pseudomonas putida KT2440
ccagcaacaucgccccc

SEQ ID NO: 3570291 - RNA, 16 nt, Pseudomonas putida KT2440
ccagcaacaugccggc

SEQ ID NO: 3570292 - RNA, 17 nt, Pseudomonas putida KT2440
ccagcaaccgccccugc

SEQ ID NO: 3570293 - RNA, 21 nt, Pseudomonas putida KT2440
ccagcaacggacgucccagca

SEQ ID NO: 3570294 - RNA, 13 nt, Pseudomonas putida KT2440
ccagcaacggauu

SEQ ID NO: 3570295 - RNA, 14 nt, Pseudomonas putida KT2440
ccagcaacggccgc

SEQ ID NO: 3570296 - RNA, 15 nt, Pseudomonas putida KT2440
ccagcaacggccgcg

SEQ ID NO: 3570297 - RNA, 21 nt, Pseudomonas putida KT2440
ccagcaacggugaaaaacgcg

SEQ ID NO: 3570298 - RNA, 22 nt, Pseudomonas putida KT2440
ccagcaacuccccccgcgccag

SEQ ID NO: 3570299 - RNA, 23 nt, Pseudomonas putida KT2440
ccagcaacuccccccgcgccaga

SEQ ID NO: 3570300 - RNA, 16 nt, Pseudomonas putida KT2440
ccagcaacugcgccca

SEQ ID NO: 3570301 - RNA, 16 nt, Pseudomonas putida KT2440
ccagcaagcgcucaua

SEQ ID NO: 3570302 - RNA, 14 nt, Pseudomonas putida KT2440
ccagcacaccgcgc

SEQ ID NO: 3570303 - RNA, 16 nt, Pseudomonas putida KT2440
ccagcacaccgcgcac

SEQ ID NO: 3570304 - RNA, 18 nt, Pseudomonas putida KT2440
ccagcacacugagcacca

SEQ ID NO: 3570305 - RNA, 19 nt, Pseudomonas putida KT2440
ccagcacagauaaaccugc

SEQ ID NO: 3570306 - RNA, 23 nt, Pseudomonas putida KT2440
ccagcacagauaaaccugccacc

SEQ ID NO: 3570307 - RNA, 18 nt, Pseudomonas putida KT2440
ccagcaccacccaccagc

SEQ ID NO: 3570308 - RNA, 21 nt, Pseudomonas putida KT2440
ccagcaccacccaccagcagu

SEQ ID NO: 3570309 - RNA, 12 nt, Pseudomonas putida KT2440
ccagcaccagcg

SEQ ID NO: 3570310 - RNA, 13 nt, Pseudomonas putida KT2440
ccagcauggacca

SEQ ID NO: 3570311 - RNA, 12 nt, Pseudomonas putida KT2440
ccagcauggccg

SEQ ID NO: 3570312 - RNA, 16 nt, Pseudomonas putida KT2440
ccagcauggcgucggc

SEQ ID NO: 3570313 - RNA, 14 nt, Pseudomonas putida KT2440
ccagcauggugcag

SEQ ID NO: 3570314 - RNA, 21 nt, Pseudomonas putida KT2440
ccagcauuggauacugcccgu

SEQ ID NO: 3570315 - RNA, 19 nt, Pseudomonas putida KT2440
ccagccaaacccggccgcg

SEQ ID NO: 3570316 - RNA, 23 nt, Pseudomonas putida KT2440
ccagccaaacccggccgcgguaa

SEQ ID NO: 3570317 - RNA, 17 nt, Pseudomonas putida KT2440
ccagccaacccucgacc

SEQ ID NO: 3570318 - RNA, 21 nt, Pseudomonas putida KT2440
ccagccaacgccccacccgcu

SEQ ID NO: 3570319 - RNA, 22 nt, Pseudomonas putida KT2440
ccagccaacgccccacccgcuc

SEQ ID NO: 3570320 - RNA, 23 nt, Pseudomonas putida KT2440
ccagccaacgccccacccgcuca

SEQ ID NO: 3570321 - RNA, 17 nt, Pseudomonas putida KT2440
ccagccaacgcugguag

SEQ ID NO: 3570322 - RNA, 21 nt, Pseudomonas putida KT2440
ccagccaacggucgaucagcu

SEQ ID NO: 3570323 - RNA, 22 nt, Pseudomonas putida KT2440
ccagccaccgacgaacagggcc

SEQ ID NO: 3570324 - RNA, 15 nt, Pseudomonas putida KT2440
ccagccacggaucac

SEQ ID NO: 3570325 - RNA, 17 nt, Pseudomonas putida KT2440
ccagccacuccgccucg

SEQ ID NO: 3570326 - RNA, 22 nt, Pseudomonas putida KT2440
ccagccagauauggaagcugug

SEQ ID NO: 3570327 - RNA, 13 nt, Pseudomonas putida KT2440
ccagccagcagcg

SEQ ID NO: 3570328 - RNA, 17 nt, Pseudomonas putida KT2440
ccagccagcagcguacc

SEQ ID NO: 3570329 - RNA, 11 nt, Pseudomonas putida KT2440
ccagccagcga

SEQ ID NO: 3570330 - RNA, 13 nt, Pseudomonas putida KT2440
ccagccagcgaca

SEQ ID NO: 3570331 - RNA, 15 nt, Pseudomonas putida KT2440
ccagccagcgacagc

SEQ ID NO: 3570332 - RNA, 16 nt, Pseudomonas putida KT2440
ccagccagcgacagca

SEQ ID NO: 3570333 - RNA, 12 nt, Pseudomonas putida KT2440
ccagccagcgug

SEQ ID NO: 3570334 - RNA, 20 nt, Pseudomonas putida KT2440
ccagccaggcacagaucaac

SEQ ID NO: 3570335 - RNA, 20 nt, Pseudomonas putida KT2440
ccagccaggcacuggccagc

SEQ ID NO: 3570336 - RNA, 21 nt, Pseudomonas putida KT2440
ccagccagguauggccagagc

SEQ ID NO: 3570337 - RNA, 24 nt, Pseudomonas putida KT2440
ccagccagucgcgcaacugcccag

SEQ ID NO: 3570338 - RNA, 20 nt, Pseudomonas putida KT2440
ccagccaucgagcaccggcu

SEQ ID NO: 3570339 - RNA, 14 nt, Pseudomonas putida KT2440
ccagccauuccagg

SEQ ID NO: 3570340 - RNA, 17 nt, Pseudomonas putida KT2440
ccagccauuccaggcua

SEQ ID NO: 3570341 - RNA, 20 nt, Pseudomonas putida KT2440
ccagccauuccaggcuagcc

SEQ ID NO: 3570342 - RNA, 12 nt, Pseudomonas putida KT2440
ccagcccaccac

SEQ ID NO: 3570343 - RNA, 18 nt, Pseudomonas putida KT2440
ccagcccaccacgaacgc

SEQ ID NO: 3570344 - RNA, 16 nt, Pseudomonas putida KT2440
ccagcccagcccggac

SEQ ID NO: 3570345 - RNA, 15 nt, Pseudomonas putida KT2440
ccagcccagcgccag

SEQ ID NO: 3570346 - RNA, 14 nt, Pseudomonas putida KT2440
ccagcccaggcugg

SEQ ID NO: 3570347 - RNA, 20 nt, Pseudomonas putida KT2440
ccagcccaugaacagcaagu

SEQ ID NO: 3570348 - RNA, 20 nt, Pseudomonas putida KT2440
ccagccccaacccaccagca

SEQ ID NO: 3570349 - RNA, 13 nt, Pseudomonas putida KT2440
ccagccccagccc

SEQ ID NO: 3570350 - RNA, 16 nt, Pseudomonas putida KT2440
ccagccccagcccgcc

SEQ ID NO: 3570351 - RNA, 13 nt, Pseudomonas putida KT2440
ccagccccagcgg

SEQ ID NO: 3570352 - RNA, 18 nt, Pseudomonas putida KT2440
ccagccccagcggcagca

SEQ ID NO: 3570353 - RNA, 21 nt, Pseudomonas putida KT2440
ccagccccagcggcagcagca

SEQ ID NO: 3570354 - RNA, 23 nt, Pseudomonas putida KT2440
ccagccccucauucaaagccugc

SEQ ID NO: 3570355 - RNA, 12 nt, Pseudomonas putida KT2440
ccagcccgaagc

SEQ ID NO: 3570356 - RNA, 17 nt, Pseudomonas putida KT2440
ccagcccgaagccggca

SEQ ID NO: 3570357 - RNA, 18 nt, Pseudomonas putida KT2440
ccagcccgauggccuuga

SEQ ID NO: 3570358 - RNA, 14 nt, Pseudomonas putida KT2440
ccagcccgcccaca

SEQ ID NO: 3570359 - RNA, 13 nt, Pseudomonas putida KT2440
ccagcccgccugc

SEQ ID NO: 3570360 - RNA, 20 nt, Pseudomonas putida KT2440
ccagcccggacugcaccagg

SEQ ID NO: 3570361 - RNA, 19 nt, Pseudomonas putida KT2440
ccagcccggcgccgagcca

SEQ ID NO: 3570362 - RNA, 15 nt, Pseudomonas putida KT2440
ccagcccggcggcca

SEQ ID NO: 3570363 - RNA, 18 nt, Pseudomonas putida KT2440
ccagcccgguauuggcca

SEQ ID NO: 3570364 - RNA, 22 nt, Pseudomonas putida KT2440
ccagcccgucacgugccuucac

SEQ ID NO: 3570365 - RNA, 15 nt, Pseudomonas putida KT2440
ccagcccucaaggga

SEQ ID NO: 3570366 - RNA, 22 nt, Pseudomonas putida KT2440
ccagcccugccgaggccaugug

SEQ ID NO: 3570367 - RNA, 17 nt, Pseudomonas putida KT2440
ccagcccuuccaccaca

SEQ ID NO: 3570368 - RNA, 21 nt, Pseudomonas putida KT2440
ccagcccuucggcaucggccu

SEQ ID NO: 3570369 - RNA, 23 nt, Pseudomonas putida KT2440
ccagcccuucugaaaggcguagg

SEQ ID NO: 3570370 - RNA, 23 nt, Pseudomonas putida KT2440
ccagccgaacuugucuguacugc

SEQ ID NO: 3570371 - RNA, 23 nt, Pseudomonas putida KT2440
ccagccgcaaccgggucggcgcc

SEQ ID NO: 3570372 - RNA, 15 nt, Pseudomonas putida KT2440
ccagccgccacgacc

SEQ ID NO: 3570373 - RNA, 14 nt, Pseudomonas putida KT2440
ccagccgcccaagc

SEQ ID NO: 3570374 - RNA, 13 nt, Pseudomonas putida KT2440
ccagccgccgccg

SEQ ID NO: 3570375 - RNA, 16 nt, Pseudomonas putida KT2440
ccagccgccuuugccc

SEQ ID NO: 3570376 - RNA, 12 nt, Pseudomonas putida KT2440
ccagccgcgaac

SEQ ID NO: 3570377 - RNA, 15 nt, Pseudomonas putida KT2440
ccagccgcgccacuc

SEQ ID NO: 3570378 - RNA, 18 nt, Pseudomonas putida KT2440
ccagccgcgccacuccca

SEQ ID NO: 3570379 - RNA, 15 nt, Pseudomonas putida KT2440
ccagccgcucagcca

SEQ ID NO: 3570380 - RNA, 15 nt, Pseudomonas putida KT2440
ccagccgcugcugca

SEQ ID NO: 3570381 - RNA, 13 nt, Pseudomonas putida KT2440
ccagccggcagca

SEQ ID NO: 3570382 - RNA, 14 nt, Pseudomonas putida KT2440
ccagccggcagcaa

SEQ ID NO: 3570383 - RNA, 12 nt, Pseudomonas putida KT2440
ccagccggcccg

SEQ ID NO: 3570384 - RNA, 17 nt, Pseudomonas putida KT2440
ccagccggcccggcugg

SEQ ID NO: 3570385 - RNA, 18 nt, Pseudomonas putida KT2440
ccagccggcccggcuggc

SEQ ID NO: 3570386 - RNA, 20 nt, Pseudomonas putida KT2440
ccagccggcccggcuggcca

SEQ ID NO: 3570387 - RNA, 19 nt, Pseudomonas putida KT2440
ccagccggcgcuggacagc

SEQ ID NO: 3570388 - RNA, 12 nt, Pseudomonas putida KT2440
ccagccggcuga

SEQ ID NO: 3570389 - RNA, 22 nt, Pseudomonas putida KT2440
ccagccgggcugcaaagcgggc

SEQ ID NO: 3570390 - RNA, 19 nt, Pseudomonas putida KT2440
ccagccggucauccagcag

SEQ ID NO: 3570391 - RNA, 20 nt, Pseudomonas putida KT2440
ccagccggucauccagcagc

SEQ ID NO: 3570392 - RNA, 21 nt, Pseudomonas putida KT2440
ccagccggucauccagcagcu

SEQ ID NO: 3570393 - RNA, 21 nt, Pseudomonas putida KT2440
ccagccguccucgacccaguc

SEQ ID NO: 3570394 - RNA, 20 nt, Pseudomonas putida KT2440
ccagccgucgauuacccagc

SEQ ID NO: 3570395 - RNA, 22 nt, Pseudomonas putida KT2440
ccagccgucgauuacccagcgc

SEQ ID NO: 3570396 - RNA, 13 nt, Pseudomonas putida KT2440
ccagccguggcaa

SEQ ID NO: 3570397 - RNA, 19 nt, Pseudomonas putida KT2440
ccagccguggcaacgccac

SEQ ID NO: 3570398 - RNA, 20 nt, Pseudomonas putida KT2440
ccagccguggcaacgccaca

SEQ ID NO: 3570399 - RNA, 17 nt, Pseudomonas putida KT2440
ccagccguugcgccgcu

SEQ ID NO: 3570400 - RNA, 21 nt, Pseudomonas putida KT2440
ccagccguuguacaagcuggc

SEQ ID NO: 3570401 - RNA, 14 nt, Pseudomonas putida KT2440
ccagccuccggccc

SEQ ID NO: 3570402 - RNA, 15 nt, Pseudomonas putida KT2440
ccagccuccggccca

SEQ ID NO: 3570403 - RNA, 17 nt, Pseudomonas putida KT2440
ccagccucuucuucaag

SEQ ID NO: 3570404 - RNA, 22 nt, Pseudomonas putida KT2440
ccagccucuucuucaaggcugc

SEQ ID NO: 3570405 - RNA, 12 nt, Pseudomonas putida KT2440
ccagccugcagc

SEQ ID NO: 3570406 - RNA, 18 nt, Pseudomonas putida KT2440
ccagccugcccgccgucc

SEQ ID NO: 3570407 - RNA, 19 nt, Pseudomonas putida KT2440
ccagccugggcugucgccu

SEQ ID NO: 3570408 - RNA, 14 nt, Pseudomonas putida KT2440
ccagccuucaaccc

SEQ ID NO: 3570409 - RNA, 16 nt, Pseudomonas putida KT2440
ccagccuucagcaggc

SEQ ID NO: 3570410 - RNA, 17 nt, Pseudomonas putida KT2440
ccagccuucagcaggcg

SEQ ID NO: 3570411 - RNA, 13 nt, Pseudomonas putida KT2440
ccagcgaccagcu

SEQ ID NO: 3570412 - RNA, 16 nt, Pseudomonas putida KT2440
ccagcgaccagcugcc

SEQ ID NO: 3570413 - RNA, 23 nt, Pseudomonas putida KT2440
ccagcgacccugagucuggcgcc

SEQ ID NO: 3570414 - RNA, 22 nt, Pseudomonas putida KT2440
ccagcgaggcaaucagggcauc

SEQ ID NO: 3570415 - RNA, 16 nt, Pseudomonas putida KT2440
ccagcuccgacucguc

SEQ ID NO: 3570416 - RNA, 14 nt, Pseudomonas putida KT2440
ccagcuccuggccc

SEQ ID NO: 3570417 - RNA, 16 nt, Pseudomonas putida KT2440
ccagcuccuggccgcc

SEQ ID NO: 3570418 - RNA, 17 nt, Pseudomonas putida KT2440
ccagcuccuggccgccc

SEQ ID NO: 3570419 - RNA, 19 nt, Pseudomonas putida KT2440
ccagcuccuggccgcccgc

SEQ ID NO: 3570420 - RNA, 14 nt, Pseudomonas putida KT2440
ccagcuccuucgcu

SEQ ID NO: 3570421 - RNA, 16 nt, Pseudomonas putida KT2440
ccagcucgccaacacc

SEQ ID NO: 3570422 - RNA, 14 nt, Pseudomonas putida KT2440
ccagcucgccgccc

SEQ ID NO: 3570423 - RNA, 18 nt, Pseudomonas putida KT2440
ccagcucgcgcagggcau

SEQ ID NO: 3570424 - RNA, 14 nt, Pseudomonas putida KT2440
ccagcucggcaagg

SEQ ID NO: 3570425 - RNA, 17 nt, Pseudomonas putida KT2440
ccagcucggcaguggcg

SEQ ID NO: 3570426 - RNA, 16 nt, Pseudomonas putida KT2440
ccagcucggccuugcg

SEQ ID NO: 3570427 - RNA, 17 nt, Pseudomonas putida KT2440
ccagcucggcuggcugu

SEQ ID NO: 3570428 - RNA, 17 nt, Pseudomonas putida KT2440
ccagcugaagugccaag

SEQ ID NO: 3570429 - RNA, 23 nt, Pseudomonas putida KT2440
ccagcugaagugccaaggcuuuu

SEQ ID NO: 3570430 - RNA, 18 nt, Pseudomonas putida KT2440
ccagcugcaacagcggcg

SEQ ID NO: 3570431 - RNA, 17 nt, Pseudomonas putida KT2440
ccagcugcaccaccugc

SEQ ID NO: 3570432 - RNA, 12 nt, Pseudomonas putida KT2440
ccagcugcauca

SEQ ID NO: 3570433 - RNA, 20 nt, Pseudomonas putida KT2440
ccagcugccauacagccaga

SEQ ID NO: 3570434 - RNA, 14 nt, Pseudomonas putida KT2440
ccagcugcgcacgc

SEQ ID NO: 3570435 - RNA, 13 nt, Pseudomonas putida KT2440
ccagcugcgccug

SEQ ID NO: 3570436 - RNA, 14 nt, Pseudomonas putida KT2440
ccagcugcgccugc

SEQ ID NO: 3570437 - RNA, 13 nt, Pseudomonas putida KT2440
ccagcugcguggc

SEQ ID NO: 3570438 - RNA, 12 nt, Pseudomonas putida KT2440
ccagcugcugcg

SEQ ID NO: 3570439 - RNA, 22 nt, Pseudomonas putida KT2440
ccagcuggagacgaacagcgcc

SEQ ID NO: 3570440 - RNA, 13 nt, Pseudomonas putida KT2440
ccagcuggccacc

SEQ ID NO: 3570441 - RNA, 12 nt, Pseudomonas putida KT2440
ccagcuggccau

SEQ ID NO: 3570442 - RNA, 13 nt, Pseudomonas putida KT2440
ccagcuggccauc

SEQ ID NO: 3570443 - RNA, 16 nt, Pseudomonas putida KT2440
ccagcuggccaucgac

SEQ ID NO: 3570444 - RNA, 17 nt, Pseudomonas putida KT2440
ccagcuggccaucgacc

SEQ ID NO: 3570445 - RNA, 11 nt, Pseudomonas putida KT2440
ccagcuggcuc

SEQ ID NO: 3570446 - RNA, 15 nt, Pseudomonas putida KT2440
ccagcuggcucaucu

SEQ ID NO: 3570447 - RNA, 20 nt, Pseudomonas putida KT2440
ccagcuggcucaucugccgg

SEQ ID NO: 3570448 - RNA, 19 nt, Pseudomonas putida KT2440
ccagcuguacgcuggccaa

SEQ ID NO: 3570449 - RNA, 15 nt, Pseudomonas putida KT2440
ccagcuucggccacg

SEQ ID NO: 3570450 - RNA, 14 nt, Pseudomonas putida KT2440
ccagcuucuccagc

SEQ ID NO: 3570451 - RNA, 15 nt, Pseudomonas putida KT2440
ccagcuucuccagca

SEQ ID NO: 3570452 - RNA, 17 nt, Pseudomonas putida KT2440
ccagcuucuccagcaag

SEQ ID NO: 3570453 - RNA, 20 nt, Pseudomonas putida KT2440
ccagcuucuccagcaagcgc

SEQ ID NO: 3570454 - RNA, 17 nt, Pseudomonas putida KT2440
ccagcuugaagcggccu

SEQ ID NO: 3570455 - RNA, 16 nt, Pseudomonas putida KT2440
ccagcuugccaccauc

SEQ ID NO: 3570456 - RNA, 21 nt, Pseudomonas putida KT2440
ccagcuugccaccaucgaccu

SEQ ID NO: 3570457 - RNA, 22 nt, Pseudomonas putida KT2440
ccagcuugcccagcagguacac

SEQ ID NO: 3570458 - RNA, 15 nt, Pseudomonas putida KT2440
ccagcuuggcaggcu

SEQ ID NO: 3570459 - RNA, 21 nt, Pseudomonas putida KT2440
ccagcuuggcaggcuucauga

SEQ ID NO: 3570460 - RNA, 15 nt, Pseudomonas putida KT2440
ccagcuuggucaggg

SEQ ID NO: 3570461 - RNA, 18 nt, Pseudomonas putida KT2440
ccagcuugugaucccgcg

SEQ ID NO: 3570462 - RNA, 14 nt, Pseudomonas putida KT2440
ccagcuuguugccg

SEQ ID NO: 3570463 - RNA, 13 nt, Pseudomonas putida KT2440
ccaggaacagcgc

SEQ ID NO: 3570464 - RNA, 18 nt, Pseudomonas putida KT2440
ccaggaacagcgcagcca

SEQ ID NO: 3570465 - RNA, 20 nt, Pseudomonas putida KT2440
ccaggaacaucgccgucauc

SEQ ID NO: 3570466 - RNA, 22 nt, Pseudomonas putida KT2440
ccaggaacgcugccuccacacc

SEQ ID NO: 3570467 - RNA, 16 nt, Pseudomonas putida KT2440
ccaggaacggcccgcg

SEQ ID NO: 3570468 - RNA, 13 nt, Pseudomonas putida KT2440
ccaggaagcucgc

SEQ ID NO: 3570469 - RNA, 17 nt, Pseudomonas putida KT2440
ccaggaaggccucgccg

SEQ ID NO: 3570470 - RNA, 22 nt, Pseudomonas putida KT2440
ccaggaagucgauguucagcac

SEQ ID NO: 3570471 - RNA, 20 nt, Pseudomonas putida KT2440
ccaggacaaaccagcggucu

SEQ ID NO: 3570472 - RNA, 21 nt, Pseudomonas putida KT2440
ccaggacaagccgacaaaaac

SEQ ID NO: 3570473 - RNA, 20 nt, Pseudomonas putida KT2440
ccaggacuucccggcaccgc

SEQ ID NO: 3570474 - RNA, 19 nt, Pseudomonas putida KT2440
ccaggagaacacccagcgc

SEQ ID NO: 3570475 - RNA, 14 nt, Pseudomonas putida KT2440
ccaggauauugccg

SEQ ID NO: 3570476 - RNA, 16 nt, Pseudomonas putida KT2440
ccaggaucacuggccu

SEQ ID NO: 3570477 - RNA, 22 nt, Pseudomonas putida KT2440
ccaggaucagcgugugcugggu

SEQ ID NO: 3570478 - RNA, 14 nt, Pseudomonas putida KT2440
ccaggauugccggg

SEQ ID NO: 3570479 - RNA, 18 nt, Pseudomonas putida KT2440
ccaggauugccgggcuac

SEQ ID NO: 3570480 - RNA, 15 nt, Pseudomonas putida KT2440
ccaggauuggccgca

SEQ ID NO: 3570481 - RNA, 23 nt, Pseudomonas putida KT2440
ccaggauuuucagcgcgaaaccc

SEQ ID NO: 3570482 - RNA, 16 nt, Pseudomonas putida KT2440
ccaggcaaaaaaaagg

SEQ ID NO: 3570483 - RNA, 18 nt, Pseudomonas putida KT2440
ccaggcaaagaaaaaccc

SEQ ID NO: 3570484 - RNA, 22 nt, Pseudomonas putida KT2440
ccaggcaaaguugagcgccgcg

SEQ ID NO: 3570485 - RNA, 17 nt, Pseudomonas putida KT2440
ccaggcacaccgagcca

SEQ ID NO: 3570486 - RNA, 18 nt, Pseudomonas putida KT2440
ccaggcacaggcgcacac

SEQ ID NO: 3570487 - RNA, 14 nt, Pseudomonas putida KT2440
ccaggcacuggcca

SEQ ID NO: 3570488 - RNA, 17 nt, Pseudomonas putida KT2440
ccaggcacuggccagcg

SEQ ID NO: 3570489 - RNA, 18 nt, Pseudomonas putida KT2440
ccaggcacuggccagcgg

SEQ ID NO: 3570490 - RNA, 14 nt, Pseudomonas putida KT2440
ccaggcagcagacu

SEQ ID NO: 3570491 - RNA, 14 nt, Pseudomonas putida KT2440
ccaggcagccucca

SEQ ID NO: 3570492 - RNA, 20 nt, Pseudomonas putida KT2440
ccaggcaguuucaggcgcuc

SEQ ID NO: 3570493 - RNA, 17 nt, Pseudomonas putida KT2440
ccaggcauacagcuggc

SEQ ID NO: 3570494 - RNA, 21 nt, Pseudomonas putida KT2440
ccaggcauacagcuggccuug

SEQ ID NO: 3570495 - RNA, 19 nt, Pseudomonas putida KT2440
ccaggcauuccccggucag

SEQ ID NO: 3570496 - RNA, 18 nt, Pseudomonas putida KT2440
ccaggcauugcaaggucc

SEQ ID NO: 3570497 - RNA, 16 nt, Pseudomonas putida KT2440
ccaggcauugcccgcg

SEQ ID NO: 3570498 - RNA, 18 nt, Pseudomonas putida KT2440
ccaggccaaacaggccga

SEQ ID NO: 3570499 - RNA, 17 nt, Pseudomonas putida KT2440
ccaggccaucagcagcu

SEQ ID NO: 3570500 - RNA, 14 nt, Pseudomonas putida KT2440
ccaggccauccagc

SEQ ID NO: 3570501 - RNA, 12 nt, Pseudomonas putida KT2440
ccaggcccacca

SEQ ID NO: 3570502 - RNA, 13 nt, Pseudomonas putida KT2440
ccaggcccaccac

SEQ ID NO: 3570503 - RNA, 20 nt, Pseudomonas putida KT2440
ccaggcccaccaccggugcg

SEQ ID NO: 3570504 - RNA, 14 nt, Pseudomonas putida KT2440
ccaggcccaccaug

SEQ ID NO: 3570505 - RNA, 19 nt, Pseudomonas putida KT2440
ccaggccccgauacagcgc

SEQ ID NO: 3570506 - RNA, 18 nt, Pseudomonas putida KT2440
ccaggccccuuggccaac

SEQ ID NO: 3570507 - RNA, 19 nt, Pseudomonas putida KT2440
ccaggcccgcaagggucug

SEQ ID NO: 3570508 - RNA, 20 nt, Pseudomonas putida KT2440
ccaggcccugacgccagcgc

SEQ ID NO: 3570509 - RNA, 21 nt, Pseudomonas putida KT2440
ccaggcccugacgccagcgcu

SEQ ID NO: 3570510 - RNA, 14 nt, Pseudomonas putida KT2440
ccaggcccugcagc

SEQ ID NO: 3570511 - RNA, 15 nt, Pseudomonas putida KT2440
ccaggcccugcagcg

SEQ ID NO: 3570512 - RNA, 18 nt, Pseudomonas putida KT2440
ccaggcccugcagcgcuu

SEQ ID NO: 3570513 - RNA, 10 nt, Pseudomonas putida KT2440
ccaggccgaa

SEQ ID NO: 3570514 - RNA, 16 nt, Pseudomonas putida KT2440
ccaggccgaaaccgcc

SEQ ID NO: 3570515 - RNA, 11 nt, Pseudomonas putida KT2440
ccaggccgaca

SEQ ID NO: 3570516 - RNA, 18 nt, Pseudomonas putida KT2440
ccaggccgaucaccagca

SEQ ID NO: 3570517 - RNA, 20 nt, Pseudomonas putida KT2440
ccaggccgaucaccagcacc

SEQ ID NO: 3570518 - RNA, 16 nt, Pseudomonas putida KT2440
ccaggccgauggcgau

SEQ ID NO: 3570519 - RNA, 17 nt, Pseudomonas putida KT2440
ccaggccgcacgcgccu

SEQ ID NO: 3570520 - RNA, 16 nt, Pseudomonas putida KT2440
ccaggccgcccaccca

SEQ ID NO: 3570521 - RNA, 16 nt, Pseudomonas putida KT2440
ccaggugguagucggc

SEQ ID NO: 3570522 - RNA, 17 nt, Pseudomonas putida KT2440
ccagguguuugggcuug

SEQ ID NO: 3570523 - RNA, 18 nt, Pseudomonas putida KT2440
ccagguuauacgccgccg

SEQ ID NO: 3570524 - RNA, 14 nt, Pseudomonas putida KT2440
ccagguuauccaca

SEQ ID NO: 3570525 - RNA, 14 nt, Pseudomonas putida KT2440
ccagguucggauca

SEQ ID NO: 3570526 - RNA, 16 nt, Pseudomonas putida KT2440
ccagguucucgcucca

SEQ ID NO: 3570527 - RNA, 19 nt, Pseudomonas putida KT2440
ccagguucuguaugacgau

SEQ ID NO: 3570528 - RNA, 22 nt, Pseudomonas putida KT2440
ccagguugcguugaccugcugg

SEQ ID NO: 3570529 - RNA, 23 nt, Pseudomonas putida KT2440
ccagguugcguugaccugcuggg

SEQ ID NO: 3570530 - RNA, 17 nt, Pseudomonas putida KT2440
ccagguuggccgccgcc

SEQ ID NO: 3570531 - RNA, 20 nt, Pseudomonas putida KT2440
ccagguuuucucgucuggcg

SEQ ID NO: 3570532 - RNA, 22 nt, Pseudomonas putida KT2440
ccagguuuucucgucuggcgcg

SEQ ID NO: 3570533 - RNA, 18 nt, Pseudomonas putida KT2440
ccaguaaugcagccggcc

SEQ ID NO: 3570534 - RNA, 14 nt, Pseudomonas putida KT2440
ccaguaccacagcc

SEQ ID NO: 3570535 - RNA, 14 nt, Pseudomonas putida KT2440
ccaguaccagcagc

SEQ ID NO: 3570536 - RNA, 16 nt, Pseudomonas putida KT2440
ccaguaccagcagcac

SEQ ID NO: 3570537 - RNA, 21 nt, Pseudomonas putida KT2440
ccaguaccaggucgccagcac

SEQ ID NO: 3570538 - RNA, 19 nt, Pseudomonas putida KT2440
ccaguaccgcgccuccagc

SEQ ID NO: 3570539 - RNA, 23 nt, Pseudomonas putida KT2440
ccaguacgaacuacgcgccagca

SEQ ID NO: 3570540 - RNA, 15 nt, Pseudomonas putida KT2440
ccaguacgccaccca

SEQ ID NO: 3570541 - RNA, 19 nt, Pseudomonas putida KT2440
ccaguacgccacccagaug

SEQ ID NO: 3570542 - RNA, 17 nt, Pseudomonas putida KT2440
ccaguacgcgccugcac

SEQ ID NO: 3570543 - RNA, 18 nt, Pseudomonas putida KT2440
ccaguacgcgccugcacc

SEQ ID NO: 3570544 - RNA, 22 nt, Pseudomonas putida KT2440
ccaguacgcgccugcaccuggc

SEQ ID NO: 3570545 - RNA, 19 nt, Pseudomonas putida KT2440
ccaguacggccaucagcaa

SEQ ID NO: 3570546 - RNA, 21 nt, Pseudomonas putida KT2440
ccaguacggccaucagcaagc

SEQ ID NO: 3570547 - RNA, 16 nt, Pseudomonas putida KT2440
ccaguacggcgccacu

SEQ ID NO: 3570548 - RNA, 13 nt, Pseudomonas putida KT2440
ccaguacugggcg

SEQ ID NO: 3570549 - RNA, 14 nt, Pseudomonas putida KT2440
ccaguagcaaucag

SEQ ID NO: 3570550 - RNA, 15 nt, Pseudomonas putida KT2440
ccaguagcacagugc

SEQ ID NO: 3570551 - RNA, 15 nt, Pseudomonas putida KT2440
ccaguaggcugcagc

SEQ ID NO: 3570552 - RNA, 16 nt, Pseudomonas putida KT2440
ccaguaggcugcagcc

SEQ ID NO: 3570553 - RNA, 19 nt, Pseudomonas putida KT2440
ccaguaggugugaucuucu

SEQ ID NO: 3570554 - RNA, 18 nt, Pseudomonas putida KT2440
ccaguaguucucgacagc

SEQ ID NO: 3570555 - RNA, 23 nt, Pseudomonas putida KT2440
ccagucaccuugcuccaccaggc

SEQ ID NO: 3570556 - RNA, 22 nt, Pseudomonas putida KT2440
ccagucagaagcagcugaauug

SEQ ID NO: 3570557 - RNA, 13 nt, Pseudomonas putida KT2440
ccagucagcgccg

SEQ ID NO: 3570558 - RNA, 15 nt, Pseudomonas putida KT2440
ccagucauccgggcc

SEQ ID NO: 3570559 - RNA, 12 nt, Pseudomonas putida KT2440
ccaguccaggcc

SEQ ID NO: 3570560 - RNA, 20 nt, Pseudomonas putida KT2440
ccaguccgccucgucgaugu

SEQ ID NO: 3570561 - RNA, 15 nt, Pseudomonas putida KT2440
ccaguccguuaccac

SEQ ID NO: 3570562 - RNA, 15 nt, Pseudomonas putida KT2440
ccaguccuuggccaa

SEQ ID NO: 3570563 - RNA, 17 nt, Pseudomonas putida KT2440
ccagucgaucagcgaca

SEQ ID NO: 3570564 - RNA, 20 nt, Pseudomonas putida KT2440
ccagucgaugggcccgagcc

SEQ ID NO: 3570565 - RNA, 18 nt, Pseudomonas putida KT2440
ccagucgcacagguccag

SEQ ID NO: 3570566 - RNA, 19 nt, Pseudomonas putida KT2440
ccagucgcacagguccagc

SEQ ID NO: 3570567 - RNA, 20 nt, Pseudomonas putida KT2440
ccagucgcacagguccagcc

SEQ ID NO: 3570568 - RNA, 18 nt, Pseudomonas putida KT2440
ccagucgccccgccagcg

SEQ ID NO: 3570569 - RNA, 20 nt, Pseudomonas putida KT2440
ccagucgccccgccagcgcc

SEQ ID NO: 3570570 - RNA, 12 nt, Pseudomonas putida KT2440
ccagucgcgcaa

SEQ ID NO: 3570571 - RNA, 18 nt, Pseudomonas putida KT2440
ccagucgcgcaacugccc

SEQ ID NO: 3570572 - RNA, 22 nt, Pseudomonas putida KT2440
ccagucggcauccucaagcugc

SEQ ID NO: 3570573 - RNA, 12 nt, Pseudomonas putida KT2440
ccagucugcuca

SEQ ID NO: 3570574 - RNA, 15 nt, Pseudomonas putida KT2440
ccagucugcucagcc

SEQ ID NO: 3570575 - RNA, 23 nt, Pseudomonas putida KT2440
ccagucugcucagccaaccgccc

SEQ ID NO: 3570576 - RNA, 18 nt, Pseudomonas putida KT2440
ccagucugcuccaccgca

SEQ ID NO: 3570577 - RNA, 21 nt, Pseudomonas putida KT2440
ccagugaagcucgaucugccu

SEQ ID NO: 3570578 - RNA, 18 nt, Pseudomonas putida KT2440
ccagugcaggucuacccc

SEQ ID NO: 3570579 - RNA, 22 nt, Pseudomonas putida KT2440
ccagugccaugaacaccaccgc

SEQ ID NO: 3570580 - RNA, 15 nt, Pseudomonas putida KT2440
ccagugccgcaagca

SEQ ID NO: 3570581 - RNA, 21 nt, Pseudomonas putida KT2440
ccagugccgcaagcaguccca

SEQ ID NO: 3570582 - RNA, 13 nt, Pseudomonas putida KT2440
ccagugccgccac

SEQ ID NO: 3570583 - RNA, 16 nt, Pseudomonas putida KT2440
ccagugccggguccag

SEQ ID NO: 3570584 - RNA, 19 nt, Pseudomonas putida KT2440
ccagugccugaccggucag

SEQ ID NO: 3570585 - RNA, 13 nt, Pseudomonas putida KT2440
ccagugccuucag

SEQ ID NO: 3570586 - RNA, 19 nt, Pseudomonas putida KT2440
ccagugcgcccgaggcaau

SEQ ID NO: 3570587 - RNA, 14 nt, Pseudomonas putida KT2440
ccagugcgcgcaac

SEQ ID NO: 3570588 - RNA, 21 nt, Pseudomonas putida KT2440
ccagugcgcgcaacagugccc

SEQ ID NO: 3570589 - RNA, 17 nt, Pseudomonas putida KT2440
ccagugcggugaccgag

SEQ ID NO: 3570590 - RNA, 14 nt, Pseudomonas putida KT2440
ccagugcuucacug

SEQ ID NO: 3570591 - RNA, 17 nt, Pseudomonas putida KT2440
ccagugcuucacugccg

SEQ ID NO: 3570592 - RNA, 21 nt, Pseudomonas putida KT2440
ccagugcuucacugccggcaa

SEQ ID NO: 3570593 - RNA, 21 nt, Pseudomonas putida KT2440
ccaguggcacccacagcgccu

SEQ ID NO: 3570594 - RNA, 15 nt, Pseudomonas putida KT2440
ccaguggugcaaggu

SEQ ID NO: 3570595 - RNA, 15 nt, Pseudomonas putida KT2440
ccagugucugcaacu

SEQ ID NO: 3570596 - RNA, 18 nt, Pseudomonas putida KT2440
ccagugugcaaacaccca

SEQ ID NO: 3570597 - RNA, 21 nt, Pseudomonas putida KT2440
ccaguuacccuguacccgcug

SEQ ID NO: 3570598 - RNA, 17 nt, Pseudomonas putida KT2440
ccaguucaaugccagca

SEQ ID NO: 3570599 - RNA, 14 nt, Pseudomonas putida KT2440
ccaguucagcgccc

SEQ ID NO: 3570600 - RNA, 16 nt, Pseudomonas putida KT2440
ccaguucagcgcccgc

SEQ ID NO: 3570601 - RNA, 17 nt, Pseudomonas putida KT2440
ccaguucagcgcccgca

SEQ ID NO: 3570602 - RNA, 12 nt, Pseudomonas putida KT2440
ccaguucagcuc

SEQ ID NO: 3570603 - RNA, 14 nt, Pseudomonas putida KT2440
ccaguucagcucgc

SEQ ID NO: 3570604 - RNA, 16 nt, Pseudomonas putida KT2440
ccaguucaugcagcgu

SEQ ID NO: 3570605 - RNA, 18 nt, Pseudomonas putida KT2440
ccaguucauucccggcca

SEQ ID NO: 3570606 - RNA, 15 nt, Pseudomonas putida KT2440
ccaguuccaccggca

SEQ ID NO: 3570607 - RNA, 16 nt, Pseudomonas putida KT2440
ccaguuccaccggcaa

SEQ ID NO: 3570608 - RNA, 22 nt, Pseudomonas putida KT2440
ccaguuccacgaccgugaaacc

SEQ ID NO: 3570609 - RNA, 18 nt, Pseudomonas putida KT2440
ccaguuccauccaguccg

SEQ ID NO: 3570610 - RNA, 14 nt, Pseudomonas putida KT2440
ccaguuccggcagg

SEQ ID NO: 3570611 - RNA, 17 nt, Pseudomonas putida KT2440
ccaguuccucggccuga

SEQ ID NO: 3570612 - RNA, 13 nt, Pseudomonas putida KT2440
ccaguuccuggcg

SEQ ID NO: 3570613 - RNA, 21 nt, Pseudomonas putida KT2440
ccaguucgacgcugcugucca

SEQ ID NO: 3570614 - RNA, 17 nt, Pseudomonas putida KT2440
ccaguucgcccuucagc

SEQ ID NO: 3570615 - RNA, 17 nt, Pseudomonas putida KT2440
ccaguucgcgcaagcag

SEQ ID NO: 3570616 - RNA, 14 nt, Pseudomonas putida KT2440
ccaguucggacagg

SEQ ID NO: 3570617 - RNA, 17 nt, Pseudomonas putida KT2440
ccaguucggacaggcgc

SEQ ID NO: 3570618 - RNA, 16 nt, Pseudomonas putida KT2440
ccaguugaucaacccg

SEQ ID NO: 3570619 - RNA, 19 nt, Pseudomonas putida KT2440
ccaguugaucaacccgugc

SEQ ID NO: 3570620 - RNA, 23 nt, Pseudomonas putida KT2440
ccaguugcaggucggcacgcggg

SEQ ID NO: 3570621 - RNA, 15 nt, Pseudomonas putida KT2440
ccaguugcuccaccu

SEQ ID NO: 3570622 - RNA, 22 nt, Pseudomonas putida KT2440
ccaguugcuccaccugccaccc

SEQ ID NO: 3570623 - RNA, 18 nt, Pseudomonas putida KT2440
ccaguugcuggcuggucu

SEQ ID NO: 3570624 - RNA, 14 nt, Pseudomonas putida KT2440
ccaguugcuucugc

SEQ ID NO: 3570625 - RNA, 14 nt, Pseudomonas putida KT2440
ccaguuggcagggc

SEQ ID NO: 3570626 - RNA, 13 nt, Pseudomonas putida KT2440
aggaagcugggaa

SEQ ID NO: 3570627 - RNA, 14 nt, Pseudomonas putida KT2440
aggaaguacgccgg

SEQ ID NO: 3570628 - RNA, 19 nt, Pseudomonas putida KT2440
aggaauagccggugccgaa

SEQ ID NO: 3570629 - RNA, 12 nt, Pseudomonas putida KT2440
aggaaucaccag

SEQ ID NO: 3570630 - RNA, 15 nt, Pseudomonas putida KT2440
aggaauuacgcaggc

SEQ ID NO: 3570631 - RNA, 19 nt, Pseudomonas putida KT2440
aggaauuucggcguugacc

SEQ ID NO: 3570632 - RNA, 23 nt, Pseudomonas putida KT2440
aggacaaaccagcggucugcugc

SEQ ID NO: 3570633 - RNA, 18 nt, Pseudomonas putida KT2440
aggacaagccgacaaaaa

SEQ ID NO: 3570634 - RNA, 21 nt, Pseudomonas putida KT2440
aggacaagccgacaaaaacaa

SEQ ID NO: 3570635 - RNA, 22 nt, Pseudomonas putida KT2440
aggacagugcgacccgcuggcc

SEQ ID NO: 3570636 - RNA, 15 nt, Pseudomonas putida KT2440
aggacugcuucaggc

SEQ ID NO: 3570637 - RNA, 20 nt, Pseudomonas putida KT2440
aggagagccucggcucuccu

SEQ ID NO: 3570638 - RNA, 22 nt, Pseudomonas putida KT2440
aggagcaacuaccaugaaaaac

SEQ ID NO: 3570639 - RNA, 14 nt, Pseudomonas putida KT2440
aggagcgggcacgu

SEQ ID NO: 3570640 - RNA, 11 nt, Pseudomonas putida KT2440
aggagcgggcu

SEQ ID NO: 3570641 - RNA, 21 nt, Pseudomonas putida KT2440
aggagcgggcuuacccgcgaa

SEQ ID NO: 3570642 - RNA, 19 nt, Pseudomonas putida KT2440
aggagcgggcuugcccgcg

SEQ ID NO: 3570643 - RNA, 21 nt, Pseudomonas putida KT2440
aggagcgggucuacccgcgaa

SEQ ID NO: 3570644 - RNA, 20 nt, Pseudomonas putida KT2440
aggagcggguucacccgcga

SEQ ID NO: 3570645 - RNA, 22 nt, Pseudomonas putida KT2440
aggagcggguucacccgcgaag

SEQ ID NO: 3570646 - RNA, 18 nt, Pseudomonas putida KT2440
aggagcggguuuacccgc

SEQ ID NO: 3570647 - RNA, 22 nt, Pseudomonas putida KT2440
aggagcggguuuacccgcgaag

SEQ ID NO: 3570648 - RNA, 14 nt, Pseudomonas putida KT2440
aggagcguccgagc

SEQ ID NO: 3570649 - RNA, 13 nt, Pseudomonas putida KT2440
aggagcugauuca

SEQ ID NO: 3570650 - RNA, 17 nt, Pseudomonas putida KT2440
aggagcugauucagcac

SEQ ID NO: 3570651 - RNA, 18 nt, Pseudomonas putida KT2440
aggagcugauucagcaca

SEQ ID NO: 3570652 - RNA, 23 nt, Pseudomonas putida KT2440
aggagcugauucagcacaccgcu

SEQ ID NO: 3570653 - RNA, 19 nt, Pseudomonas putida KT2440
aggaggcuguuucagcccu

SEQ ID NO: 3570654 - RNA, 21 nt, Pseudomonas putida KT2440
aggagggccguaggacagugc

SEQ ID NO: 3570655 - RNA, 14 nt, Pseudomonas putida KT2440
aggaguccagcugc

SEQ ID NO: 3570656 - RNA, 15 nt, Pseudomonas putida KT2440
aggaguccagcugca

SEQ ID NO: 3570657 - RNA, 16 nt, Pseudomonas putida KT2440
aggaguccagcugcau

SEQ ID NO: 3570658 - RNA, 14 nt, Pseudomonas putida KT2440
aggagugucagcgu

SEQ ID NO: 3570659 - RNA, 17 nt, Pseudomonas putida KT2440
aggauauaagccgcccc

SEQ ID NO: 3570660 - RNA, 19 nt, Pseudomonas putida KT2440
aggauauugccgacuccaa

SEQ ID NO: 3570661 - RNA, 17 nt, Pseudomonas putida KT2440
aggaucaacugccgcgc

SEQ ID NO: 3570662 - RNA, 17 nt, Pseudomonas putida KT2440
aggaucaccaaggcuug

SEQ ID NO: 3570663 - RNA, 12 nt, Pseudomonas putida KT2440
aggaucacccag

SEQ ID NO: 3570664 - RNA, 14 nt, Pseudomonas putida KT2440
aggaucagcgcauc

SEQ ID NO: 3570665 - RNA, 15 nt, Pseudomonas putida KT2440
aggaucagcucggca

SEQ ID NO: 3570666 - RNA, 18 nt, Pseudomonas putida KT2440
aggaucgcgcagcagcuc

SEQ ID NO: 3570667 - RNA, 15 nt, Pseudomonas putida KT2440
aggaucuccucggcc

SEQ ID NO: 3570668 - RNA, 21 nt, Pseudomonas putida KT2440
aggaucuuuuaugccuagcca

SEQ ID NO: 3570669 - RNA, 13 nt, Pseudomonas putida KT2440
aggaugcggcuga

SEQ ID NO: 3570670 - RNA, 16 nt, Pseudomonas putida KT2440
aggaugcggcugaccc

SEQ ID NO: 3570671 - RNA, 19 nt, Pseudomonas putida KT2440
aggaugcggcugaccccac

SEQ ID NO: 3570672 - RNA, 22 nt, Pseudomonas putida KT2440
aggauggcaccgaucaccuggg

SEQ ID NO: 3570673 - RNA, 16 nt, Pseudomonas putida KT2440
aggauggcauuggcca

SEQ ID NO: 3570674 - RNA, 14 nt, Pseudomonas putida KT2440
aggauggccgcagg

SEQ ID NO: 3570675 - RNA, 17 nt, Pseudomonas putida KT2440
aggauucagcacgcugg

SEQ ID NO: 3570676 - RNA, 20 nt, Pseudomonas putida KT2440
aggauucgaaccuacgacca

SEQ ID NO: 3570677 - RNA, 19 nt, Pseudomonas putida KT2440
aggauuugcccgcaaagca

SEQ ID NO: 3570678 - RNA, 23 nt, Pseudomonas putida KT2440
aggcaaaacaaaaagcgcagcgc

SEQ ID NO: 3570679 - RNA, 21 nt, Pseudomonas putida KT2440
aggcaaacgaaaucugccugc

SEQ ID NO: 3570680 - RNA, 21 nt, Pseudomonas putida KT2440
aggcaaacgcggucagcgaau

SEQ ID NO: 3570681 - RNA, 22 nt, Pseudomonas putida KT2440
aggcaaacgcggucagcgaaua

SEQ ID NO: 3570682 - RNA, 17 nt, Pseudomonas putida KT2440
aggcaaagaaacaccag

SEQ ID NO: 3570683 - RNA, 16 nt, Pseudomonas putida KT2440
aggcaaaggucugcug

SEQ ID NO: 3570684 - RNA, 17 nt, Pseudomonas putida KT2440
aggcaaaggucugcugc

SEQ ID NO: 3570685 - RNA, 18 nt, Pseudomonas putida KT2440
aggcaaaggucugcugcg

SEQ ID NO: 3570686 - RNA, 23 nt, Pseudomonas putida KT2440
aggcaaaggucugcugcggccgc

SEQ ID NO: 3570687 - RNA, 19 nt, Pseudomonas putida KT2440
aggcaaaguugagcgccgc

SEQ ID NO: 3570688 - RNA, 21 nt, Pseudomonas putida KT2440
aggcaaaguugagcgccgcga

SEQ ID NO: 3570689 - RNA, 13 nt, Pseudomonas putida KT2440
aggcaaccgcauc

SEQ ID NO: 3570690 - RNA, 14 nt, Pseudomonas putida KT2440
aggcaaccgcaucc

SEQ ID NO: 3570691 - RNA, 22 nt, Pseudomonas putida KT2440
aggcaacgucaucggcccacgg

SEQ ID NO: 3570692 - RNA, 20 nt, Pseudomonas putida KT2440
aggcaagcccgcuugcugug

SEQ ID NO: 3570693 - RNA, 18 nt, Pseudomonas putida KT2440
aggcaaguggaagcgcgg

SEQ ID NO: 3570694 - RNA, 20 nt, Pseudomonas putida KT2440
aggcaauaaaaaaccggcgc

SEQ ID NO: 3570695 - RNA, 17 nt, Pseudomonas putida KT2440
aggcaaucgcgcccggu

SEQ ID NO: 3570696 - RNA, 21 nt, Pseudomonas putida KT2440
aggcaaucgugaucaucccca

SEQ ID NO: 3570697 - RNA, 13 nt, Pseudomonas putida KT2440
aggcaaugcccau

SEQ ID NO: 3570698 - RNA, 16 nt, Pseudomonas putida KT2440
aggcaauugugccgcg

SEQ ID NO: 3570699 - RNA, 18 nt, Pseudomonas putida KT2440
aggcacaaaaaagcccgg

SEQ ID NO: 3570700 - RNA, 12 nt, Pseudomonas putida KT2440
aggcacacccgg

SEQ ID NO: 3570701 - RNA, 13 nt, Pseudomonas putida KT2440
aggcacacccgga

SEQ ID NO: 3570702 - RNA, 19 nt, Pseudomonas putida KT2440
aggcacacccggacccugg

SEQ ID NO: 3570703 - RNA, 13 nt, Pseudomonas putida KT2440
aggcacaggccag

SEQ ID NO: 3570704 - RNA, 13 nt, Pseudomonas putida KT2440
aggcacaggccca

SEQ ID NO: 3570705 - RNA, 17 nt, Pseudomonas putida KT2440
aggcacaggcccagcaa

SEQ ID NO: 3570706 - RNA, 18 nt, Pseudomonas putida KT2440
aggcacauccugcaaggc

SEQ ID NO: 3570707 - RNA, 11 nt, Pseudomonas putida KT2440
aggcaccaacu

SEQ ID NO: 3570708 - RNA, 15 nt, Pseudomonas putida KT2440
aggcaccaacugcac

SEQ ID NO: 3570709 - RNA, 20 nt, Pseudomonas putida KT2440
aggcaccaacugcacccgcc

SEQ ID NO: 3570710 - RNA, 20 nt, Pseudomonas putida KT2440
aggcaccacaagaacugcga

SEQ ID NO: 3570711 - RNA, 15 nt, Pseudomonas putida KT2440
aggcaccagcgcugc

SEQ ID NO: 3570712 - RNA, 14 nt, Pseudomonas putida KT2440
aggcacccagccag

SEQ ID NO: 3570713 - RNA, 22 nt, Pseudomonas putida KT2440
aggcaccgaguaccgucggcac

SEQ ID NO: 3570714 - RNA, 23 nt, Pseudomonas putida KT2440
aggcacgacugaacaccugccag

SEQ ID NO: 3570715 - RNA, 14 nt, Pseudomonas putida KT2440
aggcacgaugaccg

SEQ ID NO: 3570716 - RNA, 14 nt, Pseudomonas putida KT2440
aggcacggcaccag

SEQ ID NO: 3570717 - RNA, 18 nt, Pseudomonas putida KT2440
aggcacggcaccagcacc

SEQ ID NO: 3570718 - RNA, 21 nt, Pseudomonas putida KT2440
aggcacuaagcgaaacaccag

SEQ ID NO: 3570719 - RNA, 15 nt, Pseudomonas putida KT2440
aggcacuggccagcg

SEQ ID NO: 3570720 - RNA, 18 nt, Pseudomonas putida KT2440
aggcagaucgaaagacag

SEQ ID NO: 3570721 - RNA, 20 nt, Pseudomonas putida KT2440
aggcagcaacgccuucaggc

SEQ ID NO: 3570722 - RNA, 12 nt, Pseudomonas putida KT2440
aggcagcagcuc

SEQ ID NO: 3570723 - RNA, 17 nt, Pseudomonas putida KT2440
aggcagccuccagguuc

SEQ ID NO: 3570724 - RNA, 18 nt, Pseudomonas putida KT2440
aggcagcucaaagagcaa

SEQ ID NO: 3570725 - RNA, 15 nt, Pseudomonas putida KT2440
aggcaggccagcacg

SEQ ID NO: 3570726 - RNA, 21 nt, Pseudomonas putida KT2440
aggcaggccagcacggccagc

SEQ ID NO: 3570727 - RNA, 14 nt, Pseudomonas putida KT2440
aggcaggucagcga

SEQ ID NO: 3570728 - RNA, 17 nt, Pseudomonas putida KT2440
aggcaguaggugcaggc

SEQ ID NO: 3570729 - RNA, 23 nt, Pseudomonas putida KT2440
aggcaguccugcaacucggccuu

SEQ ID NO: 3570730 - RNA, 22 nt, Pseudomonas putida KT2440
aggcaguucgagcgccugauua

SEQ ID NO: 3570731 - RNA, 19 nt, Pseudomonas putida KT2440
aggcaguuucaggcgcuca

SEQ ID NO: 3570732 - RNA, 23 nt, Pseudomonas putida KT2440
aggcauaaaaaaaccggccacga

SEQ ID NO: 3570733 - RNA, 19 nt, Pseudomonas putida KT2440
aggcauagcgguacagcac

SEQ ID NO: 3570734 - RNA, 21 nt, Pseudomonas putida KT2440
aggcauagcgguacagcaccc

SEQ ID NO: 3570735 - RNA, 19 nt, Pseudomonas putida KT2440
aggcauauccggccuuuuc

SEQ ID NO: 3570736 - RNA, 12 nt, Pseudomonas putida KT2440
aggcauccacac

SEQ ID NO: 3570737 - RNA, 14 nt, Pseudomonas putida KT2440
aggcauccacaccc

SEQ ID NO: 3570738 - RNA, 12 nt, Pseudomonas putida KT2440
aggcauccagcu

SEQ ID NO: 3570739 - RNA, 20 nt, Pseudomonas putida KT2440
aggcaugaauaaccugguua

SEQ ID NO: 3570740 - RNA, 22 nt, Pseudomonas putida KT2440
aggcaugacaaacgccagcaug

SEQ ID NO: 3570741 - RNA, 16 nt, Pseudomonas putida KT2440
aggcaugccagcagcu

SEQ ID NO: 3570742 - RNA, 19 nt, Pseudomonas putida KT2440
aggcaugccagcagcuggc

SEQ ID NO: 3570743 - RNA, 15 nt, Pseudomonas putida KT2440
aggcaugcgucuggc

SEQ ID NO: 3570744 - RNA, 20 nt, Pseudomonas putida KT2440
aggcaugcgucuggcggccc

SEQ ID NO: 3570745 - RNA, 12 nt, Pseudomonas putida KT2440
aggcaugggcca

SEQ ID NO: 3570746 - RNA, 21 nt, Pseudomonas putida KT2440
aggcauucagcucggccaccc

SEQ ID NO: 3570747 - RNA, 15 nt, Pseudomonas putida KT2440
aggcauucgcgggcg

SEQ ID NO: 3570748 - RNA, 23 nt, Pseudomonas putida KT2440
aggcauucggugugcucggcgau

SEQ ID NO: 3570749 - RNA, 23 nt, Pseudomonas putida KT2440
aggcauugcucgauuagcuccac

SEQ ID NO: 3570750 - RNA, 21 nt, Pseudomonas putida KT2440
aggcauuuucaaugcuuugau

SEQ ID NO: 3570751 - RNA, 20 nt, Pseudomonas putida KT2440
aggcauuuucgaucaucgcc

SEQ ID NO: 3570752 - RNA, 13 nt, Pseudomonas putida KT2440
aggccaacugcgc

SEQ ID NO: 3570753 - RNA, 22 nt, Pseudomonas putida KT2440
aggccaacugcgcccgccccuc

SEQ ID NO: 3570754 - RNA, 14 nt, Pseudomonas putida KT2440
aggccaagguugcc

SEQ ID NO: 3570755 - RNA, 18 nt, Pseudomonas putida KT2440
aggccaagguugccacca

SEQ ID NO: 3570756 - RNA, 14 nt, Pseudomonas putida KT2440
aggccaaguacggc

SEQ ID NO: 3570757 - RNA, 17 nt, Pseudomonas putida KT2440
aggccaaguacggccag

SEQ ID NO: 3570758 - RNA, 21 nt, Pseudomonas putida KT2440
aggccaaguacggccagcagg

SEQ ID NO: 3570759 - RNA, 20 nt, Pseudomonas putida KT2440
aggccaaugcagcuuugagg

SEQ ID NO: 3570760 - RNA, 20 nt, Pseudomonas putida KT2440
aggccaaugcccaugcccag

SEQ ID NO: 3570761 - RNA, 14 nt, Pseudomonas putida KT2440
aggccaccggcagc

SEQ ID NO: 3570762 - RNA, 15 nt, Pseudomonas putida KT2440
aggccaccguugcgc

SEQ ID NO: 3570763 - RNA, 14 nt, Pseudomonas putida KT2440
aggccacgcgguac

SEQ ID NO: 3570764 - RNA, 14 nt, Pseudomonas putida KT2440
aggccacgguaggc

SEQ ID NO: 3570765 - RNA, 18 nt, Pseudomonas putida KT2440
aggccagcacggccagca

SEQ ID NO: 3570766 - RNA, 16 nt, Pseudomonas putida KT2440
aggccagccagguaug

SEQ ID NO: 3570767 - RNA, 17 nt, Pseudomonas putida KT2440
aggccagcccauggcgc

SEQ ID NO: 3570768 - RNA, 20 nt, Pseudomonas putida KT2440
aggccagcccauggcgcuga

SEQ ID NO: 3570769 - RNA, 22 nt, Pseudomonas putida KT2440
aggccagcccauggcgcugacc

SEQ ID NO: 3570770 - RNA, 12 nt, Pseudomonas putida KT2440
aggccagcgcac

SEQ ID NO: 3570771 - RNA, 15 nt, Pseudomonas putida KT2440
aggccagcgcacagc

SEQ ID NO: 3570772 - RNA, 23 nt, Pseudomonas putida KT2440
aggccaggaacagcgcagccacc

SEQ ID NO: 3570773 - RNA, 17 nt, Pseudomonas putida KT2440
aggccaggacaggagag

SEQ ID NO: 3570774 - RNA, 13 nt, Pseudomonas putida KT2440
aggccaguuccuc

SEQ ID NO: 3570775 - RNA, 20 nt, Pseudomonas putida KT2440
aggccauauugcugagccag

SEQ ID NO: 3570776 - RNA, 21 nt, Pseudomonas putida KT2440
aggccauauugcugagccagu

SEQ ID NO: 3570777 - RNA, 22 nt, Pseudomonas putida KT2440
aggccauauugcugagccaguu

SEQ ID NO: 3570778 - RNA, 17 nt, Pseudomonas putida KT2440
aggccaucagcagcugu

SEQ ID NO: 3570779 - RNA, 13 nt, Pseudomonas putida KT2440
aggccauccagcg

SEQ ID NO: 3570780 - RNA, 17 nt, Pseudomonas putida KT2440
aggccaugcugcgccag

SEQ ID NO: 3570781 - RNA, 16 nt, Pseudomonas putida KT2440
aggccauucaccuguu

SEQ ID NO: 3570782 - RNA, 15 nt, Pseudomonas putida KT2440
aggcccagcaacagc

SEQ ID NO: 3570783 - RNA, 22 nt, Pseudomonas putida KT2440
aggcccagcaacagccccauca

SEQ ID NO: 3570784 - RNA, 23 nt, Pseudomonas putida KT2440
aggcccagcaugaacgcagcuuc

SEQ ID NO: 3570785 - RNA, 12 nt, Pseudomonas putida KT2440
aggcccagcccc

SEQ ID NO: 3570786 - RNA, 21 nt, Pseudomonas putida KT2440
aggcccauuucgcgggucagg

SEQ ID NO: 3570787 - RNA, 23 nt, Pseudomonas putida KT2440
aggcccauuucgcgggucagggg

SEQ ID NO: 3570788 - RNA, 14 nt, Pseudomonas putida KT2440
aggccccgacagca

SEQ ID NO: 3570789 - RNA, 18 nt, Pseudomonas putida KT2440
aggccccugcaacagggc

SEQ ID NO: 3570790 - RNA, 19 nt, Pseudomonas putida KT2440
aggccccuuggccaacggc

SEQ ID NO: 3570791 - RNA, 17 nt, Pseudomonas putida KT2440
aggcccgaacagacaac

SEQ ID NO: 3570792 - RNA, 16 nt, Pseudomonas putida KT2440
aggcccgcaagggucu

SEQ ID NO: 3570793 - RNA, 19 nt, Pseudomonas putida KT2440
aggcccgcgccgacagccu

SEQ ID NO: 3570794 - RNA, 23 nt, Pseudomonas putida KT2440
aggcccgcuauccucgaucgcca

SEQ ID NO: 3570795 - RNA, 13 nt, Pseudomonas putida KT2440
aggcccggcccuu

SEQ ID NO: 3570796 - RNA, 21 nt, Pseudomonas putida KT2440
aggcccggcugaaaccgcgaa

SEQ ID NO: 3570797 - RNA, 14 nt, Pseudomonas putida KT2440
aggcccgugacgaa

SEQ ID NO: 3570798 - RNA, 22 nt, Pseudomonas putida KT2440
aggcccuccccguuuggcagcu

SEQ ID NO: 3570799 - RNA, 13 nt, Pseudomonas putida KT2440
aggcccugacgcc

SEQ ID NO: 3570800 - RNA, 15 nt, Pseudomonas putida KT2440
aggcccugcugcuuc

SEQ ID NO: 3570801 - RNA, 18 nt, Pseudomonas putida KT2440
aggccgaaaccgcccggg

SEQ ID NO: 3570802 - RNA, 16 nt, Pseudomonas putida KT2440
aggccgacaacagcau

SEQ ID NO: 3570803 - RNA, 16 nt, Pseudomonas putida KT2440
aggccgacacggggug

SEQ ID NO: 3570804 - RNA, 18 nt, Pseudomonas putida KT2440
aggccgacaguguugccg

SEQ ID NO: 3570805 - RNA, 22 nt, Pseudomonas putida KT2440
aggccgaucaccagcaccccga

SEQ ID NO: 3570806 - RNA, 22 nt, Pseudomonas putida KT2440
aggccgauguuguggcuguuca

SEQ ID NO: 3570807 - RNA, 23 nt, Pseudomonas putida KT2440
aggccgauguuguggcuguucag

SEQ ID NO: 3570808 - RNA, 16 nt, Pseudomonas putida KT2440
aggccgauuuggcccg

SEQ ID NO: 3570809 - RNA, 14 nt, Pseudomonas putida KT2440
aggccgcagccucu

SEQ ID NO: 3570810 - RNA, 10 nt, Pseudomonas putida KT2440
aggccgccga

SEQ ID NO: 3570811 - RNA, 13 nt, Pseudomonas putida KT2440
aggccgccgacga

SEQ ID NO: 3570812 - RNA, 13 nt, Pseudomonas putida KT2440
aggccgccuuggc

SEQ ID NO: 3570813 - RNA, 18 nt, Pseudomonas putida KT2440
aggccgcucccacaggua

SEQ ID NO: 3570814 - RNA, 22 nt, Pseudomonas putida KT2440
aggccgcuccugcggucagccu

SEQ ID NO: 3570815 - RNA, 13 nt, Pseudomonas putida KT2440
aggccgcugugcc

SEQ ID NO: 3570816 - RNA, 14 nt, Pseudomonas putida KT2440
aggccgcugugcca

SEQ ID NO: 3570817 - RNA, 16 nt, Pseudomonas putida KT2440
aggccgcugugccagc

SEQ ID NO: 3570818 - RNA, 15 nt, Pseudomonas putida KT2440
aggccggcacagaca

SEQ ID NO: 3570819 - RNA, 19 nt, Pseudomonas putida KT2440
aggccggcacagaccgcaa

SEQ ID NO: 3570820 - RNA, 19 nt, Pseudomonas putida KT2440
aggccggcacaggaaggca

SEQ ID NO: 3570821 - RNA, 17 nt, Pseudomonas putida KT2440
aggccggcagccagggc

SEQ ID NO: 3570822 - RNA, 13 nt, Pseudomonas putida KT2440
aggccggccauac

SEQ ID NO: 3570823 - RNA, 18 nt, Pseudomonas putida KT2440
aggccggccauaccggua

SEQ ID NO: 3570824 - RNA, 13 nt, Pseudomonas putida KT2440
aggccggggaugc

SEQ ID NO: 3570825 - RNA, 15 nt, Pseudomonas putida KT2440
aggccggguccugca

SEQ ID NO: 3570826 - RNA, 16 nt, Pseudomonas putida KT2440
aggccgguacagccag

SEQ ID NO: 3570827 - RNA, 17 nt, Pseudomonas putida KT2440
aggccgguacagccagc

SEQ ID NO: 3570828 - RNA, 21 nt, Pseudomonas putida KT2440
aggccgguuuuuucaugcacg

SEQ ID NO: 3570829 - RNA, 18 nt, Pseudomonas putida KT2440
aggccguagcgcugacca

SEQ ID NO: 3570830 - RNA, 16 nt, Pseudomonas putida KT2440
aggccguaggccaggu

SEQ ID NO: 3570831 - RNA, 17 nt, Pseudomonas putida KT2440
aggccguaggccaggua

SEQ ID NO: 3570832 - RNA, 19 nt, Pseudomonas putida KT2440
aggccguaggccagguaca

SEQ ID NO: 3570833 - RNA, 22 nt, Pseudomonas putida KT2440
aggccguaggccagguacaggc

SEQ ID NO: 3570834 - RNA, 23 nt, Pseudomonas putida KT2440
aggccguaggccagguacaggca

SEQ ID NO: 3570835 - RNA, 15 nt, Pseudomonas putida KT2440
aggccgucagcagca

SEQ ID NO: 3570836 - RNA, 16 nt, Pseudomonas putida KT2440
aggccgucagcagcag

SEQ ID NO: 3570837 - RNA, 18 nt, Pseudomonas putida KT2440
aggccgugaaccauccca

SEQ ID NO: 3570838 - RNA, 16 nt, Pseudomonas putida KT2440
aggccguugaucagcg

SEQ ID NO: 3570839 - RNA, 23 nt, Pseudomonas putida KT2440
aggccguugaucagcgacaccgc

SEQ ID NO: 3570840 - RNA, 17 nt, Pseudomonas putida KT2440
aggccucacgcaucugc

SEQ ID NO: 3570841 - RNA, 19 nt, Pseudomonas putida KT2440
aggccucacgcaucugcgc

SEQ ID NO: 3570842 - RNA, 14 nt, Pseudomonas putida KT2440
aggccuccagguaa

SEQ ID NO: 3570843 - RNA, 16 nt, Pseudomonas putida KT2440
aggccucgaacagcag

SEQ ID NO: 3570844 - RNA, 17 nt, Pseudomonas putida KT2440
aggccugaaacccaucc

SEQ ID NO: 3570845 - RNA, 19 nt, Pseudomonas putida KT2440
aggccugaaacccauccac

SEQ ID NO: 3570846 - RNA, 21 nt, Pseudomonas putida KT2440
aggccugcacuaagggcaggc

SEQ ID NO: 3570847 - RNA, 16 nt, Pseudomonas putida KT2440
aggccugcggccaggc

SEQ ID NO: 3570848 - RNA, 17 nt, Pseudomonas putida KT2440
aggccugcggccaggcc

SEQ ID NO: 3570849 - RNA, 17 nt, Pseudomonas putida KT2440
aggccuggaugcguugc

SEQ ID NO: 3570850 - RNA, 14 nt, Pseudomonas putida KT2440
aggccuggcccagu

SEQ ID NO: 3570851 - RNA, 19 nt, Pseudomonas putida KT2440
aggccuucgccacugccac

SEQ ID NO: 3570852 - RNA, 20 nt, Pseudomonas putida KT2440
aggccuucgccacugccacu

SEQ ID NO: 3570853 - RNA, 13 nt, Pseudomonas putida KT2440
aggccuucugcgc

SEQ ID NO: 3570854 - RNA, 19 nt, Pseudomonas putida KT2440
aggccuugaagcgcggcau

SEQ ID NO: 3570855 - RNA, 14 nt, Pseudomonas putida KT2440
aggccuugaucgcu

SEQ ID NO: 3570856 - RNA, 13 nt, Pseudomonas putida KT2440
aggccuuggccac

SEQ ID NO: 3570857 - RNA, 23 nt, Pseudomonas putida KT2440
aggccuuguuccacgcgcaggcg

SEQ ID NO: 3570858 - RNA, 16 nt, Pseudomonas putida KT2440
aggccuuucagcgccc

SEQ ID NO: 3570859 - RNA, 15 nt, Pseudomonas putida KT2440
aggccuuuucacaca

SEQ ID NO: 3570860 - RNA, 15 nt, Pseudomonas putida KT2440
aggcgacgagccagu

SEQ ID NO: 3570861 - RNA, 19 nt, Pseudomonas putida KT2440
aggcgacgaucaucgcgcc

SEQ ID NO: 3570862 - RNA, 15 nt, Pseudomonas putida KT2440
aggcgaugcagggcu

SEQ ID NO: 3570863 - RNA, 17 nt, Pseudomonas putida KT2440
aggcgcaacucagcgca

SEQ ID NO: 3570864 - RNA, 16 nt, Pseudomonas putida KT2440
aggcgcacauccacau

SEQ ID NO: 3570865 - RNA, 23 nt, Pseudomonas putida KT2440
aggcgcagcacaaggcugcgccu

SEQ ID NO: 3570866 - RNA, 21 nt, Pseudomonas putida KT2440
aggcgcagcgcaugcucgcgg

SEQ ID NO: 3570867 - RNA, 13 nt, Pseudomonas putida KT2440
aggcgcagcugcc

SEQ ID NO: 3570868 - RNA, 17 nt, Pseudomonas putida KT2440
aggcgcagggugugcug

SEQ ID NO: 3570869 - RNA, 15 nt, Pseudomonas putida KT2440
aggcgcaggugcagc

SEQ ID NO: 3570870 - RNA, 23 nt, Pseudomonas putida KT2440
aggcgcaggugcagccagcccca

SEQ ID NO: 3570871 - RNA, 15 nt, Pseudomonas putida KT2440
aggcgcccugcgcca

SEQ ID NO: 3570872 - RNA, 19 nt, Pseudomonas putida KT2440
aggcgccgacgauaccgcc

SEQ ID NO: 3570873 - RNA, 23 nt, Pseudomonas putida KT2440
aggcgccgacgauaccgcccagg

SEQ ID NO: 3570874 - RNA, 18 nt, Pseudomonas putida KT2440
aggcgccgaugaagcagg

SEQ ID NO: 3570875 - RNA, 23 nt, Pseudomonas putida KT2440
aggcgccgccagcugcugcccca

SEQ ID NO: 3570876 - RNA, 12 nt, Pseudomonas putida KT2440
aggcgccugccg

SEQ ID NO: 3570877 - RNA, 15 nt, Pseudomonas putida KT2440
aggcgccugccgggu

SEQ ID NO: 3570878 - RNA, 21 nt, Pseudomonas putida KT2440
aggcgcgccugcaccugacga

SEQ ID NO: 3570879 - RNA, 20 nt, Pseudomonas putida KT2440
aggcgcggcagcaugaacag

SEQ ID NO: 3570880 - RNA, 19 nt, Pseudomonas putida KT2440
aggcgcggguuuacccgcg

SEQ ID NO: 3570881 - RNA, 20 nt, Pseudomonas putida KT2440
aggcgcggguuuacccgcga

SEQ ID NO: 3570882 - RNA, 21 nt, Pseudomonas putida KT2440
aggcgcggguuuacccgcgaa

SEQ ID NO: 3570883 - RNA, 19 nt, Pseudomonas putida KT2440
aggcgcggguuugcccgcg

SEQ ID NO: 3570884 - RNA, 20 nt, Pseudomonas putida KT2440
aggcgcggguuugcccgcga

SEQ ID NO: 3570885 - RNA, 21 nt, Pseudomonas putida KT2440
aggcgcggguuugcccgcgaa

SEQ ID NO: 3570886 - RNA, 21 nt, Pseudomonas putida KT2440
aggcgcggguuugcccgcgag

SEQ ID NO: 3570887 - RNA, 16 nt, Pseudomonas putida KT2440
aggcgcggugccggca

SEQ ID NO: 3570888 - RNA, 17 nt, Pseudomonas putida KT2440
aggcgcggugccggcag

SEQ ID NO: 3570889 - RNA, 21 nt, Pseudomonas putida KT2440
aggcgcguaguacuccagcag

SEQ ID NO: 3570890 - RNA, 22 nt, Pseudomonas putida KT2440
aggcgcguaguacuccagcagc

SEQ ID NO: 3570891 - RNA, 13 nt, Pseudomonas putida KT2440
aggcgcucacccc

SEQ ID NO: 3570892 - RNA, 21 nt, Pseudomonas putida KT2440
aggcgcucaccccgccccugc

SEQ ID NO: 3570893 - RNA, 22 nt, Pseudomonas putida KT2440
aggcgcucaccccgccccugcu

SEQ ID NO: 3570894 - RNA, 14 nt, Pseudomonas putida KT2440
aggcgcucaccuac

SEQ ID NO: 3570895 - RNA, 21 nt, Pseudomonas putida KT2440
aggcgcucgcuccagggcagg

SEQ ID NO: 3570896 - RNA, 23 nt, Pseudomonas putida KT2440
aggcgcucgggggugcacagcgu

SEQ ID NO: 3570897 - RNA, 17 nt, Pseudomonas putida KT2440
aggcgcugaaacugucg

SEQ ID NO: 3570898 - RNA, 22 nt, Pseudomonas putida KT2440
aggcgcugaaacugucguggcg

SEQ ID NO: 3570899 - RNA, 11 nt, Pseudomonas putida KT2440
aggcgcuggcg

SEQ ID NO: 3570900 - RNA, 15 nt, Pseudomonas putida KT2440
aggcgcuucagguaa

SEQ ID NO: 3570901 - RNA, 17 nt, Pseudomonas putida KT2440
aggcgcuugaagaagcc

SEQ ID NO: 3570902 - RNA, 19 nt, Pseudomonas putida KT2440
aggcgcuugagcucggcaa

SEQ ID NO: 3570903 - RNA, 21 nt, Pseudomonas putida KT2440
aggcggcaagggcgaaccagg

SEQ ID NO: 3570904 - RNA, 13 nt, Pseudomonas putida KT2440
aggcggccagcca

SEQ ID NO: 3570905 - RNA, 19 nt, Pseudomonas putida KT2440
aggcggccagccaacggca

SEQ ID NO: 3570906 - RNA, 20 nt, Pseudomonas putida KT2440
aggcggcgacaaccgaaaag

SEQ ID NO: 3570907 - RNA, 17 nt, Pseudomonas putida KT2440
aggcggcucuugcagcg

SEQ ID NO: 3570908 - RNA, 20 nt, Pseudomonas putida KT2440
aggcggcucuugcagcgagu

SEQ ID NO: 3570909 - RNA, 23 nt, Pseudomonas putida KT2440
aggcggcugaccuguucgcgcaa

SEQ ID NO: 3570910 - RNA, 13 nt, Pseudomonas putida KT2440
aggcgggucaggu

SEQ ID NO: 3570911 - RNA, 20 nt, Pseudomonas putida KT2440
aggcggguuugggcagugac

SEQ ID NO: 3570912 - RNA, 13 nt, Pseudomonas putida KT2440
aggcguaccggca

SEQ ID NO: 3570913 - RNA, 16 nt, Pseudomonas putida KT2440
aggcguaccugccccc

SEQ ID NO: 3570914 - RNA, 22 nt, Pseudomonas putida KT2440
aggcguagcacaagggccaggu

SEQ ID NO: 3570915 - RNA, 17 nt, Pseudomonas putida KT2440
aggcgucguuguugcgc

SEQ ID NO: 3570916 - RNA, 17 nt, Pseudomonas putida KT2440
aggcguuauaggaaagc

SEQ ID NO: 3570917 - RNA, 20 nt, Pseudomonas putida KT2440
aggcguucaucgaaggccuu

SEQ ID NO: 3570918 - RNA, 14 nt, Pseudomonas putida KT2440
aggcguuggccgaa

SEQ ID NO: 3570919 - RNA, 22 nt, Pseudomonas putida KT2440
aggcguugucggcccacugcac

SEQ ID NO: 3570920 - RNA, 17 nt, Pseudomonas putida KT2440
aggcguuuuuccaugcg

SEQ ID NO: 3570921 - RNA, 17 nt, Pseudomonas putida KT2440
aggcuagcagcaucacc

SEQ ID NO: 3570922 - RNA, 14 nt, Pseudomonas putida KT2440
aggcuagccgguca

SEQ ID NO: 3570923 - RNA, 20 nt, Pseudomonas putida KT2440
aggcuaucgaggggcaggcg

SEQ ID NO: 3570924 - RNA, 13 nt, Pseudomonas putida KT2440
aggcuaugccggu

SEQ ID NO: 3570925 - RNA, 14 nt, Pseudomonas putida KT2440
aggcuccaaagcca

SEQ ID NO: 3570926 - RNA, 14 nt, Pseudomonas putida KT2440
aggcuccagcaccg

SEQ ID NO: 3570927 - RNA, 21 nt, Pseudomonas putida KT2440
aggcucgacggcgcaauccgu

SEQ ID NO: 3570928 - RNA, 21 nt, Pseudomonas putida KT2440
aggcucgcccucgcggcggcu

SEQ ID NO: 3570929 - RNA, 13 nt, Pseudomonas putida KT2440
aggcucggccacc

SEQ ID NO: 3570930 - RNA, 17 nt, Pseudomonas putida KT2440
aggcucggccaccacuu

SEQ ID NO: 3570931 - RNA, 19 nt, Pseudomonas putida KT2440
aggcucucagcccauuuca

SEQ ID NO: 3570932 - RNA, 13 nt, Pseudomonas putida KT2440
aggcucuccagcc

SEQ ID NO: 3570933 - RNA, 24 nt, Pseudomonas putida KT2440
aggcucuccagccgcugcugcagu

SEQ ID NO: 3570934 - RNA, 19 nt, Pseudomonas putida KT2440
aggcucugaaugucagcgc

SEQ ID NO: 3570935 - RNA, 18 nt, Pseudomonas putida KT2440
aggcucugcuccagcugc

SEQ ID NO: 3570936 - RNA, 22 nt, Pseudomonas putida KT2440
aggcucuugaacugggcaucca

SEQ ID NO: 3570937 - RNA, 19 nt, Pseudomonas putida KT2440
aggcucuugaggucggcgc

SEQ ID NO: 3570938 - RNA, 16 nt, Pseudomonas putida KT2440
aggcugaucaggaaca

SEQ ID NO: 3570939 - RNA, 19 nt, Pseudomonas putida KT2440
aggcugaugcgcuggcccu

SEQ ID NO: 3570940 - RNA, 23 nt, Pseudomonas putida KT2440
aggcugaugcgcuggcccuugcc

SEQ ID NO: 3570941 - RNA, 17 nt, Pseudomonas putida KT2440
aggcugcacaaggugcu

SEQ ID NO: 3570942 - RNA, 12 nt, Pseudomonas putida KT2440
aggcugccgcgc

SEQ ID NO: 3570943 - RNA, 11 nt, Pseudomonas putida KT2440
aggcugcgcau

SEQ ID NO: 3570944 - RNA, 18 nt, Pseudomonas putida KT2440
aggcugcgcaucaggcug

SEQ ID NO: 3570945 - RNA, 15 nt, Pseudomonas putida KT2440
aggcugcgcccgcac

SEQ ID NO: 3570946 - RNA, 17 nt, Pseudomonas putida KT2440
aggcugcgcgccauggc

SEQ ID NO: 3570947 - RNA, 18 nt, Pseudomonas putida KT2440
aggcugcgcgccauggcg

SEQ ID NO: 3570948 - RNA, 15 nt, Pseudomonas putida KT2440
aggcugcgcggcccc

SEQ ID NO: 3570949 - RNA, 19 nt, Pseudomonas putida KT2440
aggcugcgugccugcugcu

SEQ ID NO: 3570950 - RNA, 15 nt, Pseudomonas putida KT2440
aggcuggcaaucagc

SEQ ID NO: 3570951 - RNA, 20 nt, Pseudomonas putida KT2440
aggcuggccaccaugaacag

SEQ ID NO: 3570952 - RNA, 13 nt, Pseudomonas putida KT2440
aggcuggccagca

SEQ ID NO: 3570953 - RNA, 18 nt, Pseudomonas putida KT2440
aggcuggcgcuaccccug

SEQ ID NO: 3570954 - RNA, 12 nt, Pseudomonas putida KT2440
aggcuggcgcuu

SEQ ID NO: 3570955 - RNA, 13 nt, Pseudomonas putida KT2440
aggcuggcggggu

SEQ ID NO: 3570956 - RNA, 22 nt, Pseudomonas putida KT2440
aggcuggcgucucguacgggug

SEQ ID NO: 3570957 - RNA, 22 nt, Pseudomonas putida KT2440
aggcuggcguggugcgauucgc

SEQ ID NO: 3570958 - RNA, 17 nt, Pseudomonas putida KT2440
aggcugggcgugacggc

SEQ ID NO: 3570959 - RNA, 17 nt, Pseudomonas putida KT2440
aggcuggucgcugcccu

SEQ ID NO: 3570960 - RNA, 15 nt, Pseudomonas putida KT2440
aggcugucacgauga

SEQ ID NO: 3570961 - RNA, 19 nt, Pseudomonas putida KT2440
aggcugucacgaugaugcu

SEQ ID NO: 3570962 - RNA, 15 nt, Pseudomonas putida KT2440
aggcuguccacacca

SEQ ID NO: 3570963 - RNA, 21 nt, Pseudomonas putida KT2440
aggcugucggcgucggccaug

SEQ ID NO: 3570964 - RNA, 16 nt, Pseudomonas putida KT2440
aggcugugcggcaacc

SEQ ID NO: 3570965 - RNA, 19 nt, Pseudomonas putida KT2440
aggcuguggcccaaggcga

SEQ ID NO: 3570966 - RNA, 16 nt, Pseudomonas putida KT2440
aggcuguuccauuucc

SEQ ID NO: 3570967 - RNA, 22 nt, Pseudomonas putida KT2440
aggcuuacaacugcuccaggca

SEQ ID NO: 3570968 - RNA, 17 nt, Pseudomonas putida KT2440
aggcuucaaggccacgc

SEQ ID NO: 3570969 - RNA, 18 nt, Pseudomonas putida KT2440
aggcuucaaggccacgcg

SEQ ID NO: 3570970 - RNA, 19 nt, Pseudomonas putida KT2440
aggcuucaaggccacgcgg

SEQ ID NO: 3570971 - RNA, 15 nt, Pseudomonas putida KT2440
aggcuucagaucacc

SEQ ID NO: 3570972 - RNA, 18 nt, Pseudomonas putida KT2440
aggcuucagaucacccuu

SEQ ID NO: 3570973 - RNA, 13 nt, Pseudomonas putida KT2440
aggcuugaagcug

SEQ ID NO: 3570974 - RNA, 22 nt, Pseudomonas putida KT2440
aggcuugaaucagccuuugccc

SEQ ID NO: 3570975 - RNA, 19 nt, Pseudomonas putida KT2440
aggcuugcucaaggugucg

SEQ ID NO: 3570976 - RNA, 20 nt, Pseudomonas putida KT2440
aggcuugcuucuugaagcgu

SEQ ID NO: 3570977 - RNA, 15 nt, Pseudomonas putida KT2440
aggcuuggcgaacag

SEQ ID NO: 3570978 - RNA, 19 nt, Pseudomonas putida KT2440
aggcuuuccagguccugcu

SEQ ID NO: 3570979 - RNA, 15 nt, Pseudomonas putida KT2440
aggcuuucggccacc

SEQ ID NO: 3570980 - RNA, 16 nt, Pseudomonas putida KT2440
aggcuuugcugcaggu

SEQ ID NO: 3570981 - RNA, 15 nt, Pseudomonas putida KT2440
agggaacagggcaga

SEQ ID NO: 3570982 - RNA, 14 nt, Pseudomonas putida KT2440
agggaagcucugau

SEQ ID NO: 3570983 - RNA, 19 nt, Pseudomonas putida KT2440
agggacauggggacuccgg

SEQ ID NO: 3570984 - RNA, 12 nt, Pseudomonas putida KT2440
agggagcgggcu

SEQ ID NO: 3570985 - RNA, 15 nt, Pseudomonas putida KT2440
agggauaacgucaca

SEQ ID NO: 3570986 - RNA, 23 nt, Pseudomonas putida KT2440
agggaucaagccugacucagccc

SEQ ID NO: 3570987 - RNA, 14 nt, Pseudomonas putida KT2440
agggaugcuggaca

SEQ ID NO: 3570988 - RNA, 17 nt, Pseudomonas putida KT2440
agggauuggcaacaaug

SEQ ID NO: 3570989 - RNA, 21 nt, Pseudomonas putida KT2440
agggauuggcaacaauguacc

SEQ ID NO: 3570990 - RNA, 17 nt, Pseudomonas putida KT2440
agggcaaaaugcagcaa

SEQ ID NO: 3570991 - RNA, 16 nt, Pseudomonas putida KT2440
agggcaaacacaucca

SEQ ID NO: 3570992 - RNA, 19 nt, Pseudomonas putida KT2440
agggcaaacacauccacau

SEQ ID NO: 3570993 - RNA, 22 nt, Pseudomonas putida KT2440
agggcaaacaccuugccccgca

SEQ ID NO: 3570994 - RNA, 15 nt, Pseudomonas putida KT2440
agggcaaagcccagu

SEQ ID NO: 3570995 - RNA, 14 nt, Pseudomonas putida KT2440
agggcaaugaucag

SEQ ID NO: 3570996 - RNA, 18 nt, Pseudomonas putida KT2440
agggcaaugaucagcccu

SEQ ID NO: 3570997 - RNA, 17 nt, Pseudomonas putida KT2440
agggcaccaguugcagg

SEQ ID NO: 3570998 - RNA, 18 nt, Pseudomonas putida KT2440
agggcacuuguggcgccu

SEQ ID NO: 3570999 - RNA, 14 nt, Pseudomonas putida KT2440
agggcaggggacag

SEQ ID NO: 3571000 - RNA, 16 nt, Pseudomonas putida KT2440
agggcaucggacaggu

SEQ ID NO: 3571001 - RNA, 17 nt, Pseudomonas putida KT2440
agggcaucggcgccccg

SEQ ID NO: 3571002 - RNA, 19 nt, Pseudomonas putida KT2440
agggcaucggcgccccgca

SEQ ID NO: 3571003 - RNA, 20 nt, Pseudomonas putida KT2440
agggcauggccgcccugcgg

SEQ ID NO: 3571004 - RNA, 13 nt, Pseudomonas putida KT2440
agggcaugggcca

SEQ ID NO: 3571005 - RNA, 20 nt, Pseudomonas putida KT2440
agggccaguccaggccaaca

SEQ ID NO: 3571006 - RNA, 14 nt, Pseudomonas putida KT2440
agggccgcaaagcg

SEQ ID NO: 3571007 - RNA, 18 nt, Pseudomonas putida KT2440
agggccgcaaagcggccc

SEQ ID NO: 3571008 - RNA, 19 nt, Pseudomonas putida KT2440
agggccgccaagcggcccc

SEQ ID NO: 3571009 - RNA, 15 nt, Pseudomonas putida KT2440
agggccgcgcaggcg

SEQ ID NO: 3571010 - RNA, 17 nt, Pseudomonas putida KT2440
agggccguaggacagug

SEQ ID NO: 3571011 - RNA, 19 nt, Pseudomonas putida KT2440
agggccguuacucccacag

SEQ ID NO: 3571012 - RNA, 14 nt, Pseudomonas putida KT2440
agggccucgaugcg

SEQ ID NO: 3571013 - RNA, 23 nt, Pseudomonas putida KT2440
agggccugcaggcagcauauggc

SEQ ID NO: 3571014 - RNA, 22 nt, Pseudomonas putida KT2440
agggccuggcgcgaaaagcugu

SEQ ID NO: 3571015 - RNA, 15 nt, Pseudomonas putida KT2440
agggccugugccggg

SEQ ID NO: 3571016 - RNA, 17 nt, Pseudomonas putida KT2440
agggccugugccgggcc

SEQ ID NO: 3571017 - RNA, 20 nt, Pseudomonas putida KT2440
agggccuuccccgugauauc

SEQ ID NO: 3571018 - RNA, 17 nt, Pseudomonas putida KT2440
agggcgaaccaggugcg

SEQ ID NO: 3571019 - RNA, 21 nt, Pseudomonas putida KT2440
agggcgaugcgcacaccgcug

SEQ ID NO: 3571020 - RNA, 12 nt, Pseudomonas putida KT2440
agggcgccguug

SEQ ID NO: 3571021 - RNA, 16 nt, Pseudomonas putida KT2440
agggcgcgcuggcgca

SEQ ID NO: 3571022 - RNA, 17 nt, Pseudomonas putida KT2440
agggcggccaaggcgug

SEQ ID NO: 3571023 - RNA, 14 nt, Pseudomonas putida KT2440
agggcggcgcccag

SEQ ID NO: 3571024 - RNA, 15 nt, Pseudomonas putida KT2440
agggcggcgcccagu

SEQ ID NO: 3571025 - RNA, 14 nt, Pseudomonas putida KT2440
agggcgucgaacac

SEQ ID NO: 3571026 - RNA, 14 nt, Pseudomonas putida KT2440
agggcguucagcaa

SEQ ID NO: 3571027 - RNA, 19 nt, Pseudomonas putida KT2440
agggcguuccagccaggcg

SEQ ID NO: 3571028 - RNA, 15 nt, Pseudomonas putida KT2440
agggcucaacaccag

SEQ ID NO: 3571029 - RNA, 19 nt, Pseudomonas putida KT2440
agggcucaacgccagggca

SEQ ID NO: 3571030 - RNA, 16 nt, Pseudomonas putida KT2440
agggcucauccacccc

SEQ ID NO: 3571031 - RNA, 21 nt, Pseudomonas putida KT2440
agggcugccgcgcagcccaaa

SEQ ID NO: 3571032 - RNA, 23 nt, Pseudomonas putida KT2440
agggcugcgauagaacuccacca

SEQ ID NO: 3571033 - RNA, 20 nt, Pseudomonas putida KT2440
agggcugguggcggcauaca

SEQ ID NO: 3571034 - RNA, 17 nt, Pseudomonas putida KT2440
agggcuuuuuccagcgc

SEQ ID NO: 3571035 - RNA, 18 nt, Pseudomonas putida KT2440
agggcuuuuuccagcgcc

SEQ ID NO: 3571036 - RNA, 16 nt, Pseudomonas putida KT2440
aggggacagccacaug

SEQ ID NO: 3571037 - RNA, 19 nt, Pseudomonas putida KT2440
aggggccgcuuugcggccc

SEQ ID NO: 3571038 - RNA, 21 nt, Pseudomonas putida KT2440
aggggccggcacaggcuuaca

SEQ ID NO: 3571039 - RNA, 19 nt, Pseudomonas putida KT2440
aggggcggauuugcccgcu

SEQ ID NO: 3571040 - RNA, 21 nt, Pseudomonas putida KT2440
aggggcggguggaggugcagg

SEQ ID NO: 3571041 - RNA, 13 nt, Pseudomonas putida KT2440
aggggcuaaaacc

SEQ ID NO: 3571042 - RNA, 20 nt, Pseudomonas putida KT2440
aggggcuagcuacucggcaa

SEQ ID NO: 3571043 - RNA, 19 nt, Pseudomonas putida KT2440
aggggcucuucgcggguga

SEQ ID NO: 3571044 - RNA, 12 nt, Pseudomonas putida KT2440
aggggcuguaua

SEQ ID NO: 3571045 - RNA, 18 nt, Pseudomonas putida KT2440
aggggcuuuuuguccauu

SEQ ID NO: 3571046 - RNA, 16 nt, Pseudomonas putida KT2440
agggggaugucgcugu

SEQ ID NO: 3571047 - RNA, 16 nt, Pseudomonas putida KT2440
agggggcagcugcuga

SEQ ID NO: 3571048 - RNA, 17 nt, Pseudomonas putida KT2440
agggggguaaggcuggc

SEQ ID NO: 3571049 - RNA, 22 nt, Pseudomonas putida KT2440
agggguaaugccccagccgaac

SEQ ID NO: 3571050 - RNA, 21 nt, Pseudomonas putida KT2440
agggguagcgucaacugccag

SEQ ID NO: 3571051 - RNA, 13 nt, Pseudomonas putida KT2440
aggggucgcggcc

SEQ ID NO: 3571052 - RNA, 19 nt, Pseudomonas putida KT2440
aggggugcaaagcgccccc

SEQ ID NO: 3571053 - RNA, 13 nt, Pseudomonas putida KT2440
aggguaggggugg

SEQ ID NO: 3571054 - RNA, 18 nt, Pseudomonas putida KT2440
aggguagggguggaucag

SEQ ID NO: 3571055 - RNA, 17 nt, Pseudomonas putida KT2440
aggguaucggggguucg

SEQ ID NO: 3571056 - RNA, 14 nt, Pseudomonas putida KT2440
agggucgcgcccca

SEQ ID NO: 3571057 - RNA, 15 nt, Pseudomonas putida KT2440
agggucgcgccccaa

SEQ ID NO: 3571058 - RNA, 23 nt, Pseudomonas putida KT2440
agggucgcgccccaagcgggcca

SEQ ID NO: 3571059 - RNA, 17 nt, Pseudomonas putida KT2440
agggucgggcacaggcc

SEQ ID NO: 3571060 - RNA, 22 nt, Pseudomonas putida KT2440
agggucuucucaggcaccagcg

SEQ ID NO: 3571061 - RNA, 23 nt, Pseudomonas putida KT2440
agggucuucucaggcaccagcgc

SEQ ID NO: 3571062 - RNA, 17 nt, Pseudomonas putida KT2440
agggugacccagcgcug

SEQ ID NO: 3571063 - RNA, 14 nt, Pseudomonas putida KT2440
agggugaggugcug

SEQ ID NO: 3571064 - RNA, 16 nt, Pseudomonas putida KT2440
agggugaggugcugca

SEQ ID NO: 3571065 - RNA, 18 nt, Pseudomonas putida KT2440
agggugaggugcugcaga

SEQ ID NO: 3571066 - RNA, 22 nt, Pseudomonas putida KT2440
aggguggcaaugcucgccugcu

SEQ ID NO: 3571067 - RNA, 21 nt, Pseudomonas putida KT2440
agggugucgguggcggccagc

SEQ ID NO: 3571068 - RNA, 21 nt, Pseudomonas putida KT2440
aggguuaccacauaacugccg

SEQ ID NO: 3571069 - RNA, 17 nt, Pseudomonas putida KT2440
aggguuuucagcgccgc

SEQ ID NO: 3571070 - RNA, 21 nt, Pseudomonas putida KT2440
agguaaagccaccggacagaa

SEQ ID NO: 3571071 - RNA, 15 nt, Pseudomonas putida KT2440
agguaaugcgcaggc

SEQ ID NO: 3571072 - RNA, 22 nt, Pseudomonas putida KT2440
agguaauugguggugcugggca

SEQ ID NO: 3571073 - RNA, 23 nt, Pseudomonas putida KT2440
agguacacccccagguuauccac

SEQ ID NO: 3571074 - RNA, 13 nt, Pseudomonas putida KT2440
agguacagcagcu

SEQ ID NO: 3571075 - RNA, 15 nt, Pseudomonas putida KT2440
agguacagcagcugc

SEQ ID NO: 3571076 - RNA, 16 nt, Pseudomonas putida KT2440
agguacagcagcugca

SEQ ID NO: 3571077 - RNA, 17 nt, Pseudomonas putida KT2440
agguacagcagcugcau

SEQ ID NO: 3571078 - RNA, 16 nt, Pseudomonas putida KT2440
agguacagcagcuugc

SEQ ID NO: 3571079 - RNA, 15 nt, Pseudomonas putida KT2440
agguacaguucccgg

SEQ ID NO: 3571080 - RNA, 11 nt, Pseudomonas putida KT2440
agguaccccuc

SEQ ID NO: 3571081 - RNA, 21 nt, Pseudomonas putida KT2440
agguaccguugcggaucaucg

SEQ ID NO: 3571082 - RNA, 21 nt, Pseudomonas putida KT2440
agguacgagucagcgugccag

SEQ ID NO: 3571083 - RNA, 21 nt, Pseudomonas putida KT2440
agguacgccaugugcgcccga

SEQ ID NO: 3571084 - RNA, 16 nt, Pseudomonas putida KT2440
agguacucgccgggcg

SEQ ID NO: 3571085 - RNA, 20 nt, Pseudomonas putida KT2440
agguacucugucacccgcug

SEQ ID NO: 3571086 - RNA, 14 nt, Pseudomonas putida KT2440
agguagacgaucga

SEQ ID NO: 3571087 - RNA, 13 nt, Pseudomonas putida KT2440
agguagcugggcc

SEQ ID NO: 3571088 - RNA, 15 nt, Pseudomonas putida KT2440
agguaggcagcaacg

SEQ ID NO: 3571089 - RNA, 19 nt, Pseudomonas putida KT2440
agguaggccgcagccaugc

SEQ ID NO: 3571090 - RNA, 22 nt, Pseudomonas putida KT2440
agguaggccgucagcagcaggc

SEQ ID NO: 3571091 - RNA, 10 nt, Pseudomonas putida KT2440
agguaguaaa

SEQ ID NO: 3571092 - RNA, 18 nt, Pseudomonas putida KT2440
agguagucgaaguacacc

SEQ ID NO: 3571093 - RNA, 18 nt, Pseudomonas putida KT2440
agguagucgauccaggug

SEQ ID NO: 3571094 - RNA, 18 nt, Pseudomonas putida KT2440
agguagugaauguugacg

SEQ ID NO: 3571095 - RNA, 19 nt, Pseudomonas putida KT2440
agguagugcaccaacgccg

SEQ ID NO: 3571096 - RNA, 17 nt, Pseudomonas putida KT2440
agguaguucacuggcca

SEQ ID NO: 3571097 - RNA, 17 nt, Pseudomonas putida KT2440
agguaguuggccgggcc

SEQ ID NO: 3571098 - RNA, 15 nt, Pseudomonas putida KT2440
agguaugugagcugc

SEQ ID NO: 3571099 - RNA, 20 nt, Pseudomonas putida KT2440
agguauucgaggaucagcgc

SEQ ID NO: 3571100 - RNA, 13 nt, Pseudomonas putida KT2440
aggucaacggcaa

SEQ ID NO: 3571101 - RNA, 15 nt, Pseudomonas putida KT2440
aggucaaucuugugg

SEQ ID NO: 3571102 - RNA, 23 nt, Pseudomonas putida KT2440
aggucacccuggucacgcaguuc

SEQ ID NO: 3571103 - RNA, 14 nt, Pseudomonas putida KT2440
aggucacggcuguc

SEQ ID NO: 3571104 - RNA, 17 nt, Pseudomonas putida KT2440
aggucacggucuuggcc

SEQ ID NO: 3571105 - RNA, 21 nt, Pseudomonas putida KT2440
aggucacguuguagcccacca

SEQ ID NO: 3571106 - RNA, 17 nt, Pseudomonas putida KT2440
aggucagcaagccgccg

SEQ ID NO: 3571107 - RNA, 13 nt, Pseudomonas putida KT2440
aggucagcagugg

SEQ ID NO: 3571108 - RNA, 16 nt, Pseudomonas putida KT2440
aggucagcuucugggu

SEQ ID NO: 3571109 - RNA, 21 nt, Pseudomonas putida KT2440
aggucaggucgcuaucggcag

SEQ ID NO: 3571110 - RNA, 18 nt, Pseudomonas putida KT2440
aggucauccgcacgcaug

SEQ ID NO: 3571111 - RNA, 24 nt, Pseudomonas putida KT2440
aggucauccgcacgcaugucaggg

SEQ ID NO: 3571112 - RNA, 14 nt, Pseudomonas putida KT2440
aggucaucgaacac

SEQ ID NO: 3571113 - RNA, 21 nt, Pseudomonas putida KT2440
aggucaucgaagaucagcuca

SEQ ID NO: 3571114 - RNA, 23 nt, Pseudomonas putida KT2440
aggucaucgcugcggucaucacc

SEQ ID NO: 3571115 - RNA, 17 nt, Pseudomonas putida KT2440
aggucaugaugcccguc

SEQ ID NO: 3571116 - RNA, 17 nt, Pseudomonas putida KT2440
aggucauguagcgccug

SEQ ID NO: 3571117 - RNA, 15 nt, Pseudomonas putida KT2440
aggucaugugauacc

SEQ ID NO: 3571118 - RNA, 16 nt, Pseudomonas putida KT2440
agguccaccagcaggc

SEQ ID NO: 3571119 - RNA, 16 nt, Pseudomonas putida KT2440
agguccaccgcuuuca

SEQ ID NO: 3571120 - RNA, 14 nt, Pseudomonas putida KT2440
agguccagccgcca

SEQ ID NO: 3571121 - RNA, 13 nt, Pseudomonas putida KT2440
agguccagcuccg

SEQ ID NO: 3571122 - RNA, 20 nt, Pseudomonas putida KT2440
agguccagcucuggucaccu

SEQ ID NO: 3571123 - RNA, 16 nt, Pseudomonas putida KT2440
agguccaggccagcuu

SEQ ID NO: 3571124 - RNA, 13 nt, Pseudomonas putida KT2440
agguccaggcugc

SEQ ID NO: 3571125 - RNA, 23 nt, Pseudomonas putida KT2440
agguccaggcugcgcgccauggc

SEQ ID NO: 3571126 - RNA, 19 nt, Pseudomonas putida KT2440
agguccgagugcucgauca

SEQ ID NO: 3571127 - RNA, 15 nt, Pseudomonas putida KT2440
agguccgguaacugg

SEQ ID NO: 3571128 - RNA, 22 nt, Pseudomonas putida KT2440
agguccgguaacuggcccaccc

SEQ ID NO: 3571129 - RNA, 16 nt, Pseudomonas putida KT2440
agguccugcuccaccc

SEQ ID NO: 3571130 - RNA, 18 nt, Pseudomonas putida KT2440
aggucgaacagcccccgg

SEQ ID NO: 3571131 - RNA, 15 nt, Pseudomonas putida KT2440
aggucgacacccagc

SEQ ID NO: 3571132 - RNA, 15 nt, Pseudomonas putida KT2440
aggucgaccgagaag

SEQ ID NO: 3571133 - RNA, 13 nt, Pseudomonas putida KT2440
aggucgaccugcc

SEQ ID NO: 3571134 - RNA, 15 nt, Pseudomonas putida KT2440
aggucgaccugccag

SEQ ID NO: 3571135 - RNA, 15 nt, Pseudomonas putida KT2440
aggucgaccugcccg

SEQ ID NO: 3571136 - RNA, 17 nt, Pseudomonas putida KT2440
aggucgacgaucgccgc

SEQ ID NO: 3571137 - RNA, 15 nt, Pseudomonas putida KT2440
aggucgccaggcgcg

SEQ ID NO: 3571138 - RNA, 23 nt, Pseudomonas putida KT2440
aggucgccgcuguucagcccuug

SEQ ID NO: 3571139 - RNA, 13 nt, Pseudomonas putida KT2440
aggucgccuugaa

SEQ ID NO: 3571140 - RNA, 20 nt, Pseudomonas putida KT2440
aggucgcgcugcagcuccuu

SEQ ID NO: 3571141 - RNA, 13 nt, Pseudomonas putida KT2440
aggucggacaggg

SEQ ID NO: 3571142 - RNA, 14 nt, Pseudomonas putida KT2440
aggucggcaaccau

SEQ ID NO: 3571143 - RNA, 16 nt, Pseudomonas putida KT2440
aggucggcaaccaugg

SEQ ID NO: 3571144 - RNA, 20 nt, Pseudomonas putida KT2440
aggucggcacgcaccuguuu

SEQ ID NO: 3571145 - RNA, 21 nt, Pseudomonas putida KT2440
aggucggcgauggucaaccgg

SEQ ID NO: 3571146 - RNA, 23 nt, Pseudomonas putida KT2440
aggucggcggggcccggacaggg

SEQ ID NO: 3571147 - RNA, 18 nt, Pseudomonas putida KT2440
aggucgggaauugcagcc

SEQ ID NO: 3571148 - RNA, 19 nt, Pseudomonas putida KT2440
aggucgugcuugacccccu

SEQ ID NO: 3571149 - RNA, 15 nt, Pseudomonas putida KT2440
aggucuaaccgcgcu

SEQ ID NO: 3571150 - RNA, 17 nt, Pseudomonas putida KT2440
aggucuccagcaccgcc

SEQ ID NO: 3571151 - RNA, 17 nt, Pseudomonas putida KT2440
aggucucccgcccccuc

SEQ ID NO: 3571152 - RNA, 21 nt, Pseudomonas putida KT2440
aggucugcgcgggaagcccgu

SEQ ID NO: 3571153 - RNA, 15 nt, Pseudomonas putida KT2440
aggucugcugcggcc

SEQ ID NO: 3571154 - RNA, 14 nt, Pseudomonas putida KT2440
aggucuucgaucuc

SEQ ID NO: 3571155 - RNA, 16 nt, Pseudomonas putida KT2440
aggucuucgaucucgg

SEQ ID NO: 3571156 - RNA, 16 nt, Pseudomonas putida KT2440
aggugaaucagcggca

SEQ ID NO: 3571157 - RNA, 19 nt, Pseudomonas putida KT2440
aggugauagacguggcugu

SEQ ID NO: 3571158 - RNA, 13 nt, Pseudomonas putida KT2440
aggugaucagcuu

SEQ ID NO: 3571159 - RNA, 17 nt, Pseudomonas putida KT2440
aggugaucguugcgcgc

SEQ ID NO: 3571160 - RNA, 20 nt, Pseudomonas putida KT2440
aggugauguugcccggcaug

SEQ ID NO: 3571161 - RNA, 21 nt, Pseudomonas putida KT2440
aggugcacaccuugggcccac

SEQ ID NO: 3571162 - RNA, 22 nt, Pseudomonas putida KT2440
aggugcacagggcggccaaggc

SEQ ID NO: 3571163 - RNA, 19 nt, Pseudomonas putida KT2440
aggugcaccaacacuucca

SEQ ID NO: 3571164 - RNA, 20 nt, Pseudomonas putida KT2440
aggugcaggguaggggugga

SEQ ID NO: 3571165 - RNA, 17 nt, Pseudomonas putida KT2440
aggugcccaagcggcac

SEQ ID NO: 3571166 - RNA, 22 nt, Pseudomonas putida KT2440
aggugcccaagcggcacuacca

SEQ ID NO: 3571167 - RNA, 22 nt, Pseudomonas putida KT2440
aggugcgauagauguccagcgu

SEQ ID NO: 3571168 - RNA, 16 nt, Pseudomonas putida KT2440
aggugcgcgcgcgaca

SEQ ID NO: 3571169 - RNA, 19 nt, Pseudomonas putida KT2440
aggugcggcuuuagccgug

SEQ ID NO: 3571170 - RNA, 14 nt, Pseudomonas putida KT2440
aggugcuaccggcg

SEQ ID NO: 3571171 - RNA, 14 nt, Pseudomonas putida KT2440
aggugcugaugccc

SEQ ID NO: 3571172 - RNA, 18 nt, Pseudomonas putida KT2440
aggugcugcagacccgcg

SEQ ID NO: 3571173 - RNA, 19 nt, Pseudomonas putida KT2440
aggugcuuuuuugugccug

SEQ ID NO: 3571174 - RNA, 17 nt, Pseudomonas putida KT2440
agguggacaccauggcc

SEQ ID NO: 3571175 - RNA, 15 nt, Pseudomonas putida KT2440
agguggaucagccgc

SEQ ID NO: 3571176 - RNA, 20 nt, Pseudomonas putida KT2440
agguggaucggcgugcggcu

SEQ ID NO: 3571177 - RNA, 16 nt, Pseudomonas putida KT2440
agguggcagaacaucg

SEQ ID NO: 3571178 - RNA, 18 nt, Pseudomonas putida KT2440
agguggcauuggcgugcu

SEQ ID NO: 3571179 - RNA, 14 nt, Pseudomonas putida KT2440
agguggccgccacc

SEQ ID NO: 3571180 - RNA, 22 nt, Pseudomonas putida KT2440
agguggccggcaacggccacgc

SEQ ID NO: 3571181 - RNA, 18 nt, Pseudomonas putida KT2440
agguggcuguaauugcca

SEQ ID NO: 3571182 - RNA, 15 nt, Pseudomonas putida KT2440
aggugggucacgguc

SEQ ID NO: 3571183 - RNA, 17 nt, Pseudomonas putida KT2440
agguggucgaggcaaag

SEQ ID NO: 3571184 - RNA, 19 nt, Pseudomonas putida KT2440
aggugucaccgcgagcagc

SEQ ID NO: 3571185 - RNA, 18 nt, Pseudomonas putida KT2440
aggugucgaacaccaccg

SEQ ID NO: 3571186 - RNA, 20 nt, Pseudomonas putida KT2440
aggugucgauacucacccgc

SEQ ID NO: 3571187 - RNA, 15 nt, Pseudomonas putida KT2440
agguguucaccacgc

SEQ ID NO: 3571188 - RNA, 20 nt, Pseudomonas putida KT2440
agguguugaaaugggaugag

SEQ ID NO: 3571189 - RNA, 18 nt, Pseudomonas putida KT2440
agguguuguugcaaccag

SEQ ID NO: 3571190 - RNA, 23 nt, Pseudomonas putida KT2440
agguucagcgcaaauccccaacc

SEQ ID NO: 3571191 - RNA, 21 nt, Pseudomonas putida KT2440
agguuccccccacgcacauca

SEQ ID NO: 3571192 - RNA, 16 nt, Pseudomonas putida KT2440
agguucgaauccugcu

SEQ ID NO: 3571193 - RNA, 22 nt, Pseudomonas putida KT2440
agguucgaccaccgcaggugca

SEQ ID NO: 3571194 - RNA, 22 nt, Pseudomonas putida KT2440
agguucgaccacugcaggugca

SEQ ID NO: 3571195 - RNA, 23 nt, Pseudomonas putida KT2440
agguucgaccagaacaugccacg

SEQ ID NO: 3571196 - RNA, 17 nt, Pseudomonas putida KT2440
agguugagcaccgggca

SEQ ID NO: 3571197 - RNA, 14 nt, Pseudomonas putida KT2440
agguugauccagcc

SEQ ID NO: 3571198 - RNA, 16 nt, Pseudomonas putida KT2440
agguugaugugcaggu

SEQ ID NO: 3571199 - RNA, 13 nt, Pseudomonas putida KT2440
agguugccaccag

SEQ ID NO: 3571200 - RNA, 16 nt, Pseudomonas putida KT2440
agguugccaccagcau

SEQ ID NO: 3571201 - RNA, 13 nt, Pseudomonas putida KT2440
agguugcccggcg

SEQ ID NO: 3571202 - RNA, 18 nt, Pseudomonas putida KT2440
agguugcccucggccacc

SEQ ID NO: 3571203 - RNA, 22 nt, Pseudomonas putida KT2440
agguugcccucggccaccuggc

SEQ ID NO: 3571204 - RNA, 13 nt, Pseudomonas putida KT2440
agguugcgcaagc

SEQ ID NO: 3571205 - RNA, 17 nt, Pseudomonas putida KT2440
agguugcgcaagccuca

SEQ ID NO: 3571206 - RNA, 12 nt, Pseudomonas putida KT2440
agguugcucagg

SEQ ID NO: 3571207 - RNA, 17 nt, Pseudomonas putida KT2440
agguugcucagggcggc

SEQ ID NO: 3571208 - RNA, 12 nt, Pseudomonas putida KT2440
agguugcugccg

SEQ ID NO: 3571209 - RNA, 19 nt, Pseudomonas putida KT2440
agguugcuggccuuggaca

SEQ ID NO: 3571210 - RNA, 14 nt, Pseudomonas putida KT2440
agguuguucggcag

SEQ ID NO: 3571211 - RNA, 13 nt, Pseudomonas putida KT2440
agguuucagcagc

SEQ ID NO: 3571212 - RNA, 15 nt, Pseudomonas putida KT2440
agguuuccagcccuu

SEQ ID NO: 3571213 - RNA, 20 nt, Pseudomonas putida KT2440
agguuuggggugagcgaauc

SEQ ID NO: 3571214 - RNA, 15 nt, Pseudomonas putida KT2440
agguuuggguuggcu

SEQ ID NO: 3571215 - RNA, 14 nt, Pseudomonas putida KT2440
aguaaagccagcag

SEQ ID NO: 3571216 - RNA, 15 nt, Pseudomonas putida KT2440
aguaaagccagcagc

SEQ ID NO: 3571217 - RNA, 18 nt, Pseudomonas putida KT2440
aguaaagcccccagaaug

SEQ ID NO: 3571218 - RNA, 17 nt, Pseudomonas putida KT2440
aguaacgcccuucauac

SEQ ID NO: 3571219 - RNA, 13 nt, Pseudomonas putida KT2440
aguaacggccacg

SEQ ID NO: 3571220 - RNA, 22 nt, Pseudomonas putida KT2440
aguaacggcggauguuggccac

SEQ ID NO: 3571221 - RNA, 15 nt, Pseudomonas putida KT2440
aguaaggaucgcgca

SEQ ID NO: 3571222 - RNA, 16 nt, Pseudomonas putida KT2440
aguaaggaucgcgcag

SEQ ID NO: 3571223 - RNA, 18 nt, Pseudomonas putida KT2440
aguaaggaucgcgcagca

SEQ ID NO: 3571224 - RNA, 22 nt, Pseudomonas putida KT2440
aguaaucugccggcgccuccag

SEQ ID NO: 3571225 - RNA, 15 nt, Pseudomonas putida KT2440
aguacaaacgccaga

SEQ ID NO: 3571226 - RNA, 13 nt, Pseudomonas putida KT2440
aguacaacugcca

SEQ ID NO: 3571227 - RNA, 16 nt, Pseudomonas putida KT2440
aguacaccggcagcac

SEQ ID NO: 3571228 - RNA, 20 nt, Pseudomonas putida KT2440
aguacagccguucgcucugc

SEQ ID NO: 3571229 - RNA, 15 nt, Pseudomonas putida KT2440
aguacaugacaaagc

SEQ ID NO: 3571230 - RNA, 15 nt, Pseudomonas putida KT2440
aguacaugaucgggu

SEQ ID NO: 3571231 - RNA, 15 nt, Pseudomonas putida KT2440
aguaccagcagcaca

SEQ ID NO: 3571232 - RNA, 19 nt, Pseudomonas putida KT2440
aguaccugcacacugccca

SEQ ID NO: 3571233 - RNA, 23 nt, Pseudomonas putida KT2440
aguaccuuggcguaggccugcga

SEQ ID NO: 3571234 - RNA, 21 nt, Pseudomonas putida KT2440
aguacgaacuacgcgccagca

SEQ ID NO: 3571235 - RNA, 16 nt, Pseudomonas putida KT2440
aguacgaugcugcggg

SEQ ID NO: 3571236 - RNA, 15 nt, Pseudomonas putida KT2440
aguacgccacccaga

SEQ ID NO: 3571237 - RNA, 22 nt, Pseudomonas putida KT2440
aguacgccucgaaguaggcaaa

SEQ ID NO: 3571238 - RNA, 14 nt, Pseudomonas putida KT2440
aguacgcgccugca

SEQ ID NO: 3571239 - RNA, 23 nt, Pseudomonas putida KT2440
aguacgcgccugcaccuggcuga

SEQ ID NO: 3571240 - RNA, 13 nt, Pseudomonas putida KT2440
aguacggcagcca

SEQ ID NO: 3571241 - RNA, 12 nt, Pseudomonas putida KT2440
aguacggccagc

SEQ ID NO: 3571242 - RNA, 13 nt, Pseudomonas putida KT2440
aguacggccagca

SEQ ID NO: 3571243 - RNA, 19 nt, Pseudomonas putida KT2440
aguacggccaucagcaagc

SEQ ID NO: 3571244 - RNA, 13 nt, Pseudomonas putida KT2440
aguacuccagcag

SEQ ID NO: 3571245 - RNA, 14 nt, Pseudomonas putida KT2440
aguacuccagcagc

SEQ ID NO: 3571246 - RNA, 20 nt, Pseudomonas putida KT2440
aguacugggcguccuucucc

SEQ ID NO: 3571247 - RNA, 17 nt, Pseudomonas putida KT2440
aguacuuauaagcagca

SEQ ID NO: 3571248 - RNA, 19 nt, Pseudomonas putida KT2440
aguacuuauaagcagcaag

SEQ ID NO: 3571249 - RNA, 15 nt, Pseudomonas putida KT2440
aguagaagcagauca

SEQ ID NO: 3571250 - RNA, 17 nt, Pseudomonas putida KT2440
aguagaagcagaucauc

SEQ ID NO: 3571251 - RNA, 14 nt, Pseudomonas putida KT2440
aguagaucaucagc

SEQ ID NO: 3571252 - RNA, 16 nt, Pseudomonas putida KT2440
aguagaucaucagcgc

SEQ ID NO: 3571253 - RNA, 19 nt, Pseudomonas putida KT2440
aguagaucaucagcgccag

SEQ ID NO: 3571254 - RNA, 22 nt, Pseudomonas putida KT2440
aguagccaucgaggaaguggca

SEQ ID NO: 3571255 - RNA, 23 nt, Pseudomonas putida KT2440
aguagccuucuucggucagcugg

SEQ ID NO: 3571256 - RNA, 12 nt, Pseudomonas putida KT2440
aguagcggguga

SEQ ID NO: 3571257 - RNA, 13 nt, Pseudomonas putida KT2440
aguagcuccagcc

SEQ ID NO: 3571258 - RNA, 18 nt, Pseudomonas putida KT2440
aguagcuccagcccagcg

SEQ ID NO: 3571259 - RNA, 14 nt, Pseudomonas putida KT2440
aguaggagcggguu

SEQ ID NO: 3571260 - RNA, 15 nt, Pseudomonas putida KT2440
aguaggcugcagccu

SEQ ID NO: 3571261 - RNA, 20 nt, Pseudomonas putida KT2440
aguaguccccaucacgcagc

SEQ ID NO: 3571262 - RNA, 17 nt, Pseudomonas putida KT2440
aguauccuccagcccug

SEQ ID NO: 3571263 - RNA, 23 nt, Pseudomonas putida KT2440
aguaucgccccggucagcaggaa

SEQ ID NO: 3571264 - RNA, 19 nt, Pseudomonas putida KT2440
aguauggaaauggaauuug

SEQ ID NO: 3571265 - RNA, 14 nt, Pseudomonas putida KT2440
aguauuaauuugaa

SEQ ID NO: 3571266 - RNA, 23 nt, Pseudomonas putida KT2440
aguauucgcuaaccucugcaugc

SEQ ID NO: 3571267 - RNA, 14 nt, Pseudomonas putida KT2440
aguauugcgucagg

SEQ ID NO: 3571268 - RNA, 20 nt, Pseudomonas putida KT2440
aguauuuuuaccugcuccug

SEQ ID NO: 3571269 - RNA, 23 nt, Pseudomonas putida KT2440
agucaaccaacuccuucucgccc

SEQ ID NO: 3571270 - RNA, 15 nt, Pseudomonas putida KT2440
agucacccaccggcu

SEQ ID NO: 3571271 - RNA, 13 nt, Pseudomonas putida KT2440
agucagccagguu

SEQ ID NO: 3571272 - RNA, 17 nt, Pseudomonas putida KT2440
agucagccagguuuuug

SEQ ID NO: 3571273 - RNA, 13 nt, Pseudomonas putida KT2440
agucagcgugcca

SEQ ID NO: 3571274 - RNA, 20 nt, Pseudomonas putida KT2440
agucagguugcacagcauca

SEQ ID NO: 3571275 - RNA, 21 nt, Pseudomonas putida KT2440
agucaucacguuacgccagaa

SEQ ID NO: 3571276 - RNA, 13 nt, Pseudomonas putida KT2440
agucauccauggc

SEQ ID NO: 3571277 - RNA, 16 nt, Pseudomonas putida KT2440
agucauccgccaggcu

SEQ ID NO: 3571278 - RNA, 22 nt, Pseudomonas putida KT2440
agucaugcucgccggccuuggc

SEQ ID NO: 3571279 - RNA, 16 nt, Pseudomonas putida KT2440
agucaugggccaugcc

SEQ ID NO: 3571280 - RNA, 15 nt, Pseudomonas putida KT2440
agucauucgccggca

SEQ ID NO: 3571281 - RNA, 12 nt, Pseudomonas putida KT2440
agucauuuucau

SEQ ID NO: 3571282 - RNA, 20 nt, Pseudomonas putida KT2440
aguccaaccgcaagcggcuc

SEQ ID NO: 3571283 - RNA, 17 nt, Pseudomonas putida KT2440
aguccagcaucagcaca

SEQ ID NO: 3571284 - RNA, 14 nt, Pseudomonas putida KT2440
aguccagcugcauc

SEQ ID NO: 3571285 - RNA, 16 nt, Pseudomonas putida KT2440
aguccaggaagcaggc

SEQ ID NO: 3571286 - RNA, 18 nt, Pseudomonas putida KT2440
aguccaggaagcaggcgu

SEQ ID NO: 3571287 - RNA, 14 nt, Pseudomonas putida KT2440
aguccaggccaaca

SEQ ID NO: 3571288 - RNA, 13 nt, Pseudomonas putida KT2440
aguccaucugcuu

SEQ ID NO: 3571289 - RNA, 12 nt, Pseudomonas putida KT2440
agucccagcacc

SEQ ID NO: 3571290 - RNA, 13 nt, Pseudomonas putida KT2440
agucccaguugug

SEQ ID NO: 3571291 - RNA, 21 nt, Pseudomonas putida KT2440
agucccgccauauucgcggcg

SEQ ID NO: 3571292 - RNA, 18 nt, Pseudomonas putida KT2440
aguccgacucauguaucg

SEQ ID NO: 3571293 - RNA, 14 nt, Pseudomonas putida KT2440
aguccgggguuuuu

SEQ ID NO: 3571294 - RNA, 19 nt, Pseudomonas putida KT2440
aguccuccaacucgcgcau

SEQ ID NO: 3571295 - RNA, 19 nt, Pseudomonas putida KT2440
aguccucccaguacaugau

SEQ ID NO: 3571296 - RNA, 20 nt, Pseudomonas putida KT2440
aguccugaaugucaucugag

SEQ ID NO: 3571297 - RNA, 14 nt, Pseudomonas putida KT2440
aguccugccuucca

SEQ ID NO: 3571298 - RNA, 17 nt, Pseudomonas putida KT2440
aguccuuggccaaugcc

SEQ ID NO: 3571299 - RNA, 21 nt, Pseudomonas putida KT2440
aguccuuggccaaugccagga

SEQ ID NO: 3571300 - RNA, 21 nt, Pseudomonas putida KT2440
agucgaaaccgaaaccacugc

SEQ ID NO: 3571301 - RNA, 23 nt, Pseudomonas putida KT2440
agucgaacaccaguucgccaucg

SEQ ID NO: 3571302 - RNA, 14 nt, Pseudomonas putida KT2440
agucgaaugccucg

SEQ ID NO: 3571303 - RNA, 18 nt, Pseudomonas putida KT2440
agucgacaauuuggggcu

SEQ ID NO: 3571304 - RNA, 21 nt, Pseudomonas putida KT2440
agucgagauuugucaacaaaa

SEQ ID NO: 3571305 - RNA, 13 nt, Pseudomonas putida KT2440
agucgagcgccgc

SEQ ID NO: 3571306 - RNA, 16 nt, Pseudomonas putida KT2440
agucgcacaugaagcc

SEQ ID NO: 3571307 - RNA, 19 nt, Pseudomonas putida KT2440
agucgcaucgacaggucca

SEQ ID NO: 3571308 - RNA, 14 nt, Pseudomonas putida KT2440
agucgccaggccgu

SEQ ID NO: 3571309 - RNA, 23 nt, Pseudomonas putida KT2440
agucgccccgccagcgccuggcg

SEQ ID NO: 3571310 - RNA, 17 nt, Pseudomonas putida KT2440
agucgccgauacccgca

SEQ ID NO: 3571311 - RNA, 18 nt, Pseudomonas putida KT2440
agucgccgauacccgcac

SEQ ID NO: 3571312 - RNA, 18 nt, Pseudomonas putida KT2440
agucgccgcggguaccac

SEQ ID NO: 3571313 - RNA, 22 nt, Pseudomonas putida KT2440
agucgccgcggguaccaccugg

SEQ ID NO: 3571314 - RNA, 16 nt, Pseudomonas putida KT2440
agucgcuuugcgggca

SEQ ID NO: 3571315 - RNA, 17 nt, Pseudomonas putida KT2440
agucggcaaucagcagg

SEQ ID NO: 3571316 - RNA, 17 nt, Pseudomonas putida KT2440
agucggccugaugccuc

SEQ ID NO: 3571317 - RNA, 15 nt, Pseudomonas putida KT2440
agucggccuggguca

SEQ ID NO: 3571318 - RNA, 15 nt, Pseudomonas putida KT2440
agucggcgcuggaca

SEQ ID NO: 3571319 - RNA, 21 nt, Pseudomonas putida KT2440
agucggcgcuggacagguaga

SEQ ID NO: 3571320 - RNA, 21 nt, Pseudomonas putida KT2440
agucggcucuggcaagauguc

SEQ ID NO: 3571321 - RNA, 18 nt, Pseudomonas putida KT2440
agucgguagagcaaauga

SEQ ID NO: 3571322 - RNA, 18 nt, Pseudomonas putida KT2440
agucguacuagcggugca

SEQ ID NO: 3571323 - RNA, 17 nt, Pseudomonas putida KT2440
agucgucggccgcaucc

SEQ ID NO: 3571324 - RNA, 20 nt, Pseudomonas putida KT2440
agucgugccggaacaacccc

SEQ ID NO: 3571325 - RNA, 23 nt, Pseudomonas putida KT2440
agucuacggaccuccgagucucc

SEQ ID NO: 3571326 - RNA, 16 nt, Pseudomonas putida KT2440
agucucuuucaacagc

SEQ ID NO: 3571327 - RNA, 21 nt, Pseudomonas putida KT2440
agucucuuucaacagcuggcu

SEQ ID NO: 3571328 - RNA, 23 nt, Pseudomonas putida KT2440
agucucuuucaacagcuggcugg

SEQ ID NO: 3571329 - RNA, 21 nt, Pseudomonas putida KT2440
agucugcucagccaaccgccc

SEQ ID NO: 3571330 - RNA, 18 nt, Pseudomonas putida KT2440
agucuucucauagggugu

SEQ ID NO: 3571331 - RNA, 16 nt, Pseudomonas putida KT2440
agucuugcugaucacc

SEQ ID NO: 3571332 - RNA, 20 nt, Pseudomonas putida KT2440
agugaagcucgaucugccug

SEQ ID NO: 3571333 - RNA, 23 nt, Pseudomonas putida KT2440
agugaagcucgaucugccugccu

SEQ ID NO: 3571334 - RNA, 13 nt, Pseudomonas putida KT2440
agugaauuccuug

SEQ ID NO: 3571335 - RNA, 14 nt, Pseudomonas putida KT2440
agugaauuccuugc

SEQ ID NO: 3571336 - RNA, 22 nt, Pseudomonas putida KT2440
agugacacggcgaugcgccccc

SEQ ID NO: 3571337 - RNA, 19 nt, Pseudomonas putida KT2440
agugacagguucgcccugu

SEQ ID NO: 3571338 - RNA, 17 nt, Pseudomonas putida KT2440
agugaccgcuggcgccu

SEQ ID NO: 3571339 - RNA, 22 nt, Pseudomonas putida KT2440
agugaggucgggaauugcagcc

SEQ ID NO: 3571340 - RNA, 15 nt, Pseudomonas putida KT2440
agugauaaugggcaa

SEQ ID NO: 3571341 - RNA, 22 nt, Pseudomonas putida KT2440
agugaucaucacacucgccccc

SEQ ID NO: 3571342 - RNA, 21 nt, Pseudomonas putida KT2440
agugaucuggcgcagcgggga

SEQ ID NO: 3571343 - RNA, 16 nt, Pseudomonas putida KT2440
agugcaauaccagccu

SEQ ID NO: 3571344 - RNA, 20 nt, Pseudomonas putida KT2440
agugcaauaccagccuggcc

SEQ ID NO: 3571345 - RNA, 18 nt, Pseudomonas putida KT2440
agugcacccgcgaguuca

SEQ ID NO: 3571346 - RNA, 22 nt, Pseudomonas putida KT2440
agugcaggcgcaggcucuccac

SEQ ID NO: 3571347 - RNA, 22 nt, Pseudomonas putida KT2440
agugcauaaucguucugcuugu

SEQ ID NO: 3571348 - RNA, 21 nt, Pseudomonas putida KT2440
agugccagcaacaagcuggac

SEQ ID NO: 3571349 - RNA, 20 nt, Pseudomonas putida KT2440
agugccccaaacggaccgca

SEQ ID NO: 3571350 - RNA, 20 nt, Pseudomonas putida KT2440
agugcccccgucagcggcaa

SEQ ID NO: 3571351 - RNA, 21 nt, Pseudomonas putida KT2440
agugcccccgucagcggcaac

SEQ ID NO: 3571352 - RNA, 21 nt, Pseudomonas putida KT2440
agugccccuuggcgaaugcgc

SEQ ID NO: 3571353 - RNA, 22 nt, Pseudomonas putida KT2440
agugccgcaagcagucccagca

SEQ ID NO: 3571354 - RNA, 15 nt, Pseudomonas putida KT2440
agugccgccaccugg

SEQ ID NO: 3571355 - RNA, 14 nt, Pseudomonas putida KT2440
agugccgccucguu

SEQ ID NO: 3571356 - RNA, 16 nt, Pseudomonas putida KT2440
agugccgccugguugc

SEQ ID NO: 3571357 - RNA, 16 nt, Pseudomonas putida KT2440
agugccgggggugcuu

SEQ ID NO: 3571358 - RNA, 17 nt, Pseudomonas putida KT2440
agugccggguccaguuc

SEQ ID NO: 3571359 - RNA, 23 nt, Pseudomonas putida KT2440
agugccguccgcugccuuccaac

SEQ ID NO: 3571360 - RNA, 22 nt, Pseudomonas putida KT2440
agugccgugaguggccucgaac

SEQ ID NO: 3571361 - RNA, 22 nt, Pseudomonas putida KT2440
agugccgugcauaagcgacacc

SEQ ID NO: 3571362 - RNA, 16 nt, Pseudomonas putida KT2440
agugccguggcaggca

SEQ ID NO: 3571363 - RNA, 13 nt, Pseudomonas putida KT2440
agugccucgacca

SEQ ID NO: 3571364 - RNA, 21 nt, Pseudomonas putida KT2440
agugccugcuccaugggcagg

SEQ ID NO: 3571365 - RNA, 22 nt, Pseudomonas putida KT2440
agugccugcuccaugggcaggc

SEQ ID NO: 3571366 - RNA, 13 nt, Pseudomonas putida KT2440
agugccuggaugc

SEQ ID NO: 3571367 - RNA, 20 nt, Pseudomonas putida KT2440
agugccugugagaucgagcg

SEQ ID NO: 3571368 - RNA, 15 nt, Pseudomonas putida KT2440
agugcgaaacacgaa

SEQ ID NO: 3571369 - RNA, 18 nt, Pseudomonas putida KT2440
agugcgcaugcccgcgca

SEQ ID NO: 3571370 - RNA, 21 nt, Pseudomonas putida KT2440
agugcgcugaucgaaagcugc

SEQ ID NO: 3571371 - RNA, 23 nt, Pseudomonas putida KT2440
agugcggccgggucgauagccag

SEQ ID NO: 3571372 - RNA, 15 nt, Pseudomonas putida KT2440
agugcgucggccacc

SEQ ID NO: 3571373 - RNA, 14 nt, Pseudomonas putida KT2440
agugcgugcaagag

SEQ ID NO: 3571374 - RNA, 18 nt, Pseudomonas putida KT2440
agugcuaaugcucuugga

SEQ ID NO: 3571375 - RNA, 13 nt, Pseudomonas putida KT2440
agugcugagaggg

SEQ ID NO: 3571376 - RNA, 19 nt, Pseudomonas putida KT2440
agugcugggcaugagccug

SEQ ID NO: 3571377 - RNA, 21 nt, Pseudomonas putida KT2440
agugcugggcaugagccuggc

SEQ ID NO: 3571378 - RNA, 18 nt, Pseudomonas putida KT2440
agugcuggggccgcaaag

SEQ ID NO: 3571379 - RNA, 11 nt, Pseudomonas putida KT2440
agugcuguaug

SEQ ID NO: 3571380 - RNA, 17 nt, Pseudomonas putida KT2440
agugcuucacugccggc

SEQ ID NO: 3571381 - RNA, 18 nt, Pseudomonas putida KT2440
agugcuucacugccggca

SEQ ID NO: 3571382 - RNA, 14 nt, Pseudomonas putida KT2440
agugcuucugccag

SEQ ID NO: 3571383 - RNA, 13 nt, Pseudomonas putida KT2440
agugcuuguggcc

SEQ ID NO: 3571384 - RNA, 15 nt, Pseudomonas putida KT2440
aguggauauccagcg

SEQ ID NO: 3571385 - RNA, 18 nt, Pseudomonas putida KT2440
aguggauauccagcgagg

SEQ ID NO: 3571386 - RNA, 21 nt, Pseudomonas putida KT2440
aguggaucaaccgaccagcgg

SEQ ID NO: 3571387 - RNA, 18 nt, Pseudomonas putida KT2440
aguggcacuggcgcgaug

SEQ ID NO: 3571388 - RNA, 22 nt, Pseudomonas putida KT2440
aguggcagguucgaccacugca

SEQ ID NO: 3571389 - RNA, 15 nt, Pseudomonas putida KT2440
aguggccacggauca

SEQ ID NO: 3571390 - RNA, 19 nt, Pseudomonas putida KT2440
aguggcccgaugaucaggc

SEQ ID NO: 3571391 - RNA, 14 nt, Pseudomonas putida KT2440
aguggccgaaggcg

SEQ ID NO: 3571392 - RNA, 15 nt, Pseudomonas putida KT2440
aguggccucgaacau

SEQ ID NO: 3571393 - RNA, 23 nt, Pseudomonas putida KT2440
aguggccuugguaagcgacugca

SEQ ID NO: 3571394 - RNA, 22 nt, Pseudomonas putida KT2440
aguggccuuguugccacccaga

SEQ ID NO: 3571395 - RNA, 16 nt, Pseudomonas putida KT2440
aguggcuagccucauc

SEQ ID NO: 3571396 - RNA, 17 nt, Pseudomonas putida KT2440
agugggcuugcccgcga

SEQ ID NO: 3571397 - RNA, 19 nt, Pseudomonas putida KT2440
agugggguggaaguuccug

SEQ ID NO: 3571398 - RNA, 15 nt, Pseudomonas putida KT2440
aguggguuauugaac

SEQ ID NO: 3571399 - RNA, 17 nt, Pseudomonas putida KT2440
aguggugcccgccaggc

SEQ ID NO: 3571400 - RNA, 18 nt, Pseudomonas putida KT2440
aguggugcccgccaggca

SEQ ID NO: 3571401 - RNA, 16 nt, Pseudomonas putida KT2440
aguggugcucagcggc

SEQ ID NO: 3571402 - RNA, 17 nt, Pseudomonas putida KT2440
agugguugacaagcaaa

SEQ ID NO: 3571403 - RNA, 18 nt, Pseudomonas putida KT2440
agugguugacaagcaaaa

SEQ ID NO: 3571404 - RNA, 20 nt, Pseudomonas putida KT2440
agugucagcccauccagaaa

SEQ ID NO: 3571405 - RNA, 20 nt, Pseudomonas putida KT2440
agugucagcguacacugcag

SEQ ID NO: 3571406 - RNA, 20 nt, Pseudomonas putida KT2440
agugucaguuuuuuugugua

SEQ ID NO: 3571407 - RNA, 16 nt, Pseudomonas putida KT2440
agugucggccggcccc

SEQ ID NO: 3571408 - RNA, 21 nt, Pseudomonas putida KT2440
agugugaugcagccagccucu

SEQ ID NO: 3571409 - RNA, 21 nt, Pseudomonas putida KT2440
aguguuggcagauaucuggac

SEQ ID NO: 3571410 - RNA, 14 nt, Pseudomonas putida KT2440
aguuacagaggcau

SEQ ID NO: 3571411 - RNA, 17 nt, Pseudomonas putida KT2440
aguuagacauuagaaaa

SEQ ID NO: 3571412 - RNA, 15 nt, Pseudomonas putida KT2440
aguucaccauccgcc

SEQ ID NO: 3571413 - RNA, 19 nt, Pseudomonas putida KT2440
aguucacccacacccgcgc

SEQ ID NO: 3571414 - RNA, 17 nt, Pseudomonas putida KT2440
aguucagccaggguuuc

SEQ ID NO: 3571415 - RNA, 15 nt, Pseudomonas putida KT2440
aguucagcgcccgca

SEQ ID NO: 3571416 - RNA, 18 nt, Pseudomonas putida KT2440
aguucagcgcccgcaaca

SEQ ID NO: 3571417 - RNA, 21 nt, Pseudomonas putida KT2440
aguucauggucaccacgcccg

SEQ ID NO: 3571418 - RNA, 14 nt, Pseudomonas putida KT2440
aguucauucccggc

SEQ ID NO: 3571419 - RNA, 18 nt, Pseudomonas putida KT2440
aguucauuguucuggcca

SEQ ID NO: 3571420 - RNA, 23 nt, Pseudomonas putida KT2440
aguuccaccggcaagcccauggc

SEQ ID NO: 3571421 - RNA, 16 nt, Pseudomonas putida KT2440
aguuccagggcggcgc

SEQ ID NO: 3571422 - RNA, 18 nt, Pseudomonas putida KT2440
aguuccaugucgugcugc

SEQ ID NO: 3571423 - RNA, 16 nt, Pseudomonas putida KT2440
aguuccuggcgcuccu

SEQ ID NO: 3571424 - RNA, 15 nt, Pseudomonas putida KT2440
aguuccuugagcacc

SEQ ID NO: 3571425 - RNA, 16 nt, Pseudomonas putida KT2440
aguucgacgcugcugu

SEQ ID NO: 3571426 - RNA, 14 nt, Pseudomonas putida KT2440
aguucgcccuucag

SEQ ID NO: 3571427 - RNA, 18 nt, Pseudomonas putida KT2440
aguucgcugcgcaaggca

SEQ ID NO: 3571428 - RNA, 22 nt, Pseudomonas putida KT2440
aguucggacaggcgcuugaccc

SEQ ID NO: 3571429 - RNA, 18 nt, Pseudomonas putida KT2440
aguucgggaagugguggu

SEQ ID NO: 3571430 - RNA, 14 nt, Pseudomonas putida KT2440
aguucguccaggcu

SEQ ID NO: 3571431 - RNA, 14 nt, Pseudomonas putida KT2440
aguucgucgagcau

SEQ ID NO: 3571432 - RNA, 17 nt, Pseudomonas putida KT2440
aguucguuguagcugac

SEQ ID NO: 3571433 - RNA, 14 nt, Pseudomonas putida KT2440
aguucuaccagcag

SEQ ID NO: 3571434 - RNA, 21 nt, Pseudomonas putida KT2440
aguucuaccagcagcucaugc

SEQ ID NO: 3571435 - RNA, 20 nt, Pseudomonas putida KT2440
aguucugcacagcgcggaac

SEQ ID NO: 3571436 - RNA, 16 nt, Pseudomonas putida KT2440
aguucuugcgcaucuu

SEQ ID NO: 3571437 - RNA, 18 nt, Pseudomonas putida KT2440
aguucuuggucagcauca

SEQ ID NO: 3571438 - RNA, 15 nt, Pseudomonas putida KT2440
aguugaccagcacca

SEQ ID NO: 3571439 - RNA, 17 nt, Pseudomonas putida KT2440
aguugaccagcaccagc

SEQ ID NO: 3571440 - RNA, 18 nt, Pseudomonas putida KT2440
aguugacccugaaucagc

SEQ ID NO: 3571441 - RNA, 20 nt, Pseudomonas putida KT2440
aguugaccgugaucaucagc

SEQ ID NO: 3571442 - RNA, 13 nt, Pseudomonas putida KT2440
aguugagcgccgc

SEQ ID NO: 3571443 - RNA, 14 nt, Pseudomonas putida KT2440
aguugagcgccgcg

SEQ ID NO: 3571444 - RNA, 16 nt, Pseudomonas putida KT2440
aguugaguggggugga

SEQ ID NO: 3571445 - RNA, 17 nt, Pseudomonas putida KT2440
aguugagugucagaaaa

SEQ ID NO: 3571446 - RNA, 23 nt, Pseudomonas putida KT2440
aguugaucaacccgugcccggca

SEQ ID NO: 3571447 - RNA, 11 nt, Pseudomonas putida KT2440
aguugcagcaa

SEQ ID NO: 3571448 - RNA, 19 nt, Pseudomonas putida KT2440
aguugcaggcgcagggugu

SEQ ID NO: 3571449 - RNA, 20 nt, Pseudomonas putida KT2440
aguugcaggucggcacgcgg

SEQ ID NO: 3571450 - RNA, 20 nt, Pseudomonas putida KT2440
aguugccgaugaugcgggca

SEQ ID NO: 3571451 - RNA, 15 nt, Pseudomonas putida KT2440
aguugcuccaccugc

SEQ ID NO: 3571452 - RNA, 20 nt, Pseudomonas putida KT2440
aguuggccaucaauaccggc

SEQ ID NO: 3571453 - RNA, 19 nt, Pseudomonas putida KT2440
aguuggccgggccuuucac

SEQ ID NO: 3571454 - RNA, 22 nt, Pseudomonas putida KT2440
aguuggcguccagcagugccau

SEQ ID NO: 3571455 - RNA, 15 nt, Pseudomonas putida KT2440
aguuggcucugugga

SEQ ID NO: 3571456 - RNA, 16 nt, Pseudomonas putida KT2440
aguuggcucuguggau

SEQ ID NO: 3571457 - RNA, 23 nt, Pseudomonas putida KT2440
aguuggcucuguggauuucaauu

SEQ ID NO: 3571458 - RNA, 22 nt, Pseudomonas putida KT2440
aguugguagagcaguuggcuuu

SEQ ID NO: 3571459 - RNA, 22 nt, Pseudomonas putida KT2440
aguuggucaaagaacguggaca

SEQ ID NO: 3571460 - RNA, 12 nt, Pseudomonas putida KT2440
aguuguccaggc

SEQ ID NO: 3571461 - RNA, 13 nt, Pseudomonas putida KT2440
aguuguccaggcu

SEQ ID NO: 3571462 - RNA, 22 nt, Pseudomonas putida KT2440
aguugugacuagaggaucugaa

SEQ ID NO: 3571463 - RNA, 17 nt, Pseudomonas putida KT2440
aguuuaccuccaucacc

SEQ ID NO: 3571464 - RNA, 16 nt, Pseudomonas putida KT2440
aguuucacuaccaccu

SEQ ID NO: 3571465 - RNA, 20 nt, Pseudomonas putida KT2440
aguuucagggguugccccug

SEQ ID NO: 3571466 - RNA, 21 nt, Pseudomonas putida KT2440
aguuucucgcaaaaaacuuca

SEQ ID NO: 3571467 - RNA, 21 nt, Pseudomonas putida KT2440
aguuugacggugaauuccuug

SEQ ID NO: 3571468 - RNA, 13 nt, Pseudomonas putida KT2440
aguuugcccagcg

SEQ ID NO: 3571469 - RNA, 17 nt, Pseudomonas putida KT2440
aguuugguuuuuucacu

SEQ ID NO: 3571470 - RNA, 19 nt, Pseudomonas putida KT2440
aguuuuaacuaucgggauu

SEQ ID NO: 3571471 - RNA, 14 nt, Pseudomonas putida KT2440
aguuuucaaugcug

SEQ ID NO: 3571472 - RNA, 12 nt, Pseudomonas putida KT2440
aguuuucgcagu

SEQ ID NO: 3571473 - RNA, 16 nt, Pseudomonas putida KT2440
aguuuuuguaccugug

SEQ ID NO: 3571474 - RNA, 22 nt, Pseudomonas putida KT2440
aguuuuuuuguguacgggacaa

SEQ ID NO: 3571475 - RNA, 19 nt, Pseudomonas putida KT2440
auaaaaaaccggcgcuugg

SEQ ID NO: 3571476 - RNA, 11 nt, Pseudomonas putida KT2440
auaaaaacaac

SEQ ID NO: 3571477 - RNA, 14 nt, Pseudomonas putida KT2440
auaaaacuaccuca

SEQ ID NO: 3571478 - RNA, 19 nt, Pseudomonas putida KT2440
auaaacacgaacaucagca

SEQ ID NO: 3571479 - RNA, 13 nt, Pseudomonas putida KT2440
auaaaccagcagc

SEQ ID NO: 3571480 - RNA, 17 nt, Pseudomonas putida KT2440
auaaaccagcagcgccu

SEQ ID NO: 3571481 - RNA, 15 nt, Pseudomonas putida KT2440
auaaaccccagccuu

SEQ ID NO: 3571482 - RNA, 13 nt, Pseudomonas putida KT2440
auaaagaucuaca

SEQ ID NO: 3571483 - RNA, 22 nt, Pseudomonas putida KT2440
auaaaggucuuuuggcucaggu

SEQ ID NO: 3571484 - RNA, 14 nt, Pseudomonas putida KT2440
auaacaagaacaac

SEQ ID NO: 3571485 - RNA, 16 nt, Pseudomonas putida KT2440
auaacaagaacaacac

SEQ ID NO: 3571486 - RNA, 18 nt, Pseudomonas putida KT2440
auaaccaaccccugcggc

SEQ ID NO: 3571487 - RNA, 22 nt, Pseudomonas putida KT2440
auaaccaaucaacgguggccag

SEQ ID NO: 3571488 - RNA, 16 nt, Pseudomonas putida KT2440
auaacgaaucugcagu

SEQ ID NO: 3571489 - RNA, 19 nt, Pseudomonas putida KT2440
auaacgccguuucagccac

SEQ ID NO: 3571490 - RNA, 19 nt, Pseudomonas putida KT2440
auaacguccagagggccug

SEQ ID NO: 3571491 - RNA, 20 nt, Pseudomonas putida KT2440
auaacuacuuagggaagaga

SEQ ID NO: 3571492 - RNA, 14 nt, Pseudomonas putida KT2440
auaacuccagcgcc

SEQ ID NO: 3571493 - RNA, 18 nt, Pseudomonas putida KT2440
auaacuccagcgccagca

SEQ ID NO: 3571494 - RNA, 14 nt, Pseudomonas putida KT2440
auaacuuacaucug

SEQ ID NO: 3571495 - RNA, 13 nt, Pseudomonas putida KT2440
auaaggcagcagc

SEQ ID NO: 3571496 - RNA, 15 nt, Pseudomonas putida KT2440
auaaggcuugcccuc

SEQ ID NO: 3571497 - RNA, 11 nt, Pseudomonas putida KT2440
auaauaaaaaa

SEQ ID NO: 3571498 - RNA, 13 nt, Pseudomonas putida KT2440
auaauaaaaaaag

SEQ ID NO: 3571499 - RNA, 17 nt, Pseudomonas putida KT2440
auaauaaaaaaagagca

SEQ ID NO: 3571500 - RNA, 18 nt, Pseudomonas putida KT2440
auaauaaaaaaagagcag

SEQ ID NO: 3571501 - RNA, 15 nt, Pseudomonas putida KT2440
auaaucuugcuugag

SEQ ID NO: 3571502 - RNA, 23 nt, Pseudomonas putida KT2440
auaaucuugcuugagucucggcu

SEQ ID NO: 3571503 - RNA, 15 nt, Pseudomonas putida KT2440
auaaugcuccgccac

SEQ ID NO: 3571504 - RNA, 12 nt, Pseudomonas putida KT2440
auaaugggucaa

SEQ ID NO: 3571505 - RNA, 19 nt, Pseudomonas putida KT2440
auaauggucagauaacccu

SEQ ID NO: 3571506 - RNA, 22 nt, Pseudomonas putida KT2440
auacaccaacgcauuuucauca

SEQ ID NO: 3571507 - RNA, 15 nt, Pseudomonas putida KT2440
auacacgggacaggc

SEQ ID NO: 3571508 - RNA, 18 nt, Pseudomonas putida KT2440
auacacuggcuuuccccc

SEQ ID NO: 3571509 - RNA, 16 nt, Pseudomonas putida KT2440
auacagccagaaagcc

SEQ ID NO: 3571510 - RNA, 18 nt, Pseudomonas putida KT2440
auacagccagaaagccac

SEQ ID NO: 3571511 - RNA, 23 nt, Pseudomonas putida KT2440
auacagcccuacgcagucagcca

SEQ ID NO: 3571512 - RNA, 19 nt, Pseudomonas putida KT2440
auacagcgccuccagcagg

SEQ ID NO: 3571513 - RNA, 21 nt, Pseudomonas putida KT2440
auacagcucccgcgcaugcug

SEQ ID NO: 3571514 - RNA, 22 nt, Pseudomonas putida KT2440
auacagcuggccuugcggcaag

SEQ ID NO: 3571515 - RNA, 19 nt, Pseudomonas putida KT2440
auacagcuugcccaucacc

SEQ ID NO: 3571516 - RNA, 20 nt, Pseudomonas putida KT2440
auacagcuugcccaucaccu

SEQ ID NO: 3571517 - RNA, 14 nt, Pseudomonas putida KT2440
auacagggccuggc

SEQ ID NO: 3571518 - RNA, 19 nt, Pseudomonas putida KT2440
auaccaaacggagacucga

SEQ ID NO: 3571519 - RNA, 12 nt, Pseudomonas putida KT2440
auaccacggucg

SEQ ID NO: 3571520 - RNA, 14 nt, Pseudomonas putida KT2440
auacccaacagcau

SEQ ID NO: 3571521 - RNA, 13 nt, Pseudomonas putida KT2440
auacccaacucca

SEQ ID NO: 3571522 - RNA, 13 nt, Pseudomonas putida KT2440
auacccacgccau

SEQ ID NO: 3571523 - RNA, 15 nt, Pseudomonas putida KT2440
auacccgcaacgauc

SEQ ID NO: 3571524 - RNA, 23 nt, Pseudomonas putida KT2440
auacccuguugcgucaacucauc

SEQ ID NO: 3571525 - RNA, 16 nt, Pseudomonas putida KT2440
auacccuuugccaucc

SEQ ID NO: 3571526 - RNA, 15 nt, Pseudomonas putida KT2440
auaccgaacaccagu

SEQ ID NO: 3571527 - RNA, 23 nt, Pseudomonas putida KT2440
auaccgaacaccagugucaccga

SEQ ID NO: 3571528 - RNA, 21 nt, Pseudomonas putida KT2440
auaccgauuaucgagcuacag

SEQ ID NO: 3571529 - RNA, 20 nt, Pseudomonas putida KT2440
auaccgcaacaccugccgca

SEQ ID NO: 3571530 - RNA, 18 nt, Pseudomonas putida KT2440
auaccgccuauguacucg

SEQ ID NO: 3571531 - RNA, 21 nt, Pseudomonas putida KT2440
auaccgccuauguacucggcg

SEQ ID NO: 3571532 - RNA, 16 nt, Pseudomonas putida KT2440
auaccgggauucgacu

SEQ ID NO: 3571533 - RNA, 23 nt, Pseudomonas putida KT2440
auaccguagcggucaugcagcgu

SEQ ID NO: 3571534 - RNA, 21 nt, Pseudomonas putida KT2440
auaccguuguagcugcugaca

SEQ ID NO: 3571535 - RNA, 17 nt, Pseudomonas putida KT2440
auaccucccgcacugcu

SEQ ID NO: 3571536 - RNA, 21 nt, Pseudomonas putida KT2440
auacgauagcggcggcagcgg

SEQ ID NO: 3571537 - RNA, 18 nt, Pseudomonas putida KT2440
auacgcacacgaccuugg

SEQ ID NO: 3571538 - RNA, 16 nt, Pseudomonas putida KT2440
auacgcacaggcgcag

SEQ ID NO: 3571539 - RNA, 14 nt, Pseudomonas putida KT2440
auacgcacauagcc

SEQ ID NO: 3571540 - RNA, 21 nt, Pseudomonas putida KT2440
auacgcaccaacuggucggcc

SEQ ID NO: 3571541 - RNA, 17 nt, Pseudomonas putida KT2440
auacgccgcuugauguc

SEQ ID NO: 3571542 - RNA, 18 nt, Pseudomonas putida KT2440
auacgcucgaccagauca

SEQ ID NO: 3571543 - RNA, 21 nt, Pseudomonas putida KT2440
auacgcuucgaacacccgcuu

SEQ ID NO: 3571544 - RNA, 19 nt, Pseudomonas putida KT2440
auacggcuugauauccagc

SEQ ID NO: 3571545 - RNA, 15 nt, Pseudomonas putida KT2440
auacggggaggccgu

SEQ ID NO: 3571546 - RNA, 14 nt, Pseudomonas putida KT2440
auacguaaccgccc

SEQ ID NO: 3571547 - RNA, 23 nt, Pseudomonas putida KT2440
auacgucggggaauggcccagcc

SEQ ID NO: 3571548 - RNA, 16 nt, Pseudomonas putida KT2440
auacgugcaccggccu

SEQ ID NO: 3571549 - RNA, 18 nt, Pseudomonas putida KT2440
auacguuugcucuugacc

SEQ ID NO: 3571550 - RNA, 14 nt, Pseudomonas putida KT2440
auacucacccgcuu

SEQ ID NO: 3571551 - RNA, 19 nt, Pseudomonas putida KT2440
auacuccagcgucaccacc

SEQ ID NO: 3571552 - RNA, 17 nt, Pseudomonas putida KT2440
auacucuucgcgggcuc

SEQ ID NO: 3571553 - RNA, 14 nt, Pseudomonas putida KT2440
auacugcgcacgaa

SEQ ID NO: 3571554 - RNA, 12 nt, Pseudomonas putida KT2440
auacugcugacc

SEQ ID NO: 3571555 - RNA, 22 nt, Pseudomonas putida KT2440
auacuuggccgacauggcgcuu

SEQ ID NO: 3571556 - RNA, 18 nt, Pseudomonas putida KT2440
auagaacacuggcaggcu

SEQ ID NO: 3571557 - RNA, 22 nt, Pseudomonas putida KT2440
auagaaccguuucaguacagcc

SEQ ID NO: 3571558 - RNA, 14 nt, Pseudomonas putida KT2440
auagaacuccacca

SEQ ID NO: 3571559 - RNA, 16 nt, Pseudomonas putida KT2440
auagaacuccaccagc

SEQ ID NO: 3571560 - RNA, 16 nt, Pseudomonas putida KT2440
auagaucagcgaugcc

SEQ ID NO: 3571561 - RNA, 11 nt, Pseudomonas putida KT2440
auagcaccagc

SEQ ID NO: 3571562 - RNA, 19 nt, Pseudomonas putida KT2440
auagcaccagcgggcccag

SEQ ID NO: 3571563 - RNA, 16 nt, Pseudomonas putida KT2440
auagcagcaccgauca

SEQ ID NO: 3571564 - RNA, 18 nt, Pseudomonas putida KT2440
auagcagcgcuaugccuu

SEQ ID NO: 3571565 - RNA, 19 nt, Pseudomonas putida KT2440
auagcaggaucuagcccaa

SEQ ID NO: 3571566 - RNA, 21 nt, Pseudomonas putida KT2440
auagccacaauggcgcacagg

SEQ ID NO: 3571567 - RNA, 23 nt, Pseudomonas putida KT2440
auagccacaauggcgcacagggc

SEQ ID NO: 3571568 - RNA, 20 nt, Pseudomonas putida KT2440
auagcccaccuucacgccau

SEQ ID NO: 3571569 - RNA, 22 nt, Pseudomonas putida KT2440
auagccccgcaaucgucgacca

SEQ ID NO: 3571570 - RNA, 18 nt, Pseudomonas putida KT2440
auagccucguucgggcac

SEQ ID NO: 3571571 - RNA, 17 nt, Pseudomonas putida KT2440
auagccuguggggcaac

SEQ ID NO: 3571572 - RNA, 21 nt, Pseudomonas putida KT2440
auagcgacaggcuugaagcug

SEQ ID NO: 3571573 - RNA, 14 nt, Pseudomonas putida KT2440
auagcgcuuucugg

SEQ ID NO: 3571574 - RNA, 17 nt, Pseudomonas putida KT2440
auagcucagucgguaga

SEQ ID NO: 3571575 - RNA, 19 nt, Pseudomonas putida KT2440
auaggccccgaaugcacgg

SEQ ID NO: 3571576 - RNA, 18 nt, Pseudomonas putida KT2440
auaggccuuggcuucacu

SEQ ID NO: 3571577 - RNA, 16 nt, Pseudomonas putida KT2440
auagguaaagccaccg

SEQ ID NO: 3571578 - RNA, 13 nt, Pseudomonas putida KT2440
auaguaaggcugg

SEQ ID NO: 3571579 - RNA, 13 nt, Pseudomonas putida KT2440
auagucgaaggcu

SEQ ID NO: 3571580 - RNA, 20 nt, Pseudomonas putida KT2440
auagugguaugauuucaggg

SEQ ID NO: 3571581 - RNA, 13 nt, Pseudomonas putida KT2440
auaguuguggcaa

SEQ ID NO: 3571582 - RNA, 21 nt, Pseudomonas putida KT2440
auaucaggcaugccagcagcu

SEQ ID NO: 3571583 - RNA, 17 nt, Pseudomonas putida KT2440
auauccagugcuucacu

SEQ ID NO: 3571584 - RNA, 21 nt, Pseudomonas putida KT2440
auauccgccugaaucuugcgc

SEQ ID NO: 3571585 - RNA, 15 nt, Pseudomonas putida KT2440
auauccgcuuugcuu

SEQ ID NO: 3571586 - RNA, 20 nt, Pseudomonas putida KT2440
auauccgcuuugcuugaguu

SEQ ID NO: 3571587 - RNA, 22 nt, Pseudomonas putida KT2440
auauccuuuguaggagcgggcu

SEQ ID NO: 3571588 - RNA, 20 nt, Pseudomonas putida KT2440
auaucgaaccagcagcaccu

SEQ ID NO: 3571589 - RNA, 19 nt, Pseudomonas putida KT2440
auaucgagcguuuuucucg

SEQ ID NO: 3571590 - RNA, 19 nt, Pseudomonas putida KT2440
auaucgcauucgccggcac

SEQ ID NO: 3571591 - RNA, 14 nt, Pseudomonas putida KT2440
auaucgcauuucua

SEQ ID NO: 3571592 - RNA, 18 nt, Pseudomonas putida KT2440
auaucgggauaaccgcag

SEQ ID NO: 3571593 - RNA, 14 nt, Pseudomonas putida KT2440
auaucucgggcuuc

SEQ ID NO: 3571594 - RNA, 21 nt, Pseudomonas putida KT2440
auaucucugguacaacaacaa

SEQ ID NO: 3571595 - RNA, 19 nt, Pseudomonas putida KT2440
auaucugcgccaccggccu

SEQ ID NO: 3571596 - RNA, 17 nt, Pseudomonas putida KT2440
auaucuggaccccgccc

SEQ ID NO: 3571597 - RNA, 15 nt, Pseudomonas putida KT2440
auaucuggugcaggu

SEQ ID NO: 3571598 - RNA, 14 nt, Pseudomonas putida KT2440
auaugccgccguuc

SEQ ID NO: 3571599 - RNA, 21 nt, Pseudomonas putida KT2440
auaugccgccguucaggcgcc

SEQ ID NO: 3571600 - RNA, 13 nt, Pseudomonas putida KT2440
auauuugaacacc

SEQ ID NO: 3571601 - RNA, 15 nt, Pseudomonas putida KT2440
aucaaaagccccccu

SEQ ID NO: 3571602 - RNA, 18 nt, Pseudomonas putida KT2440
aucaaaagccccccugcc

SEQ ID NO: 3571603 - RNA, 13 nt, Pseudomonas putida KT2440
aucaaauuuagag

SEQ ID NO: 3571604 - RNA, 14 nt, Pseudomonas putida KT2440
aucaacaggucgcc

SEQ ID NO: 3571605 - RNA, 18 nt, Pseudomonas putida KT2440
aucaacccgugcccggca

SEQ ID NO: 3571606 - RNA, 12 nt, Pseudomonas putida KT2440
aucaacccguuc

SEQ ID NO: 3571607 - RNA, 15 nt, Pseudomonas putida KT2440
aucaacgaaaucaug

SEQ ID NO: 3571608 - RNA, 15 nt, Pseudomonas putida KT2440
aucaacugacgcagc

SEQ ID NO: 3571609 - RNA, 18 nt, Pseudomonas putida KT2440
aucaagcccgcucgccac

SEQ ID NO: 3571610 - RNA, 20 nt, Pseudomonas putida KT2440
aucaagcccgcucgccacac

SEQ ID NO: 3571611 - RNA, 20 nt, Pseudomonas putida KT2440
aucaagcuguacaacgcagc

SEQ ID NO: 3571612 - RNA, 18 nt, Pseudomonas putida KT2440
aucaagguuucacgccgc

SEQ ID NO: 3571613 - RNA, 14 nt, Pseudomonas putida KT2440
aucaauaccggcau

SEQ ID NO: 3571614 - RNA, 18 nt, Pseudomonas putida KT2440
aucaauaccggcaugccc

SEQ ID NO: 3571615 - RNA, 22 nt, Pseudomonas putida KT2440
aucaauacgcuggaucaccacc

SEQ ID NO: 3571616 - RNA, 22 nt, Pseudomonas putida KT2440
aucaaucaacucggcagugaac

SEQ ID NO: 3571617 - RNA, 18 nt, Pseudomonas putida KT2440
aucaauccucugcccgca

SEQ ID NO: 3571618 - RNA, 17 nt, Pseudomonas putida KT2440
aucaauggcugggggcg

SEQ ID NO: 3571619 - RNA, 15 nt, Pseudomonas putida KT2440
aucacacccucugcc

SEQ ID NO: 3571620 - RNA, 19 nt, Pseudomonas putida KT2440
aucacauaaggcagcagcu

SEQ ID NO: 3571621 - RNA, 13 nt, Pseudomonas putida KT2440
aucaccagcagcu

SEQ ID NO: 3571622 - RNA, 15 nt, Pseudomonas putida KT2440
aucaccagcagcuuc

SEQ ID NO: 3571623 - RNA, 16 nt, Pseudomonas putida KT2440
aucaccaggauugccg

SEQ ID NO: 3571624 - RNA, 15 nt, Pseudomonas putida KT2440
aucaccaggcccgca

SEQ ID NO: 3571625 - RNA, 21 nt, Pseudomonas putida KT2440
aucaccagggcaucggcgccc

SEQ ID NO: 3571626 - RNA, 24 nt, Pseudomonas putida KT2440
aucaccagguugcgugccucgccc

SEQ ID NO: 3571627 - RNA, 22 nt, Pseudomonas putida KT2440
aucaccagguuguggcccauga

SEQ ID NO: 3571628 - RNA, 14 nt, Pseudomonas putida KT2440
aucaccaguuuuug

SEQ ID NO: 3571629 - RNA, 19 nt, Pseudomonas putida KT2440
aucacccgcgaaugcuccg

SEQ ID NO: 3571630 - RNA, 19 nt, Pseudomonas putida KT2440
aucacccgggaacagcagc

SEQ ID NO: 3571631 - RNA, 21 nt, Pseudomonas putida KT2440
aucacccgggaacagcagcac

SEQ ID NO: 3571632 - RNA, 15 nt, Pseudomonas putida KT2440
aucacccuuggccac

SEQ ID NO: 3571633 - RNA, 13 nt, Pseudomonas putida KT2440
aucaccgacgugu

SEQ ID NO: 3571634 - RNA, 23 nt, Pseudomonas putida KT2440
aucaccgcaagcugcaccgccac

SEQ ID NO: 3571635 - RNA, 13 nt, Pseudomonas putida KT2440
aucaccgccagca

SEQ ID NO: 3571636 - RNA, 16 nt, Pseudomonas putida KT2440
aucaccgccagcagcu

SEQ ID NO: 3571637 - RNA, 17 nt, Pseudomonas putida KT2440
aucaccgccagcggcaa

SEQ ID NO: 3571638 - RNA, 19 nt, Pseudomonas putida KT2440
aucaccgccagguccaggc

SEQ ID NO: 3571639 - RNA, 20 nt, Pseudomonas putida KT2440
aucaccgccaggucgccggu

SEQ ID NO: 3571640 - RNA, 13 nt, Pseudomonas putida KT2440
aucaccucggcac

SEQ ID NO: 3571641 - RNA, 17 nt, Pseudomonas putida KT2440
aucaccucggcaccgca

SEQ ID NO: 3571642 - RNA, 19 nt, Pseudomonas putida KT2440
aucaccugcacaucggcca

SEQ ID NO: 3571643 - RNA, 19 nt, Pseudomonas putida KT2440
aucaccugggcgaucacau

SEQ ID NO: 3571644 - RNA, 15 nt, Pseudomonas putida KT2440
aucaccuugaugcgc

SEQ ID NO: 3571645 - RNA, 22 nt, Pseudomonas putida KT2440
aucaccuugaugcgcgagcugg

SEQ ID NO: 3571646 - RNA, 22 nt, Pseudomonas putida KT2440
aucacgaucaugcuggccagga

SEQ ID NO: 3571647 - RNA, 23 nt, Pseudomonas putida KT2440
aucacgcaaccucguugcuggug

SEQ ID NO: 3571648 - RNA, 17 nt, Pseudomonas putida KT2440
aucacgcaggcccagca

SEQ ID NO: 3571649 - RNA, 19 nt, Pseudomonas putida KT2440
aucacgcaggcccagcagg

SEQ ID NO: 3571650 - RNA, 14 nt, Pseudomonas putida KT2440
aucacgcccgggcc

SEQ ID NO: 3571651 - RNA, 20 nt, Pseudomonas putida KT2440
aucacgcuccugcaugccuu

SEQ ID NO: 3571652 - RNA, 14 nt, Pseudomonas putida KT2440
aucacgcuggccau

SEQ ID NO: 3571653 - RNA, 16 nt, Pseudomonas putida KT2440
aucacggguaagccgg

SEQ ID NO: 3571654 - RNA, 21 nt, Pseudomonas putida KT2440
aucacgucacagccaagccuu

SEQ ID NO: 3571655 - RNA, 13 nt, Pseudomonas putida KT2440
aucacgucggccu

SEQ ID NO: 3571656 - RNA, 13 nt, Pseudomonas putida KT2440
aucacguuuggca

SEQ ID NO: 3571657 - RNA, 18 nt, Pseudomonas putida KT2440
aucacuccugguuggcca

SEQ ID NO: 3571658 - RNA, 18 nt, Pseudomonas putida KT2440
aucacugccaccgugagc

SEQ ID NO: 3571659 - RNA, 15 nt, Pseudomonas putida KT2440
aucacugccagcacc

SEQ ID NO: 3571660 - RNA, 20 nt, Pseudomonas putida KT2440
aucacugcgcagcccuccca

SEQ ID NO: 3571661 - RNA, 17 nt, Pseudomonas putida KT2440
aucacuuccaccugcgc

SEQ ID NO: 3571662 - RNA, 14 nt, Pseudomonas putida KT2440
aucacuuccauggc

SEQ ID NO: 3571663 - RNA, 12 nt, Pseudomonas putida KT2440
aucacuuccugg

SEQ ID NO: 3571664 - RNA, 16 nt, Pseudomonas putida KT2440
aucacuuccuggccgc

SEQ ID NO: 3571665 - RNA, 15 nt, Pseudomonas putida KT2440
aucacuugcagcucg

SEQ ID NO: 3571666 - RNA, 13 nt, Pseudomonas putida KT2440
aucagaccgccga

SEQ ID NO: 3571667 - RNA, 15 nt, Pseudomonas putida KT2440
aucagagcgccagca

SEQ ID NO: 3571668 - RNA, 18 nt, Pseudomonas putida KT2440
aucagagcgccagcaagc

SEQ ID NO: 3571669 - RNA, 16 nt, Pseudomonas putida KT2440
aucagauggcccgguc

SEQ ID NO: 3571670 - RNA, 18 nt, Pseudomonas putida KT2440
aucagcaaaccgaccagg

SEQ ID NO: 3571671 - RNA, 20 nt, Pseudomonas putida KT2440
aucagcaaaccgaccaggca

SEQ ID NO: 3571672 - RNA, 20 nt, Pseudomonas putida KT2440
aucagcaacccggccaggcc

SEQ ID NO: 3571673 - RNA, 22 nt, Pseudomonas putida KT2440
aucagcaccgagucgccuucac

SEQ ID NO: 3571674 - RNA, 21 nt, Pseudomonas putida KT2440
aucagcagcaccgaggcguga

SEQ ID NO: 3571675 - RNA, 15 nt, Pseudomonas putida KT2440
aucagcaggucggcg

SEQ ID NO: 3571676 - RNA, 17 nt, Pseudomonas putida KT2440
aucagcaucagugcagg

SEQ ID NO: 3571677 - RNA, 16 nt, Pseudomonas putida KT2440
aucagcaugcccagcg

SEQ ID NO: 3571678 - RNA, 13 nt, Pseudomonas putida KT2440
aucagccaaugca

SEQ ID NO: 3571679 - RNA, 23 nt, Pseudomonas putida KT2440
aucagccgcgcugacgcagggcc

SEQ ID NO: 3571680 - RNA, 20 nt, Pseudomonas putida KT2440
aucagcgacaccaaugccuu

SEQ ID NO: 3571681 - RNA, 17 nt, Pseudomonas putida KT2440
aucagcgacaccgccaa

SEQ ID NO: 3571682 - RNA, 13 nt, Pseudomonas putida KT2440
aucagcgcagcau

SEQ ID NO: 3571683 - RNA, 20 nt, Pseudomonas putida KT2440
aucagcgccagcacgcaggc

SEQ ID NO: 3571684 - RNA, 22 nt, Pseudomonas putida KT2440
aucagcgccagcacgcaggcca

SEQ ID NO: 3571685 - RNA, 20 nt, Pseudomonas putida KT2440
aucagcgccgaaccagcaga

SEQ ID NO: 3571686 - RNA, 15 nt, Pseudomonas putida KT2440
aucagcgccgccaau

SEQ ID NO: 3571687 - RNA, 19 nt, Pseudomonas putida KT2440
aucagcgcggugaccagcg

SEQ ID NO: 3571688 - RNA, 17 nt, Pseudomonas putida KT2440
aucagcggcacggccac

SEQ ID NO: 3571689 - RNA, 14 nt, Pseudomonas putida KT2440
aucagcggcaggcu

SEQ ID NO: 3571690 - RNA, 13 nt, Pseudomonas putida KT2440
aucagcggcucca

SEQ ID NO: 3571691 - RNA, 21 nt, Pseudomonas putida KT2440
aucagcucacaggcucagucg

SEQ ID NO: 3571692 - RNA, 15 nt, Pseudomonas putida KT2440
aucagcuuaacgcuu

SEQ ID NO: 3571693 - RNA, 11 nt, Pseudomonas putida KT2440
aucagcuucug

SEQ ID NO: 3571694 - RNA, 22 nt, Pseudomonas putida KT2440
aucagcuugugaaccccacccc

SEQ ID NO: 3571695 - RNA, 11 nt, Pseudomonas putida KT2440
aucaggaacaa

SEQ ID NO: 3571696 - RNA, 14 nt, Pseudomonas putida KT2440
aucaggaacagcuc

SEQ ID NO: 3571697 - RNA, 22 nt, Pseudomonas putida KT2440
aucaggaagccccgcgcgucca

SEQ ID NO: 3571698 - RNA, 21 nt, Pseudomonas putida KT2440
aucaggaaggcgucguacagg

SEQ ID NO: 3571699 - RNA, 21 nt, Pseudomonas putida KT2440
aucaggagcaacuaccaugaa

SEQ ID NO: 3571700 - RNA, 17 nt, Pseudomonas putida KT2440
aucaggauugccgcagc

SEQ ID NO: 3571701 - RNA, 18 nt, Pseudomonas putida KT2440
aucaggcagcucaaagag

SEQ ID NO: 3571702 - RNA, 15 nt, Pseudomonas putida KT2440
aucaggcaggccagc

SEQ ID NO: 3571703 - RNA, 16 nt, Pseudomonas putida KT2440
aucaggcaggccagca

SEQ ID NO: 3571704 - RNA, 17 nt, Pseudomonas putida KT2440
aucaggcaggccagcac

SEQ ID NO: 3571705 - RNA, 22 nt, Pseudomonas putida KT2440
aucaggcaugccagcagcuggc

SEQ ID NO: 3571706 - RNA, 16 nt, Pseudomonas putida KT2440
aucaggcccggcugaa

SEQ ID NO: 3571707 - RNA, 12 nt, Pseudomonas putida KT2440
aucaggcccugc

SEQ ID NO: 3571708 - RNA, 16 nt, Pseudomonas putida KT2440
aucaggcccugcugcu

SEQ ID NO: 3571709 - RNA, 19 nt, Pseudomonas putida KT2440
aucaggccgaaggccagcc

SEQ ID NO: 3571710 - RNA, 22 nt, Pseudomonas putida KT2440
aucaggccgaugccaagcaccg

SEQ ID NO: 3571711 - RNA, 23 nt, Pseudomonas putida KT2440
aucaggccgaugccaagcaccga

SEQ ID NO: 3571712 - RNA, 23 nt, Pseudomonas putida KT2440
aucaggccuucggugcuggcgcu

SEQ ID NO: 3571713 - RNA, 21 nt, Pseudomonas putida KT2440
aucaggcuggcgacgccaccc

SEQ ID NO: 3571714 - RNA, 14 nt, Pseudomonas putida KT2440
aucagggaugcugg

SEQ ID NO: 3571715 - RNA, 17 nt, Pseudomonas putida KT2440
aucagggaugcuggaca

SEQ ID NO: 3571716 - RNA, 22 nt, Pseudomonas putida KT2440
aucagggaugcuggacagcagg

SEQ ID NO: 3571717 - RNA, 16 nt, Pseudomonas putida KT2440
aucaggucaucgaaga

SEQ ID NO: 3571718 - RNA, 14 nt, Pseudomonas putida KT2440
aucaggucgacacc

SEQ ID NO: 3571719 - RNA, 19 nt, Pseudomonas putida KT2440
aucaggucgacacccagca

SEQ ID NO: 3571720 - RNA, 21 nt, Pseudomonas putida KT2440
aucaggucgccaggcuucaga

SEQ ID NO: 3571721 - RNA, 13 nt, Pseudomonas putida KT2440
aucagguucaccg

SEQ ID NO: 3571722 - RNA, 15 nt, Pseudomonas putida KT2440
aucagguucagcagg

SEQ ID NO: 3571723 - RNA, 17 nt, Pseudomonas putida KT2440
aucagguucagcaggau

SEQ ID NO: 3571724 - RNA, 17 nt, Pseudomonas putida KT2440
aucagguucagggcaau

SEQ ID NO: 3571725 - RNA, 16 nt, Pseudomonas putida KT2440
aucagguugcccagca

SEQ ID NO: 3571726 - RNA, 18 nt, Pseudomonas putida KT2440
aucagguugcccagcaug

SEQ ID NO: 3571727 - RNA, 19 nt, Pseudomonas putida KT2440
aucagguugcccagcaugc

SEQ ID NO: 3571728 - RNA, 18 nt, Pseudomonas putida KT2440
aucaguaaucugccggcg

SEQ ID NO: 3571729 - RNA, 14 nt, Pseudomonas putida KT2440
aucagugcaggugc

SEQ ID NO: 3571730 - RNA, 16 nt, Pseudomonas putida KT2440
aucagugcaggugcac

SEQ ID NO: 3571731 - RNA, 21 nt, Pseudomonas putida KT2440
aucagugcggucaggccaagu

SEQ ID NO: 3571732 - RNA, 19 nt, Pseudomonas putida KT2440
aucaucacacucgccccca

SEQ ID NO: 3571733 - RNA, 16 nt, Pseudomonas putida KT2440
aucaucagacagaagc

SEQ ID NO: 3571734 - RNA, 17 nt, Pseudomonas putida KT2440
aucaucagaccgccgau

SEQ ID NO: 3571735 - RNA, 19 nt, Pseudomonas putida KT2440
aucaucaggccgaugccaa

SEQ ID NO: 3571736 - RNA, 23 nt, Pseudomonas putida KT2440
aucaucaggccgaugccaagcac

SEQ ID NO: 3571737 - RNA, 16 nt, Pseudomonas putida KT2440
aucaucaugcccaaug

SEQ ID NO: 3571738 - RNA, 15 nt, Pseudomonas putida KT2440
aucauccugcucgac

SEQ ID NO: 3571739 - RNA, 22 nt, Pseudomonas putida KT2440
aucaucgaagccaguacgcagg

SEQ ID NO: 3571740 - RNA, 18 nt, Pseudomonas putida KT2440
aucaucgagauguggccc

SEQ ID NO: 3571741 - RNA, 14 nt, Pseudomonas putida KT2440
aucaucgccagcag

SEQ ID NO: 3571742 - RNA, 15 nt, Pseudomonas putida KT2440
aucaucgccagcagc

SEQ ID NO: 3571743 - RNA, 20 nt, Pseudomonas putida KT2440
aucaucggcacgcccagcaa

SEQ ID NO: 3571744 - RNA, 18 nt, Pseudomonas putida KT2440
aucaucggcaugcagcgg

SEQ ID NO: 3571745 - RNA, 21 nt, Pseudomonas putida KT2440
aucaucggcaugcagcggcca

SEQ ID NO: 3571746 - RNA, 14 nt, Pseudomonas putida KT2440
aucaucucugccga

SEQ ID NO: 3571747 - RNA, 13 nt, Pseudomonas putida KT2440
aucaucugcugau

SEQ ID NO: 3571748 - RNA, 22 nt, Pseudomonas putida KT2440
aucaucugcugaucuucccggg

SEQ ID NO: 3571749 - RNA, 17 nt, Pseudomonas putida KT2440
aucaugaacgaggacug

SEQ ID NO: 3571750 - RNA, 22 nt, Pseudomonas putida KT2440
aucaugauggucacgcggccgu

SEQ ID NO: 3571751 - RNA, 19 nt, Pseudomonas putida KT2440
aucaugcaguucuaccagc

SEQ ID NO: 3571752 - RNA, 18 nt, Pseudomonas putida KT2440
aucaugcccauggccagc

SEQ ID NO: 3571753 - RNA, 14 nt, Pseudomonas putida KT2440
aucaugccgacggu

SEQ ID NO: 3571754 - RNA, 14 nt, Pseudomonas putida KT2440
aucaugcgacaggc

SEQ ID NO: 3571755 - RNA, 15 nt, Pseudomonas putida KT2440
aucaugcgcuggcca

SEQ ID NO: 3571756 - RNA, 14 nt, Pseudomonas putida KT2440
aucaugcuggccag

SEQ ID NO: 3571757 - RNA, 17 nt, Pseudomonas putida KT2440
aucauguccuugcugcg

SEQ ID NO: 3571758 - RNA, 15 nt, Pseudomonas putida KT2440
aucauuaccugcagg

SEQ ID NO: 3571759 - RNA, 17 nt, Pseudomonas putida KT2440
aucauugggucccuggu

SEQ ID NO: 3571760 - RNA, 15 nt, Pseudomonas putida KT2440
auccaaauugcucca

SEQ ID NO: 3571761 - RNA, 14 nt, Pseudomonas putida KT2440
auccaauguuagcc

SEQ ID NO: 3571762 - RNA, 17 nt, Pseudomonas putida KT2440
auccacaaucagcacug

SEQ ID NO: 3571763 - RNA, 17 nt, Pseudomonas putida KT2440
auccacaccagcggcgc

SEQ ID NO: 3571764 - RNA, 15 nt, Pseudomonas putida KT2440
auccacacgcugcug

SEQ ID NO: 3571765 - RNA, 14 nt, Pseudomonas putida KT2440
auccacagcggguc

SEQ ID NO: 3571766 - RNA, 17 nt, Pseudomonas putida KT2440
auccacagggccuuccc

SEQ ID NO: 3571767 - RNA, 18 nt, Pseudomonas putida KT2440
auccacauacugcuucug

SEQ ID NO: 3571768 - RNA, 19 nt, Pseudomonas putida KT2440
auccacauacugcuucugc

SEQ ID NO: 3571769 - RNA, 13 nt, Pseudomonas putida KT2440
auccacauuaccg

SEQ ID NO: 3571770 - RNA, 21 nt, Pseudomonas putida KT2440
auccaccacccuggcaugccc

SEQ ID NO: 3571771 - RNA, 16 nt, Pseudomonas putida KT2440
auccaccagccccagc

SEQ ID NO: 3571772 - RNA, 16 nt, Pseudomonas putida KT2440
auccaccagccgccgu

SEQ ID NO: 3571773 - RNA, 20 nt, Pseudomonas putida KT2440
auccaccaggcuggccacca

SEQ ID NO: 3571774 - RNA, 15 nt, Pseudomonas putida KT2440
auccacccccaauca

SEQ ID NO: 3571775 - RNA, 21 nt, Pseudomonas putida KT2440
auccaccugugaggccuucag

SEQ ID NO: 3571776 - RNA, 15 nt, Pseudomonas putida KT2440
auccacguccugguc

SEQ ID NO: 3571777 - RNA, 22 nt, Pseudomonas putida KT2440
auccacuugaagaccgccauga

SEQ ID NO: 3571778 - RNA, 20 nt, Pseudomonas putida KT2440
auccacuugucccggcccag

SEQ ID NO: 3571779 - RNA, 15 nt, Pseudomonas putida KT2440
auccagaaagcgauu

SEQ ID NO: 3571780 - RNA, 15 nt, Pseudomonas putida KT2440
auccagcaccggcgu

SEQ ID NO: 3571781 - RNA, 18 nt, Pseudomonas putida KT2440
auccagcacugccuggcc

SEQ ID NO: 3571782 - RNA, 18 nt, Pseudomonas putida KT2440
auccagcaggcuugccag

SEQ ID NO: 3571783 - RNA, 22 nt, Pseudomonas putida KT2440
auccagcaggguggccagcaag

SEQ ID NO: 3571784 - RNA, 22 nt, Pseudomonas putida KT2440
auccagccggcccggcuggcca

SEQ ID NO: 3571785 - RNA, 20 nt, Pseudomonas putida KT2440
auccagcgaggcgggccgca

SEQ ID NO: 3571786 - RNA, 15 nt, Pseudomonas putida KT2440
auccagcgccgcgcc

SEQ ID NO: 3571787 - RNA, 22 nt, Pseudomonas putida KT2440
auccagcgccgcgccaccgauc

SEQ ID NO: 3571788 - RNA, 22 nt, Pseudomonas putida KT2440
auccagcgguucguugcagaag

SEQ ID NO: 3571789 - RNA, 17 nt, Pseudomonas putida KT2440
auccagcuccagcacca

SEQ ID NO: 3571790 - RNA, 11 nt, Pseudomonas putida KT2440
auccagcugcu

SEQ ID NO: 3571791 - RNA, 21 nt, Pseudomonas putida KT2440
auccagcugcuggauugccug

SEQ ID NO: 3571792 - RNA, 12 nt, Pseudomonas putida KT2440
auccagcuucuu

SEQ ID NO: 3571793 - RNA, 11 nt, Pseudomonas putida KT2440
auccagcuugc

SEQ ID NO: 3571794 - RNA, 18 nt, Pseudomonas putida KT2440
auccagcuugccaccauc

SEQ ID NO: 3571795 - RNA, 14 nt, Pseudomonas putida KT2440
auccaggcccguga

SEQ ID NO: 3571796 - RNA, 18 nt, Pseudomonas putida KT2440
auccaggcccgugacgaa

SEQ ID NO: 3571797 - RNA, 13 nt, Pseudomonas putida KT2440
auccaggcgggcg

SEQ ID NO: 3571798 - RNA, 12 nt, Pseudomonas putida KT2440
auccaggcugca

SEQ ID NO: 3571799 - RNA, 14 nt, Pseudomonas putida KT2440
auccaggcugcacu

SEQ ID NO: 3571800 - RNA, 15 nt, Pseudomonas putida KT2440
auccaggcuggccag

SEQ ID NO: 3571801 - RNA, 16 nt, Pseudomonas putida KT2440
auccaggcuggccagc

SEQ ID NO: 3571802 - RNA, 17 nt, Pseudomonas putida KT2440
auccaggcuggccagca

SEQ ID NO: 3571803 - RNA, 15 nt, Pseudomonas putida KT2440
auccaggcuggcgcu

SEQ ID NO: 3571804 - RNA, 20 nt, Pseudomonas putida KT2440
auccagucgaucagcgacac

SEQ ID NO: 3571805 - RNA, 12 nt, Pseudomonas putida KT2440
auccaucaccau

SEQ ID NO: 3571806 - RNA, 23 nt, Pseudomonas putida KT2440
auccaucuucaccuugccuaccu

SEQ ID NO: 3571807 - RNA, 13 nt, Pseudomonas putida KT2440
auccauuugugga

SEQ ID NO: 3571808 - RNA, 13 nt, Pseudomonas putida KT2440
aucccaggcgcuu

SEQ ID NO: 3571809 - RNA, 20 nt, Pseudomonas putida KT2440
auccccauguaggagauucu

SEQ ID NO: 3571810 - RNA, 19 nt, Pseudomonas putida KT2440
aucccccggcccagccccg

SEQ ID NO: 3571811 - RNA, 20 nt, Pseudomonas putida KT2440
auccccgccgccagcagcgg

SEQ ID NO: 3571812 - RNA, 21 nt, Pseudomonas putida KT2440
auccccuuauaaugcgcccca

SEQ ID NO: 3571813 - RNA, 21 nt, Pseudomonas putida KT2440
aucccgacaaaguggaaggca

SEQ ID NO: 3571814 - RNA, 23 nt, Pseudomonas putida KT2440
aucccgcaggaauaacuggcccg

SEQ ID NO: 3571815 - RNA, 21 nt, Pseudomonas putida KT2440
aucccgcucgguaucggccag

SEQ ID NO: 3571816 - RNA, 19 nt, Pseudomonas putida KT2440
aucccgcuucgccagcgcc

SEQ ID NO: 3571817 - RNA, 22 nt, Pseudomonas putida KT2440
aucccuacccccuccuccagca

SEQ ID NO: 3571818 - RNA, 15 nt, Pseudomonas putida KT2440
aucccuguacagauc

SEQ ID NO: 3571819 - RNA, 19 nt, Pseudomonas putida KT2440
aucccuguacagaucgauc

SEQ ID NO: 3571820 - RNA, 16 nt, Pseudomonas putida KT2440
aucccuuugcccgcca

SEQ ID NO: 3571821 - RNA, 22 nt, Pseudomonas putida KT2440
auccgaucuugaaccguugcga

SEQ ID NO: 3571822 - RNA, 14 nt, Pseudomonas putida KT2440
auccgcacacgcuc

SEQ ID NO: 3571823 - RNA, 21 nt, Pseudomonas putida KT2440
auccgcaccccaaggcugcca

SEQ ID NO: 3571824 - RNA, 14 nt, Pseudomonas putida KT2440
auccgcaccgggca

SEQ ID NO: 3571825 - RNA, 14 nt, Pseudomonas putida KT2440
auccgcacgcaugu

SEQ ID NO: 3571826 - RNA, 13 nt, Pseudomonas putida KT2440
auccgcagccccg

SEQ ID NO: 3571827 - RNA, 16 nt, Pseudomonas putida KT2440
auccgcagccccgccg

SEQ ID NO: 3571828 - RNA, 20 nt, Pseudomonas putida KT2440
auccgcauaucauagaucuc

SEQ ID NO: 3571829 - RNA, 18 nt, Pseudomonas putida KT2440
auccgccaacaccaccuc

SEQ ID NO: 3571830 - RNA, 23 nt, Pseudomonas putida KT2440
auccgccaggcucuccagccgcu

SEQ ID NO: 3571831 - RNA, 23 nt, Pseudomonas putida KT2440
auccgccagguauucggcaaugc

SEQ ID NO: 3571832 - RNA, 18 nt, Pseudomonas putida KT2440
auccgccaugggccugca

SEQ ID NO: 3571833 - RNA, 14 nt, Pseudomonas putida KT2440
auccgccucauccu

SEQ ID NO: 3571834 - RNA, 22 nt, Pseudomonas putida KT2440
auccgccuggccgcugcgcccg

SEQ ID NO: 3571835 - RNA, 21 nt, Pseudomonas putida KT2440
auccgcgcccagucaccguuc

SEQ ID NO: 3571836 - RNA, 19 nt, Pseudomonas putida KT2440
auccgcgcuacggcgucga

SEQ ID NO: 3571837 - RNA, 16 nt, Pseudomonas putida KT2440
auccggcacuccagcg

SEQ ID NO: 3571838 - RNA, 19 nt, Pseudomonas putida KT2440
auccggcacuccagcgagu

SEQ ID NO: 3571839 - RNA, 21 nt, Pseudomonas putida KT2440
auccggccguguucaggcacg

SEQ ID NO: 3571840 - RNA, 22 nt, Pseudomonas putida KT2440
auccggccguguucaggcacga

SEQ ID NO: 3571841 - RNA, 18 nt, Pseudomonas putida KT2440
auccggccuuuucauccg

SEQ ID NO: 3571842 - RNA, 21 nt, Pseudomonas putida KT2440
auccggccuuuucauccggcg

SEQ ID NO: 3571843 - RNA, 22 nt, Pseudomonas putida KT2440
auccggcgauacuuggccauca

SEQ ID NO: 3571844 - RNA, 20 nt, Pseudomonas putida KT2440
auccggcgcaucgacgggca

SEQ ID NO: 3571845 - RNA, 23 nt, Pseudomonas putida KT2440
auccggcgcggccugcuccacaa

SEQ ID NO: 3571846 - RNA, 16 nt, Pseudomonas putida KT2440
auccggggccgcaagg

SEQ ID NO: 3571847 - RNA, 22 nt, Pseudomonas putida KT2440
auccgggugcuggcucgcugcc

SEQ ID NO: 3571848 - RNA, 20 nt, Pseudomonas putida KT2440
auccgguggcaucaccggca

SEQ ID NO: 3571849 - RNA, 21 nt, Pseudomonas putida KT2440
auccgguggcaucaccggcag

SEQ ID NO: 3571850 - RNA, 20 nt, Pseudomonas putida KT2440
auccguggguugaucucuuc

SEQ ID NO: 3571851 - RNA, 20 nt, Pseudomonas putida KT2440
auccucaaaucgcugcggcc

SEQ ID NO: 3571852 - RNA, 18 nt, Pseudomonas putida KT2440
auccuccagcccugcucg

SEQ ID NO: 3571853 - RNA, 17 nt, Pseudomonas putida KT2440
auccuccgcccugcccu

SEQ ID NO: 3571854 - RNA, 15 nt, Pseudomonas putida KT2440
auccuccugcgcaug

SEQ ID NO: 3571855 - RNA, 14 nt, Pseudomonas putida KT2440
auccucgacgacca

SEQ ID NO: 3571856 - RNA, 13 nt, Pseudomonas putida KT2440
auccucgcccacc

SEQ ID NO: 3571857 - RNA, 15 nt, Pseudomonas putida KT2440
auccucggccaggcc

SEQ ID NO: 3571858 - RNA, 18 nt, Pseudomonas putida KT2440
auccucguccagcucguc

SEQ ID NO: 3571859 - RNA, 17 nt, Pseudomonas putida KT2440
auccugcacugcaacac

SEQ ID NO: 3571860 - RNA, 16 nt, Pseudomonas putida KT2440
auccugcagcaccagc

SEQ ID NO: 3571861 - RNA, 18 nt, Pseudomonas putida KT2440
auccugcagcaccagcuu

SEQ ID NO: 3571862 - RNA, 14 nt, Pseudomonas putida KT2440
auccugcagccgca

SEQ ID NO: 3571863 - RNA, 19 nt, Pseudomonas putida KT2440
auccugcagccgcaccugc

SEQ ID NO: 3571864 - RNA, 15 nt, Pseudomonas putida KT2440
auccugcgcggccac

SEQ ID NO: 3571865 - RNA, 18 nt, Pseudomonas putida KT2440
auccugcgugcugugcac

SEQ ID NO: 3571866 - RNA, 15 nt, Pseudomonas putida KT2440
auccugcucgacaag

SEQ ID NO: 3571867 - RNA, 21 nt, Pseudomonas putida KT2440
auccugcucgacaagccgcug

SEQ ID NO: 3571868 - RNA, 22 nt, Pseudomonas putida KT2440
auccuggugaucaacaaaccga

SEQ ID NO: 3571869 - RNA, 18 nt, Pseudomonas putida KT2440
auccuguggaagcgggcg

SEQ ID NO: 3571870 - RNA, 18 nt, Pseudomonas putida KT2440
auccugugggagcgggcu

SEQ ID NO: 3571871 - RNA, 15 nt, Pseudomonas putida KT2440
auccuugcccaccag

SEQ ID NO: 3571872 - RNA, 20 nt, Pseudomonas putida KT2440
auccuuuguaggagcgggcu

SEQ ID NO: 3571873 - RNA, 21 nt, Pseudomonas putida KT2440
aucgaaacauugacagcuuuu

SEQ ID NO: 3571874 - RNA, 22 nt, Pseudomonas putida KT2440
aucgaaacauugacagcuuuug

SEQ ID NO: 3571875 - RNA, 16 nt, Pseudomonas putida KT2440
aucgaaccagcagcac

SEQ ID NO: 3571876 - RNA, 13 nt, Pseudomonas putida KT2440
aucgaagcagcag

SEQ ID NO: 3571877 - RNA, 18 nt, Pseudomonas putida KT2440
aucgaagcagugcugcca

SEQ ID NO: 3571878 - RNA, 23 nt, Pseudomonas putida KT2440
aucgaagcgacagcggccagcuc

SEQ ID NO: 3571879 - RNA, 12 nt, Pseudomonas putida KT2440
aucgaagcgcac

SEQ ID NO: 3571880 - RNA, 17 nt, Pseudomonas putida KT2440
aucgaaggugguagccg

SEQ ID NO: 3571881 - RNA, 14 nt, Pseudomonas putida KT2440
aucgaaugaucgaa

SEQ ID NO: 3571882 - RNA, 16 nt, Pseudomonas putida KT2440
aucgaauucagugucc

SEQ ID NO: 3571883 - RNA, 16 nt, Pseudomonas putida KT2440
aucgacaaccccagcc

SEQ ID NO: 3571884 - RNA, 20 nt, Pseudomonas putida KT2440
aucgacaggugcggcagcuc

SEQ ID NO: 3571885 - RNA, 14 nt, Pseudomonas putida KT2440
aucgacccuggcau

SEQ ID NO: 3571886 - RNA, 23 nt, Pseudomonas putida KT2440
aucgaccggguaaucgccaggcc

SEQ ID NO: 3571887 - RNA, 16 nt, Pseudomonas putida KT2440
aucgaccugcaggccc

SEQ ID NO: 3571888 - RNA, 15 nt, Pseudomonas putida KT2440
aucgaccuggcccga

SEQ ID NO: 3571889 - RNA, 13 nt, Pseudomonas putida KT2440
aucgacgaugccg

SEQ ID NO: 3571890 - RNA, 13 nt, Pseudomonas putida KT2440
aucgacgcaauga

SEQ ID NO: 3571891 - RNA, 16 nt, Pseudomonas putida KT2440
aucgacgcaaugaucg

SEQ ID NO: 3571892 - RNA, 15 nt, Pseudomonas putida KT2440
aucgacgggcauggc

SEQ ID NO: 3571893 - RNA, 13 nt, Pseudomonas putida KT2440
aucgacucaagga

SEQ ID NO: 3571894 - RNA, 13 nt, Pseudomonas putida KT2440
aucgacuggaugc

SEQ ID NO: 3571895 - RNA, 19 nt, Pseudomonas putida KT2440
aucgacuggaugcucgaua

SEQ ID NO: 3571896 - RNA, 12 nt, Pseudomonas putida KT2440
aucgagaucagg

SEQ ID NO: 3571897 - RNA, 22 nt, Pseudomonas putida KT2440
aucgagauguggcccgggaagg

SEQ ID NO: 3571898 - RNA, 15 nt, Pseudomonas putida KT2440
aucgagccgaacagc

SEQ ID NO: 3571899 - RNA, 20 nt, Pseudomonas putida KT2440
aucgagccgaacagcaggca

SEQ ID NO: 3571900 - RNA, 17 nt, Pseudomonas putida KT2440
aucgagccgaucaggaa

SEQ ID NO: 3571901 - RNA, 14 nt, Pseudomonas putida KT2440
aucgagcgcccacg

SEQ ID NO: 3571902 - RNA, 12 nt, Pseudomonas putida KT2440
aucgagcgccgc

SEQ ID NO: 3571903 - RNA, 14 nt, Pseudomonas putida KT2440
aucgagcgccgccc

SEQ ID NO: 3571904 - RNA, 15 nt, Pseudomonas putida KT2440
aucgagcgccgcccg

SEQ ID NO: 3571905 - RNA, 17 nt, Pseudomonas putida KT2440
aucgagcuacagccccu

SEQ ID NO: 3571906 - RNA, 22 nt, Pseudomonas putida KT2440
aucgaggcguuguacaggaguc

SEQ ID NO: 3571907 - RNA, 15 nt, Pseudomonas putida KT2440
aucgagggacucuug

SEQ ID NO: 3571908 - RNA, 15 nt, Pseudomonas putida KT2440
aucgaguaucgccuc

SEQ ID NO: 3571909 - RNA, 18 nt, Pseudomonas putida KT2440
aucgauacccacgccaug

SEQ ID NO: 3571910 - RNA, 18 nt, Pseudomonas putida KT2440
aucgaucacuuccaggcc

SEQ ID NO: 3571911 - RNA, 16 nt, Pseudomonas putida KT2440
aucgaucaggaaggca

SEQ ID NO: 3571912 - RNA, 17 nt, Pseudomonas putida KT2440
aucgaucaggaaggcac

SEQ ID NO: 3571913 - RNA, 24 nt, Pseudomonas putida KT2440
aucgaucaggaaggcaccacggaa

SEQ ID NO: 3571914 - RNA, 15 nt, Pseudomonas putida KT2440
aucgauccccaguuc

SEQ ID NO: 3571915 - RNA, 17 nt, Pseudomonas putida KT2440
aucgauccccaguucac

SEQ ID NO: 3571916 - RNA, 20 nt, Pseudomonas putida KT2440
aucgaucugcucgcccaccg

SEQ ID NO: 3571917 - RNA, 16 nt, Pseudomonas putida KT2440
aucgaugagcgagccc

SEQ ID NO: 3571918 - RNA, 13 nt, Pseudomonas putida KT2440
aucgauggucuuc

SEQ ID NO: 3571919 - RNA, 20 nt, Pseudomonas putida KT2440
aucgauguagauacgcucgu

SEQ ID NO: 3571920 - RNA, 21 nt, Pseudomonas putida KT2440
aucgcaauccccuccgccugc

SEQ ID NO: 3571921 - RNA, 13 nt, Pseudomonas putida KT2440
aucgcaccgugcu

SEQ ID NO: 3571922 - RNA, 21 nt, Pseudomonas putida KT2440
aucgcacucaguuaaucagca

SEQ ID NO: 3571923 - RNA, 15 nt, Pseudomonas putida KT2440
aucgcagggucgcgc

SEQ ID NO: 3571924 - RNA, 15 nt, Pseudomonas putida KT2440
aucgcauugccccug

SEQ ID NO: 3571925 - RNA, 16 nt, Pseudomonas putida KT2440
aucgccaaccccaacc

SEQ ID NO: 3571926 - RNA, 20 nt, Pseudomonas putida KT2440
aucgccaaccccaacccggu

SEQ ID NO: 3571927 - RNA, 21 nt, Pseudomonas putida KT2440
aucgccaaucagguuguucac

SEQ ID NO: 3571928 - RNA, 19 nt, Pseudomonas putida KT2440
aucgccaccggcauucccg

SEQ ID NO: 3571929 - RNA, 15 nt, Pseudomonas putida KT2440
aucgccagcaggccg

SEQ ID NO: 3571930 - RNA, 19 nt, Pseudomonas putida KT2440
aucgccagcaggccgccga

SEQ ID NO: 3571931 - RNA, 22 nt, Pseudomonas putida KT2440
aucgccagcaggccgccgacga

SEQ ID NO: 3571932 - RNA, 12 nt, Pseudomonas putida KT2440
aucgccagcccc

SEQ ID NO: 3571933 - RNA, 14 nt, Pseudomonas putida KT2440
aucgccaggacggu

SEQ ID NO: 3571934 - RNA, 16 nt, Pseudomonas putida KT2440
aucgccaggcccagcc

SEQ ID NO: 3571935 - RNA, 19 nt, Pseudomonas putida KT2440
aucgccaggcccagccccg

SEQ ID NO: 3571936 - RNA, 21 nt, Pseudomonas putida KT2440
aucgccaggcccagccccgca

SEQ ID NO: 3571937 - RNA, 13 nt, Pseudomonas putida KT2440
aucgccaggcgca

SEQ ID NO: 3571938 - RNA, 20 nt, Pseudomonas putida KT2440
aucgccagggcucaagacag

SEQ ID NO: 3571939 - RNA, 22 nt, Pseudomonas putida KT2440
aucgcccaucccggucaccugc

SEQ ID NO: 3571940 - RNA, 14 nt, Pseudomonas putida KT2440
aucgcccgcugcuu

SEQ ID NO: 3571941 - RNA, 14 nt, Pseudomonas putida KT2440
aucgccgcaaccgc

SEQ ID NO: 3571942 - RNA, 22 nt, Pseudomonas putida KT2440
aucgccgcaucguuauccagca

SEQ ID NO: 3571943 - RNA, 14 nt, Pseudomonas putida KT2440
aucgccgccgagcu

SEQ ID NO: 3571944 - RNA, 14 nt, Pseudomonas putida KT2440
aucgccgggcgcac

SEQ ID NO: 3571945 - RNA, 20 nt, Pseudomonas putida KT2440
aucgccggguccaccagccc

SEQ ID NO: 3571946 - RNA, 17 nt, Pseudomonas putida KT2440
aucgccgucgaccaggc

SEQ ID NO: 3571947 - RNA, 14 nt, Pseudomonas putida KT2440
aucgccuccaggcg

SEQ ID NO: 3571948 - RNA, 15 nt, Pseudomonas putida KT2440
aucgccucgcuggcg

SEQ ID NO: 3571949 - RNA, 13 nt, Pseudomonas putida KT2440
aucgccucggcac

SEQ ID NO: 3571950 - RNA, 13 nt, Pseudomonas putida KT2440
aucgccucgugca

SEQ ID NO: 3571951 - RNA, 18 nt, Pseudomonas putida KT2440
aucgccucgugcagcugc

SEQ ID NO: 3571952 - RNA, 12 nt, Pseudomonas putida KT2440
aucgccugcuug

SEQ ID NO: 3571953 - RNA, 20 nt, Pseudomonas putida KT2440
aucgccuggccggccgggcu

SEQ ID NO: 3571954 - RNA, 18 nt, Pseudomonas putida KT2440
aucgcgacacaaggccgc

SEQ ID NO: 3571955 - RNA, 19 nt, Pseudomonas putida KT2440
aucgcgaggcccgaacugg

SEQ ID NO: 3571956 - RNA, 15 nt, Pseudomonas putida KT2440
aucgcgcaagccuuu

SEQ ID NO: 3571957 - RNA, 22 nt, Pseudomonas putida KT2440
aucgcgcaagccuuugcgccuu

SEQ ID NO: 3571958 - RNA, 15 nt, Pseudomonas putida KT2440
aucgcgcaggucgac

SEQ ID NO: 3571959 - RNA, 23 nt, Pseudomonas putida KT2440
aucgcgccuucauaggcggccac

SEQ ID NO: 3571960 - RNA, 20 nt, Pseudomonas putida KT2440
aucgcgcuugcgguccugca

SEQ ID NO: 3571961 - RNA, 17 nt, Pseudomonas putida KT2440
aucgcggccgaaggcgc

SEQ ID NO: 3571962 - RNA, 18 nt, Pseudomonas putida KT2440
aucgcgggccagguggcc

SEQ ID NO: 3571963 - RNA, 22 nt, Pseudomonas putida KT2440
aucgcggucuuguaucccaggc

SEQ ID NO: 3571964 - RNA, 16 nt, Pseudomonas putida KT2440
aucgcuaucugaaaga

SEQ ID NO: 3571965 - RNA, 17 nt, Pseudomonas putida KT2440
aucgcuaucugaaagaa

SEQ ID NO: 3571966 - RNA, 14 nt, Pseudomonas putida KT2440
aucgcucaccguuc

SEQ ID NO: 3571967 - RNA, 13 nt, Pseudomonas putida KT2440
aucgcucaugccc

SEQ ID NO: 3571968 - RNA, 17 nt, Pseudomonas putida KT2440
aucgcugacuuccagca

SEQ ID NO: 3571969 - RNA, 19 nt, Pseudomonas putida KT2440
aucgcugcccgggcaaagc

SEQ ID NO: 3571970 - RNA, 20 nt, Pseudomonas putida KT2440
aucgcugcccgggcaaagca

SEQ ID NO: 3571971 - RNA, 21 nt, Pseudomonas putida KT2440
aucgcugccgccuuggcagcc

SEQ ID NO: 3571972 - RNA, 16 nt, Pseudomonas putida KT2440
aucgcugugcaacagc

SEQ ID NO: 3571973 - RNA, 20 nt, Pseudomonas putida KT2440
aucgcugugcaacagcgccu

SEQ ID NO: 3571974 - RNA, 23 nt, Pseudomonas putida KT2440
aucgcugugcaacagcgccuggc

SEQ ID NO: 3571975 - RNA, 20 nt, Pseudomonas putida KT2440
aucgcuucgaggauuuucac

SEQ ID NO: 3571976 - RNA, 20 nt, Pseudomonas putida KT2440
aucgcuuuugaagucgagcg

SEQ ID NO: 3571977 - RNA, 22 nt, Pseudomonas putida KT2440
aucggaacgaaaaacuccuuga

SEQ ID NO: 3571978 - RNA, 18 nt, Pseudomonas putida KT2440
aucggacgaugaggccgg

SEQ ID NO: 3571979 - RNA, 16 nt, Pseudomonas putida KT2440
aucggcaaacacaucc

SEQ ID NO: 3571980 - RNA, 18 nt, Pseudomonas putida KT2440
aucggcaaacacauccag

SEQ ID NO: 3571981 - RNA, 20 nt, Pseudomonas putida KT2440
aucggcaaacacauccagcg

SEQ ID NO: 3571982 - RNA, 21 nt, Pseudomonas putida KT2440
aucggcacacgguuuccaggc

SEQ ID NO: 3571983 - RNA, 20 nt, Pseudomonas putida KT2440
aucggcacccgcacaugccu

SEQ ID NO: 3571984 - RNA, 18 nt, Pseudomonas putida KT2440
aucggcacgaagcccagu

SEQ ID NO: 3571985 - RNA, 19 nt, Pseudomonas putida KT2440
aucggcacgccagcagcgu

SEQ ID NO: 3571986 - RNA, 20 nt, Pseudomonas putida KT2440
aucggcagcgcgcaggucgu

SEQ ID NO: 3571987 - RNA, 20 nt, Pseudomonas putida KT2440
aucggcaggcgguccagcaa

SEQ ID NO: 3571988 - RNA, 13 nt, Pseudomonas putida KT2440
aucggcaggcugg

SEQ ID NO: 3571989 - RNA, 22 nt, Pseudomonas putida KT2440
aucggcaggucauuggcgccau

SEQ ID NO: 3571990 - RNA, 21 nt, Pseudomonas putida KT2440
aucggcaguagagcccccagc

SEQ ID NO: 3571991 - RNA, 16 nt, Pseudomonas putida KT2440
aucggcauugcugaag

SEQ ID NO: 3571992 - RNA, 20 nt, Pseudomonas putida KT2440
aucggccaccgccggguggg

SEQ ID NO: 3571993 - RNA, 19 nt, Pseudomonas putida KT2440
aucggccacuucgcggaag

SEQ ID NO: 3571994 - RNA, 13 nt, Pseudomonas putida KT2440
aucggccagcaaa

SEQ ID NO: 3571995 - RNA, 23 nt, Pseudomonas putida KT2440
aucggccggcucgaacugaagga

SEQ ID NO: 3571996 - RNA, 19 nt, Pseudomonas putida KT2440
aucggccguggguaccuuc

SEQ ID NO: 3571997 - RNA, 13 nt, Pseudomonas putida KT2440
aucggccucucuc

SEQ ID NO: 3571998 - RNA, 17 nt, Pseudomonas putida KT2440
aucggccuggggcaggc

SEQ ID NO: 3571999 - RNA, 16 nt, Pseudomonas putida KT2440
aucggccuguggguaa

SEQ ID NO: 3572000 - RNA, 15 nt, Pseudomonas putida KT2440
aucggcgcgacagcg

SEQ ID NO: 3572001 - RNA, 16 nt, Pseudomonas putida KT2440
aucggcgcugacgaac

SEQ ID NO: 3572002 - RNA, 23 nt, Pseudomonas putida KT2440
aucggcgugguccagcguucggc

SEQ ID NO: 3572003 - RNA, 14 nt, Pseudomonas putida KT2440
aucggcuccagcgc

SEQ ID NO: 3572004 - RNA, 22 nt, Pseudomonas putida KT2440
aucggcuucagguucacuucca

SEQ ID NO: 3572005 - RNA, 13 nt, Pseudomonas putida KT2440
aucgggaucagca

SEQ ID NO: 3572006 - RNA, 19 nt, Pseudomonas putida KT2440
aucgggcagacgacccgga

SEQ ID NO: 3572007 - RNA, 20 nt, Pseudomonas putida KT2440
aucgggcgcgucgucauggu

SEQ ID NO: 3572008 - RNA, 18 nt, Pseudomonas putida KT2440
aucggguaagccaugcgc

SEQ ID NO: 3572009 - RNA, 14 nt, Pseudomonas putida KT2440
aucgggucacgcuc

SEQ ID NO: 3572010 - RNA, 18 nt, Pseudomonas putida KT2440
aucggguucuuccaaguu

SEQ ID NO: 3572011 - RNA, 16 nt, Pseudomonas putida KT2440
aucggguuuacccgcg

SEQ ID NO: 3572012 - RNA, 18 nt, Pseudomonas putida KT2440
ggaagucgcggaacagug

SEQ ID NO: 3572013 - RNA, 19 nt, Pseudomonas putida KT2440
ggaagugcuucaccuugcc

SEQ ID NO: 3572014 - RNA, 21 nt, Pseudomonas putida KT2440
ggaaguugccauuuuggauuu

SEQ ID NO: 3572015 - RNA, 14 nt, Pseudomonas putida KT2440
ggaauagaacacug

SEQ ID NO: 3572016 - RNA, 17 nt, Pseudomonas putida KT2440
ggaauagaacacuggca

SEQ ID NO: 3572017 - RNA, 16 nt, Pseudomonas putida KT2440
ggaaugcccgggcgca

SEQ ID NO: 3572018 - RNA, 21 nt, Pseudomonas putida KT2440
ggaaugcucgucaccaucggu

SEQ ID NO: 3572019 - RNA, 17 nt, Pseudomonas putida KT2440
ggaaugugucagggcug

SEQ ID NO: 3572020 - RNA, 20 nt, Pseudomonas putida KT2440
ggaauguuaccggccuggca

SEQ ID NO: 3572021 - RNA, 23 nt, Pseudomonas putida KT2440
ggaauuauuggccagcaacggug

SEQ ID NO: 3572022 - RNA, 14 nt, Pseudomonas putida KT2440
ggaauuucugcacc

SEQ ID NO: 3572023 - RNA, 14 nt, Pseudomonas putida KT2440
ggaauuugccggga

SEQ ID NO: 3572024 - RNA, 20 nt, Pseudomonas putida KT2440
ggacaaauccaggucgguga

SEQ ID NO: 3572025 - RNA, 18 nt, Pseudomonas putida KT2440
ggacaacaaggacugccu

SEQ ID NO: 3572026 - RNA, 12 nt, Pseudomonas putida KT2440
ggacacaggccg

SEQ ID NO: 3572027 - RNA, 20 nt, Pseudomonas putida KT2440
ggacacaucgaucaggucga

SEQ ID NO: 3572028 - RNA, 14 nt, Pseudomonas putida KT2440
ggacaccaggcugg

SEQ ID NO: 3572029 - RNA, 12 nt, Pseudomonas putida KT2440
ggacaccagguu

SEQ ID NO: 3572030 - RNA, 15 nt, Pseudomonas putida KT2440
ggacaccucccgcgc

SEQ ID NO: 3572031 - RNA, 14 nt, Pseudomonas putida KT2440
ggacacgucacuga

SEQ ID NO: 3572032 - RNA, 11 nt, Pseudomonas putida KT2440
ggacagcagcu

SEQ ID NO: 3572033 - RNA, 18 nt, Pseudomonas putida KT2440
ggacagcaucucggucga

SEQ ID NO: 3572034 - RNA, 11 nt, Pseudomonas putida KT2440
ggacaggcgcu

SEQ ID NO: 3572035 - RNA, 13 nt, Pseudomonas putida KT2440
ggacaggggaugc

SEQ ID NO: 3572036 - RNA, 17 nt, Pseudomonas putida KT2440
ggacaucaccaggccgg

SEQ ID NO: 3572037 - RNA, 15 nt, Pseudomonas putida KT2440
ggaccaccugggcca

SEQ ID NO: 3572038 - RNA, 13 nt, Pseudomonas putida KT2440
ggaccagacccgc

SEQ ID NO: 3572039 - RNA, 16 nt, Pseudomonas putida KT2440
ggaccagcaccaccug

SEQ ID NO: 3572040 - RNA, 12 nt, Pseudomonas putida KT2440
ggaccagcgccg

SEQ ID NO: 3572041 - RNA, 15 nt, Pseudomonas putida KT2440
ggaccaggccgaugu

SEQ ID NO: 3572042 - RNA, 16 nt, Pseudomonas putida KT2440
ggacccacggagucag

SEQ ID NO: 3572043 - RNA, 14 nt, Pseudomonas putida KT2440
ggacccagcgguca

SEQ ID NO: 3572044 - RNA, 12 nt, Pseudomonas putida KT2440
ggacccaggccg

SEQ ID NO: 3572045 - RNA, 22 nt, Pseudomonas putida KT2440
ggacccuacgaacaaauccgcg

SEQ ID NO: 3572046 - RNA, 16 nt, Pseudomonas putida KT2440
ggaccucacagccuuc

SEQ ID NO: 3572047 - RNA, 12 nt, Pseudomonas putida KT2440
ggaccuccgagu

SEQ ID NO: 3572048 - RNA, 19 nt, Pseudomonas putida KT2440
ggaccucuggcgugcaccu

SEQ ID NO: 3572049 - RNA, 15 nt, Pseudomonas putida KT2440
ggaccugccgcagcg

SEQ ID NO: 3572050 - RNA, 22 nt, Pseudomonas putida KT2440
ggacgaagccgacccgggccag

SEQ ID NO: 3572051 - RNA, 19 nt, Pseudomonas putida KT2440
ggacgacgcgaaugaugaa

SEQ ID NO: 3572052 - RNA, 23 nt, Pseudomonas putida KT2440
ggacgagguugccauugaggcug

SEQ ID NO: 3572053 - RNA, 21 nt, Pseudomonas putida KT2440
ggacgauggugaaggccagga

SEQ ID NO: 3572054 - RNA, 17 nt, Pseudomonas putida KT2440
ggacgcuggcagcuugg

SEQ ID NO: 3572055 - RNA, 15 nt, Pseudomonas putida KT2440
ggacggguuucgccg

SEQ ID NO: 3572056 - RNA, 19 nt, Pseudomonas putida KT2440
ggacggucaugcucagcug

SEQ ID NO: 3572057 - RNA, 22 nt, Pseudomonas putida KT2440
ggacggucaugcucagcugggc

SEQ ID NO: 3572058 - RNA, 19 nt, Pseudomonas putida KT2440
ggacggugguggccgcgcg

SEQ ID NO: 3572059 - RNA, 16 nt, Pseudomonas putida KT2440
ggacgucccagcaggc

SEQ ID NO: 3572060 - RNA, 15 nt, Pseudomonas putida KT2440
ggacgucgcgcuggc

SEQ ID NO: 3572061 - RNA, 22 nt, Pseudomonas putida KT2440
ggacgucgcgcuggccgcccgc

SEQ ID NO: 3572062 - RNA, 20 nt, Pseudomonas putida KT2440
ggacucacccgcaccucaca

SEQ ID NO: 3572063 - RNA, 20 nt, Pseudomonas putida KT2440
ggacucauagcucagcugga

SEQ ID NO: 3572064 - RNA, 17 nt, Pseudomonas putida KT2440
ggacugugggagcgggc

SEQ ID NO: 3572065 - RNA, 14 nt, Pseudomonas putida KT2440
ggagaacacccagc

SEQ ID NO: 3572066 - RNA, 22 nt, Pseudomonas putida KT2440
ggagaagcgaucgaaaggcgac

SEQ ID NO: 3572067 - RNA, 13 nt, Pseudomonas putida KT2440
ggagacgaacagc

SEQ ID NO: 3572068 - RNA, 16 nt, Pseudomonas putida KT2440
ggagagcagggcugcg

SEQ ID NO: 3572069 - RNA, 19 nt, Pseudomonas putida KT2440
ggagagccccaccaggaag

SEQ ID NO: 3572070 - RNA, 22 nt, Pseudomonas putida KT2440
ggagagcgauuccaagugccuc

SEQ ID NO: 3572071 - RNA, 17 nt, Pseudomonas putida KT2440
ggagagguacaccccca

SEQ ID NO: 3572072 - RNA, 17 nt, Pseudomonas putida KT2440
ggagaucgagugcucga

SEQ ID NO: 3572073 - RNA, 21 nt, Pseudomonas putida KT2440
ggagaucgucguaggagcggg

SEQ ID NO: 3572074 - RNA, 17 nt, Pseudomonas putida KT2440
ggagauucuauggccgg

SEQ ID NO: 3572075 - RNA, 15 nt, Pseudomonas putida KT2440
ggagauuggccagca

SEQ ID NO: 3572076 - RNA, 11 nt, Pseudomonas putida KT2440
ggagccggcug

SEQ ID NO: 3572077 - RNA, 21 nt, Pseudomonas putida KT2440
ggagcgagcuugcucgcgaug

SEQ ID NO: 3572078 - RNA, 18 nt, Pseudomonas putida KT2440
ggagcgcgcccccgacca

SEQ ID NO: 3572079 - RNA, 11 nt, Pseudomonas putida KT2440
ggagcggccuu

SEQ ID NO: 3572080 - RNA, 22 nt, Pseudomonas putida KT2440
ggagcggccuugcgucgcgaug

SEQ ID NO: 3572081 - RNA, 19 nt, Pseudomonas putida KT2440
ggagcgggacugcccgccc

SEQ ID NO: 3572082 - RNA, 21 nt, Pseudomonas putida KT2440
ggagcgggacugcccgccccc

SEQ ID NO: 3572083 - RNA, 19 nt, Pseudomonas putida KT2440
ggagcgggcaugcccgcga

SEQ ID NO: 3572084 - RNA, 20 nt, Pseudomonas putida KT2440
ggagcgggcaugcccgcgaa

SEQ ID NO: 3572085 - RNA, 13 nt, Pseudomonas putida KT2440
ggagcgggcgacg

SEQ ID NO: 3572086 - RNA, 19 nt, Pseudomonas putida KT2440
ggagcgggcgcgcccgcga

SEQ ID NO: 3572087 - RNA, 20 nt, Pseudomonas putida KT2440
ggagcgggcgcgcccgcgaa

SEQ ID NO: 3572088 - RNA, 20 nt, Pseudomonas putida KT2440
ggagcgggcgugccugcgaa

SEQ ID NO: 3572089 - RNA, 12 nt, Pseudomonas putida KT2440
ggagcgggcuug

SEQ ID NO: 3572090 - RNA, 15 nt, Pseudomonas putida KT2440
ggagcgggcuugccc

SEQ ID NO: 3572091 - RNA, 20 nt, Pseudomonas putida KT2440
ggagcgggcuugcccgcgaa

SEQ ID NO: 3572092 - RNA, 21 nt, Pseudomonas putida KT2440
ggagcgggcuugcccgcgaau

SEQ ID NO: 3572093 - RNA, 16 nt, Pseudomonas putida KT2440
ggagcggguucacccg

SEQ ID NO: 3572094 - RNA, 20 nt, Pseudomonas putida KT2440
ggagcggguucacccgcgaa

SEQ ID NO: 3572095 - RNA, 21 nt, Pseudomonas putida KT2440
ggagcggguucacccgcgaau

SEQ ID NO: 3572096 - RNA, 19 nt, Pseudomonas putida KT2440
ggagcggguuuacccgcga

SEQ ID NO: 3572097 - RNA, 20 nt, Pseudomonas putida KT2440
ggagcggguuuacccgcgaa

SEQ ID NO: 3572098 - RNA, 20 nt, Pseudomonas putida KT2440
ggagcggguuuucucgcgaa

SEQ ID NO: 3572099 - RNA, 16 nt, Pseudomonas putida KT2440
ggagcguggaugaagc

SEQ ID NO: 3572100 - RNA, 20 nt, Pseudomonas putida KT2440
ggagcguugcaggcgcucca

SEQ ID NO: 3572101 - RNA, 11 nt, Pseudomonas putida KT2440
ggaggccgggg

SEQ ID NO: 3572102 - RNA, 21 nt, Pseudomonas putida KT2440
ggaggccgucaggccuccccg

SEQ ID NO: 3572103 - RNA, 18 nt, Pseudomonas putida KT2440
ggaggcuguuucagcccu

SEQ ID NO: 3572104 - RNA, 23 nt, Pseudomonas putida KT2440
ggagggggcuguuuugagagggu

SEQ ID NO: 3572105 - RNA, 16 nt, Pseudomonas putida KT2440
ggaguaaauguaugcg

SEQ ID NO: 3572106 - RNA, 12 nt, Pseudomonas putida KT2440
ggaguccagcug

SEQ ID NO: 3572107 - RNA, 14 nt, Pseudomonas putida KT2440
ggaguccagcugca

SEQ ID NO: 3572108 - RNA, 17 nt, Pseudomonas putida KT2440
ggagucgaaccugcccg

SEQ ID NO: 3572109 - RNA, 19 nt, Pseudomonas putida KT2440
ggagucggcucuggcaaga

SEQ ID NO: 3572110 - RNA, 21 nt, Pseudomonas putida KT2440
ggagugcucgccucacagcgc

SEQ ID NO: 3572111 - RNA, 19 nt, Pseudomonas putida KT2440
ggaguggaagauggucucg

SEQ ID NO: 3572112 - RNA, 22 nt, Pseudomonas putida KT2440
ggaguugcucgagugcgaaggc

SEQ ID NO: 3572113 - RNA, 16 nt, Pseudomonas putida KT2440
ggauacugcugaaccu

SEQ ID NO: 3572114 - RNA, 19 nt, Pseudomonas putida KT2440
ggauagcgcgccaaagccu

SEQ ID NO: 3572115 - RNA, 21 nt, Pseudomonas putida KT2440
ggauauaagccgccccacccu

SEQ ID NO: 3572116 - RNA, 14 nt, Pseudomonas putida KT2440
ggauaucaggcccu

SEQ ID NO: 3572117 - RNA, 22 nt, Pseudomonas putida KT2440
ggaucaagccugacucagcccu

SEQ ID NO: 3572118 - RNA, 16 nt, Pseudomonas putida KT2440
ggaucaccgccagcag

SEQ ID NO: 3572119 - RNA, 12 nt, Pseudomonas putida KT2440
ggaucaccuggc

SEQ ID NO: 3572120 - RNA, 22 nt, Pseudomonas putida KT2440
ggaucagcacgcgaucggcagc

SEQ ID NO: 3572121 - RNA, 18 nt, Pseudomonas putida KT2440
ggaucagccgcgccauug

SEQ ID NO: 3572122 - RNA, 16 nt, Pseudomonas putida KT2440
ggaucagccgcgcuga

SEQ ID NO: 3572123 - RNA, 12 nt, Pseudomonas putida KT2440
ggaucagcucau

SEQ ID NO: 3572124 - RNA, 22 nt, Pseudomonas putida KT2440
ggaucaggaacaaucuucuuca

SEQ ID NO: 3572125 - RNA, 18 nt, Pseudomonas putida KT2440
ggaucagggucagggcca

SEQ ID NO: 3572126 - RNA, 18 nt, Pseudomonas putida KT2440
ggaucagugucugcgccu

SEQ ID NO: 3572127 - RNA, 21 nt, Pseudomonas putida KT2440
ggaucaucggcacgcccagca

SEQ ID NO: 3572128 - RNA, 15 nt, Pseudomonas putida KT2440
ggaucauuugaaaga

SEQ ID NO: 3572129 - RNA, 12 nt, Pseudomonas putida KT2440
ggaucgccagga

SEQ ID NO: 3572130 - RNA, 13 nt, Pseudomonas putida KT2440
ggaucgccaggac

SEQ ID NO: 3572131 - RNA, 15 nt, Pseudomonas putida KT2440
ggaucgccaggacgg

SEQ ID NO: 3572132 - RNA, 23 nt, Pseudomonas putida KT2440
ggaucgccaggcugauacgcgac

SEQ ID NO: 3572133 - RNA, 22 nt, Pseudomonas putida KT2440
ggaucgcgccuucgcuggcgac

SEQ ID NO: 3572134 - RNA, 15 nt, Pseudomonas putida KT2440
ggaucggguuuaccc

SEQ ID NO: 3572135 - RNA, 20 nt, Pseudomonas putida KT2440
ggaucggguuuacccgcgaa

SEQ ID NO: 3572136 - RNA, 14 nt, Pseudomonas putida KT2440
ggaucggugccacc

SEQ ID NO: 3572137 - RNA, 21 nt, Pseudomonas putida KT2440
ggaucggugccacccaaggca

SEQ ID NO: 3572138 - RNA, 16 nt, Pseudomonas putida KT2440
ggaucgucuggcacug

SEQ ID NO: 3572139 - RNA, 17 nt, Pseudomonas putida KT2440
ggaucuccucggccagc

SEQ ID NO: 3572140 - RNA, 22 nt, Pseudomonas putida KT2440
ggaucucgcugucguccagcuc

SEQ ID NO: 3572141 - RNA, 23 nt, Pseudomonas putida KT2440
ggaucugaauguacaaugcacuu

SEQ ID NO: 3572142 - RNA, 19 nt, Pseudomonas putida KT2440
ggaucugcugcagcauggc

SEQ ID NO: 3572143 - RNA, 22 nt, Pseudomonas putida KT2440
ggaucugcugcagcauggcguc

SEQ ID NO: 3572144 - RNA, 12 nt, Pseudomonas putida KT2440
ggaucuucucuu

SEQ ID NO: 3572145 - RNA, 16 nt, Pseudomonas putida KT2440
ggaucuugcuggccgg

SEQ ID NO: 3572146 - RNA, 19 nt, Pseudomonas putida KT2440
ggaucuugcuggccggugg

SEQ ID NO: 3572147 - RNA, 15 nt, Pseudomonas putida KT2440
ggaugauccagccca

SEQ ID NO: 3572148 - RNA, 18 nt, Pseudomonas putida KT2440
ggaugccaaggaucagcu

SEQ ID NO: 3572149 - RNA, 21 nt, Pseudomonas putida KT2440
ggaugccagcggugccaguca

SEQ ID NO: 3572150 - RNA, 21 nt, Pseudomonas putida KT2440
ggaugccuggaaaauccgcuu

SEQ ID NO: 3572151 - RNA, 21 nt, Pseudomonas putida KT2440
ggaugcgcuucauccagcggg

SEQ ID NO: 3572152 - RNA, 16 nt, Pseudomonas putida KT2440
ggaugcgggcuuucca

SEQ ID NO: 3572153 - RNA, 20 nt, Pseudomonas putida KT2440
ggaugcgggcuuuccacgcc

SEQ ID NO: 3572154 - RNA, 21 nt, Pseudomonas putida KT2440
ggaugcgggcuuuccacgccu

SEQ ID NO: 3572155 - RNA, 20 nt, Pseudomonas putida KT2440
ggaugcgguugaccacgaug

SEQ ID NO: 3572156 - RNA, 20 nt, Pseudomonas putida KT2440
ggaugcucgauaccguacug

SEQ ID NO: 3572157 - RNA, 15 nt, Pseudomonas putida KT2440
ggaugcucugcagca

SEQ ID NO: 3572158 - RNA, 13 nt, Pseudomonas putida KT2440
ggaugcugaagcu

SEQ ID NO: 3572159 - RNA, 19 nt, Pseudomonas putida KT2440
ggauggcaaagcgcagcaa

SEQ ID NO: 3572160 - RNA, 14 nt, Pseudomonas putida KT2440
ggauggcaccggca

SEQ ID NO: 3572161 - RNA, 15 nt, Pseudomonas putida KT2440
ggauggcaccggcag

SEQ ID NO: 3572162 - RNA, 17 nt, Pseudomonas putida KT2440
ggauggcaccggcucug

SEQ ID NO: 3572163 - RNA, 20 nt, Pseudomonas putida KT2440
ggauggcaccggcucugccg

SEQ ID NO: 3572164 - RNA, 17 nt, Pseudomonas putida KT2440
ggauugaaacugccccu

SEQ ID NO: 3572165 - RNA, 14 nt, Pseudomonas putida KT2440
ggauugggaaaaca

SEQ ID NO: 3572166 - RNA, 13 nt, Pseudomonas putida KT2440
ggauuugccggug

SEQ ID NO: 3572167 - RNA, 14 nt, Pseudomonas putida KT2440
ggauuugccgguga

SEQ ID NO: 3572168 - RNA, 22 nt, Pseudomonas putida KT2440
ggauuuucaccuucgagccacc

SEQ ID NO: 3572169 - RNA, 14 nt, Pseudomonas putida KT2440
ggauuuucgcgcuc

SEQ ID NO: 3572170 - RNA, 22 nt, Pseudomonas putida KT2440
ggcaaaacucaccccguagcgc

SEQ ID NO: 3572171 - RNA, 14 nt, Pseudomonas putida KT2440
ggcaaaagaaaaag

SEQ ID NO: 3572172 - RNA, 18 nt, Pseudomonas putida KT2440
ggcaaaagaaaaagggca

SEQ ID NO: 3572173 - RNA, 21 nt, Pseudomonas putida KT2440
ggcaaaaucgaccagggccuu

SEQ ID NO: 3572174 - RNA, 15 nt, Pseudomonas putida KT2440
ggcaaaaugcagcaa

SEQ ID NO: 3572175 - RNA, 21 nt, Pseudomonas putida KT2440
ggcaaacaaaaagcaccucuu

SEQ ID NO: 3572176 - RNA, 21 nt, Pseudomonas putida KT2440
ggcaaacacauccaccaggcu

SEQ ID NO: 3572177 - RNA, 23 nt, Pseudomonas putida KT2440
ggcaaacaccuugccccgcaggc

SEQ ID NO: 3572178 - RNA, 14 nt, Pseudomonas putida KT2440
ggcaaacagcacca

SEQ ID NO: 3572179 - RNA, 20 nt, Pseudomonas putida KT2440
ggcaaacccggccagcaggu

SEQ ID NO: 3572180 - RNA, 20 nt, Pseudomonas putida KT2440
ggcaaacgaaaucugccugc

SEQ ID NO: 3572181 - RNA, 22 nt, Pseudomonas putida KT2440
ggcaaacgaaaucugccugcug

SEQ ID NO: 3572182 - RNA, 14 nt, Pseudomonas putida KT2440
ggcaaacgcgguca

SEQ ID NO: 3572183 - RNA, 13 nt, Pseudomonas putida KT2440
ggcaaacuccacu

SEQ ID NO: 3572184 - RNA, 18 nt, Pseudomonas putida KT2440
ggcaaacuccacugugcc

SEQ ID NO: 3572185 - RNA, 12 nt, Pseudomonas putida KT2440
ggcaaagaaaca

SEQ ID NO: 3572186 - RNA, 15 nt, Pseudomonas putida KT2440
ggcaaagaaacacca

SEQ ID NO: 3572187 - RNA, 16 nt, Pseudomonas putida KT2440
ggcaaagaaacaccag

SEQ ID NO: 3572188 - RNA, 17 nt, Pseudomonas putida KT2440
ggcaaagaacagcgcgg

SEQ ID NO: 3572189 - RNA, 15 nt, Pseudomonas putida KT2440
ggcaaagaacagcgu

SEQ ID NO: 3572190 - RNA, 14 nt, Pseudomonas putida KT2440
ggcaaagaacauca

SEQ ID NO: 3572191 - RNA, 20 nt, Pseudomonas putida KT2440
ggcaaagaacggugcugccg

SEQ ID NO: 3572192 - RNA, 13 nt, Pseudomonas putida KT2440
ggcaaagcguucg

SEQ ID NO: 3572193 - RNA, 15 nt, Pseudomonas putida KT2440
ggcaaaggucugcug

SEQ ID NO: 3572194 - RNA, 20 nt, Pseudomonas putida KT2440
ggcaaagguggcaccgccgc

SEQ ID NO: 3572195 - RNA, 16 nt, Pseudomonas putida KT2440
ggcaaaguccagcauc

SEQ ID NO: 3572196 - RNA, 11 nt, Pseudomonas putida KT2440
ggcaaauaggc

SEQ ID NO: 3572197 - RNA, 14 nt, Pseudomonas putida KT2440
ggcaacaccagcag

SEQ ID NO: 3572198 - RNA, 16 nt, Pseudomonas putida KT2440
ggcaacaccgccagaa

SEQ ID NO: 3572199 - RNA, 22 nt, Pseudomonas putida KT2440
ggcaacagcucaacccgccuga

SEQ ID NO: 3572200 - RNA, 17 nt, Pseudomonas putida KT2440
ggcaacauucaccagcc

SEQ ID NO: 3572201 - RNA, 22 nt, Pseudomonas putida KT2440
ggcaacauucaccagccaggca

SEQ ID NO: 3572202 - RNA, 23 nt, Pseudomonas putida KT2440
ggcaaccaccaacagcaccggcc

SEQ ID NO: 3572203 - RNA, 18 nt, Pseudomonas putida KT2440
ggcaacccuucggccagc

SEQ ID NO: 3572204 - RNA, 16 nt, Pseudomonas putida KT2440
ggcaaccugacccgcg

SEQ ID NO: 3572205 - RNA, 17 nt, Pseudomonas putida KT2440
ggcaaccugcacuaucu

SEQ ID NO: 3572206 - RNA, 23 nt, Pseudomonas putida KT2440
ggcaacgccacacugucccggca

SEQ ID NO: 3572207 - RNA, 13 nt, Pseudomonas putida KT2440
ggcaacgccagca

SEQ ID NO: 3572208 - RNA, 20 nt, Pseudomonas putida KT2440
cugaugcagcagugccagca

SEQ ID NO: 3572209 - RNA, 22 nt, Pseudomonas putida KT2440
cugaugcagcagugccagcaac

SEQ ID NO: 3572210 - RNA, 17 nt, Pseudomonas putida KT2440
cugaugcccaaacgcca

SEQ ID NO: 3572211 - RNA, 16 nt, Pseudomonas putida KT2440
cugaugcccaugccaa

SEQ ID NO: 3572212 - RNA, 20 nt, Pseudomonas putida KT2440
cugaugccucaucaggccga

SEQ ID NO: 3572213 - RNA, 19 nt, Pseudomonas putida KT2440
cugaugccuuguaccgaga

SEQ ID NO: 3572214 - RNA, 15 nt, Pseudomonas putida KT2440
cugaugcgcuggccc

SEQ ID NO: 3572215 - RNA, 15 nt, Pseudomonas putida KT2440
cugaugcggacccag

SEQ ID NO: 3572216 - RNA, 22 nt, Pseudomonas putida KT2440
cugaugcucaagcgccagggca

SEQ ID NO: 3572217 - RNA, 14 nt, Pseudomonas putida KT2440
cugaugcuucugcu

SEQ ID NO: 3572218 - RNA, 23 nt, Pseudomonas putida KT2440
cugauguccaaauugggcugggc

SEQ ID NO: 3572219 - RNA, 22 nt, Pseudomonas putida KT2440
cugauguucggugcucaggcuc

SEQ ID NO: 3572220 - RNA, 22 nt, Pseudomonas putida KT2440
cugauugccuggcuuuccaggu

SEQ ID NO: 3572221 - RNA, 16 nt, Pseudomonas putida KT2440
cugcaaacgcaggugc

SEQ ID NO: 3572222 - RNA, 22 nt, Pseudomonas putida KT2440
cugcaaacgccgcucgauaugc

SEQ ID NO: 3572223 - RNA, 14 nt, Pseudomonas putida KT2440
cugcaaagcagccc

SEQ ID NO: 3572224 - RNA, 17 nt, Pseudomonas putida KT2440
cugcaaagcagccccag

SEQ ID NO: 3572225 - RNA, 16 nt, Pseudomonas putida KT2440
cugcaaagcagccccg

SEQ ID NO: 3572226 - RNA, 17 nt, Pseudomonas putida KT2440
cugcaaagcagccccgg

SEQ ID NO: 3572227 - RNA, 19 nt, Pseudomonas putida KT2440
cugcaaagcgcgucugaua

SEQ ID NO: 3572228 - RNA, 15 nt, Pseudomonas putida KT2440
cugcaaagcgggcaa

SEQ ID NO: 3572229 - RNA, 22 nt, Pseudomonas putida KT2440
cugcaaagcgggcaacugcgcc

SEQ ID NO: 3572230 - RNA, 20 nt, Pseudomonas putida KT2440
cugcaaaggcaugggccagg

SEQ ID NO: 3572231 - RNA, 22 nt, Pseudomonas putida KT2440
cugcaaaggcaugggccagggu

SEQ ID NO: 3572232 - RNA, 16 nt, Pseudomonas putida KT2440
cugcaaaggcuuguca

SEQ ID NO: 3572233 - RNA, 21 nt, Pseudomonas putida KT2440
cugcaaaggcuugucaugccu

SEQ ID NO: 3572234 - RNA, 13 nt, Pseudomonas putida KT2440
cugcaacaccucc

SEQ ID NO: 3572235 - RNA, 22 nt, Pseudomonas putida KT2440
cugcaacacgucauacagcccg

SEQ ID NO: 3572236 - RNA, 18 nt, Pseudomonas putida KT2440
cugcaacagaaaaugccc

SEQ ID NO: 3572237 - RNA, 13 nt, Pseudomonas putida KT2440
cugcaacagcucc

SEQ ID NO: 3572238 - RNA, 17 nt, Pseudomonas putida KT2440
cugcaacagcuccagca

SEQ ID NO: 3572239 - RNA, 22 nt, Pseudomonas putida KT2440
cugcaacagcuccagcagugcc

SEQ ID NO: 3572240 - RNA, 17 nt, Pseudomonas putida KT2440
cugcaacucggccuugu

SEQ ID NO: 3572241 - RNA, 19 nt, Pseudomonas putida KT2440
cugcaacugcccacccaac

SEQ ID NO: 3572242 - RNA, 21 nt, Pseudomonas putida KT2440
cugcaagccggcgaacagcac

SEQ ID NO: 3572243 - RNA, 22 nt, Pseudomonas putida KT2440
cugcaagcgaugcacgccagca

SEQ ID NO: 3572244 - RNA, 19 nt, Pseudomonas putida KT2440
cugcaagcucgacaaaucc

SEQ ID NO: 3572245 - RNA, 18 nt, Pseudomonas putida KT2440
cugcaaggcaaugcccau

SEQ ID NO: 3572246 - RNA, 19 nt, Pseudomonas putida KT2440
cugcaaggcagccccugca

SEQ ID NO: 3572247 - RNA, 16 nt, Pseudomonas putida KT2440
cugcaagguccaggcg

SEQ ID NO: 3572248 - RNA, 11 nt, Pseudomonas putida KT2440
cugcaaucacc

SEQ ID NO: 3572249 - RNA, 21 nt, Pseudomonas putida KT2440
cugcaaucagcucacaggcuc

SEQ ID NO: 3572250 - RNA, 23 nt, Pseudomonas putida KT2440
cugcaaucagcucacaggcucag

SEQ ID NO: 3572251 - RNA, 17 nt, Pseudomonas putida KT2440
cugcaaucgagccgaac

SEQ ID NO: 3572252 - RNA, 16 nt, Pseudomonas putida KT2440
cugcaaugcagccccu

SEQ ID NO: 3572253 - RNA, 17 nt, Pseudomonas putida KT2440
cugcaaugcagccccuu

SEQ ID NO: 3572254 - RNA, 14 nt, Pseudomonas putida KT2440
cugcaauucgugaa

SEQ ID NO: 3572255 - RNA, 13 nt, Pseudomonas putida KT2440
cugcaauugcacc

SEQ ID NO: 3572256 - RNA, 18 nt, Pseudomonas putida KT2440
cugcaauuucuugaggca

SEQ ID NO: 3572257 - RNA, 13 nt, Pseudomonas putida KT2440
cugcacaaacuuc

SEQ ID NO: 3572258 - RNA, 16 nt, Pseudomonas putida KT2440
cugcacacugcgcuug

SEQ ID NO: 3572259 - RNA, 20 nt, Pseudomonas putida KT2440
cugcacagcgcggaacacac

SEQ ID NO: 3572260 - RNA, 18 nt, Pseudomonas putida KT2440
cugcacaggccagcccca

SEQ ID NO: 3572261 - RNA, 19 nt, Pseudomonas putida KT2440
cugcacaggccagccccag

SEQ ID NO: 3572262 - RNA, 21 nt, Pseudomonas putida KT2440
cugcacaggccagccccagcg

SEQ ID NO: 3572263 - RNA, 14 nt, Pseudomonas putida KT2440
cugcacaucggcca

SEQ ID NO: 3572264 - RNA, 15 nt, Pseudomonas putida KT2440
cugcaccacaugcac

SEQ ID NO: 3572265 - RNA, 22 nt, Pseudomonas putida KT2440
cugcaccaccugcuccuggucc

SEQ ID NO: 3572266 - RNA, 15 nt, Pseudomonas putida KT2440
cugcaccaguuccug

SEQ ID NO: 3572267 - RNA, 22 nt, Pseudomonas putida KT2440
cugcaccaguuccuggcgcucc

SEQ ID NO: 3572268 - RNA, 11 nt, Pseudomonas putida KT2440
cugcaccauga

SEQ ID NO: 3572269 - RNA, 14 nt, Pseudomonas putida KT2440
cugcacccgccagc

SEQ ID NO: 3572270 - RNA, 16 nt, Pseudomonas putida KT2440
cugcacccgcgcgccc

SEQ ID NO: 3572271 - RNA, 19 nt, Pseudomonas putida KT2440
cugcacccucuuccuugug

SEQ ID NO: 3572272 - RNA, 15 nt, Pseudomonas putida KT2440
cugcaccgaagcacc

SEQ ID NO: 3572273 - RNA, 20 nt, Pseudomonas putida KT2440
cugcaccgaaggccgccggc

SEQ ID NO: 3572274 - RNA, 15 nt, Pseudomonas putida KT2440
cugcaccgcagcccc

SEQ ID NO: 3572275 - RNA, 16 nt, Pseudomonas putida KT2440
cugcaccgcagcccca

SEQ ID NO: 3572276 - RNA, 14 nt, Pseudomonas putida KT2440
cugcaccucccgcc

SEQ ID NO: 3572277 - RNA, 20 nt, Pseudomonas putida KT2440
cugcaccucccgccacggcc

SEQ ID NO: 3572278 - RNA, 13 nt, Pseudomonas putida KT2440
cugcaccuugccc

SEQ ID NO: 3572279 - RNA, 18 nt, Pseudomonas putida KT2440
cugcaccuuguuacccgc

SEQ ID NO: 3572280 - RNA, 19 nt, Pseudomonas putida KT2440
cugcaccuuguuacccgca

SEQ ID NO: 3572281 - RNA, 24 nt, Pseudomonas putida KT2440
cugcacggcaaaguccagcaucag

SEQ ID NO: 3572282 - RNA, 20 nt, Pseudomonas putida KT2440
cugcacgucauagcccgaaa

SEQ ID NO: 3572283 - RNA, 15 nt, Pseudomonas putida KT2440
cugcacgucgcgcag

SEQ ID NO: 3572284 - RNA, 16 nt, Pseudomonas putida KT2440
cugcacgucgcgcagg

SEQ ID NO: 3572285 - RNA, 13 nt, Pseudomonas putida KT2440
ccgguccagugca

SEQ ID NO: 3572286 - RNA, 14 nt, Pseudomonas putida KT2440
ccggucccaauaau

SEQ ID NO: 3572287 - RNA, 14 nt, Pseudomonas putida KT2440
ccggucccgcccuc

SEQ ID NO: 3572288 - RNA, 18 nt, Pseudomonas putida KT2440
ccggucccgcccuccagc

SEQ ID NO: 3572289 - RNA, 22 nt, Pseudomonas putida KT2440
ccggucccgcccuccagccgcg

SEQ ID NO: 3572290 - RNA, 16 nt, Pseudomonas putida KT2440
ccggucgccgacggca

SEQ ID NO: 3572291 - RNA, 13 nt, Pseudomonas putida KT2440
ccggucgcucaac

SEQ ID NO: 3572292 - RNA, 20 nt, Pseudomonas putida KT2440
ccggucggaaggggccgcaa

SEQ ID NO: 3572293 - RNA, 15 nt, Pseudomonas putida KT2440
ccggucggccagcug

SEQ ID NO: 3572294 - RNA, 17 nt, Pseudomonas putida KT2440
ccggucgggcaaggcca

SEQ ID NO: 3572295 - RNA, 22 nt, Pseudomonas putida KT2440
ccggucgggcaaggccagugcc

SEQ ID NO: 3572296 - RNA, 19 nt, Pseudomonas putida KT2440
ccggucguuacccaccagc

SEQ ID NO: 3572297 - RNA, 13 nt, Pseudomonas putida KT2440
ccggucucccagc

SEQ ID NO: 3572298 - RNA, 17 nt, Pseudomonas putida KT2440
ccggucucccagcgcug

SEQ ID NO: 3572299 - RNA, 19 nt, Pseudomonas putida KT2440
ccggucuugucugacagca

SEQ ID NO: 3572300 - RNA, 23 nt, Pseudomonas putida KT2440
ccggucuugucugacagcaggaa

SEQ ID NO: 3572301 - RNA, 18 nt, Pseudomonas putida KT2440
cggggcagcaucaccacg

SEQ ID NO: 3572302 - RNA, 19 nt, Pseudomonas putida KT2440
cggggcagcaucaccacgc

SEQ ID NO: 3572303 - RNA, 15 nt, Pseudomonas putida KT2440
cggggcaucgccgag

SEQ ID NO: 3572304 - RNA, 14 nt, Pseudomonas putida KT2440
cggggccaggcgcg

SEQ ID NO: 3572305 - RNA, 23 nt, Pseudomonas putida KT2440
cggggcuccggcgaauccagcag

SEQ ID NO: 3572306 - RNA, 19 nt, Pseudomonas putida KT2440
cggggcugcuuugcagccc

SEQ ID NO: 3572307 - RNA, 20 nt, Pseudomonas putida KT2440
cggggcuuuuugauggugca

SEQ ID NO: 3572308 - RNA, 17 nt, Pseudomonas putida KT2440
cgggggcagugcccagu

SEQ ID NO: 3572309 - RNA, 12 nt, Pseudomonas putida KT2440
cgggggggcgca

SEQ ID NO: 3572310 - RNA, 17 nt, Pseudomonas putida KT2440
cggggucgaucuccagg

SEQ ID NO: 3572311 - RNA, 21 nt, Pseudomonas putida KT2440
cggggugaucgacagguucga

SEQ ID NO: 3572312 - RNA, 17 nt, Pseudomonas putida KT2440
cggggugauugcaguca

SEQ ID NO: 3572313 - RNA, 15 nt, Pseudomonas putida KT2440
cggggugcucugccg

SEQ ID NO: 3572314 - RNA, 14 nt, Pseudomonas putida KT2440
cggggugcugcgca

SEQ ID NO: 3572315 - RNA, 12 nt, Pseudomonas putida KT2440
cgggguggccgg

SEQ ID NO: 3572316 - RNA, 14 nt, Pseudomonas putida KT2440
cgggguguggccaa

SEQ ID NO: 3572317 - RNA, 17 nt, Pseudomonas putida KT2440
cgggguguggccaaugg

SEQ ID NO: 3572318 - RNA, 22 nt, Pseudomonas putida KT2440
cgggguguugcuugucccaggc

SEQ ID NO: 3572319 - RNA, 13 nt, Pseudomonas putida KT2440
cgggguuggugcc

SEQ ID NO: 3572320 - RNA, 22 nt, Pseudomonas putida KT2440
cgggguuuuuuuugcccggaau

SEQ ID NO: 3572321 - RNA, 22 nt, Pseudomonas putida KT2440
cggguaaaacgccccccggcuc

SEQ ID NO: 3572322 - RNA, 20 nt, Pseudomonas putida KT2440
cggguaaacccauuccuaca

SEQ ID NO: 3572323 - RNA, 20 nt, Pseudomonas putida KT2440
cggguaaacccgcgccuacg

SEQ ID NO: 3572324 - RNA, 20 nt, Pseudomonas putida KT2440
cggguaaacccgcuccuaca

SEQ ID NO: 3572325 - RNA, 20 nt, Pseudomonas putida KT2440
cggguaaacccgcuccuacu

SEQ ID NO: 3572326 - RNA, 19 nt, Pseudomonas putida KT2440
cggguaaagcccgcaguga

SEQ ID NO: 3572327 - RNA, 20 nt, Pseudomonas putida KT2440
cggguaaauguucucgccgc

SEQ ID NO: 3572328 - RNA, 20 nt, Pseudomonas putida KT2440
cggguaagccaugcgcaggc

SEQ ID NO: 3572329 - RNA, 21 nt, Pseudomonas putida KT2440
cggguaagccaugcgcaggca

SEQ ID NO: 3572330 - RNA, 16 nt, Pseudomonas putida KT2440
cggguaagccggcggc

SEQ ID NO: 3572331 - RNA, 21 nt, Pseudomonas putida KT2440
cggguaaucgccaggcccagc

SEQ ID NO: 3572332 - RNA, 17 nt, Pseudomonas putida KT2440
cggguacagccccugca

SEQ ID NO: 3572333 - RNA, 13 nt, Pseudomonas putida KT2440
cggguaccaccug

SEQ ID NO: 3572334 - RNA, 15 nt, Pseudomonas putida KT2440
cggguacccgcguug

SEQ ID NO: 3572335 - RNA, 17 nt, Pseudomonas putida KT2440
cggguacuccaccacca

SEQ ID NO: 3572336 - RNA, 23 nt, Pseudomonas putida KT2440
cggguacuucucgaccagcgcca

SEQ ID NO: 3572337 - RNA, 21 nt, Pseudomonas putida KT2440
cggguagaagggggcaaugcg

SEQ ID NO: 3572338 - RNA, 22 nt, Pseudomonas putida KT2440
cggguagaucauuaccugcagg

SEQ ID NO: 3572339 - RNA, 19 nt, Pseudomonas putida KT2440
cggguaggucaccaucagc

SEQ ID NO: 3572340 - RNA, 16 nt, Pseudomonas putida KT2440
cggguaguugcccggg

SEQ ID NO: 3572341 - RNA, 20 nt, Pseudomonas putida KT2440
cggguauuucaaagaucucg

SEQ ID NO: 3572342 - RNA, 14 nt, Pseudomonas putida KT2440
cgggucaaggccag

SEQ ID NO: 3572343 - RNA, 15 nt, Pseudomonas putida KT2440
cgggucagcagcacc

SEQ ID NO: 3572344 - RNA, 16 nt, Pseudomonas putida KT2440
cgggucagcagcaccg

SEQ ID NO: 3572345 - RNA, 17 nt, Pseudomonas putida KT2440
cgggucagcagcaccgc

SEQ ID NO: 3572346 - RNA, 22 nt, Pseudomonas putida KT2440
cgggucagcagcaccgccacca

SEQ ID NO: 3572347 - RNA, 16 nt, Pseudomonas putida KT2440
cgggucagcucgauca

SEQ ID NO: 3572348 - RNA, 13 nt, Pseudomonas putida KT2440
cgggucagguggc

SEQ ID NO: 3572349 - RNA, 14 nt, Pseudomonas putida KT2440
cgggucauccccgg

SEQ ID NO: 3572350 - RNA, 19 nt, Pseudomonas putida KT2440
cgggucaugccaccgccac

SEQ ID NO: 3572351 - RNA, 14 nt, Pseudomonas putida KT2440
cggguccaccagcc

SEQ ID NO: 3572352 - RNA, 11 nt, Pseudomonas putida KT2440
cggguccaccc

SEQ ID NO: 3572353 - RNA, 20 nt, Pseudomonas putida KT2440
cggguccaccucugcggccu

SEQ ID NO: 3572354 - RNA, 14 nt, Pseudomonas putida KT2440
cggguccagcgcgg

SEQ ID NO: 3572355 - RNA, 14 nt, Pseudomonas putida KT2440
cggguccaguuccu

SEQ ID NO: 3572356 - RNA, 20 nt, Pseudomonas putida KT2440
cgggucgaccugggccaggu

SEQ ID NO: 3572357 - RNA, 13 nt, Pseudomonas putida KT2440
cgggucgacgcgc

SEQ ID NO: 3572358 - RNA, 21 nt, Pseudomonas putida KT2440
cgggucgauagccagcccggu

SEQ ID NO: 3572359 - RNA, 15 nt, Pseudomonas putida KT2440
cgggucgaugaugcg

SEQ ID NO: 3572360 - RNA, 18 nt, Pseudomonas putida KT2440
cgggucggccugcucgcu

SEQ ID NO: 3572361 - RNA, 18 nt, Pseudomonas putida KT2440
cgggucgguggcaugcuc

SEQ ID NO: 3572362 - RNA, 17 nt, Pseudomonas putida KT2440
cgggucgucgcccaggc

SEQ ID NO: 3572363 - RNA, 15 nt, Pseudomonas putida KT2440
cgggucuacccgcga

SEQ ID NO: 3572364 - RNA, 20 nt, Pseudomonas putida KT2440
cgggucuacccgcgaaaggg

SEQ ID NO: 3572365 - RNA, 23 nt, Pseudomonas putida KT2440
cgggucuacccgcgaaagggcca

SEQ ID NO: 3572366 - RNA, 14 nt, Pseudomonas putida KT2440
cgggucuuccacca

SEQ ID NO: 3572367 - RNA, 17 nt, Pseudomonas putida KT2440
cgggucuuccaccaccu

SEQ ID NO: 3572368 - RNA, 17 nt, Pseudomonas putida KT2440
cgggucuuuucuucgcc

SEQ ID NO: 3572369 - RNA, 20 nt, Pseudomonas putida KT2440
cgggugaacccgcuccuaca

SEQ ID NO: 3572370 - RNA, 20 nt, Pseudomonas putida KT2440
cgggugaacccgcuccuacc

SEQ ID NO: 3572371 - RNA, 21 nt, Pseudomonas putida KT2440
cgggugaacccgcuccuacca

SEQ ID NO: 3572372 - RNA, 22 nt, Pseudomonas putida KT2440
cgggugaacccgcuccugcagg

SEQ ID NO: 3572373 - RNA, 18 nt, Pseudomonas putida KT2440
cgggugaccaggcccagc

SEQ ID NO: 3572374 - RNA, 21 nt, Pseudomonas putida KT2440
cgggugcagccgcacccaggc

SEQ ID NO: 3572375 - RNA, 18 nt, Pseudomonas putida KT2440
cgggugcaucggcaccga

SEQ ID NO: 3572376 - RNA, 12 nt, Pseudomonas putida KT2440
cgggugcccggg

SEQ ID NO: 3572377 - RNA, 21 nt, Pseudomonas putida KT2440
cgggugcgcucaacaggucca

SEQ ID NO: 3572378 - RNA, 17 nt, Pseudomonas putida KT2440
cggguggaaauuggcca

SEQ ID NO: 3572379 - RNA, 20 nt, Pseudomonas putida KT2440
cggguggaaauuggccagca

SEQ ID NO: 3572380 - RNA, 21 nt, Pseudomonas putida KT2440
cggguggaaauuggcgagcag

SEQ ID NO: 3572381 - RNA, 18 nt, Pseudomonas putida KT2440
cggguggagauuggccag

SEQ ID NO: 3572382 - RNA, 19 nt, Pseudomonas putida KT2440
cggguggagauuggccagc

SEQ ID NO: 3572383 - RNA, 14 nt, Pseudomonas putida KT2440
cggguguccacaaa

SEQ ID NO: 3572384 - RNA, 23 nt, Pseudomonas putida KT2440
cggguucaagggcagggugaucg

SEQ ID NO: 3572385 - RNA, 20 nt, Pseudomonas putida KT2440
cggguucacccgcgaauacg

SEQ ID NO: 3572386 - RNA, 20 nt, Pseudomonas putida KT2440
cggguucacccgcgaaugcg

SEQ ID NO: 3572387 - RNA, 20 nt, Pseudomonas putida KT2440
cggguucacccgcgaaugcu

SEQ ID NO: 3572388 - RNA, 19 nt, Pseudomonas putida KT2440
cggguucacccgcgaaugg

SEQ ID NO: 3572389 - RNA, 22 nt, Pseudomonas putida KT2440
cggguucugcaggaugucgacg

SEQ ID NO: 3572390 - RNA, 19 nt, Pseudomonas putida KT2440
cggguucugguugccgguc

SEQ ID NO: 3572391 - RNA, 23 nt, Pseudomonas putida KT2440
cggguugaagaugguuuccagcu

SEQ ID NO: 3572392 - RNA, 17 nt, Pseudomonas putida KT2440
cggguugcccuguuucu

SEQ ID NO: 3572393 - RNA, 22 nt, Pseudomonas putida KT2440
cggguugcucaggcgcuccagc

SEQ ID NO: 3572394 - RNA, 21 nt, Pseudomonas putida KT2440
cggguuuacccgcgaacaggc

SEQ ID NO: 3572395 - RNA, 23 nt, Pseudomonas putida KT2440
cggguuuacccgcgaaugggccg

SEQ ID NO: 3572396 - RNA, 19 nt, Pseudomonas putida KT2440
cggguuuaccugcgaauac

SEQ ID NO: 3572397 - RNA, 20 nt, Pseudomonas putida KT2440
cggguuuaccugcgaauacg

SEQ ID NO: 3572398 - RNA, 20 nt, Pseudomonas putida KT2440
cggguuuaccugugaaugcg

SEQ ID NO: 3572399 - RNA, 16 nt, Pseudomonas putida KT2440
cggguuucggugcgcu

SEQ ID NO: 3572400 - RNA, 16 nt, Pseudomonas putida KT2440
cggguuugaagcccgg

SEQ ID NO: 3572401 - RNA, 20 nt, Pseudomonas putida KT2440
cggguuuucucgcgaaugcg

SEQ ID NO: 3572402 - RNA, 21 nt, Pseudomonas putida KT2440
cggguuuuucaugaagcuuca

SEQ ID NO: 3572403 - RNA, 22 nt, Pseudomonas putida KT2440
cggguuuuuuuaugcuugccgg

SEQ ID NO: 3572404 - RNA, 15 nt, Pseudomonas putida KT2440
cgguaaacaauuccc

SEQ ID NO: 3572405 - RNA, 19 nt, Pseudomonas putida KT2440
cggcgcacucucgucaccu

SEQ ID NO: 3572406 - RNA, 22 nt, Pseudomonas putida KT2440
cggcgcagcauaugcuggucgc

SEQ ID NO: 3572407 - RNA, 18 nt, Pseudomonas putida KT2440
cggcgcaggccgacaaca

SEQ ID NO: 3572408 - RNA, 19 nt, Pseudomonas putida KT2440
cggcgcagggugucggugg

SEQ ID NO: 3572409 - RNA, 13 nt, Pseudomonas putida KT2440
cggcgcaggucga

SEQ ID NO: 3572410 - RNA, 14 nt, Pseudomonas putida KT2440
cggcgcagguugca

SEQ ID NO: 3572411 - RNA, 21 nt, Pseudomonas putida KT2440
cggcgcauugauagcggcagc

SEQ ID NO: 3572412 - RNA, 20 nt, Pseudomonas putida KT2440
cggcgccaaacgccagggcc

SEQ ID NO: 3572413 - RNA, 18 nt, Pseudomonas putida KT2440
cggcgccaaucaucgcca

SEQ ID NO: 3572414 - RNA, 20 nt, Pseudomonas putida KT2440
cggcgccaaucaucgccagc

SEQ ID NO: 3572415 - RNA, 13 nt, Pseudomonas putida KT2440
cggcgccacccag

SEQ ID NO: 3572416 - RNA, 17 nt, Pseudomonas putida KT2440
cggcgccacccagaaca

SEQ ID NO: 3572417 - RNA, 13 nt, Pseudomonas putida KT2440
cggcgccagcagu

SEQ ID NO: 3572418 - RNA, 15 nt, Pseudomonas putida KT2440
cggcgccagcagugc

SEQ ID NO: 3572419 - RNA, 23 nt, Pseudomonas putida KT2440
cggcgccaggaucgagaccuugc

SEQ ID NO: 3572420 - RNA, 14 nt, Pseudomonas putida KT2440
cggcgccaggccuu

SEQ ID NO: 3572421 - RNA, 19 nt, Pseudomonas putida KT2440
cggcgccaggccuuucagc

SEQ ID NO: 3572422 - RNA, 21 nt, Pseudomonas putida KT2440
cggcgccaucggcacgccagc

SEQ ID NO: 3572423 - RNA, 22 nt, Pseudomonas putida KT2440
cggcgccaucggcacgccagca

SEQ ID NO: 3572424 - RNA, 19 nt, Pseudomonas putida KT2440
cggcgccaugccccccgcc

SEQ ID NO: 3572425 - RNA, 22 nt, Pseudomonas putida KT2440
cggcgccaugccccccgccagc

SEQ ID NO: 3572426 - RNA, 21 nt, Pseudomonas putida KT2440
cggcgcccagcaacaugccgg

SEQ ID NO: 3572427 - RNA, 18 nt, Pseudomonas putida KT2440
cggcgccgccaggcagca

SEQ ID NO: 3572428 - RNA, 19 nt, Pseudomonas putida KT2440
cggcgccgccaggcagcag

SEQ ID NO: 3572429 - RNA, 14 nt, Pseudomonas putida KT2440
cggcgccggccgca

SEQ ID NO: 3572430 - RNA, 19 nt, Pseudomonas putida KT2440
cggcgccgguggcggccgc

SEQ ID NO: 3572431 - RNA, 22 nt, Pseudomonas putida KT2440
cggcgccgguggcggccgcagc

SEQ ID NO: 3572432 - RNA, 16 nt, Pseudomonas putida KT2440
cggcgccgugcuacgg

SEQ ID NO: 3572433 - RNA, 13 nt, Pseudomonas putida KT2440
cggcgccuccagc

SEQ ID NO: 3572434 - RNA, 16 nt, Pseudomonas putida KT2440
cggcgccuccagcaac

SEQ ID NO: 3572435 - RNA, 13 nt, Pseudomonas putida KT2440
cggcgccugacac

SEQ ID NO: 3572436 - RNA, 14 nt, Pseudomonas putida KT2440
cggcgccugccacg

SEQ ID NO: 3572437 - RNA, 17 nt, Pseudomonas putida KT2440
cggcgcgaaucagcgcc

SEQ ID NO: 3572438 - RNA, 19 nt, Pseudomonas putida KT2440
cggcgcgaaucagcgccuc

SEQ ID NO: 3572439 - RNA, 15 nt, Pseudomonas putida KT2440
cggcgcgacuccugu

SEQ ID NO: 3572440 - RNA, 15 nt, Pseudomonas putida KT2440
cggcgcgaucaucga

SEQ ID NO: 3572441 - RNA, 13 nt, Pseudomonas putida KT2440
cggcgcgcaacag

SEQ ID NO: 3572442 - RNA, 18 nt, Pseudomonas putida KT2440
cggcgcgcaacagcaagg

SEQ ID NO: 3572443 - RNA, 22 nt, Pseudomonas putida KT2440
cggcgcgcagcgcacuuccaca

SEQ ID NO: 3572444 - RNA, 12 nt, Pseudomonas putida KT2440
cggcgcgcccgg

SEQ ID NO: 3572445 - RNA, 15 nt, Pseudomonas putida KT2440
cggcgcgccuggcuc

SEQ ID NO: 3572446 - RNA, 14 nt, Pseudomonas putida KT2440
cggcgcgcgcgacc

SEQ ID NO: 3572447 - RNA, 17 nt, Pseudomonas putida KT2440
cggcgcgcugcugggcg

SEQ ID NO: 3572448 - RNA, 14 nt, Pseudomonas putida KT2440
cggcgcgggcaccc

SEQ ID NO: 3572449 - RNA, 21 nt, Pseudomonas putida KT2440
cggcgcgguucuucgccugca

SEQ ID NO: 3572450 - RNA, 23 nt, Pseudomonas putida KT2440
cggcgcgguucuucgccugcagc

SEQ ID NO: 3572451 - RNA, 14 nt, Pseudomonas putida KT2440
cggcgcgugccgca

SEQ ID NO: 3572452 - RNA, 21 nt, Pseudomonas putida KT2440
cggcgcgugccgcaugugcca

SEQ ID NO: 3572453 - RNA, 15 nt, Pseudomonas putida KT2440
cggcgcucaagcgug

SEQ ID NO: 3572454 - RNA, 24 nt, Pseudomonas putida KT2440
cggcgcucgaucucacaggcgaug

SEQ ID NO: 3572455 - RNA, 18 nt, Pseudomonas putida KT2440
cggcgcugagcgacagca

SEQ ID NO: 3572456 - RNA, 23 nt, Pseudomonas putida KT2440
cggcgcugagcgacagcaucugc

SEQ ID NO: 3572457 - RNA, 22 nt, Pseudomonas putida KT2440
cggcgcugaugcggacccagcg

SEQ ID NO: 3572458 - RNA, 15 nt, Pseudomonas putida KT2440
cggcgcugcuggccu

SEQ ID NO: 3572459 - RNA, 16 nt, Pseudomonas putida KT2440
cggcgcugcuggccuu

SEQ ID NO: 3572460 - RNA, 20 nt, Pseudomonas putida KT2440
cggcgcuggacagcggcagc

SEQ ID NO: 3572461 - RNA, 21 nt, Pseudomonas putida KT2440
cggcgcuggacagcggcagca

SEQ ID NO: 3572462 - RNA, 18 nt, Pseudomonas putida KT2440
cggcgcuggacagguaga

SEQ ID NO: 3572463 - RNA, 12 nt, Pseudomonas putida KT2440
cggcgcuggccg

SEQ ID NO: 3572464 - RNA, 16 nt, Pseudomonas putida KT2440
cggcgcugggacaggu

SEQ ID NO: 3572465 - RNA, 13 nt, Pseudomonas putida KT2440
cgggcacaggccg

SEQ ID NO: 3572466 - RNA, 15 nt, Pseudomonas putida KT2440
cgggcacaucaccag

SEQ ID NO: 3572467 - RNA, 18 nt, Pseudomonas putida KT2440
cgggcacaucaccagcag

SEQ ID NO: 3572468 - RNA, 22 nt, Pseudomonas putida KT2440
cgggcacaucaccagcagcuuc

SEQ ID NO: 3572469 - RNA, 16 nt, Pseudomonas putida KT2440
cgggcacgaucagcag

SEQ ID NO: 3572470 - RNA, 19 nt, Pseudomonas putida KT2440
cgggcacgaucagcagcaa

SEQ ID NO: 3572471 - RNA, 22 nt, Pseudomonas putida KT2440
cgggcacgaucagcagcaaagg

SEQ ID NO: 3572472 - RNA, 15 nt, Pseudomonas putida KT2440
cgggcacgcccgcuc

SEQ ID NO: 3572473 - RNA, 20 nt, Pseudomonas putida KT2440
cgggcacgcccgcucccaca

SEQ ID NO: 3572474 - RNA, 14 nt, Pseudomonas putida KT2440
cgggcacugcccgg

SEQ ID NO: 3572475 - RNA, 18 nt, Pseudomonas putida KT2440
cgggcacugcccggcguu

SEQ ID NO: 3572476 - RNA, 18 nt, Pseudomonas putida KT2440
cgggcacuggcugauagc

SEQ ID NO: 3572477 - RNA, 17 nt, Pseudomonas putida KT2440
cgggcagaccugcuggc

SEQ ID NO: 3572478 - RNA, 22 nt, Pseudomonas putida KT2440
cgggcagaccugcuggcacugc

SEQ ID NO: 3572479 - RNA, 13 nt, Pseudomonas putida KT2440
cgggcagacgacc

SEQ ID NO: 3572480 - RNA, 20 nt, Pseudomonas putida KT2440
cgggcaguucgaugcgaagc

SEQ ID NO: 3572481 - RNA, 20 nt, Pseudomonas putida KT2440
cgggcauaacgccccagcag

SEQ ID NO: 3572482 - RNA, 21 nt, Pseudomonas putida KT2440
cgggcauaacgccccagcagu

SEQ ID NO: 3572483 - RNA, 23 nt, Pseudomonas putida KT2440
cgggcauacagggauagagccgc

SEQ ID NO: 3572484 - RNA, 14 nt, Pseudomonas putida KT2440
cgggcaucaucaaa

SEQ ID NO: 3572485 - RNA, 22 nt, Pseudomonas putida KT2440
cgggcaugcaggucgaccugcc

SEQ ID NO: 3572486 - RNA, 13 nt, Pseudomonas putida KT2440
cgggcaugcccgc

SEQ ID NO: 3572487 - RNA, 22 nt, Pseudomonas putida KT2440
cgggcaugcccgcgaagggcuc

SEQ ID NO: 3572488 - RNA, 14 nt, Pseudomonas putida KT2440
cgggcaugcccgcu

SEQ ID NO: 3572489 - RNA, 22 nt, Pseudomonas putida KT2440
cgggcaugcccgcucccacagg

SEQ ID NO: 3572490 - RNA, 15 nt, Pseudomonas putida KT2440
cgggccaaggucauc

SEQ ID NO: 3572491 - RNA, 17 nt, Pseudomonas putida KT2440
cgggccaccaaaggccu

SEQ ID NO: 3572492 - RNA, 21 nt, Pseudomonas putida KT2440
cgggccaccaccgcguacagc

SEQ ID NO: 3572493 - RNA, 16 nt, Pseudomonas putida KT2440
cgggccagcccaucca

SEQ ID NO: 3572494 - RNA, 22 nt, Pseudomonas putida KT2440
cgggccagccgcgccaggucgg

SEQ ID NO: 3572495 - RNA, 13 nt, Pseudomonas putida KT2440
cgggccagcgcgg

SEQ ID NO: 3572496 - RNA, 13 nt, Pseudomonas putida KT2440
cgggccagucccu

SEQ ID NO: 3572497 - RNA, 15 nt, Pseudomonas putida KT2440
cgggccaucggugcc

SEQ ID NO: 3572498 - RNA, 20 nt, Pseudomonas putida KT2440
cgggcccaggcauuuccaca

SEQ ID NO: 3572499 - RNA, 15 nt, Pseudomonas putida KT2440
cgggcccgcuugcgc

SEQ ID NO: 3572500 - RNA, 18 nt, Pseudomonas putida KT2440
cgggcccgcuugcgcggu

SEQ ID NO: 3572501 - RNA, 14 nt, Pseudomonas putida KT2440
cgggccgccgaaca

SEQ ID NO: 3572502 - RNA, 18 nt, Pseudomonas putida KT2440
cgggccgcuugcucaggc

SEQ ID NO: 3572503 - RNA, 14 nt, Pseudomonas putida KT2440
cgggccggcguugg

SEQ ID NO: 3572504 - RNA, 19 nt, Pseudomonas putida KT2440
cgggccgucaccgcugccg

SEQ ID NO: 3572505 - RNA, 17 nt, Pseudomonas putida KT2440
cgggccucuucgcgggu

SEQ ID NO: 3572506 - RNA, 19 nt, Pseudomonas putida KT2440
cgggccugauuggcaucgc

SEQ ID NO: 3572507 - RNA, 11 nt, Pseudomonas putida KT2440
cgggccugcug

SEQ ID NO: 3572508 - RNA, 13 nt, Pseudomonas putida KT2440
cgggccugcuggc

SEQ ID NO: 3572509 - RNA, 15 nt, Pseudomonas putida KT2440
cgggccugcuggcga

SEQ ID NO: 3572510 - RNA, 17 nt, Pseudomonas putida KT2440
cgggccugcuggcgaag

SEQ ID NO: 3572511 - RNA, 12 nt, Pseudomonas putida KT2440
cgggccuggagc

SEQ ID NO: 3572512 - RNA, 18 nt, Pseudomonas putida KT2440
cgggccuggagcaaggcg

SEQ ID NO: 3572513 - RNA, 16 nt, Pseudomonas putida KT2440
cgggccuucaaccuca

SEQ ID NO: 3572514 - RNA, 19 nt, Pseudomonas putida KT2440
cgggccuuugggccaaccc

SEQ ID NO: 3572515 - RNA, 21 nt, Pseudomonas putida KT2440
cgggccuuugggccaacccgg

SEQ ID NO: 3572516 - RNA, 19 nt, Pseudomonas putida KT2440
cgggcgaagcccgugccau

SEQ ID NO: 3572517 - RNA, 15 nt, Pseudomonas putida KT2440
cgggcgagcgcgcag

SEQ ID NO: 3572518 - RNA, 16 nt, Pseudomonas putida KT2440
gcuaccacguuaucca

SEQ ID NO: 3572519 - RNA, 22 nt, Pseudomonas putida KT2440
gcuaccagaaauggucgcgggc

SEQ ID NO: 3572520 - RNA, 18 nt, Pseudomonas putida KT2440
gcuacccacaguugcggg

SEQ ID NO: 3572521 - RNA, 23 nt, Pseudomonas putida KT2440
gcuacccacuccccacuccugug

SEQ ID NO: 3572522 - RNA, 17 nt, Pseudomonas putida KT2440
gcuacccagccgggcau

SEQ ID NO: 3572523 - RNA, 19 nt, Pseudomonas putida KT2440
gcuaccccacaaccccugc

SEQ ID NO: 3572524 - RNA, 20 nt, Pseudomonas putida KT2440
gcuaccccacaaccccugca

SEQ ID NO: 3572525 - RNA, 22 nt, Pseudomonas putida KT2440
gcuaccgcugcgcaccaaggcg

SEQ ID NO: 3572526 - RNA, 16 nt, Pseudomonas putida KT2440
gcuaccugacuugccu

SEQ ID NO: 3572527 - RNA, 20 nt, Pseudomonas putida KT2440
gcuaccugugggagcgggcg

SEQ ID NO: 3572528 - RNA, 22 nt, Pseudomonas putida KT2440
gcuacgagagaucgcagcgagc

SEQ ID NO: 3572529 - RNA, 14 nt, Pseudomonas putida KT2440
gcuacgcagcaccc

SEQ ID NO: 3572530 - RNA, 18 nt, Pseudomonas putida KT2440
gcuacgcagcacccgguc

SEQ ID NO: 3572531 - RNA, 13 nt, Pseudomonas putida KT2440
gcuacgccgcccc

SEQ ID NO: 3572532 - RNA, 18 nt, Pseudomonas putida KT2440
gcuacgcucguccaggcc

SEQ ID NO: 3572533 - RNA, 19 nt, Pseudomonas putida KT2440
gcuacgcuggacuugccuu

SEQ ID NO: 3572534 - RNA, 21 nt, Pseudomonas putida KT2440
gcuacgcuggacuugccuugg

SEQ ID NO: 3572535 - RNA, 16 nt, Pseudomonas putida KT2440
gcuacggccgugcagg

SEQ ID NO: 3572536 - RNA, 23 nt, Pseudomonas putida KT2440
gcuacggccgugcagggcgccga

SEQ ID NO: 3572537 - RNA, 15 nt, Pseudomonas putida KT2440
gcuacgggauugccg

SEQ ID NO: 3572538 - RNA, 17 nt, Pseudomonas putida KT2440
gcuacgugauugacccg

SEQ ID NO: 3572539 - RNA, 23 nt, Pseudomonas putida KT2440
gcuagaauggcacccaucacgac

SEQ ID NO: 3572540 - RNA, 17 nt, Pseudomonas putida KT2440
gcuagcagcaucaccgc

SEQ ID NO: 3572541 - RNA, 14 nt, Pseudomonas putida KT2440
gcuagccggucacc

SEQ ID NO: 3572542 - RNA, 16 nt, Pseudomonas putida KT2440
gcuagcuacucggcaa

SEQ ID NO: 3572543 - RNA, 18 nt, Pseudomonas putida KT2440
gcuagcuacucggcaauu

SEQ ID NO: 3572544 - RNA, 17 nt, Pseudomonas putida KT2440
gcuagggucguccuggg

SEQ ID NO: 3572545 - RNA, 14 nt, Pseudomonas putida KT2440
gcuaucgccagcag

SEQ ID NO: 3572546 - RNA, 22 nt, Pseudomonas putida KT2440
gcuaucggacgaugaggccgga

SEQ ID NO: 3572547 - RNA, 15 nt, Pseudomonas putida KT2440
gcuaucggccagcaa

SEQ ID NO: 3572548 - RNA, 16 nt, Pseudomonas putida KT2440
gcuaucggccagcaaa

SEQ ID NO: 3572549 - RNA, 14 nt, Pseudomonas putida KT2440
gcuaucucaggcca

SEQ ID NO: 3572550 - RNA, 15 nt, Pseudomonas putida KT2440
gcuaucucaggccag

SEQ ID NO: 3572551 - RNA, 18 nt, Pseudomonas putida KT2440
gcuaucucaggccaguuc

SEQ ID NO: 3572552 - RNA, 16 nt, Pseudomonas putida KT2440
gcuaugccggccccgu

SEQ ID NO: 3572553 - RNA, 21 nt, Pseudomonas putida KT2440
gcuauuguggcaauugcaccc

SEQ ID NO: 3572554 - RNA, 23 nt, Pseudomonas putida KT2440
gcucaaaaugcuuuuaugauccu

SEQ ID NO: 3572555 - RNA, 15 nt, Pseudomonas putida KT2440
gcucaaagcgcaaaa

SEQ ID NO: 3572556 - RNA, 12 nt, Pseudomonas putida KT2440
gcucaaaugcug

SEQ ID NO: 3572557 - RNA, 17 nt, Pseudomonas putida KT2440
gcucaacagcaggugca

SEQ ID NO: 3572558 - RNA, 13 nt, Pseudomonas putida KT2440
gcucaacagccac

SEQ ID NO: 3572559 - RNA, 19 nt, Pseudomonas putida KT2440
gcucaacagguucgacagu

SEQ ID NO: 3572560 - RNA, 16 nt, Pseudomonas putida KT2440
gcucaaccccaucacc

SEQ ID NO: 3572561 - RNA, 23 nt, Pseudomonas putida KT2440
gcucaaccccaucaccuuggccg

SEQ ID NO: 3572562 - RNA, 15 nt, Pseudomonas putida KT2440
gcucaacccgccuga

SEQ ID NO: 3572563 - RNA, 23 nt, Pseudomonas putida KT2440
gcucaacgccagggcaaucgcca

SEQ ID NO: 3572564 - RNA, 20 nt, Pseudomonas putida KT2440
gcucaacggguuugccguga

SEQ ID NO: 3572565 - RNA, 16 nt, Pseudomonas putida KT2440
gcucaacuacccugaa

SEQ ID NO: 3572566 - RNA, 15 nt, Pseudomonas putida KT2440
gcucaacuccauggc

SEQ ID NO: 3572567 - RNA, 16 nt, Pseudomonas putida KT2440
gcucaacuccauggcc

SEQ ID NO: 3572568 - RNA, 18 nt, Pseudomonas putida KT2440
gcucaacuccauggccag

SEQ ID NO: 3572569 - RNA, 15 nt, Pseudomonas putida KT2440
gcucaagcccugccg

SEQ ID NO: 3572570 - RNA, 21 nt, Pseudomonas putida KT2440
gcucaagcccugccgccuucu

SEQ ID NO: 3572571 - RNA, 13 nt, Pseudomonas putida KT2440
gcucaagcgcagc

SEQ ID NO: 3572572 - RNA, 14 nt, Pseudomonas putida KT2440
gcucaagcgcagcc

SEQ ID NO: 3572573 - RNA, 18 nt, Pseudomonas putida KT2440
gcucaagcgcagccuugu

SEQ ID NO: 3572574 - RNA, 13 nt, Pseudomonas putida KT2440
gcucaaggugucg

SEQ ID NO: 3572575 - RNA, 18 nt, Pseudomonas putida KT2440
gcucaagucgugccggaa

SEQ ID NO: 3572576 - RNA, 13 nt, Pseudomonas putida KT2440
gcucaauagcggc

SEQ ID NO: 3572577 - RNA, 22 nt, Pseudomonas putida KT2440
gcucaaucaaccagcccgccgc

SEQ ID NO: 3572578 - RNA, 22 nt, Pseudomonas putida KT2440
gcucaauuucuaaaagcuggcg

SEQ ID NO: 3572579 - RNA, 14 nt, Pseudomonas putida KT2440
gcucacaaagcccu

SEQ ID NO: 3572580 - RNA, 14 nt, Pseudomonas putida KT2440
gcucacacccaggc

SEQ ID NO: 3572581 - RNA, 20 nt, Pseudomonas putida KT2440
gcucacacccaggcucgccc

SEQ ID NO: 3572582 - RNA, 17 nt, Pseudomonas putida KT2440
gcucacagcccgggcau

SEQ ID NO: 3572583 - RNA, 22 nt, Pseudomonas putida KT2440
gcucacagcccgggcauguuca

SEQ ID NO: 3572584 - RNA, 13 nt, Pseudomonas putida KT2440
gcucacaggcuca

SEQ ID NO: 3572585 - RNA, 11 nt, Pseudomonas putida KT2440
gcucaccacca

SEQ ID NO: 3572586 - RNA, 14 nt, Pseudomonas putida KT2440
gcucacccaccagc

SEQ ID NO: 3572587 - RNA, 18 nt, Pseudomonas putida KT2440
gcucaccccauagggcca

SEQ ID NO: 3572588 - RNA, 22 nt, Pseudomonas putida KT2440
gcucaccccauagggccagcgg

SEQ ID NO: 3572589 - RNA, 16 nt, Pseudomonas putida KT2440
gcucaccccgccccug

SEQ ID NO: 3572590 - RNA, 22 nt, Pseudomonas putida KT2440
gcucacccgaccagaucaggcc

SEQ ID NO: 3572591 - RNA, 15 nt, Pseudomonas putida KT2440
gcucaccgcagccca

SEQ ID NO: 3572592 - RNA, 17 nt, Pseudomonas putida KT2440
gcucaccggccagcgcg

SEQ ID NO: 3572593 - RNA, 20 nt, Pseudomonas putida KT2440
gcucaccggccagcgcgcug

SEQ ID NO: 3572594 - RNA, 19 nt, Pseudomonas putida KT2440
gcucaccguggucuccaac

SEQ ID NO: 3572595 - RNA, 17 nt, Pseudomonas putida KT2440
gcucaccugguaccccu

SEQ ID NO: 3572596 - RNA, 18 nt, Pseudomonas putida KT2440
gcucacgcaagcggcccu

SEQ ID NO: 3572597 - RNA, 20 nt, Pseudomonas putida KT2440
gcucacgcaagcggcccuga

SEQ ID NO: 3572598 - RNA, 11 nt, Pseudomonas putida KT2440
gcucacgcagc

SEQ ID NO: 3572599 - RNA, 14 nt, Pseudomonas putida KT2440
gcucacgcagccag

SEQ ID NO: 3572600 - RNA, 15 nt, Pseudomonas putida KT2440
gcucacgcagccagu

SEQ ID NO: 3572601 - RNA, 14 nt, Pseudomonas putida KT2440
gcucacgcagcccu

SEQ ID NO: 3572602 - RNA, 16 nt, Pseudomonas putida KT2440
gcucacgcagcucggu

SEQ ID NO: 3572603 - RNA, 18 nt, Pseudomonas putida KT2440
gcucacgcagcucgguga

SEQ ID NO: 3572604 - RNA, 19 nt, Pseudomonas putida KT2440
gcucacugaccaccuggau

SEQ ID NO: 3572605 - RNA, 13 nt, Pseudomonas putida KT2440
gcucacugcucau

SEQ ID NO: 3572606 - RNA, 13 nt, Pseudomonas putida KT2440
gcucacuggccaa

SEQ ID NO: 3572607 - RNA, 16 nt, Pseudomonas putida KT2440
gcucagcaacugggca

SEQ ID NO: 3572608 - RNA, 14 nt, Pseudomonas putida KT2440
gcucagcacauuca

SEQ ID NO: 3572609 - RNA, 23 nt, Pseudomonas putida KT2440
gcucagcacauucagcagcgccu

SEQ ID NO: 3572610 - RNA, 21 nt, Pseudomonas putida KT2440
gcucagcagguugaacagcag

SEQ ID NO: 3572611 - RNA, 22 nt, Pseudomonas putida KT2440
gcucagcagguugaacagcagc

SEQ ID NO: 3572612 - RNA, 21 nt, Pseudomonas putida KT2440
gcucagcgggcguaccuggcu

SEQ ID NO: 3572613 - RNA, 20 nt, Pseudomonas putida KT2440
gcucagcguacgcaugguca

SEQ ID NO: 3572614 - RNA, 19 nt, Pseudomonas putida KT2440
gcucagcgugacgauggcc

SEQ ID NO: 3572615 - RNA, 23 nt, Pseudomonas putida KT2440
gcucagcugggagagcgccugca

SEQ ID NO: 3572616 - RNA, 16 nt, Pseudomonas putida KT2440
gcucaggccaugcugc

SEQ ID NO: 3572617 - RNA, 22 nt, Pseudomonas putida KT2440
gcucaggccaugcugcgccagg

SEQ ID NO: 3572618 - RNA, 22 nt, Pseudomonas putida KT2440
gcucaggccuucgccacugcca

SEQ ID NO: 3572619 - RNA, 13 nt, Pseudomonas putida KT2440
gcucaggccuugc

SEQ ID NO: 3572620 - RNA, 17 nt, Pseudomonas putida KT2440
gcucaggccuugccgcu

SEQ ID NO: 3572621 - RNA, 22 nt, Pseudomonas putida KT2440
gcucaggccuugccgcucacca

SEQ ID NO: 3572622 - RNA, 14 nt, Pseudomonas putida KT2440
gcucaggcgcucca

SEQ ID NO: 3572623 - RNA, 15 nt, Pseudomonas putida KT2440
gcucaggcggcgcag

SEQ ID NO: 3572624 - RNA, 22 nt, Pseudomonas putida KT2440
gcucaggcguggaaaaggcgcu

SEQ ID NO: 3572625 - RNA, 17 nt, Pseudomonas putida KT2440
gcucaggcucagcucca

SEQ ID NO: 3572626 - RNA, 17 nt, Pseudomonas putida KT2440
gcucaggcucaguugca

SEQ ID NO: 3572627 - RNA, 19 nt, Pseudomonas putida KT2440
gcucagguaggcagcaacg

SEQ ID NO: 3572628 - RNA, 15 nt, Pseudomonas putida KT2440
gcucaggugcaccuc

SEQ ID NO: 3572629 - RNA, 22 nt, Pseudomonas putida KT2440
gcucagguuacgcaccagcucc

SEQ ID NO: 3572630 - RNA, 22 nt, Pseudomonas putida KT2440
gcucaguaauaggugcguggcu

SEQ ID NO: 3572631 - RNA, 19 nt, Pseudomonas putida KT2440
gcucagugugggggcggcc

SEQ ID NO: 3572632 - RNA, 21 nt, Pseudomonas putida KT2440
gcucauacccuuugccaucca

SEQ ID NO: 3572633 - RNA, 22 nt, Pseudomonas putida KT2440
gcucauacccuuugccauccac

SEQ ID NO: 3572634 - RNA, 14 nt, Pseudomonas putida KT2440
gcucauacugcuga

SEQ ID NO: 3572635 - RNA, 13 nt, Pseudomonas putida KT2440
gcucaucaccagg

SEQ ID NO: 3572636 - RNA, 23 nt, Pseudomonas putida KT2440
gcucaucaccaggcccgcaaggg

SEQ ID NO: 3572637 - RNA, 23 nt, Pseudomonas putida KT2440
gcucauccacaccuucggcauga

SEQ ID NO: 3572638 - RNA, 14 nt, Pseudomonas putida KT2440
gcucauccagccgc

SEQ ID NO: 3572639 - RNA, 24 nt, Pseudomonas putida KT2440
gcucauccagcguggccugcaagc

SEQ ID NO: 3572640 - RNA, 15 nt, Pseudomonas putida KT2440
gcucauccaggcugc

SEQ ID NO: 3572641 - RNA, 21 nt, Pseudomonas putida KT2440
gcucaucgcggccgaaggcgc

SEQ ID NO: 3572642 - RNA, 23 nt, Pseudomonas putida KT2440
gcucaucgcggccgaaggcgcug

SEQ ID NO: 3572643 - RNA, 19 nt, Pseudomonas putida KT2440
gcucaucguaauggccuac

SEQ ID NO: 3572644 - RNA, 15 nt, Pseudomonas putida KT2440
gcucaucuaccagcu

SEQ ID NO: 3572645 - RNA, 18 nt, Pseudomonas putida KT2440
gcucaucuaccugagccu

SEQ ID NO: 3572646 - RNA, 16 nt, Pseudomonas putida KT2440
gcucaucugccggcga

SEQ ID NO: 3572647 - RNA, 23 nt, Pseudomonas putida KT2440
gcucaucugccggcgaauccagc

SEQ ID NO: 3572648 - RNA, 20 nt, Pseudomonas putida KT2440
gcucaucugcgccagugggu

SEQ ID NO: 3572649 - RNA, 18 nt, Pseudomonas putida KT2440
gcucaugaacagcgccca

SEQ ID NO: 3572650 - RNA, 13 nt, Pseudomonas putida KT2440
gcucaugcacucg

SEQ ID NO: 3572651 - RNA, 18 nt, Pseudomonas putida KT2440
gcucaugcacucgccgau

SEQ ID NO: 3572652 - RNA, 14 nt, Pseudomonas putida KT2440
gcucaugccccgca

SEQ ID NO: 3572653 - RNA, 15 nt, Pseudomonas putida KT2440
gcucaugcgccaggg

SEQ ID NO: 3572654 - RNA, 18 nt, Pseudomonas putida KT2440
gcucaugcgccagggcug

SEQ ID NO: 3572655 - RNA, 12 nt, Pseudomonas putida KT2440
gcucaugcgggu

SEQ ID NO: 3572656 - RNA, 18 nt, Pseudomonas putida KT2440
gcucaugggcuucgagca

SEQ ID NO: 3572657 - RNA, 17 nt, Pseudomonas putida KT2440
gcucauggucagccggc

SEQ ID NO: 3572658 - RNA, 18 nt, Pseudomonas putida KT2440
gcucaugguucuggcgca

SEQ ID NO: 3572659 - RNA, 20 nt, Pseudomonas putida KT2440
gcucaugguucuggcgcacg

SEQ ID NO: 3572660 - RNA, 18 nt, Pseudomonas putida KT2440
gcuccaacaagucuuccc

SEQ ID NO: 3572661 - RNA, 20 nt, Pseudomonas putida KT2440
gcuccaacaagucuuccccu

SEQ ID NO: 3572662 - RNA, 17 nt, Pseudomonas putida KT2440
gcuccaagugccgugca

SEQ ID NO: 3572663 - RNA, 13 nt, Pseudomonas putida KT2440
gcuccacaaucuc

SEQ ID NO: 3572664 - RNA, 19 nt, Pseudomonas putida KT2440
gcuccacacucgacgcugc

SEQ ID NO: 3572665 - RNA, 21 nt, Pseudomonas putida KT2440
gcuccacacucgacgcugccg

SEQ ID NO: 3572666 - RNA, 12 nt, Pseudomonas putida KT2440
gcuccaccugcc

SEQ ID NO: 3572667 - RNA, 15 nt, Pseudomonas putida KT2440
gcuccaccugccacc

SEQ ID NO: 3572668 - RNA, 18 nt, Pseudomonas putida KT2440
gcuccaccugccaccccg

SEQ ID NO: 3572669 - RNA, 12 nt, Pseudomonas putida KT2440
gcuccaccugcu

SEQ ID NO: 3572670 - RNA, 14 nt, Pseudomonas putida KT2440
gcuccaccugcucc

SEQ ID NO: 3572671 - RNA, 19 nt, Pseudomonas putida KT2440
gcuccaccugcuccagcac

SEQ ID NO: 3572672 - RNA, 22 nt, Pseudomonas putida KT2440
gcuccaccuuccacucuuccac

SEQ ID NO: 3572673 - RNA, 12 nt, Pseudomonas putida KT2440
gcuccacugcaa

SEQ ID NO: 3572674 - RNA, 14 nt, Pseudomonas putida KT2440
gcuccagcaccucg

SEQ ID NO: 3572675 - RNA, 18 nt, Pseudomonas putida KT2440
gcuccagcaccucgcuca

SEQ ID NO: 3572676 - RNA, 20 nt, Pseudomonas putida KT2440
gcuccagcaccucgcucagc

SEQ ID NO: 3572677 - RNA, 21 nt, Pseudomonas putida KT2440
gcuccagcacuuuugccacca

SEQ ID NO: 3572678 - RNA, 15 nt, Pseudomonas putida KT2440
gcuccagcagugccg

SEQ ID NO: 3572679 - RNA, 15 nt, Pseudomonas putida KT2440
gcuccagcccagcgc

SEQ ID NO: 3572680 - RNA, 16 nt, Pseudomonas putida KT2440
gcuccagcccagcgcc

SEQ ID NO: 3572681 - RNA, 18 nt, Pseudomonas putida KT2440
gcuccagcccagcgccag

SEQ ID NO: 3572682 - RNA, 13 nt, Pseudomonas putida KT2440
gcuccagcgcacg

SEQ ID NO: 3572683 - RNA, 19 nt, Pseudomonas putida KT2440
gcuccagcgcacgcaacag

SEQ ID NO: 3572684 - RNA, 15 nt, Pseudomonas putida KT2440
gcuccagcguguuca

SEQ ID NO: 3572685 - RNA, 16 nt, Pseudomonas putida KT2440
gcuccagcguguucaa

SEQ ID NO: 3572686 - RNA, 18 nt, Pseudomonas putida KT2440
gcuccagcguuugcacgg

SEQ ID NO: 3572687 - RNA, 18 nt, Pseudomonas putida KT2440
gcuccagcucacagcacu

SEQ ID NO: 3572688 - RNA, 14 nt, Pseudomonas putida KT2440
gcuccaggcacagg

SEQ ID NO: 3572689 - RNA, 18 nt, Pseudomonas putida KT2440
gcuccaggcacaggcgca

SEQ ID NO: 3572690 - RNA, 19 nt, Pseudomonas putida KT2440
gcuccaggcacaggcgcac

SEQ ID NO: 3572691 - RNA, 20 nt, Pseudomonas putida KT2440
gcuccaggcacaggcgcaca

SEQ ID NO: 3572692 - RNA, 14 nt, Pseudomonas putida KT2440
gcuccaggcagccu

SEQ ID NO: 3572693 - RNA, 16 nt, Pseudomonas putida KT2440
gcuccaggcagccugc

SEQ ID NO: 3572694 - RNA, 18 nt, Pseudomonas putida KT2440
gcuccaggcagccugcca

SEQ ID NO: 3572695 - RNA, 19 nt, Pseudomonas putida KT2440
gcuccaggcagccugccag

SEQ ID NO: 3572696 - RNA, 18 nt, Pseudomonas putida KT2440
gcuccaggccugcggcag

SEQ ID NO: 3572697 - RNA, 15 nt, Pseudomonas putida KT2440
gcuccaggcggccag

SEQ ID NO: 3572698 - RNA, 17 nt, Pseudomonas putida KT2440
gcuccaggcggccagcc

SEQ ID NO: 3572699 - RNA, 15 nt, Pseudomonas putida KT2440
gcuccagggcaggcu

SEQ ID NO: 3572700 - RNA, 17 nt, Pseudomonas putida KT2440
gcuccagggcaggcuga

SEQ ID NO: 3572701 - RNA, 15 nt, Pseudomonas putida KT2440
gcuccagguacucgc

SEQ ID NO: 3572702 - RNA, 17 nt, Pseudomonas putida KT2440
gcuccaggugaaucagc

SEQ ID NO: 3572703 - RNA, 20 nt, Pseudomonas putida KT2440
gcuccaggugaaucagcggc

SEQ ID NO: 3572704 - RNA, 23 nt, Pseudomonas putida KT2440
gcuccaggugaaucagcggcagg

SEQ ID NO: 3572705 - RNA, 20 nt, Pseudomonas putida KT2440
gcuccaguucauucccggcc

SEQ ID NO: 3572706 - RNA, 20 nt, Pseudomonas putida KT2440
gcuccaguugcaagccuucg

SEQ ID NO: 3572707 - RNA, 12 nt, Pseudomonas putida KT2440
gcuccauccagu

SEQ ID NO: 3572708 - RNA, 22 nt, Pseudomonas putida KT2440
gcuccauggcaauuggcuucca

SEQ ID NO: 3572709 - RNA, 15 nt, Pseudomonas putida KT2440
gcuccaugggcaggc

SEQ ID NO: 3572710 - RNA, 17 nt, Pseudomonas putida KT2440
gcuccaugggcaggccc

SEQ ID NO: 3572711 - RNA, 18 nt, Pseudomonas putida KT2440
gcuccaugggcaggccca

SEQ ID NO: 3572712 - RNA, 24 nt, Pseudomonas putida KT2440
gcuccaugggcaggcccagguaac

SEQ ID NO: 3572713 - RNA, 19 nt, Pseudomonas putida KT2440
gcucccacaaaggccgcgu

SEQ ID NO: 3572714 - RNA, 15 nt, Pseudomonas putida KT2440
gcucccacaggaaug

SEQ ID NO: 3572715 - RNA, 18 nt, Pseudomonas putida KT2440
gcucccacagggaccgca

SEQ ID NO: 3572716 - RNA, 14 nt, Pseudomonas putida KT2440
gcucccacaggggc

SEQ ID NO: 3572717 - RNA, 20 nt, Pseudomonas putida KT2440
gcucccacagguaagucaca

SEQ ID NO: 3572718 - RNA, 19 nt, Pseudomonas putida KT2440
gcucccacagguacucgca

SEQ ID NO: 3572719 - RNA, 21 nt, Pseudomonas putida KT2440
gcucccacagguccagcgcag

SEQ ID NO: 3572720 - RNA, 22 nt, Pseudomonas putida KT2440
gcucccaccgguauagcgacag

SEQ ID NO: 3572721 - RNA, 12 nt, Pseudomonas putida KT2440
gcucccagaaag

SEQ ID NO: 3572722 - RNA, 16 nt, Pseudomonas putida KT2440
gcuccccaaccaccuc

SEQ ID NO: 3572723 - RNA, 17 nt, Pseudomonas putida KT2440
gcuccccaaccaccucc

SEQ ID NO: 3572724 - RNA, 19 nt, Pseudomonas putida KT2440
gcucccccuccacccgguc

SEQ ID NO: 3572725 - RNA, 14 nt, Pseudomonas putida KT2440
gcucccgagccagg

SEQ ID NO: 3572726 - RNA, 20 nt, Pseudomonas putida KT2440
gcucccgcaggggcugcgca

SEQ ID NO: 3572727 - RNA, 17 nt, Pseudomonas putida KT2440
gcucccggcauugccca

SEQ ID NO: 3572728 - RNA, 18 nt, Pseudomonas putida KT2440
gcucccggcauugcccaa

SEQ ID NO: 3572729 - RNA, 22 nt, Pseudomonas putida KT2440
gcucccucgguuucucaccccg

SEQ ID NO: 3572730 - RNA, 17 nt, Pseudomonas putida KT2440
gcucccucguaggagcg

SEQ ID NO: 3572731 - RNA, 21 nt, Pseudomonas putida KT2440
gcucccucguaggagcggguu

SEQ ID NO: 3572732 - RNA, 15 nt, Pseudomonas putida KT2440
gcuccgacaggcugu

SEQ ID NO: 3572733 - RNA, 22 nt, Pseudomonas putida KT2440
gcuccgacaggcuguguggccg

SEQ ID NO: 3572734 - RNA, 19 nt, Pseudomonas putida KT2440
gcuccgacauugaucggcg

SEQ ID NO: 3572735 - RNA, 18 nt, Pseudomonas putida KT2440
gcuccgaccgguggccug

SEQ ID NO: 3572736 - RNA, 20 nt, Pseudomonas putida KT2440
gcuccgacucgucaauaccg

SEQ ID NO: 3572737 - RNA, 21 nt, Pseudomonas putida KT2440
gcuccgccaaaccccagcaag

SEQ ID NO: 3572738 - RNA, 21 nt, Pseudomonas putida KT2440
gcuccggaauccgcacacgcu

SEQ ID NO: 3572739 - RNA, 23 nt, Pseudomonas putida KT2440
gcuccggcgacagcucaagcccu

SEQ ID NO: 3572740 - RNA, 20 nt, Pseudomonas putida KT2440
gcuccggcguguccagcagg

SEQ ID NO: 3572741 - RNA, 18 nt, Pseudomonas putida KT2440
gcuccgggugcggcauca

SEQ ID NO: 3572742 - RNA, 17 nt, Pseudomonas putida KT2440
gcuccuacaaagcggcg

SEQ ID NO: 3572743 - RNA, 21 nt, Pseudomonas putida KT2440
gcuccuacaacggcugugccg

SEQ ID NO: 3572744 - RNA, 14 nt, Pseudomonas putida KT2440
gcuccuacaaggua

SEQ ID NO: 3572745 - RNA, 17 nt, Pseudomonas putida KT2440
gcuccuacacgcggccu

SEQ ID NO: 3572746 - RNA, 21 nt, Pseudomonas putida KT2440
gcuccuaccacguacacacau

SEQ ID NO: 3572747 - RNA, 16 nt, Pseudomonas putida KT2440
gcuccuacgacggccu

SEQ ID NO: 3572748 - RNA, 22 nt, Pseudomonas putida KT2440
gcuccuacgacgggcugagccc

SEQ ID NO: 3572749 - RNA, 13 nt, Pseudomonas putida KT2440
gcuccuacgcggg

SEQ ID NO: 3572750 - RNA, 17 nt, Pseudomonas putida KT2440
gcuccuacgcggggcag

SEQ ID NO: 3572751 - RNA, 18 nt, Pseudomonas putida KT2440
gcuccuacgcggggcagc

SEQ ID NO: 3572752 - RNA, 13 nt, Pseudomonas putida KT2440
gcuccuacgggca

SEQ ID NO: 3572753 - RNA, 20 nt, Pseudomonas putida KT2440
gcuccuacgggcaaccgcau

SEQ ID NO: 3572754 - RNA, 21 nt, Pseudomonas putida KT2440
gcuccuacgggcaaccgcauc

SEQ ID NO: 3572755 - RNA, 21 nt, Pseudomonas putida KT2440
gcuccuacgggcgagcgcgca

SEQ ID NO: 3572756 - RNA, 20 nt, Pseudomonas putida KT2440
gcuccuacggggguucacag

SEQ ID NO: 3572757 - RNA, 16 nt, Pseudomonas putida KT2440
gcuccuacuacggccu

SEQ ID NO: 3572758 - RNA, 23 nt, Pseudomonas putida KT2440
gcuccuacuacggccugugucca

SEQ ID NO: 3572759 - RNA, 19 nt, Pseudomonas putida KT2440
gcuccucggccguaaaguc

SEQ ID NO: 3572760 - RNA, 19 nt, Pseudomonas putida KT2440
gcuccugcagguaucacgc

SEQ ID NO: 3572761 - RNA, 17 nt, Pseudomonas putida KT2440
gcuccugcaugccuucc

SEQ ID NO: 3572762 - RNA, 16 nt, Pseudomonas putida KT2440
gcuccugcggucagcc

SEQ ID NO: 3572763 - RNA, 16 nt, Pseudomonas putida KT2440
gcuccuggccgcccgc

SEQ ID NO: 3572764 - RNA, 21 nt, Pseudomonas putida KT2440
gcuccuggucaucgaagccaa

SEQ ID NO: 3572765 - RNA, 16 nt, Pseudomonas putida KT2440
gcuccugguccugcgc

SEQ ID NO: 3572766 - RNA, 13 nt, Pseudomonas putida KT2440
gcuccuucaccag

SEQ ID NO: 3572767 - RNA, 13 nt, Pseudomonas putida KT2440
gcuccuucuucac

SEQ ID NO: 3572768 - RNA, 22 nt, Pseudomonas putida KT2440
gcuccuucuucacccgcagcaa

SEQ ID NO: 3572769 - RNA, 21 nt, Pseudomonas putida KT2440
gcuccuugcuguagcccacca

SEQ ID NO: 3572770 - RNA, 23 nt, Pseudomonas putida KT2440
gcuccuuguagauauugaccagc

SEQ ID NO: 3572771 - RNA, 15 nt, Pseudomonas putida KT2440
gcucgaacacuucac

SEQ ID NO: 3572772 - RNA, 13 nt, Pseudomonas putida KT2440
gcucgaaccaagg

SEQ ID NO: 3572773 - RNA, 16 nt, Pseudomonas putida KT2440
gcucgaacccacuguc

SEQ ID NO: 3572774 - RNA, 18 nt, Pseudomonas putida KT2440
gcucgaacucuuccagcu

SEQ ID NO: 3572775 - RNA, 18 nt, Pseudomonas putida KT2440
gcucgaaucaagccugcg

SEQ ID NO: 3572776 - RNA, 21 nt, Pseudomonas putida KT2440
gcucgaaucaagccugcgcag

SEQ ID NO: 3572777 - RNA, 18 nt, Pseudomonas putida KT2440
gcucgaaugccgcugcug

SEQ ID NO: 3572778 - RNA, 14 nt, Pseudomonas putida KT2440
gcucgacaaauccc

SEQ ID NO: 3572779 - RNA, 17 nt, Pseudomonas putida KT2440
gcucgacaacccgcgcu

SEQ ID NO: 3572780 - RNA, 15 nt, Pseudomonas putida KT2440
gcucgacaagccgcu

SEQ ID NO: 3572781 - RNA, 15 nt, Pseudomonas putida KT2440
gcucgacagcaacuu

SEQ ID NO: 3572782 - RNA, 18 nt, Pseudomonas putida KT2440
gcucgacauccagcgccg

SEQ ID NO: 3572783 - RNA, 23 nt, Pseudomonas putida KT2440
gcucgacauccagcgccgccaug

SEQ ID NO: 3572784 - RNA, 16 nt, Pseudomonas putida KT2440
gcucgaccaagccuga

SEQ ID NO: 3572785 - RNA, 22 nt, Pseudomonas putida KT2440
gcucgacccgcgucagcucaag

SEQ ID NO: 3572786 - RNA, 15 nt, Pseudomonas putida KT2440
gcucgacgcgcgcag

SEQ ID NO: 3572787 - RNA, 17 nt, Pseudomonas putida KT2440
gcucgacgcgcgcagcc

SEQ ID NO: 3572788 - RNA, 15 nt, Pseudomonas putida KT2440
gcucgacggucaugg

SEQ ID NO: 3572789 - RNA, 20 nt, Pseudomonas putida KT2440
gcucgagcccgccagcaggc

SEQ ID NO: 3572790 - RNA, 22 nt, Pseudomonas putida KT2440
gcucgagcccgccagcaggcca

SEQ ID NO: 3572791 - RNA, 18 nt, Pseudomonas putida KT2440
gcucgaucucacaggcga

SEQ ID NO: 3572792 - RNA, 19 nt, Pseudomonas putida KT2440
gcucgaucucacaggcgau

SEQ ID NO: 3572793 - RNA, 15 nt, Pseudomonas putida KT2440
gcucgaucugccugc

SEQ ID NO: 3572794 - RNA, 17 nt, Pseudomonas putida KT2440
gcucgaucuugccuucg

SEQ ID NO: 3572795 - RNA, 21 nt, Pseudomonas putida KT2440
gcucgaugaucaucccggcga

SEQ ID NO: 3572796 - RNA, 22 nt, Pseudomonas putida KT2440
gcucgaugccuuugcaaagcgc

SEQ ID NO: 3572797 - RNA, 14 nt, Pseudomonas putida KT2440
gcucgaugcgcacg

SEQ ID NO: 3572798 - RNA, 17 nt, Pseudomonas putida KT2440
gcucgauggccaggaac

SEQ ID NO: 3572799 - RNA, 17 nt, Pseudomonas putida KT2440
gcucgcacaucuugcug

SEQ ID NO: 3572800 - RNA, 16 nt, Pseudomonas putida KT2440
gcucgcagauaaccug

SEQ ID NO: 3572801 - RNA, 13 nt, Pseudomonas putida KT2440
gcucgcaugagcc

SEQ ID NO: 3572802 - RNA, 18 nt, Pseudomonas putida KT2440
gcucgccaacaccgcccc

SEQ ID NO: 3572803 - RNA, 15 nt, Pseudomonas putida KT2440
gcucgccaucgcccc

SEQ ID NO: 3572804 - RNA, 16 nt, Pseudomonas putida KT2440
gcucgcccgcccgcuu

SEQ ID NO: 3572805 - RNA, 17 nt, Pseudomonas putida KT2440
gcucgcccgcccgcuuc

SEQ ID NO: 3572806 - RNA, 14 nt, Pseudomonas putida KT2440
gcucgccgcccagu

SEQ ID NO: 3572807 - RNA, 12 nt, Pseudomonas putida KT2440
gcucgccggccu

SEQ ID NO: 3572808 - RNA, 16 nt, Pseudomonas putida KT2440
gcucgccggccuuggc

SEQ ID NO: 3572809 - RNA, 14 nt, Pseudomonas putida KT2440
gcucgccugcuugg

SEQ ID NO: 3572810 - RNA, 17 nt, Pseudomonas putida KT2440
gcucgcgaugcgccgcg

SEQ ID NO: 3572811 - RNA, 17 nt, Pseudomonas putida KT2440
gcucgcgcaacaaggcc

SEQ ID NO: 3572812 - RNA, 18 nt, Pseudomonas putida KT2440
gcucgcgcaacaaggcca

SEQ ID NO: 3572813 - RNA, 19 nt, Pseudomonas putida KT2440
gcucgcgcagggcaucgcg

SEQ ID NO: 3572814 - RNA, 17 nt, Pseudomonas putida KT2440
gcucgcgcaugaucgcu

SEQ ID NO: 3572815 - RNA, 20 nt, Pseudomonas putida KT2440
gcucgcgcaugaucgcuucg

SEQ ID NO: 3572816 - RNA, 19 nt, Pseudomonas putida KT2440
gcucgcgccgccgcugcug

SEQ ID NO: 3572817 - RNA, 13 nt, Pseudomonas putida KT2440
gcucgcgcgggua

SEQ ID NO: 3572818 - RNA, 14 nt, Pseudomonas putida KT2440
gcucgcgcugccag

SEQ ID NO: 3572819 - RNA, 18 nt, Pseudomonas putida KT2440
gcucgcgggccuggagca

SEQ ID NO: 3572820 - RNA, 20 nt, Pseudomonas putida KT2440
gcucgcgguucaucggcaaa

SEQ ID NO: 3572821 - RNA, 22 nt, Pseudomonas putida KT2440
gcucgcuauuccgauacgccgc

SEQ ID NO: 3572822 - RNA, 16 nt, Pseudomonas putida KT2440
gcucgcucaggcgcag

SEQ ID NO: 3572823 - RNA, 17 nt, Pseudomonas putida KT2440
gcucgcucaggcgcagc

SEQ ID NO: 3572824 - RNA, 23 nt, Pseudomonas putida KT2440
gcucgcucaggcgcagcgcaugc

SEQ ID NO: 3572825 - RNA, 16 nt, Pseudomonas putida KT2440
gcucgcuccagggcag

SEQ ID NO: 3572826 - RNA, 21 nt, Pseudomonas putida KT2440
gcucgcuccagggcaggcuga

SEQ ID NO: 3572827 - RNA, 15 nt, Pseudomonas putida KT2440
gcucgcugccccagu

SEQ ID NO: 3572828 - RNA, 20 nt, Pseudomonas putida KT2440
gcucgcugcgaucgaaauca

SEQ ID NO: 3572829 - RNA, 16 nt, Pseudomonas putida KT2440
gcucgcugcugccuuc

SEQ ID NO: 3572830 - RNA, 21 nt, Pseudomonas putida KT2440
gcucgcugcugccuucccguc

SEQ ID NO: 3572831 - RNA, 15 nt, Pseudomonas putida KT2440
gcucgcuggccacca

SEQ ID NO: 3572832 - RNA, 23 nt, Pseudomonas putida KT2440
gcucgcuggccaccagcauggcg

SEQ ID NO: 3572833 - RNA, 13 nt, Pseudomonas putida KT2440
gcucgcuggcgaa

SEQ ID NO: 3572834 - RNA, 19 nt, Pseudomonas putida KT2440
gcucgcuuuccaaaccugc

SEQ ID NO: 3572835 - RNA, 20 nt, Pseudomonas putida KT2440
gcucgcuuuccaaaccugcg

SEQ ID NO: 3572836 - RNA, 20 nt, Pseudomonas putida KT2440
gcucgcuuuccuugcacgcg

SEQ ID NO: 3572837 - RNA, 19 nt, Pseudomonas putida KT2440
gcucggaaaggucggcggc

SEQ ID NO: 3572838 - RNA, 14 nt, Pseudomonas putida KT2440
gcucggcaccaccg

SEQ ID NO: 3572839 - RNA, 15 nt, Pseudomonas putida KT2440
gcucggcaugcaugc

SEQ ID NO: 3572840 - RNA, 21 nt, Pseudomonas putida KT2440
gcucggcauguucaucaccgg

SEQ ID NO: 3572841 - RNA, 17 nt, Pseudomonas putida KT2440
gcucggccaccacuucu

SEQ ID NO: 3572842 - RNA, 23 nt, Pseudomonas putida KT2440
gcucggccaccacuucuggcugg

SEQ ID NO: 3572843 - RNA, 12 nt, Pseudomonas putida KT2440
gcucggccagcu

SEQ ID NO: 3572844 - RNA, 21 nt, Pseudomonas putida KT2440
gcucggccggggcaaccuggg

SEQ ID NO: 3572845 - RNA, 15 nt, Pseudomonas putida KT2440
gcucggccugggcag

SEQ ID NO: 3572846 - RNA, 21 nt, Pseudomonas putida KT2440
gcucggcggugccugcagccc

SEQ ID NO: 3572847 - RNA, 11 nt, Pseudomonas putida KT2440
gcucggcuggg

SEQ ID NO: 3572848 - RNA, 11 nt, Pseudomonas putida KT2440
gcucgggaaca

SEQ ID NO: 3572849 - RNA, 17 nt, Pseudomonas putida KT2440
gcucgggggugcacagc

SEQ ID NO: 3572850 - RNA, 17 nt, Pseudomonas putida KT2440
gcucgggguuggugcca

SEQ ID NO: 3572851 - RNA, 15 nt, Pseudomonas putida KT2440
gcucggguucguaca

SEQ ID NO: 3572852 - RNA, 17 nt, Pseudomonas putida KT2440
gcucgguaucggccagc

SEQ ID NO: 3572853 - RNA, 18 nt, Pseudomonas putida KT2440
gcucgguaucggccagcc

SEQ ID NO: 3572854 - RNA, 21 nt, Pseudomonas putida KT2440
gcucguaauccucguccagcu

SEQ ID NO: 3572855 - RNA, 18 nt, Pseudomonas putida KT2440
gcucguacaugguguagu

SEQ ID NO: 3572856 - RNA, 19 nt, Pseudomonas putida KT2440
gcucguacgucgccugguc

SEQ ID NO: 3572857 - RNA, 18 nt, Pseudomonas putida KT2440
gcucguaggcugcagcga

SEQ ID NO: 3572858 - RNA, 17 nt, Pseudomonas putida KT2440
gcucguaggcuucacgc

SEQ ID NO: 3572859 - RNA, 17 nt, Pseudomonas putida KT2440
gcucgucaaccacagcc

SEQ ID NO: 3572860 - RNA, 14 nt, Pseudomonas putida KT2440
gcucgucaccaucg

SEQ ID NO: 3572861 - RNA, 13 nt, Pseudomonas putida KT2440
gcucgucagcccc

SEQ ID NO: 3572862 - RNA, 18 nt, Pseudomonas putida KT2440
gcucguccugcagggcga

SEQ ID NO: 3572863 - RNA, 16 nt, Pseudomonas putida KT2440
gcucgucgaacagcau

SEQ ID NO: 3572864 - RNA, 15 nt, Pseudomonas putida KT2440
gcucgucgagcaacu

SEQ ID NO: 3572865 - RNA, 16 nt, Pseudomonas putida KT2440
gcucgucgagcaacuu

SEQ ID NO: 3572866 - RNA, 22 nt, Pseudomonas putida KT2440
gcucguugaacacauccucaaa

SEQ ID NO: 3572867 - RNA, 21 nt, Pseudomonas putida KT2440
gcucguugaugaugcgcaccg

SEQ ID NO: 3572868 - RNA, 15 nt, Pseudomonas putida KT2440
gcucguugcugagca

SEQ ID NO: 3572869 - RNA, 15 nt, Pseudomonas putida KT2440
gcucguuguccagca

SEQ ID NO: 3572870 - RNA, 15 nt, Pseudomonas putida KT2440
gcucuaaaucgaccu

SEQ ID NO: 3572871 - RNA, 16 nt, Pseudomonas putida KT2440
gcucuaaaucgaccug

SEQ ID NO: 3572872 - RNA, 20 nt, Pseudomonas putida KT2440
gcucucaacguucauccccu

SEQ ID NO: 3572873 - RNA, 15 nt, Pseudomonas putida KT2440
gcucucacagggacc

SEQ ID NO: 3572874 - RNA, 13 nt, Pseudomonas putida KT2440
gcucuccagcagg

SEQ ID NO: 3572875 - RNA, 17 nt, Pseudomonas putida KT2440
gcucuccagcagguuca

SEQ ID NO: 3572876 - RNA, 14 nt, Pseudomonas putida KT2440
gcucuccagccgcu

SEQ ID NO: 3572877 - RNA, 18 nt, Pseudomonas putida KT2440
gcucuccagccgcugcug

SEQ ID NO: 3572878 - RNA, 14 nt, Pseudomonas putida KT2440
gcucuccagcgaug

SEQ ID NO: 3572879 - RNA, 14 nt, Pseudomonas putida KT2440
gcucuccucuccca

SEQ ID NO: 3572880 - RNA, 13 nt, Pseudomonas putida KT2440
gcucuccuuuuuu

SEQ ID NO: 3572881 - RNA, 21 nt, Pseudomonas putida KT2440
gcucucgucgguuuccucgac

SEQ ID NO: 3572882 - RNA, 22 nt, Pseudomonas putida KT2440
gcucugacauaacaagaacaac

SEQ ID NO: 3572883 - RNA, 17 nt, Pseudomonas putida KT2440
gcucugcaaugccgcca

SEQ ID NO: 3572884 - RNA, 18 nt, Pseudomonas putida KT2440
gcucugcaggcacacccg

SEQ ID NO: 3572885 - RNA, 23 nt, Pseudomonas putida KT2440
gcucugcaggcacacccggaccc

SEQ ID NO: 3572886 - RNA, 23 nt, Pseudomonas putida KT2440
gcucugcccgcgccacccgcugg

SEQ ID NO: 3572887 - RNA, 14 nt, Pseudomonas putida KT2440
gcucugcgccagca

SEQ ID NO: 3572888 - RNA, 21 nt, Pseudomonas putida KT2440
gcucugcggcccauucgcggg

SEQ ID NO: 3572889 - RNA, 21 nt, Pseudomonas putida KT2440
gcucugcuccagcugcucgua

SEQ ID NO: 3572890 - RNA, 23 nt, Pseudomonas putida KT2440
gcucugcuugagcgcagcgacga

SEQ ID NO: 3572891 - RNA, 16 nt, Pseudomonas putida KT2440
gcucuggcccgaacag

SEQ ID NO: 3572892 - RNA, 17 nt, Pseudomonas putida KT2440
gcucuggcccgaacagc

SEQ ID NO: 3572893 - RNA, 16 nt, Pseudomonas putida KT2440
gcucuggcugagcgca

SEQ ID NO: 3572894 - RNA, 23 nt, Pseudomonas putida KT2440
gcucuggucgaucuucagcgcau

SEQ ID NO: 3572895 - RNA, 14 nt, Pseudomonas putida KT2440
gcucuguaucgaac

SEQ ID NO: 3572896 - RNA, 18 nt, Pseudomonas putida KT2440
gcucuguaucgaacaggc

SEQ ID NO: 3572897 - RNA, 19 nt, Pseudomonas putida KT2440
gcucuguaucgaacaggca

SEQ ID NO: 3572898 - RNA, 20 nt, Pseudomonas putida KT2440
gcucuguaucgaacaggcag

SEQ ID NO: 3572899 - RNA, 17 nt, Pseudomonas putida KT2440
gcucugugcaugcgccc

SEQ ID NO: 3572900 - RNA, 12 nt, Pseudomonas putida KT2440
gcucuguggauu

SEQ ID NO: 3572901 - RNA, 15 nt, Pseudomonas putida KT2440
gcucuguggauuuca

SEQ ID NO: 3572902 - RNA, 14 nt, Pseudomonas putida KT2440
gcucuguucgcugg

SEQ ID NO: 3572903 - RNA, 19 nt, Pseudomonas putida KT2440
gcucuguuucugccccugg

SEQ ID NO: 3572904 - RNA, 21 nt, Pseudomonas putida KT2440
gcucuguuucugccccuggcc

SEQ ID NO: 3572905 - RNA, 20 nt, Pseudomonas putida KT2440
gcucuucaacaccagcaugu

SEQ ID NO: 3572906 - RNA, 23 nt, Pseudomonas putida KT2440
gcucuucaaccaguucagcgccc

SEQ ID NO: 3572907 - RNA, 23 nt, Pseudomonas putida KT2440
gcucuucaccugaccauuggcca

SEQ ID NO: 3572908 - RNA, 13 nt, Pseudomonas putida KT2440
gcucuucaucgcg

SEQ ID NO: 3572909 - RNA, 16 nt, Pseudomonas putida KT2440
gcucuucaucgcggua

SEQ ID NO: 3572910 - RNA, 22 nt, Pseudomonas putida KT2440
gcucuucgacacugaucucgcg

SEQ ID NO: 3572911 - RNA, 24 nt, Pseudomonas putida KT2440
gcucuucgacacugaucucgcgca

SEQ ID NO: 3572912 - RNA, 21 nt, Pseudomonas putida KT2440
gcucuucgaguuuggccagcc

SEQ ID NO: 3572913 - RNA, 14 nt, Pseudomonas putida KT2440
gcucuucgaucucu

SEQ ID NO: 3572914 - RNA, 12 nt, Pseudomonas putida KT2440
gcucuucgcggg

SEQ ID NO: 3572915 - RNA, 15 nt, Pseudomonas putida KT2440
gcucuucgcggguga

SEQ ID NO: 3572916 - RNA, 23 nt, Pseudomonas putida KT2440
gcucuugaacugggcauccagcu

SEQ ID NO: 3572917 - RNA, 18 nt, Pseudomonas putida KT2440
gcucuuugggggugcuga

SEQ ID NO: 3572918 - RNA, 16 nt, Pseudomonas putida KT2440
gcugaaaccgcgaauc

SEQ ID NO: 3572919 - RNA, 22 nt, Pseudomonas putida KT2440
gcugaacaacuccgggugcucc

SEQ ID NO: 3572920 - RNA, 16 nt, Pseudomonas putida KT2440
gcugaacacgcagguc

SEQ ID NO: 3572921 - RNA, 14 nt, Pseudomonas putida KT2440
gcugaacagccggc

SEQ ID NO: 3572922 - RNA, 15 nt, Pseudomonas putida KT2440
gcugaaccugaccuu

SEQ ID NO: 3572923 - RNA, 20 nt, Pseudomonas putida KT2440
gcugaaccugaccuugcugc

SEQ ID NO: 3572924 - RNA, 22 nt, Pseudomonas putida KT2440
gcugaaccugaccuugcugcuc

SEQ ID NO: 3572925 - RNA, 18 nt, Pseudomonas putida KT2440
gcugaacuucaaccgcac

SEQ ID NO: 3572926 - RNA, 18 nt, Pseudomonas putida KT2440
gcugaacuuccaggucgg

SEQ ID NO: 3572927 - RNA, 19 nt, Pseudomonas putida KT2440
gcugaagaagcuaccccac

SEQ ID NO: 3572928 - RNA, 15 nt, Pseudomonas putida KT2440
gcugaagucauacca

SEQ ID NO: 3572929 - RNA, 16 nt, Pseudomonas putida KT2440
gcugaagugccaaggc

SEQ ID NO: 3572930 - RNA, 18 nt, Pseudomonas putida KT2440
gcugaaugcggaaaaggc

SEQ ID NO: 3572931 - RNA, 16 nt, Pseudomonas putida KT2440
gcugaccacaaagccu

SEQ ID NO: 3572932 - RNA, 14 nt, Pseudomonas putida KT2440
gcugaccaccgugc

SEQ ID NO: 3572933 - RNA, 21 nt, Pseudomonas putida KT2440
gcugaccacgccgaagcgcgc

SEQ ID NO: 3572934 - RNA, 22 nt, Pseudomonas putida KT2440
gcugaccacgccgaagcgcgcc

SEQ ID NO: 3572935 - RNA, 17 nt, Pseudomonas putida KT2440
gcugaccagugucugca

SEQ ID NO: 3572936 - RNA, 19 nt, Pseudomonas putida KT2440
gcugaccggcacgggauca

SEQ ID NO: 3572937 - RNA, 14 nt, Pseudomonas putida KT2440
gcugaccgggucga

SEQ ID NO: 3572938 - RNA, 22 nt, Pseudomonas putida KT2440
gcugaccgggucgacgcgcaag

SEQ ID NO: 3572939 - RNA, 18 nt, Pseudomonas putida KT2440
gcugaccucgacccgccc

SEQ ID NO: 3572940 - RNA, 18 nt, Pseudomonas putida KT2440
gcugacguugucauggcu

SEQ ID NO: 3572941 - RNA, 12 nt, Pseudomonas putida KT2440
gcugacugccag

SEQ ID NO: 3572942 - RNA, 19 nt, Pseudomonas putida KT2440
gcugacuuccagcagcaca

SEQ ID NO: 3572943 - RNA, 14 nt, Pseudomonas putida KT2440
gcugagcgccaucc

SEQ ID NO: 3572944 - RNA, 19 nt, Pseudomonas putida KT2440
gcugagcuugacuuccagc

SEQ ID NO: 3572945 - RNA, 20 nt, Pseudomonas putida KT2440
gcugagcuugacuuccagcu

SEQ ID NO: 3572946 - RNA, 20 nt, Pseudomonas putida KT2440
gcugaggaaguuguccgggu

SEQ ID NO: 3572947 - RNA, 14 nt, Pseudomonas putida KT2440
gcugauaaccugca

SEQ ID NO: 3572948 - RNA, 15 nt, Pseudomonas putida KT2440
gcugauaaccugcau

SEQ ID NO: 3572949 - RNA, 21 nt, Pseudomonas putida KT2440
gcugauacgagucauccucac

SEQ ID NO: 3572950 - RNA, 17 nt, Pseudomonas putida KT2440
gcugauagccgccagca

SEQ ID NO: 3572951 - RNA, 15 nt, Pseudomonas putida KT2440
gcugaucaagcccgc

SEQ ID NO: 3572952 - RNA, 16 nt, Pseudomonas putida KT2440
gcugaucaagcccgcu

SEQ ID NO: 3572953 - RNA, 15 nt, Pseudomonas putida KT2440
gcugaucaccgccgc

SEQ ID NO: 3572954 - RNA, 16 nt, Pseudomonas putida KT2440
gcugaucagcuggucg

SEQ ID NO: 3572955 - RNA, 17 nt, Pseudomonas putida KT2440
gcugaucgaaagcugcg

SEQ ID NO: 3572956 - RNA, 18 nt, Pseudomonas putida KT2440
gcugaucgaaagcugcgc

SEQ ID NO: 3572957 - RNA, 22 nt, Pseudomonas putida KT2440
gcugaucgccgucgaccaggca

SEQ ID NO: 3572958 - RNA, 13 nt, Pseudomonas putida KT2440
gcugaucgcgggu

SEQ ID NO: 3572959 - RNA, 18 nt, Pseudomonas putida KT2440
gcugaucucuucagccac

SEQ ID NO: 3572960 - RNA, 19 nt, Pseudomonas putida KT2440
gcugaugaagccacgcucg

SEQ ID NO: 3572961 - RNA, 15 nt, Pseudomonas putida KT2440
gcugaugcgcuggcc

SEQ ID NO: 3572962 - RNA, 18 nt, Pseudomonas putida KT2440
gcugaugcgcuggcccuu

SEQ ID NO: 3572963 - RNA, 18 nt, Pseudomonas putida KT2440
gcugaugcgggaccagca

SEQ ID NO: 3572964 - RNA, 22 nt, Pseudomonas putida KT2440
gcugaugcgggaccagcaccac

SEQ ID NO: 3572965 - RNA, 23 nt, Pseudomonas putida KT2440
gcugaugcgguagugcaggcgau

SEQ ID NO: 3572966 - RNA, 22 nt, Pseudomonas putida KT2440
gcugaugcucaagcgccagggc

SEQ ID NO: 3572967 - RNA, 13 nt, Pseudomonas putida KT2440
gcugauggugguc

SEQ ID NO: 3572968 - RNA, 20 nt, Pseudomonas putida KT2440
gcugaugguggucggcagcu

SEQ ID NO: 3572969 - RNA, 17 nt, Pseudomonas putida KT2440
gcugauggugucuucca

SEQ ID NO: 3572970 - RNA, 13 nt, Pseudomonas putida KT2440
gcugauguugaug

SEQ ID NO: 3572971 - RNA, 17 nt, Pseudomonas putida KT2440
gcugauguuggccauca

SEQ ID NO: 3572972 - RNA, 14 nt, Pseudomonas putida KT2440
gcugauucaacgcc

SEQ ID NO: 3572973 - RNA, 18 nt, Pseudomonas putida KT2440
gcugauugagcagcuggg

SEQ ID NO: 3572974 - RNA, 18 nt, Pseudomonas putida KT2440
gcugcaaagcagacccag

SEQ ID NO: 3572975 - RNA, 15 nt, Pseudomonas putida KT2440
gcugcaaagcagccc

SEQ ID NO: 3572976 - RNA, 16 nt, Pseudomonas putida KT2440
gcugcaaagcagcccc

SEQ ID NO: 3572977 - RNA, 21 nt, Pseudomonas putida KT2440
gcugcaaagcagccccaaaag

SEQ ID NO: 3572978 - RNA, 19 nt, Pseudomonas putida KT2440
gcugcaaagcagccccagg

SEQ ID NO: 3572979 - RNA, 22 nt, Pseudomonas putida KT2440
gcugcaaagcagccccggcaau

SEQ ID NO: 3572980 - RNA, 16 nt, Pseudomonas putida KT2440
gcugcaaagcgggcaa

SEQ ID NO: 3572981 - RNA, 19 nt, Pseudomonas putida KT2440
gcugcaaaugggucgcgaa

SEQ ID NO: 3572982 - RNA, 20 nt, Pseudomonas putida KT2440
gcugcaacacgucauacagc

SEQ ID NO: 3572983 - RNA, 12 nt, Pseudomonas putida KT2440
gcugcaacagcg

SEQ ID NO: 3572984 - RNA, 19 nt, Pseudomonas putida KT2440
gcugcaacagcucauccag

SEQ ID NO: 3572985 - RNA, 22 nt, Pseudomonas putida KT2440
gcugcaacagcucauccaggcu

SEQ ID NO: 3572986 - RNA, 21 nt, Pseudomonas putida KT2440
gcugcaacagcuccagcaacu

SEQ ID NO: 3572987 - RNA, 21 nt, Pseudomonas putida KT2440
gcugcaacgaaaaaaagggca

SEQ ID NO: 3572988 - RNA, 19 nt, Pseudomonas putida KT2440
gcugcaagcgcaccugcag

SEQ ID NO: 3572989 - RNA, 13 nt, Pseudomonas putida KT2440
gcugcaaggcagc

SEQ ID NO: 3572990 - RNA, 23 nt, Pseudomonas putida KT2440
gcugcaagguccaggcgugggua

SEQ ID NO: 3572991 - RNA, 20 nt, Pseudomonas putida KT2440
gcugcaagguguuggucagg

SEQ ID NO: 3572992 - RNA, 21 nt, Pseudomonas putida KT2440
gcugcaaucgagccgaacagc

SEQ ID NO: 3572993 - RNA, 22 nt, Pseudomonas putida KT2440
gcugcaaucgagccgaacagca

SEQ ID NO: 3572994 - RNA, 23 nt, Pseudomonas putida KT2440
gcugcaaucgagccgaacagcag

SEQ ID NO: 3572995 - RNA, 17 nt, Pseudomonas putida KT2440
gcugcacaggccagccc

SEQ ID NO: 3572996 - RNA, 18 nt, Pseudomonas putida KT2440
gcugcacaggccagcccc

SEQ ID NO: 3572997 - RNA, 17 nt, Pseudomonas putida KT2440
gcugcacaucuccacug

SEQ ID NO: 3572998 - RNA, 18 nt, Pseudomonas putida KT2440
gcugcaccaccugcuccu

SEQ ID NO: 3572999 - RNA, 17 nt, Pseudomonas putida KT2440
gcugcaccgaccgugca

SEQ ID NO: 3573000 - RNA, 21 nt, Pseudomonas putida KT2440
gcugcaccggccucuucgcgg

SEQ ID NO: 3573001 - RNA, 22 nt, Pseudomonas putida KT2440
gcugcaccggccucuucgcggg

SEQ ID NO: 3573002 - RNA, 21 nt, Pseudomonas putida KT2440
gcugcacgucgcgcagggccu

SEQ ID NO: 3573003 - RNA, 22 nt, Pseudomonas putida KT2440
gcugcacugccgcauucgcggg

SEQ ID NO: 3573004 - RNA, 15 nt, Pseudomonas putida KT2440
gcugcacuggcaugc

SEQ ID NO: 3573005 - RNA, 12 nt, Pseudomonas putida KT2440
gcugcacuggcg

SEQ ID NO: 3573006 - RNA, 18 nt, Pseudomonas putida KT2440
gcugcacugggcgauggc

SEQ ID NO: 3573007 - RNA, 18 nt, Pseudomonas putida KT2440
gcugcacuuccacacccg

SEQ ID NO: 3573008 - RNA, 14 nt, Pseudomonas putida KT2440
gcugcagacccgcg

SEQ ID NO: 3573009 - RNA, 15 nt, Pseudomonas putida KT2440
gcugcagacccgcga

SEQ ID NO: 3573010 - RNA, 14 nt, Pseudomonas putida KT2440
gcugcagcacugcc

SEQ ID NO: 3573011 - RNA, 22 nt, Pseudomonas putida KT2440
gcugcagcagcuuccugugccg

SEQ ID NO: 3573012 - RNA, 15 nt, Pseudomonas putida KT2440
gcugcagcaggcugg

SEQ ID NO: 3573013 - RNA, 16 nt, Pseudomonas putida KT2440
gcugcagcaggcuggc

SEQ ID NO: 3573014 - RNA, 21 nt, Pseudomonas putida KT2440
gcugcagcgucgccucggggu

SEQ ID NO: 3573015 - RNA, 22 nt, Pseudomonas putida KT2440
gcugcaggcucugaaugucagc

SEQ ID NO: 3573016 - RNA, 12 nt, Pseudomonas putida KT2440
gcugcagggcac

SEQ ID NO: 3573017 - RNA, 20 nt, Pseudomonas putida KT2440
gcugcagggcacgccaauca

SEQ ID NO: 3573018 - RNA, 18 nt, Pseudomonas putida KT2440
gcugcagggcccagccac

SEQ ID NO: 3573019 - RNA, 20 nt, Pseudomonas putida KT2440
gcugcagggcccagccaccg

SEQ ID NO: 3573020 - RNA, 21 nt, Pseudomonas putida KT2440
gcugcagggcccagccaccga

SEQ ID NO: 3573021 - RNA, 16 nt, Pseudomonas putida KT2440
gcugcaggucggccag

SEQ ID NO: 3573022 - RNA, 17 nt, Pseudomonas putida KT2440
gcugcaggucggccagc

SEQ ID NO: 3573023 - RNA, 18 nt, Pseudomonas putida KT2440
gcugcaggucggccagcu

SEQ ID NO: 3573024 - RNA, 21 nt, Pseudomonas putida KT2440
gcugcagguucugaaucuggc

SEQ ID NO: 3573025 - RNA, 22 nt, Pseudomonas putida KT2440
gcugcaguagucgccaggccgu

SEQ ID NO: 3573026 - RNA, 17 nt, Pseudomonas putida KT2440
gcugcagugcugggcau

SEQ ID NO: 3573027 - RNA, 16 nt, Pseudomonas putida KT2440
gcugcauauaccgcgc

SEQ ID NO: 3573028 - RNA, 17 nt, Pseudomonas putida KT2440
gcugcauauaccgcgca

SEQ ID NO: 3573029 - RNA, 15 nt, Pseudomonas putida KT2440
gcugcauaugggcga

SEQ ID NO: 3573030 - RNA, 21 nt, Pseudomonas putida KT2440
gcugcauuggcggcaggcgca

SEQ ID NO: 3573031 - RNA, 23 nt, Pseudomonas putida KT2440
gcugcauuggcggcaggcgcagc

SEQ ID NO: 3573032 - RNA, 24 nt, Pseudomonas putida KT2440
gcugcauuggcggcaggcgcagcu

SEQ ID NO: 3573033 - RNA, 20 nt, Pseudomonas putida KT2440
gcugccaaaccgccccacca

SEQ ID NO: 3573034 - RNA, 14 nt, Pseudomonas putida KT2440
gcugccaaccggcu

SEQ ID NO: 3573035 - RNA, 18 nt, Pseudomonas putida KT2440
gcugccaccuuccagguc

SEQ ID NO: 3573036 - RNA, 14 nt, Pseudomonas putida KT2440
gcugccacgggcau

SEQ ID NO: 3573037 - RNA, 12 nt, Pseudomonas putida KT2440
gcugccacugcg

SEQ ID NO: 3573038 - RNA, 13 nt, Pseudomonas putida KT2440
gcugccagcaggg

SEQ ID NO: 3573039 - RNA, 16 nt, Pseudomonas putida KT2440
gcugccagcagggcag

SEQ ID NO: 3573040 - RNA, 17 nt, Pseudomonas putida KT2440
gcugccagcagggcagg

SEQ ID NO: 3573041 - RNA, 12 nt, Pseudomonas putida KT2440
gcugccagcgcg

SEQ ID NO: 3573042 - RNA, 18 nt, Pseudomonas putida KT2440
gcugccagcguuuccggg

SEQ ID NO: 3573043 - RNA, 13 nt, Pseudomonas putida KT2440
gcugccaggccgc

SEQ ID NO: 3573044 - RNA, 20 nt, Pseudomonas putida KT2440
gcugccauagcgcugcaccg

SEQ ID NO: 3573045 - RNA, 15 nt, Pseudomonas putida KT2440
gcugccaugcaaggc

SEQ ID NO: 3573046 - RNA, 17 nt, Pseudomonas putida KT2440
gcugccaugcaaggcaa

SEQ ID NO: 3573047 - RNA, 21 nt, Pseudomonas putida KT2440
gcugccauuucuucagcagga

SEQ ID NO: 3573048 - RNA, 23 nt, Pseudomonas putida KT2440
gcugccauuucuucagcaggaag

SEQ ID NO: 3573049 - RNA, 14 nt, Pseudomonas putida KT2440
gcugcccaacgccu

SEQ ID NO: 3573050 - RNA, 19 nt, Pseudomonas putida KT2440
gcugcccaacgccugaagc

SEQ ID NO: 3573051 - RNA, 21 nt, Pseudomonas putida KT2440
gcugcccaaguacaccggcag

SEQ ID NO: 3573052 - RNA, 23 nt, Pseudomonas putida KT2440
gcugcccagcgaauagcaacaca

SEQ ID NO: 3573053 - RNA, 14 nt, Pseudomonas putida KT2440
gcugcccaggugcc

SEQ ID NO: 3573054 - RNA, 15 nt, Pseudomonas putida KT2440
gcugcccaggugcca

SEQ ID NO: 3573055 - RNA, 16 nt, Pseudomonas putida KT2440
gcugcccaggugccag

SEQ ID NO: 3573056 - RNA, 17 nt, Pseudomonas putida KT2440
gcugcccaggugccagg

SEQ ID NO: 3573057 - RNA, 21 nt, Pseudomonas putida KT2440
gcugcccaggugccaggcuca

SEQ ID NO: 3573058 - RNA, 20 nt, Pseudomonas putida KT2440
gcugccccaacugcauccgc

SEQ ID NO: 3573059 - RNA, 15 nt, Pseudomonas putida KT2440
gcugccccaagugcc

SEQ ID NO: 3573060 - RNA, 15 nt, Pseudomonas putida KT2440
gcugcccgcgugcgc

SEQ ID NO: 3573061 - RNA, 17 nt, Pseudomonas putida KT2440
gcugcccggugccgcgc

SEQ ID NO: 3573062 - RNA, 22 nt, Pseudomonas putida KT2440
gcugcccguccggcaugcgccg

SEQ ID NO: 3573063 - RNA, 15 nt, Pseudomonas putida KT2440
gcugcccgugcuguc

SEQ ID NO: 3573064 - RNA, 17 nt, Pseudomonas putida KT2440
gcugcccgugcugucgg

SEQ ID NO: 3573065 - RNA, 18 nt, Pseudomonas putida KT2440
gcugcccguugcgcauca

SEQ ID NO: 3573066 - RNA, 16 nt, Pseudomonas putida KT2440
gcugcccucgggcagc

SEQ ID NO: 3573067 - RNA, 19 nt, Pseudomonas putida KT2440
gcugcccucgggcagccuu

SEQ ID NO: 3573068 - RNA, 13 nt, Pseudomonas putida KT2440
gcugccgaccugc

SEQ ID NO: 3573069 - RNA, 17 nt, Pseudomonas putida KT2440
gcugccgaccugcgccg

SEQ ID NO: 3573070 - RNA, 23 nt, Pseudomonas putida KT2440
gcugccgaucagcacgccgccga

SEQ ID NO: 3573071 - RNA, 14 nt, Pseudomonas putida KT2440
gcugccgcaccugc

SEQ ID NO: 3573072 - RNA, 20 nt, Pseudomonas putida KT2440
gcugccgcccucuugcugca

SEQ ID NO: 3573073 - RNA, 22 nt, Pseudomonas putida KT2440
gcugccgccgaacauggugcuu

SEQ ID NO: 3573074 - RNA, 15 nt, Pseudomonas putida KT2440
gcugccgcgcagccc

SEQ ID NO: 3573075 - RNA, 18 nt, Pseudomonas putida KT2440
gcugccgcguucacaucg

SEQ ID NO: 3573076 - RNA, 21 nt, Pseudomonas putida KT2440
gcugccggaacguuuccagca

SEQ ID NO: 3573077 - RNA, 15 nt, Pseudomonas putida KT2440
gcugccggaccugcc

SEQ ID NO: 3573078 - RNA, 20 nt, Pseudomonas putida KT2440
gcugccggaccugccgcagc

SEQ ID NO: 3573079 - RNA, 14 nt, Pseudomonas putida KT2440
gcugccggccagcg

SEQ ID NO: 3573080 - RNA, 16 nt, Pseudomonas putida KT2440
gcugccggccagcgcc

SEQ ID NO: 3573081 - RNA, 17 nt, Pseudomonas putida KT2440
gcugccggccagcgccu

SEQ ID NO: 3573082 - RNA, 14 nt, Pseudomonas putida KT2440
gcugccggucggcc

SEQ ID NO: 3573083 - RNA, 18 nt, Pseudomonas putida KT2440
gcugccggucggccugca

SEQ ID NO: 3573084 - RNA, 20 nt, Pseudomonas putida KT2440
gcugccggucguagcgucuc

SEQ ID NO: 3573085 - RNA, 15 nt, Pseudomonas putida KT2440
gcugccgucucguca

SEQ ID NO: 3573086 - RNA, 22 nt, Pseudomonas putida KT2440
gcugccugugccggccucuucg

SEQ ID NO: 3573087 - RNA, 13 nt, Pseudomonas putida KT2440
gcugccuuccaac

SEQ ID NO: 3573088 - RNA, 22 nt, Pseudomonas putida KT2440
gcugccuucccgucgagccggg

SEQ ID NO: 3573089 - RNA, 20 nt, Pseudomonas putida KT2440
gcugccuucgcucaggugca

SEQ ID NO: 3573090 - RNA, 21 nt, Pseudomonas putida KT2440
gcugccuucucuguguucuuc

SEQ ID NO: 3573091 - RNA, 12 nt, Pseudomonas putida KT2440
gcugccuugccc

SEQ ID NO: 3573092 - RNA, 16 nt, Pseudomonas putida KT2440
gcugccuugcccagcu

SEQ ID NO: 3573093 - RNA, 22 nt, Pseudomonas putida KT2440
gcugccuugcccagcuccagca

SEQ ID NO: 3573094 - RNA, 17 nt, Pseudomonas putida KT2440
gcugccuuuggccgcca

SEQ ID NO: 3573095 - RNA, 19 nt, Pseudomonas putida KT2440
gcugccuuuuccugcugca

SEQ ID NO: 3573096 - RNA, 20 nt, Pseudomonas putida KT2440
gcugccuuuuccugcugcaa

SEQ ID NO: 3573097 - RNA, 18 nt, Pseudomonas putida KT2440
gcugcgaaugggcugcaa

SEQ ID NO: 3573098 - RNA, 19 nt, Pseudomonas putida KT2440
gcugcgaaugggcugcaaa

SEQ ID NO: 3573099 - RNA, 15 nt, Pseudomonas putida KT2440
gcugcgacacgcgaa

SEQ ID NO: 3573100 - RNA, 17 nt, Pseudomonas putida KT2440
gcugcgaggaucagcgc

SEQ ID NO: 3573101 - RNA, 19 nt, Pseudomonas putida KT2440
gcugcgaggaucagcgcau

SEQ ID NO: 3573102 - RNA, 18 nt, Pseudomonas putida KT2440
gcugcgaguucaggcgcc

SEQ ID NO: 3573103 - RNA, 22 nt, Pseudomonas putida KT2440
gcugcgaguucaggcgcccugc

SEQ ID NO: 3573104 - RNA, 20 nt, Pseudomonas putida KT2440
gcugcgauagaacuccacca

SEQ ID NO: 3573105 - RNA, 21 nt, Pseudomonas putida KT2440
gcugcgauagaacuccaccag

SEQ ID NO: 3573106 - RNA, 23 nt, Pseudomonas putida KT2440
gcugcgauagaacuccaccagcc

SEQ ID NO: 3573107 - RNA, 22 nt, Pseudomonas putida KT2440
gcugcgcaaggcauucagcucg

SEQ ID NO: 3573108 - RNA, 15 nt, Pseudomonas putida KT2440
gcugcgcaaggcgag

SEQ ID NO: 3573109 - RNA, 14 nt, Pseudomonas putida KT2440
gcugcgcacgcagg

SEQ ID NO: 3573110 - RNA, 14 nt, Pseudomonas putida KT2440
gcugcgcacguagc

SEQ ID NO: 3573111 - RNA, 13 nt, Pseudomonas putida KT2440
gcugcgcagccca

SEQ ID NO: 3573112 - RNA, 20 nt, Pseudomonas putida KT2440
gcugcgcagcccauucgcgg

SEQ ID NO: 3573113 - RNA, 15 nt, Pseudomonas putida KT2440
gcugcgcagcccugu

SEQ ID NO: 3573114 - RNA, 16 nt, Pseudomonas putida KT2440
gcugcgcagcuggucg

SEQ ID NO: 3573115 - RNA, 14 nt, Pseudomonas putida KT2440
gcugcgcagguugg

SEQ ID NO: 3573116 - RNA, 23 nt, Pseudomonas putida KT2440
gcugcgcagguuggugcaauugc

SEQ ID NO: 3573117 - RNA, 19 nt, Pseudomonas putida KT2440
gcugcgcaucacccgcccc

SEQ ID NO: 3573118 - RNA, 23 nt, Pseudomonas putida KT2440
gcugcgcaucaggcugcgcccgc

SEQ ID NO: 3573119 - RNA, 14 nt, Pseudomonas putida KT2440
gcugcgcccgccuu

SEQ ID NO: 3573120 - RNA, 17 nt, Pseudomonas putida KT2440
gcugcgcccuuugcggg

SEQ ID NO: 3573121 - RNA, 15 nt, Pseudomonas putida KT2440
gcugcgccgcucugc

SEQ ID NO: 3573122 - RNA, 23 nt, Pseudomonas putida KT2440
gcugcgccgguguucgcgggcau

SEQ ID NO: 3573123 - RNA, 14 nt, Pseudomonas putida KT2440
gcugcgccucgcag

SEQ ID NO: 3573124 - RNA, 17 nt, Pseudomonas putida KT2440
gcugcgccucgcaggua

SEQ ID NO: 3573125 - RNA, 23 nt, Pseudomonas putida KT2440
gcugcgcgaaguggauauccagc

SEQ ID NO: 3573126 - RNA, 18 nt, Pseudomonas putida KT2440
gcugcgcgauucggggau

SEQ ID NO: 3573127 - RNA, 15 nt, Pseudomonas putida KT2440
gcugcgcgccauggc

SEQ ID NO: 3573128 - RNA, 18 nt, Pseudomonas putida KT2440
gcugcgcgccauggcgac

SEQ ID NO: 3573129 - RNA, 23 nt, Pseudomonas putida KT2440
gcugcgcgcgagagcgacgcgcu

SEQ ID NO: 3573130 - RNA, 16 nt, Pseudomonas putida KT2440
gcugcgcggcagcccu

SEQ ID NO: 3573131 - RNA, 18 nt, Pseudomonas putida KT2440
gcugcgcggcagcccuuc

SEQ ID NO: 3573132 - RNA, 21 nt, Pseudomonas putida KT2440
gcugcgcggcagcccuucgcg

SEQ ID NO: 3573133 - RNA, 22 nt, Pseudomonas putida KT2440
gcugcgcggcagcccuucgcgg

SEQ ID NO: 3573134 - RNA, 23 nt, Pseudomonas putida KT2440
gcugcgcggcagcccuucgcggg

SEQ ID NO: 3573135 - RNA, 12 nt, Pseudomonas putida KT2440
gcugcgcggguu

SEQ ID NO: 3573136 - RNA, 14 nt, Pseudomonas putida KT2440
gcugcgcugccugc

SEQ ID NO: 3573137 - RNA, 14 nt, Pseudomonas putida KT2440
gcugcgcuggccaa

SEQ ID NO: 3573138 - RNA, 16 nt, Pseudomonas putida KT2440
gcugcggauacagcgc

SEQ ID NO: 3573139 - RNA, 17 nt, Pseudomonas putida KT2440
gcugcggauacagcgcc

SEQ ID NO: 3573140 - RNA, 18 nt, Pseudomonas putida KT2440
gcugcggauacagcgccc

SEQ ID NO: 3573141 - RNA, 15 nt, Pseudomonas putida KT2440
gcugcggcaggcugg

SEQ ID NO: 3573142 - RNA, 19 nt, Pseudomonas putida KT2440
gcugcggcaggcuggcacg

SEQ ID NO: 3573143 - RNA, 15 nt, Pseudomonas putida KT2440
gcugcggcagguagg

SEQ ID NO: 3573144 - RNA, 21 nt, Pseudomonas putida KT2440
gcugcggcagguaggcccagc

SEQ ID NO: 3573145 - RNA, 14 nt, Pseudomonas putida KT2440
gcugcggccaccgc

SEQ ID NO: 3573146 - RNA, 18 nt, Pseudomonas putida KT2440
gcugcggcgaaagccagc

SEQ ID NO: 3573147 - RNA, 19 nt, Pseudomonas putida KT2440
gcugcggcgaaagccagca

SEQ ID NO: 3573148 - RNA, 13 nt, Pseudomonas putida KT2440
gcugcggcugcuc

SEQ ID NO: 3573149 - RNA, 15 nt, Pseudomonas putida KT2440
gcugcggggcagccc

SEQ ID NO: 3573150 - RNA, 17 nt, Pseudomonas putida KT2440
gcugcggggugcucugc

SEQ ID NO: 3573151 - RNA, 20 nt, Pseudomonas putida KT2440
gcugcgggugcccgggcuuu

SEQ ID NO: 3573152 - RNA, 15 nt, Pseudomonas putida KT2440
gcugcgguaccggcc

SEQ ID NO: 3573153 - RNA, 17 nt, Pseudomonas putida KT2440
gcugcgguaccggccag

SEQ ID NO: 3573154 - RNA, 18 nt, Pseudomonas putida KT2440
gcugcgguaccggccagc

SEQ ID NO: 3573155 - RNA, 15 nt, Pseudomonas putida KT2440
gcugcgguagcgcag

SEQ ID NO: 3573156 - RNA, 17 nt, Pseudomonas putida KT2440
gcugcggucaucaccac

SEQ ID NO: 3573157 - RNA, 20 nt, Pseudomonas putida KT2440
gcugcggucaucaccacccc

SEQ ID NO: 3573158 - RNA, 19 nt, Pseudomonas putida KT2440
gcugcgguuugcucugaca

SEQ ID NO: 3573159 - RNA, 18 nt, Pseudomonas putida KT2440
gcugcguacgcucugguc

SEQ ID NO: 3573160 - RNA, 15 nt, Pseudomonas putida KT2440
gcugcgucagcaucc

SEQ ID NO: 3573161 - RNA, 16 nt, Pseudomonas putida KT2440
gcugcgucagcaucca

SEQ ID NO: 3573162 - RNA, 15 nt, Pseudomonas putida KT2440
gcugcgucaggccau

SEQ ID NO: 3573163 - RNA, 18 nt, Pseudomonas putida KT2440
gcugcgucaggccaugcc

SEQ ID NO: 3573164 - RNA, 15 nt, Pseudomonas putida KT2440
gcugcgugccugcug

SEQ ID NO: 3573165 - RNA, 20 nt, Pseudomonas putida KT2440
gcugcgugccugcugcucgc

SEQ ID NO: 3573166 - RNA, 22 nt, Pseudomonas putida KT2440
gcugcguuuaccggcaccgccu

SEQ ID NO: 3573167 - RNA, 20 nt, Pseudomonas putida KT2440
gcugcucaccauguuccagu

SEQ ID NO: 3573168 - RNA, 15 nt, Pseudomonas putida KT2440
gcugcuccaugaucu

SEQ ID NO: 3573169 - RNA, 21 nt, Pseudomonas putida KT2440
gcugcuccaugaucucgcgcu

SEQ ID NO: 3573170 - RNA, 21 nt, Pseudomonas putida KT2440
gcugcuccccaaccaccuccc

SEQ ID NO: 3573171 - RNA, 17 nt, Pseudomonas putida KT2440
gcugcucguacgaguug

SEQ ID NO: 3573172 - RNA, 15 nt, Pseudomonas putida KT2440
gcugcucugcaaugc

SEQ ID NO: 3573173 - RNA, 17 nt, Pseudomonas putida KT2440
gcugcugcagcacugcc

SEQ ID NO: 3573174 - RNA, 18 nt, Pseudomonas putida KT2440
gcugcugcagcacugccu

SEQ ID NO: 3573175 - RNA, 12 nt, Pseudomonas putida KT2440
gcugcugcaggg

SEQ ID NO: 3573176 - RNA, 15 nt, Pseudomonas putida KT2440
gcugcugcagggccc

SEQ ID NO: 3573177 - RNA, 14 nt, Pseudomonas putida KT2440
gcugcugccgcccc

SEQ ID NO: 3573178 - RNA, 12 nt, Pseudomonas putida KT2440
gcugcugcgcag

SEQ ID NO: 3573179 - RNA, 13 nt, Pseudomonas putida KT2440
gcugcugcgccuc

SEQ ID NO: 3573180 - RNA, 21 nt, Pseudomonas putida KT2440
gcugcugcucuuucggcagca

SEQ ID NO: 3573181 - RNA, 15 nt, Pseudomonas putida KT2440
gcugcuggcacgccu

SEQ ID NO: 3573182 - RNA, 17 nt, Pseudomonas putida KT2440
gcugcuggccgccagac

SEQ ID NO: 3573183 - RNA, 18 nt, Pseudomonas putida KT2440
gcugcuggccgccagaca

SEQ ID NO: 3573184 - RNA, 14 nt, Pseudomonas putida KT2440
gcugcuggccuugc

SEQ ID NO: 3573185 - RNA, 20 nt, Pseudomonas putida KT2440
gcugcugguacaugccgccg

SEQ ID NO: 3573186 - RNA, 21 nt, Pseudomonas putida KT2440
gcugcugguacaugccgccga

SEQ ID NO: 3573187 - RNA, 22 nt, Pseudomonas putida KT2440
gcugcugguacaugccgccgau

SEQ ID NO: 3573188 - RNA, 16 nt, Pseudomonas putida KT2440
gcugcugguccucgac

SEQ ID NO: 3573189 - RNA, 15 nt, Pseudomonas putida KT2440
gcugcugugcggcug

SEQ ID NO: 3573190 - RNA, 17 nt, Pseudomonas putida KT2440
gcugcugugcggcuggc

SEQ ID NO: 3573191 - RNA, 12 nt, Pseudomonas putida KT2440
gcugcuuaccag

SEQ ID NO: 3573192 - RNA, 19 nt, Pseudomonas putida KT2440
gcugcuuaccagcuuggcg

SEQ ID NO: 3573193 - RNA, 13 nt, Pseudomonas putida KT2440
gcugcuucacggg

SEQ ID NO: 3573194 - RNA, 21 nt, Pseudomonas putida KT2440
gcugcuucacgggucaugcca

SEQ ID NO: 3573195 - RNA, 17 nt, Pseudomonas putida KT2440
gcugcuuccggcuggua

SEQ ID NO: 3573196 - RNA, 22 nt, Pseudomonas putida KT2440
gcugcuugaacacauagaacag

SEQ ID NO: 3573197 - RNA, 14 nt, Pseudomonas putida KT2440
gcugcuuugcagcc

SEQ ID NO: 3573198 - RNA, 16 nt, Pseudomonas putida KT2440
gcugcuuugcagccca

SEQ ID NO: 3573199 - RNA, 16 nt, Pseudomonas putida KT2440
gcugcuuugcagcccu

SEQ ID NO: 3573200 - RNA, 21 nt, Pseudomonas putida KT2440
gcugcuuugcagcccuucgcg

SEQ ID NO: 3573201 - RNA, 18 nt, Pseudomonas putida KT2440
gcuggaaaaagaacagac

SEQ ID NO: 3573202 - RNA, 17 nt, Pseudomonas putida KT2440
gcuggaacugcugcacu

SEQ ID NO: 3573203 - RNA, 19 nt, Pseudomonas putida KT2440
gcuggaagcuucgcggaua

SEQ ID NO: 3573204 - RNA, 21 nt, Pseudomonas putida KT2440
gcuggacaccucccgcgcauc

SEQ ID NO: 3573205 - RNA, 18 nt, Pseudomonas putida KT2440
gcuggacagcggcagcau

SEQ ID NO: 3573206 - RNA, 16 nt, Pseudomonas putida KT2440
gcuggacaugcacgcc

SEQ ID NO: 3573207 - RNA, 17 nt, Pseudomonas putida KT2440
gcuggaccuggcuggcg

SEQ ID NO: 3573208 - RNA, 20 nt, Pseudomonas putida KT2440
gcuggacuaacaggugcuca

SEQ ID NO: 3573209 - RNA, 16 nt, Pseudomonas putida KT2440
gcuggacucgccgaga

SEQ ID NO: 3573210 - RNA, 22 nt, Pseudomonas putida KT2440
gcuggagcuauuuggcuccaac

SEQ ID NO: 3573211 - RNA, 12 nt, Pseudomonas putida KT2440
gcuggauaccca

SEQ ID NO: 3573212 - RNA, 15 nt, Pseudomonas putida KT2440
gcuggauacccagcg

SEQ ID NO: 3573213 - RNA, 12 nt, Pseudomonas putida KT2440
gcuggauagagu

SEQ ID NO: 3573214 - RNA, 13 nt, Pseudomonas putida KT2440
gcuggaucaccac

SEQ ID NO: 3573215 - RNA, 15 nt, Pseudomonas putida KT2440
gcuggaucaccaccg

SEQ ID NO: 3573216 - RNA, 20 nt, Pseudomonas putida KT2440
gcuggaucaccaccgucgaa

SEQ ID NO: 3573217 - RNA, 19 nt, Pseudomonas putida KT2440
gcuggaucagugucugcgc

SEQ ID NO: 3573218 - RNA, 15 nt, Pseudomonas putida KT2440
gcuggaugaagcccg

SEQ ID NO: 3573219 - RNA, 16 nt, Pseudomonas putida KT2440
gcuggauggucacgcc

SEQ ID NO: 3573220 - RNA, 18 nt, Pseudomonas putida KT2440
gcuggcaauccagcguga

SEQ ID NO: 3573221 - RNA, 15 nt, Pseudomonas putida KT2440
gcuggcaaugcaacu

SEQ ID NO: 3573222 - RNA, 17 nt, Pseudomonas putida KT2440
gcuggcacccgcaggac

SEQ ID NO: 3573223 - RNA, 15 nt, Pseudomonas putida KT2440
gcuggcacgccuuca

SEQ ID NO: 3573224 - RNA, 20 nt, Pseudomonas putida KT2440
gcuggcacgccuucagcagc

SEQ ID NO: 3573225 - RNA, 15 nt, Pseudomonas putida KT2440
gcuggcacgugcagg

SEQ ID NO: 3573226 - RNA, 19 nt, Pseudomonas putida KT2440
gcuggcacugcccaagcca

SEQ ID NO: 3573227 - RNA, 14 nt, Pseudomonas putida KT2440
gcuggcagcugcag

SEQ ID NO: 3573228 - RNA, 16 nt, Pseudomonas putida KT2440
gcuggcagcugcagug

SEQ ID NO: 3573229 - RNA, 21 nt, Pseudomonas putida KT2440
gcuggcagcugcagugcuggg

SEQ ID NO: 3573230 - RNA, 18 nt, Pseudomonas putida KT2440
gcuggcagcuugcccugc

SEQ ID NO: 3573231 - RNA, 14 nt, Pseudomonas putida KT2440
gcuggcagcuuggc

SEQ ID NO: 3573232 - RNA, 12 nt, Pseudomonas putida KT2440
gcuggcauccac

SEQ ID NO: 3573233 - RNA, 19 nt, Pseudomonas putida KT2440
gcuggcaucgccucguacc

SEQ ID NO: 3573234 - RNA, 22 nt, Pseudomonas putida KT2440
gcuggcauucaacgcccgccgu

SEQ ID NO: 3573235 - RNA, 14 nt, Pseudomonas putida KT2440
gcuggccaaggccu

SEQ ID NO: 3573236 - RNA, 15 nt, Pseudomonas putida KT2440
gcuggccaaggccuc

SEQ ID NO: 3573237 - RNA, 14 nt, Pseudomonas putida KT2440
gcuggccaaggucu

SEQ ID NO: 3573238 - RNA, 17 nt, Pseudomonas putida KT2440
gcuggccaaucuccacc

SEQ ID NO: 3573239 - RNA, 23 nt, Pseudomonas putida KT2440
gcuggccaauuucuacccgccgu

SEQ ID NO: 3573240 - RNA, 21 nt, Pseudomonas putida KT2440
gcuggccaccaugaacagcac

SEQ ID NO: 3573241 - RNA, 13 nt, Pseudomonas putida KT2440
gcuggccaggaug

SEQ ID NO: 3573242 - RNA, 17 nt, Pseudomonas putida KT2440
gcuggccaucccgcugu

SEQ ID NO: 3573243 - RNA, 18 nt, Pseudomonas putida KT2440
gcuggccaucgacccgcu

SEQ ID NO: 3573244 - RNA, 16 nt, Pseudomonas putida KT2440
gcuggccauuucgcgg

SEQ ID NO: 3573245 - RNA, 12 nt, Pseudomonas putida KT2440
gcuggcccgcga

SEQ ID NO: 3573246 - RNA, 13 nt, Pseudomonas putida KT2440
gcuggcccgcgau

SEQ ID NO: 3573247 - RNA, 20 nt, Pseudomonas putida KT2440
gcuggcccgcgaugccgaca

SEQ ID NO: 3573248 - RNA, 20 nt, Pseudomonas putida KT2440
gcuggcccuguacauccagc

SEQ ID NO: 3573249 - RNA, 14 nt, Pseudomonas putida KT2440
gcuggcccuucgcg

SEQ ID NO: 3573250 - RNA, 17 nt, Pseudomonas putida KT2440
gcuggcccuuucgcggg

SEQ ID NO: 3573251 - RNA, 14 nt, Pseudomonas putida KT2440
gcuggccgacguca

SEQ ID NO: 3573252 - RNA, 14 nt, Pseudomonas putida KT2440
gcuggccgcaccca

SEQ ID NO: 3573253 - RNA, 16 nt, Pseudomonas putida KT2440
gcuggccgcacccagc

SEQ ID NO: 3573254 - RNA, 21 nt, Pseudomonas putida KT2440
gcugucgaacgcugccugcag

SEQ ID NO: 3573255 - RNA, 20 nt, Pseudomonas putida KT2440
gcugucgaagcgcucccagg

SEQ ID NO: 3573256 - RNA, 23 nt, Pseudomonas putida KT2440
gcugucgaagcgcucccaggccu

SEQ ID NO: 3573257 - RNA, 24 nt, Pseudomonas putida KT2440
gcugucgagcagguucaggcgcag

SEQ ID NO: 3573258 - RNA, 19 nt, Pseudomonas putida KT2440
gcugucgaucagacgcucc

SEQ ID NO: 3573259 - RNA, 21 nt, Pseudomonas putida KT2440
gcugucgaucagacgcuccag

SEQ ID NO: 3573260 - RNA, 19 nt, Pseudomonas putida KT2440
gcugucgaugucuuucgcg

SEQ ID NO: 3573261 - RNA, 19 nt, Pseudomonas putida KT2440
gcugucgauuuccagugcc

SEQ ID NO: 3573262 - RNA, 14 nt, Pseudomonas putida KT2440
gcugucgcagucga

SEQ ID NO: 3573263 - RNA, 17 nt, Pseudomonas putida KT2440
gcugucgcuacgcgcca

SEQ ID NO: 3573264 - RNA, 22 nt, Pseudomonas putida KT2440
gcugucgcuacgcgccauccgc

SEQ ID NO: 3573265 - RNA, 18 nt, Pseudomonas putida KT2440
gcugucggcauagggcac

SEQ ID NO: 3573266 - RNA, 19 nt, Pseudomonas putida KT2440
gcugucggcauagggcaca

SEQ ID NO: 3573267 - RNA, 21 nt, Pseudomonas putida KT2440
gcugucggcgucggccaugcc

SEQ ID NO: 3573268 - RNA, 17 nt, Pseudomonas putida KT2440
gcugucgguaccuggcc

SEQ ID NO: 3573269 - RNA, 14 nt, Pseudomonas putida KT2440
gcugucggucagca

SEQ ID NO: 3573270 - RNA, 21 nt, Pseudomonas putida KT2440
gcugucggucagggcacggcu

SEQ ID NO: 3573271 - RNA, 16 nt, Pseudomonas putida KT2440
gcugucggugaagccg

SEQ ID NO: 3573272 - RNA, 21 nt, Pseudomonas putida KT2440
gcugucgucaagcucuuccuu

SEQ ID NO: 3573273 - RNA, 14 nt, Pseudomonas putida KT2440
gcugucguccagcu

SEQ ID NO: 3573274 - RNA, 12 nt, Pseudomonas putida KT2440
gcugugcacugc

SEQ ID NO: 3573275 - RNA, 13 nt, Pseudomonas putida KT2440
gcugugcacugcg

SEQ ID NO: 3573276 - RNA, 14 nt, Pseudomonas putida KT2440
gcugugcagcgcuc

SEQ ID NO: 3573277 - RNA, 16 nt, Pseudomonas putida KT2440
gcugugcagcgcucgc

SEQ ID NO: 3573278 - RNA, 22 nt, Pseudomonas putida KT2440
gcugugcggcguauacccgguc

SEQ ID NO: 3573279 - RNA, 17 nt, Pseudomonas putida KT2440
gcugugguucaccgugu

SEQ ID NO: 3573280 - RNA, 20 nt, Pseudomonas putida KT2440
gcuguuaccagagagcugag

SEQ ID NO: 3573281 - RNA, 12 nt, Pseudomonas putida KT2440
gcuguuccagca

SEQ ID NO: 3573282 - RNA, 15 nt, Pseudomonas putida KT2440
gcuguuccauuuccc

SEQ ID NO: 3573283 - RNA, 22 nt, Pseudomonas putida KT2440
gcuguuccggccgcuucgcgga

SEQ ID NO: 3573284 - RNA, 14 nt, Pseudomonas putida KT2440
gcuguucgcagcac

SEQ ID NO: 3573285 - RNA, 12 nt, Pseudomonas putida KT2440
gcuguucgcuga

SEQ ID NO: 3573286 - RNA, 22 nt, Pseudomonas putida KT2440
gcuguucuugaacucgccgcgc

SEQ ID NO: 3573287 - RNA, 13 nt, Pseudomonas putida KT2440
gcuguugagcagc

SEQ ID NO: 3573288 - RNA, 16 nt, Pseudomonas putida KT2440
gcuguugagcagcagc

SEQ ID NO: 3573289 - RNA, 20 nt, Pseudomonas putida KT2440
gcuguugagcagcagcccuu

SEQ ID NO: 3573290 - RNA, 22 nt, Pseudomonas putida KT2440
gcuguugcgcaccuugugcacg

SEQ ID NO: 3573291 - RNA, 21 nt, Pseudomonas putida KT2440
gcuguuggcgcgacauguuca

SEQ ID NO: 3573292 - RNA, 20 nt, Pseudomonas putida KT2440
gcuguuguugccucaggugc

SEQ ID NO: 3573293 - RNA, 23 nt, Pseudomonas putida KT2440
gcuguuguugccucaggugcaca

SEQ ID NO: 3573294 - RNA, 19 nt, Pseudomonas putida KT2440
gcuguuugaagcgagagcu

SEQ ID NO: 3573295 - RNA, 13 nt, Pseudomonas putida KT2440
gcuuaaguuucau

SEQ ID NO: 3573296 - RNA, 18 nt, Pseudomonas putida KT2440
gcuuacagaugucuggca

SEQ ID NO: 3573297 - RNA, 20 nt, Pseudomonas putida KT2440
gcuuacccgcgaagaggccg

SEQ ID NO: 3573298 - RNA, 15 nt, Pseudomonas putida KT2440
gcuuaucggcugacc

SEQ ID NO: 3573299 - RNA, 21 nt, Pseudomonas putida KT2440
gcuucaaaauagucgaaggcu

SEQ ID NO: 3573300 - RNA, 15 nt, Pseudomonas putida KT2440
gcuucaaacccgguu

SEQ ID NO: 3573301 - RNA, 22 nt, Pseudomonas putida KT2440
gcuucaagcagguaaccgcugc

SEQ ID NO: 3573302 - RNA, 21 nt, Pseudomonas putida KT2440
gcuucaaguuuggcuuugccc

SEQ ID NO: 3573303 - RNA, 20 nt, Pseudomonas putida KT2440
gcuucacccucgcgcagcau

SEQ ID NO: 3573304 - RNA, 13 nt, Pseudomonas putida KT2440
gcuucaccgcgca

SEQ ID NO: 3573305 - RNA, 18 nt, Pseudomonas putida KT2440
gcuucaccgcgcaccucc

SEQ ID NO: 3573306 - RNA, 18 nt, Pseudomonas putida KT2440
gcuucacgggucaugcca

SEQ ID NO: 3573307 - RNA, 21 nt, Pseudomonas putida KT2440
gcuucacgggucaugccaccg

SEQ ID NO: 3573308 - RNA, 17 nt, Pseudomonas putida KT2440
gcuucagaucacccuug

SEQ ID NO: 3573309 - RNA, 21 nt, Pseudomonas putida KT2440
gcuucagaucacccuuggcca

SEQ ID NO: 3573310 - RNA, 19 nt, Pseudomonas putida KT2440
gcuucagccuuuuccagcu

SEQ ID NO: 3573311 - RNA, 21 nt, Pseudomonas putida KT2440
gcuucagccuuuuccagcucg

SEQ ID NO: 3573312 - RNA, 17 nt, Pseudomonas putida KT2440
gcuucagcgaccgacac

SEQ ID NO: 3573313 - RNA, 16 nt, Pseudomonas putida KT2440
gcuucagcgcgccauc

SEQ ID NO: 3573314 - RNA, 14 nt, Pseudomonas putida KT2440
gcuucaggccuucg

SEQ ID NO: 3573315 - RNA, 22 nt, Pseudomonas putida KT2440
gcuucagggucgggcacaggcc

SEQ ID NO: 3573316 - RNA, 20 nt, Pseudomonas putida KT2440
gcuucagguaagucagcgag

SEQ ID NO: 3573317 - RNA, 21 nt, Pseudomonas putida KT2440
gcuucagguucacuuccacac

SEQ ID NO: 3573318 - RNA, 12 nt, Pseudomonas putida KT2440
gcuucaugaagu

SEQ ID NO: 3573319 - RNA, 16 nt, Pseudomonas putida KT2440
gcuucaugcugcugca

SEQ ID NO: 3573320 - RNA, 20 nt, Pseudomonas putida KT2440
gcuucaugcugcugcagcac

SEQ ID NO: 3573321 - RNA, 22 nt, Pseudomonas putida KT2440
gcuucauggcgccgaugccguc

SEQ ID NO: 3573322 - RNA, 21 nt, Pseudomonas putida KT2440
gcuuccaccauucccugcaca

SEQ ID NO: 3573323 - RNA, 16 nt, Pseudomonas putida KT2440
gcuuccacucggugca

SEQ ID NO: 3573324 - RNA, 23 nt, Pseudomonas putida KT2440
gcuuccagcaggacccggcugga

SEQ ID NO: 3573325 - RNA, 16 nt, Pseudomonas putida KT2440
gcuuccaggucgcggu

SEQ ID NO: 3573326 - RNA, 17 nt, Pseudomonas putida KT2440
gcuuccaguuggccggc

SEQ ID NO: 3573327 - RNA, 22 nt, Pseudomonas putida KT2440
gcuuccaguuggccggcauggc

SEQ ID NO: 3573328 - RNA, 13 nt, Pseudomonas putida KT2440
gcuucccccaauc

SEQ ID NO: 3573329 - RNA, 22 nt, Pseudomonas putida KT2440
gcuucccccaaucuccagcccg

SEQ ID NO: 3573330 - RNA, 21 nt, Pseudomonas putida KT2440
gcuucccgguaacgggccagc

SEQ ID NO: 3573331 - RNA, 22 nt, Pseudomonas putida KT2440
gcuucccgguaacgggccagcc

SEQ ID NO: 3573332 - RNA, 21 nt, Pseudomonas putida KT2440
gcuuccggcgcugguaggcga

SEQ ID NO: 3573333 - RNA, 13 nt, Pseudomonas putida KT2440
gcuuccucuucaa

SEQ ID NO: 3573334 - RNA, 18 nt, Pseudomonas putida KT2440
gcuuccucuucaaggccc

SEQ ID NO: 3573335 - RNA, 21 nt, Pseudomonas putida KT2440
gcuuccucuucaaggcccagu

SEQ ID NO: 3573336 - RNA, 13 nt, Pseudomonas putida KT2440
gcuuccugcuggc

SEQ ID NO: 3573337 - RNA, 18 nt, Pseudomonas putida KT2440
gcuuccuggccuuccuug

SEQ ID NO: 3573338 - RNA, 22 nt, Pseudomonas putida KT2440
gcuuccuggccuuccuugccca

SEQ ID NO: 3573339 - RNA, 16 nt, Pseudomonas putida KT2440
gcuuccuuccuggaag

SEQ ID NO: 3573340 - RNA, 15 nt, Pseudomonas putida KT2440
gcuuccuuguccgcc

SEQ ID NO: 3573341 - RNA, 19 nt, Pseudomonas putida KT2440
gcuuccuuguccgccaaga

SEQ ID NO: 3573342 - RNA, 17 nt, Pseudomonas putida KT2440
gcuucgacgaagaagcc

SEQ ID NO: 3573343 - RNA, 21 nt, Pseudomonas putida KT2440
gcuucgaggauuuucaccuuc

SEQ ID NO: 3573344 - RNA, 22 nt, Pseudomonas putida KT2440
gcuucgaucagcgccugcucau

SEQ ID NO: 3573345 - RNA, 16 nt, Pseudomonas putida KT2440
gcuucgaugauccccg

SEQ ID NO: 3573346 - RNA, 16 nt, Pseudomonas putida KT2440
gcuucgaugcccggca

SEQ ID NO: 3573347 - RNA, 14 nt, Pseudomonas putida KT2440
gcuucgccagcgcc

SEQ ID NO: 3573348 - RNA, 15 nt, Pseudomonas putida KT2440
gcuucgccagcgcca

SEQ ID NO: 3573349 - RNA, 16 nt, Pseudomonas putida KT2440
gcuucgcccagugccu

SEQ ID NO: 3573350 - RNA, 19 nt, Pseudomonas putida KT2440
gcuucgcccguguucgcgg

SEQ ID NO: 3573351 - RNA, 20 nt, Pseudomonas putida KT2440
gcuucgcccguguucgcggg

SEQ ID NO: 3573352 - RNA, 20 nt, Pseudomonas putida KT2440
gcuucgcccucguucgcggg

SEQ ID NO: 3573353 - RNA, 18 nt, Pseudomonas putida KT2440
gcuucgccgguguucgcg

SEQ ID NO: 3573354 - RNA, 22 nt, Pseudomonas putida KT2440
gcuucgcgacccauuugcagca

SEQ ID NO: 3573355 - RNA, 19 nt, Pseudomonas putida KT2440
gcuucgcgcauuucgucca

SEQ ID NO: 3573356 - RNA, 14 nt, Pseudomonas putida KT2440
gcuucgcggccaag

SEQ ID NO: 3573357 - RNA, 23 nt, Pseudomonas putida KT2440
gcuucgcgggcacgcccgcuccc

SEQ ID NO: 3573358 - RNA, 18 nt, Pseudomonas putida KT2440
gcuugucccaggccauca

SEQ ID NO: 3573359 - RNA, 19 nt, Pseudomonas putida KT2440
gcuuguccuugagcgccgc

SEQ ID NO: 3573360 - RNA, 16 nt, Pseudomonas putida KT2440
gcuugucgagguugcg

SEQ ID NO: 3573361 - RNA, 16 nt, Pseudomonas putida KT2440
gcuugucuuccagcug

SEQ ID NO: 3573362 - RNA, 18 nt, Pseudomonas putida KT2440
gcuugucuuccaguucca

SEQ ID NO: 3573363 - RNA, 21 nt, Pseudomonas putida KT2440
gcuuguggucgacgucggcgu

SEQ ID NO: 3573364 - RNA, 14 nt, Pseudomonas putida KT2440
gcuuguuauggcac

SEQ ID NO: 3573365 - RNA, 16 nt, Pseudomonas putida KT2440
gcuuucaccuugcugg

SEQ ID NO: 3573366 - RNA, 16 nt, Pseudomonas putida KT2440
gcuuucacuucaucca

SEQ ID NO: 3573367 - RNA, 15 nt, Pseudomonas putida KT2440
gcuuucagccgagcc

SEQ ID NO: 3573368 - RNA, 17 nt, Pseudomonas putida KT2440
gcuuucagcgccgcuuc

SEQ ID NO: 3573369 - RNA, 17 nt, Pseudomonas putida KT2440
gcuuucaggcgcagcac

SEQ ID NO: 3573370 - RNA, 14 nt, Pseudomonas putida KT2440
gcuuuccaaaccug

SEQ ID NO: 3573371 - RNA, 22 nt, Pseudomonas putida KT2440
gcuuuccaccuggccacccggc

SEQ ID NO: 3573372 - RNA, 18 nt, Pseudomonas putida KT2440
gcuuuccagguccugcuc

SEQ ID NO: 3573373 - RNA, 21 nt, Pseudomonas putida KT2440
gcuuuccagguccugcuccac

SEQ ID NO: 3573374 - RNA, 22 nt, Pseudomonas putida KT2440
gcuuucccccagccaacgcccc

SEQ ID NO: 3573375 - RNA, 18 nt, Pseudomonas putida KT2440
gcuuucgaucgagccacu

SEQ ID NO: 3573376 - RNA, 13 nt, Pseudomonas putida KT2440
gcuuucggcagug

SEQ ID NO: 3573377 - RNA, 16 nt, Pseudomonas putida KT2440
gcuuucggcaguguaa

SEQ ID NO: 3573378 - RNA, 20 nt, Pseudomonas putida KT2440
gcuuucucaagccugccaaa

SEQ ID NO: 3573379 - RNA, 13 nt, Pseudomonas putida KT2440
gcuuucucauccc

SEQ ID NO: 3573380 - RNA, 16 nt, Pseudomonas putida KT2440
gcuuucugcugugucg

SEQ ID NO: 3573381 - RNA, 16 nt, Pseudomonas putida KT2440
gcuuugaacagcucga

SEQ ID NO: 3573382 - RNA, 16 nt, Pseudomonas putida KT2440
gcuuugaagucacuuu

SEQ ID NO: 3573383 - RNA, 12 nt, Pseudomonas putida KT2440
gcuuugcacuga

SEQ ID NO: 3573384 - RNA, 12 nt, Pseudomonas putida KT2440
gcuuugcagccc

SEQ ID NO: 3573385 - RNA, 13 nt, Pseudomonas putida KT2440
gcuuugcagccca

SEQ ID NO: 3573386 - RNA, 14 nt, Pseudomonas putida KT2440
gcuuugcagcccau

SEQ ID NO: 3573387 - RNA, 21 nt, Pseudomonas putida KT2440
gcuuugcagcccauucgcggg

SEQ ID NO: 3573388 - RNA, 15 nt, Pseudomonas putida KT2440
gcuuugcagcccuuc

SEQ ID NO: 3573389 - RNA, 20 nt, Pseudomonas putida KT2440
gcuuugcagcccuucgcagg

SEQ ID NO: 3573390 - RNA, 20 nt, Pseudomonas putida KT2440
gcuuugcagcccuucgccgg

SEQ ID NO: 3573391 - RNA, 19 nt, Pseudomonas putida KT2440
gcuuugcagcccuucgcgg

SEQ ID NO: 3573392 - RNA, 13 nt, Pseudomonas putida KT2440
gcuuugccggccu

SEQ ID NO: 3573393 - RNA, 21 nt, Pseudomonas putida KT2440
gcuuugccggccucuucgcgg

SEQ ID NO: 3573394 - RNA, 19 nt, Pseudomonas putida KT2440
gcuuugccgguguucgcgg

SEQ ID NO: 3573395 - RNA, 18 nt, Pseudomonas putida KT2440
gcuuugcgggcacgggca

SEQ ID NO: 3573396 - RNA, 20 nt, Pseudomonas putida KT2440
gcuuugcgggcacgggcagc

SEQ ID NO: 3573397 - RNA, 14 nt, Pseudomonas putida KT2440
gcuuugcgucauca

SEQ ID NO: 3573398 - RNA, 18 nt, Pseudomonas putida KT2440
gcuuugcguggcaccggc

SEQ ID NO: 3573399 - RNA, 15 nt, Pseudomonas putida KT2440
gcuuuggcagcagcc

SEQ ID NO: 3573400 - RNA, 16 nt, Pseudomonas putida KT2440
gcuuuggcagcagccu

SEQ ID NO: 3573401 - RNA, 22 nt, Pseudomonas putida KT2440
gcuuugggagcaguggugcuca

SEQ ID NO: 3573402 - RNA, 22 nt, Pseudomonas putida KT2440
gcuuuggggggcgacagacagg

SEQ ID NO: 3573403 - RNA, 20 nt, Pseudomonas putida KT2440
gcuuuguauggccgagcagg

SEQ ID NO: 3573404 - RNA, 22 nt, Pseudomonas putida KT2440
gcuuuguauggccgagcaggag

SEQ ID NO: 3573405 - RNA, 18 nt, Pseudomonas putida KT2440
gcuuugugugcccaccag

SEQ ID NO: 3573406 - RNA, 15 nt, Pseudomonas putida KT2440
gcuuuguuugcuggc

SEQ ID NO: 3573407 - RNA, 16 nt, Pseudomonas putida KT2440
gcuuuguuugcuggca

SEQ ID NO: 3573408 - RNA, 21 nt, Pseudomonas putida KT2440
gcuuuguuugcuggcauggca

SEQ ID NO: 3573409 - RNA, 15 nt, Pseudomonas putida KT2440
gcuuuuaugauccug

SEQ ID NO: 3573410 - RNA, 18 nt, Pseudomonas putida KT2440
gcuuuuccagcaaagucu

SEQ ID NO: 3573411 - RNA, 22 nt, Pseudomonas putida KT2440
gcuuuuccagcaaagucuucag

SEQ ID NO: 3573412 - RNA, 17 nt, Pseudomonas putida KT2440
gcuuuuccaguuccugg

SEQ ID NO: 3573413 - RNA, 22 nt, Pseudomonas putida KT2440
gcuuuucguuggccagcuuggc

SEQ ID NO: 3573414 - RNA, 17 nt, Pseudomonas putida KT2440
gcuuuucuucgcugcug

SEQ ID NO: 3573415 - RNA, 17 nt, Pseudomonas putida KT2440
gcuuuugaagucggcgu

SEQ ID NO: 3573416 - RNA, 17 nt, Pseudomonas putida KT2440
gcuuuuucauggcuuga

SEQ ID NO: 3573417 - RNA, 20 nt, Pseudomonas putida KT2440
gcuuuuugauuguggagcug

SEQ ID NO: 3573418 - RNA, 14 nt, Pseudomonas putida KT2440
gcuuuuuugugccu

SEQ ID NO: 3573419 - RNA, 14 nt, Pseudomonas putida KT2440
ggaaaaccgcucga

SEQ ID NO: 3573420 - RNA, 13 nt, Pseudomonas putida KT2440
ggaaaacucgguc

SEQ ID NO: 3573421 - RNA, 17 nt, Pseudomonas putida KT2440
ggaaacaguuucuucag

SEQ ID NO: 3573422 - RNA, 21 nt, Pseudomonas putida KT2440
ggaaaccuccggcaucauccu

SEQ ID NO: 3573423 - RNA, 23 nt, Pseudomonas putida KT2440
ggaaagcccccgccugcuggccg

SEQ ID NO: 3573424 - RNA, 14 nt, Pseudomonas putida KT2440
ggaaaggucggcgg

SEQ ID NO: 3573425 - RNA, 11 nt, Pseudomonas putida KT2440
ggaaauccucg

SEQ ID NO: 3573426 - RNA, 17 nt, Pseudomonas putida KT2440
ggaaaucgccugcuugg

SEQ ID NO: 3573427 - RNA, 19 nt, Pseudomonas putida KT2440
ggaaaugaagacggugaga

SEQ ID NO: 3573428 - RNA, 18 nt, Pseudomonas putida KT2440
ggaaauguucacggcggc

SEQ ID NO: 3573429 - RNA, 15 nt, Pseudomonas putida KT2440
ggaaauuggccagca

SEQ ID NO: 3573430 - RNA, 15 nt, Pseudomonas putida KT2440
ggaaauuggcgagca

SEQ ID NO: 3573431 - RNA, 20 nt, Pseudomonas putida KT2440
ggaacaacggcucacugcuc

SEQ ID NO: 3573432 - RNA, 18 nt, Pseudomonas putida KT2440
ggaacacacgcuccgggu

SEQ ID NO: 3573433 - RNA, 14 nt, Pseudomonas putida KT2440
ggaacacuucgcuu

SEQ ID NO: 3573434 - RNA, 15 nt, Pseudomonas putida KT2440
ggaacagcagcaccg

SEQ ID NO: 3573435 - RNA, 14 nt, Pseudomonas putida KT2440
ggaacagcgcagcc

SEQ ID NO: 3573436 - RNA, 17 nt, Pseudomonas putida KT2440
ggaacagcggcagcaac

SEQ ID NO: 3573437 - RNA, 22 nt, Pseudomonas putida KT2440
ggaacagcguggccagcccaag

SEQ ID NO: 3573438 - RNA, 20 nt, Pseudomonas putida KT2440
ggaacagcucgauggccagg

SEQ ID NO: 3573439 - RNA, 19 nt, Pseudomonas putida KT2440
ggaacauacgcaucagcgc

SEQ ID NO: 3573440 - RNA, 23 nt, Pseudomonas putida KT2440
ggaacauacgcaucagcgcagca

SEQ ID NO: 3573441 - RNA, 15 nt, Pseudomonas putida KT2440
ggaaccccauccaca

SEQ ID NO: 3573442 - RNA, 23 nt, Pseudomonas putida KT2440
ggaaccccauccacaucgccagg

SEQ ID NO: 3573443 - RNA, 13 nt, Pseudomonas putida KT2440
ggaaccgcuccca

SEQ ID NO: 3573444 - RNA, 13 nt, Pseudomonas putida KT2440
ggaacgcugccuc

SEQ ID NO: 3573445 - RNA, 19 nt, Pseudomonas putida KT2440
ggaacggcuggcugccguc

SEQ ID NO: 3573446 - RNA, 21 nt, Pseudomonas putida KT2440
gccuucaugguguccggcaug

SEQ ID NO: 3573447 - RNA, 18 nt, Pseudomonas putida KT2440
gccuuccaaccagccagc

SEQ ID NO: 3573448 - RNA, 19 nt, Pseudomonas putida KT2440
gccuuccaaccagccagcc

SEQ ID NO: 3573449 - RNA, 21 nt, Pseudomonas putida KT2440
gccuuccaaccagccagccac

SEQ ID NO: 3573450 - RNA, 20 nt, Pseudomonas putida KT2440
gccuuccacccgccugcaac

SEQ ID NO: 3573451 - RNA, 12 nt, Pseudomonas putida KT2440
gccuuccagcuu

SEQ ID NO: 3573452 - RNA, 19 nt, Pseudomonas putida KT2440
gccuucccgucgagccggg

SEQ ID NO: 3573453 - RNA, 12 nt, Pseudomonas putida KT2440
gccuuccgggca

SEQ ID NO: 3573454 - RNA, 17 nt, Pseudomonas putida KT2440
gccuuccucggccaugc

SEQ ID NO: 3573455 - RNA, 22 nt, Pseudomonas putida KT2440
gccuuccucggccaugcgcggg

SEQ ID NO: 3573456 - RNA, 15 nt, Pseudomonas putida KT2440
gccuuccugcaccuu

SEQ ID NO: 3573457 - RNA, 21 nt, Pseudomonas putida KT2440
gccuuccuugaacucagugcc

SEQ ID NO: 3573458 - RNA, 22 nt, Pseudomonas putida KT2440
gccuucgaacaauucuuccagc

SEQ ID NO: 3573459 - RNA, 18 nt, Pseudomonas putida KT2440
gccuucgaacagcgaagu

SEQ ID NO: 3573460 - RNA, 14 nt, Pseudomonas putida KT2440
gccuucgccacugc

SEQ ID NO: 3573461 - RNA, 15 nt, Pseudomonas putida KT2440
gccuucgccacugcc

SEQ ID NO: 3573462 - RNA, 21 nt, Pseudomonas putida KT2440
gccuucgcccgaccgccagcc

SEQ ID NO: 3573463 - RNA, 15 nt, Pseudomonas putida KT2440
gccuucgcccgccgc

SEQ ID NO: 3573464 - RNA, 18 nt, Pseudomonas putida KT2440
gccuucgcgggcucgccc

SEQ ID NO: 3573465 - RNA, 20 nt, Pseudomonas putida KT2440
gccuucgcucaggugcaccu

SEQ ID NO: 3573466 - RNA, 22 nt, Pseudomonas putida KT2440
gccuucgcucaggugcaccucc

SEQ ID NO: 3573467 - RNA, 13 nt, Pseudomonas putida KT2440
gccuucgcuggcg

SEQ ID NO: 3573468 - RNA, 13 nt, Pseudomonas putida KT2440
gccuucggccaug

SEQ ID NO: 3573469 - RNA, 16 nt, Pseudomonas putida KT2440
gccuucggugcuggcg

SEQ ID NO: 3573470 - RNA, 22 nt, Pseudomonas putida KT2440
gccuucguaguaauggccgaug

SEQ ID NO: 3573471 - RNA, 19 nt, Pseudomonas putida KT2440
gccuucgucgcuggccagc

SEQ ID NO: 3573472 - RNA, 20 nt, Pseudomonas putida KT2440
gccuucgucgcuggccagcu

SEQ ID NO: 3573473 - RNA, 14 nt, Pseudomonas putida KT2440
gccuucuccagcuc

SEQ ID NO: 3573474 - RNA, 16 nt, Pseudomonas putida KT2440
gccuucuccagcucgc

SEQ ID NO: 3573475 - RNA, 16 nt, Pseudomonas putida KT2440
gccuucucuguguucu

SEQ ID NO: 3573476 - RNA, 13 nt, Pseudomonas putida KT2440
gccuucucuuccg

SEQ ID NO: 3573477 - RNA, 23 nt, Pseudomonas putida KT2440
gccuucucuuccgccagccaacg

SEQ ID NO: 3573478 - RNA, 14 nt, Pseudomonas putida KT2440
gccuucuucgaugu

SEQ ID NO: 3573479 - RNA, 11 nt, Pseudomonas putida KT2440
gccuugaaaag

SEQ ID NO: 3573480 - RNA, 16 nt, Pseudomonas putida KT2440
gccuugaagcgcggca

SEQ ID NO: 3573481 - RNA, 19 nt, Pseudomonas putida KT2440
gccuugaagcgcggcaugc

SEQ ID NO: 3573482 - RNA, 19 nt, Pseudomonas putida KT2440
gccuugaccagcaacggcc

SEQ ID NO: 3573483 - RNA, 18 nt, Pseudomonas putida KT2440
gccuugaccucgaccagg

SEQ ID NO: 3573484 - RNA, 19 nt, Pseudomonas putida KT2440
gccuugaggaccuugcggg

SEQ ID NO: 3573485 - RNA, 21 nt, Pseudomonas putida KT2440
gccuugauacgcccauccaac

SEQ ID NO: 3573486 - RNA, 17 nt, Pseudomonas putida KT2440
gccuugaucaggcccug

SEQ ID NO: 3573487 - RNA, 19 nt, Pseudomonas putida KT2440
gccuugaucaggcccugcu

SEQ ID NO: 3573488 - RNA, 21 nt, Pseudomonas putida KT2440
gccuugaucaggcccugcugc

SEQ ID NO: 3573489 - RNA, 22 nt, Pseudomonas putida KT2440
gccuugaucaggggccgcgcag

SEQ ID NO: 3573490 - RNA, 15 nt, Pseudomonas putida KT2440
gccuugaugacuuug

SEQ ID NO: 3573491 - RNA, 19 nt, Pseudomonas putida KT2440
gccuugauuaccagcgccc

SEQ ID NO: 3573492 - RNA, 16 nt, Pseudomonas putida KT2440
gccuugcagccccugc

SEQ ID NO: 3573493 - RNA, 15 nt, Pseudomonas putida KT2440
gccuugcagcccuuc

SEQ ID NO: 3573494 - RNA, 19 nt, Pseudomonas putida KT2440
gccuugcagcccuucgcgg

SEQ ID NO: 3573495 - RNA, 18 nt, Pseudomonas putida KT2440
gccuugcaggaagcggcg

SEQ ID NO: 3573496 - RNA, 24 nt, Pseudomonas putida KT2440
gcgaauccagcaggcuugccagcu

SEQ ID NO: 3573497 - RNA, 21 nt, Pseudomonas putida KT2440
gcgaaugcaaugguaaauuca

SEQ ID NO: 3573498 - RNA, 18 nt, Pseudomonas putida KT2440
gcgaaugcgcucauccag

SEQ ID NO: 3573499 - RNA, 15 nt, Pseudomonas putida KT2440
gcgaauggcagguga

SEQ ID NO: 3573500 - RNA, 13 nt, Pseudomonas putida KT2440
gcgaauggccgca

SEQ ID NO: 3573501 - RNA, 14 nt, Pseudomonas putida KT2440
gcgaaugggcugca

SEQ ID NO: 3573502 - RNA, 20 nt, Pseudomonas putida KT2440
gcgaaugggcugcaaagcag

SEQ ID NO: 3573503 - RNA, 17 nt, Pseudomonas putida KT2440
gcgacaaccgaaaaggc

SEQ ID NO: 3573504 - RNA, 19 nt, Pseudomonas putida KT2440
gcgacaaccgaaaaggcca

SEQ ID NO: 3573505 - RNA, 14 nt, Pseudomonas putida KT2440
gcgacaaucaggcg

SEQ ID NO: 3573506 - RNA, 20 nt, Pseudomonas putida KT2440
gcgacacaaggccccacaau

SEQ ID NO: 3573507 - RNA, 20 nt, Pseudomonas putida KT2440
gcgacacaaggccgcuccca

SEQ ID NO: 3573508 - RNA, 21 nt, Pseudomonas putida KT2440
gcgacacaaggccgcucccac

SEQ ID NO: 3573509 - RNA, 18 nt, Pseudomonas putida KT2440
gcgacaccagcgcaccac

SEQ ID NO: 3573510 - RNA, 19 nt, Pseudomonas putida KT2440
gcgacaccagcgcaccacu

SEQ ID NO: 3573511 - RNA, 21 nt, Pseudomonas putida KT2440
gcgacaccagcgcaccacugu

SEQ ID NO: 3573512 - RNA, 14 nt, Pseudomonas putida KT2440
gcgacacccugguc

SEQ ID NO: 3573513 - RNA, 21 nt, Pseudomonas putida KT2440
gcgacacccuggucaugcagc

SEQ ID NO: 3573514 - RNA, 22 nt, Pseudomonas putida KT2440
gcgacacccuggucaugcagcg

SEQ ID NO: 3573515 - RNA, 15 nt, Pseudomonas putida KT2440
gcgacagcaucauca

SEQ ID NO: 3573516 - RNA, 20 nt, Pseudomonas putida KT2440
gcgacagcaucaucaggccg

SEQ ID NO: 3573517 - RNA, 16 nt, Pseudomonas putida KT2440
gcgacagcaucggcag

SEQ ID NO: 3573518 - RNA, 22 nt, Pseudomonas putida KT2440
gcgacagcccauagcgccaucg

SEQ ID NO: 3573519 - RNA, 13 nt, Pseudomonas putida KT2440
gcgacagcguugc

SEQ ID NO: 3573520 - RNA, 20 nt, Pseudomonas putida KT2440
gcgacagcucaagcccugcc

SEQ ID NO: 3573521 - RNA, 14 nt, Pseudomonas putida KT2440
gcgacagcugcggc

SEQ ID NO: 3573522 - RNA, 18 nt, Pseudomonas putida KT2440
gcgacaggcuugaagcug

SEQ ID NO: 3573523 - RNA, 22 nt, Pseudomonas putida KT2440
gcgacaggcuugaagcugcgcu

SEQ ID NO: 3573524 - RNA, 14 nt, Pseudomonas putida KT2440
gcgacagggcgccc

SEQ ID NO: 3573525 - RNA, 22 nt, Pseudomonas putida KT2440
gcgacagguaguuggccgggcc

SEQ ID NO: 3573526 - RNA, 15 nt, Pseudomonas putida KT2440
gcgacaugccggcca

SEQ ID NO: 3573527 - RNA, 17 nt, Pseudomonas putida KT2440
gcgacaugccggccacc

SEQ ID NO: 3573528 - RNA, 19 nt, Pseudomonas putida KT2440
gcgacaugccggccaccac

SEQ ID NO: 3573529 - RNA, 18 nt, Pseudomonas putida KT2440
gcgaccacaggcgcuuga

SEQ ID NO: 3573530 - RNA, 19 nt, Pseudomonas putida KT2440
gcgaccacaggcgcuugaa

SEQ ID NO: 3573531 - RNA, 14 nt, Pseudomonas putida KT2440
gcgaccaucaccag

SEQ ID NO: 3573532 - RNA, 19 nt, Pseudomonas putida KT2440
gcgaccaucaccgccagca

SEQ ID NO: 3573533 - RNA, 14 nt, Pseudomonas putida KT2440
gcgaccaugcggcu

SEQ ID NO: 3573534 - RNA, 17 nt, Pseudomonas putida KT2440
gcgaccaugcggcucug

SEQ ID NO: 3573535 - RNA, 18 nt, Pseudomonas putida KT2440
gcgacccgcuggccggac

SEQ ID NO: 3573536 - RNA, 13 nt, Pseudomonas putida KT2440
gcgaccgccauug

SEQ ID NO: 3573537 - RNA, 18 nt, Pseudomonas putida KT2440
gcgaccuggaucgcgccu

SEQ ID NO: 3573538 - RNA, 19 nt, Pseudomonas putida KT2440
gcgaccuggaucgcgccuu

SEQ ID NO: 3573539 - RNA, 17 nt, Pseudomonas putida KT2440
gcgaccuucacgccagc

SEQ ID NO: 3573540 - RNA, 22 nt, Pseudomonas putida KT2440
gcgacgaaacccaguacggcgc

SEQ ID NO: 3573541 - RNA, 12 nt, Pseudomonas putida KT2440
gcgacgaccgca

SEQ ID NO: 3573542 - RNA, 22 nt, Pseudomonas putida KT2440
gcgacgaguuuaccuccaucac

SEQ ID NO: 3573543 - RNA, 22 nt, Pseudomonas putida KT2440
gcgacgaucaucgcgccgacca

SEQ ID NO: 3573544 - RNA, 20 nt, Pseudomonas putida KT2440
gcgacgcaaggccgcuccca

SEQ ID NO: 3573545 - RNA, 17 nt, Pseudomonas putida KT2440
gcgacgcagcagcgcga

SEQ ID NO: 3573546 - RNA, 13 nt, Pseudomonas putida KT2440
gcgacgccacccc

SEQ ID NO: 3573547 - RNA, 14 nt, Pseudomonas putida KT2440
gcgacgcgcuaccu

SEQ ID NO: 3573548 - RNA, 14 nt, Pseudomonas putida KT2440
gcgacgcggcauug

SEQ ID NO: 3573549 - RNA, 12 nt, Pseudomonas putida KT2440
gcgacgcggccc

SEQ ID NO: 3573550 - RNA, 16 nt, Pseudomonas putida KT2440
gcgacgcugcccagca

SEQ ID NO: 3573551 - RNA, 18 nt, Pseudomonas putida KT2440
gcgacgcugcccagcaac

SEQ ID NO: 3573552 - RNA, 15 nt, Pseudomonas putida KT2440
gcgacggaucggcac

SEQ ID NO: 3573553 - RNA, 13 nt, Pseudomonas putida KT2440
gcgacggcgaggu

SEQ ID NO: 3573554 - RNA, 19 nt, Pseudomonas putida KT2440
gcgacgggaagugcacugc

SEQ ID NO: 3573555 - RNA, 15 nt, Pseudomonas putida KT2440
gcgacggucauaccu

SEQ ID NO: 3573556 - RNA, 15 nt, Pseudomonas putida KT2440
gcgacgguugacagc

SEQ ID NO: 3573557 - RNA, 19 nt, Pseudomonas putida KT2440
gcgacguagugacgcggau

SEQ ID NO: 3573558 - RNA, 20 nt, Pseudomonas putida KT2440
gcgacguucuugccgguggu

SEQ ID NO: 3573559 - RNA, 22 nt, Pseudomonas putida KT2440
gcgacguucuugccggugguga

SEQ ID NO: 3573560 - RNA, 22 nt, Pseudomonas putida KT2440
gcgacuccugugggagcgggcg

SEQ ID NO: 3573561 - RNA, 16 nt, Pseudomonas putida KT2440
gcgacucgcggccggu

SEQ ID NO: 3573562 - RNA, 22 nt, Pseudomonas putida KT2440
gcgacucguccgacaaugccag

SEQ ID NO: 3573563 - RNA, 17 nt, Pseudomonas putida KT2440
gcgacugaagcgcgggu

SEQ ID NO: 3573564 - RNA, 18 nt, Pseudomonas putida KT2440
gcgacugaauacagccaa

SEQ ID NO: 3573565 - RNA, 15 nt, Pseudomonas putida KT2440
gcgacugaggcaccg

SEQ ID NO: 3573566 - RNA, 17 nt, Pseudomonas putida KT2440
gcgacugcaagcgaugc

SEQ ID NO: 3573567 - RNA, 22 nt, Pseudomonas putida KT2440
gcgacugcagguaguuuuccag

SEQ ID NO: 3573568 - RNA, 13 nt, Pseudomonas putida KT2440
gcgacuucgacca

SEQ ID NO: 3573569 - RNA, 20 nt, Pseudomonas putida KT2440
gcgacuucgugcgcuacaag

SEQ ID NO: 3573570 - RNA, 16 nt, Pseudomonas putida KT2440
gcgacuugauccagau

SEQ ID NO: 3573571 - RNA, 17 nt, Pseudomonas putida KT2440
gcgacuuucgggucgcc

SEQ ID NO: 3573572 - RNA, 17 nt, Pseudomonas putida KT2440
gcgagaaugcugcgcag

SEQ ID NO: 3573573 - RNA, 18 nt, Pseudomonas putida KT2440
gcgagaaugcugcgcagc

SEQ ID NO: 3573574 - RNA, 21 nt, Pseudomonas putida KT2440
gcgagaaugcugcgcagcugg

SEQ ID NO: 3573575 - RNA, 17 nt, Pseudomonas putida KT2440
gcgagagaucacuguug

SEQ ID NO: 3573576 - RNA, 17 nt, Pseudomonas putida KT2440
gcgagagcggcuucuac

SEQ ID NO: 3573577 - RNA, 13 nt, Pseudomonas putida KT2440
gcgagaucgacag

SEQ ID NO: 3573578 - RNA, 15 nt, Pseudomonas putida KT2440
gcgagcaagcucgcu

SEQ ID NO: 3573579 - RNA, 21 nt, Pseudomonas putida KT2440
gcgagcaagcucgcuccuaca

SEQ ID NO: 3573580 - RNA, 11 nt, Pseudomonas putida KT2440
gcgagcaggcc

SEQ ID NO: 3573581 - RNA, 12 nt, Pseudomonas putida KT2440
gcgagcaggccc

SEQ ID NO: 3573582 - RNA, 21 nt, Pseudomonas putida KT2440
gcgagcaggucaugcagguca

SEQ ID NO: 3573583 - RNA, 12 nt, Pseudomonas putida KT2440
gcgagcauggcg

SEQ ID NO: 3573584 - RNA, 13 nt, Pseudomonas putida KT2440
gcgagccaagugu

SEQ ID NO: 3573585 - RNA, 21 nt, Pseudomonas putida KT2440
gcgagccaaguguuugaagcu

SEQ ID NO: 3573586 - RNA, 24 nt, Pseudomonas putida KT2440
gcgagccaauuucaacgcucgcgc

SEQ ID NO: 3573587 - RNA, 13 nt, Pseudomonas putida KT2440
gcgagccagauca

SEQ ID NO: 3573588 - RNA, 18 nt, Pseudomonas putida KT2440
gcgagccgcauuggccgg

SEQ ID NO: 3573589 - RNA, 16 nt, Pseudomonas putida KT2440
gcgagccugggucacg

SEQ ID NO: 3573590 - RNA, 19 nt, Pseudomonas putida KT2440
gcgagccugggucacggca

SEQ ID NO: 3573591 - RNA, 19 nt, Pseudomonas putida KT2440
gcgagccuugccaacggca

SEQ ID NO: 3573592 - RNA, 14 nt, Pseudomonas putida KT2440
gcgagcgaacagcu

SEQ ID NO: 3573593 - RNA, 14 nt, Pseudomonas putida KT2440
gcgagcgucucgcc

SEQ ID NO: 3573594 - RNA, 21 nt, Pseudomonas putida KT2440
gcgagcgucucgccaaacugc

SEQ ID NO: 3573595 - RNA, 14 nt, Pseudomonas putida KT2440
gcgagcucaaccag

SEQ ID NO: 3573596 - RNA, 24 nt, Pseudomonas putida KT2440
gcgagcuugcucgcgaugcgccgc

SEQ ID NO: 3573597 - RNA, 18 nt, Pseudomonas putida KT2440
gcgagcuuguacacgccu

SEQ ID NO: 3573598 - RNA, 20 nt, Pseudomonas putida KT2440
gcgaggaaacccgcgccuac

SEQ ID NO: 3573599 - RNA, 15 nt, Pseudomonas putida KT2440
gcgaggaggccgggg

SEQ ID NO: 3573600 - RNA, 16 nt, Pseudomonas putida KT2440
gcgaggaggccgggga

SEQ ID NO: 3573601 - RNA, 20 nt, Pseudomonas putida KT2440
gcgcaaggcauucagcucgg

SEQ ID NO: 3573602 - RNA, 21 nt, Pseudomonas putida KT2440
gcgcaaggcauucagcucggc

SEQ ID NO: 3573603 - RNA, 15 nt, Pseudomonas putida KT2440
gcgcaaggccgcggc

SEQ ID NO: 3573604 - RNA, 19 nt, Pseudomonas putida KT2440
gcgcaaggggucgcggccu

SEQ ID NO: 3573605 - RNA, 19 nt, Pseudomonas putida KT2440
gcgcaagguggcauuggcg

SEQ ID NO: 3573606 - RNA, 23 nt, Pseudomonas putida KT2440
gcgcaaucaaagcagacagcugu

SEQ ID NO: 3573607 - RNA, 14 nt, Pseudomonas putida KT2440
gcgcaaucaccgcc

SEQ ID NO: 3573608 - RNA, 15 nt, Pseudomonas putida KT2440
gcgcaaugcccagcg

SEQ ID NO: 3573609 - RNA, 13 nt, Pseudomonas putida KT2440
gcgcacacuucgc

SEQ ID NO: 3573610 - RNA, 19 nt, Pseudomonas putida KT2440
gcgcacagcugccggccag

SEQ ID NO: 3573611 - RNA, 13 nt, Pseudomonas putida KT2440
gcgcaccagcggc

SEQ ID NO: 3573612 - RNA, 21 nt, Pseudomonas putida KT2440
gcgcaccaucggcuccagcgc

SEQ ID NO: 3573613 - RNA, 14 nt, Pseudomonas putida KT2440
gcgcaccgagcgcu

SEQ ID NO: 3573614 - RNA, 18 nt, Pseudomonas putida KT2440
gcgcaccgcuugcgcacg

SEQ ID NO: 3573615 - RNA, 22 nt, Pseudomonas putida KT2440
gcgcaccggaguccccaccggc

SEQ ID NO: 3573616 - RNA, 19 nt, Pseudomonas putida KT2440
gcgcaccgguuacacccau

SEQ ID NO: 3573617 - RNA, 16 nt, Pseudomonas putida KT2440
gcgcaccgugcaccag

SEQ ID NO: 3573618 - RNA, 22 nt, Pseudomonas putida KT2440
gcgcaccucggccagugcgccc

SEQ ID NO: 3573619 - RNA, 21 nt, Pseudomonas putida KT2440
gcgcaccuggauguugugcga

SEQ ID NO: 3573620 - RNA, 16 nt, Pseudomonas putida KT2440
gcgcaccuugugcacg

SEQ ID NO: 3573621 - RNA, 16 nt, Pseudomonas putida KT2440
gcgcacgaagaucacc

SEQ ID NO: 3573622 - RNA, 15 nt, Pseudomonas putida KT2440
gcgcacgaauacgcu

SEQ ID NO: 3573623 - RNA, 17 nt, Pseudomonas putida KT2440
gcgcacgcaucugcacc

SEQ ID NO: 3573624 - RNA, 22 nt, Pseudomonas putida KT2440
gcgcacgcaucugcaccggcag

SEQ ID NO: 3573625 - RNA, 23 nt, Pseudomonas putida KT2440
gcgcacgcaucugcaccggcagc

SEQ ID NO: 3573626 - RNA, 13 nt, Pseudomonas putida KT2440
gcgcacgccggua

SEQ ID NO: 3573627 - RNA, 13 nt, Pseudomonas putida KT2440
gcgcacgcgcuuu

SEQ ID NO: 3573628 - RNA, 17 nt, Pseudomonas putida KT2440
gcgcacgcugcccaggu

SEQ ID NO: 3573629 - RNA, 23 nt, Pseudomonas putida KT2440
gcgcacgcugcccaggugccagg

SEQ ID NO: 3573630 - RNA, 17 nt, Pseudomonas putida KT2440
gcgcacggcaucggccg

SEQ ID NO: 3573631 - RNA, 12 nt, Pseudomonas putida KT2440
gcgcacggccuc

SEQ ID NO: 3573632 - RNA, 17 nt, Pseudomonas putida KT2440
gcgcacggccuccacca

SEQ ID NO: 3573633 - RNA, 16 nt, Pseudomonas putida KT2440
gcgcacgguaggugau

SEQ ID NO: 3573634 - RNA, 13 nt, Pseudomonas putida KT2440
gcgcacggucucc

SEQ ID NO: 3573635 - RNA, 21 nt, Pseudomonas putida KT2440
gcgcacguacuccaccaaggc

SEQ ID NO: 3573636 - RNA, 13 nt, Pseudomonas putida KT2440
gcgcacguagcgc

SEQ ID NO: 3573637 - RNA, 16 nt, Pseudomonas putida KT2440
gcgcacguagcgcccg

SEQ ID NO: 3573638 - RNA, 22 nt, Pseudomonas putida KT2440
gcgcacguagcgcccgucuggc

SEQ ID NO: 3573639 - RNA, 16 nt, Pseudomonas putida KT2440
gcgcacucucccgcag

SEQ ID NO: 3573640 - RNA, 17 nt, Pseudomonas putida KT2440
gcgcacugaacagcgcc

SEQ ID NO: 3573641 - RNA, 19 nt, Pseudomonas putida KT2440
gcgcacugaacagcgccuu

SEQ ID NO: 3573642 - RNA, 18 nt, Pseudomonas putida KT2440
gcgcacugaauacaccag

SEQ ID NO: 3573643 - RNA, 20 nt, Pseudomonas putida KT2440
gcgcacugaauacaccagcu

SEQ ID NO: 3573644 - RNA, 22 nt, Pseudomonas putida KT2440
gcgcacugaauacaccagcuug

SEQ ID NO: 3573645 - RNA, 15 nt, Pseudomonas putida KT2440
gcgcacugccgccgg

SEQ ID NO: 3573646 - RNA, 11 nt, Pseudomonas putida KT2440
gcgcacuucca

SEQ ID NO: 3573647 - RNA, 16 nt, Pseudomonas putida KT2440
gcgcacuucguagcgc

SEQ ID NO: 3573648 - RNA, 13 nt, Pseudomonas putida KT2440
gcgcacuugccag

SEQ ID NO: 3573649 - RNA, 14 nt, Pseudomonas putida KT2440
gcgcacuugccagc

SEQ ID NO: 3573650 - RNA, 16 nt, Pseudomonas putida KT2440
gcgcacuuggccugcu

SEQ ID NO: 3573651 - RNA, 17 nt, Pseudomonas putida KT2440
gcgcacuuguuccagcc

SEQ ID NO: 3573652 - RNA, 19 nt, Pseudomonas putida KT2440
gcgcacuuguuccagccgc

SEQ ID NO: 3573653 - RNA, 17 nt, Pseudomonas putida KT2440
gcgcagacgggcgacgg

SEQ ID NO: 3573654 - RNA, 16 nt, Pseudomonas putida KT2440
gcgcagagccacgggu

SEQ ID NO: 3573655 - RNA, 17 nt, Pseudomonas putida KT2440
gcgcagagcgccccggc

SEQ ID NO: 3573656 - RNA, 19 nt, Pseudomonas putida KT2440
gcgcagagcgccccggcaa

SEQ ID NO: 3573657 - RNA, 13 nt, Pseudomonas putida KT2440
gcgcagaucccgc

SEQ ID NO: 3573658 - RNA, 17 nt, Pseudomonas putida KT2440
gcgcagaucccgcucgg

SEQ ID NO: 3573659 - RNA, 16 nt, Pseudomonas putida KT2440
gcgcagaugguggcau

SEQ ID NO: 3573660 - RNA, 16 nt, Pseudomonas putida KT2440
gcgcagauuccgcgau

SEQ ID NO: 3573661 - RNA, 16 nt, Pseudomonas putida KT2440
gcgcagcaaggucgcc

SEQ ID NO: 3573662 - RNA, 21 nt, Pseudomonas putida KT2440
gcgcagcaaggucgccgccgu

SEQ ID NO: 3573663 - RNA, 22 nt, Pseudomonas putida KT2440
gcgcagcaauacgcacaggcgc

SEQ ID NO: 3573664 - RNA, 24 nt, Pseudomonas putida KT2440
gcgcagcaauacgcacaggcgcag

SEQ ID NO: 3573665 - RNA, 19 nt, Pseudomonas putida KT2440
gcgcagcaccgugggcgcu

SEQ ID NO: 3573666 - RNA, 16 nt, Pseudomonas putida KT2440
gcgcagcagcaggccc

SEQ ID NO: 3573667 - RNA, 17 nt, Pseudomonas putida KT2440
gcgcagcagcaggcccg

SEQ ID NO: 3573668 - RNA, 13 nt, Pseudomonas putida KT2440
gcgcagcagcucc

SEQ ID NO: 3573669 - RNA, 22 nt, Pseudomonas putida KT2440
gcgcagcagcucccgagccagg

SEQ ID NO: 3573670 - RNA, 13 nt, Pseudomonas putida KT2440
gcgcagcaucugc

SEQ ID NO: 3573671 - RNA, 17 nt, Pseudomonas putida KT2440
gcgcagcaucugcacgu

SEQ ID NO: 3573672 - RNA, 15 nt, Pseudomonas putida KT2440
gcgcagcaucuuccu

SEQ ID NO: 3573673 - RNA, 17 nt, Pseudomonas putida KT2440
gcgcagccaaucggcgc

SEQ ID NO: 3573674 - RNA, 14 nt, Pseudomonas putida KT2440
gcgcagccaccagc

SEQ ID NO: 3573675 - RNA, 18 nt, Pseudomonas putida KT2440
gcgcagcccauucgcggg

SEQ ID NO: 3573676 - RNA, 13 nt, Pseudomonas putida KT2440
gcgcagccccaaa

SEQ ID NO: 3573677 - RNA, 23 nt, Pseudomonas putida KT2440
gcgcagcccccaccgggcuggca

SEQ ID NO: 3573678 - RNA, 16 nt, Pseudomonas putida KT2440
gcgcagcccucccagg

SEQ ID NO: 3573679 - RNA, 16 nt, Pseudomonas putida KT2440
gcgcagccggccuugc

SEQ ID NO: 3573680 - RNA, 13 nt, Pseudomonas putida KT2440
gcgcagccguucu

SEQ ID NO: 3573681 - RNA, 13 nt, Pseudomonas putida KT2440
gcgcagccuggcc

SEQ ID NO: 3573682 - RNA, 15 nt, Pseudomonas putida KT2440
gcgcagccuggcccu

SEQ ID NO: 3573683 - RNA, 18 nt, Pseudomonas putida KT2440
gcgcagcgacgaccugca

SEQ ID NO: 3573684 - RNA, 15 nt, Pseudomonas putida KT2440
gcgcagcgcacggcu

SEQ ID NO: 3573685 - RNA, 16 nt, Pseudomonas putida KT2440
gcgcagcgcacggcug

SEQ ID NO: 3573686 - RNA, 17 nt, Pseudomonas putida KT2440
gcgcagcgcacggcugu

SEQ ID NO: 3573687 - RNA, 18 nt, Pseudomonas putida KT2440
gcgcagcgcacuuccaca

SEQ ID NO: 3573688 - RNA, 17 nt, Pseudomonas putida KT2440
gcgcagcggcgucaccu

SEQ ID NO: 3573689 - RNA, 19 nt, Pseudomonas putida KT2440
gcgcagcguaauagcuggu

SEQ ID NO: 3573690 - RNA, 15 nt, Pseudomonas putida KT2440
gcgcagcuuccacca

SEQ ID NO: 3573691 - RNA, 17 nt, Pseudomonas putida KT2440
gcgcaggaacaggcuga

SEQ ID NO: 3573692 - RNA, 12 nt, Pseudomonas putida KT2440
gcgcaggaaccg

SEQ ID NO: 3573693 - RNA, 18 nt, Pseudomonas putida KT2440
gcgcaggcagcgauggcc

SEQ ID NO: 3573694 - RNA, 12 nt, Pseudomonas putida KT2440
gcgcaggcagcu

SEQ ID NO: 3573695 - RNA, 14 nt, Pseudomonas putida KT2440
gcgcaggccgacaa

SEQ ID NO: 3573696 - RNA, 24 nt, Pseudomonas putida KT2440
gcgcaggccgacaacagcaugcuc

SEQ ID NO: 3573697 - RNA, 12 nt, Pseudomonas putida KT2440
gcgcaggccgcu

SEQ ID NO: 3573698 - RNA, 16 nt, Pseudomonas putida KT2440
gcgcaggccgcuggcc

SEQ ID NO: 3573699 - RNA, 14 nt, Pseudomonas putida KT2440
gcgcaggcgcugca

SEQ ID NO: 3573700 - RNA, 15 nt, Pseudomonas putida KT2440
gcgcaggcgguuggc

SEQ ID NO: 3573701 - RNA, 21 nt, Pseudomonas putida KT2440
gcgcaggcugucgaacaggcu

SEQ ID NO: 3573702 - RNA, 16 nt, Pseudomonas putida KT2440
gcgcagggcaucgcgc

SEQ ID NO: 3573703 - RNA, 18 nt, Pseudomonas putida KT2440
gcgcagggcaucgcgcag

SEQ ID NO: 3573704 - RNA, 12 nt, Pseudomonas putida KT2440
gcgcagggcgcg

SEQ ID NO: 3573705 - RNA, 14 nt, Pseudomonas putida KT2440
gcgcagggcgcgaa

SEQ ID NO: 3573706 - RNA, 15 nt, Pseudomonas putida KT2440
gcgcagggcgcgaaa

SEQ ID NO: 3573707 - RNA, 23 nt, Pseudomonas putida KT2440
gcgccaucaaaugggucguuagc

SEQ ID NO: 3573708 - RNA, 15 nt, Pseudomonas putida KT2440
gcgccaucagcugcg

SEQ ID NO: 3573709 - RNA, 13 nt, Pseudomonas putida KT2440
gcgccaucgccca

SEQ ID NO: 3573710 - RNA, 22 nt, Pseudomonas putida KT2440
gcgccaucggcacgccagcagc

SEQ ID NO: 3573711 - RNA, 15 nt, Pseudomonas putida KT2440
gcgccaugagugcag

SEQ ID NO: 3573712 - RNA, 21 nt, Pseudomonas putida KT2440
gcgccaugccccccgccagca

SEQ ID NO: 3573713 - RNA, 22 nt, Pseudomonas putida KT2440
gcgccaugccccuaccgccaac

SEQ ID NO: 3573714 - RNA, 21 nt, Pseudomonas putida KT2440
gcgccauggccucgucgcggu

SEQ ID NO: 3573715 - RNA, 23 nt, Pseudomonas putida KT2440
gcgccauggccucgucgcggucc

SEQ ID NO: 3573716 - RNA, 20 nt, Pseudomonas putida KT2440
gcgccauggccuggcggguu

SEQ ID NO: 3573717 - RNA, 14 nt, Pseudomonas putida KT2440
gcgccauggcuugc

SEQ ID NO: 3573718 - RNA, 18 nt, Pseudomonas putida KT2440
gcgccauuggugcccuug

SEQ ID NO: 3573719 - RNA, 17 nt, Pseudomonas putida KT2440
gcgcccaaggucagcca

SEQ ID NO: 3573720 - RNA, 16 nt, Pseudomonas putida KT2440
gcgcccaaucggguaa

SEQ ID NO: 3573721 - RNA, 19 nt, Pseudomonas putida KT2440
gcgcccaaugcagccgccc

SEQ ID NO: 3573722 - RNA, 19 nt, Pseudomonas putida KT2440
gcgcccacgcggguccagc

SEQ ID NO: 3573723 - RNA, 20 nt, Pseudomonas putida KT2440
gcgcccacgcggguccagcg

SEQ ID NO: 3573724 - RNA, 21 nt, Pseudomonas putida KT2440
gcgcccacgcggguccagcgc

SEQ ID NO: 3573725 - RNA, 18 nt, Pseudomonas putida KT2440
gcgcccagaucagcagca

SEQ ID NO: 3573726 - RNA, 16 nt, Pseudomonas putida KT2440
gcgcccaguagcgcca

SEQ ID NO: 3573727 - RNA, 18 nt, Pseudomonas putida KT2440
gcgcccaguagcgccacc

SEQ ID NO: 3573728 - RNA, 17 nt, Pseudomonas putida KT2440
gcgcccaucucaggccc

SEQ ID NO: 3573729 - RNA, 23 nt, Pseudomonas putida KT2440
gcgcccaugaaguucauccagau

SEQ ID NO: 3573730 - RNA, 17 nt, Pseudomonas putida KT2440
gcgccccacuuccagcg

SEQ ID NO: 3573731 - RNA, 20 nt, Pseudomonas putida KT2440
gcgccccacuuccagcgaca

SEQ ID NO: 3573732 - RNA, 16 nt, Pseudomonas putida KT2440
gcgccccagcagcgcu

SEQ ID NO: 3573733 - RNA, 14 nt, Pseudomonas putida KT2440
gcgccccagguugc

SEQ ID NO: 3573734 - RNA, 13 nt, Pseudomonas putida KT2440
gcgccccgcucgc

SEQ ID NO: 3573735 - RNA, 12 nt, Pseudomonas putida KT2440
gcgccccggcga

SEQ ID NO: 3573736 - RNA, 17 nt, Pseudomonas putida KT2440
gcgcccgaacaacaggu

SEQ ID NO: 3573737 - RNA, 21 nt, Pseudomonas putida KT2440
gcgcccgaacaacaggucggc

SEQ ID NO: 3573738 - RNA, 14 nt, Pseudomonas putida KT2440
gcgcccgaggcaau

SEQ ID NO: 3573739 - RNA, 21 nt, Pseudomonas putida KT2440
gcgcccgcaacagaucccgcu

SEQ ID NO: 3573740 - RNA, 12 nt, Pseudomonas putida KT2440
gcgcccgcccac

SEQ ID NO: 3573741 - RNA, 13 nt, Pseudomonas putida KT2440
gcgcccgccccuc

SEQ ID NO: 3573742 - RNA, 17 nt, Pseudomonas putida KT2440
gcgcccgcgaagaggcc

SEQ ID NO: 3573743 - RNA, 23 nt, Pseudomonas putida KT2440
gcgcccgcgaagaggccggcaca

SEQ ID NO: 3573744 - RNA, 18 nt, Pseudomonas putida KT2440
gcgcccgcucccacaggu

SEQ ID NO: 3573745 - RNA, 16 nt, Pseudomonas putida KT2440
gcgcccgcugcgccgc

SEQ ID NO: 3573746 - RNA, 12 nt, Pseudomonas putida KT2440
gcgcccggcaaa

SEQ ID NO: 3573747 - RNA, 19 nt, Pseudomonas putida KT2440
gcgcccggcagaucgagcg

SEQ ID NO: 3573748 - RNA, 22 nt, Pseudomonas putida KT2440
gcgcccggcagaucgagcgccg

SEQ ID NO: 3573749 - RNA, 14 nt, Pseudomonas putida KT2440
gcgcccggccaggu

SEQ ID NO: 3573750 - RNA, 16 nt, Pseudomonas putida KT2440
gcgcccggcgcagcau

SEQ ID NO: 3573751 - RNA, 12 nt, Pseudomonas putida KT2440
gcgcccggcgcu

SEQ ID NO: 3573752 - RNA, 13 nt, Pseudomonas putida KT2440
gcgcccggcgcug

SEQ ID NO: 3573753 - RNA, 13 nt, Pseudomonas putida KT2440
gcgcccggcuugc

SEQ ID NO: 3573754 - RNA, 12 nt, Pseudomonas putida KT2440
gcgcccgggcca

SEQ ID NO: 3573755 - RNA, 19 nt, Pseudomonas putida KT2440
gcgcccggggcaaugccga

SEQ ID NO: 3573756 - RNA, 15 nt, Pseudomonas putida KT2440
gcgcccggugcaagc

SEQ ID NO: 3573757 - RNA, 16 nt, Pseudomonas putida KT2440
gcgcccggugcaagcc

SEQ ID NO: 3573758 - RNA, 20 nt, Pseudomonas putida KT2440
gcgcccgguggcgcggccgg

SEQ ID NO: 3573759 - RNA, 16 nt, Pseudomonas putida KT2440
gcgcccguaacgguca

SEQ ID NO: 3573760 - RNA, 16 nt, Pseudomonas putida KT2440
gcgcccgucuggcugc

SEQ ID NO: 3573761 - RNA, 17 nt, Pseudomonas putida KT2440
gcgcccguugcgcuuga

SEQ ID NO: 3573762 - RNA, 19 nt, Pseudomonas putida KT2440
gcgcccugcaaaggcaugg

SEQ ID NO: 3573763 - RNA, 23 nt, Pseudomonas putida KT2440
gcgcccugccuuagaacagaucc

SEQ ID NO: 3573764 - RNA, 16 nt, Pseudomonas putida KT2440
gcgcccugugggagcg

SEQ ID NO: 3573765 - RNA, 14 nt, Pseudomonas putida KT2440
gcgcccuucgcgga

SEQ ID NO: 3573766 - RNA, 15 nt, Pseudomonas putida KT2440
gcgcccuugcggacc

SEQ ID NO: 3573767 - RNA, 20 nt, Pseudomonas putida KT2440
gcgccgaccaagcgccccac

SEQ ID NO: 3573768 - RNA, 12 nt, Pseudomonas putida KT2440
gcgccgaccagu

SEQ ID NO: 3573769 - RNA, 20 nt, Pseudomonas putida KT2440
gcgccgacccugugggagcg

SEQ ID NO: 3573770 - RNA, 16 nt, Pseudomonas putida KT2440
gcgccgagccauagcg

SEQ ID NO: 3573771 - RNA, 15 nt, Pseudomonas putida KT2440
gcgccgagcgaguga

SEQ ID NO: 3573772 - RNA, 20 nt, Pseudomonas putida KT2440
gcgccgagcgagugaccuug

SEQ ID NO: 3573773 - RNA, 20 nt, Pseudomonas putida KT2440
gcgccgagcgcggcgcccag

SEQ ID NO: 3573774 - RNA, 22 nt, Pseudomonas putida KT2440
gcgccgagcgcggcgcccagca

SEQ ID NO: 3573775 - RNA, 17 nt, Pseudomonas putida KT2440
gcgccgauaaagguugc

SEQ ID NO: 3573776 - RNA, 22 nt, Pseudomonas putida KT2440
gcgccgauaaagguugcccggc

SEQ ID NO: 3573777 - RNA, 18 nt, Pseudomonas putida KT2440
gcgccgaucacaccggca

SEQ ID NO: 3573778 - RNA, 13 nt, Pseudomonas putida KT2440
gcgccgaucagcu

SEQ ID NO: 3573779 - RNA, 19 nt, Pseudomonas putida KT2440
gcgccgaugaagcaggccg

SEQ ID NO: 3573780 - RNA, 23 nt, Pseudomonas putida KT2440
gcgccgaugaguugucugccgaa

SEQ ID NO: 3573781 - RNA, 21 nt, Pseudomonas putida KT2440
gcgccgaugcucgucagcccc

SEQ ID NO: 3573782 - RNA, 22 nt, Pseudomonas putida KT2440
gcgccgaugcucgucagccccu

SEQ ID NO: 3573783 - RNA, 16 nt, Pseudomonas putida KT2440
gcgccgauugcugccg

SEQ ID NO: 3573784 - RNA, 17 nt, Pseudomonas putida KT2440
gcgccgcagguccaccu

SEQ ID NO: 3573785 - RNA, 21 nt, Pseudomonas putida KT2440
gcgccgccaaaaaauccgccu

SEQ ID NO: 3573786 - RNA, 22 nt, Pseudomonas putida KT2440
gcgccgccaaccccuccagcac

SEQ ID NO: 3573787 - RNA, 19 nt, Pseudomonas putida KT2440
gcgccgccacauccagcgc

SEQ ID NO: 3573788 - RNA, 23 nt, Pseudomonas putida KT2440
gcgccgccacauccagcgccucc

SEQ ID NO: 3573789 - RNA, 12 nt, Pseudomonas putida KT2440
gcgccgccagcu

SEQ ID NO: 3573790 - RNA, 15 nt, Pseudomonas putida KT2440
gcgccgccagcugcu

SEQ ID NO: 3573791 - RNA, 16 nt, Pseudomonas putida KT2440
gcgccgccaggcagca

SEQ ID NO: 3573792 - RNA, 13 nt, Pseudomonas putida KT2440
gcgccgccaggcc

SEQ ID NO: 3573793 - RNA, 15 nt, Pseudomonas putida KT2440
gcgccgccaggccca

SEQ ID NO: 3573794 - RNA, 12 nt, Pseudomonas putida KT2440
gcgccgccaugc

SEQ ID NO: 3573795 - RNA, 15 nt, Pseudomonas putida KT2440
gcgccgcccagcucu

SEQ ID NO: 3573796 - RNA, 16 nt, Pseudomonas putida KT2440
gcgccgcccagcucuu

SEQ ID NO: 3573797 - RNA, 12 nt, Pseudomonas putida KT2440
gcgccgcccagu

SEQ ID NO: 3573798 - RNA, 15 nt, Pseudomonas putida KT2440
gcgccgcccgcgcgg

SEQ ID NO: 3573799 - RNA, 14 nt, Pseudomonas putida KT2440
gcgccgccgauagc

SEQ ID NO: 3573800 - RNA, 21 nt, Pseudomonas putida KT2440
gcgccgccgauagcagcaccg

SEQ ID NO: 3573801 - RNA, 15 nt, Pseudomonas putida KT2440
gcgccgccgcugcug

SEQ ID NO: 3573802 - RNA, 20 nt, Pseudomonas putida KT2440
gcgccgccgcugcugcgccu

SEQ ID NO: 3573803 - RNA, 15 nt, Pseudomonas putida KT2440
gcgccgccggcugaa

SEQ ID NO: 3573804 - RNA, 12 nt, Pseudomonas putida KT2440
gcgccgccuucg

SEQ ID NO: 3573805 - RNA, 15 nt, Pseudomonas putida KT2440
gcgccgcgcccauga

SEQ ID NO: 3573806 - RNA, 12 nt, Pseudomonas putida KT2440
gcgccgcggcca

SEQ ID NO: 3573807 - RNA, 16 nt, Pseudomonas putida KT2440
gcgccgcucgcccagc

SEQ ID NO: 3573808 - RNA, 19 nt, Pseudomonas putida KT2440
gcgccgcucgcccagcagc

SEQ ID NO: 3573809 - RNA, 14 nt, Pseudomonas putida KT2440
gcgccgcucugccc

SEQ ID NO: 3573810 - RNA, 14 nt, Pseudomonas putida KT2440
gcgccgcugccugg

SEQ ID NO: 3573811 - RNA, 22 nt, Pseudomonas putida KT2440
gcgccggauuucuuccauggcc

SEQ ID NO: 3573812 - RNA, 15 nt, Pseudomonas putida KT2440
gcgccggccgcacuu

SEQ ID NO: 3573813 - RNA, 15 nt, Pseudomonas putida KT2440
gcgcgccggcgucga

SEQ ID NO: 3573814 - RNA, 16 nt, Pseudomonas putida KT2440
gcgcgccuccagcuga

SEQ ID NO: 3573815 - RNA, 23 nt, Pseudomonas putida KT2440
gcgcgccugcaccugacgagcga

SEQ ID NO: 3573816 - RNA, 16 nt, Pseudomonas putida KT2440
gcgcgccuggucgccg

SEQ ID NO: 3573817 - RNA, 12 nt, Pseudomonas putida KT2440
gcgcgcgaauca

SEQ ID NO: 3573818 - RNA, 15 nt, Pseudomonas putida KT2440
gcgcgcgacagcacg

SEQ ID NO: 3573819 - RNA, 16 nt, Pseudomonas putida KT2440
gcgcgcgagagcgacg

SEQ ID NO: 3573820 - RNA, 20 nt, Pseudomonas putida KT2440
gcgcgcgcauccacaggcgc

SEQ ID NO: 3573821 - RNA, 15 nt, Pseudomonas putida KT2440
gcgcgcgcccaccgg

SEQ ID NO: 3573822 - RNA, 22 nt, Pseudomonas putida KT2440
gcgcgcgccuggguggcgcggu

SEQ ID NO: 3573823 - RNA, 16 nt, Pseudomonas putida KT2440
gcgcgcgguucaccag

SEQ ID NO: 3573824 - RNA, 16 nt, Pseudomonas putida KT2440
gcgcgcugagcagguu

SEQ ID NO: 3573825 - RNA, 14 nt, Pseudomonas putida KT2440
gcgcgcugcgcaag

SEQ ID NO: 3573826 - RNA, 16 nt, Pseudomonas putida KT2440
gcgcggaacacacgcu

SEQ ID NO: 3573827 - RNA, 23 nt, Pseudomonas putida KT2440
gcgcggaacacacgcuccgggug

SEQ ID NO: 3573828 - RNA, 23 nt, Pseudomonas putida KT2440
gcgcggacccuugugugggccuu

SEQ ID NO: 3573829 - RNA, 12 nt, Pseudomonas putida KT2440
gcgcggcaaagg

SEQ ID NO: 3573830 - RNA, 16 nt, Pseudomonas putida KT2440
gcgcggcaugcccgcc

SEQ ID NO: 3573831 - RNA, 18 nt, Pseudomonas putida KT2440
gcgcggcaugcccgcccc

SEQ ID NO: 3573832 - RNA, 15 nt, Pseudomonas putida KT2440
gcgcggccacgcccu

SEQ ID NO: 3573833 - RNA, 19 nt, Pseudomonas putida KT2440
gcgcggccggucgaagaag

SEQ ID NO: 3573834 - RNA, 17 nt, Pseudomonas putida KT2440
gcgcggcgcccagcaac

SEQ ID NO: 3573835 - RNA, 12 nt, Pseudomonas putida KT2440
gcgcggcgcgcc

SEQ ID NO: 3573836 - RNA, 14 nt, Pseudomonas putida KT2440
gcgcggcuugcucg

SEQ ID NO: 3573837 - RNA, 18 nt, Pseudomonas putida KT2440
gcgcggcuugcucgcggc

SEQ ID NO: 3573838 - RNA, 22 nt, Pseudomonas putida KT2440
gcgcgggcaauggccacacgcu

SEQ ID NO: 3573839 - RNA, 16 nt, Pseudomonas putida KT2440
gcgcgggcccuguggg

SEQ ID NO: 3573840 - RNA, 13 nt, Pseudomonas putida KT2440
gcgcgggcgcagg

SEQ ID NO: 3573841 - RNA, 13 nt, Pseudomonas putida KT2440
gcgcggggcccga

SEQ ID NO: 3573842 - RNA, 17 nt, Pseudomonas putida KT2440
gcgcggggugaucgccu

SEQ ID NO: 3573843 - RNA, 22 nt, Pseudomonas putida KT2440
gcgcgggucuuccaccaccucc

SEQ ID NO: 3573844 - RNA, 19 nt, Pseudomonas putida KT2440
gcgcggguuuacccgcgaa

SEQ ID NO: 3573845 - RNA, 20 nt, Pseudomonas putida KT2440
gcgcggguuuacccgcgaau

SEQ ID NO: 3573846 - RNA, 19 nt, Pseudomonas putida KT2440
gcgcggguuugcccgcgag

SEQ ID NO: 3573847 - RNA, 22 nt, Pseudomonas putida KT2440
gcgcgguaagauugcaggccau

SEQ ID NO: 3573848 - RNA, 15 nt, Pseudomonas putida KT2440
gcgcggucaagcucg

SEQ ID NO: 3573849 - RNA, 15 nt, Pseudomonas putida KT2440
gcgcggugaccagcg

SEQ ID NO: 3573850 - RNA, 17 nt, Pseudomonas putida KT2440
gcgcggugaccagcggc

SEQ ID NO: 3573851 - RNA, 21 nt, Pseudomonas putida KT2440
gcgcggugaccagcggcagca

SEQ ID NO: 3573852 - RNA, 23 nt, Pseudomonas putida KT2440
gcgcggugaccagcggcagcaag

SEQ ID NO: 3573853 - RNA, 16 nt, Pseudomonas putida KT2440
gcgcggugauggcgca

SEQ ID NO: 3573854 - RNA, 16 nt, Pseudomonas putida KT2440
gcgcggugccggcagc

SEQ ID NO: 3573855 - RNA, 17 nt, Pseudomonas putida KT2440
gcgcggugccggcagcu

SEQ ID NO: 3573856 - RNA, 21 nt, Pseudomonas putida KT2440
gcgcgguucuucgccugcagc

SEQ ID NO: 3573857 - RNA, 17 nt, Pseudomonas putida KT2440
gcgcgguuuuuucaugc

SEQ ID NO: 3573858 - RNA, 13 nt, Pseudomonas putida KT2440
gcgcguacagcga

SEQ ID NO: 3573859 - RNA, 19 nt, Pseudomonas putida KT2440
gcgcguaguacuccagcag

SEQ ID NO: 3573860 - RNA, 21 nt, Pseudomonas putida KT2440
gcgcguaguacuccagcagcg

SEQ ID NO: 3573861 - RNA, 22 nt, Pseudomonas putida KT2440
gcgcguaguacuccagcagcgc

SEQ ID NO: 3573862 - RNA, 23 nt, Pseudomonas putida KT2440
gcgcguauccuugcccaccagga

SEQ ID NO: 3573863 - RNA, 16 nt, Pseudomonas putida KT2440
gcgcgucauccgccaa

SEQ ID NO: 3573864 - RNA, 12 nt, Pseudomonas putida KT2440
gcgcguccagca

SEQ ID NO: 3573865 - RNA, 18 nt, Pseudomonas putida KT2440
gcgcguccagcaacagcu

SEQ ID NO: 3573866 - RNA, 21 nt, Pseudomonas putida KT2440
gcgcguccagcaacagcugcc

SEQ ID NO: 3573867 - RNA, 18 nt, Pseudomonas putida KT2440
gcgcguccauggcgccga

SEQ ID NO: 3573868 - RNA, 23 nt, Pseudomonas putida KT2440
gcgcgucccccgguaccagcagg

SEQ ID NO: 3573869 - RNA, 22 nt, Pseudomonas putida KT2440
gcgcgucucuuucaggcacagc

SEQ ID NO: 3573870 - RNA, 15 nt, Pseudomonas putida KT2440
gcgcgucugauagcc

SEQ ID NO: 3573871 - RNA, 20 nt, Pseudomonas putida KT2440
gcgcgugcggggcaucgccg

SEQ ID NO: 3573872 - RNA, 14 nt, Pseudomonas putida KT2440
gcgcguugcagcca

SEQ ID NO: 3573873 - RNA, 23 nt, Pseudomonas putida KT2440
gcgcuaaaggccgcuccugcaca

SEQ ID NO: 3573874 - RNA, 16 nt, Pseudomonas putida KT2440
gcgcuacaagccggcg

SEQ ID NO: 3573875 - RNA, 18 nt, Pseudomonas putida KT2440
gcgcuacaagccggcgcu

SEQ ID NO: 3573876 - RNA, 15 nt, Pseudomonas putida KT2440
gcgcuacggcgucga

SEQ ID NO: 3573877 - RNA, 21 nt, Pseudomonas putida KT2440
gcgcuaugccuuggaggcugg

SEQ ID NO: 3573878 - RNA, 16 nt, Pseudomonas putida KT2440
gcgcucaaccagccgc

SEQ ID NO: 3573879 - RNA, 18 nt, Pseudomonas putida KT2440
gcgcucaaccagccgccu

SEQ ID NO: 3573880 - RNA, 17 nt, Pseudomonas putida KT2440
gcgcucaaccgaccugc

SEQ ID NO: 3573881 - RNA, 19 nt, Pseudomonas putida KT2440
gcgcucaaccgaccugcaa

SEQ ID NO: 3573882 - RNA, 22 nt, Pseudomonas putida KT2440
gcgcucaaccgaccugcaacgu

SEQ ID NO: 3573883 - RNA, 15 nt, Pseudomonas putida KT2440
gcgcucaauggcacc

SEQ ID NO: 3573884 - RNA, 15 nt, Pseudomonas putida KT2440
gcgcucacugcaucg

SEQ ID NO: 3573885 - RNA, 23 nt, Pseudomonas putida KT2440
gcgcucaggcguggaaaaggcgc

SEQ ID NO: 3573886 - RNA, 16 nt, Pseudomonas putida KT2440
gcgcuccagcaacgga

SEQ ID NO: 3573887 - RNA, 20 nt, Pseudomonas putida KT2440
gcgcuccauguaacgcucca

SEQ ID NO: 3573888 - RNA, 22 nt, Pseudomonas putida KT2440
gcgcuccccgguaaugcuggug

SEQ ID NO: 3573889 - RNA, 18 nt, Pseudomonas putida KT2440
gcgcuccgccaaacccca

SEQ ID NO: 3573890 - RNA, 22 nt, Pseudomonas putida KT2440
gcgcuccgccaauugcgccagc

SEQ ID NO: 3573891 - RNA, 11 nt, Pseudomonas putida KT2440
gcgcuccucca

SEQ ID NO: 3573892 - RNA, 16 nt, Pseudomonas putida KT2440
gcgcuccuggucaucg

SEQ ID NO: 3573893 - RNA, 18 nt, Pseudomonas putida KT2440
gcgcucgaaacgccgggu

SEQ ID NO: 3573894 - RNA, 17 nt, Pseudomonas putida KT2440
gcgcucgaacaacgccu

SEQ ID NO: 3573895 - RNA, 15 nt, Pseudomonas putida KT2440
gcgcucgacauccag

SEQ ID NO: 3573896 - RNA, 23 nt, Pseudomonas putida KT2440
gcgcucgacauccagcgccgcca

SEQ ID NO: 3573897 - RNA, 23 nt, Pseudomonas putida KT2440
gcgcucgacgcgcgcagccuggc

SEQ ID NO: 3573898 - RNA, 17 nt, Pseudomonas putida KT2440
gcgcucgagcccgccag

SEQ ID NO: 3573899 - RNA, 20 nt, Pseudomonas putida KT2440
gcgcucgaucucacaggcga

SEQ ID NO: 3573900 - RNA, 17 nt, Pseudomonas putida KT2440
gcgcucgaugcgguggg

SEQ ID NO: 3573901 - RNA, 13 nt, Pseudomonas putida KT2440
gcgcucgcgcagg

SEQ ID NO: 3573902 - RNA, 22 nt, Pseudomonas putida KT2440
gcgcucgcgguucaucggcaaa

SEQ ID NO: 3573903 - RNA, 14 nt, Pseudomonas putida KT2440
gcgcucgcuccagg

SEQ ID NO: 3573904 - RNA, 21 nt, Pseudomonas putida KT2440
gcgcucgcugccggcguggcg

SEQ ID NO: 3573905 - RNA, 23 nt, Pseudomonas putida KT2440
gcgcucgggggugcacagcgucc

SEQ ID NO: 3573906 - RNA, 24 nt, Pseudomonas putida KT2440
gcgcucgggggugcacagcgucca

SEQ ID NO: 3573907 - RNA, 20 nt, Pseudomonas putida KT2440
gcgcucggucucacaggcgc

SEQ ID NO: 3573908 - RNA, 20 nt, Pseudomonas putida KT2440
gcgcucggucucauaggcgc

SEQ ID NO: 3573909 - RNA, 15 nt, Pseudomonas putida KT2440
gcgcucguaggcugc

SEQ ID NO: 3573910 - RNA, 23 nt, Pseudomonas putida KT2440
gcgcucguaggcuucacgcgcca

SEQ ID NO: 3573911 - RNA, 14 nt, Pseudomonas putida KT2440
gcgcucgucgaacu

SEQ ID NO: 3573912 - RNA, 21 nt, Pseudomonas putida KT2440
gcgcucgucgaacucgcgccc

SEQ ID NO: 3573913 - RNA, 23 nt, Pseudomonas putida KT2440
gcgcucgucgaacucgcgcccac

SEQ ID NO: 3573914 - RNA, 20 nt, Pseudomonas putida KT2440
gcgcucguugcgagcgaaca

SEQ ID NO: 3573915 - RNA, 21 nt, Pseudomonas putida KT2440
gcgcucguugcgagcgaacag

SEQ ID NO: 3573916 - RNA, 17 nt, Pseudomonas putida KT2440
gcgcugaccaacaggcu

SEQ ID NO: 3573917 - RNA, 13 nt, Pseudomonas putida KT2440
gcggcaaaggugg

SEQ ID NO: 3573918 - RNA, 22 nt, Pseudomonas putida KT2440
gcggcaaagguggcaccgccgc

SEQ ID NO: 3573919 - RNA, 17 nt, Pseudomonas putida KT2440
gcggcaacaccagcagc

SEQ ID NO: 3573920 - RNA, 24 nt, Pseudomonas putida KT2440
gcggcaacaccagcagccacgggu

SEQ ID NO: 3573921 - RNA, 19 nt, Pseudomonas putida KT2440
gcggcaaccaccaacagca

SEQ ID NO: 3573922 - RNA, 20 nt, Pseudomonas putida KT2440
gcggcaaccaccaacagcac

SEQ ID NO: 3573923 - RNA, 12 nt, Pseudomonas putida KT2440
gcggcaaccgga

SEQ ID NO: 3573924 - RNA, 13 nt, Pseudomonas putida KT2440
gcggcaaccugca

SEQ ID NO: 3573925 - RNA, 16 nt, Pseudomonas putida KT2440
gcggcaaccugcucgc

SEQ ID NO: 3573926 - RNA, 19 nt, Pseudomonas putida KT2440
gcggcaagcccgcuccuac

SEQ ID NO: 3573927 - RNA, 17 nt, Pseudomonas putida KT2440
gcggcaaggucaacggc

SEQ ID NO: 3573928 - RNA, 16 nt, Pseudomonas putida KT2440
gcggcaaucacgaaca

SEQ ID NO: 3573929 - RNA, 23 nt, Pseudomonas putida KT2440
gcggcaaucacgaacaccagccc

SEQ ID NO: 3573930 - RNA, 18 nt, Pseudomonas putida KT2440
gcggcaaugcgccggucg

SEQ ID NO: 3573931 - RNA, 22 nt, Pseudomonas putida KT2440
gcggcaaugcgccggucgcguu

SEQ ID NO: 3573932 - RNA, 21 nt, Pseudomonas putida KT2440
gcggcacaacgcgccaccgcc

SEQ ID NO: 3573933 - RNA, 18 nt, Pseudomonas putida KT2440
gcggcacaucucaaggcu

SEQ ID NO: 3573934 - RNA, 20 nt, Pseudomonas putida KT2440
gcggcacccaauagcccacc

SEQ ID NO: 3573935 - RNA, 18 nt, Pseudomonas putida KT2440
gcggcaccgucgccugca

SEQ ID NO: 3573936 - RNA, 17 nt, Pseudomonas putida KT2440
gcggcaccucguccagg

SEQ ID NO: 3573937 - RNA, 23 nt, Pseudomonas putida KT2440
gcggcacuaccaggcccaacagc

SEQ ID NO: 3573938 - RNA, 22 nt, Pseudomonas putida KT2440
gcggcacugaugcccaugccaa

SEQ ID NO: 3573939 - RNA, 16 nt, Pseudomonas putida KT2440
gcggcagaacacaucg

SEQ ID NO: 3573940 - RNA, 14 nt, Pseudomonas putida KT2440
gcggcagauccugc

SEQ ID NO: 3573941 - RNA, 17 nt, Pseudomonas putida KT2440
gcggcagauccugcagc

SEQ ID NO: 3573942 - RNA, 19 nt, Pseudomonas putida KT2440
gcggcagauccugcagccg

SEQ ID NO: 3573943 - RNA, 14 nt, Pseudomonas putida KT2440
gcggcagcagcagc

SEQ ID NO: 3573944 - RNA, 18 nt, Pseudomonas putida KT2440
gcggcagcaucgaccugc

SEQ ID NO: 3573945 - RNA, 22 nt, Pseudomonas putida KT2440
gcggcagcaucgaccugccacu

SEQ ID NO: 3573946 - RNA, 16 nt, Pseudomonas putida KT2440
gcggcagcaugaacag

SEQ ID NO: 3573947 - RNA, 17 nt, Pseudomonas putida KT2440
gcggcagcaugaacagc

SEQ ID NO: 3573948 - RNA, 19 nt, Pseudomonas putida KT2440
gcggcagcaugaacagcgc

SEQ ID NO: 3573949 - RNA, 21 nt, Pseudomonas putida KT2440
gcggcagcaugaacagcgcug

SEQ ID NO: 3573950 - RNA, 13 nt, Pseudomonas putida KT2440
gcggcagccagca

SEQ ID NO: 3573951 - RNA, 15 nt, Pseudomonas putida KT2440
gcggcagccagcauc

SEQ ID NO: 3573952 - RNA, 15 nt, Pseudomonas putida KT2440
gcggcagcgauccca

SEQ ID NO: 3573953 - RNA, 17 nt, Pseudomonas putida KT2440
gcggcaggcgcagcugc

SEQ ID NO: 3573954 - RNA, 12 nt, Pseudomonas putida KT2440
gcggcaggcugg

SEQ ID NO: 3573955 - RNA, 16 nt, Pseudomonas putida KT2440
gcggcaggcuggcgug

SEQ ID NO: 3573956 - RNA, 13 nt, Pseudomonas putida KT2440
gcggcagguaggc

SEQ ID NO: 3573957 - RNA, 18 nt, Pseudomonas putida KT2440
gcggcaguugcaggcgca

SEQ ID NO: 3573958 - RNA, 18 nt, Pseudomonas putida KT2440
gcggcaguugccugccuu

SEQ ID NO: 3573959 - RNA, 19 nt, Pseudomonas putida KT2440
gcggcaguugccugccuug

SEQ ID NO: 3573960 - RNA, 18 nt, Pseudomonas putida KT2440
gcggcauagcucgagaaa

SEQ ID NO: 3573961 - RNA, 14 nt, Pseudomonas putida KT2440
gcggcaucagcuca

SEQ ID NO: 3573962 - RNA, 19 nt, Pseudomonas putida KT2440
gcggcaugaaggcccagcu

SEQ ID NO: 3573963 - RNA, 16 nt, Pseudomonas putida KT2440
gcggcaugucgaugcg

SEQ ID NO: 3573964 - RNA, 15 nt, Pseudomonas putida KT2440
gcggccaaggcgugg

SEQ ID NO: 3573965 - RNA, 19 nt, Pseudomonas putida KT2440
gcggccaaggcguggcuug

SEQ ID NO: 3573966 - RNA, 23 nt, Pseudomonas putida KT2440
gcggccaaugaucgagcgcaccu

SEQ ID NO: 3573967 - RNA, 14 nt, Pseudomonas putida KT2440
gcggccaaugcacg

SEQ ID NO: 3573968 - RNA, 17 nt, Pseudomonas putida KT2440
gcggccaaugcacgccu

SEQ ID NO: 3573969 - RNA, 14 nt, Pseudomonas putida KT2440
gcggccaaugcugc

SEQ ID NO: 3573970 - RNA, 16 nt, Pseudomonas putida KT2440
gcggccacagcgccaa

SEQ ID NO: 3573971 - RNA, 17 nt, Pseudomonas putida KT2440
gcggccacagcgccaac

SEQ ID NO: 3573972 - RNA, 20 nt, Pseudomonas putida KT2440
gcggccacagcgccaacgcc

SEQ ID NO: 3573973 - RNA, 13 nt, Pseudomonas putida KT2440
gcggccaccgccu

SEQ ID NO: 3573974 - RNA, 20 nt, Pseudomonas putida KT2440
gcggccaccggccacgcgca

SEQ ID NO: 3573975 - RNA, 15 nt, Pseudomonas putida KT2440
gcggccaccugcccc

SEQ ID NO: 3573976 - RNA, 20 nt, Pseudomonas putida KT2440
gcggccacgcccuuuuucac

SEQ ID NO: 3573977 - RNA, 12 nt, Pseudomonas putida KT2440
gcggccagcacg

SEQ ID NO: 3573978 - RNA, 14 nt, Pseudomonas putida KT2440
gcggccagcccgcc

SEQ ID NO: 3573979 - RNA, 13 nt, Pseudomonas putida KT2440
gcggccagcgcau

SEQ ID NO: 3573980 - RNA, 13 nt, Pseudomonas putida KT2440
gcggccagcgccu

SEQ ID NO: 3573981 - RNA, 18 nt, Pseudomonas putida KT2440
gcggccaggccggcgcag

SEQ ID NO: 3573982 - RNA, 21 nt, Pseudomonas putida KT2440
gcggccagggcaucggacagg

SEQ ID NO: 3573983 - RNA, 23 nt, Pseudomonas putida KT2440
gcggcccacagugcuuccagcag

SEQ ID NO: 3573984 - RNA, 16 nt, Pseudomonas putida KT2440
gcggcccauucgcggg

SEQ ID NO: 3573985 - RNA, 12 nt, Pseudomonas putida KT2440
gcggccccagau

SEQ ID NO: 3573986 - RNA, 15 nt, Pseudomonas putida KT2440
gcggccccaguggcu

SEQ ID NO: 3573987 - RNA, 18 nt, Pseudomonas putida KT2440
gcggcccccacgccgacc

SEQ ID NO: 3573988 - RNA, 22 nt, Pseudomonas putida KT2440
gcggccccggauucacggauca

SEQ ID NO: 3573989 - RNA, 14 nt, Pseudomonas putida KT2440
gcggccccuggaac

SEQ ID NO: 3573990 - RNA, 14 nt, Pseudomonas putida KT2440
gcggcccgccggca

SEQ ID NO: 3573991 - RNA, 15 nt, Pseudomonas putida KT2440
gcggcccucgguggc

SEQ ID NO: 3573992 - RNA, 19 nt, Pseudomonas putida KT2440
gcggcccuuaaggucaauc

SEQ ID NO: 3573993 - RNA, 22 nt, Pseudomonas putida KT2440
gcggcccuucgcgggcacgccc

SEQ ID NO: 3573994 - RNA, 18 nt, Pseudomonas putida KT2440
gcggccgaaggcgcuggc

SEQ ID NO: 3573995 - RNA, 21 nt, Pseudomonas putida KT2440
gcggccgaaggcgcuggcgag

SEQ ID NO: 3573996 - RNA, 22 nt, Pseudomonas putida KT2440
gcggccgaggccgauuuggccc

SEQ ID NO: 3573997 - RNA, 19 nt, Pseudomonas putida KT2440
gcggccgaucacucggcag

SEQ ID NO: 3573998 - RNA, 13 nt, Pseudomonas putida KT2440
gcggccgcuggua

SEQ ID NO: 3573999 - RNA, 13 nt, Pseudomonas putida KT2440
gcggccgggucga

SEQ ID NO: 3574000 - RNA, 20 nt, Pseudomonas putida KT2440
gcggccgggucgauagccag

SEQ ID NO: 3574001 - RNA, 22 nt, Pseudomonas putida KT2440
gcggccgggucgauagccagcc

SEQ ID NO: 3574002 - RNA, 13 nt, Pseudomonas putida KT2440
gcggccggucacc

SEQ ID NO: 3574003 - RNA, 15 nt, Pseudomonas putida KT2440
gcggccgucgcggcu

SEQ ID NO: 3574004 - RNA, 22 nt, Pseudomonas putida KT2440
gcggccucgguccaccccaugu

SEQ ID NO: 3574005 - RNA, 13 nt, Pseudomonas putida KT2440
gcggccugcagcu

SEQ ID NO: 3574006 - RNA, 14 nt, Pseudomonas putida KT2440
gcggccugcugccg

SEQ ID NO: 3574007 - RNA, 18 nt, Pseudomonas putida KT2440
gcggccuggcccggugca

SEQ ID NO: 3574008 - RNA, 14 nt, Pseudomonas putida KT2440
gcggccugugccca

SEQ ID NO: 3574009 - RNA, 15 nt, Pseudomonas putida KT2440
gcggccuucaagcuc

SEQ ID NO: 3574010 - RNA, 19 nt, Pseudomonas putida KT2440
gcggccuucaagcucccca

SEQ ID NO: 3574011 - RNA, 21 nt, Pseudomonas putida KT2440
gcggccuucaagcuccccagc

SEQ ID NO: 3574012 - RNA, 22 nt, Pseudomonas putida KT2440
gcggccuucaagcuccccagca

SEQ ID NO: 3574013 - RNA, 18 nt, Pseudomonas putida KT2440
gcggccuugcccgcgaag

SEQ ID NO: 3574014 - RNA, 17 nt, Pseudomonas putida KT2440
gcggccuugcgucgcga

SEQ ID NO: 3574015 - RNA, 21 nt, Pseudomonas putida KT2440
gcggccuugcgucgcgaaagg

SEQ ID NO: 3574016 - RNA, 20 nt, Pseudomonas putida KT2440
gcggccuuggucucgaucag

SEQ ID NO: 3574017 - RNA, 19 nt, Pseudomonas putida KT2440
gcggccuugucgcgaaagg

SEQ ID NO: 3574018 - RNA, 20 nt, Pseudomonas putida KT2440
gcggccuugugucucgaugg

SEQ ID NO: 3574019 - RNA, 21 nt, Pseudomonas putida KT2440
gcggccuugugucucgauggg

SEQ ID NO: 3574020 - RNA, 16 nt, Pseudomonas putida KT2440
gcggcgaaagccagca

SEQ ID NO: 3574021 - RNA, 20 nt, Pseudomonas putida KT2440
gcggcgaacacagcggccuu

SEQ ID NO: 3574022 - RNA, 17 nt, Pseudomonas putida KT2440
gcggggcaucgccgagg

SEQ ID NO: 3574023 - RNA, 13 nt, Pseudomonas putida KT2440
gcgggggcgcguc

SEQ ID NO: 3574024 - RNA, 16 nt, Pseudomonas putida KT2440
gcggguaaacccgccc

SEQ ID NO: 3574025 - RNA, 21 nt, Pseudomonas putida KT2440
gcggguaaacccgcgccuaca

SEQ ID NO: 3574026 - RNA, 20 nt, Pseudomonas putida KT2440
gcggguaaacccgcuccuac

SEQ ID NO: 3574027 - RNA, 20 nt, Pseudomonas putida KT2440
gcggguaaagcccgcaguga

SEQ ID NO: 3574028 - RNA, 22 nt, Pseudomonas putida KT2440
gcggguaaauguucucgccgcc

SEQ ID NO: 3574029 - RNA, 19 nt, Pseudomonas putida KT2440
gcggguaaugucccgcacg

SEQ ID NO: 3574030 - RNA, 20 nt, Pseudomonas putida KT2440
gcggguaaugucccgcacga

SEQ ID NO: 3574031 - RNA, 23 nt, Pseudomonas putida KT2440
gcggguaaugucccgcacgaucc

SEQ ID NO: 3574032 - RNA, 20 nt, Pseudomonas putida KT2440
gcggguagacccgcuccuac

SEQ ID NO: 3574033 - RNA, 15 nt, Pseudomonas putida KT2440
gcgggucaagcugga

SEQ ID NO: 3574034 - RNA, 15 nt, Pseudomonas putida KT2440
gcgggucacugcgcg

SEQ ID NO: 3574035 - RNA, 18 nt, Pseudomonas putida KT2440
gcgggucagcucgaucag

SEQ ID NO: 3574036 - RNA, 19 nt, Pseudomonas putida KT2440
gcgggucagcucgaucagg

SEQ ID NO: 3574037 - RNA, 18 nt, Pseudomonas putida KT2440
gcgggucagguggcugua

SEQ ID NO: 3574038 - RNA, 19 nt, Pseudomonas putida KT2440
gcgggucauccaggaaaag

SEQ ID NO: 3574039 - RNA, 17 nt, Pseudomonas putida KT2440
gcggguccagcgcggcc

SEQ ID NO: 3574040 - RNA, 20 nt, Pseudomonas putida KT2440
gcggguccgauccgguggcc

SEQ ID NO: 3574041 - RNA, 17 nt, Pseudomonas putida KT2440
gcgggucuuccaccacc

SEQ ID NO: 3574042 - RNA, 18 nt, Pseudomonas putida KT2440
gcgggucuuccaccaccu

SEQ ID NO: 3574043 - RNA, 18 nt, Pseudomonas putida KT2440
gcgggugaaccgcgccua

SEQ ID NO: 3574044 - RNA, 15 nt, Pseudomonas putida KT2440
gcgggugccgcagca

SEQ ID NO: 3574045 - RNA, 23 nt, Pseudomonas putida KT2440
gcggguggaaauuggccagcagg

SEQ ID NO: 3574046 - RNA, 17 nt, Pseudomonas putida KT2440
gcgggugggugcagcug

SEQ ID NO: 3574047 - RNA, 16 nt, Pseudomonas putida KT2440
gcggguucacccgcga

SEQ ID NO: 3574048 - RNA, 19 nt, Pseudomonas putida KT2440
gcggguucacccgcgaagc

SEQ ID NO: 3574049 - RNA, 18 nt, Pseudomonas putida KT2440
gcggguucacccgcgaau

SEQ ID NO: 3574050 - RNA, 20 nt, Pseudomonas putida KT2440
gcggguucacccgcgaauac

SEQ ID NO: 3574051 - RNA, 20 nt, Pseudomonas putida KT2440
gcggguucacccgcgaaugc

SEQ ID NO: 3574052 - RNA, 14 nt, Pseudomonas putida KT2440
gcggguuggaucgg

SEQ ID NO: 3574053 - RNA, 20 nt, Pseudomonas putida KT2440
gcggguuuacccgcgaacac

SEQ ID NO: 3574054 - RNA, 23 nt, Pseudomonas putida KT2440
gcggguuuacccgcgaacaggcc

SEQ ID NO: 3574055 - RNA, 20 nt, Pseudomonas putida KT2440
gcggguuuacccgcgaauac

SEQ ID NO: 3574056 - RNA, 23 nt, Pseudomonas putida KT2440
gcggguuuccucggucgccgagc

SEQ ID NO: 3574057 - RNA, 14 nt, Pseudomonas putida KT2440
gcggguuugcccgc

SEQ ID NO: 3574058 - RNA, 16 nt, Pseudomonas putida KT2440
gcgguaaacgucggca

SEQ ID NO: 3574059 - RNA, 21 nt, Pseudomonas putida KT2440
gcgguaaagaacaugaucaag

SEQ ID NO: 3574060 - RNA, 12 nt, Pseudomonas putida KT2440
gcgguacagcac

SEQ ID NO: 3574061 - RNA, 15 nt, Pseudomonas putida KT2440
gcgguacagcaccca

SEQ ID NO: 3574062 - RNA, 16 nt, Pseudomonas putida KT2440
gcgguacagcacccag

SEQ ID NO: 3574063 - RNA, 22 nt, Pseudomonas putida KT2440
gcgguaccuggaauaccaccuc

SEQ ID NO: 3574064 - RNA, 20 nt, Pseudomonas putida KT2440
gcgguaccuguggggcaacu

SEQ ID NO: 3574065 - RNA, 13 nt, Pseudomonas putida KT2440
gcgguagccgaac

SEQ ID NO: 3574066 - RNA, 12 nt, Pseudomonas putida KT2440
gcgguagcggcu

SEQ ID NO: 3574067 - RNA, 16 nt, Pseudomonas putida KT2440
gcgguagggcguucag

SEQ ID NO: 3574068 - RNA, 15 nt, Pseudomonas putida KT2440
gcgguagugcggccg

SEQ ID NO: 3574069 - RNA, 21 nt, Pseudomonas putida KT2440
gcgguaugggugaugcuggug

SEQ ID NO: 3574070 - RNA, 19 nt, Pseudomonas putida KT2440
gcggucaagcucguccugc

SEQ ID NO: 3574071 - RNA, 20 nt, Pseudomonas putida KT2440
gcggucaagcucguccugca

SEQ ID NO: 3574072 - RNA, 20 nt, Pseudomonas putida KT2440
gcggucaauuggagcggccu

SEQ ID NO: 3574073 - RNA, 17 nt, Pseudomonas putida KT2440
gcggucagcgcugcggg

SEQ ID NO: 3574074 - RNA, 13 nt, Pseudomonas putida KT2440
gcggucaggccaa

SEQ ID NO: 3574075 - RNA, 14 nt, Pseudomonas putida KT2440
gcggucaggccaag

SEQ ID NO: 3574076 - RNA, 21 nt, Pseudomonas putida KT2440
gcgguccgcccuugccaccag

SEQ ID NO: 3574077 - RNA, 20 nt, Pseudomonas putida KT2440
gcgguccggacuuggacccc

SEQ ID NO: 3574078 - RNA, 13 nt, Pseudomonas putida KT2440
gcgguccggugau

SEQ ID NO: 3574079 - RNA, 15 nt, Pseudomonas putida KT2440
gcgguccuccuuggc

SEQ ID NO: 3574080 - RNA, 12 nt, Pseudomonas putida KT2440
gcgguccugcac

SEQ ID NO: 3574081 - RNA, 14 nt, Pseudomonas putida KT2440
gcgguccugcacca

SEQ ID NO: 3574082 - RNA, 13 nt, Pseudomonas putida KT2440
gcgguccuggucg

SEQ ID NO: 3574083 - RNA, 14 nt, Pseudomonas putida KT2440
gcgguccuggucgc

SEQ ID NO: 3574084 - RNA, 17 nt, Pseudomonas putida KT2440
gcgguccuucaugccga

SEQ ID NO: 3574085 - RNA, 17 nt, Pseudomonas putida KT2440
gcggucgaacccagcuu

SEQ ID NO: 3574086 - RNA, 15 nt, Pseudomonas putida KT2440
gcggucgaugcagga

SEQ ID NO: 3574087 - RNA, 23 nt, Pseudomonas putida KT2440
gcggucgccaaauucgaccagca

SEQ ID NO: 3574088 - RNA, 18 nt, Pseudomonas putida KT2440
gcggucgcccauguugcg

SEQ ID NO: 3574089 - RNA, 21 nt, Pseudomonas putida KT2440
gcggucgcgcguaaaucccgc

SEQ ID NO: 3574090 - RNA, 13 nt, Pseudomonas putida KT2440
gcggucggccagc

SEQ ID NO: 3574091 - RNA, 17 nt, Pseudomonas putida KT2440
gcggucggccagcggca

SEQ ID NO: 3574092 - RNA, 20 nt, Pseudomonas putida KT2440
gcggucggucagcaccuggc

SEQ ID NO: 3574093 - RNA, 16 nt, Pseudomonas putida KT2440
gcggucgguggucagc

SEQ ID NO: 3574094 - RNA, 17 nt, Pseudomonas putida KT2440
gcggucgguggucagcu

SEQ ID NO: 3574095 - RNA, 20 nt, Pseudomonas putida KT2440
gcggucguuacccagguaga

SEQ ID NO: 3574096 - RNA, 14 nt, Pseudomonas putida KT2440
gcggucugcggcag

SEQ ID NO: 3574097 - RNA, 13 nt, Pseudomonas putida KT2440
gcggucugcugcg

SEQ ID NO: 3574098 - RNA, 18 nt, Pseudomonas putida KT2440
gcggucugcugcgucagc

SEQ ID NO: 3574099 - RNA, 21 nt, Pseudomonas putida KT2440
gcggucuuguaucccaggcgc

SEQ ID NO: 3574100 - RNA, 22 nt, Pseudomonas putida KT2440
gcggucuuguaucccaggcgcu

SEQ ID NO: 3574101 - RNA, 19 nt, Pseudomonas putida KT2440
gcggugaaacccucugggu

SEQ ID NO: 3574102 - RNA, 12 nt, Pseudomonas putida KT2440
gcggugaagacc

SEQ ID NO: 3574103 - RNA, 16 nt, Pseudomonas putida KT2440
gcggugaauagcaggc

SEQ ID NO: 3574104 - RNA, 19 nt, Pseudomonas putida KT2440
gcggugaauagcaggccgc

SEQ ID NO: 3574105 - RNA, 12 nt, Pseudomonas putida KT2440
gcggugaccagc

SEQ ID NO: 3574106 - RNA, 17 nt, Pseudomonas putida KT2440
gcggugaccagcggcag

SEQ ID NO: 3574107 - RNA, 21 nt, Pseudomonas putida KT2440
gcggugacccguguaggagcg

SEQ ID NO: 3574108 - RNA, 20 nt, Pseudomonas putida KT2440
gcggugagauguguccgcca

SEQ ID NO: 3574109 - RNA, 14 nt, Pseudomonas putida KT2440
gcggugaggcaacg

SEQ ID NO: 3574110 - RNA, 16 nt, Pseudomonas putida KT2440
gcggugaggcaacggc

SEQ ID NO: 3574111 - RNA, 21 nt, Pseudomonas putida KT2440
gcggugaucguacgccggcgc

SEQ ID NO: 3574112 - RNA, 15 nt, Pseudomonas putida KT2440
gcggugauggcgcau

SEQ ID NO: 3574113 - RNA, 19 nt, Pseudomonas putida KT2440
gcggugauggcgcauggcc

SEQ ID NO: 3574114 - RNA, 19 nt, Pseudomonas putida KT2440
gcggugcacggccugcauc

SEQ ID NO: 3574115 - RNA, 23 nt, Pseudomonas putida KT2440
gcggugcacggccugcauccaca

SEQ ID NO: 3574116 - RNA, 18 nt, Pseudomonas putida KT2440
gcggugccugcagcccgg

SEQ ID NO: 3574117 - RNA, 18 nt, Pseudomonas putida KT2440
gcggugccuucaggcgcu

SEQ ID NO: 3574118 - RNA, 21 nt, Pseudomonas putida KT2440
gcggugccuucaggcgcuggu

SEQ ID NO: 3574119 - RNA, 20 nt, Pseudomonas putida KT2440
gcggugcggcgacagggcga

SEQ ID NO: 3574120 - RNA, 13 nt, Pseudomonas putida KT2440
gcggugcucaugc

SEQ ID NO: 3574121 - RNA, 12 nt, Pseudomonas putida KT2440
gcgguggaagcu

SEQ ID NO: 3574122 - RNA, 18 nt, Pseudomonas putida KT2440
gcgguggagggcaccggc

SEQ ID NO: 3574123 - RNA, 19 nt, Pseudomonas putida KT2440
gcgguggaucgcacucagu

SEQ ID NO: 3574124 - RNA, 13 nt, Pseudomonas putida KT2440
gcgguggcguugc

SEQ ID NO: 3574125 - RNA, 15 nt, Pseudomonas putida KT2440
gcggugggucgacga

SEQ ID NO: 3574126 - RNA, 19 nt, Pseudomonas putida KT2440
gcgguguagaacggcagca

SEQ ID NO: 3574127 - RNA, 13 nt, Pseudomonas putida KT2440
gcgucuucgccag

SEQ ID NO: 3574128 - RNA, 15 nt, Pseudomonas putida KT2440
gcgucuucgccaggu

SEQ ID NO: 3574129 - RNA, 16 nt, Pseudomonas putida KT2440
gcgucuucgccaggug

SEQ ID NO: 3574130 - RNA, 18 nt, Pseudomonas putida KT2440
gcgugaaaaaagcgugaa

SEQ ID NO: 3574131 - RNA, 19 nt, Pseudomonas putida KT2440
gcgugaaauaagaaccggc

SEQ ID NO: 3574132 - RNA, 13 nt, Pseudomonas putida KT2440
gcgugaaauccuc

SEQ ID NO: 3574133 - RNA, 12 nt, Pseudomonas putida KT2440
gcgugaccagcc

SEQ ID NO: 3574134 - RNA, 16 nt, Pseudomonas putida KT2440
gcgugacgcggagccg

SEQ ID NO: 3574135 - RNA, 19 nt, Pseudomonas putida KT2440
gcgugacgugcgcuccugg

SEQ ID NO: 3574136 - RNA, 19 nt, Pseudomonas putida KT2440
gcgugagauguucaccagu

SEQ ID NO: 3574137 - RNA, 14 nt, Pseudomonas putida KT2440
gcgugccaggcuug

SEQ ID NO: 3574138 - RNA, 16 nt, Pseudomonas putida KT2440
gcgugccaggcuuggc

SEQ ID NO: 3574139 - RNA, 18 nt, Pseudomonas putida KT2440
gcgugcccgccacaccug

SEQ ID NO: 3574140 - RNA, 19 nt, Pseudomonas putida KT2440
gcgugcccgccacaccugc

SEQ ID NO: 3574141 - RNA, 22 nt, Pseudomonas putida KT2440
gcgugcccgccacaccugccag

SEQ ID NO: 3574142 - RNA, 16 nt, Pseudomonas putida KT2440
gcgugccgucgagcag

SEQ ID NO: 3574143 - RNA, 16 nt, Pseudomonas putida KT2440
gcgugccucagccagg

SEQ ID NO: 3574144 - RNA, 18 nt, Pseudomonas putida KT2440
gcgugccucagccaggcu

SEQ ID NO: 3574145 - RNA, 16 nt, Pseudomonas putida KT2440
gcgugccucgcccagg

SEQ ID NO: 3574146 - RNA, 18 nt, Pseudomonas putida KT2440
gcgugccucgcccagguc

SEQ ID NO: 3574147 - RNA, 23 nt, Pseudomonas putida KT2440
gcgugcgauguugaucagguacc

SEQ ID NO: 3574148 - RNA, 14 nt, Pseudomonas putida KT2440
gcgugcgcccagau

SEQ ID NO: 3574149 - RNA, 15 nt, Pseudomonas putida KT2440
gcgugcgcccggcaa

SEQ ID NO: 3574150 - RNA, 19 nt, Pseudomonas putida KT2440
gcgugcggggcaucgccga

SEQ ID NO: 3574151 - RNA, 15 nt, Pseudomonas putida KT2440
gcgugcucggcaugc

SEQ ID NO: 3574152 - RNA, 19 nt, Pseudomonas putida KT2440
gcgugcuuccaccucgggc

SEQ ID NO: 3574153 - RNA, 22 nt, Pseudomonas putida KT2440
gcgugcuugugcucccacaggg

SEQ ID NO: 3574154 - RNA, 16 nt, Pseudomonas putida KT2440
gcguggaacaacggcu

SEQ ID NO: 3574155 - RNA, 19 nt, Pseudomonas putida KT2440
gcguggaugaucggcuggc

SEQ ID NO: 3574156 - RNA, 18 nt, Pseudomonas putida KT2440
gcguggcaccggcgaaga

SEQ ID NO: 3574157 - RNA, 20 nt, Pseudomonas putida KT2440
gcguggcauccuuuaccugu

SEQ ID NO: 3574158 - RNA, 17 nt, Pseudomonas putida KT2440
gcguggccgccaacagc

SEQ ID NO: 3574159 - RNA, 18 nt, Pseudomonas putida KT2440
gcguggccgccaacagcg

SEQ ID NO: 3574160 - RNA, 17 nt, Pseudomonas putida KT2440
gcguggccuguaccgac

SEQ ID NO: 3574161 - RNA, 17 nt, Pseudomonas putida KT2440
gcguggcugcguucagg

SEQ ID NO: 3574162 - RNA, 14 nt, Pseudomonas putida KT2440
gcguggggccugcc

SEQ ID NO: 3574163 - RNA, 16 nt, Pseudomonas putida KT2440
gcguggggccugccgg

SEQ ID NO: 3574164 - RNA, 14 nt, Pseudomonas putida KT2440
gcguggucgccggc

SEQ ID NO: 3574165 - RNA, 21 nt, Pseudomonas putida KT2440
gcguggugcugcauaugggcg

SEQ ID NO: 3574166 - RNA, 21 nt, Pseudomonas putida KT2440
gcguguaguagcuccagccca

SEQ ID NO: 3574167 - RNA, 18 nt, Pseudomonas putida KT2440
gcgugucaggagggccgu

SEQ ID NO: 3574168 - RNA, 13 nt, Pseudomonas putida KT2440
gcguguccagcag

SEQ ID NO: 3574169 - RNA, 18 nt, Pseudomonas putida KT2440
gcguuauaccggcccuga

SEQ ID NO: 3574170 - RNA, 17 nt, Pseudomonas putida KT2440
gcguuaugacuggccuc

SEQ ID NO: 3574171 - RNA, 16 nt, Pseudomonas putida KT2440
gcguucacaucgcccu

SEQ ID NO: 3574172 - RNA, 18 nt, Pseudomonas putida KT2440
gcguucaccggcaccugc

SEQ ID NO: 3574173 - RNA, 23 nt, Pseudomonas putida KT2440
gcguucagccgaucacuuccugg

SEQ ID NO: 3574174 - RNA, 22 nt, Pseudomonas putida KT2440
gcguucagcuugucgaccagga

SEQ ID NO: 3574175 - RNA, 23 nt, Pseudomonas putida KT2440
gcguucaggcaggaacuggcugc

SEQ ID NO: 3574176 - RNA, 21 nt, Pseudomonas putida KT2440
gcguuccagccaggcgucgau

SEQ ID NO: 3574177 - RNA, 15 nt, Pseudomonas putida KT2440
gcguucgaaagccca

SEQ ID NO: 3574178 - RNA, 22 nt, Pseudomonas putida KT2440
gcguucgcccaggcgccgcagc

SEQ ID NO: 3574179 - RNA, 18 nt, Pseudomonas putida KT2440
gcguucgcccuccugcag

SEQ ID NO: 3574180 - RNA, 22 nt, Pseudomonas putida KT2440
gcguucggcaucugccgggucg

SEQ ID NO: 3574181 - RNA, 23 nt, Pseudomonas putida KT2440
gcguucgucaagcucgacccgcg

SEQ ID NO: 3574182 - RNA, 19 nt, Pseudomonas putida KT2440
gcguucuagaacucggcga

SEQ ID NO: 3574183 - RNA, 14 nt, Pseudomonas putida KT2440
gcguucucgcucag

SEQ ID NO: 3574184 - RNA, 16 nt, Pseudomonas putida KT2440
gcguucuuucucccag

SEQ ID NO: 3574185 - RNA, 21 nt, Pseudomonas putida KT2440
gcguucuuucucccaggccga

SEQ ID NO: 3574186 - RNA, 18 nt, Pseudomonas putida KT2440
gcguugaccgagguacca

SEQ ID NO: 3574187 - RNA, 14 nt, Pseudomonas putida KT2440
gcguugaccugcug

SEQ ID NO: 3574188 - RNA, 22 nt, Pseudomonas putida KT2440
gcguugaugcgugauggugguc

SEQ ID NO: 3574189 - RNA, 18 nt, Pseudomonas putida KT2440
gcguugauuuagcaggca

SEQ ID NO: 3574190 - RNA, 23 nt, Pseudomonas putida KT2440
gcguugcaggcgcuccaucaugc

SEQ ID NO: 3574191 - RNA, 18 nt, Pseudomonas putida KT2440
gcguugcccccagccggu

SEQ ID NO: 3574192 - RNA, 13 nt, Pseudomonas putida KT2440
gcguugccccuuc

SEQ ID NO: 3574193 - RNA, 21 nt, Pseudomonas putida KT2440
gcguugccgaugaccugcguc

SEQ ID NO: 3574194 - RNA, 13 nt, Pseudomonas putida KT2440
gcguugccuucgc

SEQ ID NO: 3574195 - RNA, 21 nt, Pseudomonas putida KT2440
gcguugccuucgcgaccgcca

SEQ ID NO: 3574196 - RNA, 21 nt, Pseudomonas putida KT2440
gcguugcggaacauacgcauc

SEQ ID NO: 3574197 - RNA, 23 nt, Pseudomonas putida KT2440
gcguugcggaacauacgcaucag

SEQ ID NO: 3574198 - RNA, 20 nt, Pseudomonas putida KT2440
gcguugcggcccuucgcggg

SEQ ID NO: 3574199 - RNA, 17 nt, Pseudomonas putida KT2440
gcguugcggucagcgcu

SEQ ID NO: 3574200 - RNA, 15 nt, Pseudomonas putida KT2440
gcguugcucaacagg

SEQ ID NO: 3574201 - RNA, 21 nt, Pseudomonas putida KT2440
cggucaucaccacccccagcg

SEQ ID NO: 3574202 - RNA, 20 nt, Pseudomonas putida KT2440
cggucauggucguguugagc

SEQ ID NO: 3574203 - RNA, 18 nt, Pseudomonas putida KT2440
cgguccaccgccagugcg

SEQ ID NO: 3574204 - RNA, 23 nt, Pseudomonas putida KT2440
cggucccgaucuccccaccauca

SEQ ID NO: 3574205 - RNA, 17 nt, Pseudomonas putida KT2440
cggucccgcccuccagc

SEQ ID NO: 3574206 - RNA, 16 nt, Pseudomonas putida KT2440
cgguccgcccuugcca

SEQ ID NO: 3574207 - RNA, 17 nt, Pseudomonas putida KT2440
cgguccgcccuugccac

SEQ ID NO: 3574208 - RNA, 22 nt, Pseudomonas putida KT2440
cgguccgcccuugccaccagug

SEQ ID NO: 3574209 - RNA, 11 nt, Pseudomonas putida KT2440
cgguccuccuu

SEQ ID NO: 3574210 - RNA, 20 nt, Pseudomonas putida KT2440
cgguccuucaugccgaacga

SEQ ID NO: 3574211 - RNA, 19 nt, Pseudomonas putida KT2440
cggucgaacauguagaacg

SEQ ID NO: 3574212 - RNA, 23 nt, Pseudomonas putida KT2440
cggucgaaguauuccagaaucug

SEQ ID NO: 3574213 - RNA, 18 nt, Pseudomonas putida KT2440
cggucgagcugcccacca

SEQ ID NO: 3574214 - RNA, 13 nt, Pseudomonas putida KT2440
cggucgagcuuuu

SEQ ID NO: 3574215 - RNA, 15 nt, Pseudomonas putida KT2440
cggucgagcuuuucu

SEQ ID NO: 3574216 - RNA, 15 nt, Pseudomonas putida KT2440
cggucgaucuucgcc

SEQ ID NO: 3574217 - RNA, 16 nt, Pseudomonas putida KT2440
cggucgaucuucgccg

SEQ ID NO: 3574218 - RNA, 19 nt, Pseudomonas putida KT2440
cggucgaucuucgccggca

SEQ ID NO: 3574219 - RNA, 19 nt, Pseudomonas putida KT2440
cggucgaugcaggagcggc

SEQ ID NO: 3574220 - RNA, 21 nt, Pseudomonas putida KT2440
cggucgccaaauucgaccagc

SEQ ID NO: 3574221 - RNA, 23 nt, Pseudomonas putida KT2440
cggucgccaaauucgaccagcag

SEQ ID NO: 3574222 - RNA, 14 nt, Pseudomonas putida KT2440
cggucgccaacccc

SEQ ID NO: 3574223 - RNA, 19 nt, Pseudomonas putida KT2440
cggucggccaucgacgugc

SEQ ID NO: 3574224 - RNA, 17 nt, Pseudomonas putida KT2440
cggucggccccucgacc

SEQ ID NO: 3574225 - RNA, 13 nt, Pseudomonas putida KT2440
cggucggccugca

SEQ ID NO: 3574226 - RNA, 16 nt, Pseudomonas putida KT2440
cggucgggucgcugcc

SEQ ID NO: 3574227 - RNA, 19 nt, Pseudomonas putida KT2440
cggucguagucaucggccg

SEQ ID NO: 3574228 - RNA, 19 nt, Pseudomonas putida KT2440
cggucguuacccaccagcu

SEQ ID NO: 3574229 - RNA, 17 nt, Pseudomonas putida KT2440
cggucucacaggcgcug

SEQ ID NO: 3574230 - RNA, 13 nt, Pseudomonas putida KT2440
cggucuccccuuc

SEQ ID NO: 3574231 - RNA, 17 nt, Pseudomonas putida KT2440
cggucugcugcgucagc

SEQ ID NO: 3574232 - RNA, 20 nt, Pseudomonas putida KT2440
cggucugguaacccucgcuc

SEQ ID NO: 3574233 - RNA, 14 nt, Pseudomonas putida KT2440
cggucuguucggca

SEQ ID NO: 3574234 - RNA, 23 nt, Pseudomonas putida KT2440
cggugaaaccaccccggcguuca

SEQ ID NO: 3574235 - RNA, 19 nt, Pseudomonas putida KT2440
cggugaagaucgccgcgcu

SEQ ID NO: 3574236 - RNA, 13 nt, Pseudomonas putida KT2440
cggugaagccgac

SEQ ID NO: 3574237 - RNA, 15 nt, Pseudomonas putida KT2440
cggugaagccgacca

SEQ ID NO: 3574238 - RNA, 14 nt, Pseudomonas putida KT2440
cggugaagcgacca

SEQ ID NO: 3574239 - RNA, 16 nt, Pseudomonas putida KT2440
cggugaauuccuugca

SEQ ID NO: 3574240 - RNA, 22 nt, Pseudomonas putida KT2440
cggugacaaaggccggcaccga

SEQ ID NO: 3574241 - RNA, 12 nt, Pseudomonas putida KT2440
cggugaccagcg

SEQ ID NO: 3574242 - RNA, 17 nt, Pseudomonas putida KT2440
cggugaccagcggcagc

SEQ ID NO: 3574243 - RNA, 21 nt, Pseudomonas putida KT2440
cggugacgaccucggccaggu

SEQ ID NO: 3574244 - RNA, 11 nt, Pseudomonas putida KT2440
cggugagaugu

SEQ ID NO: 3574245 - RNA, 13 nt, Pseudomonas putida KT2440
cggugaugcgcac

SEQ ID NO: 3574246 - RNA, 21 nt, Pseudomonas putida KT2440
cggugaugcgcccuucgcgga

SEQ ID NO: 3574247 - RNA, 12 nt, Pseudomonas putida KT2440
cggugaugcgcu

SEQ ID NO: 3574248 - RNA, 22 nt, Pseudomonas putida KT2440
cguaggcacucggucggcuggc

SEQ ID NO: 3574249 - RNA, 16 nt, Pseudomonas putida KT2440
cguaggccagguacag

SEQ ID NO: 3574250 - RNA, 20 nt, Pseudomonas putida KT2440
cguaggccagguacaggcaa

SEQ ID NO: 3574251 - RNA, 19 nt, Pseudomonas putida KT2440
cguaggucaugcgggccgg

SEQ ID NO: 3574252 - RNA, 15 nt, Pseudomonas putida KT2440
cguaggugcgcggcc

SEQ ID NO: 3574253 - RNA, 18 nt, Pseudomonas putida KT2440
cguaguaacggcggaugu

SEQ ID NO: 3574254 - RNA, 17 nt, Pseudomonas putida KT2440
cguaguaauccggcaac

SEQ ID NO: 3574255 - RNA, 19 nt, Pseudomonas putida KT2440
cguaguaauggccgaugaa

SEQ ID NO: 3574256 - RNA, 18 nt, Pseudomonas putida KT2440
cguaguacuccagcagcg

SEQ ID NO: 3574257 - RNA, 17 nt, Pseudomonas putida KT2440
cguagucgucagggucu

SEQ ID NO: 3574258 - RNA, 15 nt, Pseudomonas putida KT2440
cguagugacgcggau

SEQ ID NO: 3574259 - RNA, 15 nt, Pseudomonas putida KT2440
cguagugcuucugcc

SEQ ID NO: 3574260 - RNA, 14 nt, Pseudomonas putida KT2440
cguauagccaccgg

SEQ ID NO: 3574261 - RNA, 17 nt, Pseudomonas putida KT2440
cguauccuugcccacca

SEQ ID NO: 3574262 - RNA, 13 nt, Pseudomonas putida KT2440
cguauggcuucac

SEQ ID NO: 3574263 - RNA, 12 nt, Pseudomonas putida KT2440
cguauucgcggg

SEQ ID NO: 3574264 - RNA, 18 nt, Pseudomonas putida KT2440
cguauucgcggguaaacc

SEQ ID NO: 3574265 - RNA, 20 nt, Pseudomonas putida KT2440
cguauucgcggguaaacccg

SEQ ID NO: 3574266 - RNA, 18 nt, Pseudomonas putida KT2440
cgucaaaaaucucgacga

SEQ ID NO: 3574267 - RNA, 24 nt, Pseudomonas putida KT2440
cgucaaacagccgcccaguuccag

SEQ ID NO: 3574268 - RNA, 22 nt, Pseudomonas putida KT2440
cgucaaaguuuugcaucaagag

SEQ ID NO: 3574269 - RNA, 16 nt, Pseudomonas putida KT2440
cgucaaccacagcccg

SEQ ID NO: 3574270 - RNA, 13 nt, Pseudomonas putida KT2440
cgucaaccgugcc

SEQ ID NO: 3574271 - RNA, 14 nt, Pseudomonas putida KT2440
cgucaaccgugccc

SEQ ID NO: 3574272 - RNA, 18 nt, Pseudomonas putida KT2440
cgucaacgaggccgccau

SEQ ID NO: 3574273 - RNA, 19 nt, Pseudomonas putida KT2440
cgucaagagcgacuggugu

SEQ ID NO: 3574274 - RNA, 17 nt, Pseudomonas putida KT2440
cgucaagcucgacccgc

SEQ ID NO: 3574275 - RNA, 21 nt, Pseudomonas putida KT2440
cgucaaggaagcuccaggcga

SEQ ID NO: 3574276 - RNA, 23 nt, Pseudomonas putida KT2440
cgucaagguugcucagggcggca

SEQ ID NO: 3574277 - RNA, 22 nt, Pseudomonas putida KT2440
cgucaaguacuugcaggugcag

SEQ ID NO: 3574278 - RNA, 20 nt, Pseudomonas putida KT2440
cgucaauaccggugccccgg

SEQ ID NO: 3574279 - RNA, 15 nt, Pseudomonas putida KT2440
cgucaauuguugucc

SEQ ID NO: 3574280 - RNA, 15 nt, Pseudomonas putida KT2440
cgucacagccaagcc

SEQ ID NO: 3574281 - RNA, 16 nt, Pseudomonas putida KT2440
cgucacagccaagccu

SEQ ID NO: 3574282 - RNA, 16 nt, Pseudomonas putida KT2440
cgucacauccugcucg

SEQ ID NO: 3574283 - RNA, 21 nt, Pseudomonas putida KT2440
cgucacaucgguuucgccggu

SEQ ID NO: 3574284 - RNA, 14 nt, Pseudomonas putida KT2440
cgucaccaccaacc

SEQ ID NO: 3574285 - RNA, 16 nt, Pseudomonas putida KT2440
cgucaccauugaugaa

SEQ ID NO: 3574286 - RNA, 14 nt, Pseudomonas putida KT2440
cgucacccaggugc

SEQ ID NO: 3574287 - RNA, 22 nt, Pseudomonas putida KT2440
cgucaccccucggcucacgccc

SEQ ID NO: 3574288 - RNA, 15 nt, Pseudomonas putida KT2440
cgucacccgcgccac

SEQ ID NO: 3574289 - RNA, 20 nt, Pseudomonas putida KT2440
cgucacccguggcagccccc

SEQ ID NO: 3574290 - RNA, 17 nt, Pseudomonas putida KT2440
cgucaccgcugccgauc

SEQ ID NO: 3574291 - RNA, 22 nt, Pseudomonas putida KT2440
cgucaccgucaucgggaacucg

SEQ ID NO: 3574292 - RNA, 12 nt, Pseudomonas putida KT2440
cgucaccgugca

SEQ ID NO: 3574293 - RNA, 14 nt, Pseudomonas putida KT2440
cgucaccgugcacg

SEQ ID NO: 3574294 - RNA, 20 nt, Pseudomonas putida KT2440
cgucaccuuuuccacuugca

SEQ ID NO: 3574295 - RNA, 15 nt, Pseudomonas putida KT2440
cgucacggcgcgggu

SEQ ID NO: 3574296 - RNA, 21 nt, Pseudomonas putida KT2440
cgucacggguauagccaugca

SEQ ID NO: 3574297 - RNA, 19 nt, Pseudomonas putida KT2440
cgucacguuuuuugggagc

SEQ ID NO: 3574298 - RNA, 14 nt, Pseudomonas putida KT2440
cgucacugaugcgc

SEQ ID NO: 3574299 - RNA, 16 nt, Pseudomonas putida KT2440
cgucacugaugcgcca

SEQ ID NO: 3574300 - RNA, 17 nt, Pseudomonas putida KT2440
cgucacuggcugcugcg

SEQ ID NO: 3574301 - RNA, 22 nt, Pseudomonas putida KT2440
cgucagcauccaacccugcgcc

SEQ ID NO: 3574302 - RNA, 20 nt, Pseudomonas putida KT2440
cgucagccaccaccagcucc

SEQ ID NO: 3574303 - RNA, 12 nt, Pseudomonas putida KT2440
cgucagccccua

SEQ ID NO: 3574304 - RNA, 21 nt, Pseudomonas putida KT2440
cgucagccgaaacgauacucc

SEQ ID NO: 3574305 - RNA, 18 nt, Pseudomonas putida KT2440
cgucagcggcaacaccag

SEQ ID NO: 3574306 - RNA, 20 nt, Pseudomonas putida KT2440
cgucagcggcaacaccagca

SEQ ID NO: 3574307 - RNA, 21 nt, Pseudomonas putida KT2440
cgucagcggcaacaccagcag

SEQ ID NO: 3574308 - RNA, 13 nt, Pseudomonas putida KT2440
cgucagcguggua

SEQ ID NO: 3574309 - RNA, 17 nt, Pseudomonas putida KT2440
cgucagcguugcuggcg

SEQ ID NO: 3574310 - RNA, 19 nt, Pseudomonas putida KT2440
cgucagcucaagcgcuccc

SEQ ID NO: 3574311 - RNA, 17 nt, Pseudomonas putida KT2440
cgucagcuuccgcugcc

SEQ ID NO: 3574312 - RNA, 21 nt, Pseudomonas putida KT2440
cgucaggccaugcccuugccu

SEQ ID NO: 3574313 - RNA, 15 nt, Pseudomonas putida KT2440
cgucaggcucagcag

SEQ ID NO: 3574314 - RNA, 19 nt, Pseudomonas putida KT2440
cgucaggcuucaucaacgc

SEQ ID NO: 3574315 - RNA, 20 nt, Pseudomonas putida KT2440
cgucagggucuuccggcagg

SEQ ID NO: 3574316 - RNA, 23 nt, Pseudomonas putida KT2440
cgucagucgccaaccgccagcag

SEQ ID NO: 3574317 - RNA, 18 nt, Pseudomonas putida KT2440
cgucaguugcagacgcgc

SEQ ID NO: 3574318 - RNA, 21 nt, Pseudomonas putida KT2440
cgucaguugcagacgcgcagc

SEQ ID NO: 3574319 - RNA, 15 nt, Pseudomonas putida KT2440
cgucauacagcccga

SEQ ID NO: 3574320 - RNA, 12 nt, Pseudomonas putida KT2440
cgucaucacccg

SEQ ID NO: 3574321 - RNA, 14 nt, Pseudomonas putida KT2440
cgucaucacccggg

SEQ ID NO: 3574322 - RNA, 19 nt, Pseudomonas putida KT2440
cgucaucaucagcaggcag

SEQ ID NO: 3574323 - RNA, 15 nt, Pseudomonas putida KT2440
cgucauccaccgccc

SEQ ID NO: 3574324 - RNA, 14 nt, Pseudomonas putida KT2440
cgucauccugcgcg

SEQ ID NO: 3574325 - RNA, 23 nt, Pseudomonas putida KT2440
cgucaucgacuucaaugcccagg

SEQ ID NO: 3574326 - RNA, 20 nt, Pseudomonas putida KT2440
cgucaucugcgcacggaagg

SEQ ID NO: 3574327 - RNA, 16 nt, Pseudomonas putida KT2440
cgucaugcagcgccaa

SEQ ID NO: 3574328 - RNA, 20 nt, Pseudomonas putida KT2440
cgucaugcgguacagcacug

SEQ ID NO: 3574329 - RNA, 16 nt, Pseudomonas putida KT2440
cgucauuagccuucau

SEQ ID NO: 3574330 - RNA, 17 nt, Pseudomonas putida KT2440
cgucauugcucaccgug

SEQ ID NO: 3574331 - RNA, 20 nt, Pseudomonas putida KT2440
cguccaauagccauuccggc

SEQ ID NO: 3574332 - RNA, 15 nt, Pseudomonas putida KT2440
cguccacaaaccccg

SEQ ID NO: 3574333 - RNA, 13 nt, Pseudomonas putida KT2440
cguccacagcgau

SEQ ID NO: 3574334 - RNA, 15 nt, Pseudomonas putida KT2440
cguccacgcgcaggc

SEQ ID NO: 3574335 - RNA, 18 nt, Pseudomonas putida KT2440
cguccacgcgcaggccac

SEQ ID NO: 3574336 - RNA, 18 nt, Pseudomonas putida KT2440
cguccacuaccuccagcc

SEQ ID NO: 3574337 - RNA, 17 nt, Pseudomonas putida KT2440
cguccacugcacccgug

SEQ ID NO: 3574338 - RNA, 15 nt, Pseudomonas putida KT2440
cguccagcaacagcu

SEQ ID NO: 3574339 - RNA, 19 nt, Pseudomonas putida KT2440
cguccagcaacagcugccg

SEQ ID NO: 3574340 - RNA, 23 nt, Pseudomonas putida KT2440
cguccagcaacagcugccgggcc

SEQ ID NO: 3574341 - RNA, 19 nt, Pseudomonas putida KT2440
cguccagcaggcuggcggc

SEQ ID NO: 3574342 - RNA, 22 nt, Pseudomonas putida KT2440
cguccagccccgcaccgcggau

SEQ ID NO: 3574343 - RNA, 16 nt, Pseudomonas putida KT2440
cguccagcucgcgcag

SEQ ID NO: 3574344 - RNA, 17 nt, Pseudomonas putida KT2440
cguccagcucgcgcagg

SEQ ID NO: 3574345 - RNA, 18 nt, Pseudomonas putida KT2440
cguccagcugagcgccau

SEQ ID NO: 3574346 - RNA, 17 nt, Pseudomonas putida KT2440
cguccaggcccgccaga

SEQ ID NO: 3574347 - RNA, 12 nt, Pseudomonas putida KT2440
cguccaggcuca

SEQ ID NO: 3574348 - RNA, 21 nt, Pseudomonas putida KT2440
cguccagggcauugcgcaugc

SEQ ID NO: 3574349 - RNA, 22 nt, Pseudomonas putida KT2440
cguccagguaauggcgugacgg

SEQ ID NO: 3574350 - RNA, 13 nt, Pseudomonas putida KT2440
cguccagguagcg

SEQ ID NO: 3574351 - RNA, 20 nt, Pseudomonas putida KT2440
cguccagguagcgcucgaca

SEQ ID NO: 3574352 - RNA, 22 nt, Pseudomonas putida KT2440
cguccagguccaggccagcuuc

SEQ ID NO: 3574353 - RNA, 19 nt, Pseudomonas putida KT2440
cguccaguucaaugccagc

SEQ ID NO: 3574354 - RNA, 20 nt, Pseudomonas putida KT2440
cguccaguucaaugccagca

SEQ ID NO: 3574355 - RNA, 14 nt, Pseudomonas putida KT2440
cguccaguuccggc

SEQ ID NO: 3574356 - RNA, 18 nt, Pseudomonas putida KT2440
cguccaguuggcggcgca

SEQ ID NO: 3574357 - RNA, 18 nt, Pseudomonas putida KT2440
cguccaucuugcugcucu

SEQ ID NO: 3574358 - RNA, 19 nt, Pseudomonas putida KT2440
cguccaucuugcugcucug

SEQ ID NO: 3574359 - RNA, 12 nt, Pseudomonas putida KT2440
cguccauggcgc

SEQ ID NO: 3574360 - RNA, 18 nt, Pseudomonas putida KT2440
cguccauguuacggccca

SEQ ID NO: 3574361 - RNA, 14 nt, Pseudomonas putida KT2440
cgucccaguuauca

SEQ ID NO: 3574362 - RNA, 18 nt, Pseudomonas putida KT2440
cgucccccgguaccagca

SEQ ID NO: 3574363 - RNA, 14 nt, Pseudomonas putida KT2440
cguccccgggucca

SEQ ID NO: 3574364 - RNA, 20 nt, Pseudomonas putida KT2440
cguccccggguccaccucug

SEQ ID NO: 3574365 - RNA, 23 nt, Pseudomonas putida KT2440
cgucccgaaagggccgcaaagcg

SEQ ID NO: 3574366 - RNA, 16 nt, Pseudomonas putida KT2440
cgucccugcccgaucg

SEQ ID NO: 3574367 - RNA, 17 nt, Pseudomonas putida KT2440
cguccgacaaugccagc

SEQ ID NO: 3574368 - RNA, 15 nt, Pseudomonas putida KT2440
cguccgaccaacggu

SEQ ID NO: 3574369 - RNA, 14 nt, Pseudomonas putida KT2440
cguccgagcggagc

SEQ ID NO: 3574370 - RNA, 21 nt, Pseudomonas putida KT2440
cguccgcagucccguuggccc

SEQ ID NO: 3574371 - RNA, 14 nt, Pseudomonas putida KT2440
cguccggcaugcgc

SEQ ID NO: 3574372 - RNA, 23 nt, Pseudomonas putida KT2440
cguccggugccgccugggucagg

SEQ ID NO: 3574373 - RNA, 16 nt, Pseudomonas putida KT2440
cguccucgaacucaug

SEQ ID NO: 3574374 - RNA, 21 nt, Pseudomonas putida KT2440
cguccucgacccacggcugaa

SEQ ID NO: 3574375 - RNA, 16 nt, Pseudomonas putida KT2440
cguccugcccccaaug

SEQ ID NO: 3574376 - RNA, 20 nt, Pseudomonas putida KT2440
cguccuggaaaagcaaggcu

SEQ ID NO: 3574377 - RNA, 15 nt, Pseudomonas putida KT2440
cguccuggguaauca

SEQ ID NO: 3574378 - RNA, 16 nt, Pseudomonas putida KT2440
cguccuggucacggcc

SEQ ID NO: 3574379 - RNA, 21 nt, Pseudomonas putida KT2440
cguccuugagaaccuccgcca

SEQ ID NO: 3574380 - RNA, 23 nt, Pseudomonas putida KT2440
cguccuugagaaccuccgccaac

SEQ ID NO: 3574381 - RNA, 14 nt, Pseudomonas putida KT2440
cgucgaacacggcg

SEQ ID NO: 3574382 - RNA, 14 nt, Pseudomonas putida KT2440
cgucgaacagcaug

SEQ ID NO: 3574383 - RNA, 19 nt, Pseudomonas putida KT2440
cgucgaacucgcgcccacg

SEQ ID NO: 3574384 - RNA, 20 nt, Pseudomonas putida KT2440
cgucgaccgccgccuggcuc

SEQ ID NO: 3574385 - RNA, 23 nt, Pseudomonas putida KT2440
cgucgacgacgaucucguccagg

SEQ ID NO: 3574386 - RNA, 17 nt, Pseudomonas putida KT2440
cgucgagcaccacggcg

SEQ ID NO: 3574387 - RNA, 20 nt, Pseudomonas putida KT2440
cgucgagcaccacggcggcg

SEQ ID NO: 3574388 - RNA, 22 nt, Pseudomonas putida KT2440
cgucgagcaccacggcggcgau

SEQ ID NO: 3574389 - RNA, 16 nt, Pseudomonas putida KT2440
cgucgagccgggucca

SEQ ID NO: 3574390 - RNA, 19 nt, Pseudomonas putida KT2440
cgucgagcucgaucggcaa

SEQ ID NO: 3574391 - RNA, 16 nt, Pseudomonas putida KT2440
cgucgaucugcaggug

SEQ ID NO: 3574392 - RNA, 15 nt, Pseudomonas putida KT2440
cgucgaugccugugu

SEQ ID NO: 3574393 - RNA, 14 nt, Pseudomonas putida KT2440
cgucgccagcggca

SEQ ID NO: 3574394 - RNA, 16 nt, Pseudomonas putida KT2440
cgucgccagcggcaaa

SEQ ID NO: 3574395 - RNA, 21 nt, Pseudomonas putida KT2440
cgucgccgcuucggcaugcac

SEQ ID NO: 3574396 - RNA, 15 nt, Pseudomonas putida KT2440
cgucgccggccggcu

SEQ ID NO: 3574397 - RNA, 19 nt, Pseudomonas putida KT2440
cgucgccucaccuccaccg

SEQ ID NO: 3574398 - RNA, 18 nt, Pseudomonas putida KT2440
cgucgccucccccuccac

SEQ ID NO: 3574399 - RNA, 15 nt, Pseudomonas putida KT2440
cgucgccugcaaccc

SEQ ID NO: 3574400 - RNA, 13 nt, Pseudomonas putida KT2440
cgucgccugggca

SEQ ID NO: 3574401 - RNA, 21 nt, Pseudomonas putida KT2440
cgucgcgaucacgcaggccca

SEQ ID NO: 3574402 - RNA, 15 nt, Pseudomonas putida KT2440
cgucgcgcgcccagg

SEQ ID NO: 3574403 - RNA, 14 nt, Pseudomonas putida KT2440
cgucgcggccccag

SEQ ID NO: 3574404 - RNA, 16 nt, Pseudomonas putida KT2440
cgucgcggccccaggg

SEQ ID NO: 3574405 - RNA, 21 nt, Pseudomonas putida KT2440
cgucgcgugaggcauggaagg

SEQ ID NO: 3574406 - RNA, 15 nt, Pseudomonas putida KT2440
cgucgcuggccagcu

SEQ ID NO: 3574407 - RNA, 17 nt, Pseudomonas putida KT2440
cgucgcuggccagcuuc

SEQ ID NO: 3574408 - RNA, 19 nt, Pseudomonas putida KT2440
cgucgcuucaucggcuggc

SEQ ID NO: 3574409 - RNA, 20 nt, Pseudomonas putida KT2440
cgucgcuucaucggcuggca

SEQ ID NO: 3574410 - RNA, 18 nt, Pseudomonas putida KT2440
cgucggcagagcgccagc

SEQ ID NO: 3574411 - RNA, 19 nt, Pseudomonas putida KT2440
cgucggcagagcgccagca

SEQ ID NO: 3574412 - RNA, 18 nt, Pseudomonas putida KT2440
cgucggcauaggcccgcc

SEQ ID NO: 3574413 - RNA, 19 nt, Pseudomonas putida KT2440
cgucggccgcauccaugcc

SEQ ID NO: 3574414 - RNA, 22 nt, Pseudomonas putida KT2440
cgucggcgcugaugcggaccca

SEQ ID NO: 3574415 - RNA, 14 nt, Pseudomonas putida KT2440
cgucggcgucagcc

SEQ ID NO: 3574416 - RNA, 22 nt, Pseudomonas putida KT2440
cgucggcguggaacaacggcuc

SEQ ID NO: 3574417 - RNA, 17 nt, Pseudomonas putida KT2440
cgucggcuggcagcuug

SEQ ID NO: 3574418 - RNA, 20 nt, Pseudomonas putida KT2440
cgucggggaauggcccagcc

SEQ ID NO: 3574419 - RNA, 15 nt, Pseudomonas putida KT2440
cgucggggccggaga

SEQ ID NO: 3574420 - RNA, 11 nt, Pseudomonas putida KT2440
cgucggucagc

SEQ ID NO: 3574421 - RNA, 15 nt, Pseudomonas putida KT2440
cgucggucgccccca

SEQ ID NO: 3574422 - RNA, 13 nt, Pseudomonas putida KT2440
cgucggucgcugg

SEQ ID NO: 3574423 - RNA, 21 nt, Pseudomonas putida KT2440
cgucggugaugaucagggaca

SEQ ID NO: 3574424 - RNA, 13 nt, Pseudomonas putida KT2440
cgucgguugcccc

SEQ ID NO: 3574425 - RNA, 20 nt, Pseudomonas putida KT2440
cgucgguuuucaaguccuga

SEQ ID NO: 3574426 - RNA, 16 nt, Pseudomonas putida KT2440
cgucguaggagcgggu

SEQ ID NO: 3574427 - RNA, 22 nt, Pseudomonas putida KT2440
cgucguaggagcggguuuaccc

SEQ ID NO: 3574428 - RNA, 13 nt, Pseudomonas putida KT2440
cgucguaggcgcg

SEQ ID NO: 3574429 - RNA, 18 nt, Pseudomonas putida KT2440
cgucguaggcgcggguuu

SEQ ID NO: 3574430 - RNA, 14 nt, Pseudomonas putida KT2440
cgucgucacugccc

SEQ ID NO: 3574431 - RNA, 19 nt, Pseudomonas putida KT2440
cgucguccucgaacucaug

SEQ ID NO: 3574432 - RNA, 21 nt, Pseudomonas putida KT2440
cgucgucgaagaucaucgagg

SEQ ID NO: 3574433 - RNA, 13 nt, Pseudomonas putida KT2440
cgucguugcaguu

SEQ ID NO: 3574434 - RNA, 18 nt, Pseudomonas putida KT2440
cgucucgaacggcgccag

SEQ ID NO: 3574435 - RNA, 19 nt, Pseudomonas putida KT2440
cgucucgaacggcgccagc

SEQ ID NO: 3574436 - RNA, 21 nt, Pseudomonas putida KT2440
cgucucgaacggcgccagcag

SEQ ID NO: 3574437 - RNA, 20 nt, Pseudomonas putida KT2440
cgucucgaugcaauccgcca

SEQ ID NO: 3574438 - RNA, 21 nt, Pseudomonas putida KT2440
cgucucgaugcaauccgccac

SEQ ID NO: 3574439 - RNA, 22 nt, Pseudomonas putida KT2440
cgucucgcaagaagcauuacuu

SEQ ID NO: 3574440 - RNA, 21 nt, Pseudomonas putida KT2440
cgucucgggaauuguacgacc

SEQ ID NO: 3574441 - RNA, 16 nt, Pseudomonas putida KT2440
cgucucgucacuggcu

SEQ ID NO: 3574442 - RNA, 13 nt, Pseudomonas putida KT2440
cgucucuggccgc

SEQ ID NO: 3574443 - RNA, 18 nt, Pseudomonas putida KT2440
cgucuggacugggaaacc

SEQ ID NO: 3574444 - RNA, 15 nt, Pseudomonas putida KT2440
cgucuggcgcggcac

SEQ ID NO: 3574445 - RNA, 12 nt, Pseudomonas putida KT2440
cgucuuccaggu

SEQ ID NO: 3574446 - RNA, 23 nt, Pseudomonas putida KT2440
cgucuucgccaggugcgcgucga

SEQ ID NO: 3574447 - RNA, 20 nt, Pseudomonas putida KT2440
cgucuucgggugagcgcgau

SEQ ID NO: 3574448 - RNA, 22 nt, Pseudomonas putida KT2440
cgucuugaucacgucggcguca

SEQ ID NO: 3574449 - RNA, 21 nt, Pseudomonas putida KT2440
cgucuuguaguucaucuucuu

SEQ ID NO: 3574450 - RNA, 23 nt, Pseudomonas putida KT2440
cgucuuugagggucagcuggccu

SEQ ID NO: 3574451 - RNA, 22 nt, Pseudomonas putida KT2440
cgugaaaccgaaaaagccuaca

SEQ ID NO: 3574452 - RNA, 22 nt, Pseudomonas putida KT2440
cgugaaauccucaaccuggauu

SEQ ID NO: 3574453 - RNA, 19 nt, Pseudomonas putida KT2440
cgugaaccggcuguuggcc

SEQ ID NO: 3574454 - RNA, 13 nt, Pseudomonas putida KT2440
cgugaacuggagg

SEQ ID NO: 3574455 - RNA, 16 nt, Pseudomonas putida KT2440
cgugaagcaccgccac

SEQ ID NO: 3574456 - RNA, 17 nt, Pseudomonas putida KT2440
cgugaagcaccgccaca

SEQ ID NO: 3574457 - RNA, 23 nt, Pseudomonas putida KT2440
cgugaagcgcacuuggccugcug

SEQ ID NO: 3574458 - RNA, 18 nt, Pseudomonas putida KT2440
cgugaagcggccaccugc

SEQ ID NO: 3574459 - RNA, 18 nt, Pseudomonas putida KT2440
cgugaauaugcucuuucc

SEQ ID NO: 3574460 - RNA, 23 nt, Pseudomonas putida KT2440
cgugacagguaggcgccacgccg

SEQ ID NO: 3574461 - RNA, 14 nt, Pseudomonas putida KT2440
cgugacgauggcca

SEQ ID NO: 3574462 - RNA, 22 nt, Pseudomonas putida KT2440
cgugacggauacaucgcauaca

SEQ ID NO: 3574463 - RNA, 13 nt, Pseudomonas putida KT2440
cgugacggccagc

SEQ ID NO: 3574464 - RNA, 15 nt, Pseudomonas putida KT2440
cgugacggcgauggc

SEQ ID NO: 3574465 - RNA, 12 nt, Pseudomonas putida KT2440
cgugagaccugc

SEQ ID NO: 3574466 - RNA, 18 nt, Pseudomonas putida KT2440
cgugagcaucggcguugc

SEQ ID NO: 3574467 - RNA, 16 nt, Pseudomonas putida KT2440
cgugagggggcacgcg

SEQ ID NO: 3574468 - RNA, 18 nt, Pseudomonas putida KT2440
cgugagggggcacgcggc

SEQ ID NO: 3574469 - RNA, 21 nt, Pseudomonas putida KT2440
cgugagggggcacgcggcgcu

SEQ ID NO: 3574470 - RNA, 17 nt, Pseudomonas putida KT2440
cgugaggugcgcuucaa

SEQ ID NO: 3574471 - RNA, 18 nt, Pseudomonas putida KT2440
cgugauagaccugcaagu

SEQ ID NO: 3574472 - RNA, 17 nt, Pseudomonas putida KT2440
cgugauagauaucaagc

SEQ ID NO: 3574473 - RNA, 23 nt, Pseudomonas putida KT2440
cgugauagauaucaagcaugcgu

SEQ ID NO: 3574474 - RNA, 18 nt, Pseudomonas putida KT2440
cgugauaucgggauaacc

SEQ ID NO: 3574475 - RNA, 14 nt, Pseudomonas putida KT2440
cgugaucaucagcg

SEQ ID NO: 3574476 - RNA, 14 nt, Pseudomonas putida KT2440
cgugaucaucccca

SEQ ID NO: 3574477 - RNA, 15 nt, Pseudomonas putida KT2440
cgugaucauccccag

SEQ ID NO: 3574478 - RNA, 20 nt, Pseudomonas putida KT2440
cgugaucauccccagcaugg

SEQ ID NO: 3574479 - RNA, 19 nt, Pseudomonas putida KT2440
cgugaugguaucugccagc

SEQ ID NO: 3574480 - RNA, 20 nt, Pseudomonas putida KT2440
cgugaugguaucugccagca

SEQ ID NO: 3574481 - RNA, 21 nt, Pseudomonas putida KT2440
cgugaugguaucugccagcac

SEQ ID NO: 3574482 - RNA, 22 nt, Pseudomonas putida KT2440
cgugaugguaucugccagcacg

SEQ ID NO: 3574483 - RNA, 19 nt, Pseudomonas putida KT2440
cgugauuugaacuugcgca

SEQ ID NO: 3574484 - RNA, 22 nt, Pseudomonas putida KT2440
cgugcaacgccgguagcugcgc

SEQ ID NO: 3574485 - RNA, 18 nt, Pseudomonas putida KT2440
cgugcaaggaucaccaag

SEQ ID NO: 3574486 - RNA, 15 nt, Pseudomonas putida KT2440
cgugcaagggauauc

SEQ ID NO: 3574487 - RNA, 12 nt, Pseudomonas putida KT2440
cgugcaccagca

SEQ ID NO: 3574488 - RNA, 14 nt, Pseudomonas putida KT2440
cgugcacccaaccu

SEQ ID NO: 3574489 - RNA, 20 nt, Pseudomonas putida KT2440
cgugcacccaaccugccgau

SEQ ID NO: 3574490 - RNA, 22 nt, Pseudomonas putida KT2440
cgugcacccaaccugccgaucu

SEQ ID NO: 3574491 - RNA, 19 nt, Pseudomonas putida KT2440
cgugcaccccauaacgccc

SEQ ID NO: 3574492 - RNA, 14 nt, Pseudomonas putida KT2440
cgugcaccugucgc

SEQ ID NO: 3574493 - RNA, 20 nt, Pseudomonas putida KT2440
cgugcacgcuugagcgcgcc

SEQ ID NO: 3574494 - RNA, 21 nt, Pseudomonas putida KT2440
cgugcacgcuugagcgcgccg

SEQ ID NO: 3574495 - RNA, 23 nt, Pseudomonas putida KT2440
cgugcacgcuugagcgcgccgcc

SEQ ID NO: 3574496 - RNA, 20 nt, Pseudomonas putida KT2440
cgugcacggccuugucagca

SEQ ID NO: 3574497 - RNA, 22 nt, Pseudomonas putida KT2440
cgugcacuuucgcggcccagcc

SEQ ID NO: 3574498 - RNA, 16 nt, Pseudomonas putida KT2440
cgugcaggcggcgaca

SEQ ID NO: 3574499 - RNA, 19 nt, Pseudomonas putida KT2440
cgugcaggcggcgacaacc

SEQ ID NO: 3574500 - RNA, 21 nt, Pseudomonas putida KT2440
cgugcaggcggcgacaaccga

SEQ ID NO: 3574501 - RNA, 18 nt, Pseudomonas putida KT2440
cgugcaucugcuccccca

SEQ ID NO: 3574502 - RNA, 19 nt, Pseudomonas putida KT2440
cgugcaucugcucccccag

SEQ ID NO: 3574503 - RNA, 14 nt, Pseudomonas putida KT2440
cgugccauucaucg

SEQ ID NO: 3574504 - RNA, 18 nt, Pseudomonas putida KT2440
cgugcccaccagcgcuuc

SEQ ID NO: 3574505 - RNA, 19 nt, Pseudomonas putida KT2440
cgugcccagaucacuucca

SEQ ID NO: 3574506 - RNA, 19 nt, Pseudomonas putida KT2440
cgugcccccccaacaacag

SEQ ID NO: 3574507 - RNA, 16 nt, Pseudomonas putida KT2440
cgugcccggcaaucgc

SEQ ID NO: 3574508 - RNA, 18 nt, Pseudomonas putida KT2440
cgugcccggcaaucgcca

SEQ ID NO: 3574509 - RNA, 15 nt, Pseudomonas putida KT2440
cgugccgaggacaac

SEQ ID NO: 3574510 - RNA, 18 nt, Pseudomonas putida KT2440
cgugccgcaucagccggc

SEQ ID NO: 3574511 - RNA, 13 nt, Pseudomonas putida KT2440
cgugccgcaugug

SEQ ID NO: 3574512 - RNA, 18 nt, Pseudomonas putida KT2440
cgugccgcaugugccagg

SEQ ID NO: 3574513 - RNA, 15 nt, Pseudomonas putida KT2440
cgugccggaacaacc

SEQ ID NO: 3574514 - RNA, 15 nt, Pseudomonas putida KT2440
cgugccggucacugg

SEQ ID NO: 3574515 - RNA, 20 nt, Pseudomonas putida KT2440
cgugccggucacuggcaacg

SEQ ID NO: 3574516 - RNA, 17 nt, Pseudomonas putida KT2440
cgugccgucgagcaggu

SEQ ID NO: 3574517 - RNA, 16 nt, Pseudomonas putida KT2440
cgugccucagccaggc

SEQ ID NO: 3574518 - RNA, 20 nt, Pseudomonas putida KT2440
cgugccucgcgcauggccgc

SEQ ID NO: 3574519 - RNA, 13 nt, Pseudomonas putida KT2440
cgugccugcugcu

SEQ ID NO: 3574520 - RNA, 13 nt, Pseudomonas putida KT2440
cgugccugguugc

SEQ ID NO: 3574521 - RNA, 18 nt, Pseudomonas putida KT2440
cgugccuuccagcuucug

SEQ ID NO: 3574522 - RNA, 14 nt, Pseudomonas putida KT2440
cgugcgcccggcaa

SEQ ID NO: 3574523 - RNA, 20 nt, Pseudomonas putida KT2440
cgugcgccucaugcagcacc

SEQ ID NO: 3574524 - RNA, 23 nt, Pseudomonas putida KT2440
cgugcgcggggcccgaccucacg

SEQ ID NO: 3574525 - RNA, 19 nt, Pseudomonas putida KT2440
cgugcgcuacaagccggcg

SEQ ID NO: 3574526 - RNA, 21 nt, Pseudomonas putida KT2440
cgugcgcuacaagccggcgcu

SEQ ID NO: 3574527 - RNA, 17 nt, Pseudomonas putida KT2440
cgugcgcuccuggucau

SEQ ID NO: 3574528 - RNA, 20 nt, Pseudomonas putida KT2440
cgugcgcugcauggcggcac

SEQ ID NO: 3574529 - RNA, 20 nt, Pseudomonas putida KT2440
cgugcggccaaagcuguuga

SEQ ID NO: 3574530 - RNA, 15 nt, Pseudomonas putida KT2440
cgugcggggcaucgc

SEQ ID NO: 3574531 - RNA, 21 nt, Pseudomonas putida KT2440
cgugcucacgccccuuggcac

SEQ ID NO: 3574532 - RNA, 16 nt, Pseudomonas putida KT2440
cgugcucaggcggcca

SEQ ID NO: 3574533 - RNA, 15 nt, Pseudomonas putida KT2440
cgugcucggcacugc

SEQ ID NO: 3574534 - RNA, 19 nt, Pseudomonas putida KT2440
cgugcucguccuugccguc

SEQ ID NO: 3574535 - RNA, 22 nt, Pseudomonas putida KT2440
cgugcuucaucgcugacuucca

SEQ ID NO: 3574536 - RNA, 17 nt, Pseudomonas putida KT2440
cguggaaaaggcgcugu

SEQ ID NO: 3574537 - RNA, 15 nt, Pseudomonas putida KT2440
cguggaacaacggcu

SEQ ID NO: 3574538 - RNA, 16 nt, Pseudomonas putida KT2440
cguggaacaacggcuc

SEQ ID NO: 3574539 - RNA, 14 nt, Pseudomonas putida KT2440
cguggacagcagcu

SEQ ID NO: 3574540 - RNA, 14 nt, Pseudomonas putida KT2440
cguggaccagagcg

SEQ ID NO: 3574541 - RNA, 23 nt, Pseudomonas putida KT2440
cguggcaaggcccgcgccgacag

SEQ ID NO: 3574542 - RNA, 19 nt, Pseudomonas putida KT2440
cguggcaaucuucuugccg

SEQ ID NO: 3574543 - RNA, 20 nt, Pseudomonas putida KT2440
cguggcaaucuucuugccgg

SEQ ID NO: 3574544 - RNA, 13 nt, Pseudomonas putida KT2440
cguggcaccggcg

SEQ ID NO: 3574545 - RNA, 21 nt, Pseudomonas putida KT2440
cguggcagcaaucggcagcgc

SEQ ID NO: 3574546 - RNA, 19 nt, Pseudomonas putida KT2440
cguggcagcccccccagca

SEQ ID NO: 3574547 - RNA, 22 nt, Pseudomonas putida KT2440
cguggcagcccccccagcaacg

SEQ ID NO: 3574548 - RNA, 16 nt, Pseudomonas putida KT2440
cguggcaggcaguucg

SEQ ID NO: 3574549 - RNA, 13 nt, Pseudomonas putida KT2440
cguggccagccca

SEQ ID NO: 3574550 - RNA, 20 nt, Pseudomonas putida KT2440
cguggccccgggccauggca

SEQ ID NO: 3574551 - RNA, 14 nt, Pseudomonas putida KT2440
cguggccgccaaca

SEQ ID NO: 3574552 - RNA, 19 nt, Pseudomonas putida KT2440
cguggccgccaacagcgca

SEQ ID NO: 3574553 - RNA, 15 nt, Pseudomonas putida KT2440
cguggccggcaucgc

SEQ ID NO: 3574554 - RNA, 18 nt, Pseudomonas putida KT2440
cguggccuguaccgaccu

SEQ ID NO: 3574555 - RNA, 13 nt, Pseudomonas putida KT2440
cguggccuucucu

SEQ ID NO: 3574556 - RNA, 17 nt, Pseudomonas putida KT2440
cguggccuucucuuccg

SEQ ID NO: 3574557 - RNA, 19 nt, Pseudomonas putida KT2440
cguggcgaacacuuggcag

SEQ ID NO: 3574558 - RNA, 16 nt, Pseudomonas putida KT2440
cguggcgcuggcgggc

SEQ ID NO: 3574559 - RNA, 18 nt, Pseudomonas putida KT2440
cguggcgcuggcgggcaa

SEQ ID NO: 3574560 - RNA, 16 nt, Pseudomonas putida KT2440
cguggcugcguucagg

SEQ ID NO: 3574561 - RNA, 18 nt, Pseudomonas putida KT2440
cguggcugcguucaggca

SEQ ID NO: 3574562 - RNA, 19 nt, Pseudomonas putida KT2440
cguggcugcguucaggcag

SEQ ID NO: 3574563 - RNA, 13 nt, Pseudomonas putida KT2440
cguugucgacugc

SEQ ID NO: 3574564 - RNA, 19 nt, Pseudomonas putida KT2440
cguugucggcccacugcac

SEQ ID NO: 3574565 - RNA, 15 nt, Pseudomonas putida KT2440
cguugugcagcacuu

SEQ ID NO: 3574566 - RNA, 18 nt, Pseudomonas putida KT2440
cguuguucgaucagccgu

SEQ ID NO: 3574567 - RNA, 19 nt, Pseudomonas putida KT2440
cguuuaccugcagcucagc

SEQ ID NO: 3574568 - RNA, 15 nt, Pseudomonas putida KT2440
cguuucaguacagcc

SEQ ID NO: 3574569 - RNA, 18 nt, Pseudomonas putida KT2440
cguuucaugauguacgcc

SEQ ID NO: 3574570 - RNA, 16 nt, Pseudomonas putida KT2440
cguuuccccuguuccc

SEQ ID NO: 3574571 - RNA, 16 nt, Pseudomonas putida KT2440
cguuucgaucucgcca

SEQ ID NO: 3574572 - RNA, 18 nt, Pseudomonas putida KT2440
cguuucgucauccaccgc

SEQ ID NO: 3574573 - RNA, 18 nt, Pseudomonas putida KT2440
cguuucguugaccccgcc

SEQ ID NO: 3574574 - RNA, 19 nt, Pseudomonas putida KT2440
cguuugcaacuggcgcagg

SEQ ID NO: 3574575 - RNA, 14 nt, Pseudomonas putida KT2440
cguuugcuggccug

SEQ ID NO: 3574576 - RNA, 14 nt, Pseudomonas putida KT2440
cguuuggcagugcc

SEQ ID NO: 3574577 - RNA, 15 nt, Pseudomonas putida KT2440
cguuugggcggcgug

SEQ ID NO: 3574578 - RNA, 14 nt, Pseudomonas putida KT2440
cguuugggguccug

SEQ ID NO: 3574579 - RNA, 22 nt, Pseudomonas putida KT2440
cguuuuucucgaugaugcuggu

SEQ ID NO: 3574580 - RNA, 16 nt, Pseudomonas putida KT2440
cuaaaagcuggcgcga

SEQ ID NO: 3574581 - RNA, 21 nt, Pseudomonas putida KT2440
cuaaagugccuugaucaaugc

SEQ ID NO: 3574582 - RNA, 17 nt, Pseudomonas putida KT2440
cuaaaucgaccugcagg

SEQ ID NO: 3574583 - RNA, 22 nt, Pseudomonas putida KT2440
cuaaaucgaccugcaggcccug

SEQ ID NO: 3574584 - RNA, 17 nt, Pseudomonas putida KT2440
cuaacaggugcucacca

SEQ ID NO: 3574585 - RNA, 16 nt, Pseudomonas putida KT2440
cuaaccucugcaugcc

SEQ ID NO: 3574586 - RNA, 17 nt, Pseudomonas putida KT2440
cuaacgcaaccaucagu

SEQ ID NO: 3574587 - RNA, 17 nt, Pseudomonas putida KT2440
cuaagccuccagagaac

SEQ ID NO: 3574588 - RNA, 22 nt, Pseudomonas putida KT2440
cuaagcgaaacaccagcaacau

SEQ ID NO: 3574589 - RNA, 13 nt, Pseudomonas putida KT2440
cuaagcgccagca

SEQ ID NO: 3574590 - RNA, 18 nt, Pseudomonas putida KT2440
cuaagggaguauaccuca

SEQ ID NO: 3574591 - RNA, 13 nt, Pseudomonas putida KT2440
cuaagggcuagau

SEQ ID NO: 3574592 - RNA, 17 nt, Pseudomonas putida KT2440
cuaaguuugcccagcgc

SEQ ID NO: 3574593 - RNA, 21 nt, Pseudomonas putida KT2440
cuaaguuugcccagcgcugca

SEQ ID NO: 3574594 - RNA, 19 nt, Pseudomonas putida KT2440
cuaauauuaagcggucucg

SEQ ID NO: 3574595 - RNA, 14 nt, Pseudomonas putida KT2440
cuaaucgggcagau

SEQ ID NO: 3574596 - RNA, 19 nt, Pseudomonas putida KT2440
cuaaugugacugaugauga

SEQ ID NO: 3574597 - RNA, 17 nt, Pseudomonas putida KT2440
cuaauugcccgagcgcu

SEQ ID NO: 3574598 - RNA, 22 nt, Pseudomonas putida KT2440
cuacaacauaccgcugggcacc

SEQ ID NO: 3574599 - RNA, 17 nt, Pseudomonas putida KT2440
cuacaacggcugugccg

SEQ ID NO: 3574600 - RNA, 12 nt, Pseudomonas putida KT2440
cuacaaggguga

SEQ ID NO: 3574601 - RNA, 15 nt, Pseudomonas putida KT2440
cuacaagguacccca

SEQ ID NO: 3574602 - RNA, 17 nt, Pseudomonas putida KT2440
cuacaagugguuaaccu

SEQ ID NO: 3574603 - RNA, 16 nt, Pseudomonas putida KT2440
cuacacgacccaccau

SEQ ID NO: 3574604 - RNA, 12 nt, Pseudomonas putida KT2440
cuacagccccuu

SEQ ID NO: 3574605 - RNA, 19 nt, Pseudomonas putida KT2440
cuacagccccuuccccagg

SEQ ID NO: 3574606 - RNA, 14 nt, Pseudomonas putida KT2440
cuacagcggccugu

SEQ ID NO: 3574607 - RNA, 20 nt, Pseudomonas putida KT2440
cuacaggaaucugucagccu

SEQ ID NO: 3574608 - RNA, 21 nt, Pseudomonas putida KT2440
cuacaggaaucugucagccuu

SEQ ID NO: 3574609 - RNA, 15 nt, Pseudomonas putida KT2440
cuacagguucugcgc

SEQ ID NO: 3574610 - RNA, 16 nt, Pseudomonas putida KT2440
cuacagguuucagucg

SEQ ID NO: 3574611 - RNA, 17 nt, Pseudomonas putida KT2440
cuacaugaaccacacac

SEQ ID NO: 3574612 - RNA, 20 nt, Pseudomonas putida KT2440
cuacauggaucgcauugccc

SEQ ID NO: 3574613 - RNA, 21 nt, Pseudomonas putida KT2440
cuaccaaccugccaugcaggu

SEQ ID NO: 3574614 - RNA, 15 nt, Pseudomonas putida KT2440
cuaccaacgcagcau

SEQ ID NO: 3574615 - RNA, 15 nt, Pseudomonas putida KT2440
cuaccaacugagcua

SEQ ID NO: 3574616 - RNA, 15 nt, Pseudomonas putida KT2440
cuaccacguuaucca

SEQ ID NO: 3574617 - RNA, 17 nt, Pseudomonas putida KT2440
cuaccacguuauccagc

SEQ ID NO: 3574618 - RNA, 18 nt, Pseudomonas putida KT2440
cuaccacguuauccagcu

SEQ ID NO: 3574619 - RNA, 21 nt, Pseudomonas putida KT2440
cuaccacguuauccagcugca

SEQ ID NO: 3574620 - RNA, 21 nt, Pseudomonas putida KT2440
cuaccagaaauggucgcgggc

SEQ ID NO: 3574621 - RNA, 24 nt, Pseudomonas putida KT2440
cuaccagcuugccgcgugcgaugu

SEQ ID NO: 3574622 - RNA, 23 nt, Pseudomonas putida KT2440
cuacccaaacucuugagcuggcc

SEQ ID NO: 3574623 - RNA, 15 nt, Pseudomonas putida KT2440
cuacccagccgggca

SEQ ID NO: 3574624 - RNA, 22 nt, Pseudomonas putida KT2440
cuaccgcaaaugcugccaugca

SEQ ID NO: 3574625 - RNA, 18 nt, Pseudomonas putida KT2440
cuaccgccaacgaaucag

SEQ ID NO: 3574626 - RNA, 15 nt, Pseudomonas putida KT2440
cuaccgcccgcgcuu

SEQ ID NO: 3574627 - RNA, 20 nt, Pseudomonas putida KT2440
cuaccggcauaccaucuucu

SEQ ID NO: 3574628 - RNA, 17 nt, Pseudomonas putida KT2440
cuaccggcgccacuucg

SEQ ID NO: 3574629 - RNA, 17 nt, Pseudomonas putida KT2440
cuaccugagccugcagg

SEQ ID NO: 3574630 - RNA, 20 nt, Pseudomonas putida KT2440
cuaccugugggagcgggcgu

SEQ ID NO: 3574631 - RNA, 19 nt, Pseudomonas putida KT2440
cuacgacccugaagcccug

SEQ ID NO: 3574632 - RNA, 14 nt, Pseudomonas putida KT2440
cuacgacggccugc

SEQ ID NO: 3574633 - RNA, 17 nt, Pseudomonas putida KT2440
cuacgagacgguggcug

SEQ ID NO: 3574634 - RNA, 20 nt, Pseudomonas putida KT2440
cuacgagacgguggcugcca

SEQ ID NO: 3574635 - RNA, 20 nt, Pseudomonas putida KT2440
cuacgcaaaccaaacgcccg

SEQ ID NO: 3574636 - RNA, 15 nt, Pseudomonas putida KT2440
cuacgcaaggugcca

SEQ ID NO: 3574637 - RNA, 16 nt, Pseudomonas putida KT2440
cuacgcagcacccggu

SEQ ID NO: 3574638 - RNA, 14 nt, Pseudomonas putida KT2440
cuacgcaggcaccg

SEQ ID NO: 3574639 - RNA, 17 nt, Pseudomonas putida KT2440
cuacgcccccagccuug

SEQ ID NO: 3574640 - RNA, 18 nt, Pseudomonas putida KT2440
cuacgcccccagccuuga

SEQ ID NO: 3574641 - RNA, 22 nt, Pseudomonas putida KT2440
cuacgccgccccacucgcgcag

SEQ ID NO: 3574642 - RNA, 16 nt, Pseudomonas putida KT2440
cuacgccggccaaggu

SEQ ID NO: 3574643 - RNA, 21 nt, Pseudomonas putida KT2440
cuacgcgagccaccgucgaac

SEQ ID NO: 3574644 - RNA, 17 nt, Pseudomonas putida KT2440
cuacgcgccagcaugga

SEQ ID NO: 3574645 - RNA, 21 nt, Pseudomonas putida KT2440
cuacgcggggcagcgcacguc

SEQ ID NO: 3574646 - RNA, 21 nt, Pseudomonas putida KT2440
cuacgcucguccaggcccugc

SEQ ID NO: 3574647 - RNA, 20 nt, Pseudomonas putida KT2440
cuacggccgugcagggcgcc

SEQ ID NO: 3574648 - RNA, 17 nt, Pseudomonas putida KT2440
cuacggcgggccaucug

SEQ ID NO: 3574649 - RNA, 17 nt, Pseudomonas putida KT2440
cuacgggggggcgcagg

SEQ ID NO: 3574650 - RNA, 15 nt, Pseudomonas putida KT2440
cuacgucagcuugca

SEQ ID NO: 3574651 - RNA, 15 nt, Pseudomonas putida KT2440
cuacguggaccagag

SEQ ID NO: 3574652 - RNA, 23 nt, Pseudomonas putida KT2440
cuacuccgcgagcauucagcuca

SEQ ID NO: 3574653 - RNA, 14 nt, Pseudomonas putida KT2440
cuacugcuggcgcg

SEQ ID NO: 3574654 - RNA, 22 nt, Pseudomonas putida KT2440
cuagaaacagauagaucaugca

SEQ ID NO: 3574655 - RNA, 16 nt, Pseudomonas putida KT2440
cuagaggaucugaaug

SEQ ID NO: 3574656 - RNA, 18 nt, Pseudomonas putida KT2440
cuagauaaccaaccccug

SEQ ID NO: 3574657 - RNA, 20 nt, Pseudomonas putida KT2440
cuagcagucccaucugguug

SEQ ID NO: 3574658 - RNA, 21 nt, Pseudomonas putida KT2440
cuagcagucccaucugguugg

SEQ ID NO: 3574659 - RNA, 15 nt, Pseudomonas putida KT2440
cuagccgccugccgc

SEQ ID NO: 3574660 - RNA, 15 nt, Pseudomonas putida KT2440
cuagccggucaccga

SEQ ID NO: 3574661 - RNA, 16 nt, Pseudomonas putida KT2440
cuagccggucaccgac

SEQ ID NO: 3574662 - RNA, 15 nt, Pseudomonas putida KT2440
cuagccucaucagag

SEQ ID NO: 3574663 - RNA, 18 nt, Pseudomonas putida KT2440
cuagcgcaacaccgccau

SEQ ID NO: 3574664 - RNA, 19 nt, Pseudomonas putida KT2440
cuagcgccugacaugcaca

SEQ ID NO: 3574665 - RNA, 14 nt, Pseudomonas putida KT2440
cuagcuaucucaag

SEQ ID NO: 3574666 - RNA, 16 nt, Pseudomonas putida KT2440
cuagcuaucucaagcc

SEQ ID NO: 3574667 - RNA, 19 nt, Pseudomonas putida KT2440
cuagguaguaaagccccca

SEQ ID NO: 3574668 - RNA, 19 nt, Pseudomonas putida KT2440
cucagcuacgcuggacuug

SEQ ID NO: 3574669 - RNA, 23 nt, Pseudomonas putida KT2440
cucagcucuucaucccugaccga

SEQ ID NO: 3574670 - RNA, 13 nt, Pseudomonas putida KT2440
cucagcugcugcu

SEQ ID NO: 3574671 - RNA, 14 nt, Pseudomonas putida KT2440
cucagcugcugcuc

SEQ ID NO: 3574672 - RNA, 20 nt, Pseudomonas putida KT2440
cucagcugggcguuuccagg

SEQ ID NO: 3574673 - RNA, 14 nt, Pseudomonas putida KT2440
cucagcuuacgccu

SEQ ID NO: 3574674 - RNA, 21 nt, Pseudomonas putida KT2440
cucagcuuacgccugaaccac

SEQ ID NO: 3574675 - RNA, 14 nt, Pseudomonas putida KT2440
cucaggcaccagcg

SEQ ID NO: 3574676 - RNA, 19 nt, Pseudomonas putida KT2440
cucaggcaccagcgcugcc

SEQ ID NO: 3574677 - RNA, 16 nt, Pseudomonas putida KT2440
cucaggccaguuccuc

SEQ ID NO: 3574678 - RNA, 12 nt, Pseudomonas putida KT2440
cucaggccaugc

SEQ ID NO: 3574679 - RNA, 16 nt, Pseudomonas putida KT2440
cucaggccaugcugcg

SEQ ID NO: 3574680 - RNA, 22 nt, Pseudomonas putida KT2440
cucaggccaugcugcgccagga

SEQ ID NO: 3574681 - RNA, 19 nt, Pseudomonas putida KT2440
cucaggccccaggccaucc

SEQ ID NO: 3574682 - RNA, 14 nt, Pseudomonas putida KT2440
cucaggccuucgcc

SEQ ID NO: 3574683 - RNA, 21 nt, Pseudomonas putida KT2440
cucaggccuucgccacugcca

SEQ ID NO: 3574684 - RNA, 21 nt, Pseudomonas putida KT2440
cucaggccuugcucgaaugcc

SEQ ID NO: 3574685 - RNA, 19 nt, Pseudomonas putida KT2440
cucaggcgcagcgcaugcu

SEQ ID NO: 3574686 - RNA, 20 nt, Pseudomonas putida KT2440
cucaggcgcgccgaucaucu

SEQ ID NO: 3574687 - RNA, 14 nt, Pseudomonas putida KT2440
cucaggcgcuccag

SEQ ID NO: 3574688 - RNA, 17 nt, Pseudomonas putida KT2440
cucaggcgcuggcgcca

SEQ ID NO: 3574689 - RNA, 19 nt, Pseudomonas putida KT2440
cucaggcgcuggcgccagc

SEQ ID NO: 3574690 - RNA, 22 nt, Pseudomonas putida KT2440
cucaggcgcuggcgccagccgc

SEQ ID NO: 3574691 - RNA, 15 nt, Pseudomonas putida KT2440
cucaggcggccaaac

SEQ ID NO: 3574692 - RNA, 16 nt, Pseudomonas putida KT2440
cucaggcggcgcaggu

SEQ ID NO: 3574693 - RNA, 18 nt, Pseudomonas putida KT2440
cucaggcgggcagcgcaa

SEQ ID NO: 3574694 - RNA, 11 nt, Pseudomonas putida KT2440
cucaggcucag

SEQ ID NO: 3574695 - RNA, 19 nt, Pseudomonas putida KT2440
cucaggcucagcuccaugc

SEQ ID NO: 3574696 - RNA, 21 nt, Pseudomonas putida KT2440
cucaggcugagcagaccagcc

SEQ ID NO: 3574697 - RNA, 14 nt, Pseudomonas putida KT2440
cucagggcagcaac

SEQ ID NO: 3574698 - RNA, 15 nt, Pseudomonas putida KT2440
cucagggcagcaacg

SEQ ID NO: 3574699 - RNA, 22 nt, Pseudomonas putida KT2440
cucaggggcauugcgcuggucg

SEQ ID NO: 3574700 - RNA, 15 nt, Pseudomonas putida KT2440
cucagguagaccugc

SEQ ID NO: 3574701 - RNA, 16 nt, Pseudomonas putida KT2440
cucagguaggcagcaa

SEQ ID NO: 3574702 - RNA, 18 nt, Pseudomonas putida KT2440
cucagguaggcagcaacg

SEQ ID NO: 3574703 - RNA, 20 nt, Pseudomonas putida KT2440
cucaggugcacagggcggcc

SEQ ID NO: 3574704 - RNA, 14 nt, Pseudomonas putida KT2440
cucaggugcaccuc

SEQ ID NO: 3574705 - RNA, 20 nt, Pseudomonas putida KT2440
cucagguuacgcaccagcuc

SEQ ID NO: 3574706 - RNA, 14 nt, Pseudomonas putida KT2440
cucagucgcaucga

SEQ ID NO: 3574707 - RNA, 19 nt, Pseudomonas putida KT2440
cucagucgcaucgacaggu

SEQ ID NO: 3574708 - RNA, 18 nt, Pseudomonas putida KT2440
cucagugccuggcgugcu

SEQ ID NO: 3574709 - RNA, 18 nt, Pseudomonas putida KT2440
cucagugugggggcggcc

SEQ ID NO: 3574710 - RNA, 20 nt, Pseudomonas putida KT2440
cucauacccuuugccaucca

SEQ ID NO: 3574711 - RNA, 21 nt, Pseudomonas putida KT2440
cucauagaaauggcuuccggc

SEQ ID NO: 3574712 - RNA, 17 nt, Pseudomonas putida KT2440
cucauagcucagcugga

SEQ ID NO: 3574713 - RNA, 22 nt, Pseudomonas putida KT2440
cucauagcuuucaggcgcagca

SEQ ID NO: 3574714 - RNA, 20 nt, Pseudomonas putida KT2440
cucauaguaaggcuggucgc

SEQ ID NO: 3574715 - RNA, 19 nt, Pseudomonas putida KT2440
cucaucaccaggcccgcaa

SEQ ID NO: 3574716 - RNA, 20 nt, Pseudomonas putida KT2440
cucaucaccaggcccgcaag

SEQ ID NO: 3574717 - RNA, 13 nt, Pseudomonas putida KT2440
cucaucaccucgg

SEQ ID NO: 3574718 - RNA, 21 nt, Pseudomonas putida KT2440
cucaucaggccgaaggccagc

SEQ ID NO: 3574719 - RNA, 23 nt, Pseudomonas putida KT2440
cucaucaggcgauucaggcuuug

SEQ ID NO: 3574720 - RNA, 16 nt, Pseudomonas putida KT2440
cucauccacaccuucg

SEQ ID NO: 3574721 - RNA, 13 nt, Pseudomonas putida KT2440
cucauccaccaca

SEQ ID NO: 3574722 - RNA, 12 nt, Pseudomonas putida KT2440
cucauccacccc

SEQ ID NO: 3574723 - RNA, 15 nt, Pseudomonas putida KT2440
cucauccacccccgc

SEQ ID NO: 3574724 - RNA, 12 nt, Pseudomonas putida KT2440
cucauccagcgu

SEQ ID NO: 3574725 - RNA, 12 nt, Pseudomonas putida KT2440
cucauccaggcu

SEQ ID NO: 3574726 - RNA, 14 nt, Pseudomonas putida KT2440
cucauccaggcugc

SEQ ID NO: 3574727 - RNA, 14 nt, Pseudomonas putida KT2440
cucaucccccggcc

SEQ ID NO: 3574728 - RNA, 17 nt, Pseudomonas putida KT2440
cucauccucgcccacca

SEQ ID NO: 3574729 - RNA, 11 nt, Pseudomonas putida KT2440
cucaucgaugc

SEQ ID NO: 3574730 - RNA, 15 nt, Pseudomonas putida KT2440
cucaucggcauugcu

SEQ ID NO: 3574731 - RNA, 17 nt, Pseudomonas putida KT2440
cucaucggcgccggccg

SEQ ID NO: 3574732 - RNA, 13 nt, Pseudomonas putida KT2440
cucaucggcggcu

SEQ ID NO: 3574733 - RNA, 16 nt, Pseudomonas putida KT2440
cucaucggcggcuucc

SEQ ID NO: 3574734 - RNA, 14 nt, Pseudomonas putida KT2440
cucaucguccaccg

SEQ ID NO: 3574735 - RNA, 17 nt, Pseudomonas putida KT2440
cucaucguccaccgcgc

SEQ ID NO: 3574736 - RNA, 23 nt, Pseudomonas putida KT2440
cucaucguccaccgcgccaucaa

SEQ ID NO: 3574737 - RNA, 13 nt, Pseudomonas putida KT2440
cucaucugccggc

SEQ ID NO: 3574738 - RNA, 14 nt, Pseudomonas putida KT2440
cucaucugccggcg

SEQ ID NO: 3574739 - RNA, 17 nt, Pseudomonas putida KT2440
cucaucugcgccagugg

SEQ ID NO: 3574740 - RNA, 15 nt, Pseudomonas putida KT2440
cucaugaacagcgcc

SEQ ID NO: 3574741 - RNA, 16 nt, Pseudomonas putida KT2440
cucaugaacagcgccc

SEQ ID NO: 3574742 - RNA, 19 nt, Pseudomonas putida KT2440
cucaugcagcaccuccugc

SEQ ID NO: 3574743 - RNA, 14 nt, Pseudomonas putida KT2440
cucaugccccgcac

SEQ ID NO: 3574744 - RNA, 18 nt, Pseudomonas putida KT2440
cucaugcgccagggcuga

SEQ ID NO: 3574745 - RNA, 19 nt, Pseudomonas putida KT2440
cucaugcgggucaagcugg

SEQ ID NO: 3574746 - RNA, 17 nt, Pseudomonas putida KT2440
cucaugggugucggcau

SEQ ID NO: 3574747 - RNA, 18 nt, Pseudomonas putida KT2440
cucauggucagccggcag

SEQ ID NO: 3574748 - RNA, 21 nt, Pseudomonas putida KT2440
cucaugugugccgagugccaa

SEQ ID NO: 3574749 - RNA, 21 nt, Pseudomonas putida KT2440
cucauuguuuugccugggggu

SEQ ID NO: 3574750 - RNA, 22 nt, Pseudomonas putida KT2440
cuccaaagccagcgcuaaaccu

SEQ ID NO: 3574751 - RNA, 13 nt, Pseudomonas putida KT2440
cuccaacaaacuc

SEQ ID NO: 3574752 - RNA, 23 nt, Pseudomonas putida KT2440
cuccaacaaucgcgucagcaccg

SEQ ID NO: 3574753 - RNA, 16 nt, Pseudomonas putida KT2440
cuccaaccccagcgca

SEQ ID NO: 3574754 - RNA, 21 nt, Pseudomonas putida KT2440
cuccaacucgcgcauccagcc

SEQ ID NO: 3574755 - RNA, 16 nt, Pseudomonas putida KT2440
cuccaagugccgugca

SEQ ID NO: 3574756 - RNA, 23 nt, Pseudomonas putida KT2440
cuccacaauguagucgucggccg

SEQ ID NO: 3574757 - RNA, 18 nt, Pseudomonas putida KT2440
cuccacaccccaagccau

SEQ ID NO: 3574758 - RNA, 16 nt, Pseudomonas putida KT2440
cuccacacucgacgcu

SEQ ID NO: 3574759 - RNA, 21 nt, Pseudomonas putida KT2440
cuccaccaaggcugacgccag

SEQ ID NO: 3574760 - RNA, 11 nt, Pseudomonas putida KT2440
cuccaccacca

SEQ ID NO: 3574761 - RNA, 13 nt, Pseudomonas putida KT2440
cuccaccaccacu

SEQ ID NO: 3574762 - RNA, 13 nt, Pseudomonas putida KT2440
cuccaccaccugc

SEQ ID NO: 3574763 - RNA, 20 nt, Pseudomonas putida KT2440
cuccaccagcccaccgagcu

SEQ ID NO: 3574764 - RNA, 16 nt, Pseudomonas putida KT2440
cuccaccaggccacgu

SEQ ID NO: 3574765 - RNA, 14 nt, Pseudomonas putida KT2440
cuccacccaccuug

SEQ ID NO: 3574766 - RNA, 18 nt, Pseudomonas putida KT2440
cuccacccaccuuggccc

SEQ ID NO: 3574767 - RNA, 18 nt, Pseudomonas putida KT2440
cuccaccccgcaggccgc

SEQ ID NO: 3574768 - RNA, 16 nt, Pseudomonas putida KT2440
cuccacccggucccgc

SEQ ID NO: 3574769 - RNA, 19 nt, Pseudomonas putida KT2440
cuccaccgauccuuggcga

SEQ ID NO: 3574770 - RNA, 21 nt, Pseudomonas putida KT2440
cuccaccgauccuuggcgaag

SEQ ID NO: 3574771 - RNA, 22 nt, Pseudomonas putida KT2440
cuccaccgggauggcggcgccu

SEQ ID NO: 3574772 - RNA, 19 nt, Pseudomonas putida KT2440
cuccaccuuccacucuucc

SEQ ID NO: 3574773 - RNA, 19 nt, Pseudomonas putida KT2440
cuccacgacaaaucgacau

SEQ ID NO: 3574774 - RNA, 21 nt, Pseudomonas putida KT2440
cucccggcuacgcacccgcac

SEQ ID NO: 3574775 - RNA, 19 nt, Pseudomonas putida KT2440
cucccggcucaucaggcga

SEQ ID NO: 3574776 - RNA, 20 nt, Pseudomonas putida KT2440
cucccggcucaucaggcgau

SEQ ID NO: 3574777 - RNA, 17 nt, Pseudomonas putida KT2440
cucccgggaucaccgca

SEQ ID NO: 3574778 - RNA, 18 nt, Pseudomonas putida KT2440
cucccgggaucaccgcaa

SEQ ID NO: 3574779 - RNA, 14 nt, Pseudomonas putida KT2440
cucccgggcaauca

SEQ ID NO: 3574780 - RNA, 18 nt, Pseudomonas putida KT2440
cucccguuugacagcgag

SEQ ID NO: 3574781 - RNA, 19 nt, Pseudomonas putida KT2440
cucccucguaggagcgggu

SEQ ID NO: 3574782 - RNA, 18 nt, Pseudomonas putida KT2440
cuccgaacgccuuggccu

SEQ ID NO: 3574783 - RNA, 24 nt, Pseudomonas putida KT2440
cuccgacaaaugcaccacgcgcaa

SEQ ID NO: 3574784 - RNA, 13 nt, Pseudomonas putida KT2440
cuccgacagcgca

SEQ ID NO: 3574785 - RNA, 14 nt, Pseudomonas putida KT2440
cuccgacagcgcag

SEQ ID NO: 3574786 - RNA, 20 nt, Pseudomonas putida KT2440
cuccgacagcgcagucacca

SEQ ID NO: 3574787 - RNA, 18 nt, Pseudomonas putida KT2440
cuccgauuguggccggcg

SEQ ID NO: 3574788 - RNA, 21 nt, Pseudomonas putida KT2440
cuccgcacaggcuggccacca

SEQ ID NO: 3574789 - RNA, 19 nt, Pseudomonas putida KT2440
cuccgccaaaccccagcaa

SEQ ID NO: 3574790 - RNA, 17 nt, Pseudomonas putida KT2440
cuccgccccaaaccagg

SEQ ID NO: 3574791 - RNA, 22 nt, Pseudomonas putida KT2440
cuccgcccgcucacgcagcccu

SEQ ID NO: 3574792 - RNA, 14 nt, Pseudomonas putida KT2440
cuccgcccugcccu

SEQ ID NO: 3574793 - RNA, 15 nt, Pseudomonas putida KT2440
cuccgcgagcauuca

SEQ ID NO: 3574794 - RNA, 15 nt, Pseudomonas putida KT2440
cuccgcgcaagcggu

SEQ ID NO: 3574795 - RNA, 13 nt, Pseudomonas putida KT2440
cuccgcuucauca

SEQ ID NO: 3574796 - RNA, 15 nt, Pseudomonas putida KT2440
cuccgcuuucagccg

SEQ ID NO: 3574797 - RNA, 21 nt, Pseudomonas putida KT2440
cuccggcaaggcauccagaaa

SEQ ID NO: 3574798 - RNA, 18 nt, Pseudomonas putida KT2440
cuccggcaucauccugcu

SEQ ID NO: 3574799 - RNA, 20 nt, Pseudomonas putida KT2440
cuccggcaucauccugcugg

SEQ ID NO: 3574800 - RNA, 19 nt, Pseudomonas putida KT2440
cuccggcccaucccgcuuc

SEQ ID NO: 3574801 - RNA, 14 nt, Pseudomonas putida KT2440
cuccggcgacagcu

SEQ ID NO: 3574802 - RNA, 17 nt, Pseudomonas putida KT2440
cuccggcgacagcucaa

SEQ ID NO: 3574803 - RNA, 19 nt, Pseudomonas putida KT2440
cuccgggaagguuuccagc

SEQ ID NO: 3574804 - RNA, 13 nt, Pseudomonas putida KT2440
cuccgggugcggc

SEQ ID NO: 3574805 - RNA, 14 nt, Pseudomonas putida KT2440
cuccgggugcuccu

SEQ ID NO: 3574806 - RNA, 17 nt, Pseudomonas putida KT2440
cuccgggugcuccuuau

SEQ ID NO: 3574807 - RNA, 22 nt, Pseudomonas putida KT2440
cuccgguaacgguaauggccgg

SEQ ID NO: 3574808 - RNA, 23 nt, Pseudomonas putida KT2440
cuccgguaacgguaauggccggc

SEQ ID NO: 3574809 - RNA, 21 nt, Pseudomonas putida KT2440
cuccuacaaagcggcgcggcc

SEQ ID NO: 3574810 - RNA, 15 nt, Pseudomonas putida KT2440
cuccuacaggccgcc

SEQ ID NO: 3574811 - RNA, 16 nt, Pseudomonas putida KT2440
cuccuacaggcgaccg

SEQ ID NO: 3574812 - RNA, 18 nt, Pseudomonas putida KT2440
cuccuacgaaagccgcgu

SEQ ID NO: 3574813 - RNA, 20 nt, Pseudomonas putida KT2440
cuccuacgacgggcugagcc

SEQ ID NO: 3574814 - RNA, 19 nt, Pseudomonas putida KT2440
cuccuacggaaucugcacc

SEQ ID NO: 3574815 - RNA, 18 nt, Pseudomonas putida KT2440
cuccuacgggggggcgca

SEQ ID NO: 3574816 - RNA, 20 nt, Pseudomonas putida KT2440
cuccuacggggguucacagc

SEQ ID NO: 3574817 - RNA, 21 nt, Pseudomonas putida KT2440
cuccuacggggguucacagcc

SEQ ID NO: 3574818 - RNA, 17 nt, Pseudomonas putida KT2440
cuccucaccgcaggcau

SEQ ID NO: 3574819 - RNA, 20 nt, Pseudomonas putida KT2440
cuccuccagcucgcgcgggu

SEQ ID NO: 3574820 - RNA, 20 nt, Pseudomonas putida KT2440
cuccucgaucaccugcggcc

SEQ ID NO: 3574821 - RNA, 21 nt, Pseudomonas putida KT2440
cuccucgaucaccugcggccu

SEQ ID NO: 3574822 - RNA, 14 nt, Pseudomonas putida KT2440
cuccucgcgggcaa

SEQ ID NO: 3574823 - RNA, 13 nt, Pseudomonas putida KT2440
cuccucggccagc

SEQ ID NO: 3574824 - RNA, 14 nt, Pseudomonas putida KT2440
cuccucggccagcg

SEQ ID NO: 3574825 - RNA, 22 nt, Pseudomonas putida KT2440
cuccucggccguaaaguccgug

SEQ ID NO: 3574826 - RNA, 23 nt, Pseudomonas putida KT2440
cuccugaacggugaagucaacca

SEQ ID NO: 3574827 - RNA, 15 nt, Pseudomonas putida KT2440
cuccugauccaccuc

SEQ ID NO: 3574828 - RNA, 20 nt, Pseudomonas putida KT2440
cuccugcaacccgucagugc

SEQ ID NO: 3574829 - RNA, 16 nt, Pseudomonas putida KT2440
cuccugcagcaggccg

SEQ ID NO: 3574830 - RNA, 13 nt, Pseudomonas putida KT2440
cuccugcagggaa

SEQ ID NO: 3574831 - RNA, 22 nt, Pseudomonas putida KT2440
cuccugcagguaucacgcgagc

SEQ ID NO: 3574832 - RNA, 15 nt, Pseudomonas putida KT2440
cuccugccgggguaa

SEQ ID NO: 3574833 - RNA, 13 nt, Pseudomonas putida KT2440
cuccugcgccacc

SEQ ID NO: 3574834 - RNA, 20 nt, Pseudomonas putida KT2440
cuccugcggaaaagcgaggu

SEQ ID NO: 3574835 - RNA, 22 nt, Pseudomonas putida KT2440
cuccugcggcagauccugcagc

SEQ ID NO: 3574836 - RNA, 14 nt, Pseudomonas putida KT2440
cuccugcugcagcu

SEQ ID NO: 3574837 - RNA, 17 nt, Pseudomonas putida KT2440
cuccugcugcagcuccg

SEQ ID NO: 3574838 - RNA, 17 nt, Pseudomonas putida KT2440
cuccugcugcugcauac

SEQ ID NO: 3574839 - RNA, 13 nt, Pseudomonas putida KT2440
cuccuggcucagu

SEQ ID NO: 3574840 - RNA, 21 nt, Pseudomonas putida KT2440
cuccuggucaucgaagccaag

SEQ ID NO: 3574841 - RNA, 18 nt, Pseudomonas putida KT2440
cuccugugggagcgggcg

SEQ ID NO: 3574842 - RNA, 17 nt, Pseudomonas putida KT2440
cuccuucagguaaucca

SEQ ID NO: 3574843 - RNA, 20 nt, Pseudomonas putida KT2440
cuccuucagguaauccacca

SEQ ID NO: 3574844 - RNA, 11 nt, Pseudomonas putida KT2440
cuccuugagau

SEQ ID NO: 3574845 - RNA, 23 nt, Pseudomonas putida KT2440
cuccuugauguacuccugcacca

SEQ ID NO: 3574846 - RNA, 21 nt, Pseudomonas putida KT2440
cuccuugcgcaucaagcggcu

SEQ ID NO: 3574847 - RNA, 23 nt, Pseudomonas putida KT2440
cuccuugcuguagcccaccaggu

SEQ ID NO: 3574848 - RNA, 16 nt, Pseudomonas putida KT2440
cuccuuggacagcaau

SEQ ID NO: 3574849 - RNA, 18 nt, Pseudomonas putida KT2440
cuccuuggacagcaauuc

SEQ ID NO: 3574850 - RNA, 21 nt, Pseudomonas putida KT2440
cuccuuguagauauugaccag

SEQ ID NO: 3574851 - RNA, 23 nt, Pseudomonas putida KT2440
cuccuuguagauauugaccagcg

SEQ ID NO: 3574852 - RNA, 17 nt, Pseudomonas putida KT2440
cuccuugucgcaaugga

SEQ ID NO: 3574853 - RNA, 22 nt, Pseudomonas putida KT2440
cucgaaaaucucguucaugccc

SEQ ID NO: 3574854 - RNA, 16 nt, Pseudomonas putida KT2440
cucgaaaccaucaauc

SEQ ID NO: 3574855 - RNA, 16 nt, Pseudomonas putida KT2440
cucgaacaagcgcgac

SEQ ID NO: 3574856 - RNA, 20 nt, Pseudomonas putida KT2440
cucgaacacuucacgcacau

SEQ ID NO: 3574857 - RNA, 16 nt, Pseudomonas putida KT2440
cucgaacagcaguucg

SEQ ID NO: 3574858 - RNA, 14 nt, Pseudomonas putida KT2440
cucgaacagcgccg

SEQ ID NO: 3574859 - RNA, 17 nt, Pseudomonas putida KT2440
cucgaacagcgccggca

SEQ ID NO: 3574860 - RNA, 18 nt, Pseudomonas putida KT2440
cucgaacgacagcugcaa

SEQ ID NO: 3574861 - RNA, 17 nt, Pseudomonas putida KT2440
cucgaacggcgccagca

SEQ ID NO: 3574862 - RNA, 16 nt, Pseudomonas putida KT2440
cucgaacucaugcucc

SEQ ID NO: 3574863 - RNA, 17 nt, Pseudomonas putida KT2440
cucgaacucaugcuccu

SEQ ID NO: 3574864 - RNA, 19 nt, Pseudomonas putida KT2440
cucgaacugaugaccggcc

SEQ ID NO: 3574865 - RNA, 21 nt, Pseudomonas putida KT2440
cucgaagauauccgccugaau

SEQ ID NO: 3574866 - RNA, 22 nt, Pseudomonas putida KT2440
cucgaagauauccgccugaauc

SEQ ID NO: 3574867 - RNA, 19 nt, Pseudomonas putida KT2440
cucgaaguagcgcucuuug

SEQ ID NO: 3574868 - RNA, 21 nt, Pseudomonas putida KT2440
cucgaauacacgggacaggcu

SEQ ID NO: 3574869 - RNA, 14 nt, Pseudomonas putida KT2440
cucgacaacccgcg

SEQ ID NO: 3574870 - RNA, 21 nt, Pseudomonas putida KT2440
cucgacaacccgcgcugccuc

SEQ ID NO: 3574871 - RNA, 18 nt, Pseudomonas putida KT2440
cucgacaagccgcugggc

SEQ ID NO: 3574872 - RNA, 13 nt, Pseudomonas putida KT2440
cucgacagcaacu

SEQ ID NO: 3574873 - RNA, 11 nt, Pseudomonas putida KT2440
cucgacagcca

SEQ ID NO: 3574874 - RNA, 14 nt, Pseudomonas putida KT2440
cucgacauccagcg

SEQ ID NO: 3574875 - RNA, 14 nt, Pseudomonas putida KT2440
cucgaccaagccug

SEQ ID NO: 3574876 - RNA, 14 nt, Pseudomonas putida KT2440
cucgaccaccaucg

SEQ ID NO: 3574877 - RNA, 12 nt, Pseudomonas putida KT2440
cucgaccacugu

SEQ ID NO: 3574878 - RNA, 16 nt, Pseudomonas putida KT2440
cucgaccacuucccac

SEQ ID NO: 3574879 - RNA, 20 nt, Pseudomonas putida KT2440
cucggacagcuucugguugu

SEQ ID NO: 3574880 - RNA, 14 nt, Pseudomonas putida KT2440
cucggacuucagcu

SEQ ID NO: 3574881 - RNA, 22 nt, Pseudomonas putida KT2440
cucggacuucagcuucauggcg

SEQ ID NO: 3574882 - RNA, 18 nt, Pseudomonas putida KT2440
cucggagaacgggcuguc

SEQ ID NO: 3574883 - RNA, 15 nt, Pseudomonas putida KT2440
cucggaugccacgcu

SEQ ID NO: 3574884 - RNA, 17 nt, Pseudomonas putida KT2440
cucggcaaucagcauca

SEQ ID NO: 3574885 - RNA, 22 nt, Pseudomonas putida KT2440
cucggcaaucagcaucagugca

SEQ ID NO: 3574886 - RNA, 18 nt, Pseudomonas putida KT2440
cucggcaaucugcagcag

SEQ ID NO: 3574887 - RNA, 20 nt, Pseudomonas putida KT2440
cucggcaaucugcagcagca

SEQ ID NO: 3574888 - RNA, 14 nt, Pseudomonas putida KT2440
cucggcaccaccga

SEQ ID NO: 3574889 - RNA, 13 nt, Pseudomonas putida KT2440
cucggcacugcac

SEQ ID NO: 3574890 - RNA, 19 nt, Pseudomonas putida KT2440
cucggcaggaaacaccagg

SEQ ID NO: 3574891 - RNA, 18 nt, Pseudomonas putida KT2440
cucggcauguucaucacc

SEQ ID NO: 3574892 - RNA, 20 nt, Pseudomonas putida KT2440
cucggccacaucggcaaguu

SEQ ID NO: 3574893 - RNA, 23 nt, Pseudomonas putida KT2440
cucggccaccacuucuggcuggg

SEQ ID NO: 3574894 - RNA, 13 nt, Pseudomonas putida KT2440
cucggccacccgc

SEQ ID NO: 3574895 - RNA, 16 nt, Pseudomonas putida KT2440
cucggccaccuggccu

SEQ ID NO: 3574896 - RNA, 15 nt, Pseudomonas putida KT2440
cucggccagguacuc

SEQ ID NO: 3574897 - RNA, 20 nt, Pseudomonas putida KT2440
cucggccagguacucgcgcu

SEQ ID NO: 3574898 - RNA, 13 nt, Pseudomonas putida KT2440
cucggccaggucg

SEQ ID NO: 3574899 - RNA, 14 nt, Pseudomonas putida KT2440
cucggccaggucga

SEQ ID NO: 3574900 - RNA, 17 nt, Pseudomonas putida KT2440
cucggccagugcgugca

SEQ ID NO: 3574901 - RNA, 23 nt, Pseudomonas putida KT2440
cucggcccauuccgggucgccag

SEQ ID NO: 3574902 - RNA, 16 nt, Pseudomonas putida KT2440
cucggccgaugccagg

SEQ ID NO: 3574903 - RNA, 21 nt, Pseudomonas putida KT2440
cucggccgcauccugcgugcu

SEQ ID NO: 3574904 - RNA, 19 nt, Pseudomonas putida KT2440
cucggccggggcaaccugg

SEQ ID NO: 3574905 - RNA, 17 nt, Pseudomonas putida KT2440
cucggccggggccaggc

SEQ ID NO: 3574906 - RNA, 22 nt, Pseudomonas putida KT2440
cucggccguaaaguccgugccc

SEQ ID NO: 3574907 - RNA, 12 nt, Pseudomonas putida KT2440
cucggccucagc

SEQ ID NO: 3574908 - RNA, 14 nt, Pseudomonas putida KT2440
cucggccucagccg

SEQ ID NO: 3574909 - RNA, 18 nt, Pseudomonas putida KT2440
cucggccucagccggcuu

SEQ ID NO: 3574910 - RNA, 20 nt, Pseudomonas putida KT2440
cucggccucgguacccgcca

SEQ ID NO: 3574911 - RNA, 23 nt, Pseudomonas putida KT2440
cucggccucgguacccgccagca

SEQ ID NO: 3574912 - RNA, 20 nt, Pseudomonas putida KT2440
cucggccuugucuggcacca

SEQ ID NO: 3574913 - RNA, 16 nt, Pseudomonas putida KT2440
cucggcgagccgccag

SEQ ID NO: 3574914 - RNA, 14 nt, Pseudomonas putida KT2440
cucggcgaucgcca

SEQ ID NO: 3574915 - RNA, 15 nt, Pseudomonas putida KT2440
cucggcgaucgccag

SEQ ID NO: 3574916 - RNA, 18 nt, Pseudomonas putida KT2440
cucggcgaucgccaggug

SEQ ID NO: 3574917 - RNA, 20 nt, Pseudomonas putida KT2440
cucggcgaucgccaggugga

SEQ ID NO: 3574918 - RNA, 24 nt, Pseudomonas putida KT2440
cucggcgccauaggcuugcgcuga

SEQ ID NO: 3574919 - RNA, 15 nt, Pseudomonas putida KT2440
cucggcgcgugccgc

SEQ ID NO: 3574920 - RNA, 16 nt, Pseudomonas putida KT2440
cucggcgcucaagcgu

SEQ ID NO: 3574921 - RNA, 16 nt, Pseudomonas putida KT2440
cucggcguacuccaga

SEQ ID NO: 3574922 - RNA, 14 nt, Pseudomonas putida KT2440
cucggcguagcagg

SEQ ID NO: 3574923 - RNA, 15 nt, Pseudomonas putida KT2440
cucggcguagcaggu

SEQ ID NO: 3574924 - RNA, 16 nt, Pseudomonas putida KT2440
cucggcguagcaggua

SEQ ID NO: 3574925 - RNA, 18 nt, Pseudomonas putida KT2440
cucggcguagcagguacg

SEQ ID NO: 3574926 - RNA, 16 nt, Pseudomonas putida KT2440
cucggcguucagcucg

SEQ ID NO: 3574927 - RNA, 20 nt, Pseudomonas putida KT2440
cucggcguucagcucguaca

SEQ ID NO: 3574928 - RNA, 12 nt, Pseudomonas putida KT2440
cucggcucuccu

SEQ ID NO: 3574929 - RNA, 15 nt, Pseudomonas putida KT2440
cucggcucuccuuuu

SEQ ID NO: 3574930 - RNA, 19 nt, Pseudomonas putida KT2440
cucgggaugaacuucuucg

SEQ ID NO: 3574931 - RNA, 21 nt, Pseudomonas putida KT2440
cucgggggugcacagcgucca

SEQ ID NO: 3574932 - RNA, 23 nt, Pseudomonas putida KT2440
cucgggguagaacaagucgcgca

SEQ ID NO: 3574933 - RNA, 12 nt, Pseudomonas putida KT2440
cucgguaccacg

SEQ ID NO: 3574934 - RNA, 17 nt, Pseudomonas putida KT2440
cucgguacccgccagca

SEQ ID NO: 3574935 - RNA, 18 nt, Pseudomonas putida KT2440
cucgguacccgccagcaa

SEQ ID NO: 3574936 - RNA, 22 nt, Pseudomonas putida KT2440
cucgguaccguucgccagcuug

SEQ ID NO: 3574937 - RNA, 13 nt, Pseudomonas putida KT2440
cucgguacgcacu

SEQ ID NO: 3574938 - RNA, 18 nt, Pseudomonas putida KT2440
cucgguaucggccagccg

SEQ ID NO: 3574939 - RNA, 19 nt, Pseudomonas putida KT2440
cucgguaucggccagccgu

SEQ ID NO: 3574940 - RNA, 15 nt, Pseudomonas putida KT2440
cucggucagguacuc

SEQ ID NO: 3574941 - RNA, 14 nt, Pseudomonas putida KT2440
cucggucgccgagc

SEQ ID NO: 3574942 - RNA, 19 nt, Pseudomonas putida KT2440
cucggucggcuggcacucc

SEQ ID NO: 3574943 - RNA, 16 nt, Pseudomonas putida KT2440
cucggucugguaaccc

SEQ ID NO: 3574944 - RNA, 17 nt, Pseudomonas putida KT2440
cucggugcacgggccga

SEQ ID NO: 3574945 - RNA, 15 nt, Pseudomonas putida KT2440
cucgguggcucuccu

SEQ ID NO: 3574946 - RNA, 20 nt, Pseudomonas putida KT2440
cucgguugaugcagcgcccg

SEQ ID NO: 3574947 - RNA, 20 nt, Pseudomonas putida KT2440
cucgguuucucaccccgugu

SEQ ID NO: 3574948 - RNA, 23 nt, Pseudomonas putida KT2440
cucguaacgagccuuggccagcg

SEQ ID NO: 3574949 - RNA, 14 nt, Pseudomonas putida KT2440
cucguacgucgccu

SEQ ID NO: 3574950 - RNA, 14 nt, Pseudomonas putida KT2440
cucguagagcuugg

SEQ ID NO: 3574951 - RNA, 19 nt, Pseudomonas putida KT2440
cucgucaauaccggugccc

SEQ ID NO: 3574952 - RNA, 22 nt, Pseudomonas putida KT2440
cucgucaauaccggugccccgg

SEQ ID NO: 3574953 - RNA, 13 nt, Pseudomonas putida KT2440
cucgucacugccg

SEQ ID NO: 3574954 - RNA, 16 nt, Pseudomonas putida KT2440
cucgucacuggcugcu

SEQ ID NO: 3574955 - RNA, 20 nt, Pseudomonas putida KT2440
cucgucacuggcugcugcgg

SEQ ID NO: 3574956 - RNA, 19 nt, Pseudomonas putida KT2440
cucgucagccaccaccagc

SEQ ID NO: 3574957 - RNA, 14 nt, Pseudomonas putida KT2440
cucgucagccccua

SEQ ID NO: 3574958 - RNA, 15 nt, Pseudomonas putida KT2440
cucgucagccccuag

SEQ ID NO: 3574959 - RNA, 16 nt, Pseudomonas putida KT2440
cucgucagccccuagc

SEQ ID NO: 3574960 - RNA, 17 nt, Pseudomonas putida KT2440
cucgucaugcagcgcca

SEQ ID NO: 3574961 - RNA, 14 nt, Pseudomonas putida KT2440
cucguccagcucgu

SEQ ID NO: 3574962 - RNA, 12 nt, Pseudomonas putida KT2440
cucguccaggcc

SEQ ID NO: 3574963 - RNA, 13 nt, Pseudomonas putida KT2440
cucguccaggccc

SEQ ID NO: 3574964 - RNA, 17 nt, Pseudomonas putida KT2440
cucguccccgcgcuuug

SEQ ID NO: 3574965 - RNA, 16 nt, Pseudomonas putida KT2440
cucguccgacaaugcc

SEQ ID NO: 3574966 - RNA, 16 nt, Pseudomonas putida KT2440
cucguccgggcgccag

SEQ ID NO: 3574967 - RNA, 16 nt, Pseudomonas putida KT2440
cucgucgaacagcaug

SEQ ID NO: 3574968 - RNA, 20 nt, Pseudomonas putida KT2440
cucgucgagcaacuugcgca

SEQ ID NO: 3574969 - RNA, 19 nt, Pseudomonas putida KT2440
cucgucgcacucugggcuu

SEQ ID NO: 3574970 - RNA, 22 nt, Pseudomonas putida KT2440
cucgugacagguaggcgccacg

SEQ ID NO: 3574971 - RNA, 18 nt, Pseudomonas putida KT2440
cucgugggucaucuugcc

SEQ ID NO: 3574972 - RNA, 17 nt, Pseudomonas putida KT2440
cucguucaacaccuucu

SEQ ID NO: 3574973 - RNA, 13 nt, Pseudomonas putida KT2440
cucguucaugccc

SEQ ID NO: 3574974 - RNA, 19 nt, Pseudomonas putida KT2440
cucguugaacacauccuca

SEQ ID NO: 3574975 - RNA, 13 nt, Pseudomonas putida KT2440
cucguugaccgac

SEQ ID NO: 3574976 - RNA, 15 nt, Pseudomonas putida KT2440
cucguugaccgucca

SEQ ID NO: 3574977 - RNA, 20 nt, Pseudomonas putida KT2440
cucguuggcgaagucggccu

SEQ ID NO: 3574978 - RNA, 17 nt, Pseudomonas putida KT2440
cucguuguccagcagca

SEQ ID NO: 3574979 - RNA, 20 nt, Pseudomonas putida KT2440
cucguuucacagcacaaggc

SEQ ID NO: 3574980 - RNA, 18 nt, Pseudomonas putida KT2440
cucuaccacgccgcugcc

SEQ ID NO: 3574981 - RNA, 23 nt, Pseudomonas putida KT2440
cucuaccccuucauccgcggcau

SEQ ID NO: 3574982 - RNA, 20 nt, Pseudomonas putida KT2440
cucuaucaccuguuccccca

SEQ ID NO: 3574983 - RNA, 15 nt, Pseudomonas putida KT2440
cucuaucuucaggca

SEQ ID NO: 3574984 - RNA, 23 nt, Pseudomonas putida KT2440
cugaauuggccggcgcugagcga

SEQ ID NO: 3574985 - RNA, 21 nt, Pseudomonas putida KT2440
cugaauugucggggaaaugcc

SEQ ID NO: 3574986 - RNA, 15 nt, Pseudomonas putida KT2440
cugacaaagccugca

SEQ ID NO: 3574987 - RNA, 23 nt, Pseudomonas putida KT2440
cugacaaagccugcacccagcgu

SEQ ID NO: 3574988 - RNA, 15 nt, Pseudomonas putida KT2440
cugacaaugcgacug

SEQ ID NO: 3574989 - RNA, 19 nt, Pseudomonas putida KT2440
cugacacauaggcagccac

SEQ ID NO: 3574990 - RNA, 21 nt, Pseudomonas putida KT2440
cugacacauaggcagccaccu

SEQ ID NO: 3574991 - RNA, 16 nt, Pseudomonas putida KT2440
cugacacaucacgcac

SEQ ID NO: 3574992 - RNA, 19 nt, Pseudomonas putida KT2440
cugacaccgcugccgggca

SEQ ID NO: 3574993 - RNA, 14 nt, Pseudomonas putida KT2440
cugacagcaggaac

SEQ ID NO: 3574994 - RNA, 15 nt, Pseudomonas putida KT2440
cugacagcaggaaca

SEQ ID NO: 3574995 - RNA, 14 nt, Pseudomonas putida KT2440
cugacauaacaaga

SEQ ID NO: 3574996 - RNA, 20 nt, Pseudomonas putida KT2440
cugaccacgccgaagcgcgc

SEQ ID NO: 3574997 - RNA, 23 nt, Pseudomonas putida KT2440
cugaccacgccgaagcgcgccug

SEQ ID NO: 3574998 - RNA, 13 nt, Pseudomonas putida KT2440
cugaccagguaaa

SEQ ID NO: 3574999 - RNA, 21 nt, Pseudomonas putida KT2440
cugaccagugucugcaacugc

SEQ ID NO: 3575000 - RNA, 13 nt, Pseudomonas putida KT2440
cugaccaguugcu

SEQ ID NO: 3575001 - RNA, 23 nt, Pseudomonas putida KT2440
cugaccaguugcucgcagacuuc

SEQ ID NO: 3575002 - RNA, 15 nt, Pseudomonas putida KT2440
cugaccauaccuccc

SEQ ID NO: 3575003 - RNA, 20 nt, Pseudomonas putida KT2440
cugaccccacccuugaagac

SEQ ID NO: 3575004 - RNA, 14 nt, Pseudomonas putida KT2440
cugacccgcgccuc

SEQ ID NO: 3575005 - RNA, 14 nt, Pseudomonas putida KT2440
cugacccgcuucgc

SEQ ID NO: 3575006 - RNA, 22 nt, Pseudomonas putida KT2440
cugacccgcuucgcucagaauc

SEQ ID NO: 3575007 - RNA, 22 nt, Pseudomonas putida KT2440
cugaccgaugaucugccgggcc

SEQ ID NO: 3575008 - RNA, 15 nt, Pseudomonas putida KT2440
cugaccgccugcgca

SEQ ID NO: 3575009 - RNA, 16 nt, Pseudomonas putida KT2440
cugaccgccugcgcac

SEQ ID NO: 3575010 - RNA, 14 nt, Pseudomonas putida KT2440
cugaccgcggugcu

SEQ ID NO: 3575011 - RNA, 21 nt, Pseudomonas putida KT2440
cugaccgggacgcaggcgcaa

SEQ ID NO: 3575012 - RNA, 18 nt, Pseudomonas putida KT2440
cugaccggucagcccggc

SEQ ID NO: 3575013 - RNA, 18 nt, Pseudomonas putida KT2440
cugaccguuucauugccg

SEQ ID NO: 3575014 - RNA, 17 nt, Pseudomonas putida KT2440
cugaccucgacccgccc

SEQ ID NO: 3575015 - RNA, 19 nt, Pseudomonas putida KT2440
cugaccucgacccgcccgc

SEQ ID NO: 3575016 - RNA, 22 nt, Pseudomonas putida KT2440
cugaccugugcugaauuuucuu

SEQ ID NO: 3575017 - RNA, 14 nt, Pseudomonas putida KT2440
cugaccuguucgcg

SEQ ID NO: 3575018 - RNA, 17 nt, Pseudomonas putida KT2440
cugacgaacaacgccac

SEQ ID NO: 3575019 - RNA, 19 nt, Pseudomonas putida KT2440
cugacgaacaacgccaccg

SEQ ID NO: 3575020 - RNA, 20 nt, Pseudomonas putida KT2440
cugacgaagcgccuggagag

SEQ ID NO: 3575021 - RNA, 13 nt, Pseudomonas putida KT2440
cugacgcaagcgc

SEQ ID NO: 3575022 - RNA, 18 nt, Pseudomonas putida KT2440
cugacgcagggccucgau

SEQ ID NO: 3575023 - RNA, 16 nt, Pseudomonas putida KT2440
cugacgcaggguagcc

SEQ ID NO: 3575024 - RNA, 14 nt, Pseudomonas putida KT2440
cugacgcagugcag

SEQ ID NO: 3575025 - RNA, 15 nt, Pseudomonas putida KT2440
cugacgccagcgcug

SEQ ID NO: 3575026 - RNA, 19 nt, Pseudomonas putida KT2440
cugacgccagcgcugggcg

SEQ ID NO: 3575027 - RNA, 15 nt, Pseudomonas putida KT2440
cugacgccgccagcg

SEQ ID NO: 3575028 - RNA, 15 nt, Pseudomonas putida KT2440
cugacgcgccagguc

SEQ ID NO: 3575029 - RNA, 20 nt, Pseudomonas putida KT2440
cugacgcgccaggucuuccu

SEQ ID NO: 3575030 - RNA, 22 nt, Pseudomonas putida KT2440
cugacgcugcacuuccacaccc

SEQ ID NO: 3575031 - RNA, 19 nt, Pseudomonas putida KT2440
cugacggcgcugcuggccu

SEQ ID NO: 3575032 - RNA, 15 nt, Pseudomonas putida KT2440
cugacguaguccuug

SEQ ID NO: 3575033 - RNA, 18 nt, Pseudomonas putida KT2440
cugacgucuggaucugag

SEQ ID NO: 3575034 - RNA, 18 nt, Pseudomonas putida KT2440
cugacguugucauggcua

SEQ ID NO: 3575035 - RNA, 22 nt, Pseudomonas putida KT2440
cugacucagcggccuuucugcu

SEQ ID NO: 3575036 - RNA, 20 nt, Pseudomonas putida KT2440
cugacucgaccgccgcacag

SEQ ID NO: 3575037 - RNA, 14 nt, Pseudomonas putida KT2440
cugacugccaggcc

SEQ ID NO: 3575038 - RNA, 16 nt, Pseudomonas putida KT2440
cugacugcggaucuug

SEQ ID NO: 3575039 - RNA, 15 nt, Pseudomonas putida KT2440
cugacuggcagcaag

SEQ ID NO: 3575040 - RNA, 20 nt, Pseudomonas putida KT2440
cugacuggcagcaaggccau

SEQ ID NO: 3575041 - RNA, 12 nt, Pseudomonas putida KT2440
cugacugucucg

SEQ ID NO: 3575042 - RNA, 16 nt, Pseudomonas putida KT2440
cugacugucucgccca

SEQ ID NO: 3575043 - RNA, 21 nt, Pseudomonas putida KT2440
cugacugugagcucuacaccu

SEQ ID NO: 3575044 - RNA, 16 nt, Pseudomonas putida KT2440
cugagcaagaacgcua

SEQ ID NO: 3575045 - RNA, 21 nt, Pseudomonas putida KT2440
cugagcaagcgcgcgcccacc

SEQ ID NO: 3575046 - RNA, 21 nt, Pseudomonas putida KT2440
cugagcaccacauacggcgca

SEQ ID NO: 3575047 - RNA, 18 nt, Pseudomonas putida KT2440
cugagcagguuguccacc

SEQ ID NO: 3575048 - RNA, 19 nt, Pseudomonas putida KT2440
cugagcagguuguccaccg

SEQ ID NO: 3575049 - RNA, 15 nt, Pseudomonas putida KT2440
cugagccaaggccgc

SEQ ID NO: 3575050 - RNA, 17 nt, Pseudomonas putida KT2440
cugagccaggccgacaa

SEQ ID NO: 3575051 - RNA, 13 nt, Pseudomonas putida KT2440
cugagccaguuca

SEQ ID NO: 3575052 - RNA, 14 nt, Pseudomonas putida KT2440
cugagcccggcacg

SEQ ID NO: 3575053 - RNA, 14 nt, Pseudomonas putida KT2440
cugagccggcuggc

SEQ ID NO: 3575054 - RNA, 17 nt, Pseudomonas putida KT2440
cugagccggucggagag

SEQ ID NO: 3575055 - RNA, 15 nt, Pseudomonas putida KT2440
cugagcgccauccac

SEQ ID NO: 3575056 - RNA, 16 nt, Pseudomonas putida KT2440
cugagcgccauccacc

SEQ ID NO: 3575057 - RNA, 15 nt, Pseudomonas putida KT2440
cugagcuaacgaccc

SEQ ID NO: 3575058 - RNA, 16 nt, Pseudomonas putida KT2440
cugagcuucaacgcga

SEQ ID NO: 3575059 - RNA, 21 nt, Pseudomonas putida KT2440
cugaggcaccgguucgccgcc

SEQ ID NO: 3575060 - RNA, 19 nt, Pseudomonas putida KT2440
gagcggguuuacccgcgaa

SEQ ID NO: 3575061 - RNA, 20 nt, Pseudomonas putida KT2440
gagcggguuuacccgcgaaa

SEQ ID NO: 3575062 - RNA, 20 nt, Pseudomonas putida KT2440
gagcggguuuacccgcgaag

SEQ ID NO: 3575063 - RNA, 20 nt, Pseudomonas putida KT2440
gagcggguuuucucgcgaau

SEQ ID NO: 3575064 - RNA, 23 nt, Pseudomonas putida KT2440
gagcgguugcacggcccccgcgg

SEQ ID NO: 3575065 - RNA, 21 nt, Pseudomonas putida KT2440
gagcgucaaccaggcgcagca

SEQ ID NO: 3575066 - RNA, 12 nt, Pseudomonas putida KT2440
gagcgugaagcg

SEQ ID NO: 3575067 - RNA, 18 nt, Pseudomonas putida KT2440
gagcgugaagcggacagc

SEQ ID NO: 3575068 - RNA, 23 nt, Pseudomonas putida KT2440
gagcguggcaaacccggccagca

SEQ ID NO: 3575069 - RNA, 20 nt, Pseudomonas putida KT2440
gagcuaacgacccaaaaaug

SEQ ID NO: 3575070 - RNA, 21 nt, Pseudomonas putida KT2440
gagcuaacgacccaaaaaugg

SEQ ID NO: 3575071 - RNA, 14 nt, Pseudomonas putida KT2440
gagcuacagccccu

SEQ ID NO: 3575072 - RNA, 16 nt, Pseudomonas putida KT2440
gagcuauuuggcucca

SEQ ID NO: 3575073 - RNA, 15 nt, Pseudomonas putida KT2440
gagcucaaccagcug

SEQ ID NO: 3575074 - RNA, 22 nt, Pseudomonas putida KT2440
gagcugaaacugaucagcuucg

SEQ ID NO: 3575075 - RNA, 20 nt, Pseudomonas putida KT2440
gagcugaugcucaagcgcca

SEQ ID NO: 3575076 - RNA, 14 nt, Pseudomonas putida KT2440
gagcugggcacggc

SEQ ID NO: 3575077 - RNA, 17 nt, Pseudomonas putida KT2440
gagcugggcacggcgcu

SEQ ID NO: 3575078 - RNA, 15 nt, Pseudomonas putida KT2440
gagcuggucaucguc

SEQ ID NO: 3575079 - RNA, 19 nt, Pseudomonas putida KT2440
gagcuguuucaugcugcga

SEQ ID NO: 3575080 - RNA, 15 nt, Pseudomonas putida KT2440
gagcuugacuuccag

SEQ ID NO: 3575081 - RNA, 17 nt, Pseudomonas putida KT2440
gagcuuggacaggcccc

SEQ ID NO: 3575082 - RNA, 18 nt, Pseudomonas putida KT2440
gagcuuggacaggcccca

SEQ ID NO: 3575083 - RNA, 17 nt, Pseudomonas putida KT2440
gagcuuggcguccacag

SEQ ID NO: 3575084 - RNA, 17 nt, Pseudomonas putida KT2440
gaggaaggcgacuuucg

SEQ ID NO: 3575085 - RNA, 16 nt, Pseudomonas putida KT2440
gaggacacaucgauca

SEQ ID NO: 3575086 - RNA, 14 nt, Pseudomonas putida KT2440
gaggaggccgggga

SEQ ID NO: 3575087 - RNA, 18 nt, Pseudomonas putida KT2440
gaggaggccggggaugcg

SEQ ID NO: 3575088 - RNA, 15 nt, Pseudomonas putida KT2440
gaggaggcuggggau

SEQ ID NO: 3575089 - RNA, 13 nt, Pseudomonas putida KT2440
gaggaguccagcu

SEQ ID NO: 3575090 - RNA, 21 nt, Pseudomonas putida KT2440
gaggaguccagcugcaucagg

SEQ ID NO: 3575091 - RNA, 20 nt, Pseudomonas putida KT2440
gaggaucagcgcagacuggg

SEQ ID NO: 3575092 - RNA, 22 nt, Pseudomonas putida KT2440
gaggaugcguucguugcguugc

SEQ ID NO: 3575093 - RNA, 15 nt, Pseudomonas putida KT2440
gaggaugcugaagcu

SEQ ID NO: 3575094 - RNA, 23 nt, Pseudomonas putida KT2440
gaggaugcugaagcucuccagca

SEQ ID NO: 3575095 - RNA, 17 nt, Pseudomonas putida KT2440
gaggcaaaagaaaaagg

SEQ ID NO: 3575096 - RNA, 18 nt, Pseudomonas putida KT2440
gaggcaaaagaaaaaggg

SEQ ID NO: 3575097 - RNA, 17 nt, Pseudomonas putida KT2440
gaggcauccacacccug

SEQ ID NO: 3575098 - RNA, 19 nt, Pseudomonas putida KT2440
gaggcauggaagggcgggu

SEQ ID NO: 3575099 - RNA, 22 nt, Pseudomonas putida KT2440
gaggcauuuucgaucaucgcca

SEQ ID NO: 3575100 - RNA, 16 nt, Pseudomonas putida KT2440
gaggccaguaccagca

SEQ ID NO: 3575101 - RNA, 17 nt, Pseudomonas putida KT2440
gaggccaguaccagcag

SEQ ID NO: 3575102 - RNA, 13 nt, Pseudomonas putida KT2440
gaggccaugugcu

SEQ ID NO: 3575103 - RNA, 19 nt, Pseudomonas putida KT2440
gaggcccucaagggcgcug

SEQ ID NO: 3575104 - RNA, 17 nt, Pseudomonas putida KT2440
gaggccgaacaccgcca

SEQ ID NO: 3575105 - RNA, 20 nt, Pseudomonas putida KT2440
gaggccgaacaccgccagcc

SEQ ID NO: 3575106 - RNA, 17 nt, Pseudomonas putida KT2440
gaggccgccauugaugc

SEQ ID NO: 3575107 - RNA, 21 nt, Pseudomonas putida KT2440
gaggccggcacagacaccgca

SEQ ID NO: 3575108 - RNA, 20 nt, Pseudomonas putida KT2440
gaggccggcacagaccgcaa

SEQ ID NO: 3575109 - RNA, 14 nt, Pseudomonas putida KT2440
gaggccggcacagg

SEQ ID NO: 3575110 - RNA, 19 nt, Pseudomonas putida KT2440
gaggccggcacaggaaggc

SEQ ID NO: 3575111 - RNA, 22 nt, Pseudomonas putida KT2440
gaggccggcacaggaaggcaua

SEQ ID NO: 3575112 - RNA, 14 nt, Pseudomonas putida KT2440
gaggccggcacugg

SEQ ID NO: 3575113 - RNA, 23 nt, Pseudomonas putida KT2440
gaggccgguaggccuccccgcuu

SEQ ID NO: 3575114 - RNA, 21 nt, Pseudomonas putida KT2440
gaggccgguaggucuaaccgc

SEQ ID NO: 3575115 - RNA, 21 nt, Pseudomonas putida KT2440
gaggccgucaggccuccccgc

SEQ ID NO: 3575116 - RNA, 11 nt, Pseudomonas putida KT2440
gaggccgucgu

SEQ ID NO: 3575117 - RNA, 14 nt, Pseudomonas putida KT2440
gaggccgucguagg

SEQ ID NO: 3575118 - RNA, 16 nt, Pseudomonas putida KT2440
gaggcgaauggcaggu

SEQ ID NO: 3575119 - RNA, 23 nt, Pseudomonas putida KT2440
gaggcgaauggcaggugaucguu

SEQ ID NO: 3575120 - RNA, 16 nt, Pseudomonas putida KT2440
gaggcgcgcgccuggg

SEQ ID NO: 3575121 - RNA, 23 nt, Pseudomonas putida KT2440
gaggcguagcacaagggccaggu

SEQ ID NO: 3575122 - RNA, 14 nt, Pseudomonas putida KT2440
gaggcguuggccga

SEQ ID NO: 3575123 - RNA, 19 nt, Pseudomonas putida KT2440
gaggcucuugaggucggcg

SEQ ID NO: 3575124 - RNA, 20 nt, Pseudomonas putida KT2440
gaggcucuugaggucggcgc

SEQ ID NO: 3575125 - RNA, 16 nt, Pseudomonas putida KT2440
gaggcuugaaucccug

SEQ ID NO: 3575126 - RNA, 20 nt, Pseudomonas putida KT2440
gagggaugagaaagcccgca

SEQ ID NO: 3575127 - RNA, 17 nt, Pseudomonas putida KT2440
gagggcaggaugacuuu

SEQ ID NO: 3575128 - RNA, 18 nt, Pseudomonas putida KT2440
gagggccgcgcaggcggc

SEQ ID NO: 3575129 - RNA, 17 nt, Pseudomonas putida KT2440
gagggcgacaccggucu

SEQ ID NO: 3575130 - RNA, 20 nt, Pseudomonas putida KT2440
gagggcuucuucuucaagca

SEQ ID NO: 3575131 - RNA, 12 nt, Pseudomonas putida KT2440
gaggggcggcgu

SEQ ID NO: 3575132 - RNA, 18 nt, Pseudomonas putida KT2440
gagggucgugagccugca

SEQ ID NO: 3575133 - RNA, 14 nt, Pseudomonas putida KT2440
gaggguggcaaugc

SEQ ID NO: 3575134 - RNA, 15 nt, Pseudomonas putida KT2440
gaggguggcaaugcu

SEQ ID NO: 3575135 - RNA, 17 nt, Pseudomonas putida KT2440
gaggguggcgaucacgu

SEQ ID NO: 3575136 - RNA, 22 nt, Pseudomonas putida KT2440
gagguacgagucagcgugccag

SEQ ID NO: 3575137 - RNA, 16 nt, Pseudomonas putida KT2440
gagguauacacuggcu

SEQ ID NO: 3575138 - RNA, 18 nt, Pseudomonas putida KT2440
gaggucggcgcguggggu

SEQ ID NO: 3575139 - RNA, 23 nt, Pseudomonas putida KT2440
gaggucggcucgucgaacagcau

SEQ ID NO: 3575140 - RNA, 23 nt, Pseudomonas putida KT2440
gaggucgggaauugcagcccgca

SEQ ID NO: 3575141 - RNA, 21 nt, Pseudomonas putida KT2440
gaggugcaggguaggggugga

SEQ ID NO: 3575142 - RNA, 19 nt, Pseudomonas putida KT2440
gaggugcgcggcaggucga

SEQ ID NO: 3575143 - RNA, 23 nt, Pseudomonas putida KT2440
gagguguacgcgaaggcggucgc

SEQ ID NO: 3575144 - RNA, 19 nt, Pseudomonas putida KT2440
gagguugccauugaggcug

SEQ ID NO: 3575145 - RNA, 15 nt, Pseudomonas putida KT2440
gagguuugccaaggc

SEQ ID NO: 3575146 - RNA, 16 nt, Pseudomonas putida KT2440
gaguaaccggcggcga

SEQ ID NO: 3575147 - RNA, 20 nt, Pseudomonas putida KT2440
gaguaaucgaugaaauucac

SEQ ID NO: 3575148 - RNA, 16 nt, Pseudomonas putida KT2440
gaguacgggcacaccu

SEQ ID NO: 3575149 - RNA, 20 nt, Pseudomonas putida KT2440
gagucaacaauuuucgacca

SEQ ID NO: 3575150 - RNA, 18 nt, Pseudomonas putida KT2440
gagucagcgugccagaga

SEQ ID NO: 3575151 - RNA, 17 nt, Pseudomonas putida KT2440
gagucaggcgcccugcc

SEQ ID NO: 3575152 - RNA, 22 nt, Pseudomonas putida KT2440
gagucagggcuuuuuccagcgc

SEQ ID NO: 3575153 - RNA, 19 nt, Pseudomonas putida KT2440
gagucagugugaccuucaa

SEQ ID NO: 3575154 - RNA, 11 nt, Pseudomonas putida KT2440
gagucaugaag

SEQ ID NO: 3575155 - RNA, 18 nt, Pseudomonas putida KT2440
gaguccaggucgcggagc

SEQ ID NO: 3575156 - RNA, 21 nt, Pseudomonas putida KT2440
gaguccuccaacucgcgcauc

SEQ ID NO: 3575157 - RNA, 17 nt, Pseudomonas putida KT2440
gaguccugcgcgcuuga

SEQ ID NO: 3575158 - RNA, 17 nt, Pseudomonas putida KT2440
gaguccuugcgugccuc

SEQ ID NO: 3575159 - RNA, 15 nt, Pseudomonas putida KT2440
gagucgacagugacc

SEQ ID NO: 3575160 - RNA, 18 nt, Pseudomonas putida KT2440
gagucuauggaugccagc

SEQ ID NO: 3575161 - RNA, 19 nt, Pseudomonas putida KT2440
gagucucggcuagcgccug

SEQ ID NO: 3575162 - RNA, 14 nt, Pseudomonas putida KT2440
gagugcaugcuguu

SEQ ID NO: 3575163 - RNA, 21 nt, Pseudomonas putida KT2440
gagugccccaaacggaccgca

SEQ ID NO: 3575164 - RNA, 20 nt, Pseudomonas putida KT2440
gagugcgcugaucgaaagcu

SEQ ID NO: 3575165 - RNA, 22 nt, Pseudomonas putida KT2440
gagugcucgccucacagcgccg

SEQ ID NO: 3575166 - RNA, 14 nt, Pseudomonas putida KT2440
gagugcuucgccca

SEQ ID NO: 3575167 - RNA, 20 nt, Pseudomonas putida KT2440
gagugcuucgcccagugccu

SEQ ID NO: 3575168 - RNA, 23 nt, Pseudomonas putida KT2440
gaguggaucaaccgaccagcgga

SEQ ID NO: 3575169 - RNA, 21 nt, Pseudomonas putida KT2440
gaguuacagguuguaaacaaa

SEQ ID NO: 3575170 - RNA, 19 nt, Pseudomonas putida KT2440
gaguuagacauuagaaaau

SEQ ID NO: 3575171 - RNA, 20 nt, Pseudomonas putida KT2440
gaguuagacauuagaaaaug

SEQ ID NO: 3575172 - RNA, 23 nt, Pseudomonas putida KT2440
gaguuagacauuagaaaauggcu

SEQ ID NO: 3575173 - RNA, 21 nt, Pseudomonas putida KT2440
gaguucagggccuugcucgug

SEQ ID NO: 3575174 - RNA, 15 nt, Pseudomonas putida KT2440
gaguucauggucacc

SEQ ID NO: 3575175 - RNA, 14 nt, Pseudomonas putida KT2440
gaguuccguugcua

SEQ ID NO: 3575176 - RNA, 14 nt, Pseudomonas putida KT2440
gaguugaguggggu

SEQ ID NO: 3575177 - RNA, 20 nt, Pseudomonas putida KT2440
gaguugcguggggccugccg

SEQ ID NO: 3575178 - RNA, 17 nt, Pseudomonas putida KT2440
gauaaacacgaacauca

SEQ ID NO: 3575179 - RNA, 18 nt, Pseudomonas putida KT2440
gauaaacacgaacaucag

SEQ ID NO: 3575180 - RNA, 18 nt, Pseudomonas putida KT2440
gauaaaccagcagcgccu

SEQ ID NO: 3575181 - RNA, 14 nt, Pseudomonas putida KT2440
gauaaaccugccac

SEQ ID NO: 3575182 - RNA, 22 nt, Pseudomonas putida KT2440
gauaacguccagagggccugca

SEQ ID NO: 3575183 - RNA, 18 nt, Pseudomonas putida KT2440
gauaagcaugggucagac

SEQ ID NO: 3575184 - RNA, 19 nt, Pseudomonas putida KT2440
gauaagucauggcuauucu

SEQ ID NO: 3575185 - RNA, 13 nt, Pseudomonas putida KT2440
gauacacccgcuc

SEQ ID NO: 3575186 - RNA, 21 nt, Pseudomonas putida KT2440
gauacccaauaaaaacaacag

SEQ ID NO: 3575187 - RNA, 15 nt, Pseudomonas putida KT2440
gauacccagcgccga

SEQ ID NO: 3575188 - RNA, 13 nt, Pseudomonas putida KT2440
gauacccaggcgc

SEQ ID NO: 3575189 - RNA, 14 nt, Pseudomonas putida KT2440
gauaccccgcugcc

SEQ ID NO: 3575190 - RNA, 15 nt, Pseudomonas putida KT2440
gauaccccgcugccu

SEQ ID NO: 3575191 - RNA, 14 nt, Pseudomonas putida KT2440
gauacccgccacca

SEQ ID NO: 3575192 - RNA, 22 nt, Pseudomonas putida KT2440
gauaccgaggaggaggcugggg

SEQ ID NO: 3575193 - RNA, 14 nt, Pseudomonas putida KT2440
gauaccgcccaggu

SEQ ID NO: 3575194 - RNA, 16 nt, Pseudomonas putida KT2440
gauaccggcgccgccc

SEQ ID NO: 3575195 - RNA, 17 nt, Pseudomonas putida KT2440
gauaccugcuugcugac

SEQ ID NO: 3575196 - RNA, 20 nt, Pseudomonas putida KT2440
gauaccugugggagcgggcg

SEQ ID NO: 3575197 - RNA, 14 nt, Pseudomonas putida KT2440
gauacgcccaucca

SEQ ID NO: 3575198 - RNA, 13 nt, Pseudomonas putida KT2440
gauacgccuguaa

SEQ ID NO: 3575199 - RNA, 13 nt, Pseudomonas putida KT2440
gauacgcgcagau

SEQ ID NO: 3575200 - RNA, 16 nt, Pseudomonas putida KT2440
gauacggugccaauaa

SEQ ID NO: 3575201 - RNA, 18 nt, Pseudomonas putida KT2440
gauacucacccgcuugcc

SEQ ID NO: 3575202 - RNA, 20 nt, Pseudomonas putida KT2440
gauacucacccgcuugccac

SEQ ID NO: 3575203 - RNA, 14 nt, Pseudomonas putida KT2440
gauacuccggcaac

SEQ ID NO: 3575204 - RNA, 15 nt, Pseudomonas putida KT2440
gauacuccggcaacc

SEQ ID NO: 3575205 - RNA, 21 nt, Pseudomonas putida KT2440
gauacugcacccucucugugg

SEQ ID NO: 3575206 - RNA, 18 nt, Pseudomonas putida KT2440
gauacuggcccggcggga

SEQ ID NO: 3575207 - RNA, 15 nt, Pseudomonas putida KT2440
gauacuuggccauca

SEQ ID NO: 3575208 - RNA, 16 nt, Pseudomonas putida KT2440
gauagaacgggucauu

SEQ ID NO: 3575209 - RNA, 19 nt, Pseudomonas putida KT2440
gauagaccuugccagcgcu

SEQ ID NO: 3575210 - RNA, 15 nt, Pseudomonas putida KT2440
gauagauaucaagca

SEQ ID NO: 3575211 - RNA, 15 nt, Pseudomonas putida KT2440
gauagccagggccug

SEQ ID NO: 3575212 - RNA, 16 nt, Pseudomonas putida KT2440
gauagccuguggggca

SEQ ID NO: 3575213 - RNA, 21 nt, Pseudomonas putida KT2440
gauagccuguggggcaacugc

SEQ ID NO: 3575214 - RNA, 23 nt, Pseudomonas putida KT2440
gauagccuguggggcaacugcgc

SEQ ID NO: 3575215 - RNA, 19 nt, Pseudomonas putida KT2440
gauagcgcuuuuccaguuc

SEQ ID NO: 3575216 - RNA, 17 nt, Pseudomonas putida KT2440
gauagcggcagcgacga

SEQ ID NO: 3575217 - RNA, 12 nt, Pseudomonas putida KT2440
gauaggcauuga

SEQ ID NO: 3575218 - RNA, 17 nt, Pseudomonas putida KT2440
gauagggaacagggcag

SEQ ID NO: 3575219 - RNA, 14 nt, Pseudomonas putida KT2440
gauagggcugcggg

SEQ ID NO: 3575220 - RNA, 17 nt, Pseudomonas putida KT2440
gauaguccagcaacucc

SEQ ID NO: 3575221 - RNA, 24 nt, Pseudomonas putida KT2440
gauaguggcguuuuucacacgcca

SEQ ID NO: 3575222 - RNA, 17 nt, Pseudomonas putida KT2440
gauaucagcgccagcac

SEQ ID NO: 3575223 - RNA, 15 nt, Pseudomonas putida KT2440
gauaucggcgcggcc

SEQ ID NO: 3575224 - RNA, 16 nt, Pseudomonas putida KT2440
gauaugcuccauguuc

SEQ ID NO: 3575225 - RNA, 22 nt, Pseudomonas putida KT2440
gauauggaagcuguggggcuga

SEQ ID NO: 3575226 - RNA, 14 nt, Pseudomonas putida KT2440
gauauugaccagcg

SEQ ID NO: 3575227 - RNA, 19 nt, Pseudomonas putida KT2440
gauauugaccagcgacggu

SEQ ID NO: 3575228 - RNA, 15 nt, Pseudomonas putida KT2440
gaucaaaacucugca

SEQ ID NO: 3575229 - RNA, 23 nt, Pseudomonas putida KT2440
gaucaacaaaccgacccugcugc

SEQ ID NO: 3575230 - RNA, 16 nt, Pseudomonas putida KT2440
gaucaacgccgccagc

SEQ ID NO: 3575231 - RNA, 21 nt, Pseudomonas putida KT2440
gaucaagcuguacaacgcagc

SEQ ID NO: 3575232 - RNA, 21 nt, Pseudomonas putida KT2440
gaucaauacacccacaccucg

SEQ ID NO: 3575233 - RNA, 20 nt, Pseudomonas putida KT2440
gaucaaugucggagcgggcu

SEQ ID NO: 3575234 - RNA, 18 nt, Pseudomonas putida KT2440
gaucacacccucugccau

SEQ ID NO: 3575235 - RNA, 14 nt, Pseudomonas putida KT2440
gaucacaccggcaa

SEQ ID NO: 3575236 - RNA, 15 nt, Pseudomonas putida KT2440
gaucacaccggccgc

SEQ ID NO: 3575237 - RNA, 20 nt, Pseudomonas putida KT2440
gaucacauaaggcagcagcu

SEQ ID NO: 3575238 - RNA, 15 nt, Pseudomonas putida KT2440
gaucacaucgugaag

SEQ ID NO: 3575239 - RNA, 17 nt, Pseudomonas putida KT2440
gaucaccagcaccccga

SEQ ID NO: 3575240 - RNA, 14 nt, Pseudomonas putida KT2440
gaucaccagccccu

SEQ ID NO: 3575241 - RNA, 15 nt, Pseudomonas putida KT2440
gaucaccagcucgcc

SEQ ID NO: 3575242 - RNA, 16 nt, Pseudomonas putida KT2440
gaucacccagucaccu

SEQ ID NO: 3575243 - RNA, 17 nt, Pseudomonas putida KT2440
gaucaccgacaagauaa

SEQ ID NO: 3575244 - RNA, 22 nt, Pseudomonas putida KT2440
gaucaccgacaagauaacaccc

SEQ ID NO: 3575245 - RNA, 17 nt, Pseudomonas putida KT2440
gaucaccgcaagcugca

SEQ ID NO: 3575246 - RNA, 13 nt, Pseudomonas putida KT2440
gaucaccgccagc

SEQ ID NO: 3575247 - RNA, 15 nt, Pseudomonas putida KT2440
gaucaccgccagcag

SEQ ID NO: 3575248 - RNA, 16 nt, Pseudomonas putida KT2440
gaucaccgccagcggc

SEQ ID NO: 3575249 - RNA, 11 nt, Pseudomonas putida KT2440
gaucaccugcg

SEQ ID NO: 3575250 - RNA, 15 nt, Pseudomonas putida KT2440
gaucaccugcggccu

SEQ ID NO: 3575251 - RNA, 16 nt, Pseudomonas putida KT2440
gaucaccugcggccug

SEQ ID NO: 3575252 - RNA, 19 nt, Pseudomonas putida KT2440
gaucaccugcggccuggcc

SEQ ID NO: 3575253 - RNA, 13 nt, Pseudomonas putida KT2440
gaucaccuggccg

SEQ ID NO: 3575254 - RNA, 12 nt, Pseudomonas putida KT2440
gaucacgaacac

SEQ ID NO: 3575255 - RNA, 18 nt, Pseudomonas putida KT2440
gaucacgcaggcccagca

SEQ ID NO: 3575256 - RNA, 19 nt, Pseudomonas putida KT2440
gaucacgcaggcccagcag

SEQ ID NO: 3575257 - RNA, 19 nt, Pseudomonas putida KT2440
gaucacgcccgggccaggc

SEQ ID NO: 3575258 - RNA, 17 nt, Pseudomonas putida KT2440
gaucacgcuuaagucuu

SEQ ID NO: 3575259 - RNA, 13 nt, Pseudomonas putida KT2440
gaucacgggcaau

SEQ ID NO: 3575260 - RNA, 22 nt, Pseudomonas putida KT2440
gaucacgggcaggccccugcaa

SEQ ID NO: 3575261 - RNA, 15 nt, Pseudomonas putida KT2440
gaucacgucacccag

SEQ ID NO: 3575262 - RNA, 16 nt, Pseudomonas putida KT2440
gaucacgucggccugc

SEQ ID NO: 3575263 - RNA, 16 nt, Pseudomonas putida KT2440
gaucacgucggcguca

SEQ ID NO: 3575264 - RNA, 18 nt, Pseudomonas putida KT2440
gaucacuacaugcggccc

SEQ ID NO: 3575265 - RNA, 19 nt, Pseudomonas putida KT2440
gaucacuccugguuggcca

SEQ ID NO: 3575266 - RNA, 16 nt, Pseudomonas putida KT2440
gaucacuuccaccugc

SEQ ID NO: 3575267 - RNA, 18 nt, Pseudomonas putida KT2440
gaucacuuccaccugcgc

SEQ ID NO: 3575268 - RNA, 19 nt, Pseudomonas putida KT2440
gaucacuuccaccugcgcc

SEQ ID NO: 3575269 - RNA, 13 nt, Pseudomonas putida KT2440
gaucacuuccugg

SEQ ID NO: 3575270 - RNA, 18 nt, Pseudomonas putida KT2440
gaucagacuuugcggacg

SEQ ID NO: 3575271 - RNA, 15 nt, Pseudomonas putida KT2440
gaucagcaaccugcu

SEQ ID NO: 3575272 - RNA, 15 nt, Pseudomonas putida KT2440
gaucagcaccgaguc

SEQ ID NO: 3575273 - RNA, 22 nt, Pseudomonas putida KT2440
gaucagcacgcccaucagcgcc

SEQ ID NO: 3575274 - RNA, 15 nt, Pseudomonas putida KT2440
gaucagcagcaccga

SEQ ID NO: 3575275 - RNA, 17 nt, Pseudomonas putida KT2440
gaucagcaugucccggg

SEQ ID NO: 3575276 - RNA, 15 nt, Pseudomonas putida KT2440
gaucagccgcgccau

SEQ ID NO: 3575277 - RNA, 14 nt, Pseudomonas putida KT2440
gaucagccgugaca

SEQ ID NO: 3575278 - RNA, 20 nt, Pseudomonas putida KT2440
gaucagcgcagacuggguga

SEQ ID NO: 3575279 - RNA, 19 nt, Pseudomonas putida KT2440
gaucagcgccgaaccagca

SEQ ID NO: 3575280 - RNA, 16 nt, Pseudomonas putida KT2440
gaucagcgccucgccc

SEQ ID NO: 3575281 - RNA, 15 nt, Pseudomonas putida KT2440
gaucagcgccugcuc

SEQ ID NO: 3575282 - RNA, 22 nt, Pseudomonas putida KT2440
gaucagcgccugcucauccacc

SEQ ID NO: 3575283 - RNA, 18 nt, Pseudomonas putida KT2440
gaucagcgcguccagcaa

SEQ ID NO: 3575284 - RNA, 22 nt, Pseudomonas putida KT2440
gaucagcggcuuguucagcugg

SEQ ID NO: 3575285 - RNA, 21 nt, Pseudomonas putida KT2440
gaucagcgguucgaccgacau

SEQ ID NO: 3575286 - RNA, 14 nt, Pseudomonas putida KT2440
gaucagcugccacu

SEQ ID NO: 3575287 - RNA, 14 nt, Pseudomonas putida KT2440
gaucagcuggguga

SEQ ID NO: 3575288 - RNA, 22 nt, Pseudomonas putida KT2440
gaucagcuggucgaggcggcug

SEQ ID NO: 3575289 - RNA, 17 nt, Pseudomonas putida KT2440
gaucagcuuaacgcuug

SEQ ID NO: 3575290 - RNA, 22 nt, Pseudomonas putida KT2440
gaucaggaacaaucuucuucau

SEQ ID NO: 3575291 - RNA, 13 nt, Pseudomonas putida KT2440
gaucaggcaggcc

SEQ ID NO: 3575292 - RNA, 14 nt, Pseudomonas putida KT2440
gaucaggcaggcca

SEQ ID NO: 3575293 - RNA, 18 nt, Pseudomonas putida KT2440
gaucaggcaggccagcac

SEQ ID NO: 3575294 - RNA, 19 nt, Pseudomonas putida KT2440
gaucaggcaggccagcacg

SEQ ID NO: 3575295 - RNA, 12 nt, Pseudomonas putida KT2440
gaucaggcaguc

SEQ ID NO: 3575296 - RNA, 15 nt, Pseudomonas putida KT2440
gaucaggccgcucac

SEQ ID NO: 3575297 - RNA, 15 nt, Pseudomonas putida KT2440
gaucagguaccccuc

SEQ ID NO: 3575298 - RNA, 13 nt, Pseudomonas putida KT2440
gaucaggucgaca

SEQ ID NO: 3575299 - RNA, 19 nt, Pseudomonas putida KT2440
gaucaggucgacacccagc

SEQ ID NO: 3575300 - RNA, 14 nt, Pseudomonas putida KT2440
gaucaggucggcgg

SEQ ID NO: 3575301 - RNA, 17 nt, Pseudomonas putida KT2440
gaucaggucggcggccu

SEQ ID NO: 3575302 - RNA, 14 nt, Pseudomonas putida KT2440
gaucaggugcagga

SEQ ID NO: 3575303 - RNA, 17 nt, Pseudomonas putida KT2440
gaucagguuacuggcca

SEQ ID NO: 3575304 - RNA, 16 nt, Pseudomonas putida KT2440
gaucagguugcccagc

SEQ ID NO: 3575305 - RNA, 14 nt, Pseudomonas putida KT2440
gaucagguugcccg

SEQ ID NO: 3575306 - RNA, 22 nt, Pseudomonas putida KT2440
gaucagugucugcgccugcugg

SEQ ID NO: 3575307 - RNA, 18 nt, Pseudomonas putida KT2440
gaucaguuccgcguccuu

SEQ ID NO: 3575308 - RNA, 23 nt, Pseudomonas putida KT2440
gaucaguuccgcguccuugacgg

SEQ ID NO: 3575309 - RNA, 18 nt, Pseudomonas putida KT2440
gaucaucagaccgccgau

SEQ ID NO: 3575310 - RNA, 14 nt, Pseudomonas putida KT2440
gaucaucagcgccg

SEQ ID NO: 3575311 - RNA, 13 nt, Pseudomonas putida KT2440
gaucaucaucggc

SEQ ID NO: 3575312 - RNA, 17 nt, Pseudomonas putida KT2440
gaucaucaucggcaugc

SEQ ID NO: 3575313 - RNA, 18 nt, Pseudomonas putida KT2440
gaucauccacaaucagca

SEQ ID NO: 3575314 - RNA, 16 nt, Pseudomonas putida KT2440
gaucaucgaagccagu

SEQ ID NO: 3575315 - RNA, 17 nt, Pseudomonas putida KT2440
gaucaucggcacgccca

SEQ ID NO: 3575316 - RNA, 16 nt, Pseudomonas putida KT2440
gaucaugaacgaggac

SEQ ID NO: 3575317 - RNA, 19 nt, Pseudomonas putida KT2440
gaucaugaacgaggacugc

SEQ ID NO: 3575318 - RNA, 16 nt, Pseudomonas putida KT2440
gaucaugcccauggcc

SEQ ID NO: 3575319 - RNA, 18 nt, Pseudomonas putida KT2440
gaucaugccgacggugcc

SEQ ID NO: 3575320 - RNA, 17 nt, Pseudomonas putida KT2440
gaucaugcggcaagcca

SEQ ID NO: 3575321 - RNA, 14 nt, Pseudomonas putida KT2440
gaucauuaccugca

SEQ ID NO: 3575322 - RNA, 13 nt, Pseudomonas putida KT2440
gaucauucaggca

SEQ ID NO: 3575323 - RNA, 15 nt, Pseudomonas putida KT2440
gaucauucaggcacg

SEQ ID NO: 3575324 - RNA, 14 nt, Pseudomonas putida KT2440
gauccacagcgggu

SEQ ID NO: 3575325 - RNA, 16 nt, Pseudomonas putida KT2440
gauccacagcgggucg

SEQ ID NO: 3575326 - RNA, 19 nt, Pseudomonas putida KT2440
gauccaccucucagcacca

SEQ ID NO: 3575327 - RNA, 16 nt, Pseudomonas putida KT2440
gauccagucagacucc

SEQ ID NO: 3575328 - RNA, 23 nt, Pseudomonas putida KT2440
gauccaucuucaccuugccuacc

SEQ ID NO: 3575329 - RNA, 17 nt, Pseudomonas putida KT2440
gauccccaccagcauca

SEQ ID NO: 3575330 - RNA, 16 nt, Pseudomonas putida KT2440
gauccccggcgacggc

SEQ ID NO: 3575331 - RNA, 11 nt, Pseudomonas putida KT2440
gaucccgacaa

SEQ ID NO: 3575332 - RNA, 23 nt, Pseudomonas putida KT2440
gaucccgacaaaguggaaggcau

SEQ ID NO: 3575333 - RNA, 14 nt, Pseudomonas putida KT2440
gaucccgaugcgcu

SEQ ID NO: 3575334 - RNA, 15 nt, Pseudomonas putida KT2440
gaucccgaugcgcuu

SEQ ID NO: 3575335 - RNA, 22 nt, Pseudomonas putida KT2440
gaucccgccgagcauccgcgcc

SEQ ID NO: 3575336 - RNA, 17 nt, Pseudomonas putida KT2440
gaucccgccgccagacc

SEQ ID NO: 3575337 - RNA, 14 nt, Pseudomonas putida KT2440
gaucccuggggcca

SEQ ID NO: 3575338 - RNA, 22 nt, Pseudomonas putida KT2440
gaucccugugggagcgggcuug

SEQ ID NO: 3575339 - RNA, 12 nt, Pseudomonas putida KT2440
gauccgcggcau

SEQ ID NO: 3575340 - RNA, 20 nt, Pseudomonas putida KT2440
gauccgcggcaugugcgggu

SEQ ID NO: 3575341 - RNA, 18 nt, Pseudomonas putida KT2440
gauccgcuuucggcagug

SEQ ID NO: 3575342 - RNA, 12 nt, Pseudomonas putida KT2440
gauccggcacuc

SEQ ID NO: 3575343 - RNA, 19 nt, Pseudomonas putida KT2440
gauccggcacuccagcgag

SEQ ID NO: 3575344 - RNA, 14 nt, Pseudomonas putida KT2440
gauccgucaagggg

SEQ ID NO: 3575345 - RNA, 22 nt, Pseudomonas putida KT2440
gauccucaucguccaccgcgcc

SEQ ID NO: 3575346 - RNA, 19 nt, Pseudomonas putida KT2440
gauccucuucgaagacgcc

SEQ ID NO: 3575347 - RNA, 12 nt, Pseudomonas putida KT2440
gauccugcagcc

SEQ ID NO: 3575348 - RNA, 19 nt, Pseudomonas putida KT2440
gauccuguggaagcgggcg

SEQ ID NO: 3575349 - RNA, 14 nt, Pseudomonas putida KT2440
gauccuuggcgaag

SEQ ID NO: 3575350 - RNA, 19 nt, Pseudomonas putida KT2440
gauccuuggcgaaggcugc

SEQ ID NO: 3575351 - RNA, 13 nt, Pseudomonas putida KT2440
gaucgaaaaaccg

SEQ ID NO: 3575352 - RNA, 16 nt, Pseudomonas putida KT2440
gaucgaaaucagccuu

SEQ ID NO: 3575353 - RNA, 17 nt, Pseudomonas putida KT2440
gaucgaaaucagccuuc

SEQ ID NO: 3575354 - RNA, 16 nt, Pseudomonas putida KT2440
gaucgaacaacugucc

SEQ ID NO: 3575355 - RNA, 15 nt, Pseudomonas putida KT2440
gaucgaagcagcagc

SEQ ID NO: 3575356 - RNA, 17 nt, Pseudomonas putida KT2440
gaucgaagcagcagcuu

SEQ ID NO: 3575357 - RNA, 19 nt, Pseudomonas putida KT2440
gaucgacaaccccagcccg

SEQ ID NO: 3575358 - RNA, 18 nt, Pseudomonas putida KT2440
gaucgacuucaucaccuc

SEQ ID NO: 3575359 - RNA, 17 nt, Pseudomonas putida KT2440
gaucgagccgaucagga

SEQ ID NO: 3575360 - RNA, 14 nt, Pseudomonas putida KT2440
gaucgauccccugc

SEQ ID NO: 3575361 - RNA, 21 nt, Pseudomonas putida KT2440
gaucgcaagcuggcgcaagcc

SEQ ID NO: 3575362 - RNA, 16 nt, Pseudomonas putida KT2440
gaucgccagccccagc

SEQ ID NO: 3575363 - RNA, 17 nt, Pseudomonas putida KT2440
gaucgccgccgagcuga

SEQ ID NO: 3575364 - RNA, 17 nt, Pseudomonas putida KT2440
gaucgccgucgaccagg

SEQ ID NO: 3575365 - RNA, 22 nt, Pseudomonas putida KT2440
gaucgccuccaggcguugcggg

SEQ ID NO: 3575366 - RNA, 21 nt, Pseudomonas putida KT2440
gaucgccucgugcagcugcac

SEQ ID NO: 3575367 - RNA, 15 nt, Pseudomonas putida KT2440
gaucgcgcagcagcu

SEQ ID NO: 3575368 - RNA, 17 nt, Pseudomonas putida KT2440
gaucgcgccuucgcugg

SEQ ID NO: 3575369 - RNA, 19 nt, Pseudomonas putida KT2440
gaucgcgcuggcacugcgg

SEQ ID NO: 3575370 - RNA, 23 nt, Pseudomonas putida KT2440
gaucgcgcuuggcaccggcagca

SEQ ID NO: 3575371 - RNA, 17 nt, Pseudomonas putida KT2440
gaucggcaguggcucgu

SEQ ID NO: 3575372 - RNA, 18 nt, Pseudomonas putida KT2440
gaucggccgccagaucau

SEQ ID NO: 3575373 - RNA, 18 nt, Pseudomonas putida KT2440
gaucggcgugguccagcg

SEQ ID NO: 3575374 - RNA, 20 nt, Pseudomonas putida KT2440
gaucggcgugguccagcguu

SEQ ID NO: 3575375 - RNA, 14 nt, Pseudomonas putida KT2440
gaucggcuggccau

SEQ ID NO: 3575376 - RNA, 17 nt, Pseudomonas putida KT2440
gaucggcugguccgggc

SEQ ID NO: 3575377 - RNA, 19 nt, Pseudomonas putida KT2440
gaucggguacuccaccacc

SEQ ID NO: 3575378 - RNA, 14 nt, Pseudomonas putida KT2440
gaucggguuuaccc

SEQ ID NO: 3575379 - RNA, 16 nt, Pseudomonas putida KT2440
gaucggguuuacccgc

SEQ ID NO: 3575380 - RNA, 13 nt, Pseudomonas putida KT2440
gaucgguacaugc

SEQ ID NO: 3575381 - RNA, 23 nt, Pseudomonas putida KT2440
gaucgucgacaacgcacccgccu

SEQ ID NO: 3575382 - RNA, 22 nt, Pseudomonas putida KT2440
gaucgucggccccggccccagg

SEQ ID NO: 3575383 - RNA, 16 nt, Pseudomonas putida KT2440
gaucgucuggcacuga

SEQ ID NO: 3575384 - RNA, 17 nt, Pseudomonas putida KT2440
gaucgugcaccgucugg

SEQ ID NO: 3575385 - RNA, 18 nt, Pseudomonas putida KT2440
gaucguugcgcgccaggg

SEQ ID NO: 3575386 - RNA, 13 nt, Pseudomonas putida KT2440
gaucguugguccg

SEQ ID NO: 3575387 - RNA, 20 nt, Pseudomonas putida KT2440
gaucguuguaggagcgggcu

SEQ ID NO: 3575388 - RNA, 15 nt, Pseudomonas putida KT2440
gaucucaagcaaucc

SEQ ID NO: 3575389 - RNA, 14 nt, Pseudomonas putida KT2440
gaucucacaggcga

SEQ ID NO: 3575390 - RNA, 16 nt, Pseudomonas putida KT2440
gaucuccccaccauca

SEQ ID NO: 3575391 - RNA, 16 nt, Pseudomonas putida KT2440
gaucuccucggccagc

SEQ ID NO: 3575392 - RNA, 16 nt, Pseudomonas putida KT2440
gaucucgaagcugcca

SEQ ID NO: 3575393 - RNA, 13 nt, Pseudomonas putida KT2440
gaucucgccagcc

SEQ ID NO: 3575394 - RNA, 19 nt, Pseudomonas putida KT2440
gaucucgccagccugcagc

SEQ ID NO: 3575395 - RNA, 21 nt, Pseudomonas putida KT2440
gaucucgccagccugcagcgc

SEQ ID NO: 3575396 - RNA, 21 nt, Pseudomonas putida KT2440
gaucucgcugucguccagcuc

SEQ ID NO: 3575397 - RNA, 21 nt, Pseudomonas putida KT2440
gaucucgcuucauggccccac

SEQ ID NO: 3575398 - RNA, 15 nt, Pseudomonas putida KT2440
gaucucggccagcag

SEQ ID NO: 3575399 - RNA, 16 nt, Pseudomonas putida KT2440
gaucucggccagcagg

SEQ ID NO: 3575400 - RNA, 19 nt, Pseudomonas putida KT2440
gaucucggccagcaggcca

SEQ ID NO: 3575401 - RNA, 20 nt, Pseudomonas putida KT2440
gaucucguccagggcauugc

SEQ ID NO: 3575402 - RNA, 20 nt, Pseudomonas putida KT2440
gaucucugugggagcgggcg

SEQ ID NO: 3575403 - RNA, 12 nt, Pseudomonas putida KT2440
gaucucuucgcc

SEQ ID NO: 3575404 - RNA, 20 nt, Pseudomonas putida KT2440
gaucucuucggccaguuuca

SEQ ID NO: 3575405 - RNA, 20 nt, Pseudomonas putida KT2440
gaucugaaaguucagcgccu

SEQ ID NO: 3575406 - RNA, 22 nt, Pseudomonas putida KT2440
gaucugagcagcagagagauug

SEQ ID NO: 3575407 - RNA, 16 nt, Pseudomonas putida KT2440
gaucugcagguggugg

SEQ ID NO: 3575408 - RNA, 13 nt, Pseudomonas putida KT2440
gaucugccaggca

SEQ ID NO: 3575409 - RNA, 16 nt, Pseudomonas putida KT2440
gaucugccaggcacca

SEQ ID NO: 3575410 - RNA, 11 nt, Pseudomonas putida KT2440
gaucugccccu

SEQ ID NO: 3575411 - RNA, 19 nt, Pseudomonas putida KT2440
gaucugcucgcccaccgac

SEQ ID NO: 3575412 - RNA, 15 nt, Pseudomonas putida KT2440
gaucugcucuucgcc

SEQ ID NO: 3575413 - RNA, 17 nt, Pseudomonas putida KT2440
gaucuggaucacugcca

SEQ ID NO: 3575414 - RNA, 21 nt, Pseudomonas putida KT2440
gaucuggucgaagcucaggua

SEQ ID NO: 3575415 - RNA, 23 nt, Pseudomonas putida KT2440
gaucugucagguguggcucagcu

SEQ ID NO: 3575416 - RNA, 16 nt, Pseudomonas putida KT2440
gaucuguccuccugcc

SEQ ID NO: 3575417 - RNA, 17 nt, Pseudomonas putida KT2440
gaucuucccgggaaaag

SEQ ID NO: 3575418 - RNA, 19 nt, Pseudomonas putida KT2440
gaucuucgccggcaucgcc

SEQ ID NO: 3575419 - RNA, 17 nt, Pseudomonas putida KT2440
gaucuugcgccccagca

SEQ ID NO: 3575420 - RNA, 18 nt, Pseudomonas putida KT2440
gaucuuggccagggccuu

SEQ ID NO: 3575421 - RNA, 17 nt, Pseudomonas putida KT2440
gaucuugguggucagcc

SEQ ID NO: 3575422 - RNA, 16 nt, Pseudomonas putida KT2440
gaugaaauccaccagc

SEQ ID NO: 3575423 - RNA, 15 nt, Pseudomonas putida KT2440
gaugaacucacccgc

SEQ ID NO: 3575424 - RNA, 15 nt, Pseudomonas putida KT2440
gaugaacucgucacc

SEQ ID NO: 3575425 - RNA, 18 nt, Pseudomonas putida KT2440
gaugaacuugcgcucaag

SEQ ID NO: 3575426 - RNA, 19 nt, Pseudomonas putida KT2440
gaugaagacgcucgacagc

SEQ ID NO: 3575427 - RNA, 24 nt, Pseudomonas putida KT2440
gaugaagacgcucgacagcaacuu

SEQ ID NO: 3575428 - RNA, 20 nt, Pseudomonas putida KT2440
gaugaagccacgcucgugca

SEQ ID NO: 3575429 - RNA, 13 nt, Pseudomonas putida KT2440
gaugaagcggucg

SEQ ID NO: 3575430 - RNA, 13 nt, Pseudomonas putida KT2440
gaugaaggcugcu

SEQ ID NO: 3575431 - RNA, 17 nt, Pseudomonas putida KT2440
gaugaaguggcgcaggc

SEQ ID NO: 3575432 - RNA, 20 nt, Pseudomonas putida KT2440
gaugaauaaugcuccagcga

SEQ ID NO: 3575433 - RNA, 20 nt, Pseudomonas putida KT2440
gaugacacggauggcaccga

SEQ ID NO: 3575434 - RNA, 13 nt, Pseudomonas putida KT2440
gaugaccaccagg

SEQ ID NO: 3575435 - RNA, 16 nt, Pseudomonas putida KT2440
gaugaccaccaggaac

SEQ ID NO: 3575436 - RNA, 21 nt, Pseudomonas putida KT2440
gaugacccuuccagcccgccu

SEQ ID NO: 3575437 - RNA, 17 nt, Pseudomonas putida KT2440
gaugacgaacucgucac

SEQ ID NO: 3575438 - RNA, 12 nt, Pseudomonas putida KT2440
gaugagccuuca

SEQ ID NO: 3575439 - RNA, 14 nt, Pseudomonas putida KT2440
gaugaggaacugcu

SEQ ID NO: 3575440 - RNA, 16 nt, Pseudomonas putida KT2440
gaugaggcgaugcagg

SEQ ID NO: 3575441 - RNA, 17 nt, Pseudomonas putida KT2440
gaugaggcgaugcaggg

SEQ ID NO: 3575442 - RNA, 14 nt, Pseudomonas putida KT2440
gaugaguaaagccg

SEQ ID NO: 3575443 - RNA, 19 nt, Pseudomonas putida KT2440
gaugaguuccguugcuacu

SEQ ID NO: 3575444 - RNA, 20 nt, Pseudomonas putida KT2440
gaugauauuugccacucagg

SEQ ID NO: 3575445 - RNA, 17 nt, Pseudomonas putida KT2440
gaugaucagggacaugg

SEQ ID NO: 3575446 - RNA, 17 nt, Pseudomonas putida KT2440
gaugauccagcccacca

SEQ ID NO: 3575447 - RNA, 21 nt, Pseudomonas putida KT2440
gaugaugauaccgaacagcac

SEQ ID NO: 3575448 - RNA, 14 nt, Pseudomonas putida KT2440
gaugaugcuggucg

SEQ ID NO: 3575449 - RNA, 21 nt, Pseudomonas putida KT2440
gaugcaccaggcccagccggg

SEQ ID NO: 3575450 - RNA, 17 nt, Pseudomonas putida KT2440
gaugcacgccagcauca

SEQ ID NO: 3575451 - RNA, 21 nt, Pseudomonas putida KT2440
gaugcagauggggggauuuga

SEQ ID NO: 3575452 - RNA, 13 nt, Pseudomonas putida KT2440
gaugcagcagugc

SEQ ID NO: 3575453 - RNA, 19 nt, Pseudomonas putida KT2440
gaugcagcagugccagcaa

SEQ ID NO: 3575454 - RNA, 16 nt, Pseudomonas putida KT2440
gaugcaggagcggcuu

SEQ ID NO: 3575455 - RNA, 15 nt, Pseudomonas putida KT2440
gaugcaucagcucgg

SEQ ID NO: 3575456 - RNA, 24 nt, Pseudomonas putida KT2440
gaugccagcggugccagucauucc

SEQ ID NO: 3575457 - RNA, 21 nt, Pseudomonas putida KT2440
gaugcccaaacgccaacagca

SEQ ID NO: 3575458 - RNA, 13 nt, Pseudomonas putida KT2440
gaugccccugcgc

SEQ ID NO: 3575459 - RNA, 14 nt, Pseudomonas putida KT2440
gaugccccugcgcc

SEQ ID NO: 3575460 - RNA, 13 nt, Pseudomonas putida KT2440
gaugcccgcagua

SEQ ID NO: 3575461 - RNA, 19 nt, Pseudomonas putida KT2440
gaugcccgggccuucaacc

SEQ ID NO: 3575462 - RNA, 16 nt, Pseudomonas putida KT2440
gaugccgccgcugcca

SEQ ID NO: 3575463 - RNA, 19 nt, Pseudomonas putida KT2440
gaugccgccgcugccagca

SEQ ID NO: 3575464 - RNA, 20 nt, Pseudomonas putida KT2440
gaugccgccgcugccagcag

SEQ ID NO: 3575465 - RNA, 19 nt, Pseudomonas putida KT2440
gaugccguaguaagccagc

SEQ ID NO: 3575466 - RNA, 23 nt, Pseudomonas putida KT2440
gaugcgcaagcaaccgggggcuu

SEQ ID NO: 3575467 - RNA, 15 nt, Pseudomonas putida KT2440
gaugcgcacaccgcu

SEQ ID NO: 3575468 - RNA, 18 nt, Pseudomonas putida KT2440
gaugcgcacggcaucggc

SEQ ID NO: 3575469 - RNA, 13 nt, Pseudomonas putida KT2440
gaugcgccaguac

SEQ ID NO: 3575470 - RNA, 20 nt, Pseudomonas putida KT2440
gaugcgccaguacgccagca

SEQ ID NO: 3575471 - RNA, 13 nt, Pseudomonas putida KT2440
gaugcgccgcgcg

SEQ ID NO: 3575472 - RNA, 17 nt, Pseudomonas putida KT2440
gaugcgccuggcccgca

SEQ ID NO: 3575473 - RNA, 22 nt, Pseudomonas putida KT2440
gaugcgccuggcccgcagcgcu

SEQ ID NO: 3575474 - RNA, 13 nt, Pseudomonas putida KT2440
gaugcgcuggccc

SEQ ID NO: 3575475 - RNA, 20 nt, Pseudomonas putida KT2440
gaugcgcuggcccuugccau

SEQ ID NO: 3575476 - RNA, 23 nt, Pseudomonas putida KT2440
gaugcggccacagccgagggcau

SEQ ID NO: 3575477 - RNA, 13 nt, Pseudomonas putida KT2440
gaugcggcugacc

SEQ ID NO: 3575478 - RNA, 15 nt, Pseudomonas putida KT2440
gaugcgggcaaagaa

SEQ ID NO: 3575479 - RNA, 15 nt, Pseudomonas putida KT2440
gaugcggugcagcac

SEQ ID NO: 3575480 - RNA, 23 nt, Pseudomonas putida KT2440
gaugcgguggguguccugcaacu

SEQ ID NO: 3575481 - RNA, 14 nt, Pseudomonas putida KT2440
gaugcgguugcccg

SEQ ID NO: 3575482 - RNA, 13 nt, Pseudomonas putida KT2440
gaugcugcgggcg

SEQ ID NO: 3575483 - RNA, 12 nt, Pseudomonas putida KT2440
gaugcugugccg

SEQ ID NO: 3575484 - RNA, 12 nt, Pseudomonas putida KT2440
gaugcuucgcgg

SEQ ID NO: 3575485 - RNA, 13 nt, Pseudomonas putida KT2440
gaugcuucgcggg

SEQ ID NO: 3575486 - RNA, 16 nt, Pseudomonas putida KT2440
gaugcuugcgcggcac

SEQ ID NO: 3575487 - RNA, 19 nt, Pseudomonas putida KT2440
gaugcuuuugauggucucc

SEQ ID NO: 3575488 - RNA, 21 nt, Pseudomonas putida KT2440
gauggaccgacuucaaaacca

SEQ ID NO: 3575489 - RNA, 15 nt, Pseudomonas putida KT2440
gauggcaccgacuuc

SEQ ID NO: 3575490 - RNA, 23 nt, Pseudomonas putida KT2440
gauggcaccgacuuccccggcgc

SEQ ID NO: 3575491 - RNA, 18 nt, Pseudomonas putida KT2440
gauggcaccggcucugcc

SEQ ID NO: 3575492 - RNA, 18 nt, Pseudomonas putida KT2440
gauggcagacaaguccuu

SEQ ID NO: 3575493 - RNA, 23 nt, Pseudomonas putida KT2440
gauggcauccacacgcugcugcg

SEQ ID NO: 3575494 - RNA, 18 nt, Pseudomonas putida KT2440
gauggccaauaccgcugc

SEQ ID NO: 3575495 - RNA, 21 nt, Pseudomonas putida KT2440
gauggccaauaccgcugcaac

SEQ ID NO: 3575496 - RNA, 17 nt, Pseudomonas putida KT2440
gauggccaccagcaccu

SEQ ID NO: 3575497 - RNA, 19 nt, Pseudomonas putida KT2440
gauggccgcaggcccaaac

SEQ ID NO: 3575498 - RNA, 16 nt, Pseudomonas putida KT2440
gauggcgcauggccug

SEQ ID NO: 3575499 - RNA, 17 nt, Pseudomonas putida KT2440
gauggcggaucagcgcg

SEQ ID NO: 3575500 - RNA, 14 nt, Pseudomonas putida KT2440
gauggcucaucgcc

SEQ ID NO: 3575501 - RNA, 14 nt, Pseudomonas putida KT2440
gauggcugucugca

SEQ ID NO: 3575502 - RNA, 13 nt, Pseudomonas putida KT2440
gaugggcaggcca

SEQ ID NO: 3575503 - RNA, 17 nt, Pseudomonas putida KT2440
gaugggcccgagccccc

SEQ ID NO: 3575504 - RNA, 17 nt, Pseudomonas putida KT2440
gaugggccgcuccuuca

SEQ ID NO: 3575505 - RNA, 14 nt, Pseudomonas putida KT2440
gaugggcgucgccu

SEQ ID NO: 3575506 - RNA, 15 nt, Pseudomonas putida KT2440
gauggggcgugcaug

SEQ ID NO: 3575507 - RNA, 12 nt, Pseudomonas putida KT2440
gauggggggauu

SEQ ID NO: 3575508 - RNA, 23 nt, Pseudomonas putida KT2440
gaugguaacgggcaaaguccauc

SEQ ID NO: 3575509 - RNA, 17 nt, Pseudomonas putida KT2440
gauggucagcgcuucgc

SEQ ID NO: 3575510 - RNA, 18 nt, Pseudomonas putida KT2440
gauggucuucgccgccau

SEQ ID NO: 3575511 - RNA, 16 nt, Pseudomonas putida KT2440
gauggugcaggggggu

SEQ ID NO: 3575512 - RNA, 14 nt, Pseudomonas putida KT2440
gaugguggucggca

SEQ ID NO: 3575513 - RNA, 13 nt, Pseudomonas putida KT2440
gauggugugcagc

SEQ ID NO: 3575514 - RNA, 17 nt, Pseudomonas putida KT2440
gaugguugacagcgcuu

SEQ ID NO: 3575515 - RNA, 20 nt, Pseudomonas putida KT2440
gaugguugacagcgcuucca

SEQ ID NO: 3575516 - RNA, 16 nt, Pseudomonas putida KT2440
gauguacgccagguga

SEQ ID NO: 3575517 - RNA, 22 nt, Pseudomonas putida KT2440
gauguacgccaggugauuuccu

SEQ ID NO: 3575518 - RNA, 23 nt, Pseudomonas putida KT2440
gauguacgccaggugauuuccuc

SEQ ID NO: 3575519 - RNA, 16 nt, Pseudomonas putida KT2440
gauguacucaggggca

SEQ ID NO: 3575520 - RNA, 15 nt, Pseudomonas putida KT2440
gauguaggcagcugc

SEQ ID NO: 3575521 - RNA, 18 nt, Pseudomonas putida KT2440
gauguaggcagcugccuu

SEQ ID NO: 3575522 - RNA, 15 nt, Pseudomonas putida KT2440
gauguagucgucgcu

SEQ ID NO: 3575523 - RNA, 14 nt, Pseudomonas putida KT2440
gauguccaggccga

SEQ ID NO: 3575524 - RNA, 16 nt, Pseudomonas putida KT2440
gaugucgccguagcug

SEQ ID NO: 3575525 - RNA, 22 nt, Pseudomonas putida KT2440
gaugucguugaugaucugcucc

SEQ ID NO: 3575526 - RNA, 21 nt, Pseudomonas putida KT2440
gaugucuacccacaagcgcag

SEQ ID NO: 3575527 - RNA, 16 nt, Pseudomonas putida KT2440
gaugucuuccagacca

SEQ ID NO: 3575528 - RNA, 20 nt, Pseudomonas putida KT2440
gaugucuucgcggaaggccu

SEQ ID NO: 3575529 - RNA, 17 nt, Pseudomonas putida KT2440
gaugugcggcgccaucg

SEQ ID NO: 3575530 - RNA, 20 nt, Pseudomonas putida KT2440
gauguucaggucgcgcugca

SEQ ID NO: 3575531 - RNA, 14 nt, Pseudomonas putida KT2440
gauguuggccacga

SEQ ID NO: 3575532 - RNA, 18 nt, Pseudomonas putida KT2440
gauuacaaacggcuuggc

SEQ ID NO: 3575533 - RNA, 19 nt, Pseudomonas putida KT2440
gauuacaagggccugugcc

SEQ ID NO: 3575534 - RNA, 19 nt, Pseudomonas putida KT2440
gauuacgcgucaucugcgc

SEQ ID NO: 3575535 - RNA, 13 nt, Pseudomonas putida KT2440
gauuagacccaga

SEQ ID NO: 3575536 - RNA, 16 nt, Pseudomonas putida KT2440
gauucacggaucagcc

SEQ ID NO: 3575537 - RNA, 20 nt, Pseudomonas putida KT2440
gauucagcacaccgcucaac

SEQ ID NO: 3575538 - RNA, 16 nt, Pseudomonas putida KT2440
gauucagcacgcuggc

SEQ ID NO: 3575539 - RNA, 11 nt, Pseudomonas putida KT2440
gauucaggccu

SEQ ID NO: 3575540 - RNA, 16 nt, Pseudomonas putida KT2440
gauuccucgcgcuugc

SEQ ID NO: 3575541 - RNA, 16 nt, Pseudomonas putida KT2440
gauuccuugcagcgcc

SEQ ID NO: 3575542 - RNA, 13 nt, Pseudomonas putida KT2440
gauucgccucccg

SEQ ID NO: 3575543 - RNA, 13 nt, Pseudomonas putida KT2440
gauucggggauga

SEQ ID NO: 3575544 - RNA, 21 nt, Pseudomonas putida KT2440
gauucuacgccguacugcugg

SEQ ID NO: 3575545 - RNA, 15 nt, Pseudomonas putida KT2440
gauucuauggccgga

SEQ ID NO: 3575546 - RNA, 13 nt, Pseudomonas putida KT2440
gauucugccagcu

SEQ ID NO: 3575547 - RNA, 15 nt, Pseudomonas putida KT2440
gauucugccagcucc

SEQ ID NO: 3575548 - RNA, 16 nt, Pseudomonas putida KT2440
gauugaauucuggcuu

SEQ ID NO: 3575549 - RNA, 16 nt, Pseudomonas putida KT2440
gauugaucagcgccuc

SEQ ID NO: 3575550 - RNA, 19 nt, Pseudomonas putida KT2440
gauugccagggugccagac

SEQ ID NO: 3575551 - RNA, 21 nt, Pseudomonas putida KT2440
gauugccgcagcugcggucga

SEQ ID NO: 3575552 - RNA, 22 nt, Pseudomonas putida KT2440
gauugccucaggccccaggcca

SEQ ID NO: 3575553 - RNA, 23 nt, Pseudomonas putida KT2440
gauugccucaggccccaggccau

SEQ ID NO: 3575554 - RNA, 13 nt, Pseudomonas putida KT2440
gauugcgaguuga

SEQ ID NO: 3575555 - RNA, 20 nt, Pseudomonas putida KT2440
gauugcuuauucuucuggcu

SEQ ID NO: 3575556 - RNA, 14 nt, Pseudomonas putida KT2440
gauuggcaguccug

SEQ ID NO: 3575557 - RNA, 16 nt, Pseudomonas putida KT2440
gauuggcaucgcugcc

SEQ ID NO: 3575558 - RNA, 14 nt, Pseudomonas putida KT2440
gauuggccagcagg

SEQ ID NO: 3575559 - RNA, 18 nt, Pseudomonas putida KT2440
gauuggccagcagggccg

SEQ ID NO: 3575560 - RNA, 18 nt, Pseudomonas putida KT2440
gauuguuaagaagccgac

SEQ ID NO: 3575561 - RNA, 19 nt, Pseudomonas putida KT2440
gauuuccaccggcuugccc

SEQ ID NO: 3575562 - RNA, 23 nt, Pseudomonas putida KT2440
gauuuccagugccgccaccuggc

SEQ ID NO: 3575563 - RNA, 14 nt, Pseudomonas putida KT2440
gauuucggcggcga

SEQ ID NO: 3575564 - RNA, 21 nt, Pseudomonas putida KT2440
gauuugccgucgcgcccaccg

SEQ ID NO: 3575565 - RNA, 19 nt, Pseudomonas putida KT2440
gauuugcgcuacagcuuug

SEQ ID NO: 3575566 - RNA, 18 nt, Pseudomonas putida KT2440
gauuuggggcgcccggca

SEQ ID NO: 3575567 - RNA, 17 nt, Pseudomonas putida KT2440
gcaaaaccugagucagg

SEQ ID NO: 3575568 - RNA, 18 nt, Pseudomonas putida KT2440
gcaaaaccugagucaggc

SEQ ID NO: 3575569 - RNA, 12 nt, Pseudomonas putida KT2440
gcaaaaccugcc

SEQ ID NO: 3575570 - RNA, 23 nt, Pseudomonas putida KT2440
gcaaaacgguuguuucagccuug

SEQ ID NO: 3575571 - RNA, 20 nt, Pseudomonas putida KT2440
gcaaaaucgaccagggccuu

SEQ ID NO: 3575572 - RNA, 22 nt, Pseudomonas putida KT2440
gcaaacaccuugccccgcaggc

SEQ ID NO: 3575573 - RNA, 12 nt, Pseudomonas putida KT2440
gcaaacccgcgc

SEQ ID NO: 3575574 - RNA, 18 nt, Pseudomonas putida KT2440
gcaaacccgcgccuacag

SEQ ID NO: 3575575 - RNA, 19 nt, Pseudomonas putida KT2440
gcaaacccggccagcaggu

SEQ ID NO: 3575576 - RNA, 14 nt, Pseudomonas putida KT2440
gcaaaccgaccagg

SEQ ID NO: 3575577 - RNA, 17 nt, Pseudomonas putida KT2440
gcaaaccgaccaggcag

SEQ ID NO: 3575578 - RNA, 19 nt, Pseudomonas putida KT2440
gcaaaccgaccaggcagua

SEQ ID NO: 3575579 - RNA, 21 nt, Pseudomonas putida KT2440
gcaaacgcaggugcgcacgcu

SEQ ID NO: 3575580 - RNA, 17 nt, Pseudomonas putida KT2440
gcaaacgcggucagcga

SEQ ID NO: 3575581 - RNA, 18 nt, Pseudomonas putida KT2440
gcaaacuccacugugccc

SEQ ID NO: 3575582 - RNA, 18 nt, Pseudomonas putida KT2440
gcaaacucgucgcugguc

SEQ ID NO: 3575583 - RNA, 19 nt, Pseudomonas putida KT2440
gcaaacuggcgcccggcau

SEQ ID NO: 3575584 - RNA, 17 nt, Pseudomonas putida KT2440
gcaaacuucucgccuca

SEQ ID NO: 3575585 - RNA, 16 nt, Pseudomonas putida KT2440
gcaaagaaaaacccgg

SEQ ID NO: 3575586 - RNA, 17 nt, Pseudomonas putida KT2440
gcaaagaaacaccaggc

SEQ ID NO: 3575587 - RNA, 20 nt, Pseudomonas putida KT2440
gcaaagaacacuuccgggcu

SEQ ID NO: 3575588 - RNA, 22 nt, Pseudomonas putida KT2440
gcaaagaacggugcugccgagg

SEQ ID NO: 3575589 - RNA, 20 nt, Pseudomonas putida KT2440
gcaaagagugccccaaacgg

SEQ ID NO: 3575590 - RNA, 13 nt, Pseudomonas putida KT2440
gcaaagaucgccc

SEQ ID NO: 3575591 - RNA, 14 nt, Pseudomonas putida KT2440
gcaaagaucgccca

SEQ ID NO: 3575592 - RNA, 15 nt, Pseudomonas putida KT2440
gcaaagaucgcccag

SEQ ID NO: 3575593 - RNA, 16 nt, Pseudomonas putida KT2440
gcaaagcagacccaga

SEQ ID NO: 3575594 - RNA, 13 nt, Pseudomonas putida KT2440
gcaaagcagcccc

SEQ ID NO: 3575595 - RNA, 16 nt, Pseudomonas putida KT2440
gcaaagcagccccagg

SEQ ID NO: 3575596 - RNA, 23 nt, Pseudomonas putida KT2440
gcaaagcagccccagggcccuca

SEQ ID NO: 3575597 - RNA, 14 nt, Pseudomonas putida KT2440
gcaaagcagccccc

SEQ ID NO: 3575598 - RNA, 13 nt, Pseudomonas putida KT2440
gcaaagcgcagca

SEQ ID NO: 3575599 - RNA, 15 nt, Pseudomonas putida KT2440
gcaaagcgcagcaau

SEQ ID NO: 3575600 - RNA, 16 nt, Pseudomonas putida KT2440
gcaaagcggccccagc

SEQ ID NO: 3575601 - RNA, 16 nt, Pseudomonas putida KT2440
gcaaagcggcccccac

SEQ ID NO: 3575602 - RNA, 23 nt, Pseudomonas putida KT2440
gcaaagcggcccccacgccgacc

SEQ ID NO: 3575603 - RNA, 19 nt, Pseudomonas putida KT2440
gcaaagcggcccccagcaa

SEQ ID NO: 3575604 - RNA, 20 nt, Pseudomonas putida KT2440
gcaaagcggcccccagcaau

SEQ ID NO: 3575605 - RNA, 20 nt, Pseudomonas putida KT2440
gcaaagcgggucgccagguu

SEQ ID NO: 3575606 - RNA, 14 nt, Pseudomonas putida KT2440
gcaaaggcaugggc

SEQ ID NO: 3575607 - RNA, 15 nt, Pseudomonas putida KT2440
gcaaaggcaugggcc

SEQ ID NO: 3575608 - RNA, 17 nt, Pseudomonas putida KT2440
gcaaaggccucuucagg

SEQ ID NO: 3575609 - RNA, 21 nt, Pseudomonas putida KT2440
gcaaaggcuagcagcaucacc

SEQ ID NO: 3575610 - RNA, 17 nt, Pseudomonas putida KT2440
gcaaaggcuuuggccgu

SEQ ID NO: 3575611 - RNA, 13 nt, Pseudomonas putida KT2440
gcaaagguggcac

SEQ ID NO: 3575612 - RNA, 16 nt, Pseudomonas putida KT2440
gcaaaguccagcauca

SEQ ID NO: 3575613 - RNA, 16 nt, Pseudomonas putida KT2440
gcaaagucuucagcca

SEQ ID NO: 3575614 - RNA, 21 nt, Pseudomonas putida KT2440
gcaaagucuucagccaaggcg

SEQ ID NO: 3575615 - RNA, 17 nt, Pseudomonas putida KT2440
gcaaaguugagcgccgc

SEQ ID NO: 3575616 - RNA, 17 nt, Pseudomonas putida KT2440
gcaaauacggccaauaa

SEQ ID NO: 3575617 - RNA, 15 nt, Pseudomonas putida KT2440
gcaaauccuccugcg

SEQ ID NO: 3575618 - RNA, 22 nt, Pseudomonas putida KT2440
gcaaauccuccugcgcaugcaa

SEQ ID NO: 3575619 - RNA, 12 nt, Pseudomonas putida KT2440
gcaaaucgccaa

SEQ ID NO: 3575620 - RNA, 17 nt, Pseudomonas putida KT2440
gcaaaucgccaaucagg

SEQ ID NO: 3575621 - RNA, 18 nt, Pseudomonas putida KT2440
gcaaaucgccaaucaggu

SEQ ID NO: 3575622 - RNA, 24 nt, Pseudomonas putida KT2440
gcaaaugcggcgcgggcgcaggca

SEQ ID NO: 3575623 - RNA, 17 nt, Pseudomonas putida KT2440
gcaaaugcuugcccgcc

SEQ ID NO: 3575624 - RNA, 19 nt, Pseudomonas putida KT2440
gcaacaaccuggccgggcu

SEQ ID NO: 3575625 - RNA, 18 nt, Pseudomonas putida KT2440
gcaacaagcuggacaugc

SEQ ID NO: 3575626 - RNA, 17 nt, Pseudomonas putida KT2440
gcaacaaggccaaccac

SEQ ID NO: 3575627 - RNA, 19 nt, Pseudomonas putida KT2440
gcaacaaggucgccaggcg

SEQ ID NO: 3575628 - RNA, 13 nt, Pseudomonas putida KT2440
gcaacaccagcag

SEQ ID NO: 3575629 - RNA, 14 nt, Pseudomonas putida KT2440
gcaacaccagcagc

SEQ ID NO: 3575630 - RNA, 16 nt, Pseudomonas putida KT2440
gcaacaccagcagcca

SEQ ID NO: 3575631 - RNA, 16 nt, Pseudomonas putida KT2440
gcaacaccgccagaaa

SEQ ID NO: 3575632 - RNA, 23 nt, Pseudomonas putida KT2440
gcaacaccgccagcgggcuggca

SEQ ID NO: 3575633 - RNA, 15 nt, Pseudomonas putida KT2440
gcaacaccggucagg

SEQ ID NO: 3575634 - RNA, 16 nt, Pseudomonas putida KT2440
gcaacaccugccgcag

SEQ ID NO: 3575635 - RNA, 18 nt, Pseudomonas putida KT2440
gcaacacgcagucgaacu

SEQ ID NO: 3575636 - RNA, 20 nt, Pseudomonas putida KT2440
gcaacacgcagucgaacuug

SEQ ID NO: 3575637 - RNA, 13 nt, Pseudomonas putida KT2440
gcaacacuucagg

SEQ ID NO: 3575638 - RNA, 19 nt, Pseudomonas putida KT2440
gcaacagaaaaugcccgcu

SEQ ID NO: 3575639 - RNA, 21 nt, Pseudomonas putida KT2440
gcaacagcaaggcaucggcgc

SEQ ID NO: 3575640 - RNA, 17 nt, Pseudomonas putida KT2440
gcaacagccccaucacc

SEQ ID NO: 3575641 - RNA, 20 nt, Pseudomonas putida KT2440
gcaacagcucaacccgccug

SEQ ID NO: 3575642 - RNA, 16 nt, Pseudomonas putida KT2440
gcaacagcuccagcaa

SEQ ID NO: 3575643 - RNA, 19 nt, Pseudomonas putida KT2440
gcaacagggcgcuugcccg

SEQ ID NO: 3575644 - RNA, 17 nt, Pseudomonas putida KT2440
gcaacaguuucuugccu

SEQ ID NO: 3575645 - RNA, 21 nt, Pseudomonas putida KT2440
gcaacaguuucuugccuucca

SEQ ID NO: 3575646 - RNA, 20 nt, Pseudomonas putida KT2440
gcaacaguuuucaaugcugc

SEQ ID NO: 3575647 - RNA, 21 nt, Pseudomonas putida KT2440
gcaacaguuuucaaugcugcu

SEQ ID NO: 3575648 - RNA, 20 nt, Pseudomonas putida KT2440
gcaacauaaggugcaaagcg

SEQ ID NO: 3575649 - RNA, 12 nt, Pseudomonas putida KT2440
gcaacaucgccc

SEQ ID NO: 3575650 - RNA, 16 nt, Pseudomonas putida KT2440
gcaacaucgcccccgc

SEQ ID NO: 3575651 - RNA, 20 nt, Pseudomonas putida KT2440
gcaacaugccggcccaaggc

SEQ ID NO: 3575652 - RNA, 17 nt, Pseudomonas putida KT2440
gcaacauucaccagcca

SEQ ID NO: 3575653 - RNA, 18 nt, Pseudomonas putida KT2440
gcaacauucaccagccag

SEQ ID NO: 3575654 - RNA, 21 nt, Pseudomonas putida KT2440
gcaacauucaccagccaggca

SEQ ID NO: 3575655 - RNA, 12 nt, Pseudomonas putida KT2440
gcaaccacgcuu

SEQ ID NO: 3575656 - RNA, 18 nt, Pseudomonas putida KT2440
gcaaccacgcuuggcuca

SEQ ID NO: 3575657 - RNA, 16 nt, Pseudomonas putida KT2440
gcaaccaggcgccgag

SEQ ID NO: 3575658 - RNA, 17 nt, Pseudomonas putida KT2440
gcaaccaggcgccgagc

SEQ ID NO: 3575659 - RNA, 15 nt, Pseudomonas putida KT2440
gcaaccauggcuucg

SEQ ID NO: 3575660 - RNA, 11 nt, Pseudomonas putida KT2440
gcaacccagcc

SEQ ID NO: 3575661 - RNA, 12 nt, Pseudomonas putida KT2440
gcaacccgcauu

SEQ ID NO: 3575662 - RNA, 14 nt, Pseudomonas putida KT2440
gcaacccggccuug

SEQ ID NO: 3575663 - RNA, 20 nt, Pseudomonas putida KT2440
gcaacccuucggccagcagu

SEQ ID NO: 3575664 - RNA, 20 nt, Pseudomonas putida KT2440
gcaaccgauagcgugaagcg

SEQ ID NO: 3575665 - RNA, 16 nt, Pseudomonas putida KT2440
gcaaccgaugcccagg

SEQ ID NO: 3575666 - RNA, 17 nt, Pseudomonas putida KT2440
gcaaccgaugcccaggc

SEQ ID NO: 3575667 - RNA, 15 nt, Pseudomonas putida KT2440
gcaaccgcauccccg

SEQ ID NO: 3575668 - RNA, 16 nt, Pseudomonas putida KT2440
gcaaccgcauccccug

SEQ ID NO: 3575669 - RNA, 18 nt, Pseudomonas putida KT2440
gcaaccggacggguuucg

SEQ ID NO: 3575670 - RNA, 15 nt, Pseudomonas putida KT2440
gcaaccgggucggcg

SEQ ID NO: 3575671 - RNA, 21 nt, Pseudomonas putida KT2440
gcaaccgggucggcgccaggc

SEQ ID NO: 3575672 - RNA, 22 nt, Pseudomonas putida KT2440
gcaaccgggucggcgccaggcc

SEQ ID NO: 3575673 - RNA, 15 nt, Pseudomonas putida KT2440
gcaaccugcucgcuc

SEQ ID NO: 3575674 - RNA, 13 nt, Pseudomonas putida KT2440
gcaacgacaaggu

SEQ ID NO: 3575675 - RNA, 14 nt, Pseudomonas putida KT2440
gcaacgacaaggua

SEQ ID NO: 3575676 - RNA, 18 nt, Pseudomonas putida KT2440
gcaacgauugggcggcag

SEQ ID NO: 3575677 - RNA, 17 nt, Pseudomonas putida KT2440
gcaacgcagcgcgugcu

SEQ ID NO: 3575678 - RNA, 15 nt, Pseudomonas putida KT2440
gcaacgccacacugu

SEQ ID NO: 3575679 - RNA, 12 nt, Pseudomonas putida KT2440
gcaacgccacca

SEQ ID NO: 3575680 - RNA, 21 nt, Pseudomonas putida KT2440
gcaacgccaccaguuccaccg

SEQ ID NO: 3575681 - RNA, 20 nt, Pseudomonas putida KT2440
gcaacgccuuggccugcggg

SEQ ID NO: 3575682 - RNA, 16 nt, Pseudomonas putida KT2440
gcaacgcgccauggcc

SEQ ID NO: 3575683 - RNA, 15 nt, Pseudomonas putida KT2440
gcaacgcggcccugg

SEQ ID NO: 3575684 - RNA, 20 nt, Pseudomonas putida KT2440
gcaacggacgucccagcagg

SEQ ID NO: 3575685 - RNA, 21 nt, Pseudomonas putida KT2440
gcaacggcacacgcaccaccc

SEQ ID NO: 3575686 - RNA, 16 nt, Pseudomonas putida KT2440
gcaacggccacgcugc

SEQ ID NO: 3575687 - RNA, 19 nt, Pseudomonas putida KT2440
gcaacggccacgcugcggc

SEQ ID NO: 3575688 - RNA, 17 nt, Pseudomonas putida KT2440
gcaacggugaacggcgg

SEQ ID NO: 3575689 - RNA, 17 nt, Pseudomonas putida KT2440
gcaacgguuuaccgccg

SEQ ID NO: 3575690 - RNA, 17 nt, Pseudomonas putida KT2440
gcaacguucaccgucga

SEQ ID NO: 3575691 - RNA, 16 nt, Pseudomonas putida KT2440
gcaacuccuccagccg

SEQ ID NO: 3575692 - RNA, 17 nt, Pseudomonas putida KT2440
gcaacuccucgaucacc

SEQ ID NO: 3575693 - RNA, 15 nt, Pseudomonas putida KT2440
gcaacucggccuugu

SEQ ID NO: 3575694 - RNA, 13 nt, Pseudomonas putida KT2440
gcaacugcgcgau

SEQ ID NO: 3575695 - RNA, 18 nt, Pseudomonas putida KT2440
gcaacugcggccccugga

SEQ ID NO: 3575696 - RNA, 13 nt, Pseudomonas putida KT2440
gcaacuggcacaa

SEQ ID NO: 3575697 - RNA, 18 nt, Pseudomonas putida KT2440
gcaacuggcaucggucac

SEQ ID NO: 3575698 - RNA, 15 nt, Pseudomonas putida KT2440
gcaacuggcccgcgc

SEQ ID NO: 3575699 - RNA, 22 nt, Pseudomonas putida KT2440
gcaacuggcccgcgccaggcug

SEQ ID NO: 3575700 - RNA, 15 nt, Pseudomonas putida KT2440
gcaacuggcgcaggc

SEQ ID NO: 3575701 - RNA, 18 nt, Pseudomonas putida KT2440
gcaacugguucuccaggu

SEQ ID NO: 3575702 - RNA, 19 nt, Pseudomonas putida KT2440
gcaacugguucuccagguu

SEQ ID NO: 3575703 - RNA, 20 nt, Pseudomonas putida KT2440
gcaacuguuggaauggcgca

SEQ ID NO: 3575704 - RNA, 23 nt, Pseudomonas putida KT2440
gcaacuguuggaauggcgcaccg

SEQ ID NO: 3575705 - RNA, 20 nt, Pseudomonas putida KT2440
gcaacuucucggucgccaac

SEQ ID NO: 3575706 - RNA, 20 nt, Pseudomonas putida KT2440
gcaacuugcgggucagcagc

SEQ ID NO: 3575707 - RNA, 14 nt, Pseudomonas putida KT2440
gcaagaaggcugcc

SEQ ID NO: 3575708 - RNA, 17 nt, Pseudomonas putida KT2440
gcaagaugucaucaaua

SEQ ID NO: 3575709 - RNA, 16 nt, Pseudomonas putida KT2440
gcaagcaaacgccaga

SEQ ID NO: 3575710 - RNA, 19 nt, Pseudomonas putida KT2440
gcaagcaggugcgcaggcu

SEQ ID NO: 3575711 - RNA, 21 nt, Pseudomonas putida KT2440
gcaagccaaugguauugcccg

SEQ ID NO: 3575712 - RNA, 17 nt, Pseudomonas putida KT2440
gcaagcccauggcuggc

SEQ ID NO: 3575713 - RNA, 19 nt, Pseudomonas putida KT2440
gcaagcccgcgaagaggcc

SEQ ID NO: 3575714 - RNA, 22 nt, Pseudomonas putida KT2440
gcaagcccgcgaagaggccagg

SEQ ID NO: 3575715 - RNA, 23 nt, Pseudomonas putida KT2440
gcaagcccgcgaagaggccagga

SEQ ID NO: 3575716 - RNA, 17 nt, Pseudomonas putida KT2440
gcaagcccgcucccaca

SEQ ID NO: 3575717 - RNA, 20 nt, Pseudomonas putida KT2440
gcaagcccgcucccacaggg

SEQ ID NO: 3575718 - RNA, 18 nt, Pseudomonas putida KT2440
gcaagcccgcuccuacag

SEQ ID NO: 3575719 - RNA, 20 nt, Pseudomonas putida KT2440
gcaagcccgcuccuacaggu

SEQ ID NO: 3575720 - RNA, 22 nt, Pseudomonas putida KT2440
gcaagcccgcuccuacagguuc

SEQ ID NO: 3575721 - RNA, 17 nt, Pseudomonas putida KT2440
gcaagccgccgaccagg

SEQ ID NO: 3575722 - RNA, 18 nt, Pseudomonas putida KT2440
gcaagccgccgaccaggu

SEQ ID NO: 3575723 - RNA, 17 nt, Pseudomonas putida KT2440
gcaagccggcgaacagc

SEQ ID NO: 3575724 - RNA, 14 nt, Pseudomonas putida KT2440
gcaagccgugccug

SEQ ID NO: 3575725 - RNA, 23 nt, Pseudomonas putida KT2440
gcaagccuucgucgcuggccagc

SEQ ID NO: 3575726 - RNA, 18 nt, Pseudomonas putida KT2440
gcaagccuugugggagcg

SEQ ID NO: 3575727 - RNA, 16 nt, Pseudomonas putida KT2440
gcaagccuuugcgccu

SEQ ID NO: 3575728 - RNA, 11 nt, Pseudomonas putida KT2440
gcaagcgccga

SEQ ID NO: 3575729 - RNA, 16 nt, Pseudomonas putida KT2440
gcaagcgcgcgcccac

SEQ ID NO: 3575730 - RNA, 21 nt, Pseudomonas putida KT2440
gcaagcgcucaaaaugcuuuu

SEQ ID NO: 3575731 - RNA, 18 nt, Pseudomonas putida KT2440
gcaagcggcucucgaagu

SEQ ID NO: 3575732 - RNA, 15 nt, Pseudomonas putida KT2440
gcaagcucaucacca

SEQ ID NO: 3575733 - RNA, 16 nt, Pseudomonas putida KT2440
gcaagcucaucaccag

SEQ ID NO: 3575734 - RNA, 20 nt, Pseudomonas putida KT2440
gcaagcugcaccgccacccc

SEQ ID NO: 3575735 - RNA, 20 nt, Pseudomonas putida KT2440
gcaagcuggcgcaagccgug

SEQ ID NO: 3575736 - RNA, 13 nt, Pseudomonas putida KT2440
gcaagcuggucag

SEQ ID NO: 3575737 - RNA, 14 nt, Pseudomonas putida KT2440
gcaaggaucaccaa

SEQ ID NO: 3575738 - RNA, 21 nt, Pseudomonas putida KT2440
gcaaggcaaugcccauggcca

SEQ ID NO: 3575739 - RNA, 23 nt, Pseudomonas putida KT2440
gcaaggcaaugcccauggccagg

SEQ ID NO: 3575740 - RNA, 16 nt, Pseudomonas putida KT2440
gcaaggcauccagaaa

SEQ ID NO: 3575741 - RNA, 15 nt, Pseudomonas putida KT2440
gcaaggccagcggaa

SEQ ID NO: 3575742 - RNA, 23 nt, Pseudomonas putida KT2440
gcaaggccgcggcugaacacgcu

SEQ ID NO: 3575743 - RNA, 20 nt, Pseudomonas putida KT2440
gcaaggccguucccacaaag

SEQ ID NO: 3575744 - RNA, 16 nt, Pseudomonas putida KT2440
gcaaggcggcccaacg

SEQ ID NO: 3575745 - RNA, 15 nt, Pseudomonas putida KT2440
gcaaggcguaccggc

SEQ ID NO: 3575746 - RNA, 20 nt, Pseudomonas putida KT2440
gcaaggcguaccggcaaccc

SEQ ID NO: 3575747 - RNA, 16 nt, Pseudomonas putida KT2440
gcaagggccugcaggc

SEQ ID NO: 3575748 - RNA, 16 nt, Pseudomonas putida KT2440
gcaagggccugugccg

SEQ ID NO: 3575749 - RNA, 17 nt, Pseudomonas putida KT2440
gcaagggcgaaccaggu

SEQ ID NO: 3575750 - RNA, 18 nt, Pseudomonas putida KT2440
gcaagggcgaaccaggug

SEQ ID NO: 3575751 - RNA, 23 nt, Pseudomonas putida KT2440
gcaagguagccugcugacgcagg

SEQ ID NO: 3575752 - RNA, 15 nt, Pseudomonas putida KT2440
gcaaggucaacggca

SEQ ID NO: 3575753 - RNA, 14 nt, Pseudomonas putida KT2440
gcaagguccuugua

SEQ ID NO: 3575754 - RNA, 20 nt, Pseudomonas putida KT2440
gcaaggugggguugaccagg

SEQ ID NO: 3575755 - RNA, 17 nt, Pseudomonas putida KT2440
gcaagucccccaucggc

SEQ ID NO: 3575756 - RNA, 21 nt, Pseudomonas putida KT2440
gcaauaaaaaaccccggcaca

SEQ ID NO: 3575757 - RNA, 16 nt, Pseudomonas putida KT2440
gcaauaaccaaucaac

SEQ ID NO: 3575758 - RNA, 17 nt, Pseudomonas putida KT2440
gcaauaaccaaucaacg

SEQ ID NO: 3575759 - RNA, 23 nt, Pseudomonas putida KT2440
gcaauacaacgaucagcgccgaa

SEQ ID NO: 3575760 - RNA, 17 nt, Pseudomonas putida KT2440
gcaauaccgauggcccc

SEQ ID NO: 3575761 - RNA, 15 nt, Pseudomonas putida KT2440
gcaauaccggccacg

SEQ ID NO: 3575762 - RNA, 16 nt, Pseudomonas putida KT2440
gcaauaugggucgacu

SEQ ID NO: 3575763 - RNA, 18 nt, Pseudomonas putida KT2440
gcaaucacccgcaggguc

SEQ ID NO: 3575764 - RNA, 14 nt, Pseudomonas putida KT2440
gcaaucaccgccag

SEQ ID NO: 3575765 - RNA, 21 nt, Pseudomonas putida KT2440
gcaaucacgaacaccagcccc

SEQ ID NO: 3575766 - RNA, 20 nt, Pseudomonas putida KT2440
gcaaucagcucacaggcuca

SEQ ID NO: 3575767 - RNA, 20 nt, Pseudomonas putida KT2440
gcaaucaggcugaucaccgc

SEQ ID NO: 3575768 - RNA, 15 nt, Pseudomonas putida KT2440
gcaaucaggucaucg

SEQ ID NO: 3575769 - RNA, 23 nt, Pseudomonas putida KT2440
gcaaucaguaagauacgcgcaga

SEQ ID NO: 3575770 - RNA, 17 nt, Pseudomonas putida KT2440
gcaauccagcgugaccu

SEQ ID NO: 3575771 - RNA, 15 nt, Pseudomonas putida KT2440
gcaauccccuccgcc

SEQ ID NO: 3575772 - RNA, 22 nt, Pseudomonas putida KT2440
gcaauccgcuugacgaucgcca

SEQ ID NO: 3575773 - RNA, 18 nt, Pseudomonas putida KT2440
gcaauccuuggcgcacuu

SEQ ID NO: 3575774 - RNA, 23 nt, Pseudomonas putida KT2440
gcaaucgagccgaacagcaggca

SEQ ID NO: 3575775 - RNA, 14 nt, Pseudomonas putida KT2440
gcaaucgccaaggu

SEQ ID NO: 3575776 - RNA, 13 nt, Pseudomonas putida KT2440
gcaaucgccaggc

SEQ ID NO: 3575777 - RNA, 23 nt, Pseudomonas putida KT2440
gcaaucgccaggcgcaccgccgg

SEQ ID NO: 3575778 - RNA, 16 nt, Pseudomonas putida KT2440
gcaaucgcgauauauu

SEQ ID NO: 3575779 - RNA, 17 nt, Pseudomonas putida KT2440
gcaaucggcagcgcgca

SEQ ID NO: 3575780 - RNA, 21 nt, Pseudomonas putida KT2440
gcaaucggcaggccggccacc

SEQ ID NO: 3575781 - RNA, 16 nt, Pseudomonas putida KT2440
gcaaucgggauggcac

SEQ ID NO: 3575782 - RNA, 14 nt, Pseudomonas putida KT2440
gcaaucgucgguga

SEQ ID NO: 3575783 - RNA, 15 nt, Pseudomonas putida KT2440
gcaaucugcagcagc

SEQ ID NO: 3575784 - RNA, 12 nt, Pseudomonas putida KT2440
gcaaucugcugg

SEQ ID NO: 3575785 - RNA, 16 nt, Pseudomonas putida KT2440
gcaaucuucuugccgg

SEQ ID NO: 3575786 - RNA, 17 nt, Pseudomonas putida KT2440
gcaaucuucuugccggu

SEQ ID NO: 3575787 - RNA, 14 nt, Pseudomonas putida KT2440
gcaaucuugccacg

SEQ ID NO: 3575788 - RNA, 15 nt, Pseudomonas putida KT2440
gcaaugaaaaagccc

SEQ ID NO: 3575789 - RNA, 19 nt, Pseudomonas putida KT2440
gcaaugaccaagcaacgca

SEQ ID NO: 3575790 - RNA, 16 nt, Pseudomonas putida KT2440
gcaaugauggcaauca

SEQ ID NO: 3575791 - RNA, 21 nt, Pseudomonas putida KT2440
gcaaugauggcaaucacgaac

SEQ ID NO: 3575792 - RNA, 21 nt, Pseudomonas putida KT2440
gcaaugauugcugccggaccu

SEQ ID NO: 3575793 - RNA, 15 nt, Pseudomonas putida KT2440
gcaaugcaggcagua

SEQ ID NO: 3575794 - RNA, 18 nt, Pseudomonas putida KT2440
gcaaugcaggcaguaggc

SEQ ID NO: 3575795 - RNA, 20 nt, Pseudomonas putida KT2440
gcaaugcccgcucgcugcga

SEQ ID NO: 3575796 - RNA, 16 nt, Pseudomonas putida KT2440
gcaaugccgaacaguc

SEQ ID NO: 3575797 - RNA, 21 nt, Pseudomonas putida KT2440
gcaaugcggugugcugcggcc

SEQ ID NO: 3575798 - RNA, 23 nt, Pseudomonas putida KT2440
gcaauggccacacgcugcugcug

SEQ ID NO: 3575799 - RNA, 12 nt, Pseudomonas putida KT2440
gcaauggccggg

SEQ ID NO: 3575800 - RNA, 17 nt, Pseudomonas putida KT2440
gcaauggcgcgaacagg

SEQ ID NO: 3575801 - RNA, 13 nt, Pseudomonas putida KT2440
gcaaugggcacaa

SEQ ID NO: 3575802 - RNA, 15 nt, Pseudomonas putida KT2440
gcaaugggcacaauu

SEQ ID NO: 3575803 - RNA, 18 nt, Pseudomonas putida KT2440
gcaaugucagcggcauca

SEQ ID NO: 3575804 - RNA, 13 nt, Pseudomonas putida KT2440
gcaauguccagcc

SEQ ID NO: 3575805 - RNA, 15 nt, Pseudomonas putida KT2440
gcaauguccagcccg

SEQ ID NO: 3575806 - RNA, 14 nt, Pseudomonas putida KT2440
gcaauguucgcugc

SEQ ID NO: 3575807 - RNA, 22 nt, Pseudomonas putida KT2440
gcaauguucgcugccagcguuu

SEQ ID NO: 3575808 - RNA, 21 nt, Pseudomonas putida KT2440
gcaauguugaagaugacuggc

SEQ ID NO: 3575809 - RNA, 17 nt, Pseudomonas putida KT2440
gcaauguuuucauaccg

SEQ ID NO: 3575810 - RNA, 14 nt, Pseudomonas putida KT2440
gcaauucgccggca

SEQ ID NO: 3575811 - RNA, 16 nt, Pseudomonas putida KT2440
gcaauugcacccgcgg

SEQ ID NO: 3575812 - RNA, 16 nt, Pseudomonas putida KT2440
gcaauugcgagguacc

SEQ ID NO: 3575813 - RNA, 22 nt, Pseudomonas putida KT2440
gcaauuucauccacauaggcca

SEQ ID NO: 3575814 - RNA, 15 nt, Pseudomonas putida KT2440
gcacaaccacugcaa

SEQ ID NO: 3575815 - RNA, 19 nt, Pseudomonas putida KT2440
gcacaacccuaucagggcu

SEQ ID NO: 3575816 - RNA, 19 nt, Pseudomonas putida KT2440
gcacaaccgaacccgcugc

SEQ ID NO: 3575817 - RNA, 21 nt, Pseudomonas putida KT2440
gcacaaccgaacccgcugcca

SEQ ID NO: 3575818 - RNA, 17 nt, Pseudomonas putida KT2440
gcacaacgcgcgggcaa

SEQ ID NO: 3575819 - RNA, 14 nt, Pseudomonas putida KT2440
gcacaagacugcug

SEQ ID NO: 3575820 - RNA, 16 nt, Pseudomonas putida KT2440
gcacaagcugcugaua

SEQ ID NO: 3575821 - RNA, 17 nt, Pseudomonas putida KT2440
gcacaaggccgcuccca

SEQ ID NO: 3575822 - RNA, 18 nt, Pseudomonas putida KT2440
gcacaaggccgcucccac

SEQ ID NO: 3575823 - RNA, 19 nt, Pseudomonas putida KT2440
gcacaaggccgcucccaca

SEQ ID NO: 3575824 - RNA, 22 nt, Pseudomonas putida KT2440
gcacaaggcggcucuugcagcg

SEQ ID NO: 3575825 - RNA, 23 nt, Pseudomonas putida KT2440
gcacaaggcggcucuugcagcga

SEQ ID NO: 3575826 - RNA, 14 nt, Pseudomonas putida KT2440
gcacaaggcugcgc

SEQ ID NO: 3575827 - RNA, 12 nt, Pseudomonas putida KT2440
gcacaaggcugu

SEQ ID NO: 3575828 - RNA, 18 nt, Pseudomonas putida KT2440
gcacaaggcuguuccaca

SEQ ID NO: 3575829 - RNA, 21 nt, Pseudomonas putida KT2440
gcacaaggcuguuccacagca

SEQ ID NO: 3575830 - RNA, 23 nt, Pseudomonas putida KT2440
gcacaaucagcucgucagccacc

SEQ ID NO: 3575831 - RNA, 15 nt, Pseudomonas putida KT2440
gcacaccacgccaac

SEQ ID NO: 3575832 - RNA, 19 nt, Pseudomonas putida KT2440
gcacacccagcacgaaggc

SEQ ID NO: 3575833 - RNA, 21 nt, Pseudomonas putida KT2440
gcacacccagcacgaaggcca

SEQ ID NO: 3575834 - RNA, 21 nt, Pseudomonas putida KT2440
gcacacccugucgaucacggg

SEQ ID NO: 3575835 - RNA, 14 nt, Pseudomonas putida KT2440
gcacaccgcuggug

SEQ ID NO: 3575836 - RNA, 21 nt, Pseudomonas putida KT2440
gcacaccgcugguggcguggc

SEQ ID NO: 3575837 - RNA, 16 nt, Pseudomonas putida KT2440
gcacaccuugggccca

SEQ ID NO: 3575838 - RNA, 13 nt, Pseudomonas putida KT2440
gcacacgaccuug

SEQ ID NO: 3575839 - RNA, 22 nt, Pseudomonas putida KT2440
gcacacgaccuuggacgcuggc

SEQ ID NO: 3575840 - RNA, 23 nt, Pseudomonas putida KT2440
gcacacgaccuuggacgcuggca

SEQ ID NO: 3575841 - RNA, 21 nt, Pseudomonas putida KT2440
gcacacgcaccaccccggggc

SEQ ID NO: 3575842 - RNA, 18 nt, Pseudomonas putida KT2440
gcacacgguaguccugcc

SEQ ID NO: 3575843 - RNA, 18 nt, Pseudomonas putida KT2440
gcacacgguuuccaggcg

SEQ ID NO: 3575844 - RNA, 18 nt, Pseudomonas putida KT2440
gcacacgucgccugggca

SEQ ID NO: 3575845 - RNA, 20 nt, Pseudomonas putida KT2440
gcacacugagcaccacauac

SEQ ID NO: 3575846 - RNA, 15 nt, Pseudomonas putida KT2440
gcacacugcccagca

SEQ ID NO: 3575847 - RNA, 18 nt, Pseudomonas putida KT2440
gcacacugcccagcagcc

SEQ ID NO: 3575848 - RNA, 12 nt, Pseudomonas putida KT2440
gcacagaacaau

SEQ ID NO: 3575849 - RNA, 15 nt, Pseudomonas putida KT2440
gcacagaccgcaaca

SEQ ID NO: 3575850 - RNA, 17 nt, Pseudomonas putida KT2440
gcacagcaucagcacac

SEQ ID NO: 3575851 - RNA, 15 nt, Pseudomonas putida KT2440
gcacagcgcggaaca

SEQ ID NO: 3575852 - RNA, 14 nt, Pseudomonas putida KT2440
gcacagcgcucgau

SEQ ID NO: 3575853 - RNA, 22 nt, Pseudomonas putida KT2440
gcacagcucccucguaggagcg

SEQ ID NO: 3575854 - RNA, 18 nt, Pseudomonas putida KT2440
gcacagcucgaugccuuu

SEQ ID NO: 3575855 - RNA, 21 nt, Pseudomonas putida KT2440
gcacagcucgcgcugccaggc

SEQ ID NO: 3575856 - RNA, 17 nt, Pseudomonas putida KT2440
gcacagcugccggccag

SEQ ID NO: 3575857 - RNA, 18 nt, Pseudomonas putida KT2440
gcacaggcauaccgcaac

SEQ ID NO: 3575858 - RNA, 15 nt, Pseudomonas putida KT2440
gcacaggccagccag

SEQ ID NO: 3575859 - RNA, 16 nt, Pseudomonas putida KT2440
gcacaggccagcccca

SEQ ID NO: 3575860 - RNA, 18 nt, Pseudomonas putida KT2440
gcacaggccagccccagc

SEQ ID NO: 3575861 - RNA, 13 nt, Pseudomonas putida KT2440
gcacaggcccaaa

SEQ ID NO: 3575862 - RNA, 13 nt, Pseudomonas putida KT2440
gcacaggcccagc

SEQ ID NO: 3575863 - RNA, 22 nt, Pseudomonas putida KT2440
gcacaggcccagcaugaacgca

SEQ ID NO: 3575864 - RNA, 15 nt, Pseudomonas putida KT2440
gcacaggccgcgcau

SEQ ID NO: 3575865 - RNA, 13 nt, Pseudomonas putida KT2440
gcacaggcgcagc

SEQ ID NO: 3575866 - RNA, 17 nt, Pseudomonas putida KT2440
gcacaggcuacgcagca

SEQ ID NO: 3575867 - RNA, 14 nt, Pseudomonas putida KT2440
gcacaggcuggcca

SEQ ID NO: 3575868 - RNA, 16 nt, Pseudomonas putida KT2440
gcacaggcuggccacc

SEQ ID NO: 3575869 - RNA, 23 nt, Pseudomonas putida KT2440
gcacagggcgaugcccuucaggc

SEQ ID NO: 3575870 - RNA, 21 nt, Pseudomonas putida KT2440
gcacagggucaggucaaagcg

SEQ ID NO: 3575871 - RNA, 19 nt, Pseudomonas putida KT2440
gcacagguaucgccgcccu

SEQ ID NO: 3575872 - RNA, 15 nt, Pseudomonas putida KT2440
gcacagguccagccg

SEQ ID NO: 3575873 - RNA, 16 nt, Pseudomonas putida KT2440
gcacagguccagccgc

SEQ ID NO: 3575874 - RNA, 16 nt, Pseudomonas putida KT2440
gcacagugccaaggac

SEQ ID NO: 3575875 - RNA, 15 nt, Pseudomonas putida KT2440
gcacagugcggcggc

SEQ ID NO: 3575876 - RNA, 20 nt, Pseudomonas putida KT2440
gcacagugguguacagcaac

SEQ ID NO: 3575877 - RNA, 22 nt, Pseudomonas putida KT2440
gcacauacaaaaugugccggcu

SEQ ID NO: 3575878 - RNA, 17 nt, Pseudomonas putida KT2440
gcacauagaccauuucg

SEQ ID NO: 3575879 - RNA, 15 nt, Pseudomonas putida KT2440
gcacaucaccagcag

SEQ ID NO: 3575880 - RNA, 16 nt, Pseudomonas putida KT2440
gcacaucaccagcagc

SEQ ID NO: 3575881 - RNA, 18 nt, Pseudomonas putida KT2440
gcacaucacggcgcaggc

SEQ ID NO: 3575882 - RNA, 17 nt, Pseudomonas putida KT2440
gcacauccacauuaccg

SEQ ID NO: 3575883 - RNA, 16 nt, Pseudomonas putida KT2440
gcacaucccgucagcc

SEQ ID NO: 3575884 - RNA, 14 nt, Pseudomonas putida KT2440
gcacaucggccacc

SEQ ID NO: 3575885 - RNA, 23 nt, Pseudomonas putida KT2440
gcacaucguccgccgcgcugacc

SEQ ID NO: 3575886 - RNA, 17 nt, Pseudomonas putida KT2440
gcacaugccugcacugg

SEQ ID NO: 3575887 - RNA, 15 nt, Pseudomonas putida KT2440
gcacauucagcagcg

SEQ ID NO: 3575888 - RNA, 17 nt, Pseudomonas putida KT2440
gcacauucagcagcgcc

SEQ ID NO: 3575889 - RNA, 18 nt, Pseudomonas putida KT2440
gcacauuucacagcaaaa

SEQ ID NO: 3575890 - RNA, 11 nt, Pseudomonas putida KT2440
gcaccaaacac

SEQ ID NO: 3575891 - RNA, 16 nt, Pseudomonas putida KT2440
gcaccaacacuuccag

SEQ ID NO: 3575892 - RNA, 13 nt, Pseudomonas putida KT2440
gcaccaacgccga

SEQ ID NO: 3575893 - RNA, 16 nt, Pseudomonas putida KT2440
gcaccaacugcacccg

SEQ ID NO: 3575894 - RNA, 15 nt, Pseudomonas putida KT2440
gcaccaacuggucgg

SEQ ID NO: 3575895 - RNA, 23 nt, Pseudomonas putida KT2440
gcaccaaucgagauguaguccac

SEQ ID NO: 3575896 - RNA, 12 nt, Pseudomonas putida KT2440
gcaccaaugacu

SEQ ID NO: 3575897 - RNA, 20 nt, Pseudomonas putida KT2440
gcaccaaugacuccgcccca

SEQ ID NO: 3575898 - RNA, 20 nt, Pseudomonas putida KT2440
gcaccacaagaacugcgacg

SEQ ID NO: 3575899 - RNA, 17 nt, Pseudomonas putida KT2440
gcaccacauacggcgca

SEQ ID NO: 3575900 - RNA, 22 nt, Pseudomonas putida KT2440
gcaccaccagggcgcgcuggcg

SEQ ID NO: 3575901 - RNA, 17 nt, Pseudomonas putida KT2440
gcaccacccaccagcag

SEQ ID NO: 3575902 - RNA, 18 nt, Pseudomonas putida KT2440
gcaccacccaccagcagu

SEQ ID NO: 3575903 - RNA, 20 nt, Pseudomonas putida KT2440
gcaccacccccagcgccucc

SEQ ID NO: 3575904 - RNA, 22 nt, Pseudomonas putida KT2440
gcaccaccccggggcgcuccag

SEQ ID NO: 3575905 - RNA, 15 nt, Pseudomonas putida KT2440
gcaccaccugaugca

SEQ ID NO: 3575906 - RNA, 14 nt, Pseudomonas putida KT2440
gcaccacgaucacg

SEQ ID NO: 3575907 - RNA, 13 nt, Pseudomonas putida KT2440
gcaccacgccacc

SEQ ID NO: 3575908 - RNA, 18 nt, Pseudomonas putida KT2440
gcaccacgccaccaugcu

SEQ ID NO: 3575909 - RNA, 15 nt, Pseudomonas putida KT2440
gcaccacggaaggcc

SEQ ID NO: 3575910 - RNA, 16 nt, Pseudomonas putida KT2440
gcaccacggaaggcca

SEQ ID NO: 3575911 - RNA, 17 nt, Pseudomonas putida KT2440
gcaccacggaaggccac

SEQ ID NO: 3575912 - RNA, 13 nt, Pseudomonas putida KT2440
gcaccacggcggc

SEQ ID NO: 3575913 - RNA, 19 nt, Pseudomonas putida KT2440
gcaccacggcggcgaucag

SEQ ID NO: 3575914 - RNA, 15 nt, Pseudomonas putida KT2440
gcaccacguccggcc

SEQ ID NO: 3575915 - RNA, 19 nt, Pseudomonas putida KT2440
gcaccacguccggccagca

SEQ ID NO: 3575916 - RNA, 20 nt, Pseudomonas putida KT2440
gcaccacguccggccagcaa

SEQ ID NO: 3575917 - RNA, 21 nt, Pseudomonas putida KT2440
gcaccacguccggccagcaac

SEQ ID NO: 3575918 - RNA, 17 nt, Pseudomonas putida KT2440
gcaccagaccagcagca

SEQ ID NO: 3575919 - RNA, 18 nt, Pseudomonas putida KT2440
gcaccagaccagcagcag

SEQ ID NO: 3575920 - RNA, 17 nt, Pseudomonas putida KT2440
gcaccagauucaagccc

SEQ ID NO: 3575921 - RNA, 16 nt, Pseudomonas putida KT2440
gcaccagcaccaccgg

SEQ ID NO: 3575922 - RNA, 18 nt, Pseudomonas putida KT2440
gcaccagcaccagcuccu

SEQ ID NO: 3575923 - RNA, 16 nt, Pseudomonas putida KT2440
gcaccagcggcuuggc

SEQ ID NO: 3575924 - RNA, 18 nt, Pseudomonas putida KT2440
gcaccaggcccagccggg

SEQ ID NO: 3575925 - RNA, 15 nt, Pseudomonas putida KT2440
gcaccagggcuggca

SEQ ID NO: 3575926 - RNA, 18 nt, Pseudomonas putida KT2440
gcaccagggcuggcagcg

SEQ ID NO: 3575927 - RNA, 22 nt, Pseudomonas putida KT2440
gcaccagggcuggcagcgggua

SEQ ID NO: 3575928 - RNA, 17 nt, Pseudomonas putida KT2440
gcaccagguccaccagc

SEQ ID NO: 3575929 - RNA, 19 nt, Pseudomonas putida KT2440
gcaccagguccagcguggc

SEQ ID NO: 3575930 - RNA, 15 nt, Pseudomonas putida KT2440
gcaccaggucgcggu

SEQ ID NO: 3575931 - RNA, 19 nt, Pseudomonas putida KT2440
gcaccagguuggccgccgc

SEQ ID NO: 3575932 - RNA, 21 nt, Pseudomonas putida KT2440
gcaccagguuggccgccgcca

SEQ ID NO: 3575933 - RNA, 20 nt, Pseudomonas putida KT2440
gcaccagguuugcugccuuc

SEQ ID NO: 3575934 - RNA, 13 nt, Pseudomonas putida KT2440
gcaccaguuccug

SEQ ID NO: 3575935 - RNA, 23 nt, Pseudomonas putida KT2440
gcaccaguugcaggucggcacgc

SEQ ID NO: 3575936 - RNA, 14 nt, Pseudomonas putida KT2440
gcaccaucagagcg

SEQ ID NO: 3575937 - RNA, 20 nt, Pseudomonas putida KT2440
gcaccaucagagcgccagca

SEQ ID NO: 3575938 - RNA, 22 nt, Pseudomonas putida KT2440
gcaccaucagagcgccagcaag

SEQ ID NO: 3575939 - RNA, 22 nt, Pseudomonas putida KT2440
gcaccaucaggcacaggccagc

SEQ ID NO: 3575940 - RNA, 14 nt, Pseudomonas putida KT2440
gcaccaucggcucc

SEQ ID NO: 3575941 - RNA, 19 nt, Pseudomonas putida KT2440
gcaccaucggcuccagcgc

SEQ ID NO: 3575942 - RNA, 20 nt, Pseudomonas putida KT2440
gcaccaucggcuccagcgca

SEQ ID NO: 3575943 - RNA, 19 nt, Pseudomonas putida KT2440
gcaccaugaacucuucccc

SEQ ID NO: 3575944 - RNA, 22 nt, Pseudomonas putida KT2440
gcaccaugaacucuuccccgcc

SEQ ID NO: 3575945 - RNA, 23 nt, Pseudomonas putida KT2440
gcaccaugaacucuuccccgccc

SEQ ID NO: 3575946 - RNA, 22 nt, Pseudomonas putida KT2440
gcaccaugauguucugcuugag

SEQ ID NO: 3575947 - RNA, 15 nt, Pseudomonas putida KT2440
gcacccaaccugccg

SEQ ID NO: 3575948 - RNA, 20 nt, Pseudomonas putida KT2440
gcacccaauagcccaccguc

SEQ ID NO: 3575949 - RNA, 22 nt, Pseudomonas putida KT2440
gcacccaauagcccaccgucag

SEQ ID NO: 3575950 - RNA, 23 nt, Pseudomonas putida KT2440
gcacccacagagacaccgcaggu

SEQ ID NO: 3575951 - RNA, 15 nt, Pseudomonas putida KT2440
gcacccacagcgccu

SEQ ID NO: 3575952 - RNA, 17 nt, Pseudomonas putida KT2440
gcacccaccgcagguca

SEQ ID NO: 3575953 - RNA, 14 nt, Pseudomonas putida KT2440
gcacccaggccacg

SEQ ID NO: 3575954 - RNA, 14 nt, Pseudomonas putida KT2440
gcacccaucggcgc

SEQ ID NO: 3575955 - RNA, 22 nt, Pseudomonas putida KT2440
gcacccaucggcgcgaagguca

SEQ ID NO: 3575956 - RNA, 14 nt, Pseudomonas putida KT2440
gcaccccagcacca

SEQ ID NO: 3575957 - RNA, 16 nt, Pseudomonas putida KT2440
gcaccccgaacgcggu

SEQ ID NO: 3575958 - RNA, 18 nt, Pseudomonas putida KT2440
gcaccccgaacgcgguaa

SEQ ID NO: 3575959 - RNA, 15 nt, Pseudomonas putida KT2440
gcaccccggccgcuu

SEQ ID NO: 3575960 - RNA, 15 nt, Pseudomonas putida KT2440
gcaccccugccacca

SEQ ID NO: 3575961 - RNA, 14 nt, Pseudomonas putida KT2440
gcaccccuuucucc

SEQ ID NO: 3575962 - RNA, 19 nt, Pseudomonas putida KT2440
gcaccccuuucuccagcaa

SEQ ID NO: 3575963 - RNA, 15 nt, Pseudomonas putida KT2440
gcacccgcaagcgcc

SEQ ID NO: 3575964 - RNA, 16 nt, Pseudomonas putida KT2440
gcacccgcaagcgccg

SEQ ID NO: 3575965 - RNA, 17 nt, Pseudomonas putida KT2440
gcacccgcaagcgccga

SEQ ID NO: 3575966 - RNA, 12 nt, Pseudomonas putida KT2440
gcacccgcacau

SEQ ID NO: 3575967 - RNA, 13 nt, Pseudomonas putida KT2440
gcacccgccagcc

SEQ ID NO: 3575968 - RNA, 16 nt, Pseudomonas putida KT2440
gcacccgccuccggcg

SEQ ID NO: 3575969 - RNA, 21 nt, Pseudomonas putida KT2440
gcacccgcgaguucaugguca

SEQ ID NO: 3575970 - RNA, 17 nt, Pseudomonas putida KT2440
gcacccgcuuggccacc

SEQ ID NO: 3575971 - RNA, 16 nt, Pseudomonas putida KT2440
gcacccggcggugacc

SEQ ID NO: 3575972 - RNA, 18 nt, Pseudomonas putida KT2440
gcacccggcuaccaaucu

SEQ ID NO: 3575973 - RNA, 16 nt, Pseudomonas putida KT2440
gcacccggcuggucga

SEQ ID NO: 3575974 - RNA, 17 nt, Pseudomonas putida KT2440
gcacccgugcagggcug

SEQ ID NO: 3575975 - RNA, 15 nt, Pseudomonas putida KT2440
gcacccgugccugcc

SEQ ID NO: 3575976 - RNA, 17 nt, Pseudomonas putida KT2440
gcacccgugccugccug

SEQ ID NO: 3575977 - RNA, 15 nt, Pseudomonas putida KT2440
gcacccucaccaacu

SEQ ID NO: 3575978 - RNA, 18 nt, Pseudomonas putida KT2440
gcacccuggcgguugacc

SEQ ID NO: 3575979 - RNA, 19 nt, Pseudomonas putida KT2440
gcaccgaaccggcgaucag

SEQ ID NO: 3575980 - RNA, 20 nt, Pseudomonas putida KT2440
gcaccgaaggccgccggcaa

SEQ ID NO: 3575981 - RNA, 23 nt, Pseudomonas putida KT2440
gcaccgagaugaucgcggcaauc

SEQ ID NO: 3575982 - RNA, 15 nt, Pseudomonas putida KT2440
gcaccgagucgccuu

SEQ ID NO: 3575983 - RNA, 17 nt, Pseudomonas putida KT2440
gcaccgagucgccuuca

SEQ ID NO: 3575984 - RNA, 23 nt, Pseudomonas putida KT2440
gcaccgagucgccuucacacagg

SEQ ID NO: 3575985 - RNA, 12 nt, Pseudomonas putida KT2440
gcaccgaucacc

SEQ ID NO: 3575986 - RNA, 21 nt, Pseudomonas putida KT2440
gcaccgaucagcggcgccacc

SEQ ID NO: 3575987 - RNA, 22 nt, Pseudomonas putida KT2440
gcaccgaugcggugcagcaccu

SEQ ID NO: 3575988 - RNA, 22 nt, Pseudomonas putida KT2440
gcaccgauucaaagccauaccg

SEQ ID NO: 3575989 - RNA, 16 nt, Pseudomonas putida KT2440
gcaccgcagccccagc

SEQ ID NO: 3575990 - RNA, 14 nt, Pseudomonas putida KT2440
gcaccgccaccaug

SEQ ID NO: 3575991 - RNA, 15 nt, Pseudomonas putida KT2440
gcaccgccagcucca

SEQ ID NO: 3575992 - RNA, 19 nt, Pseudomonas putida KT2440
gcaccgccgcccacgccgg

SEQ ID NO: 3575993 - RNA, 21 nt, Pseudomonas putida KT2440
gcaccgcggaugcgccuggcc

SEQ ID NO: 3575994 - RNA, 23 nt, Pseudomonas putida KT2440
gcaccgcggaugcgccuggcccg

SEQ ID NO: 3575995 - RNA, 19 nt, Pseudomonas putida KT2440
gcaccgcguaucaggcauc

SEQ ID NO: 3575996 - RNA, 17 nt, Pseudomonas putida KT2440
gcaccgcuaccauggcc

SEQ ID NO: 3575997 - RNA, 16 nt, Pseudomonas putida KT2440
gcaccgcucagugccg

SEQ ID NO: 3575998 - RNA, 23 nt, Pseudomonas putida KT2440
gcaccgcuccgacaaaugcacca

SEQ ID NO: 3575999 - RNA, 13 nt, Pseudomonas putida KT2440
gcaccgcugacca

SEQ ID NO: 3576000 - RNA, 13 nt, Pseudomonas putida KT2440
gcaccgcugccag

SEQ ID NO: 3576001 - RNA, 15 nt, Pseudomonas putida KT2440
gcaccgcugccagcu

SEQ ID NO: 3576002 - RNA, 17 nt, Pseudomonas putida KT2440
gcaccgcugccagcugc

SEQ ID NO: 3576003 - RNA, 17 nt, Pseudomonas putida KT2440
gcaccgcuucacccucg

SEQ ID NO: 3576004 - RNA, 22 nt, Pseudomonas putida KT2440
gcaccgcuucacccucgcgcag

SEQ ID NO: 3576005 - RNA, 23 nt, Pseudomonas putida KT2440
gcaccgcuucacccucgcgcagc

SEQ ID NO: 3576006 - RNA, 14 nt, Pseudomonas putida KT2440
gcaccggcagcagc

SEQ ID NO: 3576007 - RNA, 16 nt, Pseudomonas putida KT2440
gcaccggcagcagcaa

SEQ ID NO: 3576008 - RNA, 18 nt, Pseudomonas putida KT2440
gcaccggcagcagcaaug

SEQ ID NO: 3576009 - RNA, 13 nt, Pseudomonas putida KT2440
gcaccggccacca

SEQ ID NO: 3576010 - RNA, 12 nt, Pseudomonas putida KT2440
gcaccggccagg

SEQ ID NO: 3576011 - RNA, 13 nt, Pseudomonas putida KT2440
gcaccggccaggc

SEQ ID NO: 3576012 - RNA, 14 nt, Pseudomonas putida KT2440
gcaccggccaggcu

SEQ ID NO: 3576013 - RNA, 14 nt, Pseudomonas putida KT2440
gcaccggccuugcc

SEQ ID NO: 3576014 - RNA, 16 nt, Pseudomonas putida KT2440
gcaccggcgaacagca

SEQ ID NO: 3576015 - RNA, 19 nt, Pseudomonas putida KT2440
gcaccggcgaacagcaaug

SEQ ID NO: 3576016 - RNA, 12 nt, Pseudomonas putida KT2440
gcaccggcgacg

SEQ ID NO: 3576017 - RNA, 19 nt, Pseudomonas putida KT2440
gcaccggcgccaaucaucg

SEQ ID NO: 3576018 - RNA, 17 nt, Pseudomonas putida KT2440
gcaccggcuucgccggu

SEQ ID NO: 3576019 - RNA, 18 nt, Pseudomonas putida KT2440
gcaccgggcgggugcaug

SEQ ID NO: 3576020 - RNA, 19 nt, Pseudomonas putida KT2440
gcaccgggugguauccggg

SEQ ID NO: 3576021 - RNA, 22 nt, Pseudomonas putida KT2440
gcaccgguaccgcucugcgcca

SEQ ID NO: 3576022 - RNA, 13 nt, Pseudomonas putida KT2440
gcaccgucgaugu

SEQ ID NO: 3576023 - RNA, 15 nt, Pseudomonas putida KT2440
gcaccgucuggacug

SEQ ID NO: 3576024 - RNA, 17 nt, Pseudomonas putida KT2440
gcaccgugcaccagcac

SEQ ID NO: 3576025 - RNA, 22 nt, Pseudomonas putida KT2440
gcaccgugcaccagcaccaccg

SEQ ID NO: 3576026 - RNA, 15 nt, Pseudomonas putida KT2440
gcaccuaaccagugg

SEQ ID NO: 3576027 - RNA, 22 nt, Pseudomonas putida KT2440
gcaccucacaacgcgcaucccu

SEQ ID NO: 3576028 - RNA, 22 nt, Pseudomonas putida KT2440
gcaccucauagaucagcaucgg

SEQ ID NO: 3576029 - RNA, 18 nt, Pseudomonas putida KT2440
gcaccuccugcggcagau

SEQ ID NO: 3576030 - RNA, 12 nt, Pseudomonas putida KT2440
gcaccucggcca

SEQ ID NO: 3576031 - RNA, 18 nt, Pseudomonas putida KT2440
gcaccucggccagugcgc

SEQ ID NO: 3576032 - RNA, 10 nt, Pseudomonas putida KT2440
gcaccucuug

SEQ ID NO: 3576033 - RNA, 15 nt, Pseudomonas putida KT2440
gcaccugcagguaca

SEQ ID NO: 3576034 - RNA, 17 nt, Pseudomonas putida KT2440
gcaccugcccgcccuca

SEQ ID NO: 3576035 - RNA, 24 nt, Pseudomonas putida KT2440
gcaccugcccgcccucacucaccg

SEQ ID NO: 3576036 - RNA, 15 nt, Pseudomonas putida KT2440
gcaccugccgggcau

SEQ ID NO: 3576037 - RNA, 17 nt, Pseudomonas putida KT2440
gcaccugccgggcaucg

SEQ ID NO: 3576038 - RNA, 23 nt, Pseudomonas putida KT2440
gcaccugccgggcaucgggugaa

SEQ ID NO: 3576039 - RNA, 16 nt, Pseudomonas putida KT2440
gcaccugccugacgcg

SEQ ID NO: 3576040 - RNA, 20 nt, Pseudomonas putida KT2440
gcaccugcuugccgcuggca

SEQ ID NO: 3576041 - RNA, 18 nt, Pseudomonas putida KT2440
gcaccuggcggcccgccg

SEQ ID NO: 3576042 - RNA, 21 nt, Pseudomonas putida KT2440
gcaccugguaggucacuucag

SEQ ID NO: 3576043 - RNA, 15 nt, Pseudomonas putida KT2440
gcaccuuguauucga

SEQ ID NO: 3576044 - RNA, 17 nt, Pseudomonas putida KT2440
gcaccuuguuacccgca

SEQ ID NO: 3576045 - RNA, 16 nt, Pseudomonas putida KT2440
gcacgaaacugcgcug

SEQ ID NO: 3576046 - RNA, 19 nt, Pseudomonas putida KT2440
gcacgaacacguccagccc

SEQ ID NO: 3576047 - RNA, 15 nt, Pseudomonas putida KT2440
gcacgaacagauggu

SEQ ID NO: 3576048 - RNA, 16 nt, Pseudomonas putida KT2440
gcacgaacagauggug

SEQ ID NO: 3576049 - RNA, 21 nt, Pseudomonas putida KT2440
gcacgaagaucaccgacaaga

SEQ ID NO: 3576050 - RNA, 16 nt, Pseudomonas putida KT2440
gcacgaagcccaguug

SEQ ID NO: 3576051 - RNA, 21 nt, Pseudomonas putida KT2440
gcacgaagcccaguugcuggc

SEQ ID NO: 3576052 - RNA, 16 nt, Pseudomonas putida KT2440
gcacgaaggccagcaa

SEQ ID NO: 3576053 - RNA, 17 nt, Pseudomonas putida KT2440
gcacgaaggccagcaaa

SEQ ID NO: 3576054 - RNA, 18 nt, Pseudomonas putida KT2440
gcacgaaggccagcaaag

SEQ ID NO: 3576055 - RNA, 17 nt, Pseudomonas putida KT2440
gcacgaaguaacggcca

SEQ ID NO: 3576056 - RNA, 21 nt, Pseudomonas putida KT2440
gcacgaauacgcucgaccaga

SEQ ID NO: 3576057 - RNA, 17 nt, Pseudomonas putida KT2440
gcacgaccauuggcguc

SEQ ID NO: 3576058 - RNA, 19 nt, Pseudomonas putida KT2440
gcacgaccauuggcgucag

SEQ ID NO: 3576059 - RNA, 15 nt, Pseudomonas putida KT2440
gcacgaucagcagca

SEQ ID NO: 3576060 - RNA, 16 nt, Pseudomonas putida KT2440
gcacgaucagcagcaa

SEQ ID NO: 3576061 - RNA, 18 nt, Pseudomonas putida KT2440
gcacgaucagcagcaaag

SEQ ID NO: 3576062 - RNA, 17 nt, Pseudomonas putida KT2440
gcacgaucagcgcggca

SEQ ID NO: 3576063 - RNA, 20 nt, Pseudomonas putida KT2440
gcacgaucgaccggguaauc

SEQ ID NO: 3576064 - RNA, 22 nt, Pseudomonas putida KT2440
gcacgaucucgucacugcgggu

SEQ ID NO: 3576065 - RNA, 22 nt, Pseudomonas putida KT2440
gcacgauggcggucgaacccag

SEQ ID NO: 3576066 - RNA, 22 nt, Pseudomonas putida KT2440
gcacgcaacaggucgaccugcc

SEQ ID NO: 3576067 - RNA, 15 nt, Pseudomonas putida KT2440
gcacgcaucugcacc

SEQ ID NO: 3576068 - RNA, 16 nt, Pseudomonas putida KT2440
gcacgcaucugcaccg

SEQ ID NO: 3576069 - RNA, 16 nt, Pseudomonas putida KT2440
gcacgccagcaucacc

SEQ ID NO: 3576070 - RNA, 14 nt, Pseudomonas putida KT2440
gcacgcccagcaac

SEQ ID NO: 3576071 - RNA, 15 nt, Pseudomonas putida KT2440
gcacgcccagcaacu

SEQ ID NO: 3576072 - RNA, 14 nt, Pseudomonas putida KT2440
gcacgcccauuucc

SEQ ID NO: 3576073 - RNA, 12 nt, Pseudomonas putida KT2440
gcacgcccgcuc

SEQ ID NO: 3576074 - RNA, 16 nt, Pseudomonas putida KT2440
gcacgcccgcucccac

SEQ ID NO: 3576075 - RNA, 17 nt, Pseudomonas putida KT2440
gcacgcccgcucccaca

SEQ ID NO: 3576076 - RNA, 19 nt, Pseudomonas putida KT2440
gcacgcccgcucccacagg

SEQ ID NO: 3576077 - RNA, 20 nt, Pseudomonas putida KT2440
gcacgcccgcucccacaggg

SEQ ID NO: 3576078 - RNA, 20 nt, Pseudomonas putida KT2440
gcacgcccgcucccacaggu

SEQ ID NO: 3576079 - RNA, 14 nt, Pseudomonas putida KT2440
gcacgcccggcacc

SEQ ID NO: 3576080 - RNA, 23 nt, Pseudomonas putida KT2440
gcacgcccggcaccugccgggca

SEQ ID NO: 3576081 - RNA, 19 nt, Pseudomonas putida KT2440
gcacgccgguaucacccag

SEQ ID NO: 3576082 - RNA, 19 nt, Pseudomonas putida KT2440
gcacgccuucagcagccgg

SEQ ID NO: 3576083 - RNA, 16 nt, Pseudomonas putida KT2440
gcacgcgaucggcagc

SEQ ID NO: 3576084 - RNA, 15 nt, Pseudomonas putida KT2440
gcacgcgccagcagc

SEQ ID NO: 3576085 - RNA, 16 nt, Pseudomonas putida KT2440
gcacgcgccagcagcg

SEQ ID NO: 3576086 - RNA, 19 nt, Pseudomonas putida KT2440
gcacgcgccucuugcaccu

SEQ ID NO: 3576087 - RNA, 13 nt, Pseudomonas putida KT2440
gcacgcgggccgu

SEQ ID NO: 3576088 - RNA, 14 nt, Pseudomonas putida KT2440
gcacgcguaccccu

SEQ ID NO: 3576089 - RNA, 20 nt, Pseudomonas putida KT2440
gcacgcguaccccuggcgcu

SEQ ID NO: 3576090 - RNA, 14 nt, Pseudomonas putida KT2440
gcacgcugcccagg

SEQ ID NO: 3576091 - RNA, 13 nt, Pseudomonas putida KT2440
gcacgcuggcugu

SEQ ID NO: 3576092 - RNA, 16 nt, Pseudomonas putida KT2440
gcacgcuggcugugau

SEQ ID NO: 3576093 - RNA, 21 nt, Pseudomonas putida KT2440
gcacgcuggcugugauacagc

SEQ ID NO: 3576094 - RNA, 15 nt, Pseudomonas putida KT2440
gcacgcuucgauccg

SEQ ID NO: 3576095 - RNA, 21 nt, Pseudomonas putida KT2440
gcacgcuucgauccgcgccca

SEQ ID NO: 3576096 - RNA, 17 nt, Pseudomonas putida KT2440
gcacgcuugagcgcgcc

SEQ ID NO: 3576097 - RNA, 23 nt, Pseudomonas putida KT2440
gcacgcuuucgccgaucagcugg

SEQ ID NO: 3576098 - RNA, 17 nt, Pseudomonas putida KT2440
gcacggacgucgcgcug

SEQ ID NO: 3576099 - RNA, 17 nt, Pseudomonas putida KT2440
gcacggcaaaguccagc

SEQ ID NO: 3576100 - RNA, 14 nt, Pseudomonas putida KT2440
gcacggcaaucagg

SEQ ID NO: 3576101 - RNA, 18 nt, Pseudomonas putida KT2440
gcacggcaaucaggcuga

SEQ ID NO: 3576102 - RNA, 23 nt, Pseudomonas putida KT2440
gcacggcaauuucuaccggcaua

SEQ ID NO: 3576103 - RNA, 13 nt, Pseudomonas putida KT2440
gcacggcaccagc

SEQ ID NO: 3576104 - RNA, 16 nt, Pseudomonas putida KT2440
gcacggcaccagcacc

SEQ ID NO: 3576105 - RNA, 19 nt, Pseudomonas putida KT2440
gcacggcaccagcaccagc

SEQ ID NO: 3576106 - RNA, 20 nt, Pseudomonas putida KT2440
gcacggcaccagcaccagcu

SEQ ID NO: 3576107 - RNA, 18 nt, Pseudomonas putida KT2440
gcacggcagcaaucgccg

SEQ ID NO: 3576108 - RNA, 18 nt, Pseudomonas putida KT2440
gcacggccaccauguacu

SEQ ID NO: 3576109 - RNA, 16 nt, Pseudomonas putida KT2440
gcacggccagcaccga

SEQ ID NO: 3576110 - RNA, 15 nt, Pseudomonas putida KT2440
gcacggccagccagc

SEQ ID NO: 3576111 - RNA, 22 nt, Pseudomonas putida KT2440
gcacggccuccaccaccugcag

SEQ ID NO: 3576112 - RNA, 16 nt, Pseudomonas putida KT2440
gcacggccugcaucca

SEQ ID NO: 3576113 - RNA, 21 nt, Pseudomonas putida KT2440
gcacggccuucccgccuggcg

SEQ ID NO: 3576114 - RNA, 21 nt, Pseudomonas putida KT2440
gcacggccuucuucgguggcg

SEQ ID NO: 3576115 - RNA, 14 nt, Pseudomonas putida KT2440
gcacggcugcccug

SEQ ID NO: 3576116 - RNA, 13 nt, Pseudomonas putida KT2440
gcacggcugucag

SEQ ID NO: 3576117 - RNA, 20 nt, Pseudomonas putida KT2440
gcacggcuucgcgcauuucg

SEQ ID NO: 3576118 - RNA, 12 nt, Pseudomonas putida KT2440
gcacgggaucaa

SEQ ID NO: 3576119 - RNA, 19 nt, Pseudomonas putida KT2440
gcacgggcacacuggccac

SEQ ID NO: 3576120 - RNA, 17 nt, Pseudomonas putida KT2440
gcacgggccagcgcggu

SEQ ID NO: 3576121 - RNA, 23 nt, Pseudomonas putida KT2440
gcacggguucacggaagaucacc

SEQ ID NO: 3576122 - RNA, 18 nt, Pseudomonas putida KT2440
gcacggucgguagccugg

SEQ ID NO: 3576123 - RNA, 17 nt, Pseudomonas putida KT2440
gcacggucuccggcgaa

SEQ ID NO: 3576124 - RNA, 17 nt, Pseudomonas putida KT2440
gcacguaccuggcugca

SEQ ID NO: 3576125 - RNA, 18 nt, Pseudomonas putida KT2440
gcacguaguaauccggca

SEQ ID NO: 3576126 - RNA, 20 nt, Pseudomonas putida KT2440
gcacguagucgucagggucu

SEQ ID NO: 3576127 - RNA, 16 nt, Pseudomonas putida KT2440
gcacgucacccacuuc

SEQ ID NO: 3576128 - RNA, 17 nt, Pseudomonas putida KT2440
gcacgucagacuuuccu

SEQ ID NO: 3576129 - RNA, 18 nt, Pseudomonas putida KT2440
gcacgucgaugaaggcau

SEQ ID NO: 3576130 - RNA, 13 nt, Pseudomonas putida KT2440
gcacgucgcgauu

SEQ ID NO: 3576131 - RNA, 15 nt, Pseudomonas putida KT2440
gcacgucgcgauuga

SEQ ID NO: 3576132 - RNA, 16 nt, Pseudomonas putida KT2440
gcacgucgcgcagggc

SEQ ID NO: 3576133 - RNA, 12 nt, Pseudomonas putida KT2440
gcacgucggcgc

SEQ ID NO: 3576134 - RNA, 22 nt, Pseudomonas putida KT2440
gcacgugauaccugggcuggag

SEQ ID NO: 3576135 - RNA, 20 nt, Pseudomonas putida KT2440
gcacgugggucgggaacagc

SEQ ID NO: 3576136 - RNA, 21 nt, Pseudomonas putida KT2440
gcacgugggucgggaacagcu

SEQ ID NO: 3576137 - RNA, 20 nt, Pseudomonas putida KT2440
gcacguuauccacagcguuu

SEQ ID NO: 3576138 - RNA, 20 nt, Pseudomonas putida KT2440
gcacuaccaggcccaacagc

SEQ ID NO: 3576139 - RNA, 21 nt, Pseudomonas putida KT2440
gcacuaccaggcccaacagcg

SEQ ID NO: 3576140 - RNA, 22 nt, Pseudomonas putida KT2440
gcacuaccaggcccaacagcgc

SEQ ID NO: 3576141 - RNA, 15 nt, Pseudomonas putida KT2440
gcacuaccucgcuca

SEQ ID NO: 3576142 - RNA, 22 nt, Pseudomonas putida KT2440
gcacuaccucgcucaggccaug

SEQ ID NO: 3576143 - RNA, 12 nt, Pseudomonas putida KT2440
gcacuccagcga

SEQ ID NO: 3576144 - RNA, 13 nt, Pseudomonas putida KT2440
gcacuccagcgag

SEQ ID NO: 3576145 - RNA, 21 nt, Pseudomonas putida KT2440
gcacuccagcgaguggccacg

SEQ ID NO: 3576146 - RNA, 17 nt, Pseudomonas putida KT2440
gcacuccccaucagcag

SEQ ID NO: 3576147 - RNA, 19 nt, Pseudomonas putida KT2440
gcacuccccaucagcagcu

SEQ ID NO: 3576148 - RNA, 21 nt, Pseudomonas putida KT2440
gcacuccgcccguaugcaucc

SEQ ID NO: 3576149 - RNA, 18 nt, Pseudomonas putida KT2440
gcacucggucggcuggca

SEQ ID NO: 3576150 - RNA, 19 nt, Pseudomonas putida KT2440
gcacucguuggcaaagcug

SEQ ID NO: 3576151 - RNA, 16 nt, Pseudomonas putida KT2440
gcacucucccgcagcc

SEQ ID NO: 3576152 - RNA, 23 nt, Pseudomonas putida KT2440
gcacucucgcggugccuucaggc

SEQ ID NO: 3576153 - RNA, 17 nt, Pseudomonas putida KT2440
gcacucucgucaccuga

SEQ ID NO: 3576154 - RNA, 17 nt, Pseudomonas putida KT2440
gcacucugcugcucugc

SEQ ID NO: 3576155 - RNA, 18 nt, Pseudomonas putida KT2440
gcacucugcugcucugcc

SEQ ID NO: 3576156 - RNA, 16 nt, Pseudomonas putida KT2440
gcacugaacagcgccu

SEQ ID NO: 3576157 - RNA, 13 nt, Pseudomonas putida KT2440
gcacugaagauuu

SEQ ID NO: 3576158 - RNA, 20 nt, Pseudomonas putida KT2440
gcacugaagauuuucagcca

SEQ ID NO: 3576159 - RNA, 18 nt, Pseudomonas putida KT2440
gcacugaauacaccagcu

SEQ ID NO: 3576160 - RNA, 21 nt, Pseudomonas putida KT2440
gcacugacaagauaguaggca

SEQ ID NO: 3576161 - RNA, 23 nt, Pseudomonas putida KT2440
gcacugaccacuucaagcacgcc

SEQ ID NO: 3576162 - RNA, 16 nt, Pseudomonas putida KT2440
gcacugcaacaccggu

SEQ ID NO: 3576163 - RNA, 11 nt, Pseudomonas putida KT2440
gcacugcaccc

SEQ ID NO: 3576164 - RNA, 16 nt, Pseudomonas putida KT2440
gcacugcacccucuuc

SEQ ID NO: 3576165 - RNA, 13 nt, Pseudomonas putida KT2440
gcacugccagcgc

SEQ ID NO: 3576166 - RNA, 19 nt, Pseudomonas putida KT2440
gcacugccgcauucgcggg

SEQ ID NO: 3576167 - RNA, 15 nt, Pseudomonas putida KT2440
gcacugccuggccac

SEQ ID NO: 3576168 - RNA, 18 nt, Pseudomonas putida KT2440
gcacugccuggccacugu

SEQ ID NO: 3576169 - RNA, 18 nt, Pseudomonas putida KT2440
gcacugccuggcucaggc

SEQ ID NO: 3576170 - RNA, 17 nt, Pseudomonas putida KT2440
gcacugcgaagcccagu

SEQ ID NO: 3576171 - RNA, 16 nt, Pseudomonas putida KT2440
gcacugcggcucaucg

SEQ ID NO: 3576172 - RNA, 14 nt, Pseudomonas putida KT2440
gcacuggcaggccu

SEQ ID NO: 3576173 - RNA, 12 nt, Pseudomonas putida KT2440
gcacuggccacc

SEQ ID NO: 3576174 - RNA, 14 nt, Pseudomonas putida KT2440
gcacuggccacccc

SEQ ID NO: 3576175 - RNA, 17 nt, Pseudomonas putida KT2440
gcacuggccacccccac

SEQ ID NO: 3576176 - RNA, 21 nt, Pseudomonas putida KT2440
gcacuggccagcggcgcggcc

SEQ ID NO: 3576177 - RNA, 20 nt, Pseudomonas putida KT2440
gcacuggccucuucgcgggu

SEQ ID NO: 3576178 - RNA, 22 nt, Pseudomonas putida KT2440
gcacuggcgcgaugcgguugca

SEQ ID NO: 3576179 - RNA, 11 nt, Pseudomonas putida KT2440
gcacuggcuga

SEQ ID NO: 3576180 - RNA, 20 nt, Pseudomonas putida KT2440
gcacuggcugauagccgcca

SEQ ID NO: 3576181 - RNA, 16 nt, Pseudomonas putida KT2440
gcacugggugcacagg

SEQ ID NO: 3576182 - RNA, 19 nt, Pseudomonas putida KT2440
gcacuguaggcaaacagcu

SEQ ID NO: 3576183 - RNA, 23 nt, Pseudomonas putida KT2440
gcacugucgauggcggugcgcac

SEQ ID NO: 3576184 - RNA, 13 nt, Pseudomonas putida KT2440
gcacuguugcugg

SEQ ID NO: 3576185 - RNA, 20 nt, Pseudomonas putida KT2440
gcacuguuguccaagggaga

SEQ ID NO: 3576186 - RNA, 13 nt, Pseudomonas putida KT2440
gcacuuccacucc

SEQ ID NO: 3576187 - RNA, 20 nt, Pseudomonas putida KT2440
gcacuuccacuccagccguc

SEQ ID NO: 3576188 - RNA, 12 nt, Pseudomonas putida KT2440
gcacuuccagga

SEQ ID NO: 3576189 - RNA, 20 nt, Pseudomonas putida KT2440
gcacuuccaggaaggccucg

SEQ ID NO: 3576190 - RNA, 21 nt, Pseudomonas putida KT2440
gcacuucgauacccagccagc

SEQ ID NO: 3576191 - RNA, 16 nt, Pseudomonas putida KT2440
gcacuucguccagggu

SEQ ID NO: 3576192 - RNA, 16 nt, Pseudomonas putida KT2440
gcacuucuguggaaaa

SEQ ID NO: 3576193 - RNA, 20 nt, Pseudomonas putida KT2440
gcacuucuguggaaaaccgc

SEQ ID NO: 3576194 - RNA, 22 nt, Pseudomonas putida KT2440
gcacuucuguggaaaaccgcuc

SEQ ID NO: 3576195 - RNA, 18 nt, Pseudomonas putida KT2440
gcacuugggaucgaugca

SEQ ID NO: 3576196 - RNA, 21 nt, Pseudomonas putida KT2440
gcacuuguuccagccgcgcca

SEQ ID NO: 3576197 - RNA, 20 nt, Pseudomonas putida KT2440
gcacuuguugcgcagguaca

SEQ ID NO: 3576198 - RNA, 13 nt, Pseudomonas putida KT2440
gcacuuguuggug

SEQ ID NO: 3576199 - RNA, 18 nt, Pseudomonas putida KT2440
gcacuuuugccaccaccc

SEQ ID NO: 3576200 - RNA, 15 nt, Pseudomonas putida KT2440
gcagaacaucgccca

SEQ ID NO: 3576201 - RNA, 16 nt, Pseudomonas putida KT2440
gcagaaccgccagcac

SEQ ID NO: 3576202 - RNA, 14 nt, Pseudomonas putida KT2440
gcagaacguacugg

SEQ ID NO: 3576203 - RNA, 19 nt, Pseudomonas putida KT2440
gcagaacguacuggccgcu

SEQ ID NO: 3576204 - RNA, 19 nt, Pseudomonas putida KT2440
gcagaagcgcugacugcca

SEQ ID NO: 3576205 - RNA, 19 nt, Pseudomonas putida KT2440
gcagacaacgcggcggaua

SEQ ID NO: 3576206 - RNA, 16 nt, Pseudomonas putida KT2440
gcagacacaggcgcuc

SEQ ID NO: 3576207 - RNA, 14 nt, Pseudomonas putida KT2440
gcagaccagccggg

SEQ ID NO: 3576208 - RNA, 15 nt, Pseudomonas putida KT2440
gcagaccagccgggc

SEQ ID NO: 3576209 - RNA, 12 nt, Pseudomonas putida KT2440
gcagacccagaa

SEQ ID NO: 3576210 - RNA, 17 nt, Pseudomonas putida KT2440
gcagaccugugggagcg

SEQ ID NO: 3576211 - RNA, 22 nt, Pseudomonas putida KT2440
gcagacgacccggauaccgacc

SEQ ID NO: 3576212 - RNA, 16 nt, Pseudomonas putida KT2440
gcagacgcgcagcacu

SEQ ID NO: 3576213 - RNA, 15 nt, Pseudomonas putida KT2440
gcagacgucgcaauu

SEQ ID NO: 3576214 - RNA, 21 nt, Pseudomonas putida KT2440
gcagacgucgcaauugaugca

SEQ ID NO: 3576215 - RNA, 14 nt, Pseudomonas putida KT2440
gcagacugggugau

SEQ ID NO: 3576216 - RNA, 20 nt, Pseudomonas putida KT2440
gcagacuucgcugucuucca

SEQ ID NO: 3576217 - RNA, 21 nt, Pseudomonas putida KT2440
gcagacuucgcugucuuccag

SEQ ID NO: 3576218 - RNA, 14 nt, Pseudomonas putida KT2440
gcagagcaugguca

SEQ ID NO: 3576219 - RNA, 18 nt, Pseudomonas putida KT2440
gcagagccugcacccagg

SEQ ID NO: 3576220 - RNA, 14 nt, Pseudomonas putida KT2440
gcagagcgccagca

SEQ ID NO: 3576221 - RNA, 17 nt, Pseudomonas putida KT2440
gcagagcgccagcaucg

SEQ ID NO: 3576222 - RNA, 16 nt, Pseudomonas putida KT2440
gcagagcgcccaccaa

SEQ ID NO: 3576223 - RNA, 19 nt, Pseudomonas putida KT2440
gcagagcggcccugagccu

SEQ ID NO: 3576224 - RNA, 20 nt, Pseudomonas putida KT2440
gcagaggcguagcaagcaga

SEQ ID NO: 3576225 - RNA, 16 nt, Pseudomonas putida KT2440
gcagaguaaccgcggc

SEQ ID NO: 3576226 - RNA, 18 nt, Pseudomonas putida KT2440
gcagauaaccuggcucgg

SEQ ID NO: 3576227 - RNA, 23 nt, Pseudomonas putida KT2440
gcagauaaccuggcucggcuggg

SEQ ID NO: 3576228 - RNA, 18 nt, Pseudomonas putida KT2440
gcagauacaaccccagau

SEQ ID NO: 3576229 - RNA, 17 nt, Pseudomonas putida KT2440
gcagauaucuggacccc

SEQ ID NO: 3576230 - RNA, 14 nt, Pseudomonas putida KT2440
gcagaucaccagcu

SEQ ID NO: 3576231 - RNA, 17 nt, Pseudomonas putida KT2440
gcagaucaggcaaucac

SEQ ID NO: 3576232 - RNA, 15 nt, Pseudomonas putida KT2440
gcagauccaggugcc

SEQ ID NO: 3576233 - RNA, 14 nt, Pseudomonas putida KT2440
gcagauccugcagc

SEQ ID NO: 3576234 - RNA, 15 nt, Pseudomonas putida KT2440
gcagauccugcagcc

SEQ ID NO: 3576235 - RNA, 16 nt, Pseudomonas putida KT2440
gcagauccugcagccg

SEQ ID NO: 3576236 - RNA, 18 nt, Pseudomonas putida KT2440
gcagauccugcagccgca

SEQ ID NO: 3576237 - RNA, 18 nt, Pseudomonas putida KT2440
gcagaucguuguaggagc

SEQ ID NO: 3576238 - RNA, 19 nt, Pseudomonas putida KT2440
gcagaugcuccaaccccag

SEQ ID NO: 3576239 - RNA, 21 nt, Pseudomonas putida KT2440
gcagaugcuccaaccccagcg

SEQ ID NO: 3576240 - RNA, 14 nt, Pseudomonas putida KT2440
gcagauggccgcuu

SEQ ID NO: 3576241 - RNA, 18 nt, Pseudomonas putida KT2440
gcagauggcucaucgccg

SEQ ID NO: 3576242 - RNA, 19 nt, Pseudomonas putida KT2440
gcagauggcucaucgccgu

SEQ ID NO: 3576243 - RNA, 16 nt, Pseudomonas putida KT2440
gcagaugguccggcau

SEQ ID NO: 3576244 - RNA, 19 nt, Pseudomonas putida KT2440
gcagaugguccggcaucac

SEQ ID NO: 3576245 - RNA, 14 nt, Pseudomonas putida KT2440
gcagauuccgcgau

SEQ ID NO: 3576246 - RNA, 14 nt, Pseudomonas putida KT2440
gcagauugcaucac

SEQ ID NO: 3576247 - RNA, 13 nt, Pseudomonas putida KT2440
gcagcaacacgac

SEQ ID NO: 3576248 - RNA, 15 nt, Pseudomonas putida KT2440
gcagcaacagguaca

SEQ ID NO: 3576249 - RNA, 22 nt, Pseudomonas putida KT2440
gcagcaacagguacauguuggu

SEQ ID NO: 3576250 - RNA, 23 nt, Pseudomonas putida KT2440
gcagcaacaguuucuugccuucc

SEQ ID NO: 3576251 - RNA, 15 nt, Pseudomonas putida KT2440
gcagcaacgccuuca

SEQ ID NO: 3576252 - RNA, 22 nt, Pseudomonas putida KT2440
gcagcaacgccuucaggcgaag

SEQ ID NO: 3576253 - RNA, 15 nt, Pseudomonas putida KT2440
gcagcaacugugucu

SEQ ID NO: 3576254 - RNA, 13 nt, Pseudomonas putida KT2440
gcagcaagccugc

SEQ ID NO: 3576255 - RNA, 14 nt, Pseudomonas putida KT2440
gcagcaagcuggca

SEQ ID NO: 3576256 - RNA, 15 nt, Pseudomonas putida KT2440
gcagcaagcuggcac

SEQ ID NO: 3576257 - RNA, 14 nt, Pseudomonas putida KT2440
gcagcacacuccac

SEQ ID NO: 3576258 - RNA, 13 nt, Pseudomonas putida KT2440
gcagcacaggucu

SEQ ID NO: 3576259 - RNA, 21 nt, Pseudomonas putida KT2440
gcagcacaggucucgaacgcu

SEQ ID NO: 3576260 - RNA, 12 nt, Pseudomonas putida KT2440
gcagcacaucac

SEQ ID NO: 3576261 - RNA, 18 nt, Pseudomonas putida KT2440
gcagcacaucacacagcg

SEQ ID NO: 3576262 - RNA, 22 nt, Pseudomonas putida KT2440
gcagcacaucacacagcggcag

SEQ ID NO: 3576263 - RNA, 22 nt, Pseudomonas putida KT2440
gcagcaccacgaagcgcggcaa

SEQ ID NO: 3576264 - RNA, 12 nt, Pseudomonas putida KT2440
gcagcaccagcu

SEQ ID NO: 3576265 - RNA, 16 nt, Pseudomonas putida KT2440
gcagcacccgcuuggc

SEQ ID NO: 3576266 - RNA, 23 nt, Pseudomonas putida KT2440
gcagcacccggucgccgacggca

SEQ ID NO: 3576267 - RNA, 24 nt, Pseudomonas putida KT2440
gcagcacccggucgccgacggcau

SEQ ID NO: 3576268 - RNA, 16 nt, Pseudomonas putida KT2440
gcagcaccgaggcgug

SEQ ID NO: 3576269 - RNA, 14 nt, Pseudomonas putida KT2440
gcagcaccgaucag

SEQ ID NO: 3576270 - RNA, 19 nt, Pseudomonas putida KT2440
gcagcaccgaucagcggcg

SEQ ID NO: 3576271 - RNA, 17 nt, Pseudomonas putida KT2440
gcagcaccgcuucaccc

SEQ ID NO: 3576272 - RNA, 19 nt, Pseudomonas putida KT2440
gcagcaccgcuucacccuc

SEQ ID NO: 3576273 - RNA, 22 nt, Pseudomonas putida KT2440
gcagcaccgggcgggugcaugg

SEQ ID NO: 3576274 - RNA, 15 nt, Pseudomonas putida KT2440
gcagcaccuccaccu

SEQ ID NO: 3576275 - RNA, 14 nt, Pseudomonas putida KT2440
gcagcaccugccag

SEQ ID NO: 3576276 - RNA, 16 nt, Pseudomonas putida KT2440
gcagcaccugccagcc

SEQ ID NO: 3576277 - RNA, 17 nt, Pseudomonas putida KT2440
gcagcacgaucagcgcg

SEQ ID NO: 3576278 - RNA, 14 nt, Pseudomonas putida KT2440
gcagcacgaucucg

SEQ ID NO: 3576279 - RNA, 16 nt, Pseudomonas putida KT2440
gcagcacuucgaucag

SEQ ID NO: 3576280 - RNA, 17 nt, Pseudomonas putida KT2440
gcagcacuucgaucagg

SEQ ID NO: 3576281 - RNA, 18 nt, Pseudomonas putida KT2440
gcagcacuucgaucaggc

SEQ ID NO: 3576282 - RNA, 20 nt, Pseudomonas putida KT2440
gcagcacuucgaucaggcag

SEQ ID NO: 3576283 - RNA, 12 nt, Pseudomonas putida KT2440
gcagcagcaaug

SEQ ID NO: 3576284 - RNA, 15 nt, Pseudomonas putida KT2440
gcagcagcagcccca

SEQ ID NO: 3576285 - RNA, 15 nt, Pseudomonas putida KT2440
gcagcagcaggcccg

SEQ ID NO: 3576286 - RNA, 14 nt, Pseudomonas putida KT2440
gcagcagcccuucg

SEQ ID NO: 3576287 - RNA, 22 nt, Pseudomonas putida KT2440
gcagcagcccuucgcucaaccg

SEQ ID NO: 3576288 - RNA, 22 nt, Pseudomonas putida KT2440
gcagcagccucggccucccgcu

SEQ ID NO: 3576289 - RNA, 23 nt, Pseudomonas putida KT2440
gcagcagccucggccucccgcuu

SEQ ID NO: 3576290 - RNA, 14 nt, Pseudomonas putida KT2440
gcagcagcgcaccg

SEQ ID NO: 3576291 - RNA, 20 nt, Pseudomonas putida KT2440
gcagcagcucccgagccagg

SEQ ID NO: 3576292 - RNA, 21 nt, Pseudomonas putida KT2440
gcagcagcucuuuugccggga

SEQ ID NO: 3576293 - RNA, 21 nt, Pseudomonas putida KT2440
gcagcagcuuccugugccgcu

SEQ ID NO: 3576294 - RNA, 19 nt, Pseudomonas putida KT2440
gcagcagcuugcagcgccg

SEQ ID NO: 3576295 - RNA, 14 nt, Pseudomonas putida KT2440
gcagcaggcccgcc

SEQ ID NO: 3576296 - RNA, 11 nt, Pseudomonas putida KT2440
gcagcaggccg

SEQ ID NO: 3576297 - RNA, 15 nt, Pseudomonas putida KT2440
gcagcaggccgcuga

SEQ ID NO: 3576298 - RNA, 20 nt, Pseudomonas putida KT2440
gcagcaggcgcgagccuugc

SEQ ID NO: 3576299 - RNA, 12 nt, Pseudomonas putida KT2440
gcagcaggcugg

SEQ ID NO: 3576300 - RNA, 22 nt, Pseudomonas putida KT2440
gcagcaggcuggcgggguggcc

SEQ ID NO: 3576301 - RNA, 17 nt, Pseudomonas putida KT2440
gcagcagguugcuggug

SEQ ID NO: 3576302 - RNA, 15 nt, Pseudomonas putida KT2440
gcagcagugccagca

SEQ ID NO: 3576303 - RNA, 19 nt, Pseudomonas putida KT2440
gcagcagugccagcaacaa

SEQ ID NO: 3576304 - RNA, 19 nt, Pseudomonas putida KT2440
gcagcauaugcuggucgcc

SEQ ID NO: 3576305 - RNA, 15 nt, Pseudomonas putida KT2440
gcagcaucaccacgc

SEQ ID NO: 3576306 - RNA, 21 nt, Pseudomonas putida KT2440
gcagcaucaccacgcccuggc

SEQ ID NO: 3576307 - RNA, 18 nt, Pseudomonas putida KT2440
gcagcaucaccgcgucga

SEQ ID NO: 3576308 - RNA, 19 nt, Pseudomonas putida KT2440
gcagcaucaccgcgucgau

SEQ ID NO: 3576309 - RNA, 13 nt, Pseudomonas putida KT2440
gcagcaucgaccu

SEQ ID NO: 3576310 - RNA, 16 nt, Pseudomonas putida KT2440
gcagcaucgaccugcc

SEQ ID NO: 3576311 - RNA, 13 nt, Pseudomonas putida KT2440
gcagcaucuuccu

SEQ ID NO: 3576312 - RNA, 22 nt, Pseudomonas putida KT2440
gcagcaucuucuucacguccag

SEQ ID NO: 3576313 - RNA, 14 nt, Pseudomonas putida KT2440
gcagcaugaacagc

SEQ ID NO: 3576314 - RNA, 22 nt, Pseudomonas putida KT2440
gcagcaugaacagcgcugcgag

SEQ ID NO: 3576315 - RNA, 19 nt, Pseudomonas putida KT2440
gcagcauuucuucgaccug

SEQ ID NO: 3576316 - RNA, 18 nt, Pseudomonas putida KT2440
gcagccaacgccccaggc

SEQ ID NO: 3576317 - RNA, 19 nt, Pseudomonas putida KT2440
gcagccaacgccccaggcc

SEQ ID NO: 3576318 - RNA, 20 nt, Pseudomonas putida KT2440
gcagccaaucggcgccagga

SEQ ID NO: 3576319 - RNA, 18 nt, Pseudomonas putida KT2440
gcagcuguugcuguuggc

SEQ ID NO: 3576320 - RNA, 21 nt, Pseudomonas putida KT2440
gcagcuguugcuguuggcgcg

SEQ ID NO: 3576321 - RNA, 22 nt, Pseudomonas putida KT2440
gcagcuguugcuguuggcgcga

SEQ ID NO: 3576322 - RNA, 20 nt, Pseudomonas putida KT2440
gcagcuuauugcgcagggug

SEQ ID NO: 3576323 - RNA, 17 nt, Pseudomonas putida KT2440
gcagcuucagccagggc

SEQ ID NO: 3576324 - RNA, 17 nt, Pseudomonas putida KT2440
gcagcuuccaccauucc

SEQ ID NO: 3576325 - RNA, 16 nt, Pseudomonas putida KT2440
gcagcuuccgccacca

SEQ ID NO: 3576326 - RNA, 20 nt, Pseudomonas putida KT2440
gcagcuucucaagcaucugg

SEQ ID NO: 3576327 - RNA, 15 nt, Pseudomonas putida KT2440
gcagcuucuggcgcg

SEQ ID NO: 3576328 - RNA, 14 nt, Pseudomonas putida KT2440
gcagcuucuucaca

SEQ ID NO: 3576329 - RNA, 18 nt, Pseudomonas putida KT2440
gcagcuucuucacaccgg

SEQ ID NO: 3576330 - RNA, 23 nt, Pseudomonas putida KT2440
gcagcuucuucacaccggccuug

SEQ ID NO: 3576331 - RNA, 16 nt, Pseudomonas putida KT2440
gcagcuugaggcccau

SEQ ID NO: 3576332 - RNA, 17 nt, Pseudomonas putida KT2440
gcagcuugaggcccaug

SEQ ID NO: 3576333 - RNA, 20 nt, Pseudomonas putida KT2440
gcagcuugaggucgccaggg

SEQ ID NO: 3576334 - RNA, 20 nt, Pseudomonas putida KT2440
gcagcuugcgcaaggggucg

SEQ ID NO: 3576335 - RNA, 16 nt, Pseudomonas putida KT2440
gcagcuugcgcgccuu

SEQ ID NO: 3576336 - RNA, 17 nt, Pseudomonas putida KT2440
gcagcuuggccauuucc

SEQ ID NO: 3576337 - RNA, 14 nt, Pseudomonas putida KT2440
gcagcuuuugcgca

SEQ ID NO: 3576338 - RNA, 17 nt, Pseudomonas putida KT2440
gcaggaacagcggcagc

SEQ ID NO: 3576339 - RNA, 20 nt, Pseudomonas putida KT2440
gcaggaaccuccguugcugc

SEQ ID NO: 3576340 - RNA, 13 nt, Pseudomonas putida KT2440
gcaggaacuggcu

SEQ ID NO: 3576341 - RNA, 14 nt, Pseudomonas putida KT2440
gcaggaagcggcgc

SEQ ID NO: 3576342 - RNA, 15 nt, Pseudomonas putida KT2440
gcaggaagcggcgcu

SEQ ID NO: 3576343 - RNA, 22 nt, Pseudomonas putida KT2440
gcaggacuacaucuucgcgcuc

SEQ ID NO: 3576344 - RNA, 19 nt, Pseudomonas putida KT2440
gcaggagcgagcaagcucg

SEQ ID NO: 3576345 - RNA, 22 nt, Pseudomonas putida KT2440
gcaggagcgagcaagcucgcuc

SEQ ID NO: 3576346 - RNA, 12 nt, Pseudomonas putida KT2440
gcaggagcgggc

SEQ ID NO: 3576347 - RNA, 20 nt, Pseudomonas putida KT2440
gcaggagcggguucacccgc

SEQ ID NO: 3576348 - RNA, 20 nt, Pseudomonas putida KT2440
gcaggagcugaacugcucuc

SEQ ID NO: 3576349 - RNA, 24 nt, Pseudomonas putida KT2440
gcaggauauccacacccgccacgc

SEQ ID NO: 3576350 - RNA, 17 nt, Pseudomonas putida KT2440
gcaggaucaugugcgcc

SEQ ID NO: 3576351 - RNA, 12 nt, Pseudomonas putida KT2440
gcaggaucuggc

SEQ ID NO: 3576352 - RNA, 23 nt, Pseudomonas putida KT2440
gcaggaugacuuucaugcccgcg

SEQ ID NO: 3576353 - RNA, 18 nt, Pseudomonas putida KT2440
gcaggauggugacugcca

SEQ ID NO: 3576354 - RNA, 20 nt, Pseudomonas putida KT2440
gcaggauggugacugccagc

SEQ ID NO: 3576355 - RNA, 22 nt, Pseudomonas putida KT2440
gcaggaugucgacguaggcgaa

SEQ ID NO: 3576356 - RNA, 21 nt, Pseudomonas putida KT2440
gcaggcaaacgcggucagcga

SEQ ID NO: 3576357 - RNA, 15 nt, Pseudomonas putida KT2440
gcaggcaagcccgcu

SEQ ID NO: 3576358 - RNA, 15 nt, Pseudomonas putida KT2440
gcaggcaauccucga

SEQ ID NO: 3576359 - RNA, 18 nt, Pseudomonas putida KT2440
gcaggcaguaggccaccg

SEQ ID NO: 3576360 - RNA, 22 nt, Pseudomonas putida KT2440
gcaggcaguucgagcgccugau

SEQ ID NO: 3576361 - RNA, 21 nt, Pseudomonas putida KT2440
gcaggcauacaggaccaggcc

SEQ ID NO: 3576362 - RNA, 23 nt, Pseudomonas putida KT2440
gcaggcauacaggaccaggccga

SEQ ID NO: 3576363 - RNA, 17 nt, Pseudomonas putida KT2440
gcaggcauaucaagaau

SEQ ID NO: 3576364 - RNA, 17 nt, Pseudomonas putida KT2440
gcaggccaccggcagca

SEQ ID NO: 3576365 - RNA, 19 nt, Pseudomonas putida KT2440
gcaggccaccggcagcacc

SEQ ID NO: 3576366 - RNA, 21 nt, Pseudomonas putida KT2440
gcaggccagcgcacagcugcc

SEQ ID NO: 3576367 - RNA, 14 nt, Pseudomonas putida KT2440
gcaggccauggcgg

SEQ ID NO: 3576368 - RNA, 16 nt, Pseudomonas putida KT2440
gcaggcccagguaacu

SEQ ID NO: 3576369 - RNA, 23 nt, Pseudomonas putida KT2440
gcaggcccgccccuuuagcaggc

SEQ ID NO: 3576370 - RNA, 18 nt, Pseudomonas putida KT2440
gcaggcccggcagguuga

SEQ ID NO: 3576371 - RNA, 13 nt, Pseudomonas putida KT2440
gcaggccgcagcc

SEQ ID NO: 3576372 - RNA, 19 nt, Pseudomonas putida KT2440
gcaggccgccgacgaucag

SEQ ID NO: 3576373 - RNA, 16 nt, Pseudomonas putida KT2440
gcaggccgccggggua

SEQ ID NO: 3576374 - RNA, 21 nt, Pseudomonas putida KT2440
gcaggcgacgagccaguucga

SEQ ID NO: 3576375 - RNA, 14 nt, Pseudomonas putida KT2440
gcaggcgcagcugc

SEQ ID NO: 3576376 - RNA, 15 nt, Pseudomonas putida KT2440
gcaggcgcagcugcc

SEQ ID NO: 3576377 - RNA, 16 nt, Pseudomonas putida KT2440
gcaggcgcagcugcca

SEQ ID NO: 3576378 - RNA, 17 nt, Pseudomonas putida KT2440
gcaggcgcagggugugc

SEQ ID NO: 3576379 - RNA, 19 nt, Pseudomonas putida KT2440
gcaggcgccgccagcugcu

SEQ ID NO: 3576380 - RNA, 20 nt, Pseudomonas putida KT2440
gcaggcgcgacaugaucagc

SEQ ID NO: 3576381 - RNA, 20 nt, Pseudomonas putida KT2440
gcaggcgcugcagggcgccg

SEQ ID NO: 3576382 - RNA, 15 nt, Pseudomonas putida KT2440
gcaggcgguccagca

SEQ ID NO: 3576383 - RNA, 14 nt, Pseudomonas putida KT2440
gcaggcgguuggcc

SEQ ID NO: 3576384 - RNA, 20 nt, Pseudomonas putida KT2440
gcaggcgguuguagaucgcc

SEQ ID NO: 3576385 - RNA, 23 nt, Pseudomonas putida KT2440
gcaggcguguuagccguggggcu

SEQ ID NO: 3576386 - RNA, 18 nt, Pseudomonas putida KT2440
gcaggcuaucgaggggca

SEQ ID NO: 3576387 - RNA, 23 nt, Pseudomonas putida KT2440
gcaggcuaugccggucagcagca

SEQ ID NO: 3576388 - RNA, 23 nt, Pseudomonas putida KT2440
gcaggcucaucuaccagcuugcc

SEQ ID NO: 3576389 - RNA, 17 nt, Pseudomonas putida KT2440
gcaggcucugcgccagc

SEQ ID NO: 3576390 - RNA, 18 nt, Pseudomonas putida KT2440
gcaggcucugcuccagcu

SEQ ID NO: 3576391 - RNA, 19 nt, Pseudomonas putida KT2440
gcaggcucugcuccagcug

SEQ ID NO: 3576392 - RNA, 21 nt, Pseudomonas putida KT2440
gcaggcugcgugccugcugcu

SEQ ID NO: 3576393 - RNA, 22 nt, Pseudomonas putida KT2440
gcaggcugucgaacaggcugcc

SEQ ID NO: 3576394 - RNA, 20 nt, Pseudomonas putida KT2440
gcaggcuuucggccacccgg

SEQ ID NO: 3576395 - RNA, 20 nt, Pseudomonas putida KT2440
gcagggaacugcgcgagcca

SEQ ID NO: 3576396 - RNA, 20 nt, Pseudomonas putida KT2440
gcagggaagguggccggcaa

SEQ ID NO: 3576397 - RNA, 23 nt, Pseudomonas putida KT2440
gcagggcaccaguugcaggucgg

SEQ ID NO: 3576398 - RNA, 22 nt, Pseudomonas putida KT2440
gcagggcacgccaaucaccugc

SEQ ID NO: 3576399 - RNA, 17 nt, Pseudomonas putida KT2440
gcagggcccagccaccg

SEQ ID NO: 3576400 - RNA, 22 nt, Pseudomonas putida KT2440
gcagggcccccgauuccaaggu

SEQ ID NO: 3576401 - RNA, 21 nt, Pseudomonas putida KT2440
gcagggccggcccauucgcgg

SEQ ID NO: 3576402 - RNA, 22 nt, Pseudomonas putida KT2440
gcagggccuccauacgcuggug

SEQ ID NO: 3576403 - RNA, 15 nt, Pseudomonas putida KT2440
gcagggccucguuga

SEQ ID NO: 3576404 - RNA, 23 nt, Pseudomonas putida KT2440
gcagggccuggacgcgugcaagg

SEQ ID NO: 3576405 - RNA, 12 nt, Pseudomonas putida KT2440
gcagggccuugu

SEQ ID NO: 3576406 - RNA, 13 nt, Pseudomonas putida KT2440
gcagggcgccgau

SEQ ID NO: 3576407 - RNA, 22 nt, Pseudomonas putida KT2440
gcagggcgccgaucauugcugc

SEQ ID NO: 3576408 - RNA, 19 nt, Pseudomonas putida KT2440
gcagggcguugccgaucag

SEQ ID NO: 3576409 - RNA, 13 nt, Pseudomonas putida KT2440
gcagggcugcgcg

SEQ ID NO: 3576410 - RNA, 15 nt, Pseudomonas putida KT2440
gcaggggacagccac

SEQ ID NO: 3576411 - RNA, 21 nt, Pseudomonas putida KT2440
gcaggggcugccuugcagccc

SEQ ID NO: 3576412 - RNA, 19 nt, Pseudomonas putida KT2440
gcaggggcugcgcaaggcg

SEQ ID NO: 3576413 - RNA, 21 nt, Pseudomonas putida KT2440
gcaggggcuggacuaacaggu

SEQ ID NO: 3576414 - RNA, 15 nt, Pseudomonas putida KT2440
gcaggggucugugca

SEQ ID NO: 3576415 - RNA, 12 nt, Pseudomonas putida KT2440
gcagggguggga

SEQ ID NO: 3576416 - RNA, 19 nt, Pseudomonas putida KT2440
gcaggguagggguggauca

SEQ ID NO: 3576417 - RNA, 14 nt, Pseudomonas putida KT2440
gcagggucaggcgg

SEQ ID NO: 3576418 - RNA, 22 nt, Pseudomonas putida KT2440
gcagggucgccugaacgcugcg

SEQ ID NO: 3576419 - RNA, 23 nt, Pseudomonas putida KT2440
gcagggucgccugaacgcugcgc

SEQ ID NO: 3576420 - RNA, 18 nt, Pseudomonas putida KT2440
gcagggucgcgccccaag

SEQ ID NO: 3576421 - RNA, 21 nt, Pseudomonas putida KT2440
gcagggucgcgccccaagcgg

SEQ ID NO: 3576422 - RNA, 18 nt, Pseudomonas putida KT2440
gcagggugccuucagggg

SEQ ID NO: 3576423 - RNA, 23 nt, Pseudomonas putida KT2440
gcagugcccccgucagcggcaac

SEQ ID NO: 3576424 - RNA, 14 nt, Pseudomonas putida KT2440
gcagugccguggca

SEQ ID NO: 3576425 - RNA, 15 nt, Pseudomonas putida KT2440
gcagugccguggcag

SEQ ID NO: 3576426 - RNA, 16 nt, Pseudomonas putida KT2440
gcagugccguggcagg

SEQ ID NO: 3576427 - RNA, 18 nt, Pseudomonas putida KT2440
gcagugccguggcaggca

SEQ ID NO: 3576428 - RNA, 15 nt, Pseudomonas putida KT2440
gcagugccugugaga

SEQ ID NO: 3576429 - RNA, 16 nt, Pseudomonas putida KT2440
gcagugcggcaaccac

SEQ ID NO: 3576430 - RNA, 23 nt, Pseudomonas putida KT2440
gcagugcggcaaccaccaacagc

SEQ ID NO: 3576431 - RNA, 17 nt, Pseudomonas putida KT2440
gcagugcuuguggccau

SEQ ID NO: 3576432 - RNA, 18 nt, Pseudomonas putida KT2440
gcaguggcaagccgagca

SEQ ID NO: 3576433 - RNA, 15 nt, Pseudomonas putida KT2440
gcaguggcggugacc

SEQ ID NO: 3576434 - RNA, 14 nt, Pseudomonas putida KT2440
gcaguggcucgugc

SEQ ID NO: 3576435 - RNA, 17 nt, Pseudomonas putida KT2440
gcagugguugugcuggc

SEQ ID NO: 3576436 - RNA, 21 nt, Pseudomonas putida KT2440
gcagugguugugcuggcccuu

SEQ ID NO: 3576437 - RNA, 13 nt, Pseudomonas putida KT2440
gcaguguacaugg

SEQ ID NO: 3576438 - RNA, 22 nt, Pseudomonas putida KT2440
gcaguguguugcgguggaagcu

SEQ ID NO: 3576439 - RNA, 20 nt, Pseudomonas putida KT2440
gcaguucacgcaggucgggg

SEQ ID NO: 3576440 - RNA, 21 nt, Pseudomonas putida KT2440
gcaguucagggcguggugaau

SEQ ID NO: 3576441 - RNA, 16 nt, Pseudomonas putida KT2440
gcaguucgagcgccug

SEQ ID NO: 3576442 - RNA, 16 nt, Pseudomonas putida KT2440
gcaguucgcggucgcc

SEQ ID NO: 3576443 - RNA, 18 nt, Pseudomonas putida KT2440
gcaguucgcggucgccgu

SEQ ID NO: 3576444 - RNA, 16 nt, Pseudomonas putida KT2440
gcaguucguccaggcu

SEQ ID NO: 3576445 - RNA, 14 nt, Pseudomonas putida KT2440
gcaguucgucgacc

SEQ ID NO: 3576446 - RNA, 19 nt, Pseudomonas putida KT2440
gcaguugaaugccgccauc

SEQ ID NO: 3576447 - RNA, 22 nt, Pseudomonas putida KT2440
gcaguugaaugccgccauccuc

SEQ ID NO: 3576448 - RNA, 18 nt, Pseudomonas putida KT2440
gcaguuggcugccggccu

SEQ ID NO: 3576449 - RNA, 15 nt, Pseudomonas putida KT2440
gcaguuguccaggcu

SEQ ID NO: 3576450 - RNA, 22 nt, Pseudomonas putida KT2440
gcaguuucuuuuaccgguugca

SEQ ID NO: 3576451 - RNA, 13 nt, Pseudomonas putida KT2440
gcauaaccaccac

SEQ ID NO: 3576452 - RNA, 15 nt, Pseudomonas putida KT2440
gcauaaccaccaccg

SEQ ID NO: 3576453 - RNA, 15 nt, Pseudomonas putida KT2440
gcauaacgccccagc

SEQ ID NO: 3576454 - RNA, 18 nt, Pseudomonas putida KT2440
gcauaacgccccagcagu

SEQ ID NO: 3576455 - RNA, 22 nt, Pseudomonas putida KT2440
gcauacagcgcacucucccgca

SEQ ID NO: 3576456 - RNA, 14 nt, Pseudomonas putida KT2440
gcauacagcuggcc

SEQ ID NO: 3576457 - RNA, 15 nt, Pseudomonas putida KT2440
gcauacagcuggccu

SEQ ID NO: 3576458 - RNA, 16 nt, Pseudomonas putida KT2440
gcauacagcuggccuu

SEQ ID NO: 3576459 - RNA, 20 nt, Pseudomonas putida KT2440
gcauacagcuugcccaucac

SEQ ID NO: 3576460 - RNA, 15 nt, Pseudomonas putida KT2440
gcauacaggaccagg

SEQ ID NO: 3576461 - RNA, 19 nt, Pseudomonas putida KT2440
gcauacaggaccaggccga

SEQ ID NO: 3576462 - RNA, 21 nt, Pseudomonas putida KT2440
gcauaccaucuucugcagcca

SEQ ID NO: 3576463 - RNA, 19 nt, Pseudomonas putida KT2440
gcauaccgcaacaccugcc

SEQ ID NO: 3576464 - RNA, 21 nt, Pseudomonas putida KT2440
gcauaccgcaacaccugccgc

SEQ ID NO: 3576465 - RNA, 16 nt, Pseudomonas putida KT2440
gcauacuugggcgcag

SEQ ID NO: 3576466 - RNA, 20 nt, Pseudomonas putida KT2440
gcauagcccguauucgcggg

SEQ ID NO: 3576467 - RNA, 14 nt, Pseudomonas putida KT2440
gcauaggccaaggu

SEQ ID NO: 3576468 - RNA, 15 nt, Pseudomonas putida KT2440
gcauauccuuuguag

SEQ ID NO: 3576469 - RNA, 15 nt, Pseudomonas putida KT2440
gcauaugcagggccu

SEQ ID NO: 3576470 - RNA, 14 nt, Pseudomonas putida KT2440
gcauaugccccagg

SEQ ID NO: 3576471 - RNA, 15 nt, Pseudomonas putida KT2440
gcaucaacaggucgc

SEQ ID NO: 3576472 - RNA, 18 nt, Pseudomonas putida KT2440
gcaucaacaggucgccgc

SEQ ID NO: 3576473 - RNA, 19 nt, Pseudomonas putida KT2440
gcaucaacaggucgccgcu

SEQ ID NO: 3576474 - RNA, 14 nt, Pseudomonas putida KT2440
gcaucaacgcugcc

SEQ ID NO: 3576475 - RNA, 21 nt, Pseudomonas putida KT2440
gcaucaacucacuuucagcgc

SEQ ID NO: 3576476 - RNA, 17 nt, Pseudomonas putida KT2440
gcaucaagucgcccagu

SEQ ID NO: 3576477 - RNA, 20 nt, Pseudomonas putida KT2440
gcaucaccacgcccuggccc

SEQ ID NO: 3576478 - RNA, 13 nt, Pseudomonas putida KT2440
gcaucacccgccc

SEQ ID NO: 3576479 - RNA, 16 nt, Pseudomonas putida KT2440
gcaucacccgccccuc

SEQ ID NO: 3576480 - RNA, 17 nt, Pseudomonas putida KT2440
gcaucaccggcagguga

SEQ ID NO: 3576481 - RNA, 18 nt, Pseudomonas putida KT2440
gcaucacgccgcgcuggc

SEQ ID NO: 3576482 - RNA, 13 nt, Pseudomonas putida KT2440
gcaucacgcuggc

SEQ ID NO: 3576483 - RNA, 19 nt, Pseudomonas putida KT2440
gcaucagcacacccagcac

SEQ ID NO: 3576484 - RNA, 16 nt, Pseudomonas putida KT2440
gcaucagccgcgcccu

SEQ ID NO: 3576485 - RNA, 13 nt, Pseudomonas putida KT2440
gcaucagccggcu

SEQ ID NO: 3576486 - RNA, 21 nt, Pseudomonas putida KT2440
gcaucagccggcuuccagcga

SEQ ID NO: 3576487 - RNA, 15 nt, Pseudomonas putida KT2440
gcaucagcgcagcau

SEQ ID NO: 3576488 - RNA, 22 nt, Pseudomonas putida KT2440
gcaucagcgugugacccaguuc

SEQ ID NO: 3576489 - RNA, 17 nt, Pseudomonas putida KT2440
gcaucagggcaucggcg

SEQ ID NO: 3576490 - RNA, 15 nt, Pseudomonas putida KT2440
gcaucaucacgcgca

SEQ ID NO: 3576491 - RNA, 22 nt, Pseudomonas putida KT2440
gcaucauccaccacccuggcau

SEQ ID NO: 3576492 - RNA, 15 nt, Pseudomonas putida KT2440
gcaucaucucugccg

SEQ ID NO: 3576493 - RNA, 22 nt, Pseudomonas putida KT2440
gcaucaugauggucacgcggcc

SEQ ID NO: 3576494 - RNA, 17 nt, Pseudomonas putida KT2440
gcauccacaccagcggc

SEQ ID NO: 3576495 - RNA, 14 nt, Pseudomonas putida KT2440
gcauccacacccug

SEQ ID NO: 3576496 - RNA, 17 nt, Pseudomonas putida KT2440
gcauccacacgcugcug

SEQ ID NO: 3576497 - RNA, 19 nt, Pseudomonas putida KT2440
gcauccacacgcugcugcg

SEQ ID NO: 3576498 - RNA, 15 nt, Pseudomonas putida KT2440
gcauccacaggcgcc

SEQ ID NO: 3576499 - RNA, 16 nt, Pseudomonas putida KT2440
gcauccaccaggucgg

SEQ ID NO: 3576500 - RNA, 21 nt, Pseudomonas putida KT2440
gcauccaccucgucaugcagc

SEQ ID NO: 3576501 - RNA, 12 nt, Pseudomonas putida KT2440
gcauccaccugc

SEQ ID NO: 3576502 - RNA, 15 nt, Pseudomonas putida KT2440
gcauccaccugcagg

SEQ ID NO: 3576503 - RNA, 22 nt, Pseudomonas putida KT2440
gcauccagcaggguggccagca

SEQ ID NO: 3576504 - RNA, 14 nt, Pseudomonas putida KT2440
gcauccagccagau

SEQ ID NO: 3576505 - RNA, 21 nt, Pseudomonas putida KT2440
gcauccagccauuccaggcua

SEQ ID NO: 3576506 - RNA, 12 nt, Pseudomonas putida KT2440
gcauccagcgcc

SEQ ID NO: 3576507 - RNA, 13 nt, Pseudomonas putida KT2440
gcauccagcgcca

SEQ ID NO: 3576508 - RNA, 15 nt, Pseudomonas putida KT2440
gcauccagcuugcca

SEQ ID NO: 3576509 - RNA, 11 nt, Pseudomonas putida KT2440
gcauccaggcg

SEQ ID NO: 3576510 - RNA, 19 nt, Pseudomonas putida KT2440
gcauccagguuccccccac

SEQ ID NO: 3576511 - RNA, 13 nt, Pseudomonas putida KT2440
gcaucccccuccu

SEQ ID NO: 3576512 - RNA, 14 nt, Pseudomonas putida KT2440
gcauccccgccagu

SEQ ID NO: 3576513 - RNA, 21 nt, Pseudomonas putida KT2440
gcauccgccaugggccugcac

SEQ ID NO: 3576514 - RNA, 15 nt, Pseudomonas putida KT2440
gcauccgccucaucc

SEQ ID NO: 3576515 - RNA, 14 nt, Pseudomonas putida KT2440
gcauccggcagcuc

SEQ ID NO: 3576516 - RNA, 14 nt, Pseudomonas putida KT2440
gcauccucaagcug

SEQ ID NO: 3576517 - RNA, 17 nt, Pseudomonas putida KT2440
gcauccuccgcccugcc

SEQ ID NO: 3576518 - RNA, 13 nt, Pseudomonas putida KT2440
gcauccucggugc

SEQ ID NO: 3576519 - RNA, 18 nt, Pseudomonas putida KT2440
gcauccucggugcgcggu

SEQ ID NO: 3576520 - RNA, 14 nt, Pseudomonas putida KT2440
gcauccugcacugc

SEQ ID NO: 3576521 - RNA, 15 nt, Pseudomonas putida KT2440
gcauccugcacugca

SEQ ID NO: 3576522 - RNA, 20 nt, Pseudomonas putida KT2440
gcauccuugggguacaccag

SEQ ID NO: 3576523 - RNA, 19 nt, Pseudomonas putida KT2440
gcaucgaacgccgccugcc

SEQ ID NO: 3576524 - RNA, 16 nt, Pseudomonas putida KT2440
gcaucgaacuccugca

SEQ ID NO: 3576525 - RNA, 15 nt, Pseudomonas putida KT2440
gcaucgacaggucca

SEQ ID NO: 3576526 - RNA, 20 nt, Pseudomonas putida KT2440
gcaucgaccggcaggcgcuu

SEQ ID NO: 3576527 - RNA, 23 nt, Pseudomonas putida KT2440
gcaucgaccggcaggcgcuucag

SEQ ID NO: 3576528 - RNA, 15 nt, Pseudomonas putida KT2440
gcaucgacgaugccg

SEQ ID NO: 3576529 - RNA, 16 nt, Pseudomonas putida KT2440
gcaugugcacuggcag

SEQ ID NO: 3576530 - RNA, 19 nt, Pseudomonas putida KT2440
gcaugugcacuggcaggcc

SEQ ID NO: 3576531 - RNA, 15 nt, Pseudomonas putida KT2440
gcauguucaggucgu

SEQ ID NO: 3576532 - RNA, 14 nt, Pseudomonas putida KT2440
gcauuacaggcaga

SEQ ID NO: 3576533 - RNA, 19 nt, Pseudomonas putida KT2440
gcauuacgcggcagcagca

SEQ ID NO: 3576534 - RNA, 22 nt, Pseudomonas putida KT2440
gcauuacuucuuggagcggccu

SEQ ID NO: 3576535 - RNA, 22 nt, Pseudomonas putida KT2440
gcauucggcgagccuuucaugu

SEQ ID NO: 3576536 - RNA, 16 nt, Pseudomonas putida KT2440
gcauugauagcggcag

SEQ ID NO: 3576537 - RNA, 19 nt, Pseudomonas putida KT2440
gcauugauagcggcagcga

SEQ ID NO: 3576538 - RNA, 22 nt, Pseudomonas putida KT2440
gcauugaucgccgccagggugu

SEQ ID NO: 3576539 - RNA, 14 nt, Pseudomonas putida KT2440
gcauugcagcccca

SEQ ID NO: 3576540 - RNA, 16 nt, Pseudomonas putida KT2440
gcauugcagccccaau

SEQ ID NO: 3576541 - RNA, 18 nt, Pseudomonas putida KT2440
gcauugcccgcgauagca

SEQ ID NO: 3576542 - RNA, 12 nt, Pseudomonas putida KT2440
gcauugccuguu

SEQ ID NO: 3576543 - RNA, 13 nt, Pseudomonas putida KT2440
gcauugcggccgu

SEQ ID NO: 3576544 - RNA, 19 nt, Pseudomonas putida KT2440
gcauugcucacugaccacc

SEQ ID NO: 3576545 - RNA, 13 nt, Pseudomonas putida KT2440
gcauuggcgcgcu

SEQ ID NO: 3576546 - RNA, 20 nt, Pseudomonas putida KT2440
gcauuggcgcgcucgacggu

SEQ ID NO: 3576547 - RNA, 20 nt, Pseudomonas putida KT2440
gcauuggcggcaggcgcagc

SEQ ID NO: 3576548 - RNA, 21 nt, Pseudomonas putida KT2440
gcauuggcggcaggcgcagcu

SEQ ID NO: 3576549 - RNA, 21 nt, Pseudomonas putida KT2440
gcauuggcgugcucgcgcaug

SEQ ID NO: 3576550 - RNA, 18 nt, Pseudomonas putida KT2440
gcauuggcguugagccgc

SEQ ID NO: 3576551 - RNA, 15 nt, Pseudomonas putida KT2440
gcauuggguggcccc

SEQ ID NO: 3576552 - RNA, 19 nt, Pseudomonas putida KT2440
gcauuucgacgcagaggug

SEQ ID NO: 3576553 - RNA, 19 nt, Pseudomonas putida KT2440
gcauuucgucgagcucgau

SEQ ID NO: 3576554 - RNA, 17 nt, Pseudomonas putida KT2440
gcauuuucaccgagcug

SEQ ID NO: 3576555 - RNA, 17 nt, Pseudomonas putida KT2440
gccaaaaaaaccccagg

SEQ ID NO: 3576556 - RNA, 21 nt, Pseudomonas putida KT2440
gccaaaaaauccgccuggccg

SEQ ID NO: 3576557 - RNA, 22 nt, Pseudomonas putida KT2440
gccaaacaggaucuccucggcc

SEQ ID NO: 3576558 - RNA, 23 nt, Pseudomonas putida KT2440
gccaaacaggaucuccucggcca

SEQ ID NO: 3576559 - RNA, 21 nt, Pseudomonas putida KT2440
gccaaaccguccagguagcgc

SEQ ID NO: 3576560 - RNA, 23 nt, Pseudomonas putida KT2440
gccaaaccucaaaugcgcccugc

SEQ ID NO: 3576561 - RNA, 14 nt, Pseudomonas putida KT2440
gccaaagccugagc

SEQ ID NO: 3576562 - RNA, 15 nt, Pseudomonas putida KT2440
gccaaaguccggcga

SEQ ID NO: 3576563 - RNA, 18 nt, Pseudomonas putida KT2440
gccaaaguccggcgaagc

SEQ ID NO: 3576564 - RNA, 15 nt, Pseudomonas putida KT2440
gccaaauucgaccag

SEQ ID NO: 3576565 - RNA, 19 nt, Pseudomonas putida KT2440
gccaaauucgaccagcagu

SEQ ID NO: 3576566 - RNA, 14 nt, Pseudomonas putida KT2440
gccaacaccaccuc

SEQ ID NO: 3576567 - RNA, 18 nt, Pseudomonas putida KT2440
gccaacaccaccuccacc

SEQ ID NO: 3576568 - RNA, 17 nt, Pseudomonas putida KT2440
gccaacacccucaccca

SEQ ID NO: 3576569 - RNA, 20 nt, Pseudomonas putida KT2440
gccaacagcacccgcccauc

SEQ ID NO: 3576570 - RNA, 18 nt, Pseudomonas putida KT2440
gccaacagcaguugcugc

SEQ ID NO: 3576571 - RNA, 19 nt, Pseudomonas putida KT2440
gccaacagcaguugcugcu

SEQ ID NO: 3576572 - RNA, 14 nt, Pseudomonas putida KT2440
gccaacaggcagca

SEQ ID NO: 3576573 - RNA, 22 nt, Pseudomonas putida KT2440
gccaaccacccgggcagcgggc

SEQ ID NO: 3576574 - RNA, 16 nt, Pseudomonas putida KT2440
gccaaccacgccugcg

SEQ ID NO: 3576575 - RNA, 22 nt, Pseudomonas putida KT2440
gccaaccccgcagacagcucga

SEQ ID NO: 3576576 - RNA, 19 nt, Pseudomonas putida KT2440
gccaaccccuccuucaggu

SEQ ID NO: 3576577 - RNA, 23 nt, Pseudomonas putida KT2440
gccaaccccuccuucagguaauc

SEQ ID NO: 3576578 - RNA, 16 nt, Pseudomonas putida KT2440
gccaacccgaucccga

SEQ ID NO: 3576579 - RNA, 16 nt, Pseudomonas putida KT2440
gccaaccgagucaaca

SEQ ID NO: 3576580 - RNA, 15 nt, Pseudomonas putida KT2440
gccaaccgcuucacc

SEQ ID NO: 3576581 - RNA, 19 nt, Pseudomonas putida KT2440
gccaaccucaggccugcac

SEQ ID NO: 3576582 - RNA, 18 nt, Pseudomonas putida KT2440
gccaaccugaucauucac

SEQ ID NO: 3576583 - RNA, 14 nt, Pseudomonas putida KT2440
gccaacgauuggca

SEQ ID NO: 3576584 - RNA, 19 nt, Pseudomonas putida KT2440
gccaacgauuggcaguccu

SEQ ID NO: 3576585 - RNA, 22 nt, Pseudomonas putida KT2440
gccaacgcaccgaccacgguac

SEQ ID NO: 3576586 - RNA, 16 nt, Pseudomonas putida KT2440
gccaacgccccaggcc

SEQ ID NO: 3576587 - RNA, 18 nt, Pseudomonas putida KT2440
gccaacgccccaggccgc

SEQ ID NO: 3576588 - RNA, 21 nt, Pseudomonas putida KT2440
gccaacgccccaggccgcggc

SEQ ID NO: 3576589 - RNA, 16 nt, Pseudomonas putida KT2440
gccaacgcccccgcca

SEQ ID NO: 3576590 - RNA, 22 nt, Pseudomonas putida KT2440
gccaacgcccccgccacccccg

SEQ ID NO: 3576591 - RNA, 15 nt, Pseudomonas putida KT2440
gccaacgcugcucgg

SEQ ID NO: 3576592 - RNA, 18 nt, Pseudomonas putida KT2440
gccaacgcugcucggccu

SEQ ID NO: 3576593 - RNA, 12 nt, Pseudomonas putida KT2440
gccaacggcacu

SEQ ID NO: 3576594 - RNA, 15 nt, Pseudomonas putida KT2440
gccaacggcaucacg

SEQ ID NO: 3576595 - RNA, 22 nt, Pseudomonas putida KT2440
gccaacggcaucacgcuggcca

SEQ ID NO: 3576596 - RNA, 12 nt, Pseudomonas putida KT2440
gccaacgggaua

SEQ ID NO: 3576597 - RNA, 20 nt, Pseudomonas putida KT2440
gccaacggucagacgcggaa

SEQ ID NO: 3576598 - RNA, 17 nt, Pseudomonas putida KT2440
gccaacggucgaucagc

SEQ ID NO: 3576599 - RNA, 12 nt, Pseudomonas putida KT2440
gccaacucccca

SEQ ID NO: 3576600 - RNA, 17 nt, Pseudomonas putida KT2440
gccaacuccccacccag

SEQ ID NO: 3576601 - RNA, 18 nt, Pseudomonas putida KT2440
gccaacuccccacccagg

SEQ ID NO: 3576602 - RNA, 22 nt, Pseudomonas putida KT2440
gccaacuccccacccaggugau

SEQ ID NO: 3576603 - RNA, 13 nt, Pseudomonas putida KT2440
gccaacugcagca

SEQ ID NO: 3576604 - RNA, 16 nt, Pseudomonas putida KT2440
gccaacugcucuacca

SEQ ID NO: 3576605 - RNA, 19 nt, Pseudomonas putida KT2440
gccaacuguuucugcucuu

SEQ ID NO: 3576606 - RNA, 16 nt, Pseudomonas putida KT2440
gccaagcacgcacagu

SEQ ID NO: 3576607 - RNA, 17 nt, Pseudomonas putida KT2440
gccaagcacggcgccga

SEQ ID NO: 3576608 - RNA, 20 nt, Pseudomonas putida KT2440
gccaagcauucgcauuacca

SEQ ID NO: 3576609 - RNA, 23 nt, Pseudomonas putida KT2440
gccaagccaccgccaccaucggc

SEQ ID NO: 3576610 - RNA, 21 nt, Pseudomonas putida KT2440
gccaagccacuggccagcaga

SEQ ID NO: 3576611 - RNA, 23 nt, Pseudomonas putida KT2440
gccaagccggcuuugcgucauca

SEQ ID NO: 3576612 - RNA, 15 nt, Pseudomonas putida KT2440
gccaagcgacgugca

SEQ ID NO: 3576613 - RNA, 16 nt, Pseudomonas putida KT2440
gccaagcgccgucgaa

SEQ ID NO: 3576614 - RNA, 16 nt, Pseudomonas putida KT2440
gccaagcggccccaau

SEQ ID NO: 3576615 - RNA, 20 nt, Pseudomonas putida KT2440
gccaaggccucgaacagcag

SEQ ID NO: 3576616 - RNA, 13 nt, Pseudomonas putida KT2440
gccaaggcguggc

SEQ ID NO: 3576617 - RNA, 16 nt, Pseudomonas putida KT2440
gccaaggcguggcuug

SEQ ID NO: 3576618 - RNA, 16 nt, Pseudomonas putida KT2440
gccaaggcuagccacg

SEQ ID NO: 3576619 - RNA, 20 nt, Pseudomonas putida KT2440
gccaagggucgacaccagga

SEQ ID NO: 3576620 - RNA, 22 nt, Pseudomonas putida KT2440
gccaaggguuugccaggcgcag

SEQ ID NO: 3576621 - RNA, 15 nt, Pseudomonas putida KT2440
gccaagguaaucugg

SEQ ID NO: 3576622 - RNA, 20 nt, Pseudomonas putida KT2440
gccaagguaaucuggcuguc

SEQ ID NO: 3576623 - RNA, 14 nt, Pseudomonas putida KT2440
gccaaggucagcaa

SEQ ID NO: 3576624 - RNA, 16 nt, Pseudomonas putida KT2440
gccaaggucagcaagc

SEQ ID NO: 3576625 - RNA, 19 nt, Pseudomonas putida KT2440
gccaaggucaucgggauca

SEQ ID NO: 3576626 - RNA, 18 nt, Pseudomonas putida KT2440
gccaagguugccaccagc

SEQ ID NO: 3576627 - RNA, 14 nt, Pseudomonas putida KT2440
gccaaguacggcca

SEQ ID NO: 3576628 - RNA, 17 nt, Pseudomonas putida KT2440
gccaaguacggccagca

SEQ ID NO: 3576629 - RNA, 19 nt, Pseudomonas putida KT2440
gccaaguacggccagcagg

SEQ ID NO: 3576630 - RNA, 14 nt, Pseudomonas putida KT2440
gccaaguguuugaa

SEQ ID NO: 3576631 - RNA, 16 nt, Pseudomonas putida KT2440
gccaaguguuugaagc

SEQ ID NO: 3576632 - RNA, 22 nt, Pseudomonas putida KT2440
gccaauaacaaguucaagguca

SEQ ID NO: 3576633 - RNA, 16 nt, Pseudomonas putida KT2440
gccaauaacucgcagc

SEQ ID NO: 3576634 - RNA, 21 nt, Pseudomonas putida KT2440
cggccgacccgccuggugcca

SEQ ID NO: 3576635 - RNA, 18 nt, Pseudomonas putida KT2440
cggccgaucacucggcag

SEQ ID NO: 3576636 - RNA, 23 nt, Pseudomonas putida KT2440
cggccgcacuucuguggaaaacc

SEQ ID NO: 3576637 - RNA, 22 nt, Pseudomonas putida KT2440
cggccgcagccccaccucggcg

SEQ ID NO: 3576638 - RNA, 13 nt, Pseudomonas putida KT2440
cggccgcauccug

SEQ ID NO: 3576639 - RNA, 19 nt, Pseudomonas putida KT2440
cggccgccaauagcccgcu

SEQ ID NO: 3576640 - RNA, 19 nt, Pseudomonas putida KT2440
cggccgccaggauggcacc

SEQ ID NO: 3576641 - RNA, 18 nt, Pseudomonas putida KT2440
cggccgccuccugcugcu

SEQ ID NO: 3576642 - RNA, 19 nt, Pseudomonas putida KT2440
cggccgccuccugcugcug

SEQ ID NO: 3576643 - RNA, 20 nt, Pseudomonas putida KT2440
cggccgccuccugcugcugc

SEQ ID NO: 3576644 - RNA, 20 nt, Pseudomonas putida KT2440
cggccgcgcaauugccgguc

SEQ ID NO: 3576645 - RNA, 18 nt, Pseudomonas putida KT2440
cggccgcgccaccgggcg

SEQ ID NO: 3576646 - RNA, 14 nt, Pseudomonas putida KT2440
cggccgcucaccgg

SEQ ID NO: 3576647 - RNA, 14 nt, Pseudomonas putida KT2440
cggccgcuccagcu

SEQ ID NO: 3576648 - RNA, 21 nt, Pseudomonas putida KT2440
cggccgcuccagcucggcugg

SEQ ID NO: 3576649 - RNA, 21 nt, Pseudomonas putida KT2440
cggccgcuucgcggaucaacc

SEQ ID NO: 3576650 - RNA, 23 nt, Pseudomonas putida KT2440
cggccgcuugaucuuguccugga

SEQ ID NO: 3576651 - RNA, 15 nt, Pseudomonas putida KT2440
cggccggccagaccu

SEQ ID NO: 3576652 - RNA, 12 nt, Pseudomonas putida KT2440
cggccggccccc

SEQ ID NO: 3576653 - RNA, 17 nt, Pseudomonas putida KT2440
cggccggggcaaccugg

SEQ ID NO: 3576654 - RNA, 18 nt, Pseudomonas putida KT2440
cggccggggcaaccuggg

SEQ ID NO: 3576655 - RNA, 15 nt, Pseudomonas putida KT2440
cggccggggccaggc

SEQ ID NO: 3576656 - RNA, 17 nt, Pseudomonas putida KT2440
cggccgggucgaaggca

SEQ ID NO: 3576657 - RNA, 19 nt, Pseudomonas putida KT2440
cggccgguacggccaaugc

SEQ ID NO: 3576658 - RNA, 14 nt, Pseudomonas putida KT2440
cggccgucgguaaa

SEQ ID NO: 3576659 - RNA, 14 nt, Pseudomonas putida KT2440
cggccgugaacacg

SEQ ID NO: 3576660 - RNA, 12 nt, Pseudomonas putida KT2440
cggccgugcagg

SEQ ID NO: 3576661 - RNA, 20 nt, Pseudomonas putida KT2440
cggccguugaaggcgaauga

SEQ ID NO: 3576662 - RNA, 20 nt, Pseudomonas putida KT2440
cggccuauucgcggguaaac

SEQ ID NO: 3576663 - RNA, 16 nt, Pseudomonas putida KT2440
cggccucagccggcuu

SEQ ID NO: 3576664 - RNA, 15 nt, Pseudomonas putida KT2440
cggccuccaccaccu

SEQ ID NO: 3576665 - RNA, 16 nt, Pseudomonas putida KT2440
cggccuccucgcgggc

SEQ ID NO: 3576666 - RNA, 20 nt, Pseudomonas putida KT2440
cggccucgguacccgccagc

SEQ ID NO: 3576667 - RNA, 20 nt, Pseudomonas putida KT2440
cggccucucucagcaaccuc

SEQ ID NO: 3576668 - RNA, 14 nt, Pseudomonas putida KT2440
cggccucuucgcgg

SEQ ID NO: 3576669 - RNA, 16 nt, Pseudomonas putida KT2440
cggccucuucgcgggu

SEQ ID NO: 3576670 - RNA, 18 nt, Pseudomonas putida KT2440
cggccucuucgcggguaa

SEQ ID NO: 3576671 - RNA, 20 nt, Pseudomonas putida KT2440
cggccucuucgcggguaagc

SEQ ID NO: 3576672 - RNA, 17 nt, Pseudomonas putida KT2440
cggccugaugccucauc

SEQ ID NO: 3576673 - RNA, 18 nt, Pseudomonas putida KT2440
cggccugaugccucauca

SEQ ID NO: 3576674 - RNA, 14 nt, Pseudomonas putida KT2440
cggccugcacuacc

SEQ ID NO: 3576675 - RNA, 22 nt, Pseudomonas putida KT2440
cggccugcagcuuuugcgcagc

SEQ ID NO: 3576676 - RNA, 12 nt, Pseudomonas putida KT2440
cggccugcccgg

SEQ ID NO: 3576677 - RNA, 20 nt, Pseudomonas putida KT2440
cggccugcccgguacgcaga

SEQ ID NO: 3576678 - RNA, 18 nt, Pseudomonas putida KT2440
cggccugcgcccaaucac

SEQ ID NO: 3576679 - RNA, 18 nt, Pseudomonas putida KT2440
cggccugcucgcuggcuu

SEQ ID NO: 3576680 - RNA, 17 nt, Pseudomonas putida KT2440
cggccuggggcaggccc

SEQ ID NO: 3576681 - RNA, 20 nt, Pseudomonas putida KT2440
cggccuggggcaggcccggc

SEQ ID NO: 3576682 - RNA, 15 nt, Pseudomonas putida KT2440
cggccugggucagcu

SEQ ID NO: 3576683 - RNA, 21 nt, Pseudomonas putida KT2440
cggccugggucagcugguucu

SEQ ID NO: 3576684 - RNA, 22 nt, Pseudomonas putida KT2440
cggccugggucagcugguucug

SEQ ID NO: 3576685 - RNA, 15 nt, Pseudomonas putida KT2440
cggccuguggguaac

SEQ ID NO: 3576686 - RNA, 17 nt, Pseudomonas putida KT2440
cggccuguggguaaccc

SEQ ID NO: 3576687 - RNA, 20 nt, Pseudomonas putida KT2440
cggccuguggguaacccugc

SEQ ID NO: 3576688 - RNA, 16 nt, Pseudomonas putida KT2440
cggccuguugcgcacu

SEQ ID NO: 3576689 - RNA, 16 nt, Pseudomonas putida KT2440
cggccuguuuggccgc

SEQ ID NO: 3576690 - RNA, 19 nt, Pseudomonas putida KT2440
cggccuucaagcuccccag

SEQ ID NO: 3576691 - RNA, 20 nt, Pseudomonas putida KT2440
cggccuucccgccuggcgcc

SEQ ID NO: 3576692 - RNA, 14 nt, Pseudomonas putida KT2440
cggccuugaccacu

SEQ ID NO: 3576693 - RNA, 18 nt, Pseudomonas putida KT2440
cggccuugaccucgacca

SEQ ID NO: 3576694 - RNA, 20 nt, Pseudomonas putida KT2440
cggccuugccgcuggcgaug

SEQ ID NO: 3576695 - RNA, 20 nt, Pseudomonas putida KT2440
cggccuugccguagaugccg

SEQ ID NO: 3576696 - RNA, 24 nt, Pseudomonas putida KT2440
cggccuugccguuccucaagcggc

SEQ ID NO: 3576697 - RNA, 19 nt, Pseudomonas putida KT2440
cggccuugcuccaguucau

SEQ ID NO: 3576698 - RNA, 18 nt, Pseudomonas putida KT2440
cggccuuggccgcuggcc

SEQ ID NO: 3576699 - RNA, 19 nt, Pseudomonas putida KT2440
cggccuuggccgcuggccc

SEQ ID NO: 3576700 - RNA, 22 nt, Pseudomonas putida KT2440
cggccuuggccgcuggcccuuc

SEQ ID NO: 3576701 - RNA, 17 nt, Pseudomonas putida KT2440
cggccuuggcgcggcgg

SEQ ID NO: 3576702 - RNA, 19 nt, Pseudomonas putida KT2440
cggccuugucagcagcuuc

SEQ ID NO: 3576703 - RNA, 22 nt, Pseudomonas putida KT2440
cggccuugucagcagcuucagc

SEQ ID NO: 3576704 - RNA, 22 nt, Pseudomonas putida KT2440
cggccuugucgcgaaaggggcg

SEQ ID NO: 3576705 - RNA, 17 nt, Pseudomonas putida KT2440
cggccuuugaagcuguu

SEQ ID NO: 3576706 - RNA, 20 nt, Pseudomonas putida KT2440
cggccuuuucauccggcgca

SEQ ID NO: 3576707 - RNA, 13 nt, Pseudomonas putida KT2440
cggcgaacacagc

SEQ ID NO: 3576708 - RNA, 19 nt, Pseudomonas putida KT2440
cggcgaacacagcggccuu

SEQ ID NO: 3576709 - RNA, 22 nt, Pseudomonas putida KT2440
cggcgaacaccccgauucacag

SEQ ID NO: 3576710 - RNA, 20 nt, Pseudomonas putida KT2440
cggcgaacagcacugccagc

SEQ ID NO: 3576711 - RNA, 23 nt, Pseudomonas putida KT2440
cggcgaacagcacugccagcccg

SEQ ID NO: 3576712 - RNA, 23 nt, Pseudomonas putida KT2440
cggcgaagucacaccaucggccg

SEQ ID NO: 3576713 - RNA, 15 nt, Pseudomonas putida KT2440
cggcgacagggcgaa

SEQ ID NO: 3576714 - RNA, 14 nt, Pseudomonas putida KT2440
cggcgacaggugcc

SEQ ID NO: 3576715 - RNA, 13 nt, Pseudomonas putida KT2440
cggcgacgucguu

SEQ ID NO: 3576716 - RNA, 22 nt, Pseudomonas putida KT2440
cggcgacguucuugccgguggu

SEQ ID NO: 3576717 - RNA, 15 nt, Pseudomonas putida KT2440
cggcgagccgccaga

SEQ ID NO: 3576718 - RNA, 21 nt, Pseudomonas putida KT2440
cggcgauacucaccgccgccc

SEQ ID NO: 3576719 - RNA, 16 nt, Pseudomonas putida KT2440
cggcgauauggcucca

SEQ ID NO: 3576720 - RNA, 19 nt, Pseudomonas putida KT2440
cggcgauauggcuccacca

SEQ ID NO: 3576721 - RNA, 12 nt, Pseudomonas putida KT2440
cggcgaucagcg

SEQ ID NO: 3576722 - RNA, 22 nt, Pseudomonas putida KT2440
cggcgaucgccagguggaagcg

SEQ ID NO: 3576723 - RNA, 17 nt, Pseudomonas putida KT2440
cggcgaucugucaggug

SEQ ID NO: 3576724 - RNA, 13 nt, Pseudomonas putida KT2440
cggcgaugcauca

SEQ ID NO: 3576725 - RNA, 14 nt, Pseudomonas putida KT2440
cggcgaugccgcgc

SEQ ID NO: 3576726 - RNA, 16 nt, Pseudomonas putida KT2440
cggcgaugccgcgcgc

SEQ ID NO: 3576727 - RNA, 18 nt, Pseudomonas putida KT2440
cggcgaugccgcgcgccc

SEQ ID NO: 3576728 - RNA, 15 nt, Pseudomonas putida KT2440
cggcgaugcgccccc

SEQ ID NO: 3576729 - RNA, 18 nt, Pseudomonas putida KT2440
cggcgaugcgccccccag

SEQ ID NO: 3576730 - RNA, 16 nt, Pseudomonas putida KT2440
cggcgauggcgucgac

SEQ ID NO: 3576731 - RNA, 16 nt, Pseudomonas putida KT2440
cggcgauggucaaccg

SEQ ID NO: 3576732 - RNA, 20 nt, Pseudomonas putida KT2440
cggcgauggucaaccggcca

SEQ ID NO: 3576733 - RNA, 18 nt, Pseudomonas putida KT2440
cggcgauggucugcucca

SEQ ID NO: 3576734 - RNA, 23 nt, Pseudomonas putida KT2440
cggcgaugugguuuuccuugauc

SEQ ID NO: 3576735 - RNA, 21 nt, Pseudomonas putida KT2440
cggcgcaauccgugagccagg

SEQ ID NO: 3576736 - RNA, 16 nt, Pseudomonas putida KT2440
cggcgcacccggcugg

SEQ ID NO: 3576737 - RNA, 19 nt, Pseudomonas putida KT2440
cggcgcaccgcuugcgcac

SEQ ID NO: 3576738 - RNA, 23 nt, Pseudomonas putida KT2440
cggcgcacgcaugcgcgacagca

SEQ ID NO: 3576739 - RNA, 16 nt, Pseudomonas putida KT2440
cggcgcacucucguca

SEQ ID NO: 3576740 - RNA, 12 nt, Pseudomonas putida KT2440
cggcccacugca

SEQ ID NO: 3576741 - RNA, 15 nt, Pseudomonas putida KT2440
cggcccagcccagua

SEQ ID NO: 3576742 - RNA, 23 nt, Pseudomonas putida KT2440
cggcccagcccaguagaucgcgc

SEQ ID NO: 3576743 - RNA, 16 nt, Pseudomonas putida KT2440
cggcccaggggcaggu

SEQ ID NO: 3576744 - RNA, 20 nt, Pseudomonas putida KT2440
cggcccaggggcaggucguu

SEQ ID NO: 3576745 - RNA, 23 nt, Pseudomonas putida KT2440
cggcccaucccgcuucgccagcg

SEQ ID NO: 3576746 - RNA, 24 nt, Pseudomonas putida KT2440
cggcccaucgcauaugccccaggc

SEQ ID NO: 3576747 - RNA, 21 nt, Pseudomonas putida KT2440
cggcccaugucgaucagcggc

SEQ ID NO: 3576748 - RNA, 22 nt, Pseudomonas putida KT2440
cggcccaugucgaucagcggcu

SEQ ID NO: 3576749 - RNA, 14 nt, Pseudomonas putida KT2440
cggcccauucgcgg

SEQ ID NO: 3576750 - RNA, 20 nt, Pseudomonas putida KT2440
cggcccauucgcggguaaac

SEQ ID NO: 3576751 - RNA, 17 nt, Pseudomonas putida KT2440
cggcccauucgcgggug

SEQ ID NO: 3576752 - RNA, 14 nt, Pseudomonas putida KT2440
cggccccacgcagu

SEQ ID NO: 3576753 - RNA, 20 nt, Pseudomonas putida KT2440
cggccccacgcaguuggcca

SEQ ID NO: 3576754 - RNA, 13 nt, Pseudomonas putida KT2440
cggccccagggcu

SEQ ID NO: 3576755 - RNA, 12 nt, Pseudomonas putida KT2440
cggccccagggu

SEQ ID NO: 3576756 - RNA, 13 nt, Pseudomonas putida KT2440
cggccccaguggc

SEQ ID NO: 3576757 - RNA, 15 nt, Pseudomonas putida KT2440
cggccccaguggcuu

SEQ ID NO: 3576758 - RNA, 18 nt, Pseudomonas putida KT2440
cggccccaguggcuuaca

SEQ ID NO: 3576759 - RNA, 19 nt, Pseudomonas putida KT2440
cggcccccacgccgaccgc

SEQ ID NO: 3576760 - RNA, 15 nt, Pseudomonas putida KT2440
cggcccccccaucau

SEQ ID NO: 3576761 - RNA, 23 nt, Pseudomonas putida KT2440
cggcccccuguagauaggcuguu

SEQ ID NO: 3576762 - RNA, 17 nt, Pseudomonas putida KT2440
cggccccggccccaggg

SEQ ID NO: 3576763 - RNA, 14 nt, Pseudomonas putida KT2440
cggccccuggaacc

SEQ ID NO: 3576764 - RNA, 22 nt, Pseudomonas putida KT2440
cggccccuggaaccccauccac

SEQ ID NO: 3576765 - RNA, 16 nt, Pseudomonas putida KT2440
cggcccgccggcaacu

SEQ ID NO: 3576766 - RNA, 22 nt, Pseudomonas putida KT2440
cggcccgcugccaccuuccagg

SEQ ID NO: 3576767 - RNA, 17 nt, Pseudomonas putida KT2440
cggcccggcauccuugg

SEQ ID NO: 3576768 - RNA, 17 nt, Pseudomonas putida KT2440
cggcccggccaacaacg

SEQ ID NO: 3576769 - RNA, 16 nt, Pseudomonas putida KT2440
cggcccggcuggccac

SEQ ID NO: 3576770 - RNA, 18 nt, Pseudomonas putida KT2440
cggcccugagccuuguca

SEQ ID NO: 3576771 - RNA, 14 nt, Pseudomonas putida KT2440
cggcccugaucccg

SEQ ID NO: 3576772 - RNA, 15 nt, Pseudomonas putida KT2440
cggcccugugccggg

SEQ ID NO: 3576773 - RNA, 21 nt, Pseudomonas putida KT2440
cggcccuguguaggagcgggu

SEQ ID NO: 3576774 - RNA, 15 nt, Pseudomonas putida KT2440
cggcccuucgcgggc

SEQ ID NO: 3576775 - RNA, 16 nt, Pseudomonas putida KT2440
cggcccuucgcgggca

SEQ ID NO: 3576776 - RNA, 15 nt, Pseudomonas putida KT2440
cggcccuugcucaau

SEQ ID NO: 3576777 - RNA, 14 nt, Pseudomonas putida KT2440
cggcccuuggcagc

SEQ ID NO: 3576778 - RNA, 20 nt, Pseudomonas putida KT2440
cggcccuuggcagcgcugca

SEQ ID NO: 3576779 - RNA, 17 nt, Pseudomonas putida KT2440
cggcccuuucgcgggua

SEQ ID NO: 3576780 - RNA, 20 nt, Pseudomonas putida KT2440
cggcccuuucgcggguaaac

SEQ ID NO: 3576781 - RNA, 20 nt, Pseudomonas putida KT2440
cggcccuuucgcgggugaac

SEQ ID NO: 3576782 - RNA, 19 nt, Pseudomonas putida KT2440
cggccgaaggcgcuggcga

SEQ ID NO: 3576783 - RNA, 17 nt, Pseudomonas putida KT2440
cggcacagaccgcaaca

SEQ ID NO: 3576784 - RNA, 15 nt, Pseudomonas putida KT2440
cggcacagcccagcu

SEQ ID NO: 3576785 - RNA, 13 nt, Pseudomonas putida KT2440
cggcacagugcca

SEQ ID NO: 3576786 - RNA, 17 nt, Pseudomonas putida KT2440
cggcacagugccaagga

SEQ ID NO: 3576787 - RNA, 17 nt, Pseudomonas putida KT2440
cggcacaucucaaggcu

SEQ ID NO: 3576788 - RNA, 20 nt, Pseudomonas putida KT2440
cggcaccaccgauucgcgca

SEQ ID NO: 3576789 - RNA, 22 nt, Pseudomonas putida KT2440
cggcaccagcaccagcuccugg

SEQ ID NO: 3576790 - RNA, 14 nt, Pseudomonas putida KT2440
cggcaccgaaggca

SEQ ID NO: 3576791 - RNA, 14 nt, Pseudomonas putida KT2440
cggcaccgccagcu

SEQ ID NO: 3576792 - RNA, 17 nt, Pseudomonas putida KT2440
cggcaccgccauggucg

SEQ ID NO: 3576793 - RNA, 21 nt, Pseudomonas putida KT2440
cggcaccgccauggucgcguu

SEQ ID NO: 3576794 - RNA, 20 nt, Pseudomonas putida KT2440
cggcaccggcgaacagcaau

SEQ ID NO: 3576795 - RNA, 16 nt, Pseudomonas putida KT2440
cggcaccucguccagg

SEQ ID NO: 3576796 - RNA, 17 nt, Pseudomonas putida KT2440
cggcaccucguccaggu

SEQ ID NO: 3576797 - RNA, 16 nt, Pseudomonas putida KT2440
cggcaccugcuugccg

SEQ ID NO: 3576798 - RNA, 17 nt, Pseudomonas putida KT2440
cggcaccugcuugccgc

SEQ ID NO: 3576799 - RNA, 17 nt, Pseudomonas putida KT2440
cggcaccuuucuccagg

SEQ ID NO: 3576800 - RNA, 19 nt, Pseudomonas putida KT2440
cggcaccuuugcaggugcc

SEQ ID NO: 3576801 - RNA, 14 nt, Pseudomonas putida KT2440
cggcacgcccgcuc

SEQ ID NO: 3576802 - RNA, 13 nt, Pseudomonas putida KT2440
cggcacgcgccag

SEQ ID NO: 3576803 - RNA, 15 nt, Pseudomonas putida KT2440
cggcacgcgccagca

SEQ ID NO: 3576804 - RNA, 14 nt, Pseudomonas putida KT2440
cggcacgcgcccgg

SEQ ID NO: 3576805 - RNA, 15 nt, Pseudomonas putida KT2440
cggcacgcgcccggu

SEQ ID NO: 3576806 - RNA, 13 nt, Pseudomonas putida KT2440
cggcacgcgggcc

SEQ ID NO: 3576807 - RNA, 19 nt, Pseudomonas putida KT2440
cggcacguuggugccgguc

SEQ ID NO: 3576808 - RNA, 22 nt, Pseudomonas putida KT2440
cggcacguuggugccggucggc

SEQ ID NO: 3576809 - RNA, 16 nt, Pseudomonas putida KT2440
cggcacuaccaggccc

SEQ ID NO: 3576810 - RNA, 16 nt, Pseudomonas putida KT2440
cggcacuccagcgagu

SEQ ID NO: 3576811 - RNA, 23 nt, Pseudomonas putida KT2440
cggcacuccagcgaguggccacg

SEQ ID NO: 3576812 - RNA, 19 nt, Pseudomonas putida KT2440
cggcacugcacagcucccu

SEQ ID NO: 3576813 - RNA, 19 nt, Pseudomonas putida KT2440
cggcacuguaggcaaacag

SEQ ID NO: 3576814 - RNA, 22 nt, Pseudomonas putida KT2440
cggcacuguaggcaaacagcuc

SEQ ID NO: 3576815 - RNA, 19 nt, Pseudomonas putida KT2440
cggcacuucguuacccucg

SEQ ID NO: 3576816 - RNA, 23 nt, Pseudomonas putida KT2440
cggcacuucguuacccucggcau

SEQ ID NO: 3576817 - RNA, 13 nt, Pseudomonas putida KT2440
cggcagagcgcca

SEQ ID NO: 3576818 - RNA, 19 nt, Pseudomonas putida KT2440
cggcagauacaaccccaga

SEQ ID NO: 3576819 - RNA, 20 nt, Pseudomonas putida KT2440
cggcagauacaaccccagau

SEQ ID NO: 3576820 - RNA, 19 nt, Pseudomonas putida KT2440
cggcagaucaggcaaucac

SEQ ID NO: 3576821 - RNA, 16 nt, Pseudomonas putida KT2440
cggcagauccugcagc

SEQ ID NO: 3576822 - RNA, 18 nt, Pseudomonas putida KT2440
cggcagaucgagcgccgc

SEQ ID NO: 3576823 - RNA, 17 nt, Pseudomonas putida KT2440
cggcagcaaacccgaca

SEQ ID NO: 3576824 - RNA, 18 nt, Pseudomonas putida KT2440
cggcagcaaacccgacaa

SEQ ID NO: 3576825 - RNA, 16 nt, Pseudomonas putida KT2440
cggcagcaacacgacg

SEQ ID NO: 3576826 - RNA, 21 nt, Pseudomonas putida KT2440
cggcagcaacacgacgauggc

SEQ ID NO: 3576827 - RNA, 15 nt, Pseudomonas putida KT2440
cggcagcaccugcca

SEQ ID NO: 3576828 - RNA, 16 nt, Pseudomonas putida KT2440
cggcagcaugaacagc

SEQ ID NO: 3576829 - RNA, 18 nt, Pseudomonas putida KT2440
cggcagcaugaacagcgc

SEQ ID NO: 3576830 - RNA, 20 nt, Pseudomonas putida KT2440
cggcagcaugaacagcgcug

SEQ ID NO: 3576831 - RNA, 15 nt, Pseudomonas putida KT2440
cggcagccaccgccg

SEQ ID NO: 3576832 - RNA, 23 nt, Pseudomonas putida KT2440
cggcagccaggguguacuucacc

SEQ ID NO: 3576833 - RNA, 22 nt, Pseudomonas putida KT2440
cggcagcgacagcugcggcaug

SEQ ID NO: 3576834 - RNA, 22 nt, Pseudomonas putida KT2440
cggcagcgacgauaccggcgcu

SEQ ID NO: 3576835 - RNA, 13 nt, Pseudomonas putida KT2440
cggcagcgaugcc

SEQ ID NO: 3576836 - RNA, 22 nt, Pseudomonas putida KT2440
cggcagcgaugccggggcuuug

SEQ ID NO: 3576837 - RNA, 13 nt, Pseudomonas putida KT2440
cggcagcgcaauc

SEQ ID NO: 3576838 - RNA, 13 nt, Pseudomonas putida KT2440
cggcagcgcggcc

SEQ ID NO: 3576839 - RNA, 24 nt, Pseudomonas putida KT2440
cggcagcucaaccgacaccagacg

SEQ ID NO: 3576840 - RNA, 15 nt, Pseudomonas putida KT2440
cggcagcucaccggc

SEQ ID NO: 3576841 - RNA, 17 nt, Pseudomonas putida KT2440
cggcagcucaccggcaa

SEQ ID NO: 3576842 - RNA, 19 nt, Pseudomonas putida KT2440
cggcagcucaccggcaauc

SEQ ID NO: 3576843 - RNA, 17 nt, Pseudomonas putida KT2440
cggcagcucgagcaugc

SEQ ID NO: 3576844 - RNA, 16 nt, Pseudomonas putida KT2440
cggcagcucgccgugg

SEQ ID NO: 3576845 - RNA, 17 nt, Pseudomonas putida KT2440
cggcagcucgcgcugcg

SEQ ID NO: 3576846 - RNA, 20 nt, Pseudomonas putida KT2440
cggcagcucgcgcugcgcag

SEQ ID NO: 3576847 - RNA, 16 nt, Pseudomonas putida KT2440
cggcaggccggccacc

SEQ ID NO: 3576848 - RNA, 17 nt, Pseudomonas putida KT2440
cggcaggccggccacca

SEQ ID NO: 3576849 - RNA, 19 nt, Pseudomonas putida KT2440
cggcaggccggccaccagu

SEQ ID NO: 3576850 - RNA, 23 nt, Pseudomonas putida KT2440
cggcaggcgaaugcgcccggcca

SEQ ID NO: 3576851 - RNA, 15 nt, Pseudomonas putida KT2440
cggcaggcgcagcug

SEQ ID NO: 3576852 - RNA, 16 nt, Pseudomonas putida KT2440
cggcaggcgcagcugc

SEQ ID NO: 3576853 - RNA, 17 nt, Pseudomonas putida KT2440
cggcaggcucugcucca

SEQ ID NO: 3576854 - RNA, 12 nt, Pseudomonas putida KT2440
cggcaggcuggc

SEQ ID NO: 3576855 - RNA, 14 nt, Pseudomonas putida KT2440
cggcaggcuggcgu

SEQ ID NO: 3576856 - RNA, 11 nt, Pseudomonas putida KT2440
cggcagggccg

SEQ ID NO: 3576857 - RNA, 11 nt, Pseudomonas putida KT2440
cggcaggucga

SEQ ID NO: 3576858 - RNA, 11 nt, Pseudomonas putida KT2440
cggcaggucgg

SEQ ID NO: 3576859 - RNA, 18 nt, Pseudomonas putida KT2440
cggcaggugggucacggu

SEQ ID NO: 3576860 - RNA, 22 nt, Pseudomonas putida KT2440
cggcaguacauagaacagcauc

SEQ ID NO: 3576861 - RNA, 14 nt, Pseudomonas putida KT2440
cggcagucaggguc

SEQ ID NO: 3576862 - RNA, 22 nt, Pseudomonas putida KT2440
cggcagucagggucucggccaa

SEQ ID NO: 3576863 - RNA, 17 nt, Pseudomonas putida KT2440
cggcagugaacuccaac

SEQ ID NO: 3576864 - RNA, 17 nt, Pseudomonas putida KT2440
cggcaguugcaggcgca

SEQ ID NO: 3576865 - RNA, 18 nt, Pseudomonas putida KT2440
cggcaguugcaggcgcag

SEQ ID NO: 3576866 - RNA, 22 nt, Pseudomonas putida KT2440
cggcaguugcaggcgcagggug

SEQ ID NO: 3576867 - RNA, 23 nt, Pseudomonas putida KT2440
cggcaguugcaggcgcagggugu

SEQ ID NO: 3576868 - RNA, 14 nt, Pseudomonas putida KT2440
cggcaguugccugc

SEQ ID NO: 3576869 - RNA, 16 nt, Pseudomonas putida KT2440
cggcaguugccugccu

SEQ ID NO: 3576870 - RNA, 22 nt, Pseudomonas putida KT2440
cggcaguuugccgaugaucgaa

SEQ ID NO: 3576871 - RNA, 15 nt, Pseudomonas putida KT2440
cggcauaacggcugg

SEQ ID NO: 3576872 - RNA, 14 nt, Pseudomonas putida KT2440
cggcauacagcucc

SEQ ID NO: 3576873 - RNA, 17 nt, Pseudomonas putida KT2440
cggcauacagcucccgc

SEQ ID NO: 3576874 - RNA, 21 nt, Pseudomonas putida KT2440
cggcaucacuacccaggccaa

SEQ ID NO: 3576875 - RNA, 23 nt, Pseudomonas putida KT2440
cggcaucagcucauacggguguu

SEQ ID NO: 3576876 - RNA, 14 nt, Pseudomonas putida KT2440
cggcaucagggccc

SEQ ID NO: 3576877 - RNA, 21 nt, Pseudomonas putida KT2440
cggcaucauccugcucgacaa

SEQ ID NO: 3576878 - RNA, 23 nt, Pseudomonas putida KT2440
cggcaucaugauggucacgcggc

SEQ ID NO: 3576879 - RNA, 18 nt, Pseudomonas putida KT2440
cggcauccaggcgggcga

SEQ ID NO: 3576880 - RNA, 19 nt, Pseudomonas putida KT2440
cggcauccccgccagugac

SEQ ID NO: 3576881 - RNA, 17 nt, Pseudomonas putida KT2440
cggcauccgccucaucc

SEQ ID NO: 3576882 - RNA, 16 nt, Pseudomonas putida KT2440
cggcauccucaagcug

SEQ ID NO: 3576883 - RNA, 13 nt, Pseudomonas putida KT2440
cggcauccuuggg

SEQ ID NO: 3576884 - RNA, 14 nt, Pseudomonas putida KT2440
cggcaucgaacagc

SEQ ID NO: 3576885 - RNA, 16 nt, Pseudomonas putida KT2440
cggcaucgacgaugcc

SEQ ID NO: 3576886 - RNA, 20 nt, Pseudomonas putida KT2440
cggcaucgacgaugccguac

SEQ ID NO: 3576887 - RNA, 21 nt, Pseudomonas putida KT2440
cggcaucgacgaugccguaca

SEQ ID NO: 3576888 - RNA, 21 nt, Pseudomonas putida KT2440
cgcguugauuuagcaggcacc

SEQ ID NO: 3576889 - RNA, 14 nt, Pseudomonas putida KT2440
cgcguugcggaaca

SEQ ID NO: 3576890 - RNA, 18 nt, Pseudomonas putida KT2440
cgcguuguucagcagcga

SEQ ID NO: 3576891 - RNA, 19 nt, Pseudomonas putida KT2440
cgcguuguucagcagcgaa

SEQ ID NO: 3576892 - RNA, 19 nt, Pseudomonas putida KT2440
cgcguuucggcggccugca

SEQ ID NO: 3576893 - RNA, 16 nt, Pseudomonas putida KT2440
cgcuaaguuugcccag

SEQ ID NO: 3576894 - RNA, 17 nt, Pseudomonas putida KT2440
cgcuacagcuuugaggc

SEQ ID NO: 3576895 - RNA, 20 nt, Pseudomonas putida KT2440
cgcuacccaaacucuugagc

SEQ ID NO: 3576896 - RNA, 13 nt, Pseudomonas putida KT2440
cgcuaccugguuc

SEQ ID NO: 3576897 - RNA, 18 nt, Pseudomonas putida KT2440
cgcuacgacccaccgacc

SEQ ID NO: 3576898 - RNA, 17 nt, Pseudomonas putida KT2440
cgcuacgagagaucgca

SEQ ID NO: 3576899 - RNA, 18 nt, Pseudomonas putida KT2440
cgcuacgagagaucgcag

SEQ ID NO: 3576900 - RNA, 23 nt, Pseudomonas putida KT2440
cgcuacgagagaucgcagcgagc

SEQ ID NO: 3576901 - RNA, 13 nt, Pseudomonas putida KT2440
cgcuagaaacaga

SEQ ID NO: 3576902 - RNA, 15 nt, Pseudomonas putida KT2440
cgcuagucaagcugc

SEQ ID NO: 3576903 - RNA, 17 nt, Pseudomonas putida KT2440
cgcuagucaagcugcgc

SEQ ID NO: 3576904 - RNA, 19 nt, Pseudomonas putida KT2440
cgcuagucaagcugcgccg

SEQ ID NO: 3576905 - RNA, 12 nt, Pseudomonas putida KT2440
cgcucaacacgu

SEQ ID NO: 3576906 - RNA, 23 nt, Pseudomonas putida KT2440
cgcucaacuggcucaugcgccag

SEQ ID NO: 3576907 - RNA, 20 nt, Pseudomonas putida KT2440
cgcucaagcgaggugacugc

SEQ ID NO: 3576908 - RNA, 15 nt, Pseudomonas putida KT2440
cgcucaagcgugacg

SEQ ID NO: 3576909 - RNA, 17 nt, Pseudomonas putida KT2440
cgcucaagucugcauag

SEQ ID NO: 3576910 - RNA, 22 nt, Pseudomonas putida KT2440
cgcucacaaagcccuugucgaa

SEQ ID NO: 3576911 - RNA, 13 nt, Pseudomonas putida KT2440
cgcucaccccgcc

SEQ ID NO: 3576912 - RNA, 14 nt, Pseudomonas putida KT2440
cgcucaccccgccc

SEQ ID NO: 3576913 - RNA, 15 nt, Pseudomonas putida KT2440
cgcucaccccgcccc

SEQ ID NO: 3576914 - RNA, 15 nt, Pseudomonas putida KT2440
cgcucaccggccagc

SEQ ID NO: 3576915 - RNA, 18 nt, Pseudomonas putida KT2440
cgcucaccuacugccguc

SEQ ID NO: 3576916 - RNA, 20 nt, Pseudomonas putida KT2440
cgcucagaaucagcuugcca

SEQ ID NO: 3576917 - RNA, 15 nt, Pseudomonas putida KT2440
cgcucaggcucuuga

SEQ ID NO: 3576918 - RNA, 14 nt, Pseudomonas putida KT2440
cgcucagguagcgc

SEQ ID NO: 3576919 - RNA, 15 nt, Pseudomonas putida KT2440
cgcucaggugcaccu

SEQ ID NO: 3576920 - RNA, 16 nt, Pseudomonas putida KT2440
cgcucaggugcaccuc

SEQ ID NO: 3576921 - RNA, 23 nt, Pseudomonas putida KT2440
cgcucaggugcaccuccgcccgg

SEQ ID NO: 3576922 - RNA, 19 nt, Pseudomonas putida KT2440
cgcucagugugggggcggc

SEQ ID NO: 3576923 - RNA, 21 nt, Pseudomonas putida KT2440
cgcucagugugggggcggccu

SEQ ID NO: 3576924 - RNA, 19 nt, Pseudomonas putida KT2440
cgcucauccagcguggccu

SEQ ID NO: 3576925 - RNA, 15 nt, Pseudomonas putida KT2440
cgcucaugaacagcg

SEQ ID NO: 3576926 - RNA, 16 nt, Pseudomonas putida KT2440
cgcucaugaacagcgc

SEQ ID NO: 3576927 - RNA, 11 nt, Pseudomonas putida KT2440
cgcucaugccc

SEQ ID NO: 3576928 - RNA, 17 nt, Pseudomonas putida KT2440
cgcucaugccccgcacc

SEQ ID NO: 3576929 - RNA, 21 nt, Pseudomonas putida KT2440
cgcucaugcugguuuggcagc

SEQ ID NO: 3576930 - RNA, 23 nt, Pseudomonas putida KT2440
cgcucauggaaauaacgcgggca

SEQ ID NO: 3576931 - RNA, 16 nt, Pseudomonas putida KT2440
cgcucauguccagguc

SEQ ID NO: 3576932 - RNA, 16 nt, Pseudomonas putida KT2440
cgcuccagcagcucca

SEQ ID NO: 3576933 - RNA, 21 nt, Pseudomonas putida KT2440
cgcuccagcagcuccacaucu

SEQ ID NO: 3576934 - RNA, 20 nt, Pseudomonas putida KT2440
cgcuccagcagggucgccug

SEQ ID NO: 3576935 - RNA, 11 nt, Pseudomonas putida KT2440
cgcuccagcuc

SEQ ID NO: 3576936 - RNA, 17 nt, Pseudomonas putida KT2440
cgcuccagcucggcugg

SEQ ID NO: 3576937 - RNA, 12 nt, Pseudomonas putida KT2440
cgcuccaggcgg

SEQ ID NO: 3576938 - RNA, 15 nt, Pseudomonas putida KT2440
cgcuccaggcggcca

SEQ ID NO: 3576939 - RNA, 17 nt, Pseudomonas putida KT2440
cgcuccaggcggccagc

SEQ ID NO: 3576940 - RNA, 20 nt, Pseudomonas putida KT2440
cgcuccaggcggccagccaa

SEQ ID NO: 3576941 - RNA, 22 nt, Pseudomonas putida KT2440
cgcuccaggcggccagccaacg

SEQ ID NO: 3576942 - RNA, 23 nt, Pseudomonas putida KT2440
cgcuccaucaugcgguccugguc

SEQ ID NO: 3576943 - RNA, 16 nt, Pseudomonas putida KT2440
cgcucccacaaaggcc

SEQ ID NO: 3576944 - RNA, 16 nt, Pseudomonas putida KT2440
cgcucccacaggaaug

SEQ ID NO: 3576945 - RNA, 20 nt, Pseudomonas putida KT2440
cgcucccacagggaucgcgc

SEQ ID NO: 3576946 - RNA, 24 nt, Pseudomonas putida KT2440
cgcucccacagggaucgcgccagc

SEQ ID NO: 3576947 - RNA, 15 nt, Pseudomonas putida KT2440
cgcucccacaggggc

SEQ ID NO: 3576948 - RNA, 21 nt, Pseudomonas putida KT2440
cgcucccacagguccagcgca

SEQ ID NO: 3576949 - RNA, 23 nt, Pseudomonas putida KT2440
cgcucccacagguccagcgcagg

SEQ ID NO: 3576950 - RNA, 19 nt, Pseudomonas putida KT2440
cgcucccacgaggaccugc

SEQ ID NO: 3576951 - RNA, 20 nt, Pseudomonas putida KT2440
cgcucccacgaggaccugcg

SEQ ID NO: 3576952 - RNA, 13 nt, Pseudomonas putida KT2440
cgcucccaggccu

SEQ ID NO: 3576953 - RNA, 19 nt, Pseudomonas putida KT2440
cgcuccgacaaaugcacca

SEQ ID NO: 3576954 - RNA, 19 nt, Pseudomonas putida KT2440
cgcuccgccaaaccccagc

SEQ ID NO: 3576955 - RNA, 23 nt, Pseudomonas putida KT2440
cgcuccgccaaaccccagcaagg

SEQ ID NO: 3576956 - RNA, 21 nt, Pseudomonas putida KT2440
cgcuccgccaauugcgccagc

SEQ ID NO: 3576957 - RNA, 14 nt, Pseudomonas putida KT2440
cgcuccuacaggcc

SEQ ID NO: 3576958 - RNA, 16 nt, Pseudomonas putida KT2440
cgcuccuacaggccgc

SEQ ID NO: 3576959 - RNA, 22 nt, Pseudomonas putida KT2440
cgcuccuacaggggacgcauau

SEQ ID NO: 3576960 - RNA, 19 nt, Pseudomonas putida KT2440
cgcuccuacauggaucgca

SEQ ID NO: 3576961 - RNA, 15 nt, Pseudomonas putida KT2440
cgcuccuacgaaagc

SEQ ID NO: 3576962 - RNA, 18 nt, Pseudomonas putida KT2440
cgcuccuacgacggccug

SEQ ID NO: 3576963 - RNA, 21 nt, Pseudomonas putida KT2440
cgcuccuacgacggccugcgc

SEQ ID NO: 3576964 - RNA, 21 nt, Pseudomonas putida KT2440
cgcuccuacgacggucugcgu

SEQ ID NO: 3576965 - RNA, 15 nt, Pseudomonas putida KT2440
cgcugccuuccgcca

SEQ ID NO: 3576966 - RNA, 19 nt, Pseudomonas putida KT2440
cgcugccuugcccagcucc

SEQ ID NO: 3576967 - RNA, 22 nt, Pseudomonas putida KT2440
cgcugccuugcccagcuccagc

SEQ ID NO: 3576968 - RNA, 20 nt, Pseudomonas putida KT2440
cgcugccuuuggccgccagc

SEQ ID NO: 3576969 - RNA, 21 nt, Pseudomonas putida KT2440
cgcugccuuuggccgccagcg

SEQ ID NO: 3576970 - RNA, 13 nt, Pseudomonas putida KT2440
cgcugcgacucgc

SEQ ID NO: 3576971 - RNA, 17 nt, Pseudomonas putida KT2440
cgcugcgacucgcggcc

SEQ ID NO: 3576972 - RNA, 19 nt, Pseudomonas putida KT2440
cgcugcgaggaucagcgca

SEQ ID NO: 3576973 - RNA, 15 nt, Pseudomonas putida KT2440
cgcugcgaggcccca

SEQ ID NO: 3576974 - RNA, 22 nt, Pseudomonas putida KT2440
cgcugcgcaugaaacucgcgcg

SEQ ID NO: 3576975 - RNA, 13 nt, Pseudomonas putida KT2440
cgcugcgcccgcc

SEQ ID NO: 3576976 - RNA, 15 nt, Pseudomonas putida KT2440
cgcugcgcccgccuu

SEQ ID NO: 3576977 - RNA, 19 nt, Pseudomonas putida KT2440
cgcugcgccgcucugcccg

SEQ ID NO: 3576978 - RNA, 21 nt, Pseudomonas putida KT2440
cgcugcgccgcucugcccgcg

SEQ ID NO: 3576979 - RNA, 13 nt, Pseudomonas putida KT2440
cgcugcgccugcc

SEQ ID NO: 3576980 - RNA, 15 nt, Pseudomonas putida KT2440
cgcugcggcacacca

SEQ ID NO: 3576981 - RNA, 15 nt, Pseudomonas putida KT2440
cgcugcggccgucgg

SEQ ID NO: 3576982 - RNA, 12 nt, Pseudomonas putida KT2440
cgcugcggcgaa

SEQ ID NO: 3576983 - RNA, 14 nt, Pseudomonas putida KT2440
cgcugcgugaccgc

SEQ ID NO: 3576984 - RNA, 14 nt, Pseudomonas putida KT2440
cgcugcuacgccgc

SEQ ID NO: 3576985 - RNA, 13 nt, Pseudomonas putida KT2440
cgcugcucggccu

SEQ ID NO: 3576986 - RNA, 19 nt, Pseudomonas putida KT2440
cgcugcucggccucgacca

SEQ ID NO: 3576987 - RNA, 22 nt, Pseudomonas putida KT2440
cgcugcucggccucgaccacga

SEQ ID NO: 3576988 - RNA, 22 nt, Pseudomonas putida KT2440
cgcugcugguccucgacgggca

SEQ ID NO: 3576989 - RNA, 20 nt, Pseudomonas putida KT2440
cgcuggaagugcugagaggg

SEQ ID NO: 3576990 - RNA, 21 nt, Pseudomonas putida KT2440
cgcuggaauuauuggccagca

SEQ ID NO: 3576991 - RNA, 22 nt, Pseudomonas putida KT2440
cgcuggaauuauuggccagcaa

SEQ ID NO: 3576992 - RNA, 13 nt, Pseudomonas putida KT2440
cgcuggacagcgg

SEQ ID NO: 3576993 - RNA, 14 nt, Pseudomonas putida KT2440
cgcuggacuugccu

SEQ ID NO: 3576994 - RNA, 17 nt, Pseudomonas putida KT2440
cgcuggacuugccuugg

SEQ ID NO: 3576995 - RNA, 13 nt, Pseudomonas putida KT2440
cgcuggagcggga

SEQ ID NO: 3576996 - RNA, 15 nt, Pseudomonas putida KT2440
cgcuggcacaggcua

SEQ ID NO: 3576997 - RNA, 21 nt, Pseudomonas putida KT2440
cgcuggcacaggcuacgcagc

SEQ ID NO: 3576998 - RNA, 12 nt, Pseudomonas putida KT2440
cgcuggcaccca

SEQ ID NO: 3576999 - RNA, 18 nt, Pseudomonas putida KT2440
cgcuggcacccacgcgcu

SEQ ID NO: 3577000 - RNA, 22 nt, Pseudomonas putida KT2440
cgcuggcauccaccaggucggu

SEQ ID NO: 3577001 - RNA, 19 nt, Pseudomonas putida KT2440
cgcuggccaggcuugguuu

SEQ ID NO: 3577002 - RNA, 17 nt, Pseudomonas putida KT2440
cgcuggcccuucgcgga

SEQ ID NO: 3577003 - RNA, 13 nt, Pseudomonas putida KT2440
cgcuggcccuugc

SEQ ID NO: 3577004 - RNA, 16 nt, Pseudomonas putida KT2440
cgcuggcccuugccau

SEQ ID NO: 3577005 - RNA, 15 nt, Pseudomonas putida KT2440
cgcuggccgcaccca

SEQ ID NO: 3577006 - RNA, 18 nt, Pseudomonas putida KT2440
cgcuggccgcacccagca

SEQ ID NO: 3577007 - RNA, 19 nt, Pseudomonas putida KT2440
cgcuggccgcacccagcag

SEQ ID NO: 3577008 - RNA, 23 nt, Pseudomonas putida KT2440
cgcuggccgcacccagcaggccg

SEQ ID NO: 3577009 - RNA, 16 nt, Pseudomonas putida KT2440
cgcuggccgguggccc

SEQ ID NO: 3577010 - RNA, 14 nt, Pseudomonas putida KT2440
cgcuggccugcccc

SEQ ID NO: 3577011 - RNA, 15 nt, Pseudomonas putida KT2440
cgcuggcgaaacaau

SEQ ID NO: 3577012 - RNA, 12 nt, Pseudomonas putida KT2440
cgcuggcgacga

SEQ ID NO: 3577013 - RNA, 15 nt, Pseudomonas putida KT2440
cgcuggcgacgaagc

SEQ ID NO: 3577014 - RNA, 18 nt, Pseudomonas putida KT2440
cgcuggcgacgaagcugc

SEQ ID NO: 3577015 - RNA, 14 nt, Pseudomonas putida KT2440
cgcuggcgaucagg

SEQ ID NO: 3577016 - RNA, 18 nt, Pseudomonas putida KT2440
cgcuggcgcagagggucu

SEQ ID NO: 3577017 - RNA, 16 nt, Pseudomonas putida KT2440
cgcuggcgccagccgc

SEQ ID NO: 3577018 - RNA, 21 nt, Pseudomonas putida KT2440
cgcuggcgccagccgccacga

SEQ ID NO: 3577019 - RNA, 17 nt, Pseudomonas putida KT2440
cgcuggcgccugcggca

SEQ ID NO: 3577020 - RNA, 19 nt, Pseudomonas putida KT2440
cgcuggcgccugcggcauc

SEQ ID NO: 3577021 - RNA, 12 nt, Pseudomonas putida KT2440
cgcuggcgcgcu

SEQ ID NO: 3577022 - RNA, 13 nt, Pseudomonas putida KT2440
cgcuggcgcuggu

SEQ ID NO: 3577023 - RNA, 16 nt, Pseudomonas putida KT2440
cgcuggcgggcaaacu

SEQ ID NO: 3577024 - RNA, 14 nt, Pseudomonas putida KT2440
cgcuggcugccgcg

SEQ ID NO: 3577025 - RNA, 16 nt, Pseudomonas putida KT2440
cgcuggcugccgcggg

SEQ ID NO: 3577026 - RNA, 22 nt, Pseudomonas putida KT2440
cgcuggcuggcagcugcagugc

SEQ ID NO: 3577027 - RNA, 19 nt, Pseudomonas putida KT2440
cgcuggcuuccucacggca

SEQ ID NO: 3577028 - RNA, 16 nt, Pseudomonas putida KT2440
cgcuggcuuguccuug

SEQ ID NO: 3577029 - RNA, 13 nt, Pseudomonas putida KT2440
cgcugggcacccu

SEQ ID NO: 3577030 - RNA, 15 nt, Pseudomonas putida KT2440
cgcugggcacccuga

SEQ ID NO: 3577031 - RNA, 18 nt, Pseudomonas putida KT2440
cgcugggcgguacccacc

SEQ ID NO: 3577032 - RNA, 17 nt, Pseudomonas putida KT2440
cgcugggcuuacggucu

SEQ ID NO: 3577033 - RNA, 22 nt, Pseudomonas putida KT2440
cgcugggcuuacggucuccggu

SEQ ID NO: 3577034 - RNA, 14 nt, Pseudomonas putida KT2440
cgcugguaagccuc

SEQ ID NO: 3577035 - RNA, 17 nt, Pseudomonas putida KT2440
cgcuggucaaucuguga

SEQ ID NO: 3577036 - RNA, 22 nt, Pseudomonas putida KT2440
cgcuggucaaucugugaggcca

SEQ ID NO: 3577037 - RNA, 23 nt, Pseudomonas putida KT2440
cgcuggucgcgcagauggcagac

SEQ ID NO: 3577038 - RNA, 20 nt, Pseudomonas putida KT2440
cgcugguucauugccaacag

SEQ ID NO: 3577039 - RNA, 23 nt, Pseudomonas putida KT2440
cgcugguucauugccaacagcag

SEQ ID NO: 3577040 - RNA, 20 nt, Pseudomonas putida KT2440
cgcugguuuaucagcagcuc

SEQ ID NO: 3577041 - RNA, 14 nt, Pseudomonas putida KT2440
cgcuguacaccagg

SEQ ID NO: 3577042 - RNA, 20 nt, Pseudomonas putida KT2440
cgcuguacagcacaccuucc

SEQ ID NO: 3577043 - RNA, 23 nt, Pseudomonas putida KT2440
cgcugucaccgguaucgaugcac

SEQ ID NO: 3577044 - RNA, 14 nt, Pseudomonas putida KT2440
cgcuguccagcgca

SEQ ID NO: 3577045 - RNA, 15 nt, Pseudomonas putida KT2440
cgcuguccagcgcau

SEQ ID NO: 3577046 - RNA, 20 nt, Pseudomonas putida KT2440
cgcugucgauuuccagugcc

SEQ ID NO: 3577047 - RNA, 22 nt, Pseudomonas putida KT2440
cgcugucggucagcaucugggu

SEQ ID NO: 3577048 - RNA, 13 nt, Pseudomonas putida KT2440
cgcugucguccag

SEQ ID NO: 3577049 - RNA, 14 nt, Pseudomonas putida KT2440
cgcugucguccagc

SEQ ID NO: 3577050 - RNA, 19 nt, Pseudomonas putida KT2440
cgcugucuucugccagagg

SEQ ID NO: 3577051 - RNA, 22 nt, Pseudomonas putida KT2440
cgcugucuucugccagaggcgc

SEQ ID NO: 3577052 - RNA, 22 nt, Pseudomonas putida KT2440
cgcugugcagcgcucgcugccg

SEQ ID NO: 3577053 - RNA, 21 nt, Pseudomonas putida KT2440
cgcuguggcgcccggcgcugg

SEQ ID NO: 3577054 - RNA, 23 nt, Pseudomonas putida KT2440
cgcugugggaguaacggcccuug

SEQ ID NO: 3577055 - RNA, 21 nt, Pseudomonas putida KT2440
cgcuguucagcccuugcugca

SEQ ID NO: 3577056 - RNA, 14 nt, Pseudomonas putida KT2440
cgcuguugagcagc

SEQ ID NO: 3577057 - RNA, 18 nt, Pseudomonas putida KT2440
cgcuguugcgcaccuugu

SEQ ID NO: 3577058 - RNA, 15 nt, Pseudomonas putida KT2440
cgcuguuggcagcca

SEQ ID NO: 3577059 - RNA, 12 nt, Pseudomonas putida KT2440
cgcuuacagaug

SEQ ID NO: 3577060 - RNA, 15 nt, Pseudomonas putida KT2440
cgcuucaccgcgcac

SEQ ID NO: 3577061 - RNA, 14 nt, Pseudomonas putida KT2440
cgcuucauccagcg

SEQ ID NO: 3577062 - RNA, 17 nt, Pseudomonas putida KT2440
cgcuucauccagcggga

SEQ ID NO: 3577063 - RNA, 15 nt, Pseudomonas putida KT2440
cgcuucauggcccca

SEQ ID NO: 3577064 - RNA, 22 nt, Pseudomonas putida KT2440
cgcuucccgggcaauggcgcga

SEQ ID NO: 3577065 - RNA, 15 nt, Pseudomonas putida KT2440
cgcuuccuggccuuc

SEQ ID NO: 3577066 - RNA, 17 nt, Pseudomonas putida KT2440
cgcuuccuggccuuccu

SEQ ID NO: 3577067 - RNA, 17 nt, Pseudomonas putida KT2440
cgcuuccuuguccgcca

SEQ ID NO: 3577068 - RNA, 17 nt, Pseudomonas putida KT2440
cgcuucgaacacccgcu

SEQ ID NO: 3577069 - RNA, 19 nt, Pseudomonas putida KT2440
cgcuucgaucgccggcagc

SEQ ID NO: 3577070 - RNA, 12 nt, Pseudomonas putida KT2440
cggagccagcca

SEQ ID NO: 3577071 - RNA, 17 nt, Pseudomonas putida KT2440
cggagcgacuucgacca

SEQ ID NO: 3577072 - RNA, 18 nt, Pseudomonas putida KT2440
cggagcgacuucgaccac

SEQ ID NO: 3577073 - RNA, 16 nt, Pseudomonas putida KT2440
cggagcuccccucaga

SEQ ID NO: 3577074 - RNA, 14 nt, Pseudomonas putida KT2440
cggagcuggagccg

SEQ ID NO: 3577075 - RNA, 21 nt, Pseudomonas putida KT2440
cggaggacacaucgaucaggu

SEQ ID NO: 3577076 - RNA, 17 nt, Pseudomonas putida KT2440
cggaggcuucgaugauc

SEQ ID NO: 3577077 - RNA, 22 nt, Pseudomonas putida KT2440
cggaggugucaccgcgagcagc

SEQ ID NO: 3577078 - RNA, 16 nt, Pseudomonas putida KT2440
cggaguggaagauggu

SEQ ID NO: 3577079 - RNA, 14 nt, Pseudomonas putida KT2440
cggauaccgggauu

SEQ ID NO: 3577080 - RNA, 21 nt, Pseudomonas putida KT2440
cggauagagcccggcgcagcc

SEQ ID NO: 3577081 - RNA, 18 nt, Pseudomonas putida KT2440
cggauagcgccgaucagc

SEQ ID NO: 3577082 - RNA, 21 nt, Pseudomonas putida KT2440
cggauagcgccgaucagcuua

SEQ ID NO: 3577083 - RNA, 16 nt, Pseudomonas putida KT2440
cggauaucugcgccac

SEQ ID NO: 3577084 - RNA, 19 nt, Pseudomonas putida KT2440
cggaucaccacgucuuccu

SEQ ID NO: 3577085 - RNA, 18 nt, Pseudomonas putida KT2440
cggaucaccuggccgugu

SEQ ID NO: 3577086 - RNA, 14 nt, Pseudomonas putida KT2440
cggaucacuuccau

SEQ ID NO: 3577087 - RNA, 19 nt, Pseudomonas putida KT2440
cggaucagcgcguccagca

SEQ ID NO: 3577088 - RNA, 15 nt, Pseudomonas putida KT2440
cggaucaucuccaug

SEQ ID NO: 3577089 - RNA, 13 nt, Pseudomonas putida KT2440
cggaucgauguac

SEQ ID NO: 3577090 - RNA, 22 nt, Pseudomonas putida KT2440
cggaucgauguacuuguucagg

SEQ ID NO: 3577091 - RNA, 19 nt, Pseudomonas putida KT2440
cggaucgggcacaacucca

SEQ ID NO: 3577092 - RNA, 17 nt, Pseudomonas putida KT2440
cggaucgugacggucug

SEQ ID NO: 3577093 - RNA, 19 nt, Pseudomonas putida KT2440
cggaucgugacggucugcc

SEQ ID NO: 3577094 - RNA, 23 nt, Pseudomonas putida KT2440
cggaucuuguauuggccaagaau

SEQ ID NO: 3577095 - RNA, 19 nt, Pseudomonas putida KT2440
cggaugccacgcugaacac

SEQ ID NO: 3577096 - RNA, 21 nt, Pseudomonas putida KT2440
cggaugccacgcugaacacgc

SEQ ID NO: 3577097 - RNA, 14 nt, Pseudomonas putida KT2440
cggaugcgcaagca

SEQ ID NO: 3577098 - RNA, 15 nt, Pseudomonas putida KT2440
cggauggugugcagc

SEQ ID NO: 3577099 - RNA, 13 nt, Pseudomonas putida KT2440
cggcaaacacauc

SEQ ID NO: 3577100 - RNA, 22 nt, Pseudomonas putida KT2440
cggcaaacacauccagcgccgc

SEQ ID NO: 3577101 - RNA, 22 nt, Pseudomonas putida KT2440
cggcaaacagacggugcgccug

SEQ ID NO: 3577102 - RNA, 14 nt, Pseudomonas putida KT2440
cggcaaaggccucu

SEQ ID NO: 3577103 - RNA, 15 nt, Pseudomonas putida KT2440
cggcaaaggccucuu

SEQ ID NO: 3577104 - RNA, 17 nt, Pseudomonas putida KT2440
cagcaagcgacauaaaa

SEQ ID NO: 3577105 - RNA, 18 nt, Pseudomonas putida KT2440
cagcaagcgcauaggcaa

SEQ ID NO: 3577106 - RNA, 18 nt, Pseudomonas putida KT2440
cagcaagcgcucauaccc

SEQ ID NO: 3577107 - RNA, 17 nt, Pseudomonas putida KT2440
cagcaagcucaucacca

SEQ ID NO: 3577108 - RNA, 13 nt, Pseudomonas putida KT2440
cagcaagcuggca

SEQ ID NO: 3577109 - RNA, 15 nt, Pseudomonas putida KT2440
cagcaagcuggcacc

SEQ ID NO: 3577110 - RNA, 21 nt, Pseudomonas putida KT2440
cagcaaggcaauaccgauggc

SEQ ID NO: 3577111 - RNA, 23 nt, Pseudomonas putida KT2440
cagcaaggcaaucgugaucaucc

SEQ ID NO: 3577112 - RNA, 12 nt, Pseudomonas putida KT2440
cagcaagggccu

SEQ ID NO: 3577113 - RNA, 15 nt, Pseudomonas putida KT2440
cagcaagggccugug

SEQ ID NO: 3577114 - RNA, 16 nt, Pseudomonas putida KT2440
cagcaagggccugugc

SEQ ID NO: 3577115 - RNA, 18 nt, Pseudomonas putida KT2440
cagcaagggccugugccg

SEQ ID NO: 3577116 - RNA, 20 nt, Pseudomonas putida KT2440
cagcaagucccccaucggca

SEQ ID NO: 3577117 - RNA, 14 nt, Pseudomonas putida KT2440
cagcaaucccgccc

SEQ ID NO: 3577118 - RNA, 22 nt, Pseudomonas putida KT2440
cagcaaucccgccccaaaggaa

SEQ ID NO: 3577119 - RNA, 18 nt, Pseudomonas putida KT2440
cagcaaucgccgccugga

SEQ ID NO: 3577120 - RNA, 22 nt, Pseudomonas putida KT2440
cagcaaucggcagcgcgcaggu

SEQ ID NO: 3577121 - RNA, 23 nt, Pseudomonas putida KT2440
cagcaaugaugaaagcaggucag

SEQ ID NO: 3577122 - RNA, 14 nt, Pseudomonas putida KT2440
cagcaauuacagcu

SEQ ID NO: 3577123 - RNA, 17 nt, Pseudomonas putida KT2440
cagcaauucagaagucc

SEQ ID NO: 3577124 - RNA, 12 nt, Pseudomonas putida KT2440
cagcaauuccaa

SEQ ID NO: 3577125 - RNA, 15 nt, Pseudomonas putida KT2440
cagcacaagacugcu

SEQ ID NO: 3577126 - RNA, 18 nt, Pseudomonas putida KT2440
cagcacaaggcucaagcg

SEQ ID NO: 3577127 - RNA, 19 nt, Pseudomonas putida KT2440
cagcacaaggcucaagcgc

SEQ ID NO: 3577128 - RNA, 22 nt, Pseudomonas putida KT2440
cagcacaaggcucaagcgcagc

SEQ ID NO: 3577129 - RNA, 14 nt, Pseudomonas putida KT2440
cagcacaaggcugc

SEQ ID NO: 3577130 - RNA, 20 nt, Pseudomonas putida KT2440
cagcacaaggcugcgccuga

SEQ ID NO: 3577131 - RNA, 20 nt, Pseudomonas putida KT2440
cagcacaaggcugcgcuuga

SEQ ID NO: 3577132 - RNA, 17 nt, Pseudomonas putida KT2440
cagcacaaggcuguucc

SEQ ID NO: 3577133 - RNA, 22 nt, Pseudomonas putida KT2440
cagcacaaggcuguuccacagc

SEQ ID NO: 3577134 - RNA, 17 nt, Pseudomonas putida KT2440
cagcacacccagcacga

SEQ ID NO: 3577135 - RNA, 21 nt, Pseudomonas putida KT2440
cagcacacccagcacgaaggc

SEQ ID NO: 3577136 - RNA, 12 nt, Pseudomonas putida KT2440
cagcacaccgcg

SEQ ID NO: 3577137 - RNA, 22 nt, Pseudomonas putida KT2440
cagcacaccgcgcaccucgacc

SEQ ID NO: 3577138 - RNA, 13 nt, Pseudomonas putida KT2440
cagcacaccgcuc

SEQ ID NO: 3577139 - RNA, 13 nt, Pseudomonas putida KT2440
cagcacaccuucc

SEQ ID NO: 3577140 - RNA, 14 nt, Pseudomonas putida KT2440
cagcacacuccacg

SEQ ID NO: 3577141 - RNA, 14 nt, Pseudomonas putida KT2440
cagcacacugagca

SEQ ID NO: 3577142 - RNA, 23 nt, Pseudomonas putida KT2440
cagcacacugagcaccacauacg

SEQ ID NO: 3577143 - RNA, 22 nt, Pseudomonas putida KT2440
cagcacagauaaaccugccacc

SEQ ID NO: 3577144 - RNA, 13 nt, Pseudomonas putida KT2440
cagcacaggcggc

SEQ ID NO: 3577145 - RNA, 18 nt, Pseudomonas putida KT2440
cagcacaucacacagcgg

SEQ ID NO: 3577146 - RNA, 19 nt, Pseudomonas putida KT2440
cagcacauucagcagcgcc

SEQ ID NO: 3577147 - RNA, 13 nt, Pseudomonas putida KT2440
cagcaccaaccgc

SEQ ID NO: 3577148 - RNA, 23 nt, Pseudomonas putida KT2440
cagcaccaaugaaagugucggcc

SEQ ID NO: 3577149 - RNA, 19 nt, Pseudomonas putida KT2440
cagcaccacccaccagcag

SEQ ID NO: 3577150 - RNA, 22 nt, Pseudomonas putida KT2440
cagcaccaccugugccggcagc

SEQ ID NO: 3577151 - RNA, 18 nt, Pseudomonas putida KT2440
cagcaccagcgacugcaa

SEQ ID NO: 3577152 - RNA, 13 nt, Pseudomonas putida KT2440
cagcaccagcucc

SEQ ID NO: 3577153 - RNA, 17 nt, Pseudomonas putida KT2440
cagcaccaucagagcgc

SEQ ID NO: 3577154 - RNA, 14 nt, Pseudomonas putida KT2440
cagcacccacaccc

SEQ ID NO: 3577155 - RNA, 16 nt, Pseudomonas putida KT2440
cagcacccacacccuc

SEQ ID NO: 3577156 - RNA, 17 nt, Pseudomonas putida KT2440
cagcaccccagcaccac

SEQ ID NO: 3577157 - RNA, 19 nt, Pseudomonas putida KT2440
cagcaccccguccagcccc

SEQ ID NO: 3577158 - RNA, 16 nt, Pseudomonas putida KT2440
cagcacccgcaggcga

SEQ ID NO: 3577159 - RNA, 13 nt, Pseudomonas putida KT2440
cagcacccgccca

SEQ ID NO: 3577160 - RNA, 13 nt, Pseudomonas putida KT2440
cagcacccgcuug

SEQ ID NO: 3577161 - RNA, 17 nt, Pseudomonas putida KT2440
cagcacccgcuuggcca

SEQ ID NO: 3577162 - RNA, 19 nt, Pseudomonas putida KT2440
cagcacccgcuuggccacc

SEQ ID NO: 3577163 - RNA, 20 nt, Pseudomonas putida KT2440
cagcacccgcuuggccacca

SEQ ID NO: 3577164 - RNA, 21 nt, Pseudomonas putida KT2440
cagcacccgcuuggccaccac

SEQ ID NO: 3577165 - RNA, 22 nt, Pseudomonas putida KT2440
cagcacccgcuuguagcucagg

SEQ ID NO: 3577166 - RNA, 15 nt, Pseudomonas putida KT2440
cagcaccgaucagcg

SEQ ID NO: 3577167 - RNA, 15 nt, Pseudomonas putida KT2440
cagcaccgccaccau

SEQ ID NO: 3577168 - RNA, 20 nt, Pseudomonas putida KT2440
cagcaccgccauggccaggu

SEQ ID NO: 3577169 - RNA, 15 nt, Pseudomonas putida KT2440
cagcaccgcgacgac

SEQ ID NO: 3577170 - RNA, 23 nt, Pseudomonas putida KT2440
cagcaccgcuucacccucgcgca

SEQ ID NO: 3577171 - RNA, 14 nt, Pseudomonas putida KT2440
cagcaccggccagg

SEQ ID NO: 3577172 - RNA, 23 nt, Pseudomonas putida KT2440
cagcaccgucgaggaaaagcagc

SEQ ID NO: 3577173 - RNA, 14 nt, Pseudomonas putida KT2440
cagcaccuccaccu

SEQ ID NO: 3577174 - RNA, 24 nt, Pseudomonas putida KT2440
cagcaccugcagguacagcagcug

SEQ ID NO: 3577175 - RNA, 17 nt, Pseudomonas putida KT2440
cagcaccugccagccgc

SEQ ID NO: 3577176 - RNA, 20 nt, Pseudomonas putida KT2440
cagcaccugccagccgcaac

SEQ ID NO: 3577177 - RNA, 23 nt, Pseudomonas putida KT2440
cagcaccugggcgucaucacccg

SEQ ID NO: 3577178 - RNA, 16 nt, Pseudomonas putida KT2440
cagcacgaaggccagc

SEQ ID NO: 3577179 - RNA, 17 nt, Pseudomonas putida KT2440
cagcacgaaggccagca

SEQ ID NO: 3577180 - RNA, 16 nt, Pseudomonas putida KT2440
cagcacgauaccggcg

SEQ ID NO: 3577181 - RNA, 14 nt, Pseudomonas putida KT2440
cagcacgaucagcg

SEQ ID NO: 3577182 - RNA, 17 nt, Pseudomonas putida KT2440
cagcacgaucaugggga

SEQ ID NO: 3577183 - RNA, 23 nt, Pseudomonas putida KT2440
cagcacgauggcggucgaaccca

SEQ ID NO: 3577184 - RNA, 19 nt, Pseudomonas putida KT2440
cagcacgcccaagccggcc

SEQ ID NO: 3577185 - RNA, 15 nt, Pseudomonas putida KT2440
cagcacgcccaucag

SEQ ID NO: 3577186 - RNA, 20 nt, Pseudomonas putida KT2440
cagcacgcccaucagcgccg

SEQ ID NO: 3577187 - RNA, 23 nt, Pseudomonas putida KT2440
cagcacgccgccgauaccgaaca

SEQ ID NO: 3577188 - RNA, 13 nt, Pseudomonas putida KT2440
cagcacgccggca

SEQ ID NO: 3577189 - RNA, 20 nt, Pseudomonas putida KT2440
cagcacgccggcauagaugg

SEQ ID NO: 3577190 - RNA, 21 nt, Pseudomonas putida KT2440
cagcacgccguugcggucggu

SEQ ID NO: 3577191 - RNA, 18 nt, Pseudomonas putida KT2440
cagcacgcgaucggcagc

SEQ ID NO: 3577192 - RNA, 21 nt, Pseudomonas putida KT2440
cagcacgcgaucggcagcgau

SEQ ID NO: 3577193 - RNA, 12 nt, Pseudomonas putida KT2440
cagcacgcgcau

SEQ ID NO: 3577194 - RNA, 14 nt, Pseudomonas putida KT2440
cagcacgucaccca

SEQ ID NO: 3577195 - RNA, 16 nt, Pseudomonas putida KT2440
cagcacguucagcggg

SEQ ID NO: 3577196 - RNA, 14 nt, Pseudomonas putida KT2440
cagcacucguugaa

SEQ ID NO: 3577197 - RNA, 22 nt, Pseudomonas putida KT2440
cagcacugcauuggccacgccc

SEQ ID NO: 3577198 - RNA, 12 nt, Pseudomonas putida KT2440
cagcacugccag

SEQ ID NO: 3577199 - RNA, 13 nt, Pseudomonas putida KT2440
cagcacugccagc

SEQ ID NO: 3577200 - RNA, 14 nt, Pseudomonas putida KT2440
cagcacugccugca

SEQ ID NO: 3577201 - RNA, 16 nt, Pseudomonas putida KT2440
cagcacugccuggcca

SEQ ID NO: 3577202 - RNA, 18 nt, Pseudomonas putida KT2440
cagcacugugcucgcccg

SEQ ID NO: 3577203 - RNA, 16 nt, Pseudomonas putida KT2440
cagcacuuccuuguca

SEQ ID NO: 3577204 - RNA, 16 nt, Pseudomonas putida KT2440
cagcacuucgaucagg

SEQ ID NO: 3577205 - RNA, 23 nt, Pseudomonas putida KT2440
cagcacuucgaucaggcagucuu

SEQ ID NO: 3577206 - RNA, 16 nt, Pseudomonas putida KT2440
cagcacuucguccagg

SEQ ID NO: 3577207 - RNA, 19 nt, Pseudomonas putida KT2440
cagcacuuuugccaccacc

SEQ ID NO: 3577208 - RNA, 22 nt, Pseudomonas putida KT2440
cagcacuuuugccaccacccgg

SEQ ID NO: 3577209 - RNA, 21 nt, Pseudomonas putida KT2440
cagcagacugaauuggccggc

SEQ ID NO: 3577210 - RNA, 20 nt, Pseudomonas putida KT2440
cagcagagagauugagagga

SEQ ID NO: 3577211 - RNA, 23 nt, Pseudomonas putida KT2440
cagcagcaaagguuugucgcccg

SEQ ID NO: 3577212 - RNA, 24 nt, Pseudomonas putida KT2440
cagcagcaccgccaccaugcucac

SEQ ID NO: 3577213 - RNA, 14 nt, Pseudomonas putida KT2440
cagcagcaccgggu

SEQ ID NO: 3577214 - RNA, 15 nt, Pseudomonas putida KT2440
cagcagcagccccag

SEQ ID NO: 3577215 - RNA, 16 nt, Pseudomonas putida KT2440
cagcagcagccccagc

SEQ ID NO: 3577216 - RNA, 13 nt, Pseudomonas putida KT2440
cagcagcaggccc

SEQ ID NO: 3577217 - RNA, 17 nt, Pseudomonas putida KT2440
cagcagcaggcccgcca

SEQ ID NO: 3577218 - RNA, 23 nt, Pseudomonas putida KT2440
cagcagcaggcccgccaccgccu

SEQ ID NO: 3577219 - RNA, 17 nt, Pseudomonas putida KT2440
cagcagcaggcgcgagc

SEQ ID NO: 3577220 - RNA, 21 nt, Pseudomonas putida KT2440
cagcagcaggcgcgagccuug

SEQ ID NO: 3577221 - RNA, 17 nt, Pseudomonas putida KT2440
cagcagcaugaauagcg

SEQ ID NO: 3577222 - RNA, 15 nt, Pseudomonas putida KT2440
cagcagccaacgccc

SEQ ID NO: 3577223 - RNA, 17 nt, Pseudomonas putida KT2440
cagcagccaacgcccca

SEQ ID NO: 3577224 - RNA, 20 nt, Pseudomonas putida KT2440
cagcagccaacgccccaggc

SEQ ID NO: 3577225 - RNA, 21 nt, Pseudomonas putida KT2440
cagcagccacgggugcgggcu

SEQ ID NO: 3577226 - RNA, 20 nt, Pseudomonas putida KT2440
cagcagccccacgcccaggc

SEQ ID NO: 3577227 - RNA, 20 nt, Pseudomonas putida KT2440
cagcagccugugcggcuccg

SEQ ID NO: 3577228 - RNA, 17 nt, Pseudomonas putida KT2440
cagcagcgaagggcuca

SEQ ID NO: 3577229 - RNA, 17 nt, Pseudomonas putida KT2440
cagcagcgacaccagcg

SEQ ID NO: 3577230 - RNA, 22 nt, Pseudomonas putida KT2440
cagcagcgacaccagcgcacca

SEQ ID NO: 3577231 - RNA, 23 nt, Pseudomonas putida KT2440
cagcagcgacaccagcgcaccac

SEQ ID NO: 3577232 - RNA, 13 nt, Pseudomonas putida KT2440
cagcagcgacacu

SEQ ID NO: 3577233 - RNA, 15 nt, Pseudomonas putida KT2440
cagcagcgcaccgug

SEQ ID NO: 3577234 - RNA, 21 nt, Pseudomonas putida KT2440
cagcagcgcauggcucaacug

SEQ ID NO: 3577235 - RNA, 18 nt, Pseudomonas putida KT2440
cagcagcgccgccaggcc

SEQ ID NO: 3577236 - RNA, 19 nt, Pseudomonas putida KT2440
cagcagcgccgccaggccc

SEQ ID NO: 3577237 - RNA, 14 nt, Pseudomonas putida KT2440
cagcagcgccugca

SEQ ID NO: 3577238 - RNA, 16 nt, Pseudomonas putida KT2440
cagcagcgccugcagc

SEQ ID NO: 3577239 - RNA, 22 nt, Pseudomonas putida KT2440
cagcagcgccugcagcgcguca

SEQ ID NO: 3577240 - RNA, 16 nt, Pseudomonas putida KT2440
cagcagcgccugguca

SEQ ID NO: 3577241 - RNA, 12 nt, Pseudomonas putida KT2440
cagcagcgcgcc

SEQ ID NO: 3577242 - RNA, 16 nt, Pseudomonas putida KT2440
cagcagcgcgccgaac

SEQ ID NO: 3577243 - RNA, 23 nt, Pseudomonas putida KT2440
cagcagcgcgccgaacuugccga

SEQ ID NO: 3577244 - RNA, 16 nt, Pseudomonas putida KT2440
cagcagcgcgugcugg

SEQ ID NO: 3577245 - RNA, 16 nt, Pseudomonas putida KT2440
cagcagcgcuccgcca

SEQ ID NO: 3577246 - RNA, 13 nt, Pseudomonas putida KT2440
cagcagcgggcac

SEQ ID NO: 3577247 - RNA, 18 nt, Pseudomonas putida KT2440
cagcagcgggcacaggcc

SEQ ID NO: 3577248 - RNA, 23 nt, Pseudomonas putida KT2440
cagcagcuccacaucuugccccg

SEQ ID NO: 3577249 - RNA, 22 nt, Pseudomonas putida KT2440
cagcagcucccgagccaggaag

SEQ ID NO: 3577250 - RNA, 19 nt, Pseudomonas putida KT2440
cagcagcucuuuugccggg

SEQ ID NO: 3577251 - RNA, 20 nt, Pseudomonas putida KT2440
cagcagcugcauuggcggca

SEQ ID NO: 3577252 - RNA, 14 nt, Pseudomonas putida KT2440
cagcagcugccgga

SEQ ID NO: 3577253 - RNA, 15 nt, Pseudomonas putida KT2440
cagcagcuguugcug

SEQ ID NO: 3577254 - RNA, 19 nt, Pseudomonas putida KT2440
cagcagcuucuggcgcgug

SEQ ID NO: 3577255 - RNA, 14 nt, Pseudomonas putida KT2440
cagcagcuucuuca

SEQ ID NO: 3577256 - RNA, 15 nt, Pseudomonas putida KT2440
cagcagcuucuucac

SEQ ID NO: 3577257 - RNA, 21 nt, Pseudomonas putida KT2440
cagcagcuucuucacaccggc

SEQ ID NO: 3577258 - RNA, 17 nt, Pseudomonas putida KT2440
cagcagcuugcagcgcc

SEQ ID NO: 3577259 - RNA, 17 nt, Pseudomonas putida KT2440
cagcagcuugcgcgccu

SEQ ID NO: 3577260 - RNA, 20 nt, Pseudomonas putida KT2440
cagcaggaacagcggcagca

SEQ ID NO: 3577261 - RNA, 21 nt, Pseudomonas putida KT2440
cagcaggaacagcggcagcaa

SEQ ID NO: 3577262 - RNA, 12 nt, Pseudomonas putida KT2440
cagcaggaagcu

SEQ ID NO: 3577263 - RNA, 14 nt, Pseudomonas putida KT2440
cagcaggaagcugu

SEQ ID NO: 3577264 - RNA, 20 nt, Pseudomonas putida KT2440
cagcaggaagcuguacagcg

SEQ ID NO: 3577265 - RNA, 21 nt, Pseudomonas putida KT2440
cagcaggcaaagaaugccgcc

SEQ ID NO: 3577266 - RNA, 22 nt, Pseudomonas putida KT2440
cagcaggcaaagaaugccgccc

SEQ ID NO: 3577267 - RNA, 20 nt, Pseudomonas putida KT2440
cagcaggcccgccaccgccu

SEQ ID NO: 3577268 - RNA, 15 nt, Pseudomonas putida KT2440
cagcaggcccggccc

SEQ ID NO: 3577269 - RNA, 12 nt, Pseudomonas putida KT2440
cagcaggccgaa

SEQ ID NO: 3577270 - RNA, 16 nt, Pseudomonas putida KT2440
cagcaggccgccgacg

SEQ ID NO: 3577271 - RNA, 18 nt, Pseudomonas putida KT2440
cagcaggccgccgacgau

SEQ ID NO: 3577272 - RNA, 14 nt, Pseudomonas putida KT2440
cagcaggcgcggcg

SEQ ID NO: 3577273 - RNA, 15 nt, Pseudomonas putida KT2440
cagcaggcgcggcgu

SEQ ID NO: 3577274 - RNA, 19 nt, Pseudomonas putida KT2440
cagcaggcucagggccgca

SEQ ID NO: 3577275 - RNA, 16 nt, Pseudomonas putida KT2440
cagcaggcugcgugcc

SEQ ID NO: 3577276 - RNA, 20 nt, Pseudomonas putida KT2440
cagcaggcugcgugccugcu

SEQ ID NO: 3577277 - RNA, 22 nt, Pseudomonas putida KT2440
cagcaggcuggcggccaaugcu

SEQ ID NO: 3577278 - RNA, 22 nt, Pseudomonas putida KT2440
cagcaggcuggcgggguggccg

SEQ ID NO: 3577279 - RNA, 13 nt, Pseudomonas putida KT2440
cagcagggccaac

SEQ ID NO: 3577280 - RNA, 16 nt, Pseudomonas putida KT2440
cagcagggccggcccu

SEQ ID NO: 3577281 - RNA, 18 nt, Pseudomonas putida KT2440
cagcagggccggcccuuu

SEQ ID NO: 3577282 - RNA, 17 nt, Pseudomonas putida KT2440
cagcaggguggccagca

SEQ ID NO: 3577283 - RNA, 18 nt, Pseudomonas putida KT2440
cagcaggucagcacgcgc

SEQ ID NO: 3577284 - RNA, 15 nt, Pseudomonas putida KT2440
cagcaggucaggccc

SEQ ID NO: 3577285 - RNA, 18 nt, Pseudomonas putida KT2440
cagcaggucaggcccuuu

SEQ ID NO: 3577286 - RNA, 17 nt, Pseudomonas putida KT2440
cagcagguccagcuccg

SEQ ID NO: 3577287 - RNA, 22 nt, Pseudomonas putida KT2440
cagcaggucggcacgcaccugu

SEQ ID NO: 3577288 - RNA, 16 nt, Pseudomonas putida KT2440
cagcaggugcccaagc

SEQ ID NO: 3577289 - RNA, 18 nt, Pseudomonas putida KT2440
cagcaggugcccaagcgg

SEQ ID NO: 3577290 - RNA, 20 nt, Pseudomonas putida KT2440
cagcagguucaacggcgccc

SEQ ID NO: 3577291 - RNA, 23 nt, Pseudomonas putida KT2440
cagcagguugaacagcagcgccg

SEQ ID NO: 3577292 - RNA, 16 nt, Pseudomonas putida KT2440
cagcagguugaacagg

SEQ ID NO: 3577293 - RNA, 20 nt, Pseudomonas putida KT2440
cagcagguuggacagcgccc

SEQ ID NO: 3577294 - RNA, 21 nt, Pseudomonas putida KT2440
cagcagguuggacagcgcccg

SEQ ID NO: 3577295 - RNA, 18 nt, Pseudomonas putida KT2440
cagcagguuuuccagccc

SEQ ID NO: 3577296 - RNA, 17 nt, Pseudomonas putida KT2440
cagcagugaucaucaca

SEQ ID NO: 3577297 - RNA, 14 nt, Pseudomonas putida KT2440
cagcagugcaccca

SEQ ID NO: 3577298 - RNA, 21 nt, Pseudomonas putida KT2440
cagcagugcaucgaagcaggc

SEQ ID NO: 3577299 - RNA, 16 nt, Pseudomonas putida KT2440
cagcagugccagcaac

SEQ ID NO: 3577300 - RNA, 17 nt, Pseudomonas putida KT2440
cagcagugccagcaaca

SEQ ID NO: 3577301 - RNA, 18 nt, Pseudomonas putida KT2440
cagcagugcggcaaccac

SEQ ID NO: 3577302 - RNA, 20 nt, Pseudomonas putida KT2440
cagcaguggcaagccgagca

SEQ ID NO: 3577303 - RNA, 16 nt, Pseudomonas putida KT2440
cagcaguucgcagcca

SEQ ID NO: 3577304 - RNA, 14 nt, Pseudomonas putida KT2440
cagcaguucgcgca

SEQ ID NO: 3577305 - RNA, 22 nt, Pseudomonas putida KT2440
cagcaguucgcgcaccaucggc

SEQ ID NO: 3577306 - RNA, 14 nt, Pseudomonas putida KT2440
cagcaguucgcggu

SEQ ID NO: 3577307 - RNA, 21 nt, Pseudomonas putida KT2440
cagcaguucgcggucgccgug

SEQ ID NO: 3577308 - RNA, 23 nt, Pseudomonas putida KT2440
cagcaguucgcggucgccgugca

SEQ ID NO: 3577309 - RNA, 15 nt, Pseudomonas putida KT2440
cagcaguugcugcug

SEQ ID NO: 3577310 - RNA, 16 nt, Pseudomonas putida KT2440
cagcaguugcugcugc

SEQ ID NO: 3577311 - RNA, 22 nt, Pseudomonas putida KT2440
cagcaguugcugcugccagugg

SEQ ID NO: 3577312 - RNA, 14 nt, Pseudomonas putida KT2440
cagcaguuggccga

SEQ ID NO: 3577313 - RNA, 23 nt, Pseudomonas putida KT2440
cagcaguuggcugccggccucga

SEQ ID NO: 3577314 - RNA, 20 nt, Pseudomonas putida KT2440
cagcaguuugcugcgcugcc

SEQ ID NO: 3577315 - RNA, 21 nt, Pseudomonas putida KT2440
cagcauauggcgcuuucacug

SEQ ID NO: 3577316 - RNA, 14 nt, Pseudomonas putida KT2440
cagcaucaacgcug

SEQ ID NO: 3577317 - RNA, 21 nt, Pseudomonas putida KT2440
cagcaucaacgcugccaugcg

SEQ ID NO: 3577318 - RNA, 21 nt, Pseudomonas putida KT2440
cagcaucaaugcaggaucugg

SEQ ID NO: 3577319 - RNA, 20 nt, Pseudomonas putida KT2440
cagcaucacccgcgaaugcu

SEQ ID NO: 3577320 - RNA, 14 nt, Pseudomonas putida KT2440
cagcaucaccgcgc

SEQ ID NO: 3577321 - RNA, 20 nt, Pseudomonas putida KT2440
cagcaucaccgcgucgauac

SEQ ID NO: 3577322 - RNA, 23 nt, Pseudomonas putida KT2440
cagcaucacgccgcgcuggcgcg

SEQ ID NO: 3577323 - RNA, 17 nt, Pseudomonas putida KT2440
cagcaucagcacacgcc

SEQ ID NO: 3577324 - RNA, 18 nt, Pseudomonas putida KT2440
cagcaucagcacacgccc

SEQ ID NO: 3577325 - RNA, 15 nt, Pseudomonas putida KT2440
cagcaucagccaugg

SEQ ID NO: 3577326 - RNA, 12 nt, Pseudomonas putida KT2440
cagcaucagcga

SEQ ID NO: 3577327 - RNA, 14 nt, Pseudomonas putida KT2440
cagcaucagugcag

SEQ ID NO: 3577328 - RNA, 15 nt, Pseudomonas putida KT2440
cagcaucagugcagg

SEQ ID NO: 3577329 - RNA, 18 nt, Pseudomonas putida KT2440
cagcaucagugcaggugc

SEQ ID NO: 3577330 - RNA, 16 nt, Pseudomonas putida KT2440
cagcaucaucaggccg

SEQ ID NO: 3577331 - RNA, 18 nt, Pseudomonas putida KT2440
cagcaucaucucugccga

SEQ ID NO: 3577332 - RNA, 20 nt, Pseudomonas putida KT2440
cagcauccaacccugcgccc

SEQ ID NO: 3577333 - RNA, 23 nt, Pseudomonas putida KT2440
cagcauccaacccugcgcccagu

SEQ ID NO: 3577334 - RNA, 13 nt, Pseudomonas putida KT2440
cagcauccagcca

SEQ ID NO: 3577335 - RNA, 14 nt, Pseudomonas putida KT2440
cagcaucgaccugc

SEQ ID NO: 3577336 - RNA, 15 nt, Pseudomonas putida KT2440
cagcaucgaccugcc

SEQ ID NO: 3577337 - RNA, 12 nt, Pseudomonas putida KT2440
cagcaucggcac

SEQ ID NO: 3577338 - RNA, 18 nt, Pseudomonas putida KT2440
cagcaucggcaggucauu

SEQ ID NO: 3577339 - RNA, 16 nt, Pseudomonas putida KT2440
cagcaucgggucacgc

SEQ ID NO: 3577340 - RNA, 21 nt, Pseudomonas putida KT2440
cagcaucucggucgacagggg

SEQ ID NO: 3577341 - RNA, 20 nt, Pseudomonas putida KT2440
cagcaucugcaccaggaagc

SEQ ID NO: 3577342 - RNA, 16 nt, Pseudomonas putida KT2440
cagcaucuuccugcca

SEQ ID NO: 3577343 - RNA, 20 nt, Pseudomonas putida KT2440
cagcaucuucuucacgucca

SEQ ID NO: 3577344 - RNA, 15 nt, Pseudomonas putida KT2440
cagcaugaacagcgc

SEQ ID NO: 3577345 - RNA, 20 nt, Pseudomonas putida KT2440
cagcaugacaguggcagguu

SEQ ID NO: 3577346 - RNA, 20 nt, Pseudomonas putida KT2440
cagcaugaugucgcugccgc

SEQ ID NO: 3577347 - RNA, 13 nt, Pseudomonas putida KT2440
cagcaugcccagc

SEQ ID NO: 3577348 - RNA, 17 nt, Pseudomonas putida KT2440
cagcaugcccagcgcca

SEQ ID NO: 3577349 - RNA, 18 nt, Pseudomonas putida KT2440
cagcaugcccagcgccac

SEQ ID NO: 3577350 - RNA, 23 nt, Pseudomonas putida KT2440
cagcaugcccagcgccaccggca

SEQ ID NO: 3577351 - RNA, 17 nt, Pseudomonas putida KT2440
cagcaugccccgggugc

SEQ ID NO: 3577352 - RNA, 23 nt, Pseudomonas putida KT2440
cagcaugccccgggugcagccgc

SEQ ID NO: 3577353 - RNA, 14 nt, Pseudomonas putida KT2440
cagcaugcgaagcc

SEQ ID NO: 3577354 - RNA, 14 nt, Pseudomonas putida KT2440
cagcaugcgcuuga

SEQ ID NO: 3577355 - RNA, 16 nt, Pseudomonas putida KT2440
cagcaugcgggggccc

SEQ ID NO: 3577356 - RNA, 18 nt, Pseudomonas putida KT2440
cagcaugcgggggcccca

SEQ ID NO: 3577357 - RNA, 11 nt, Pseudomonas putida KT2440
cagcauggccg

SEQ ID NO: 3577358 - RNA, 23 nt, Pseudomonas putida KT2440
cagcauggccgaaaccagccccu

SEQ ID NO: 3577359 - RNA, 17 nt, Pseudomonas putida KT2440
cagcauggcgucggcga

SEQ ID NO: 3577360 - RNA, 19 nt, Pseudomonas putida KT2440
cagcauggcgucggcgaug

SEQ ID NO: 3577361 - RNA, 23 nt, Pseudomonas putida KT2440
cagcauggugcagggcguugccg

SEQ ID NO: 3577362 - RNA, 15 nt, Pseudomonas putida KT2440
cagcauguccugcug

SEQ ID NO: 3577363 - RNA, 19 nt, Pseudomonas putida KT2440
cagcauguccugcugcagg

SEQ ID NO: 3577364 - RNA, 22 nt, Pseudomonas putida KT2440
cagcauguccugcugcaggcuc

SEQ ID NO: 3577365 - RNA, 16 nt, Pseudomonas putida KT2440
cagcauuacgcggcag

SEQ ID NO: 3577366 - RNA, 17 nt, Pseudomonas putida KT2440
cagcauuacgcggcagc

SEQ ID NO: 3577367 - RNA, 21 nt, Pseudomonas putida KT2440
cagcauuacgcggcagcagca

SEQ ID NO: 3577368 - RNA, 19 nt, Pseudomonas putida KT2440
cagcauuggauacugcccg

SEQ ID NO: 3577369 - RNA, 20 nt, Pseudomonas putida KT2440
cagcauuucuucgaccugcg

SEQ ID NO: 3577370 - RNA, 20 nt, Pseudomonas putida KT2440
cagccaacccucgaccucga

SEQ ID NO: 3577371 - RNA, 14 nt, Pseudomonas putida KT2440
cagccaaccgcccc

SEQ ID NO: 3577372 - RNA, 16 nt, Pseudomonas putida KT2440
cagccaaccgccccac

SEQ ID NO: 3577373 - RNA, 15 nt, Pseudomonas putida KT2440
cagccaacgccccac

SEQ ID NO: 3577374 - RNA, 17 nt, Pseudomonas putida KT2440
cagccaacgccccaccc

SEQ ID NO: 3577375 - RNA, 17 nt, Pseudomonas putida KT2440
cagccaacgccccaggc

SEQ ID NO: 3577376 - RNA, 19 nt, Pseudomonas putida KT2440
cagccaacgccccaggccg

SEQ ID NO: 3577377 - RNA, 11 nt, Pseudomonas putida KT2440
cagccaacggc

SEQ ID NO: 3577378 - RNA, 12 nt, Pseudomonas putida KT2440
cagccaacggcg

SEQ ID NO: 3577379 - RNA, 12 nt, Pseudomonas putida KT2440
cagccaacgguc

SEQ ID NO: 3577380 - RNA, 14 nt, Pseudomonas putida KT2440
cagccaacugguug

SEQ ID NO: 3577381 - RNA, 20 nt, Pseudomonas putida KT2440
cagccaacuuuugcuggcug

SEQ ID NO: 3577382 - RNA, 19 nt, Pseudomonas putida KT2440
cagccaaucggcgccagga

SEQ ID NO: 3577383 - RNA, 18 nt, Pseudomonas putida KT2440
cagccaaugcagaugguc

SEQ ID NO: 3577384 - RNA, 22 nt, Pseudomonas putida KT2440
cagccacagcugcugcagggcc

SEQ ID NO: 3577385 - RNA, 14 nt, Pseudomonas putida KT2440
cagccacauccucu

SEQ ID NO: 3577386 - RNA, 21 nt, Pseudomonas putida KT2440
cagccacauccucugcccgca

SEQ ID NO: 3577387 - RNA, 16 nt, Pseudomonas putida KT2440
cagccacaugccagcu

SEQ ID NO: 3577388 - RNA, 20 nt, Pseudomonas putida KT2440
cagccacauugauaguagcc

SEQ ID NO: 3577389 - RNA, 24 nt, Pseudomonas putida KT2440
cagccaccaccagcuccaccuucc

SEQ ID NO: 3577390 - RNA, 19 nt, Pseudomonas putida KT2440
cagccacccggcgcgcagc

SEQ ID NO: 3577391 - RNA, 22 nt, Pseudomonas putida KT2440
cagccaccgacgaacagggccg

SEQ ID NO: 3577392 - RNA, 19 nt, Pseudomonas putida KT2440
cagccaccgcacucugcug

SEQ ID NO: 3577393 - RNA, 13 nt, Pseudomonas putida KT2440
cagccaccgccgg

SEQ ID NO: 3577394 - RNA, 14 nt, Pseudomonas putida KT2440
cagccaccgcgagc

SEQ ID NO: 3577395 - RNA, 15 nt, Pseudomonas putida KT2440
cagccaccgcgagcu

SEQ ID NO: 3577396 - RNA, 15 nt, Pseudomonas putida KT2440
cagccaccugcccgg

SEQ ID NO: 3577397 - RNA, 16 nt, Pseudomonas putida KT2440
cagccaccugcccggg

SEQ ID NO: 3577398 - RNA, 14 nt, Pseudomonas putida KT2440
cagccaccuguggg

SEQ ID NO: 3577399 - RNA, 18 nt, Pseudomonas putida KT2440
cagccacgcuggcaccca

SEQ ID NO: 3577400 - RNA, 21 nt, Pseudomonas putida KT2440
cagccacggaucaccuggccg

SEQ ID NO: 3577401 - RNA, 16 nt, Pseudomonas putida KT2440
cagccacgucgccagc

SEQ ID NO: 3577402 - RNA, 17 nt, Pseudomonas putida KT2440
cagccacgucgccagcg

SEQ ID NO: 3577403 - RNA, 16 nt, Pseudomonas putida KT2440
cagccacuuggcccca

SEQ ID NO: 3577404 - RNA, 17 nt, Pseudomonas putida KT2440
cagccagauauggaagc

SEQ ID NO: 3577405 - RNA, 15 nt, Pseudomonas putida KT2440
cagccagaugcgccg

SEQ ID NO: 3577406 - RNA, 22 nt, Pseudomonas putida KT2440
cagccagcagcguacccagcuc

SEQ ID NO: 3577407 - RNA, 12 nt, Pseudomonas putida KT2440
cagccagccucu

SEQ ID NO: 3577408 - RNA, 13 nt, Pseudomonas putida KT2440
cagccagccucuu

SEQ ID NO: 3577409 - RNA, 17 nt, Pseudomonas putida KT2440
cagccagccucuucuuc

SEQ ID NO: 3577410 - RNA, 18 nt, Pseudomonas putida KT2440
cagccagccucuucuuca

SEQ ID NO: 3577411 - RNA, 22 nt, Pseudomonas putida KT2440
cagccagcgacagcaucggcag

SEQ ID NO: 3577412 - RNA, 21 nt, Pseudomonas putida KT2440
cagccagcgguccggcccuuc

SEQ ID NO: 3577413 - RNA, 21 nt, Pseudomonas putida KT2440
cagccaggauuuucagcgcga

SEQ ID NO: 3577414 - RNA, 14 nt, Pseudomonas putida KT2440
cagccgccgcugcg

SEQ ID NO: 3577415 - RNA, 22 nt, Pseudomonas putida KT2440
cagccgcgcaugcugugcccug

SEQ ID NO: 3577416 - RNA, 17 nt, Pseudomonas putida KT2440
cagccgcgccacuccca

SEQ ID NO: 3577417 - RNA, 12 nt, Pseudomonas putida KT2440
cagccgcgcccu

SEQ ID NO: 3577418 - RNA, 16 nt, Pseudomonas putida KT2440
cagccgcgcccucuuc

SEQ ID NO: 3577419 - RNA, 11 nt, Pseudomonas putida KT2440
cagccgcgcug

SEQ ID NO: 3577420 - RNA, 12 nt, Pseudomonas putida KT2440
cagccgcgggcg

SEQ ID NO: 3577421 - RNA, 23 nt, Pseudomonas putida KT2440
cagccgcgggcucguuauccgcg

SEQ ID NO: 3577422 - RNA, 15 nt, Pseudomonas putida KT2440
cagccgcucagccac

SEQ ID NO: 3577423 - RNA, 17 nt, Pseudomonas putida KT2440
cagccgcucagccaccu

SEQ ID NO: 3577424 - RNA, 21 nt, Pseudomonas putida KT2440
cagccgcugcgccugccgggc

SEQ ID NO: 3577425 - RNA, 17 nt, Pseudomonas putida KT2440
cagccgcuguucugcag

SEQ ID NO: 3577426 - RNA, 22 nt, Pseudomonas putida KT2440
cagccgcuguucugcagucagg

SEQ ID NO: 3577427 - RNA, 13 nt, Pseudomonas putida KT2440
cagccggcagcaa

SEQ ID NO: 3577428 - RNA, 16 nt, Pseudomonas putida KT2440
cagccggcccggcugg

SEQ ID NO: 3577429 - RNA, 19 nt, Pseudomonas putida KT2440
cagccggcccggcuggcca

SEQ ID NO: 3577430 - RNA, 20 nt, Pseudomonas putida KT2440
cagccggcccuucugcugcu

SEQ ID NO: 3577431 - RNA, 14 nt, Pseudomonas putida KT2440
cagccggcgccggu

SEQ ID NO: 3577432 - RNA, 16 nt, Pseudomonas putida KT2440
cagccggcgcuggaca

SEQ ID NO: 3577433 - RNA, 21 nt, Pseudomonas putida KT2440
cagccggcgcuggacagcggc

SEQ ID NO: 3577434 - RNA, 13 nt, Pseudomonas putida KT2440
cagccggcuaucg

SEQ ID NO: 3577435 - RNA, 21 nt, Pseudomonas putida KT2440
cagccggcuaucggccagcaa

SEQ ID NO: 3577436 - RNA, 16 nt, Pseudomonas putida KT2440
cagccggcugaugaac

SEQ ID NO: 3577437 - RNA, 21 nt, Pseudomonas putida KT2440
cagccgggcaugcaggucgac

SEQ ID NO: 3577438 - RNA, 14 nt, Pseudomonas putida KT2440
cagccgggccaacu

SEQ ID NO: 3577439 - RNA, 14 nt, Pseudomonas putida KT2440
cagccgggcugcaa

SEQ ID NO: 3577440 - RNA, 17 nt, Pseudomonas putida KT2440
cagccggucauccagca

SEQ ID NO: 3577441 - RNA, 20 nt, Pseudomonas putida KT2440
cagccggucauccagcagcu

SEQ ID NO: 3577442 - RNA, 18 nt, Pseudomonas putida KT2440
cagccggucucccagcgc

SEQ ID NO: 3577443 - RNA, 19 nt, Pseudomonas putida KT2440
cagccggucucccagcgcu

SEQ ID NO: 3577444 - RNA, 20 nt, Pseudomonas putida KT2440
cagccguccucgacccaguc

SEQ ID NO: 3577445 - RNA, 15 nt, Pseudomonas putida KT2440
cagccgucgccgcuu

SEQ ID NO: 3577446 - RNA, 16 nt, Pseudomonas putida KT2440
cagccgucgccgcuuc

SEQ ID NO: 3577447 - RNA, 23 nt, Pseudomonas putida KT2440
cagccgucgccgcuucggcaugc

SEQ ID NO: 3577448 - RNA, 14 nt, Pseudomonas putida KT2440
cagccguggcaacg

SEQ ID NO: 3577449 - RNA, 20 nt, Pseudomonas putida KT2440
cagccguggcaacgccacac

SEQ ID NO: 3577450 - RNA, 21 nt, Pseudomonas putida KT2440
cagccgugguuucgaagucga

SEQ ID NO: 3577451 - RNA, 22 nt, Pseudomonas putida KT2440
cagccgugguuucgaagucgaa

SEQ ID NO: 3577452 - RNA, 21 nt, Pseudomonas putida KT2440
cagccguucaccuuugagugc

SEQ ID NO: 3577453 - RNA, 15 nt, Pseudomonas putida KT2440
cagccguucuggcca

SEQ ID NO: 3577454 - RNA, 16 nt, Pseudomonas putida KT2440
cagccguugcugggcu

SEQ ID NO: 3577455 - RNA, 17 nt, Pseudomonas putida KT2440
cagccguugcugggcug

SEQ ID NO: 3577456 - RNA, 14 nt, Pseudomonas putida KT2440
cagccguuggagca

SEQ ID NO: 3577457 - RNA, 21 nt, Pseudomonas putida KT2440
cagccguuguacaagcuggca

SEQ ID NO: 3577458 - RNA, 19 nt, Pseudomonas putida KT2440
cagccuaagguugcuccug

SEQ ID NO: 3577459 - RNA, 13 nt, Pseudomonas putida KT2440
cagccucaaggcc

SEQ ID NO: 3577460 - RNA, 13 nt, Pseudomonas putida KT2440
cagccucagcugg

SEQ ID NO: 3577461 - RNA, 18 nt, Pseudomonas putida KT2440
cagccucagcuggccggc

SEQ ID NO: 3577462 - RNA, 19 nt, Pseudomonas putida KT2440
cagccuccagguucgggua

SEQ ID NO: 3577463 - RNA, 14 nt, Pseudomonas putida KT2440
cagccucguaagcg

SEQ ID NO: 3577464 - RNA, 20 nt, Pseudomonas putida KT2440
cagccucguccaucuugcug

SEQ ID NO: 3577465 - RNA, 15 nt, Pseudomonas putida KT2440
cagccucuucggcca

SEQ ID NO: 3577466 - RNA, 20 nt, Pseudomonas putida KT2440
cagccucuucggccagcaac

SEQ ID NO: 3577467 - RNA, 21 nt, Pseudomonas putida KT2440
cagccucuucggccagcaacu

SEQ ID NO: 3577468 - RNA, 21 nt, Pseudomonas putida KT2440
cagccucuucuucaaggcugc

SEQ ID NO: 3577469 - RNA, 15 nt, Pseudomonas putida KT2440
cagccugacgcgccg

SEQ ID NO: 3577470 - RNA, 16 nt, Pseudomonas putida KT2440
cagccugccaggucac

SEQ ID NO: 3577471 - RNA, 20 nt, Pseudomonas putida KT2440
cagccuguaccgcccucuuc

SEQ ID NO: 3577472 - RNA, 21 nt, Pseudomonas putida KT2440
cagccugugcggcuccggcgu

SEQ ID NO: 3577473 - RNA, 17 nt, Pseudomonas putida KT2440
cagccuguggguaugcc

SEQ ID NO: 3577474 - RNA, 24 nt, Pseudomonas putida KT2440
cagccuuaccccccugcaccauca

SEQ ID NO: 3577475 - RNA, 19 nt, Pseudomonas putida KT2440
cagccuucagauaguccuu

SEQ ID NO: 3577476 - RNA, 12 nt, Pseudomonas putida KT2440
cagccuucagca

SEQ ID NO: 3577477 - RNA, 15 nt, Pseudomonas putida KT2440
cagccuucagcaggc

SEQ ID NO: 3577478 - RNA, 19 nt, Pseudomonas putida KT2440
cagccuucagcaggcgcgg

SEQ ID NO: 3577479 - RNA, 23 nt, Pseudomonas putida KT2440
cagccuucaggguuguggugagc

SEQ ID NO: 3577480 - RNA, 22 nt, Pseudomonas putida KT2440
cagccuucgaaauuacccugcg

SEQ ID NO: 3577481 - RNA, 16 nt, Pseudomonas putida KT2440
cagccuuucgagagcc

SEQ ID NO: 3577482 - RNA, 20 nt, Pseudomonas putida KT2440
cagccuuucuuggcaugcga

SEQ ID NO: 3577483 - RNA, 22 nt, Pseudomonas putida KT2440
cagccuuugaaacggucagcgg

SEQ ID NO: 3577484 - RNA, 13 nt, Pseudomonas putida KT2440
cagccuuuuccag

SEQ ID NO: 3577485 - RNA, 18 nt, Pseudomonas putida KT2440
cagccuuuuccagcucgg

SEQ ID NO: 3577486 - RNA, 21 nt, Pseudomonas putida KT2440
cagccuuuuuuuauuuuucug

SEQ ID NO: 3577487 - RNA, 16 nt, Pseudomonas putida KT2440
cagcgaacgccggggc

SEQ ID NO: 3577488 - RNA, 15 nt, Pseudomonas putida KT2440
cagcgaagccagcac

SEQ ID NO: 3577489 - RNA, 16 nt, Pseudomonas putida KT2440
cagcgaagggcucaac

SEQ ID NO: 3577490 - RNA, 23 nt, Pseudomonas putida KT2440
cagcgaagggcucaacgccaggg

SEQ ID NO: 3577491 - RNA, 19 nt, Pseudomonas putida KT2440
cagcgaauaguagaagcag

SEQ ID NO: 3577492 - RNA, 17 nt, Pseudomonas putida KT2440
cagcgaaugcagcucga

SEQ ID NO: 3577493 - RNA, 16 nt, Pseudomonas putida KT2440
cagcgacaacggcugg

SEQ ID NO: 3577494 - RNA, 20 nt, Pseudomonas putida KT2440
cagcgacaacggcuggcgga

SEQ ID NO: 3577495 - RNA, 21 nt, Pseudomonas putida KT2440
cagcgacaacggcuggcggaa

SEQ ID NO: 3577496 - RNA, 17 nt, Pseudomonas putida KT2440
cagcgacaccagcgcac

SEQ ID NO: 3577497 - RNA, 19 nt, Pseudomonas putida KT2440
cagcgacaccagcgcacca

SEQ ID NO: 3577498 - RNA, 20 nt, Pseudomonas putida KT2440
cagcgacagcaucggcaggu

SEQ ID NO: 3577499 - RNA, 13 nt, Pseudomonas putida KT2440
cagcgacagguag

SEQ ID NO: 3577500 - RNA, 18 nt, Pseudomonas putida KT2440
cagcgacaugccggccac

SEQ ID NO: 3577501 - RNA, 21 nt, Pseudomonas putida KT2440
cagcgaccagcugccauacag

SEQ ID NO: 3577502 - RNA, 12 nt, Pseudomonas putida KT2440
cagcgacccuga

SEQ ID NO: 3577503 - RNA, 15 nt, Pseudomonas putida KT2440
cagcgacgaccugca

SEQ ID NO: 3577504 - RNA, 13 nt, Pseudomonas putida KT2440
cagcgacugccaa

SEQ ID NO: 3577505 - RNA, 22 nt, Pseudomonas putida KT2440
cagcgacugccaaugcucagug

SEQ ID NO: 3577506 - RNA, 20 nt, Pseudomonas putida KT2440
cagcgaggggacgaucugca

SEQ ID NO: 3577507 - RNA, 20 nt, Pseudomonas putida KT2440
cagcgaggguuccaggccac

SEQ ID NO: 3577508 - RNA, 19 nt, Pseudomonas putida KT2440
cagcgauaaaccagcagcg

SEQ ID NO: 3577509 - RNA, 22 nt, Pseudomonas putida KT2440
cagcgauaaaccagcagcgccu

SEQ ID NO: 3577510 - RNA, 13 nt, Pseudomonas putida KT2440
cagcgaucagcgc

SEQ ID NO: 3577511 - RNA, 15 nt, Pseudomonas putida KT2440
cagcgaugccggggc

SEQ ID NO: 3577512 - RNA, 20 nt, Pseudomonas putida KT2440
cagcgcaaaaaaugugcgca

SEQ ID NO: 3577513 - RNA, 15 nt, Pseudomonas putida KT2440
cagcgcaaucaccgc

SEQ ID NO: 3577514 - RNA, 17 nt, Pseudomonas putida KT2440
cagcgcaaucaccgccg

SEQ ID NO: 3577515 - RNA, 18 nt, Pseudomonas putida KT2440
cagcgcaaucaccgccgc

SEQ ID NO: 3577516 - RNA, 16 nt, Pseudomonas putida KT2440
cagcgcaccacuguuc

SEQ ID NO: 3577517 - RNA, 14 nt, Pseudomonas putida KT2440
cagcgcaccgcuga

SEQ ID NO: 3577518 - RNA, 16 nt, Pseudomonas putida KT2440
cagcgcaccgugcacc

SEQ ID NO: 3577519 - RNA, 19 nt, Pseudomonas putida KT2440
cagcggaucaccgacgugc

SEQ ID NO: 3577520 - RNA, 16 nt, Pseudomonas putida KT2440
cagcggcaaacacacc

SEQ ID NO: 3577521 - RNA, 18 nt, Pseudomonas putida KT2440
cagcggcaacaccagcag

SEQ ID NO: 3577522 - RNA, 20 nt, Pseudomonas putida KT2440
cagcggcaacaccagcagcc

SEQ ID NO: 3577523 - RNA, 22 nt, Pseudomonas putida KT2440
cagcggcaaccugacccgcgcc

SEQ ID NO: 3577524 - RNA, 21 nt, Pseudomonas putida KT2440
cagcggcaaggucaacggcaa

SEQ ID NO: 3577525 - RNA, 13 nt, Pseudomonas putida KT2440
cagcggcaauucg

SEQ ID NO: 3577526 - RNA, 16 nt, Pseudomonas putida KT2440
cagcggcaauucggcc

SEQ ID NO: 3577527 - RNA, 23 nt, Pseudomonas putida KT2440
cagcggcaccuaccccuccugac

SEQ ID NO: 3577528 - RNA, 17 nt, Pseudomonas putida KT2440
cagcggcacggccacca

SEQ ID NO: 3577529 - RNA, 19 nt, Pseudomonas putida KT2440
cagcggcacggccaccaug

SEQ ID NO: 3577530 - RNA, 15 nt, Pseudomonas putida KT2440
cagcggcacgucacu

SEQ ID NO: 3577531 - RNA, 11 nt, Pseudomonas putida KT2440
cagcggcagac

SEQ ID NO: 3577532 - RNA, 19 nt, Pseudomonas putida KT2440
cagcggcagacacaggcgc

SEQ ID NO: 3577533 - RNA, 22 nt, Pseudomonas putida KT2440
cagcggcagaucacgcaaccuc

SEQ ID NO: 3577534 - RNA, 14 nt, Pseudomonas putida KT2440
cagcggcagcaagu

SEQ ID NO: 3577535 - RNA, 14 nt, Pseudomonas putida KT2440
cagcggcaggcugg

SEQ ID NO: 3577536 - RNA, 14 nt, Pseudomonas putida KT2440
cagcggcaguugca

SEQ ID NO: 3577537 - RNA, 20 nt, Pseudomonas putida KT2440
cagcggcaguugcaggcgca

SEQ ID NO: 3577538 - RNA, 16 nt, Pseudomonas putida KT2440
cagcggccacagcgcc

SEQ ID NO: 3577539 - RNA, 22 nt, Pseudomonas putida KT2440
cagcggccacuuacacgcaagc

SEQ ID NO: 3577540 - RNA, 15 nt, Pseudomonas putida KT2440
cagcggccagcucgg

SEQ ID NO: 3577541 - RNA, 23 nt, Pseudomonas putida KT2440
cagcggccagcucggccgaugcc

SEQ ID NO: 3577542 - RNA, 17 nt, Pseudomonas putida KT2440
cagcggccccaucaccc

SEQ ID NO: 3577543 - RNA, 22 nt, Pseudomonas putida KT2440
cagcggccccaucacccccgaa

SEQ ID NO: 3577544 - RNA, 18 nt, Pseudomonas putida KT2440
cagcggccgcuugaucuu

SEQ ID NO: 3577545 - RNA, 15 nt, Pseudomonas putida KT2440
cagcggcgccaccca

SEQ ID NO: 3577546 - RNA, 21 nt, Pseudomonas putida KT2440
cagcggcgccacccagaacag

SEQ ID NO: 3577547 - RNA, 14 nt, Pseudomonas putida KT2440
cagcggcgucaccu

SEQ ID NO: 3577548 - RNA, 17 nt, Pseudomonas putida KT2440
cagcggcgucaccuucc

SEQ ID NO: 3577549 - RNA, 14 nt, Pseudomonas putida KT2440
cagcggcuccaccg

SEQ ID NO: 3577550 - RNA, 20 nt, Pseudomonas putida KT2440
cagcggcucgcucaggcgca

SEQ ID NO: 3577551 - RNA, 14 nt, Pseudomonas putida KT2440
cagcggcuggcccu

SEQ ID NO: 3577552 - RNA, 13 nt, Pseudomonas putida KT2440
cagcgggaacggu

SEQ ID NO: 3577553 - RNA, 20 nt, Pseudomonas putida KT2440
cagcgggagucgaaccugcc

SEQ ID NO: 3577554 - RNA, 15 nt, Pseudomonas putida KT2440
cagcgggaugcaguc

SEQ ID NO: 3577555 - RNA, 21 nt, Pseudomonas putida KT2440
cagcgggauguuggucuugau

SEQ ID NO: 3577556 - RNA, 13 nt, Pseudomonas putida KT2440
cagcgggcacagg

SEQ ID NO: 3577557 - RNA, 14 nt, Pseudomonas putida KT2440
cagcgggcacaggc

SEQ ID NO: 3577558 - RNA, 17 nt, Pseudomonas putida KT2440
cagcgggcccagcaggu

SEQ ID NO: 3577559 - RNA, 17 nt, Pseudomonas putida KT2440
cagcgggcgauugccag

SEQ ID NO: 3577560 - RNA, 17 nt, Pseudomonas putida KT2440
cagcgggcguaccuggc

SEQ ID NO: 3577561 - RNA, 14 nt, Pseudomonas putida KT2440
cagcgggcucgccc

SEQ ID NO: 3577562 - RNA, 18 nt, Pseudomonas putida KT2440
cagcgggcucgcccacac

SEQ ID NO: 3577563 - RNA, 21 nt, Pseudomonas putida KT2440
cagcggggauucaacagcgcg

SEQ ID NO: 3577564 - RNA, 15 nt, Pseudomonas putida KT2440
cagcgggggcagugc

SEQ ID NO: 3577565 - RNA, 19 nt, Pseudomonas putida KT2440
cagcgggggcagugcccag

SEQ ID NO: 3577566 - RNA, 19 nt, Pseudomonas putida KT2440
cagcgggguguagccgcuu

SEQ ID NO: 3577567 - RNA, 22 nt, Pseudomonas putida KT2440
cagcgggguguccucgaucaca

SEQ ID NO: 3577568 - RNA, 14 nt, Pseudomonas putida KT2440
cagcggguccucga

SEQ ID NO: 3577569 - RNA, 17 nt, Pseudomonas putida KT2440
cagcgggucgaaggugu

SEQ ID NO: 3577570 - RNA, 20 nt, Pseudomonas putida KT2440
cagcgggucgucgcccaggc

SEQ ID NO: 3577571 - RNA, 18 nt, Pseudomonas putida KT2440
cagcggguuccccagcaa

SEQ ID NO: 3577572 - RNA, 21 nt, Pseudomonas putida KT2440
cagcggucugcugcgucagca

SEQ ID NO: 3577573 - RNA, 14 nt, Pseudomonas putida KT2440
cagcgguggcaaau

SEQ ID NO: 3577574 - RNA, 14 nt, Pseudomonas putida KT2440
cagcgguucgacca

SEQ ID NO: 3577575 - RNA, 19 nt, Pseudomonas putida KT2440
cagcgguucgaccaauggc

SEQ ID NO: 3577576 - RNA, 21 nt, Pseudomonas putida KT2440
cagcgguucgaccaauggcug

SEQ ID NO: 3577577 - RNA, 23 nt, Pseudomonas putida KT2440
cagcgguucgaccaauggcugcg

SEQ ID NO: 3577578 - RNA, 16 nt, Pseudomonas putida KT2440
cagcgguucgaccgac

SEQ ID NO: 3577579 - RNA, 23 nt, Pseudomonas putida KT2440
cagcgguucgaccgacaugccaa

SEQ ID NO: 3577580 - RNA, 15 nt, Pseudomonas putida KT2440
cagcguaagcuggcu

SEQ ID NO: 3577581 - RNA, 19 nt, Pseudomonas putida KT2440
cagcguacacugcaggagc

SEQ ID NO: 3577582 - RNA, 16 nt, Pseudomonas putida KT2440
cagcguagccguccuu

SEQ ID NO: 3577583 - RNA, 19 nt, Pseudomonas putida KT2440
cagcguauagccaccgggc

SEQ ID NO: 3577584 - RNA, 15 nt, Pseudomonas putida KT2440
cagcgucaagagcga

SEQ ID NO: 3577585 - RNA, 23 nt, Pseudomonas putida KT2440
cagcgucaagagcgacuggugug

SEQ ID NO: 3577586 - RNA, 13 nt, Pseudomonas putida KT2440
cagcgucacccgu

SEQ ID NO: 3577587 - RNA, 13 nt, Pseudomonas putida KT2440
cagcgucaggguc

SEQ ID NO: 3577588 - RNA, 14 nt, Pseudomonas putida KT2440
cagcgucagggucu

SEQ ID NO: 3577589 - RNA, 20 nt, Pseudomonas putida KT2440
cagcgucagggucucgcggc

SEQ ID NO: 3577590 - RNA, 21 nt, Pseudomonas putida KT2440
cagcgucagggucucgcggcu

SEQ ID NO: 3577591 - RNA, 19 nt, Pseudomonas putida KT2440
cagcgucaugcgguacagc

SEQ ID NO: 3577592 - RNA, 22 nt, Pseudomonas putida KT2440
cagcgucaugcgguacagcacu

SEQ ID NO: 3577593 - RNA, 19 nt, Pseudomonas putida KT2440
cagcguccacucaccggca

SEQ ID NO: 3577594 - RNA, 19 nt, Pseudomonas putida KT2440
cagcgucggcagagcgcca

SEQ ID NO: 3577595 - RNA, 15 nt, Pseudomonas putida KT2440
cagcgucgucugcgu

SEQ ID NO: 3577596 - RNA, 15 nt, Pseudomonas putida KT2440
cagcgucucgaugca

SEQ ID NO: 3577597 - RNA, 19 nt, Pseudomonas putida KT2440
cagcgugacgauggccacc

SEQ ID NO: 3577598 - RNA, 22 nt, Pseudomonas putida KT2440
cagcgugacgauggccaccagg

SEQ ID NO: 3577599 - RNA, 22 nt, Pseudomonas putida KT2440
cagcguggccagcccaaggaag

SEQ ID NO: 3577600 - RNA, 21 nt, Pseudomonas putida KT2440
cagcguggccgccaacagcgc

SEQ ID NO: 3577601 - RNA, 15 nt, Pseudomonas putida KT2440
cagcguggccugcaa

SEQ ID NO: 3577602 - RNA, 21 nt, Pseudomonas putida KT2440
cagcguuccugggcguucuga

SEQ ID NO: 3577603 - RNA, 13 nt, Pseudomonas putida KT2440
cagcguucggcca

SEQ ID NO: 3577604 - RNA, 16 nt, Pseudomonas putida KT2440
cagcguucggccagca

SEQ ID NO: 3577605 - RNA, 19 nt, Pseudomonas putida KT2440
cagcguucggccagcacua

SEQ ID NO: 3577606 - RNA, 17 nt, Pseudomonas putida KT2440
cagcguugccgaugacc

SEQ ID NO: 3577607 - RNA, 15 nt, Pseudomonas putida KT2440
cagcguugcuggcga

SEQ ID NO: 3577608 - RNA, 21 nt, Pseudomonas putida KT2440
cagcguuuguaaguaggcgcu

SEQ ID NO: 3577609 - RNA, 15 nt, Pseudomonas putida KT2440
cagcuacgcgagcca

SEQ ID NO: 3577610 - RNA, 18 nt, Pseudomonas putida KT2440
cagcuacgcgagccaccg

SEQ ID NO: 3577611 - RNA, 19 nt, Pseudomonas putida KT2440
cagcuacgcgagccaccgu

SEQ ID NO: 3577612 - RNA, 20 nt, Pseudomonas putida KT2440
cagcuacgcgagccaccguc

SEQ ID NO: 3577613 - RNA, 20 nt, Pseudomonas putida KT2440
cagcuacgcuggacuugccu

SEQ ID NO: 3577614 - RNA, 22 nt, Pseudomonas putida KT2440
cagcuauuucgggccuuugggc

SEQ ID NO: 3577615 - RNA, 19 nt, Pseudomonas putida KT2440
cagcucaaccauugcugga

SEQ ID NO: 3577616 - RNA, 20 nt, Pseudomonas putida KT2440
cagcucaaccccaaaccgcu

SEQ ID NO: 3577617 - RNA, 16 nt, Pseudomonas putida KT2440
cagcucaaucagccaa

SEQ ID NO: 3577618 - RNA, 15 nt, Pseudomonas putida KT2440
cagcucacagcacuc

SEQ ID NO: 3577619 - RNA, 14 nt, Pseudomonas putida KT2440
cagcucacgcaagc

SEQ ID NO: 3577620 - RNA, 15 nt, Pseudomonas putida KT2440
cagcucacgcagcca

SEQ ID NO: 3577621 - RNA, 21 nt, Pseudomonas putida KT2440
cagcucacguuugggcggcgu

SEQ ID NO: 3577622 - RNA, 19 nt, Pseudomonas putida KT2440
cagcucacugaacgcaaua

SEQ ID NO: 3577623 - RNA, 15 nt, Pseudomonas putida KT2440
cagcucacuggcauc

SEQ ID NO: 3577624 - RNA, 17 nt, Pseudomonas putida KT2440
cagcuggccuugcggca

SEQ ID NO: 3577625 - RNA, 18 nt, Pseudomonas putida KT2440
cagcuggccuugcggcaa

SEQ ID NO: 3577626 - RNA, 18 nt, Pseudomonas putida KT2440
cagcuggcucaucugccg

SEQ ID NO: 3577627 - RNA, 19 nt, Pseudomonas putida KT2440
cagcuggcucaucugccgg

SEQ ID NO: 3577628 - RNA, 23 nt, Pseudomonas putida KT2440
cagcuggcuggugacaacgcccg

SEQ ID NO: 3577629 - RNA, 23 nt, Pseudomonas putida KT2440
cagcuggucgagcaaggcaucca

SEQ ID NO: 3577630 - RNA, 16 nt, Pseudomonas putida KT2440
cagcugguucugcugc

SEQ ID NO: 3577631 - RNA, 20 nt, Pseudomonas putida KT2440
cagcuguacgcuggccaagg

SEQ ID NO: 3577632 - RNA, 23 nt, Pseudomonas putida KT2440
cagcuguugcuguuggcgcgaca

SEQ ID NO: 3577633 - RNA, 22 nt, Pseudomonas putida KT2440
cagcuucaaaauagucgaaggc

SEQ ID NO: 3577634 - RNA, 19 nt, Pseudomonas putida KT2440
cagcuucaccucaucggca

SEQ ID NO: 3577635 - RNA, 14 nt, Pseudomonas putida KT2440
cagcuucagccagg

SEQ ID NO: 3577636 - RNA, 18 nt, Pseudomonas putida KT2440
cagcuucagccagggcga

SEQ ID NO: 3577637 - RNA, 16 nt, Pseudomonas putida KT2440
cagcuucccggccugg

SEQ ID NO: 3577638 - RNA, 15 nt, Pseudomonas putida KT2440
cagcuuccugugccg

SEQ ID NO: 3577639 - RNA, 14 nt, Pseudomonas putida KT2440
cagcuucgacgaag

SEQ ID NO: 3577640 - RNA, 21 nt, Pseudomonas putida KT2440
cagcuucucaagcaucuggua

SEQ ID NO: 3577641 - RNA, 12 nt, Pseudomonas putida KT2440
cagcuucuccag

SEQ ID NO: 3577642 - RNA, 15 nt, Pseudomonas putida KT2440
cagcuucuccagcaa

SEQ ID NO: 3577643 - RNA, 21 nt, Pseudomonas putida KT2440
cagcuucucgcgcuuggccag

SEQ ID NO: 3577644 - RNA, 14 nt, Pseudomonas putida KT2440
cagcuucugcuggu

SEQ ID NO: 3577645 - RNA, 12 nt, Pseudomonas putida KT2440
cagcuucugggc

SEQ ID NO: 3577646 - RNA, 17 nt, Pseudomonas putida KT2440
cagcuucuugcaccgcu

SEQ ID NO: 3577647 - RNA, 18 nt, Pseudomonas putida KT2440
cagcuucuugcaccgcuc

SEQ ID NO: 3577648 - RNA, 21 nt, Pseudomonas putida KT2440
cagcuugaacuugcucuucaa

SEQ ID NO: 3577649 - RNA, 16 nt, Pseudomonas putida KT2440
cagcuugaccccuuca

SEQ ID NO: 3577650 - RNA, 13 nt, Pseudomonas putida KT2440
cagcuugacgauc

SEQ ID NO: 3577651 - RNA, 21 nt, Pseudomonas putida KT2440
cagcuugacggugcgcgccag

SEQ ID NO: 3577652 - RNA, 15 nt, Pseudomonas putida KT2440
cagcuugaugcuguc

SEQ ID NO: 3577653 - RNA, 21 nt, Pseudomonas putida KT2440
cagcuugaugcugucgaagcg

SEQ ID NO: 3577654 - RNA, 14 nt, Pseudomonas putida KT2440
cagcuugcagcgcc

SEQ ID NO: 3577655 - RNA, 17 nt, Pseudomonas putida KT2440
cagcuugccaccaucga

SEQ ID NO: 3577656 - RNA, 16 nt, Pseudomonas putida KT2440
cagcuugcccagcagg

SEQ ID NO: 3577657 - RNA, 17 nt, Pseudomonas putida KT2440
cagcuugcccaucaccu

SEQ ID NO: 3577658 - RNA, 21 nt, Pseudomonas putida KT2440
cagcuugcccaucaccucguc

SEQ ID NO: 3577659 - RNA, 20 nt, Pseudomonas putida KT2440
cagcuugccgaucagcgagu

SEQ ID NO: 3577660 - RNA, 19 nt, Pseudomonas putida KT2440
cagcuugcgcaaggggucg

SEQ ID NO: 3577661 - RNA, 18 nt, Pseudomonas putida KT2440
cagcuuggcaggcuucau

SEQ ID NO: 3577662 - RNA, 20 nt, Pseudomonas putida KT2440
cagcuuggucagggcaaagc

SEQ ID NO: 3577663 - RNA, 14 nt, Pseudomonas putida KT2440
cagcuugucgacca

SEQ ID NO: 3577664 - RNA, 15 nt, Pseudomonas putida KT2440
cagcuugucgaccag

SEQ ID NO: 3577665 - RNA, 18 nt, Pseudomonas putida KT2440
cagcuugucgaccaggau

SEQ ID NO: 3577666 - RNA, 18 nt, Pseudomonas putida KT2440
cagcuugugcagcgacgg

SEQ ID NO: 3577667 - RNA, 15 nt, Pseudomonas putida KT2440
cagcuuguugccagc

SEQ ID NO: 3577668 - RNA, 18 nt, Pseudomonas putida KT2440
cagcuuguugccagcggc

SEQ ID NO: 3577669 - RNA, 19 nt, Pseudomonas putida KT2440
caggaaaacggcuaccccg

SEQ ID NO: 3577670 - RNA, 22 nt, Pseudomonas putida KT2440
caggaaaacugcgggcugagga

SEQ ID NO: 3577671 - RNA, 22 nt, Pseudomonas putida KT2440
caggaacaaccugaacaaggcc

SEQ ID NO: 3577672 - RNA, 22 nt, Pseudomonas putida KT2440
caggaacaaucuucuucaucac

SEQ ID NO: 3577673 - RNA, 19 nt, Pseudomonas putida KT2440
caggaacaccacguucggg

SEQ ID NO: 3577674 - RNA, 23 nt, Pseudomonas putida KT2440
caggaacacuucgcuuucaccuu

SEQ ID NO: 3577675 - RNA, 12 nt, Pseudomonas putida KT2440
caggaacagcgc

SEQ ID NO: 3577676 - RNA, 14 nt, Pseudomonas putida KT2440
caggaacagcgcag

SEQ ID NO: 3577677 - RNA, 17 nt, Pseudomonas putida KT2440
caggaacagcgcagcca

SEQ ID NO: 3577678 - RNA, 23 nt, Pseudomonas putida KT2440
caggaacagcgcagccaccagcu

SEQ ID NO: 3577679 - RNA, 12 nt, Pseudomonas putida KT2440
caggaacagcgu

SEQ ID NO: 3577680 - RNA, 17 nt, Pseudomonas putida KT2440
caggaacagcguggcca

SEQ ID NO: 3577681 - RNA, 23 nt, Pseudomonas putida KT2440
caggaaccgcucccagguuuucu

SEQ ID NO: 3577682 - RNA, 20 nt, Pseudomonas putida KT2440
caggaacgguguaucggcca

SEQ ID NO: 3577683 - RNA, 13 nt, Pseudomonas putida KT2440
caggaacuccugc

SEQ ID NO: 3577684 - RNA, 18 nt, Pseudomonas putida KT2440
caggaagaucacgucggc

SEQ ID NO: 3577685 - RNA, 19 nt, Pseudomonas putida KT2440
caggaagaucacgucggcc

SEQ ID NO: 3577686 - RNA, 14 nt, Pseudomonas putida KT2440
caggaagauguguu

SEQ ID NO: 3577687 - RNA, 20 nt, Pseudomonas putida KT2440
caggaagccccgcgcgucca

SEQ ID NO: 3577688 - RNA, 12 nt, Pseudomonas putida KT2440
caggaagcuggc

SEQ ID NO: 3577689 - RNA, 16 nt, Pseudomonas putida KT2440
caggaagcuguacagc

SEQ ID NO: 3577690 - RNA, 20 nt, Pseudomonas putida KT2440
caggaagcuguacagcgcau

SEQ ID NO: 3577691 - RNA, 23 nt, Pseudomonas putida KT2440
caggaaggcaccacggaaggcca

SEQ ID NO: 3577692 - RNA, 21 nt, Pseudomonas putida KT2440
caggaaggcgucguacaggcc

SEQ ID NO: 3577693 - RNA, 22 nt, Pseudomonas putida KT2440
caggaaggcgucguacaggccu

SEQ ID NO: 3577694 - RNA, 14 nt, Pseudomonas putida KT2440
caggaagucgaugu

SEQ ID NO: 3577695 - RNA, 17 nt, Pseudomonas putida KT2440
caggaagucgauguuca

SEQ ID NO: 3577696 - RNA, 21 nt, Pseudomonas putida KT2440
caggaagucgauguucagcac

SEQ ID NO: 3577697 - RNA, 14 nt, Pseudomonas putida KT2440
caggaaucaccaga

SEQ ID NO: 3577698 - RNA, 23 nt, Pseudomonas putida KT2440
caggaaucaccagaccuggaggu

SEQ ID NO: 3577699 - RNA, 14 nt, Pseudomonas putida KT2440
caggaauggcacca

SEQ ID NO: 3577700 - RNA, 16 nt, Pseudomonas putida KT2440
caggaauuacgcaggc

SEQ ID NO: 3577701 - RNA, 19 nt, Pseudomonas putida KT2440
caggaauuacgcaggcucc

SEQ ID NO: 3577702 - RNA, 20 nt, Pseudomonas putida KT2440
caggaauuacgcaggcucca

SEQ ID NO: 3577703 - RNA, 17 nt, Pseudomonas putida KT2440
caggacaaaccagcggu

SEQ ID NO: 3577704 - RNA, 14 nt, Pseudomonas putida KT2440
caggaccaggccga

SEQ ID NO: 3577705 - RNA, 23 nt, Pseudomonas putida KT2440
caggaccgcggaaugaaccgcga

SEQ ID NO: 3577706 - RNA, 19 nt, Pseudomonas putida KT2440
caggacgauggugaaggcc

SEQ ID NO: 3577707 - RNA, 18 nt, Pseudomonas putida KT2440
caggacggauacaccaga

SEQ ID NO: 3577708 - RNA, 21 nt, Pseudomonas putida KT2440
caggagcggccuucagggccg

SEQ ID NO: 3577709 - RNA, 17 nt, Pseudomonas putida KT2440
caggagcggguucaccc

SEQ ID NO: 3577710 - RNA, 13 nt, Pseudomonas putida KT2440
caggagggccgua

SEQ ID NO: 3577711 - RNA, 23 nt, Pseudomonas putida KT2440
caggaggucagcgguucgauccc

SEQ ID NO: 3577712 - RNA, 15 nt, Pseudomonas putida KT2440
caggauacccaucuc

SEQ ID NO: 3577713 - RNA, 16 nt, Pseudomonas putida KT2440
caggauauugccgacu

SEQ ID NO: 3577714 - RNA, 16 nt, Pseudomonas putida KT2440
caggaucagguaaucc

SEQ ID NO: 3577715 - RNA, 17 nt, Pseudomonas putida KT2440
caggaucaugugcgcca

SEQ ID NO: 3577716 - RNA, 18 nt, Pseudomonas putida KT2440
caggaucaugugcgccac

SEQ ID NO: 3577717 - RNA, 19 nt, Pseudomonas putida KT2440
caggaucgagaccuugccu

SEQ ID NO: 3577718 - RNA, 17 nt, Pseudomonas putida KT2440
caggaucuccucggcca

SEQ ID NO: 3577719 - RNA, 19 nt, Pseudomonas putida KT2440
caggaucuccucggccagc

SEQ ID NO: 3577720 - RNA, 23 nt, Pseudomonas putida KT2440
caggaucuccucggccagcggcc

SEQ ID NO: 3577721 - RNA, 15 nt, Pseudomonas putida KT2440
caggaucucgcuguc

SEQ ID NO: 3577722 - RNA, 14 nt, Pseudomonas putida KT2440
caggaucugcugca

SEQ ID NO: 3577723 - RNA, 21 nt, Pseudomonas putida KT2440
caggaucugcugcagcauggc

SEQ ID NO: 3577724 - RNA, 17 nt, Pseudomonas putida KT2440
caggaucuucaugccau

SEQ ID NO: 3577725 - RNA, 19 nt, Pseudomonas putida KT2440
caggaugccaaggaucagc

SEQ ID NO: 3577726 - RNA, 14 nt, Pseudomonas putida KT2440
caggaugccgugcg

SEQ ID NO: 3577727 - RNA, 18 nt, Pseudomonas putida KT2440
caggaugcuucggcugau

SEQ ID NO: 3577728 - RNA, 19 nt, Pseudomonas putida KT2440
caggaugcuucggcugauc

SEQ ID NO: 3577729 - RNA, 22 nt, Pseudomonas putida KT2440
caggcccgccagagcauggcca

SEQ ID NO: 3577730 - RNA, 13 nt, Pseudomonas putida KT2440
caggcccggcccu

SEQ ID NO: 3577731 - RNA, 16 nt, Pseudomonas putida KT2440
caggcccggcugaaac

SEQ ID NO: 3577732 - RNA, 19 nt, Pseudomonas putida KT2440
caggcccggcugaaaccgc

SEQ ID NO: 3577733 - RNA, 15 nt, Pseudomonas putida KT2440
caggcccgugacgaa

SEQ ID NO: 3577734 - RNA, 21 nt, Pseudomonas putida KT2440
caggcccugacgccagcgcug

SEQ ID NO: 3577735 - RNA, 13 nt, Pseudomonas putida KT2440
caggcccugcugc

SEQ ID NO: 3577736 - RNA, 18 nt, Pseudomonas putida KT2440
caggcccuuucgcgggua

SEQ ID NO: 3577737 - RNA, 21 nt, Pseudomonas putida KT2440
caggccgaaaaaaucaugcgc

SEQ ID NO: 3577738 - RNA, 17 nt, Pseudomonas putida KT2440
caggccgaaaccgcccg

SEQ ID NO: 3577739 - RNA, 18 nt, Pseudomonas putida KT2440
caggccgaaaccgcccgg

SEQ ID NO: 3577740 - RNA, 13 nt, Pseudomonas putida KT2440
caggccgaaggcc

SEQ ID NO: 3577741 - RNA, 16 nt, Pseudomonas putida KT2440
caggccgacaacggug

SEQ ID NO: 3577742 - RNA, 20 nt, Pseudomonas putida KT2440
caggccgaucaccagcaccc

SEQ ID NO: 3577743 - RNA, 16 nt, Pseudomonas putida KT2440
caggccgauggcgaug

SEQ ID NO: 3577744 - RNA, 19 nt, Pseudomonas putida KT2440
caggccgauggcgaugggu

SEQ ID NO: 3577745 - RNA, 16 nt, Pseudomonas putida KT2440
caggccgaugggcagg

SEQ ID NO: 3577746 - RNA, 19 nt, Pseudomonas putida KT2440
caggccgaugggcaggcca

SEQ ID NO: 3577747 - RNA, 22 nt, Pseudomonas putida KT2440
caggccgaugggcaggccauuc

SEQ ID NO: 3577748 - RNA, 18 nt, Pseudomonas putida KT2440
caggccgcacgcgccucu

SEQ ID NO: 3577749 - RNA, 14 nt, Pseudomonas putida KT2440
caggccgcccaccc

SEQ ID NO: 3577750 - RNA, 16 nt, Pseudomonas putida KT2440
caggccgcccacccac

SEQ ID NO: 3577751 - RNA, 16 nt, Pseudomonas putida KT2440
caggccgccgacgauc

SEQ ID NO: 3577752 - RNA, 18 nt, Pseudomonas putida KT2440
caggccgccgacgaucag

SEQ ID NO: 3577753 - RNA, 21 nt, Pseudomonas putida KT2440
caggccgccugaccugugcug

SEQ ID NO: 3577754 - RNA, 15 nt, Pseudomonas putida KT2440
caggccgcggccgaa

SEQ ID NO: 3577755 - RNA, 17 nt, Pseudomonas putida KT2440
caggccgcugaacaacu

SEQ ID NO: 3577756 - RNA, 20 nt, Pseudomonas putida KT2440
caggccgcugaacaacuccg

SEQ ID NO: 3577757 - RNA, 22 nt, Pseudomonas putida KT2440
caggccgcugaacaacuccggg

SEQ ID NO: 3577758 - RNA, 13 nt, Pseudomonas putida KT2440
caggccgcugagg

SEQ ID NO: 3577759 - RNA, 22 nt, Pseudomonas putida KT2440
caggccggucuugucugacagc

SEQ ID NO: 3577760 - RNA, 19 nt, Pseudomonas putida KT2440
caggccgguugcuccagcg

SEQ ID NO: 3577761 - RNA, 23 nt, Pseudomonas putida KT2440
caggccgugaaccaucccacuca

SEQ ID NO: 3577762 - RNA, 17 nt, Pseudomonas putida KT2440
caggccguugaucagcg

SEQ ID NO: 3577763 - RNA, 18 nt, Pseudomonas putida KT2440
caggccguugaucagcga

SEQ ID NO: 3577764 - RNA, 19 nt, Pseudomonas putida KT2440
caggccguugaucagcgac

SEQ ID NO: 3577765 - RNA, 21 nt, Pseudomonas putida KT2440
caggccguuguaggagcgggu

SEQ ID NO: 3577766 - RNA, 22 nt, Pseudomonas putida KT2440
caggccucaagccucgcgcaac

SEQ ID NO: 3577767 - RNA, 16 nt, Pseudomonas putida KT2440
caggccuccccgcuuu

SEQ ID NO: 3577768 - RNA, 21 nt, Pseudomonas putida KT2440
caggccuggaugcguugcuuc

SEQ ID NO: 3577769 - RNA, 14 nt, Pseudomonas putida KT2440
caggccugucacgc

SEQ ID NO: 3577770 - RNA, 18 nt, Pseudomonas putida KT2440
caggccuucaucggccuc

SEQ ID NO: 3577771 - RNA, 15 nt, Pseudomonas putida KT2440
caggccuugccgcuc

SEQ ID NO: 3577772 - RNA, 20 nt, Pseudomonas putida KT2440
caggccuugccgcucaccac

SEQ ID NO: 3577773 - RNA, 16 nt, Pseudomonas putida KT2440
caggccuuguuccacg

SEQ ID NO: 3577774 - RNA, 16 nt, Pseudomonas putida KT2440
caggccuuucagcgcc

SEQ ID NO: 3577775 - RNA, 14 nt, Pseudomonas putida KT2440
caggcgaagacgaa

SEQ ID NO: 3577776 - RNA, 23 nt, Pseudomonas putida KT2440
caggcgaauauugagguuggcgc

SEQ ID NO: 3577777 - RNA, 22 nt, Pseudomonas putida KT2440
caggcgacaaaaaccucacggc

SEQ ID NO: 3577778 - RNA, 16 nt, Pseudomonas putida KT2440
caggcgacgagccagu

SEQ ID NO: 3577779 - RNA, 18 nt, Pseudomonas putida KT2440
caggcgacggaacggccg

SEQ ID NO: 3577780 - RNA, 23 nt, Pseudomonas putida KT2440
caggcgacggaacggccgcaccu

SEQ ID NO: 3577781 - RNA, 18 nt, Pseudomonas putida KT2440
caggcgacuggaaggcgc

SEQ ID NO: 3577782 - RNA, 19 nt, Pseudomonas putida KT2440
caggcgaucguugguccgc

SEQ ID NO: 3577783 - RNA, 17 nt, Pseudomonas putida KT2440
caggcgauucaggcuuu

SEQ ID NO: 3577784 - RNA, 21 nt, Pseudomonas putida KT2440
caggcgauucaggcuuugcug

SEQ ID NO: 3577785 - RNA, 23 nt, Pseudomonas putida KT2440
caggcgcacauacgucuugauca

SEQ ID NO: 3577786 - RNA, 21 nt, Pseudomonas putida KT2440
caggcgcagcacgccguugcg

SEQ ID NO: 3577787 - RNA, 13 nt, Pseudomonas putida KT2440
caggcgcagcagc

SEQ ID NO: 3577788 - RNA, 14 nt, Pseudomonas putida KT2440
caggcgcagcagcu

SEQ ID NO: 3577789 - RNA, 19 nt, Pseudomonas putida KT2440
caggcgcaggcucuccacg

SEQ ID NO: 3577790 - RNA, 20 nt, Pseudomonas putida KT2440
caggcgcagggugugcugcu

SEQ ID NO: 3577791 - RNA, 21 nt, Pseudomonas putida KT2440
caggcgcagggugugcugcug

SEQ ID NO: 3577792 - RNA, 21 nt, Pseudomonas putida KT2440
caggcgccauuuggcgccggu

SEQ ID NO: 3577793 - RNA, 16 nt, Pseudomonas putida KT2440
caggcgcccccugggc

SEQ ID NO: 3577794 - RNA, 17 nt, Pseudomonas putida KT2440
caggcgcccccugggcg

SEQ ID NO: 3577795 - RNA, 13 nt, Pseudomonas putida KT2440
caggcgcccugcc

SEQ ID NO: 3577796 - RNA, 14 nt, Pseudomonas putida KT2440
caggcgcccugcgc

SEQ ID NO: 3577797 - RNA, 14 nt, Pseudomonas putida KT2440
caggcgcgacauga

SEQ ID NO: 3577798 - RNA, 14 nt, Pseudomonas putida KT2440
caggcgcgccugca

SEQ ID NO: 3577799 - RNA, 17 nt, Pseudomonas putida KT2440
caggcgcgccugcaccu

SEQ ID NO: 3577800 - RNA, 24 nt, Pseudomonas putida KT2440
caggcgcgccugcaccugacgagc

SEQ ID NO: 3577801 - RNA, 14 nt, Pseudomonas putida KT2440
caggcgcggcagca

SEQ ID NO: 3577802 - RNA, 16 nt, Pseudomonas putida KT2440
caggcgcggcagcaug

SEQ ID NO: 3577803 - RNA, 18 nt, Pseudomonas putida KT2440
caggcgcggcucgaugcu

SEQ ID NO: 3577804 - RNA, 22 nt, Pseudomonas putida KT2440
caggcgcggcucgaugcugcgu

SEQ ID NO: 3577805 - RNA, 17 nt, Pseudomonas putida KT2440
caggcgcggugccggca

SEQ ID NO: 3577806 - RNA, 16 nt, Pseudomonas putida KT2440
caggcgcucaccccgc

SEQ ID NO: 3577807 - RNA, 19 nt, Pseudomonas putida KT2440
caggcgcucaccccgcccc

SEQ ID NO: 3577808 - RNA, 20 nt, Pseudomonas putida KT2440
caggcgcucaccccgccccu

SEQ ID NO: 3577809 - RNA, 14 nt, Pseudomonas putida KT2440
caggcgcuccagca

SEQ ID NO: 3577810 - RNA, 18 nt, Pseudomonas putida KT2440
caggcgcuccagcagggu

SEQ ID NO: 3577811 - RNA, 21 nt, Pseudomonas putida KT2440
caggcgcucgcuccagggcag

SEQ ID NO: 3577812 - RNA, 21 nt, Pseudomonas putida KT2440
caggcgcucgggggugcacag

SEQ ID NO: 3577813 - RNA, 14 nt, Pseudomonas putida KT2440
caggcgcucguagg

SEQ ID NO: 3577814 - RNA, 20 nt, Pseudomonas putida KT2440
caggcgcugcagggcgccga

SEQ ID NO: 3577815 - RNA, 14 nt, Pseudomonas putida KT2440
caggcgcuggcgcc

SEQ ID NO: 3577816 - RNA, 19 nt, Pseudomonas putida KT2440
caggcgcugguugacggcu

SEQ ID NO: 3577817 - RNA, 20 nt, Pseudomonas putida KT2440
caggcgcugguugacggcuu

SEQ ID NO: 3577818 - RNA, 23 nt, Pseudomonas putida KT2440
caggcgcugguugacggcuuuga

SEQ ID NO: 3577819 - RNA, 23 nt, Pseudomonas putida KT2440
caggcgcuugacccggugcaccc

SEQ ID NO: 3577820 - RNA, 20 nt, Pseudomonas putida KT2440
caggcgcuugagcucggcaa

SEQ ID NO: 3577821 - RNA, 16 nt, Pseudomonas putida KT2440
caggcgcuugcccgcc

SEQ ID NO: 3577822 - RNA, 13 nt, Pseudomonas putida KT2440
caggcggccaaac

SEQ ID NO: 3577823 - RNA, 19 nt, Pseudomonas putida KT2440
caggcggccaaacuggaug

SEQ ID NO: 3577824 - RNA, 14 nt, Pseudomonas putida KT2440
caggcggcccggca

SEQ ID NO: 3577825 - RNA, 21 nt, Pseudomonas putida KT2440
caggcggcugaccuguucgcg

SEQ ID NO: 3577826 - RNA, 15 nt, Pseudomonas putida KT2440
caggcgggcagcgca

SEQ ID NO: 3577827 - RNA, 19 nt, Pseudomonas putida KT2440
caggcggguagaggaaggc

SEQ ID NO: 3577828 - RNA, 14 nt, Pseudomonas putida KT2440
caggcgguccagca

SEQ ID NO: 3577829 - RNA, 14 nt, Pseudomonas putida KT2440
caggcggucggcca

SEQ ID NO: 3577830 - RNA, 17 nt, Pseudomonas putida KT2440
caggcgguuggccaugu

SEQ ID NO: 3577831 - RNA, 15 nt, Pseudomonas putida KT2440
caggcguaaacccag

SEQ ID NO: 3577832 - RNA, 16 nt, Pseudomonas putida KT2440
caggcguaaacccagg

SEQ ID NO: 3577833 - RNA, 14 nt, Pseudomonas putida KT2440
caggcguaacucag

SEQ ID NO: 3577834 - RNA, 23 nt, Pseudomonas putida KT2440
cagggccagguagacgaucgagc

SEQ ID NO: 3577835 - RNA, 12 nt, Pseudomonas putida KT2440
cagggcccagcc

SEQ ID NO: 3577836 - RNA, 13 nt, Pseudomonas putida KT2440
cagggcccagcca

SEQ ID NO: 3577837 - RNA, 17 nt, Pseudomonas putida KT2440
cagggcccagccaccga

SEQ ID NO: 3577838 - RNA, 17 nt, Pseudomonas putida KT2440
cagggcccccgauucca

SEQ ID NO: 3577839 - RNA, 14 nt, Pseudomonas putida KT2440
cagggccugaccgc

SEQ ID NO: 3577840 - RNA, 23 nt, Pseudomonas putida KT2440
cagggccuggacgcgugcaaggg

SEQ ID NO: 3577841 - RNA, 15 nt, Pseudomonas putida KT2440
cagggccuugcucgu

SEQ ID NO: 3577842 - RNA, 15 nt, Pseudomonas putida KT2440
cagggccuuggccug

SEQ ID NO: 3577843 - RNA, 16 nt, Pseudomonas putida KT2440
cagggccuuuucauau

SEQ ID NO: 3577844 - RNA, 22 nt, Pseudomonas putida KT2440
cagggccuuuucauauggcucg

SEQ ID NO: 3577845 - RNA, 14 nt, Pseudomonas putida KT2440
cagggcgaugcccu

SEQ ID NO: 3577846 - RNA, 20 nt, Pseudomonas putida KT2440
cagggcgaugcccuucaggc

SEQ ID NO: 3577847 - RNA, 17 nt, Pseudomonas putida KT2440
cagggcgcgaaaagccu

SEQ ID NO: 3577848 - RNA, 23 nt, Pseudomonas putida KT2440
cagggcgcgaaaagccugcacca

SEQ ID NO: 3577849 - RNA, 20 nt, Pseudomonas putida KT2440
cagggcgcguguagcccgcu

SEQ ID NO: 3577850 - RNA, 21 nt, Pseudomonas putida KT2440
cagggcgcguguagcccgcug

SEQ ID NO: 3577851 - RNA, 20 nt, Pseudomonas putida KT2440
cagggcgcugucggcgcgga

SEQ ID NO: 3577852 - RNA, 16 nt, Pseudomonas putida KT2440
cagggcgucaugcuca

SEQ ID NO: 3577853 - RNA, 20 nt, Pseudomonas putida KT2440
cagggcugauugagcagcug

SEQ ID NO: 3577854 - RNA, 15 nt, Pseudomonas putida KT2440
cagggcugcgcgccc

SEQ ID NO: 3577855 - RNA, 20 nt, Pseudomonas putida KT2440
cagggcuuuuuccagcgcca

SEQ ID NO: 3577856 - RNA, 21 nt, Pseudomonas putida KT2440
cagggcuuuuuccagcgccac

SEQ ID NO: 3577857 - RNA, 15 nt, Pseudomonas putida KT2440
caggggacagccaca

SEQ ID NO: 3577858 - RNA, 21 nt, Pseudomonas putida KT2440
caggggacagccacaugccag

SEQ ID NO: 3577859 - RNA, 20 nt, Pseudomonas putida KT2440
caggggacgcauauccuuug

SEQ ID NO: 3577860 - RNA, 19 nt, Pseudomonas putida KT2440
caggggagggcgugaaaaa

SEQ ID NO: 3577861 - RNA, 21 nt, Pseudomonas putida KT2440
caggggagggcgugaaaaaag

SEQ ID NO: 3577862 - RNA, 14 nt, Pseudomonas putida KT2440
caggggaugcgcga

SEQ ID NO: 3577863 - RNA, 12 nt, Pseudomonas putida KT2440
caggggaugcgg

SEQ ID NO: 3577864 - RNA, 20 nt, Pseudomonas putida KT2440
caggggcacggguacccgcg

SEQ ID NO: 3577865 - RNA, 21 nt, Pseudomonas putida KT2440
caggggcagaugcuccaaccc

SEQ ID NO: 3577866 - RNA, 16 nt, Pseudomonas putida KT2440
caggggccgcgcagcc

SEQ ID NO: 3577867 - RNA, 15 nt, Pseudomonas putida KT2440
caggggcgcagagcg

SEQ ID NO: 3577868 - RNA, 20 nt, Pseudomonas putida KT2440
caggggcugccuugcagccc

SEQ ID NO: 3577869 - RNA, 22 nt, Pseudomonas putida KT2440
cagggggccgcuucgcgaccca

SEQ ID NO: 3577870 - RNA, 21 nt, Pseudomonas putida KT2440
cagggguaaugccccagccga

SEQ ID NO: 3577871 - RNA, 19 nt, Pseudomonas putida KT2440
cagggguagcgucaacugc

SEQ ID NO: 3577872 - RNA, 18 nt, Pseudomonas putida KT2440
caggggugccuucgagca

SEQ ID NO: 3577873 - RNA, 18 nt, Pseudomonas putida KT2440
caggguaccgccguccac

SEQ ID NO: 3577874 - RNA, 19 nt, Pseudomonas putida KT2440
caggguaccgccguccacc

SEQ ID NO: 3577875 - RNA, 20 nt, Pseudomonas putida KT2440
caggguaccgccguccacca

SEQ ID NO: 3577876 - RNA, 21 nt, Pseudomonas putida KT2440
caggguacuugugugccugcu

SEQ ID NO: 3577877 - RNA, 14 nt, Pseudomonas putida KT2440
caggguagccccga

SEQ ID NO: 3577878 - RNA, 23 nt, Pseudomonas putida KT2440
caggguauugaacggcgcaucca

SEQ ID NO: 3577879 - RNA, 17 nt, Pseudomonas putida KT2440
cagggucagggccaggc

SEQ ID NO: 3577880 - RNA, 19 nt, Pseudomonas putida KT2440
cagggucagggccaggccg

SEQ ID NO: 3577881 - RNA, 23 nt, Pseudomonas putida KT2440
cagggucgccugaacgcugcgcg

SEQ ID NO: 3577882 - RNA, 14 nt, Pseudomonas putida KT2440
cagggucgcgcccc

SEQ ID NO: 3577883 - RNA, 15 nt, Pseudomonas putida KT2440
cagggucgcgcccca

SEQ ID NO: 3577884 - RNA, 21 nt, Pseudomonas putida KT2440
cagggucgcgccccaagcggg

SEQ ID NO: 3577885 - RNA, 18 nt, Pseudomonas putida KT2440
cagggucgggcacaggcc

SEQ ID NO: 3577886 - RNA, 22 nt, Pseudomonas putida KT2440
cagggucgggcacaggcccagc

SEQ ID NO: 3577887 - RNA, 13 nt, Pseudomonas putida KT2440
cagggucugcgcu

SEQ ID NO: 3577888 - RNA, 16 nt, Pseudomonas putida KT2440
cagggucugucggugg

SEQ ID NO: 3577889 - RNA, 16 nt, Pseudomonas putida KT2440
cagggugccagaccac

SEQ ID NO: 3577890 - RNA, 14 nt, Pseudomonas putida KT2440
cagggugccggcca

SEQ ID NO: 3577891 - RNA, 19 nt, Pseudomonas putida KT2440
cagggugccggccagcggc

SEQ ID NO: 3577892 - RNA, 20 nt, Pseudomonas putida KT2440
cagggugccggccagcggca

SEQ ID NO: 3577893 - RNA, 19 nt, Pseudomonas putida KT2440
cagggugcgcgcgggcucu

SEQ ID NO: 3577894 - RNA, 21 nt, Pseudomonas putida KT2440
caggguggccagcaaggcaau

SEQ ID NO: 3577895 - RNA, 23 nt, Pseudomonas putida KT2440
caggguggcgcugaccaacaggc

SEQ ID NO: 3577896 - RNA, 18 nt, Pseudomonas putida KT2440
cagggugucgacgacagu

SEQ ID NO: 3577897 - RNA, 19 nt, Pseudomonas putida KT2440
cagggugucgguggcggcc

SEQ ID NO: 3577898 - RNA, 20 nt, Pseudomonas putida KT2440
cagggugucgguggcggcca

SEQ ID NO: 3577899 - RNA, 23 nt, Pseudomonas putida KT2440
cagggugucgguggcggccagcg

SEQ ID NO: 3577900 - RNA, 15 nt, Pseudomonas putida KT2440
caggguucgcugucc

SEQ ID NO: 3577901 - RNA, 15 nt, Pseudomonas putida KT2440
caggguugucccggu

SEQ ID NO: 3577902 - RNA, 21 nt, Pseudomonas putida KT2440
caggguuguggugagcccugu

SEQ ID NO: 3577903 - RNA, 17 nt, Pseudomonas putida KT2440
cagguaaaaaucaugca

SEQ ID NO: 3577904 - RNA, 19 nt, Pseudomonas putida KT2440
cagguaaaaaucaugcagu

SEQ ID NO: 3577905 - RNA, 20 nt, Pseudomonas putida KT2440
cagguaaaaaucaugcaguu

SEQ ID NO: 3577906 - RNA, 14 nt, Pseudomonas putida KT2440
cagguaaacccgcg

SEQ ID NO: 3577907 - RNA, 14 nt, Pseudomonas putida KT2440
cagguaacgggcaa

SEQ ID NO: 3577908 - RNA, 17 nt, Pseudomonas putida KT2440
cagguaacugccgaccu

SEQ ID NO: 3577909 - RNA, 16 nt, Pseudomonas putida KT2440
cagguaagucacaggc

SEQ ID NO: 3577910 - RNA, 16 nt, Pseudomonas putida KT2440
cagguaagucagcgag

SEQ ID NO: 3577911 - RNA, 23 nt, Pseudomonas putida KT2440
cagguaauacgcugugcucuggc

SEQ ID NO: 3577912 - RNA, 14 nt, Pseudomonas putida KT2440
cagguaauccacca

SEQ ID NO: 3577913 - RNA, 19 nt, Pseudomonas putida KT2440
cagguaauccaccagccgc

SEQ ID NO: 3577914 - RNA, 17 nt, Pseudomonas putida KT2440
cagguaauccagcucgu

SEQ ID NO: 3577915 - RNA, 15 nt, Pseudomonas putida KT2440
cagguacaccgccuc

SEQ ID NO: 3577916 - RNA, 19 nt, Pseudomonas putida KT2440
cagguacacgggcaugcca

SEQ ID NO: 3577917 - RNA, 14 nt, Pseudomonas putida KT2440
cagguacagcagcu

SEQ ID NO: 3577918 - RNA, 16 nt, Pseudomonas putida KT2440
cagguacaggcaaaga

SEQ ID NO: 3577919 - RNA, 14 nt, Pseudomonas putida KT2440
cagguacaguuccc

SEQ ID NO: 3577920 - RNA, 20 nt, Pseudomonas putida KT2440
cagguacaguucccggugcu

SEQ ID NO: 3577921 - RNA, 13 nt, Pseudomonas putida KT2440
cagguacauguug

SEQ ID NO: 3577922 - RNA, 23 nt, Pseudomonas putida KT2440
cagguaccaggcugccacggcgg

SEQ ID NO: 3577923 - RNA, 21 nt, Pseudomonas putida KT2440
cagguacgaaaaggccugcac

SEQ ID NO: 3577924 - RNA, 15 nt, Pseudomonas putida KT2440
cagguacgaagccau

SEQ ID NO: 3577925 - RNA, 20 nt, Pseudomonas putida KT2440
cagguacucgcccgccaggu

SEQ ID NO: 3577926 - RNA, 18 nt, Pseudomonas putida KT2440
cagguacucgccgggcgu

SEQ ID NO: 3577927 - RNA, 21 nt, Pseudomonas putida KT2440
cagguacucugucacccgcug

SEQ ID NO: 3577928 - RNA, 20 nt, Pseudomonas putida KT2440
cagguagaucugcucuucgc

SEQ ID NO: 3577929 - RNA, 15 nt, Pseudomonas putida KT2440
cagguagccuuccag

SEQ ID NO: 3577930 - RNA, 22 nt, Pseudomonas putida KT2440
cagguagccuuccagcuccuuc

SEQ ID NO: 3577931 - RNA, 15 nt, Pseudomonas putida KT2440
cagguagcgauugcg

SEQ ID NO: 3577932 - RNA, 18 nt, Pseudomonas putida KT2440
cagguagcgcccgggcau

SEQ ID NO: 3577933 - RNA, 19 nt, Pseudomonas putida KT2440
cagguagcgcccgggcauc

SEQ ID NO: 3577934 - RNA, 18 nt, Pseudomonas putida KT2440
cagguagcucgacgccgu

SEQ ID NO: 3577935 - RNA, 13 nt, Pseudomonas putida KT2440
cagguagcugggc

SEQ ID NO: 3577936 - RNA, 16 nt, Pseudomonas putida KT2440
cagguaggccgcagcc

SEQ ID NO: 3577937 - RNA, 18 nt, Pseudomonas putida KT2440
cagguaggccgcagccau

SEQ ID NO: 3577938 - RNA, 20 nt, Pseudomonas putida KT2440
cugcacgucgcgcagggccu

SEQ ID NO: 3577939 - RNA, 17 nt, Pseudomonas putida KT2440
cugcacgucgcugucuu

SEQ ID NO: 3577940 - RNA, 18 nt, Pseudomonas putida KT2440
cugcacgucgcugucuuc

SEQ ID NO: 3577941 - RNA, 13 nt, Pseudomonas putida KT2440
cugcacugcaaca

SEQ ID NO: 3577942 - RNA, 23 nt, Pseudomonas putida KT2440
cugcacugcaacaccggucaggu

SEQ ID NO: 3577943 - RNA, 12 nt, Pseudomonas putida KT2440
cugcacugccag

SEQ ID NO: 3577944 - RNA, 17 nt, Pseudomonas putida KT2440
cugcacugccagcgccu

SEQ ID NO: 3577945 - RNA, 16 nt, Pseudomonas putida KT2440
cugcacuggcaugcgg

SEQ ID NO: 3577946 - RNA, 12 nt, Pseudomonas putida KT2440
cugcacuuccac

SEQ ID NO: 3577947 - RNA, 15 nt, Pseudomonas putida KT2440
cugcacuuccacacc

SEQ ID NO: 3577948 - RNA, 16 nt, Pseudomonas putida KT2440
cugcacuuccacaccc

SEQ ID NO: 3577949 - RNA, 16 nt, Pseudomonas putida KT2440
cugcagacagugguca

SEQ ID NO: 3577950 - RNA, 15 nt, Pseudomonas putida KT2440
cugcagacgccguca

SEQ ID NO: 3577951 - RNA, 20 nt, Pseudomonas putida KT2440
cugcagagcucagcgugacg

SEQ ID NO: 3577952 - RNA, 16 nt, Pseudomonas putida KT2440
cugcagaucaccagcu

SEQ ID NO: 3577953 - RNA, 21 nt, Pseudomonas putida KT2440
cugcagaucaccagcucgccc

SEQ ID NO: 3577954 - RNA, 19 nt, Pseudomonas putida KT2440
cugcagauugcaucacuga

SEQ ID NO: 3577955 - RNA, 15 nt, Pseudomonas putida KT2440
cugcagcacugccug

SEQ ID NO: 3577956 - RNA, 15 nt, Pseudomonas putida KT2440
cugcagcagcgcgcc

SEQ ID NO: 3577957 - RNA, 20 nt, Pseudomonas putida KT2440
cugcagcagcuuccugugcc

SEQ ID NO: 3577958 - RNA, 14 nt, Pseudomonas putida KT2440
cugcagcaggccgc

SEQ ID NO: 3577959 - RNA, 15 nt, Pseudomonas putida KT2440
cugcagcaggcuggc

SEQ ID NO: 3577960 - RNA, 16 nt, Pseudomonas putida KT2440
cugcagccauucaucc

SEQ ID NO: 3577961 - RNA, 23 nt, Pseudomonas putida KT2440
cugcagccauucauccucggccu

SEQ ID NO: 3577962 - RNA, 22 nt, Pseudomonas putida KT2440
cugcagccgcaccugcccgccc

SEQ ID NO: 3577963 - RNA, 21 nt, Pseudomonas putida KT2440
cugcagccugacgcgccgcca

SEQ ID NO: 3577964 - RNA, 20 nt, Pseudomonas putida KT2440
cugcagcgcgucauccgcca

SEQ ID NO: 3577965 - RNA, 22 nt, Pseudomonas putida KT2440
cugcagcggcaagguagccugc

SEQ ID NO: 3577966 - RNA, 23 nt, Pseudomonas putida KT2440
cugcagcucgaaaaucucguuca

SEQ ID NO: 3577967 - RNA, 21 nt, Pseudomonas putida KT2440
cugcagcuucagguucugccg

SEQ ID NO: 3577968 - RNA, 17 nt, Pseudomonas putida KT2440
cugcagcuucccggccu

SEQ ID NO: 3577969 - RNA, 21 nt, Pseudomonas putida KT2440
cugcagcuucccggccuggcg

SEQ ID NO: 3577970 - RNA, 17 nt, Pseudomonas putida KT2440
cugcagcuuuugcgcag

SEQ ID NO: 3577971 - RNA, 18 nt, Pseudomonas putida KT2440
cugcagcuuuugcgcagc

SEQ ID NO: 3577972 - RNA, 18 nt, Pseudomonas putida KT2440
cugcaggaaccuccguug

SEQ ID NO: 3577973 - RNA, 22 nt, Pseudomonas putida KT2440
cugcaggaacuccugcugcagc

SEQ ID NO: 3577974 - RNA, 16 nt, Pseudomonas putida KT2440
cugcaggagcgggcac

SEQ ID NO: 3577975 - RNA, 15 nt, Pseudomonas putida KT2440
cugcaggagcggguu

SEQ ID NO: 3577976 - RNA, 13 nt, Pseudomonas putida KT2440
cugcaggcagcau

SEQ ID NO: 3577977 - RNA, 20 nt, Pseudomonas putida KT2440
cugcaggcgcggugccggca

SEQ ID NO: 3577978 - RNA, 13 nt, Pseudomonas putida KT2440
cugcaggcucuga

SEQ ID NO: 3577979 - RNA, 17 nt, Pseudomonas putida KT2440
cugcaggcucugaaugu

SEQ ID NO: 3577980 - RNA, 18 nt, Pseudomonas putida KT2440
cugcagggacugucggcu

SEQ ID NO: 3577981 - RNA, 13 nt, Pseudomonas putida KT2440
cugcagggcacgc

SEQ ID NO: 3577982 - RNA, 19 nt, Pseudomonas putida KT2440
cugcagggcccagccaccg

SEQ ID NO: 3577983 - RNA, 23 nt, Pseudomonas putida KT2440
cugcagggcccagccaccgacga

SEQ ID NO: 3577984 - RNA, 14 nt, Pseudomonas putida KT2440
cugcagggccucca

SEQ ID NO: 3577985 - RNA, 22 nt, Pseudomonas putida KT2440
cugcagggcgagcacacccggc

SEQ ID NO: 3577986 - RNA, 15 nt, Pseudomonas putida KT2440
cugcaggggugggau

SEQ ID NO: 3577987 - RNA, 17 nt, Pseudomonas putida KT2440
cugcagggucaggcgga

SEQ ID NO: 3577988 - RNA, 12 nt, Pseudomonas putida KT2440
cugcaggguucg

SEQ ID NO: 3577989 - RNA, 18 nt, Pseudomonas putida KT2440
cugcagguaaugcgccgc

SEQ ID NO: 3577990 - RNA, 17 nt, Pseudomonas putida KT2440
cugcagguacagcagcu

SEQ ID NO: 3577991 - RNA, 20 nt, Pseudomonas putida KT2440
cugcagguaguuuuccagcc

SEQ ID NO: 3577992 - RNA, 19 nt, Pseudomonas putida KT2440
cugcaggucggccagcucg

SEQ ID NO: 3577993 - RNA, 21 nt, Pseudomonas putida KT2440
cugcagguggugguccccuuc

SEQ ID NO: 3577994 - RNA, 22 nt, Pseudomonas putida KT2440
cugcagguucugaaucuggcuc

SEQ ID NO: 3577995 - RNA, 21 nt, Pseudomonas putida KT2440
cugcagguugaaacguagcag

SEQ ID NO: 3577996 - RNA, 21 nt, Pseudomonas putida KT2440
cugcaguagccgaacgcaaga

SEQ ID NO: 3577997 - RNA, 22 nt, Pseudomonas putida KT2440
cugcagucagguugcacagcau

SEQ ID NO: 3577998 - RNA, 17 nt, Pseudomonas putida KT2440
cugcagugccucgacca

SEQ ID NO: 3577999 - RNA, 21 nt, Pseudomonas putida KT2440
cugcaguucagggcgugguga

SEQ ID NO: 3578000 - RNA, 18 nt, Pseudomonas putida KT2440
cugcaguucgcugcgcaa

SEQ ID NO: 3578001 - RNA, 13 nt, Pseudomonas putida KT2440
cugcauaggcgcu

SEQ ID NO: 3578002 - RNA, 16 nt, Pseudomonas putida KT2440
cugcauaugcagggcc

SEQ ID NO: 3578003 - RNA, 13 nt, Pseudomonas putida KT2440
cugcauaugggcg

SEQ ID NO: 3578004 - RNA, 16 nt, Pseudomonas putida KT2440
cugcauccacaccagc

SEQ ID NO: 3578005 - RNA, 18 nt, Pseudomonas putida KT2440
cugcaucgcugauccgcu

SEQ ID NO: 3578006 - RNA, 21 nt, Pseudomonas putida KT2440
cugcaugccaguagaagccca

SEQ ID NO: 3578007 - RNA, 21 nt, Pseudomonas putida KT2440
cugcauggcauaggcugucac

SEQ ID NO: 3578008 - RNA, 12 nt, Pseudomonas putida KT2440
cugcauggccug

SEQ ID NO: 3578009 - RNA, 14 nt, Pseudomonas putida KT2440
cugcauguccagcc

SEQ ID NO: 3578010 - RNA, 15 nt, Pseudomonas putida KT2440
cugcaugucggcagu

SEQ ID NO: 3578011 - RNA, 17 nt, Pseudomonas putida KT2440
cugcaugucggcagucu

SEQ ID NO: 3578012 - RNA, 16 nt, Pseudomonas putida KT2440
cugcauugcagcccca

SEQ ID NO: 3578013 - RNA, 20 nt, Pseudomonas putida KT2440
cugcauuggcggcaggcgca

SEQ ID NO: 3578014 - RNA, 18 nt, Pseudomonas putida KT2440
cugcauugucauugccca

SEQ ID NO: 3578015 - RNA, 16 nt, Pseudomonas putida KT2440
cugccaaaccgcccca

SEQ ID NO: 3578016 - RNA, 22 nt, Pseudomonas putida KT2440
cugccaaaucccuuugcccgcc

SEQ ID NO: 3578017 - RNA, 14 nt, Pseudomonas putida KT2440
cugccaacgcaccg

SEQ ID NO: 3578018 - RNA, 17 nt, Pseudomonas putida KT2440
cugccaacgcaccgacc

SEQ ID NO: 3578019 - RNA, 19 nt, Pseudomonas putida KT2440
cugccaacgcaccgaccac

SEQ ID NO: 3578020 - RNA, 19 nt, Pseudomonas putida KT2440
cugccaacgggauaccggu

SEQ ID NO: 3578021 - RNA, 20 nt, Pseudomonas putida KT2440
cugccaaucgaucacuucca

SEQ ID NO: 3578022 - RNA, 22 nt, Pseudomonas putida KT2440
cugccaaucgaucacuuccagg

SEQ ID NO: 3578023 - RNA, 16 nt, Pseudomonas putida KT2440
cugccacacacccggg

SEQ ID NO: 3578024 - RNA, 22 nt, Pseudomonas putida KT2440
cugccacagguacugcgcaauc

SEQ ID NO: 3578025 - RNA, 23 nt, Pseudomonas putida KT2440
cugccacccauucccacaucaaa

SEQ ID NO: 3578026 - RNA, 22 nt, Pseudomonas putida KT2440
cugccaccccgcaaagcccugc

SEQ ID NO: 3578027 - RNA, 12 nt, Pseudomonas putida KT2440
cugccacccucc

SEQ ID NO: 3578028 - RNA, 14 nt, Pseudomonas putida KT2440
cugccaccgugagc

SEQ ID NO: 3578029 - RNA, 23 nt, Pseudomonas putida KT2440
cugccaccuuccaggucgaucgc

SEQ ID NO: 3578030 - RNA, 17 nt, Pseudomonas putida KT2440
cugccacgauggucacc

SEQ ID NO: 3578031 - RNA, 16 nt, Pseudomonas putida KT2440
cugccacgcccgcugc

SEQ ID NO: 3578032 - RNA, 24 nt, Pseudomonas putida KT2440
cugccacuggucgccucgacgcag

SEQ ID NO: 3578033 - RNA, 14 nt, Pseudomonas putida KT2440
cugccagcaccagc

SEQ ID NO: 3578034 - RNA, 18 nt, Pseudomonas putida KT2440
cugccagcaccuggcggc

SEQ ID NO: 3578035 - RNA, 14 nt, Pseudomonas putida KT2440
cugccagccccgca

SEQ ID NO: 3578036 - RNA, 15 nt, Pseudomonas putida KT2440
cugccagccccgcac

SEQ ID NO: 3578037 - RNA, 21 nt, Pseudomonas putida KT2440
cugccagcgccucaccgaccc

SEQ ID NO: 3578038 - RNA, 19 nt, Pseudomonas putida KT2440
cugccagcgcgcugcgcaa

SEQ ID NO: 3578039 - RNA, 18 nt, Pseudomonas putida KT2440
cugccagcguuuccgggu

SEQ ID NO: 3578040 - RNA, 15 nt, Pseudomonas putida KT2440
cugccagcuccuggc

SEQ ID NO: 3578041 - RNA, 13 nt, Pseudomonas putida KT2440
cugccagcugcgc

SEQ ID NO: 3578042 - RNA, 19 nt, Pseudomonas putida KT2440
cugccagcugcgcugccug

SEQ ID NO: 3578043 - RNA, 20 nt, Pseudomonas putida KT2440
cugccagcugcgcugccugc

SEQ ID NO: 3578044 - RNA, 14 nt, Pseudomonas putida KT2440
cugccaggcaaagu

SEQ ID NO: 3578045 - RNA, 23 nt, Pseudomonas putida KT2440
cugccaggcaaaguugagcgccg

SEQ ID NO: 3578046 - RNA, 15 nt, Pseudomonas putida KT2440
cugccaggccaaaca

SEQ ID NO: 3578047 - RNA, 14 nt, Pseudomonas putida KT2440
cugccaggccucaa

SEQ ID NO: 3578048 - RNA, 20 nt, Pseudomonas putida KT2440
cugccaggccucaagccucg

SEQ ID NO: 3578049 - RNA, 18 nt, Pseudomonas putida KT2440
cugccaggcuggcgcuac

SEQ ID NO: 3578050 - RNA, 15 nt, Pseudomonas putida KT2440
cugccaggucaccgc

SEQ ID NO: 3578051 - RNA, 17 nt, Pseudomonas putida KT2440
cugccaguaaggcuugc

SEQ ID NO: 3578052 - RNA, 21 nt, Pseudomonas putida KT2440
cugccaguaaggcuugcucaa

SEQ ID NO: 3578053 - RNA, 20 nt, Pseudomonas putida KT2440
cugccagucgcacaggucca

SEQ ID NO: 3578054 - RNA, 19 nt, Pseudomonas putida KT2440
cugccagugggcacgguug

SEQ ID NO: 3578055 - RNA, 17 nt, Pseudomonas putida KT2440
cugccaguucaugcagc

SEQ ID NO: 3578056 - RNA, 17 nt, Pseudomonas putida KT2440
cugccaguugcuucugc

SEQ ID NO: 3578057 - RNA, 15 nt, Pseudomonas putida KT2440
cugccauaagcccaa

SEQ ID NO: 3578058 - RNA, 20 nt, Pseudomonas putida KT2440
cugccauagcgcugcaccga

SEQ ID NO: 3578059 - RNA, 13 nt, Pseudomonas putida KT2440
cugccaucuccaa

SEQ ID NO: 3578060 - RNA, 18 nt, Pseudomonas putida KT2440
cugccaucucgccaagca

SEQ ID NO: 3578061 - RNA, 16 nt, Pseudomonas putida KT2440
cugccaugcaaggcaa

SEQ ID NO: 3578062 - RNA, 15 nt, Pseudomonas putida KT2440
cugccaugcaggucg

SEQ ID NO: 3578063 - RNA, 16 nt, Pseudomonas putida KT2440
cugccaugcaggucga

SEQ ID NO: 3578064 - RNA, 13 nt, Pseudomonas putida KT2440
cugccaugcgcug

SEQ ID NO: 3578065 - RNA, 16 nt, Pseudomonas putida KT2440
cugccauuucuucagc

SEQ ID NO: 3578066 - RNA, 20 nt, Pseudomonas putida KT2440
cugcccaaguacaccggcag

SEQ ID NO: 3578067 - RNA, 21 nt, Pseudomonas putida KT2440
cugcccaaguacaccggcagc

SEQ ID NO: 3578068 - RNA, 14 nt, Pseudomonas putida KT2440
cugcccacauagcg

SEQ ID NO: 3578069 - RNA, 22 nt, Pseudomonas putida KT2440
cugcccaccgaucacggggcga

SEQ ID NO: 3578070 - RNA, 20 nt, Pseudomonas putida KT2440
cugcccagcugaagugccaa

SEQ ID NO: 3578071 - RNA, 21 nt, Pseudomonas putida KT2440
cugcccaggaucacuggccug

SEQ ID NO: 3578072 - RNA, 14 nt, Pseudomonas putida KT2440
cugcccaggugcca

SEQ ID NO: 3578073 - RNA, 15 nt, Pseudomonas putida KT2440
cugcccaggugccag

SEQ ID NO: 3578074 - RNA, 18 nt, Pseudomonas putida KT2440
cugcccauaaaagccuca

SEQ ID NO: 3578075 - RNA, 20 nt, Pseudomonas putida KT2440
cugcccauaaaagccucagc

SEQ ID NO: 3578076 - RNA, 23 nt, Pseudomonas putida KT2440
cugcccauaaaagccucagcgcc

SEQ ID NO: 3578077 - RNA, 22 nt, Pseudomonas putida KT2440
cugccccaacugcauccgcccc

SEQ ID NO: 3578078 - RNA, 21 nt, Pseudomonas putida KT2440
cugcccccaaugggcaccggc

SEQ ID NO: 3578079 - RNA, 13 nt, Pseudomonas putida KT2440
cugccccucgauc

SEQ ID NO: 3578080 - RNA, 14 nt, Pseudomonas putida KT2440
cugccccucgauca

SEQ ID NO: 3578081 - RNA, 13 nt, Pseudomonas putida KT2440
cugccccuggccc

SEQ ID NO: 3578082 - RNA, 14 nt, Pseudomonas putida KT2440
cugccccuggccca

SEQ ID NO: 3578083 - RNA, 20 nt, Pseudomonas putida KT2440
cugcccgaucgccucgcugg

SEQ ID NO: 3578084 - RNA, 23 nt, Pseudomonas putida KT2440
cugcccgaucgccucgcuggcgg

SEQ ID NO: 3578085 - RNA, 11 nt, Pseudomonas putida KT2440
cugcccgcagc

SEQ ID NO: 3578086 - RNA, 19 nt, Pseudomonas putida KT2440
cugcccgccccccaccugg

SEQ ID NO: 3578087 - RNA, 21 nt, Pseudomonas putida KT2440
cugcccgccccccaccuggcc

SEQ ID NO: 3578088 - RNA, 15 nt, Pseudomonas putida KT2440
cugcccgcccucacu

SEQ ID NO: 3578089 - RNA, 17 nt, Pseudomonas putida KT2440
cugcccgccguccagca

SEQ ID NO: 3578090 - RNA, 24 nt, Pseudomonas putida KT2440
cugcccgcgccacccgcugggcuu

SEQ ID NO: 3578091 - RNA, 18 nt, Pseudomonas putida KT2440
cugcccgcgccuugcgca

SEQ ID NO: 3578092 - RNA, 19 nt, Pseudomonas putida KT2440
cugcccgcgccuugcgcac

SEQ ID NO: 3578093 - RNA, 19 nt, Pseudomonas putida KT2440
cugcccgcgugcgcccaga

SEQ ID NO: 3578094 - RNA, 16 nt, Pseudomonas putida KT2440
cugcccggccagcagg

SEQ ID NO: 3578095 - RNA, 16 nt, Pseudomonas putida KT2440
cugcccggcguucagg

SEQ ID NO: 3578096 - RNA, 13 nt, Pseudomonas putida KT2440
cugcccggcugga

SEQ ID NO: 3578097 - RNA, 21 nt, Pseudomonas putida KT2440
cugcccgggaacggcugccgu

SEQ ID NO: 3578098 - RNA, 20 nt, Pseudomonas putida KT2440
cugcccgggccgcuugcuca

SEQ ID NO: 3578099 - RNA, 21 nt, Pseudomonas putida KT2440
cugcccguccggcaugcgccg

SEQ ID NO: 3578100 - RNA, 22 nt, Pseudomonas putida KT2440
cugcccguugaggguggcaaug

SEQ ID NO: 3578101 - RNA, 17 nt, Pseudomonas putida KT2440
cugcccguugcgcauca

SEQ ID NO: 3578102 - RNA, 21 nt, Pseudomonas putida KT2440
cugcccguugcgcaucaccuc

SEQ ID NO: 3578103 - RNA, 17 nt, Pseudomonas putida KT2440
cugcccucgacaaucgc

SEQ ID NO: 3578104 - RNA, 19 nt, Pseudomonas putida KT2440
cugcccucgacaaucgcca

SEQ ID NO: 3578105 - RNA, 22 nt, Pseudomonas putida KT2440
cugcccucgacaaucgccaggu

SEQ ID NO: 3578106 - RNA, 18 nt, Pseudomonas putida KT2440
cugcccucggccggggcc

SEQ ID NO: 3578107 - RNA, 19 nt, Pseudomonas putida KT2440
cugcccucggccggggcca

SEQ ID NO: 3578108 - RNA, 22 nt, Pseudomonas putida KT2440
cugcccucggccggggccaggc

SEQ ID NO: 3578109 - RNA, 13 nt, Pseudomonas putida KT2440
cugcccugcaugg

SEQ ID NO: 3578110 - RNA, 18 nt, Pseudomonas putida KT2440
cugccgaagaacgcgagc

SEQ ID NO: 3578111 - RNA, 23 nt, Pseudomonas putida KT2440
cugccgacaaacguaccagccgc

SEQ ID NO: 3578112 - RNA, 17 nt, Pseudomonas putida KT2440
cugccgacaggccguga

SEQ ID NO: 3578113 - RNA, 16 nt, Pseudomonas putida KT2440
cugccgaccugcgccg

SEQ ID NO: 3578114 - RNA, 17 nt, Pseudomonas putida KT2440
cugccgaccugcgccgg

SEQ ID NO: 3578115 - RNA, 14 nt, Pseudomonas putida KT2440
cugccgagaggauc

SEQ ID NO: 3578116 - RNA, 18 nt, Pseudomonas putida KT2440
cugccgagaggaucaccg

SEQ ID NO: 3578117 - RNA, 15 nt, Pseudomonas putida KT2440
cugccgaucagcacg

SEQ ID NO: 3578118 - RNA, 13 nt, Pseudomonas putida KT2440
cugccgaugcgcg

SEQ ID NO: 3578119 - RNA, 22 nt, Pseudomonas putida KT2440
cugccgaugggcacuggccacc

SEQ ID NO: 3578120 - RNA, 15 nt, Pseudomonas putida KT2440
cugccgcaccugccu

SEQ ID NO: 3578121 - RNA, 14 nt, Pseudomonas putida KT2440
cugccgcagcgauc

SEQ ID NO: 3578122 - RNA, 19 nt, Pseudomonas putida KT2440
cugccgccaaccagcucac

SEQ ID NO: 3578123 - RNA, 16 nt, Pseudomonas putida KT2440
cugccgccccuccacc

SEQ ID NO: 3578124 - RNA, 17 nt, Pseudomonas putida KT2440
cugccgccccuccaccc

SEQ ID NO: 3578125 - RNA, 21 nt, Pseudomonas putida KT2440
cugccgccgaacauggugcuu

SEQ ID NO: 3578126 - RNA, 20 nt, Pseudomonas putida KT2440
cugccgccgcagcaaucugc

SEQ ID NO: 3578127 - RNA, 22 nt, Pseudomonas putida KT2440
cugccgccgguguaccauccag

SEQ ID NO: 3578128 - RNA, 12 nt, Pseudomonas putida KT2440
cugccgccugug

SEQ ID NO: 3578129 - RNA, 15 nt, Pseudomonas putida KT2440
cugccgccuucucca

SEQ ID NO: 3578130 - RNA, 18 nt, Pseudomonas putida KT2440
cugccgccuucuccagcu

SEQ ID NO: 3578131 - RNA, 20 nt, Pseudomonas putida KT2440
cugccgccuucuccagcucg

SEQ ID NO: 3578132 - RNA, 23 nt, Pseudomonas putida KT2440
cugccgccuucuccagcucgcca

SEQ ID NO: 3578133 - RNA, 23 nt, Pseudomonas putida KT2440
cugccgccuuggcagccucgucc

SEQ ID NO: 3578134 - RNA, 24 nt, Pseudomonas putida KT2440
cugccgcggaaauaccagacgcag

SEQ ID NO: 3578135 - RNA, 14 nt, Pseudomonas putida KT2440
cugccgcucaucga

SEQ ID NO: 3578136 - RNA, 13 nt, Pseudomonas putida KT2440
cugccgcugacca

SEQ ID NO: 3578137 - RNA, 16 nt, Pseudomonas putida KT2440
cugccgcugaccuggg

SEQ ID NO: 3578138 - RNA, 18 nt, Pseudomonas putida KT2440
cugccgcugaccuggguc

SEQ ID NO: 3578139 - RNA, 13 nt, Pseudomonas putida KT2440
cugccgcuucgcg

SEQ ID NO: 3578140 - RNA, 20 nt, Pseudomonas putida KT2440
cugccggaacguuuccagca

SEQ ID NO: 3578141 - RNA, 18 nt, Pseudomonas putida KT2440
cugccggaccugccgcag

SEQ ID NO: 3578142 - RNA, 23 nt, Pseudomonas putida KT2440
cugccggcaaacagacggugcgc

SEQ ID NO: 3578143 - RNA, 23 nt, Pseudomonas putida KT2440
cugccggcagggcuuucuucucu

SEQ ID NO: 3578144 - RNA, 23 nt, Pseudomonas putida KT2440
cugccggcauaacggcuggcgca

SEQ ID NO: 3578145 - RNA, 16 nt, Pseudomonas putida KT2440
cugccggccagcgccu

SEQ ID NO: 3578146 - RNA, 19 nt, Pseudomonas putida KT2440
cugccggccuguugcgcac

SEQ ID NO: 3578147 - RNA, 17 nt, Pseudomonas putida KT2440
cugccgggcaucgauca

SEQ ID NO: 3578148 - RNA, 17 nt, Pseudomonas putida KT2440
cugccgggccaccaccg

SEQ ID NO: 3578149 - RNA, 18 nt, Pseudomonas putida KT2440
cugccgggccaccaccgc

SEQ ID NO: 3578150 - RNA, 13 nt, Pseudomonas putida KT2440
cugccgggccagg

SEQ ID NO: 3578151 - RNA, 17 nt, Pseudomonas putida KT2440
cugccgggccgggcacg

SEQ ID NO: 3578152 - RNA, 18 nt, Pseudomonas putida KT2440
cugccggggcaugcgcag

SEQ ID NO: 3578153 - RNA, 15 nt, Pseudomonas putida KT2440
cugccgggucggccu

SEQ ID NO: 3578154 - RNA, 22 nt, Pseudomonas putida KT2440
cugccgggucggccugcucgcu

SEQ ID NO: 3578155 - RNA, 15 nt, Pseudomonas putida KT2440
cugccgguacagccu

SEQ ID NO: 3578156 - RNA, 16 nt, Pseudomonas putida KT2440
cugccgguacagccua

SEQ ID NO: 3578157 - RNA, 19 nt, Pseudomonas putida KT2440
cugccgguaccacugcuuc

SEQ ID NO: 3578158 - RNA, 17 nt, Pseudomonas putida KT2440
cugccggucggccugca

SEQ ID NO: 3578159 - RNA, 18 nt, Pseudomonas putida KT2440
cugccggucggccugcac

SEQ ID NO: 3578160 - RNA, 20 nt, Pseudomonas putida KT2440
cugccggucggccugcacua

SEQ ID NO: 3578161 - RNA, 22 nt, Pseudomonas putida KT2440
cugccggucguagcgucucagu

SEQ ID NO: 3578162 - RNA, 23 nt, Pseudomonas putida KT2440
cugccggugcgcgggcgucgguc

SEQ ID NO: 3578163 - RNA, 18 nt, Pseudomonas putida KT2440
cugccgguguucgcgggu

SEQ ID NO: 3578164 - RNA, 14 nt, Pseudomonas putida KT2440
cugccguccccaac

SEQ ID NO: 3578165 - RNA, 14 nt, Pseudomonas putida KT2440
cugccgucucguca

SEQ ID NO: 3578166 - RNA, 18 nt, Pseudomonas putida KT2440
cugccgucucgucacugg

SEQ ID NO: 3578167 - RNA, 15 nt, Pseudomonas putida KT2440
cugccgugcagguca

SEQ ID NO: 3578168 - RNA, 19 nt, Pseudomonas putida KT2440
cugccgugcaggucagcgu

SEQ ID NO: 3578169 - RNA, 14 nt, Pseudomonas putida KT2440
cugccguuggcccg

SEQ ID NO: 3578170 - RNA, 22 nt, Pseudomonas putida KT2440
cugccguuuauugguuugacgc

SEQ ID NO: 3578171 - RNA, 14 nt, Pseudomonas putida KT2440
cugccuaccaccgc

SEQ ID NO: 3578172 - RNA, 18 nt, Pseudomonas putida KT2440
cugccuacccaggcaacg

SEQ ID NO: 3578173 - RNA, 17 nt, Pseudomonas putida KT2440
cugccugauugccuggc

SEQ ID NO: 3578174 - RNA, 18 nt, Pseudomonas putida KT2440
cugccugauugccuggcu

SEQ ID NO: 3578175 - RNA, 16 nt, Pseudomonas putida KT2440
cugccugcaggcugcc

SEQ ID NO: 3578176 - RNA, 17 nt, Pseudomonas putida KT2440
cugccugcaggcugccg

SEQ ID NO: 3578177 - RNA, 22 nt, Pseudomonas putida KT2440
cugccugcgcugugccgauaga

SEQ ID NO: 3578178 - RNA, 12 nt, Pseudomonas putida KT2440
cugccugcgcuu

SEQ ID NO: 3578179 - RNA, 12 nt, Pseudomonas putida KT2440
cugccugcugca

SEQ ID NO: 3578180 - RNA, 14 nt, Pseudomonas putida KT2440
cugccugcugcaac

SEQ ID NO: 3578181 - RNA, 15 nt, Pseudomonas putida KT2440
cugccugcugcagcu

SEQ ID NO: 3578182 - RNA, 14 nt, Pseudomonas putida KT2440
cugccuggccacug

SEQ ID NO: 3578183 - RNA, 13 nt, Pseudomonas putida KT2440
cugccuggcccuc

SEQ ID NO: 3578184 - RNA, 15 nt, Pseudomonas putida KT2440
cugccugggcaccaa

SEQ ID NO: 3578185 - RNA, 20 nt, Pseudomonas putida KT2440
cugccugggccgguccuuuc

SEQ ID NO: 3578186 - RNA, 20 nt, Pseudomonas putida KT2440
cugccugugccggccucuuc

SEQ ID NO: 3578187 - RNA, 16 nt, Pseudomonas putida KT2440
cugccuuagaacagau

SEQ ID NO: 3578188 - RNA, 22 nt, Pseudomonas putida KT2440
cugccuuagaacagauccaucg

SEQ ID NO: 3578189 - RNA, 23 nt, Pseudomonas putida KT2440
cugccuuccaaccagccagccac

SEQ ID NO: 3578190 - RNA, 12 nt, Pseudomonas putida KT2440
cugccuugcagc

SEQ ID NO: 3578191 - RNA, 14 nt, Pseudomonas putida KT2440
cugccuugcccagc

SEQ ID NO: 3578192 - RNA, 14 nt, Pseudomonas putida KT2440
cugccuugcccugc

SEQ ID NO: 3578193 - RNA, 16 nt, Pseudomonas putida KT2440
cugccuugcccugcag

SEQ ID NO: 3578194 - RNA, 19 nt, Pseudomonas putida KT2440
cugccuuuggccgccagcg

SEQ ID NO: 3578195 - RNA, 18 nt, Pseudomonas putida KT2440
cugccuuuuccugcugca

SEQ ID NO: 3578196 - RNA, 19 nt, Pseudomonas putida KT2440
cugccuuuuccugcugcaa

SEQ ID NO: 3578197 - RNA, 22 nt, Pseudomonas putida KT2440
cugcgaaacgaaacccugcugg

SEQ ID NO: 3578198 - RNA, 23 nt, Pseudomonas putida KT2440
cugcgaaacgaaacccugcuggg

SEQ ID NO: 3578199 - RNA, 12 nt, Pseudomonas putida KT2440
cugcgaaccugu

SEQ ID NO: 3578200 - RNA, 18 nt, Pseudomonas putida KT2440
cugcgaagcccaguucgc

SEQ ID NO: 3578201 - RNA, 20 nt, Pseudomonas putida KT2440
cugcgaauggguggcggcaa

SEQ ID NO: 3578202 - RNA, 21 nt, Pseudomonas putida KT2440
cugcgaauggguggcggcaau

SEQ ID NO: 3578203 - RNA, 21 nt, Pseudomonas putida KT2440
cugcgacacgcgaaucgccag

SEQ ID NO: 3578204 - RNA, 16 nt, Pseudomonas putida KT2440
cugcgaccacacugcu

SEQ ID NO: 3578205 - RNA, 17 nt, Pseudomonas putida KT2440
cugcgacgaacucaacg

SEQ ID NO: 3578206 - RNA, 15 nt, Pseudomonas putida KT2440
cugcgaggaucagcg

SEQ ID NO: 3578207 - RNA, 16 nt, Pseudomonas putida KT2440
cugcgaggaucagcgc

SEQ ID NO: 3578208 - RNA, 13 nt, Pseudomonas putida KT2440
cugcgaguucagg

SEQ ID NO: 3578209 - RNA, 19 nt, Pseudomonas putida KT2440
cugcgauagaacuccacca

SEQ ID NO: 3578210 - RNA, 22 nt, Pseudomonas putida KT2440
cugcgaugaacucgucacccuc

SEQ ID NO: 3578211 - RNA, 23 nt, Pseudomonas putida KT2440
cugcgauuuaugcuugcgggccc

SEQ ID NO: 3578212 - RNA, 24 nt, Pseudomonas putida KT2440
cugcgcaaggcauucagcucggcc

SEQ ID NO: 3578213 - RNA, 12 nt, Pseudomonas putida KT2440
cugcgcacggaa

SEQ ID NO: 3578214 - RNA, 16 nt, Pseudomonas putida KT2440
cugcgcagccccaaaa

SEQ ID NO: 3578215 - RNA, 16 nt, Pseudomonas putida KT2440
cugcgcagcccuccca

SEQ ID NO: 3578216 - RNA, 21 nt, Pseudomonas putida KT2440
cugcgcagguauagggcuacg

SEQ ID NO: 3578217 - RNA, 15 nt, Pseudomonas putida KT2440
cugcgcaguacaggc

SEQ ID NO: 3578218 - RNA, 22 nt, Pseudomonas putida KT2440
cugcgcaguacaggcugccgcc

SEQ ID NO: 3578219 - RNA, 14 nt, Pseudomonas putida KT2440
cugcgcaucacccg

SEQ ID NO: 3578220 - RNA, 16 nt, Pseudomonas putida KT2440
cugcgcaucacccgcc

SEQ ID NO: 3578221 - RNA, 19 nt, Pseudomonas putida KT2440
cugcgcaucacccgccccu

SEQ ID NO: 3578222 - RNA, 18 nt, Pseudomonas putida KT2440
cugcgcaugaaacucgcg

SEQ ID NO: 3578223 - RNA, 21 nt, Pseudomonas putida KT2440
cugcgcaugaaacucgcgcgc

SEQ ID NO: 3578224 - RNA, 22 nt, Pseudomonas putida KT2440
cugcgcaugaaacucgcgcgcg

SEQ ID NO: 3578225 - RNA, 14 nt, Pseudomonas putida KT2440
cugcgccaaagcga

SEQ ID NO: 3578226 - RNA, 15 nt, Pseudomonas putida KT2440
cugcgccaccggccu

SEQ ID NO: 3578227 - RNA, 21 nt, Pseudomonas putida KT2440
cugcgccagcaguuucagcgg

SEQ ID NO: 3578228 - RNA, 17 nt, Pseudomonas putida KT2440
cugcgccagccgcgggu

SEQ ID NO: 3578229 - RNA, 15 nt, Pseudomonas putida KT2440
cugcgccagcgggug

SEQ ID NO: 3578230 - RNA, 18 nt, Pseudomonas putida KT2440
cugcgccaggaucaacug

SEQ ID NO: 3578231 - RNA, 18 nt, Pseudomonas putida KT2440
cugcgccaggcauugcuc

SEQ ID NO: 3578232 - RNA, 23 nt, Pseudomonas putida KT2440
cugcgccaggcauugcucgauua

SEQ ID NO: 3578233 - RNA, 13 nt, Pseudomonas putida KT2440
cugcgccagugcc

SEQ ID NO: 3578234 - RNA, 14 nt, Pseudomonas putida KT2440
cugcgcccaaucac

SEQ ID NO: 3578235 - RNA, 21 nt, Pseudomonas putida KT2440
cugcgcccaguagcgccacca

SEQ ID NO: 3578236 - RNA, 20 nt, Pseudomonas putida KT2440
cugcgccccagguugcaccu

SEQ ID NO: 3578237 - RNA, 19 nt, Pseudomonas putida KT2440
cugcgccccgcucgccugg

SEQ ID NO: 3578238 - RNA, 14 nt, Pseudomonas putida KT2440
cugcgcccgcacag

SEQ ID NO: 3578239 - RNA, 18 nt, Pseudomonas putida KT2440
cugcgcccgcacagcacg

SEQ ID NO: 3578240 - RNA, 13 nt, Pseudomonas putida KT2440
cugcgcccgcccc

SEQ ID NO: 3578241 - RNA, 14 nt, Pseudomonas putida KT2440
cugcgcccgccuuc

SEQ ID NO: 3578242 - RNA, 17 nt, Pseudomonas putida KT2440
cugcgccggccaagugg

SEQ ID NO: 3578243 - RNA, 20 nt, Pseudomonas putida KT2440
cugcgccgguguucgcgggc

SEQ ID NO: 3578244 - RNA, 15 nt, Pseudomonas putida KT2440
cugcgccucgcaggu

SEQ ID NO: 3578245 - RNA, 12 nt, Pseudomonas putida KT2440
cugcgccugcug

SEQ ID NO: 3578246 - RNA, 13 nt, Pseudomonas putida KT2440
cugcgccugcugg

SEQ ID NO: 3578247 - RNA, 16 nt, Pseudomonas putida KT2440
cugcgccugcugguac

SEQ ID NO: 3578248 - RNA, 22 nt, Pseudomonas putida KT2440
cugcgccugcugguacagccgg

SEQ ID NO: 3578249 - RNA, 22 nt, Pseudomonas putida KT2440
cugcgcgagaaugcugcgcagc

SEQ ID NO: 3578250 - RNA, 23 nt, Pseudomonas putida KT2440
cugcgcgagaaugcugcgcagcu

SEQ ID NO: 3578251 - RNA, 15 nt, Pseudomonas putida KT2440
cugcgcgccauggcg

SEQ ID NO: 3578252 - RNA, 17 nt, Pseudomonas putida KT2440
cugcgcgccguugcacg

SEQ ID NO: 3578253 - RNA, 22 nt, Pseudomonas putida KT2440
cugcgcgcgagagcgacgcgcu

SEQ ID NO: 3578254 - RNA, 12 nt, Pseudomonas putida KT2440
cugcgcggcagc

SEQ ID NO: 3578255 - RNA, 13 nt, Pseudomonas putida KT2440
cugcgcggcagcc

SEQ ID NO: 3578256 - RNA, 14 nt, Pseudomonas putida KT2440
cugcgcggcagccc

SEQ ID NO: 3578257 - RNA, 14 nt, Pseudomonas putida KT2440
cugcgcggccacua

SEQ ID NO: 3578258 - RNA, 12 nt, Pseudomonas putida KT2440
cugcgcggccuu

SEQ ID NO: 3578259 - RNA, 16 nt, Pseudomonas putida KT2440
cugcgcggccuugccg

SEQ ID NO: 3578260 - RNA, 17 nt, Pseudomonas putida KT2440
cugcgcgggaagcccgu

SEQ ID NO: 3578261 - RNA, 14 nt, Pseudomonas putida KT2440
cugcgcucaaccag

SEQ ID NO: 3578262 - RNA, 18 nt, Pseudomonas putida KT2440
cugcgcucaaccagccgc

SEQ ID NO: 3578263 - RNA, 19 nt, Pseudomonas putida KT2440
cugcgcuccaacuggcgca

SEQ ID NO: 3578264 - RNA, 14 nt, Pseudomonas putida KT2440
cugcgcuccagcag

SEQ ID NO: 3578265 - RNA, 18 nt, Pseudomonas putida KT2440
cugcgcuccagcagcucc

SEQ ID NO: 3578266 - RNA, 13 nt, Pseudomonas putida KT2440
cugcgcucgaucc

SEQ ID NO: 3578267 - RNA, 22 nt, Pseudomonas putida KT2440
cugcgcucgauccuguggaagc

SEQ ID NO: 3578268 - RNA, 20 nt, Pseudomonas putida KT2440
cugcgcugagaccgaggggc

SEQ ID NO: 3578269 - RNA, 15 nt, Pseudomonas putida KT2440
cugcgcugcccagcu

SEQ ID NO: 3578270 - RNA, 14 nt, Pseudomonas putida KT2440
cugcgcugccugcu

SEQ ID NO: 3578271 - RNA, 14 nt, Pseudomonas putida KT2440
cugcgcuggccaau

SEQ ID NO: 3578272 - RNA, 19 nt, Pseudomonas putida KT2440
cugcgcugguacagcagga

SEQ ID NO: 3578273 - RNA, 22 nt, Pseudomonas putida KT2440
cugcgcugguacagcaggaacg

SEQ ID NO: 3578274 - RNA, 14 nt, Pseudomonas putida KT2440
cugcgcuucaagca

SEQ ID NO: 3578275 - RNA, 17 nt, Pseudomonas putida KT2440
cugcgcuucaagcaggu

SEQ ID NO: 3578276 - RNA, 19 nt, Pseudomonas putida KT2440
cugcgcuucaagcagguaa

SEQ ID NO: 3578277 - RNA, 17 nt, Pseudomonas putida KT2440
cugcgcuugagccuugu

SEQ ID NO: 3578278 - RNA, 16 nt, Pseudomonas putida KT2440
cugcgcuugcaccagg

SEQ ID NO: 3578279 - RNA, 22 nt, Pseudomonas putida KT2440
cugcgcuugcgaccgaugccca

SEQ ID NO: 3578280 - RNA, 23 nt, Pseudomonas putida KT2440
cugcgcuuugcguggcaccggcg

SEQ ID NO: 3578281 - RNA, 17 nt, Pseudomonas putida KT2440
cugcggcagauccugca

SEQ ID NO: 3578282 - RNA, 15 nt, Pseudomonas putida KT2440
cugcggcagcacgau

SEQ ID NO: 3578283 - RNA, 15 nt, Pseudomonas putida KT2440
cugcggcaggcuggc

SEQ ID NO: 3578284 - RNA, 22 nt, Pseudomonas putida KT2440
cugcggcagguaggcccagccc

SEQ ID NO: 3578285 - RNA, 17 nt, Pseudomonas putida KT2440
cugcggcaugaaggccc

SEQ ID NO: 3578286 - RNA, 21 nt, Pseudomonas putida KT2440
cugcggcaugaaggcccagcu

SEQ ID NO: 3578287 - RNA, 16 nt, Pseudomonas putida KT2440
cugcggccaccgccuc

SEQ ID NO: 3578288 - RNA, 14 nt, Pseudomonas putida KT2440
cugcggccaggccg

SEQ ID NO: 3578289 - RNA, 19 nt, Pseudomonas putida KT2440
cugcggccaggccggcgca

SEQ ID NO: 3578290 - RNA, 21 nt, Pseudomonas putida KT2440
cugcggcccauucgcgggcaa

SEQ ID NO: 3578291 - RNA, 15 nt, Pseudomonas putida KT2440
cugcggcgaaagcca

SEQ ID NO: 3578292 - RNA, 18 nt, Pseudomonas putida KT2440
cugcggcgaaagccagca

SEQ ID NO: 3578293 - RNA, 14 nt, Pseudomonas putida KT2440
cugcggcgugcgcc

SEQ ID NO: 3578294 - RNA, 16 nt, Pseudomonas putida KT2440
cugcggcugcucgauc

SEQ ID NO: 3578295 - RNA, 23 nt, Pseudomonas putida KT2440
cugcggcugcucgaucagguuga

SEQ ID NO: 3578296 - RNA, 16 nt, Pseudomonas putida KT2440
cugcgggagcgggcgu

SEQ ID NO: 3578297 - RNA, 21 nt, Pseudomonas putida KT2440
cugcgggcguuguguugcugg

SEQ ID NO: 3578298 - RNA, 17 nt, Pseudomonas putida KT2440
cugcgggcugaggaagu

SEQ ID NO: 3578299 - RNA, 14 nt, Pseudomonas putida KT2440
cugcggggugcucu

SEQ ID NO: 3578300 - RNA, 21 nt, Pseudomonas putida KT2440
cugcggguaaagcccgcagug

SEQ ID NO: 3578301 - RNA, 14 nt, Pseudomonas putida KT2440
cugcggucagccug

SEQ ID NO: 3578302 - RNA, 14 nt, Pseudomonas putida KT2440
cugcggucaucacc

SEQ ID NO: 3578303 - RNA, 20 nt, Pseudomonas putida KT2440
cugcggucgagcugcccacc

SEQ ID NO: 3578304 - RNA, 23 nt, Pseudomonas putida KT2440
cugcggugggcacacaccgggug

SEQ ID NO: 3578305 - RNA, 19 nt, Pseudomonas putida KT2440
cugcguaagguaguaaaaa

SEQ ID NO: 3578306 - RNA, 14 nt, Pseudomonas putida KT2440
cugcguacccagcc

SEQ ID NO: 3578307 - RNA, 19 nt, Pseudomonas putida KT2440
cugcguauuuuugcgccag

SEQ ID NO: 3578308 - RNA, 14 nt, Pseudomonas putida KT2440
cugcgucaggaccu

SEQ ID NO: 3578309 - RNA, 15 nt, Pseudomonas putida KT2440
cugcgucaggccaug

SEQ ID NO: 3578310 - RNA, 22 nt, Pseudomonas putida KT2440
cugcgucgacucuucccaccac

SEQ ID NO: 3578311 - RNA, 19 nt, Pseudomonas putida KT2440
cugcgucucuuccuccauc

SEQ ID NO: 3578312 - RNA, 20 nt, Pseudomonas putida KT2440
cugcgugcacccaaccugcc

SEQ ID NO: 3578313 - RNA, 16 nt, Pseudomonas putida KT2440
cugcgugccugcugcu

SEQ ID NO: 3578314 - RNA, 15 nt, Pseudomonas putida KT2440
cugcgugccuugccu

SEQ ID NO: 3578315 - RNA, 14 nt, Pseudomonas putida KT2440
cugcgugcugugca

SEQ ID NO: 3578316 - RNA, 15 nt, Pseudomonas putida KT2440
cugcgugcugugcac

SEQ ID NO: 3578317 - RNA, 22 nt, Pseudomonas putida KT2440
cugcguggcggugaugcgcacc

SEQ ID NO: 3578318 - RNA, 18 nt, Pseudomonas putida KT2440
cugcgugguaugcauggg

SEQ ID NO: 3578319 - RNA, 12 nt, Pseudomonas putida KT2440
cugcguugcggu

SEQ ID NO: 3578320 - RNA, 14 nt, Pseudomonas putida KT2440
cugcguuggccauc

SEQ ID NO: 3578321 - RNA, 22 nt, Pseudomonas putida KT2440
cugcguuggcuucuucgcgggc

SEQ ID NO: 3578322 - RNA, 16 nt, Pseudomonas putida KT2440
cugcguuuaccggcac

SEQ ID NO: 3578323 - RNA, 18 nt, Pseudomonas putida KT2440
cugcguuuaccggcaccg

SEQ ID NO: 3578324 - RNA, 19 nt, Pseudomonas putida KT2440
cugcuaaaggcauucgcgg

SEQ ID NO: 3578325 - RNA, 14 nt, Pseudomonas putida KT2440
cugcuacgccgccg

SEQ ID NO: 3578326 - RNA, 14 nt, Pseudomonas putida KT2440
cugcucacccgacc

SEQ ID NO: 3578327 - RNA, 16 nt, Pseudomonas putida KT2440
cugcucauacugcuga

SEQ ID NO: 3578328 - RNA, 21 nt, Pseudomonas putida KT2440
cugcucauacugcugacccgg

SEQ ID NO: 3578329 - RNA, 20 nt, Pseudomonas putida KT2440
cugcucauccaccacacgcc

SEQ ID NO: 3578330 - RNA, 17 nt, Pseudomonas putida KT2440
cugcuccacaaucucgc

SEQ ID NO: 3578331 - RNA, 16 nt, Pseudomonas putida KT2440
cugcuccacccgugca

SEQ ID NO: 3578332 - RNA, 15 nt, Pseudomonas putida KT2440
cugcuccagcugcuc

SEQ ID NO: 3578333 - RNA, 20 nt, Pseudomonas putida KT2440
cugcuccaggcagccugcca

SEQ ID NO: 3578334 - RNA, 24 nt, Pseudomonas putida KT2440
cugcuccaggcagccugccagguc

SEQ ID NO: 3578335 - RNA, 20 nt, Pseudomonas putida KT2440
cugcuccaugaucucgcgcu

SEQ ID NO: 3578336 - RNA, 14 nt, Pseudomonas putida KT2440
cugcucccccaggc

SEQ ID NO: 3578337 - RNA, 18 nt, Pseudomonas putida KT2440
cugcucccccaggcugcc

SEQ ID NO: 3578338 - RNA, 16 nt, Pseudomonas putida KT2440
cugcuccggaauccgc

SEQ ID NO: 3578339 - RNA, 15 nt, Pseudomonas putida KT2440
cugcuccggccggcc

SEQ ID NO: 3578340 - RNA, 21 nt, Pseudomonas putida KT2440
cugcucgacaagccgcugggc

SEQ ID NO: 3578341 - RNA, 14 nt, Pseudomonas putida KT2440
cugcucgcuggcuu

SEQ ID NO: 3578342 - RNA, 16 nt, Pseudomonas putida KT2440
cugcucgcuggcuugu

SEQ ID NO: 3578343 - RNA, 19 nt, Pseudomonas putida KT2440
cugcucgcuggcuuguucg

SEQ ID NO: 3578344 - RNA, 19 nt, Pseudomonas putida KT2440
cugcucuggcccgaacagc

SEQ ID NO: 3578345 - RNA, 12 nt, Pseudomonas putida KT2440
cugcucuucgag

SEQ ID NO: 3578346 - RNA, 13 nt, Pseudomonas putida KT2440
cugcucuucgccg

SEQ ID NO: 3578347 - RNA, 14 nt, Pseudomonas putida KT2440
cugcucuuugaucg

SEQ ID NO: 3578348 - RNA, 23 nt, Pseudomonas putida KT2440
cugcugaaugcggaaaaggccgg

SEQ ID NO: 3578349 - RNA, 18 nt, Pseudomonas putida KT2440
cugcugacaccgcugccg

SEQ ID NO: 3578350 - RNA, 19 nt, Pseudomonas putida KT2440
cugcugacaccgcugccgg

SEQ ID NO: 3578351 - RNA, 20 nt, Pseudomonas putida KT2440
cugcugacccggaaucggcu

SEQ ID NO: 3578352 - RNA, 21 nt, Pseudomonas putida KT2440
cugcugaccucgacccgcccg

SEQ ID NO: 3578353 - RNA, 22 nt, Pseudomonas putida KT2440
cugcugaugcgggaccagcacc

SEQ ID NO: 3578354 - RNA, 15 nt, Pseudomonas putida KT2440
cugcugcagcacugc

SEQ ID NO: 3578355 - RNA, 17 nt, Pseudomonas putida KT2440
cugcugcagcacugccu

SEQ ID NO: 3578356 - RNA, 19 nt, Pseudomonas putida KT2440
cugcugcagcacugccugc

SEQ ID NO: 3578357 - RNA, 14 nt, Pseudomonas putida KT2440
cugcugcagcaugg

SEQ ID NO: 3578358 - RNA, 20 nt, Pseudomonas putida KT2440
cugcugcagggcccagccac

SEQ ID NO: 3578359 - RNA, 21 nt, Pseudomonas putida KT2440
cugcugcagggcccagccacc

SEQ ID NO: 3578360 - RNA, 14 nt, Pseudomonas putida KT2440
cugcugcaguucuu

SEQ ID NO: 3578361 - RNA, 24 nt, Pseudomonas putida KT2440
cugcugcaguucuuccagcggcaa

SEQ ID NO: 3578362 - RNA, 15 nt, Pseudomonas putida KT2440
cugcugccaggccgc

SEQ ID NO: 3578363 - RNA, 16 nt, Pseudomonas putida KT2440
cugcugccauccuuga

SEQ ID NO: 3578364 - RNA, 20 nt, Pseudomonas putida KT2440
cugcugccauccuugaagaa

SEQ ID NO: 3578365 - RNA, 22 nt, Pseudomonas putida KT2440
cugcugccccaugcgaacugca

SEQ ID NO: 3578366 - RNA, 20 nt, Pseudomonas putida KT2440
cugcugcccguugcgcauca

SEQ ID NO: 3578367 - RNA, 23 nt, Pseudomonas putida KT2440
cugcugcccguugcgcaucaccu

SEQ ID NO: 3578368 - RNA, 20 nt, Pseudomonas putida KT2440
cugcugcgaaacgaaacccu

SEQ ID NO: 3578369 - RNA, 16 nt, Pseudomonas putida KT2440
cugcugcgcagcccca

SEQ ID NO: 3578370 - RNA, 17 nt, Pseudomonas putida KT2440
cugcugcgcagcccugu

SEQ ID NO: 3578371 - RNA, 19 nt, Pseudomonas putida KT2440
cugcugcggauacagcgcc

SEQ ID NO: 3578372 - RNA, 21 nt, Pseudomonas putida KT2440
cugcugcggauacagcgccca

SEQ ID NO: 3578373 - RNA, 16 nt, Pseudomonas putida KT2440
cugcugcggcaccucg

SEQ ID NO: 3578374 - RNA, 14 nt, Pseudomonas putida KT2440
cugcugcggcaggc

SEQ ID NO: 3578375 - RNA, 17 nt, Pseudomonas putida KT2440
cugcugcggcaggcugg

SEQ ID NO: 3578376 - RNA, 19 nt, Pseudomonas putida KT2440
cugcugcggcaggcuggca

SEQ ID NO: 3578377 - RNA, 13 nt, Pseudomonas putida KT2440
cugcugcggccgc

SEQ ID NO: 3578378 - RNA, 19 nt, Pseudomonas putida KT2440
cugcugcgguuugcucuga

SEQ ID NO: 3578379 - RNA, 22 nt, Pseudomonas putida KT2440
cugcugcuccccaaccaccucc

SEQ ID NO: 3578380 - RNA, 14 nt, Pseudomonas putida KT2440
cugcugcucguuga

SEQ ID NO: 3578381 - RNA, 14 nt, Pseudomonas putida KT2440
cugcugcuggcacg

SEQ ID NO: 3578382 - RNA, 17 nt, Pseudomonas putida KT2440
cugcugcuggcacgccu

SEQ ID NO: 3578383 - RNA, 17 nt, Pseudomonas putida KT2440
cugcugcuucucaagcc

SEQ ID NO: 3578384 - RNA, 19 nt, Pseudomonas putida KT2440
cugcuggauacccagcgcc

SEQ ID NO: 3578385 - RNA, 14 nt, Pseudomonas putida KT2440
cugcuggcacgccu

SEQ ID NO: 3578386 - RNA, 17 nt, Pseudomonas putida KT2440
cugcuggcccgcgaugc

SEQ ID NO: 3578387 - RNA, 20 nt, Pseudomonas putida KT2440
cugcuggccgccagacaacu

SEQ ID NO: 3578388 - RNA, 14 nt, Pseudomonas putida KT2440
cugcuggccgcgca

SEQ ID NO: 3578389 - RNA, 13 nt, Pseudomonas putida KT2440
cugcuggcgaaga

SEQ ID NO: 3578390 - RNA, 14 nt, Pseudomonas putida KT2440
cugcugggcgauga

SEQ ID NO: 3578391 - RNA, 22 nt, Pseudomonas putida KT2440
cugcugggcgaugaucgccugg

SEQ ID NO: 3578392 - RNA, 17 nt, Pseudomonas putida KT2440
cugcugggcgucggcaa

SEQ ID NO: 3578393 - RNA, 19 nt, Pseudomonas putida KT2440
cugcugguucaucgacugg

SEQ ID NO: 3578394 - RNA, 22 nt, Pseudomonas putida KT2440
cugcugguucaucgacuggaug

SEQ ID NO: 3578395 - RNA, 22 nt, Pseudomonas putida KT2440
cugcuguaaaugaaaacgcccc

SEQ ID NO: 3578396 - RNA, 15 nt, Pseudomonas putida KT2440
cugcuguagcgccca

SEQ ID NO: 3578397 - RNA, 17 nt, Pseudomonas putida KT2440
cugcuguggaacagccu

SEQ ID NO: 3578398 - RNA, 20 nt, Pseudomonas putida KT2440
cugcuuaucggcugaccuga

SEQ ID NO: 3578399 - RNA, 20 nt, Pseudomonas putida KT2440
cugcuucacgggucaugcca

SEQ ID NO: 3578400 - RNA, 22 nt, Pseudomonas putida KT2440
cugcuucacgggucaugccacc

SEQ ID NO: 3578401 - RNA, 14 nt, Pseudomonas putida KT2440
cugcuucagcucga

SEQ ID NO: 3578402 - RNA, 18 nt, Pseudomonas putida KT2440
cugcuucaucugcgccug

SEQ ID NO: 3578403 - RNA, 21 nt, Pseudomonas putida KT2440
cugcuucaugaagucagccag

SEQ ID NO: 3578404 - RNA, 17 nt, Pseudomonas putida KT2440
cugcuuccuugcgcacg

SEQ ID NO: 3578405 - RNA, 16 nt, Pseudomonas putida KT2440
cugcuucgcgggcacg

SEQ ID NO: 3578406 - RNA, 15 nt, Pseudomonas putida KT2440
cugcuucugagccag

SEQ ID NO: 3578407 - RNA, 15 nt, Pseudomonas putida KT2440
cugcuucugccguuc

SEQ ID NO: 3578408 - RNA, 16 nt, Pseudomonas putida KT2440
cugcuucugccguuca

SEQ ID NO: 3578409 - RNA, 15 nt, Pseudomonas putida KT2440
cugcuugaacacaua

SEQ ID NO: 3578410 - RNA, 15 nt, Pseudomonas putida KT2440
cugcuugaccauggc

SEQ ID NO: 3578411 - RNA, 22 nt, Pseudomonas putida KT2440
cugcuugaccauggcgaugaac

SEQ ID NO: 3578412 - RNA, 15 nt, Pseudomonas putida KT2440
cugcuugagcgcagc

SEQ ID NO: 3578413 - RNA, 17 nt, Pseudomonas putida KT2440
cugcuugagcgcagcga

SEQ ID NO: 3578414 - RNA, 21 nt, Pseudomonas putida KT2440
cugcuugagcgcagcgacgac

SEQ ID NO: 3578415 - RNA, 20 nt, Pseudomonas putida KT2440
cugcuugaucaggcccggcu

SEQ ID NO: 3578416 - RNA, 20 nt, Pseudomonas putida KT2440
cugcuugccugucaguuccu

SEQ ID NO: 3578417 - RNA, 22 nt, Pseudomonas putida KT2440
cugcuuggccgacuggcgcacc

SEQ ID NO: 3578418 - RNA, 19 nt, Pseudomonas putida KT2440
cugcuuguccauccccucc

SEQ ID NO: 3578419 - RNA, 23 nt, Pseudomonas putida KT2440
cugcuuguggucgacgucggcgu

SEQ ID NO: 3578420 - RNA, 15 nt, Pseudomonas putida KT2440
cugcuuucaggugcu

SEQ ID NO: 3578421 - RNA, 14 nt, Pseudomonas putida KT2440
cugcuuugcagccc

SEQ ID NO: 3578422 - RNA, 16 nt, Pseudomonas putida KT2440
cugcuuugcagcccuu

SEQ ID NO: 3578423 - RNA, 17 nt, Pseudomonas putida KT2440
cugcuuugggagcagga

SEQ ID NO: 3578424 - RNA, 20 nt, Pseudomonas putida KT2440
cuggaaaaugcccccgccga

SEQ ID NO: 3578425 - RNA, 20 nt, Pseudomonas putida KT2440
cuggaaauucucggcugccu

SEQ ID NO: 3578426 - RNA, 16 nt, Pseudomonas putida KT2440
cuggaaccccauccac

SEQ ID NO: 3578427 - RNA, 18 nt, Pseudomonas putida KT2440
cuggaacgcuuggccaga

SEQ ID NO: 3578428 - RNA, 15 nt, Pseudomonas putida KT2440
cuggaacugcugcac

SEQ ID NO: 3578429 - RNA, 17 nt, Pseudomonas putida KT2440
cuggaagagcaggaaga

SEQ ID NO: 3578430 - RNA, 20 nt, Pseudomonas putida KT2440
cuggaagugcugagaggguc

SEQ ID NO: 3578431 - RNA, 19 nt, Pseudomonas putida KT2440
cuggaauuauuggccagca

SEQ ID NO: 3578432 - RNA, 23 nt, Pseudomonas putida KT2440
cuggaauucgcugcgcaucaccc

SEQ ID NO: 3578433 - RNA, 20 nt, Pseudomonas putida KT2440
cuggacaugcacgccacgcc

SEQ ID NO: 3578434 - RNA, 21 nt, Pseudomonas putida KT2440
cuggacccaaucgcugugcaa

SEQ ID NO: 3578435 - RNA, 14 nt, Pseudomonas putida KT2440
cuggacccgcagca

SEQ ID NO: 3578436 - RNA, 20 nt, Pseudomonas putida KT2440
cuggacgcugucagaccucc

SEQ ID NO: 3578437 - RNA, 19 nt, Pseudomonas putida KT2440
cuggagaacagcgucaugc

SEQ ID NO: 3578438 - RNA, 19 nt, Pseudomonas putida KT2440
cuggagacgaacagcgccg

SEQ ID NO: 3578439 - RNA, 20 nt, Pseudomonas putida KT2440
cuggagaucuugucgaccug

SEQ ID NO: 3578440 - RNA, 21 nt, Pseudomonas putida KT2440
cuggagaucuugucgaccugg

SEQ ID NO: 3578441 - RNA, 15 nt, Pseudomonas putida KT2440
cuggagcaaggcguu

SEQ ID NO: 3578442 - RNA, 23 nt, Pseudomonas putida KT2440
cuggagccguccaggaacgcugc

SEQ ID NO: 3578443 - RNA, 19 nt, Pseudomonas putida KT2440
cuggagcuauuuggcucca

SEQ ID NO: 3578444 - RNA, 12 nt, Pseudomonas putida KT2440
cuggaggucaug

SEQ ID NO: 3578445 - RNA, 16 nt, Pseudomonas putida KT2440
cuggagucguugcgcu

SEQ ID NO: 3578446 - RNA, 15 nt, Pseudomonas putida KT2440
cuggauaagaucacu

SEQ ID NO: 3578447 - RNA, 15 nt, Pseudomonas putida KT2440
cuggaucugaugcuu

SEQ ID NO: 3578448 - RNA, 12 nt, Pseudomonas putida KT2440
cuggaucuugcu

SEQ ID NO: 3578449 - RNA, 13 nt, Pseudomonas putida KT2440
cuggaugaagccc

SEQ ID NO: 3578450 - RNA, 21 nt, Pseudomonas putida KT2440
cuggaugacacggauggcacc

SEQ ID NO: 3578451 - RNA, 21 nt, Pseudomonas putida KT2440
cuggaugacgccgcagccggg

SEQ ID NO: 3578452 - RNA, 17 nt, Pseudomonas putida KT2440
cuggaugauccagccca

SEQ ID NO: 3578453 - RNA, 19 nt, Pseudomonas putida KT2440
cuggaugauccagcccacc

SEQ ID NO: 3578454 - RNA, 14 nt, Pseudomonas putida KT2440
cuggaugaugguau

SEQ ID NO: 3578455 - RNA, 14 nt, Pseudomonas putida KT2440
cuggaugcucgaua

SEQ ID NO: 3578456 - RNA, 14 nt, Pseudomonas putida KT2440
cuggauggugcgcu

SEQ ID NO: 3578457 - RNA, 15 nt, Pseudomonas putida KT2440
cuggauggugcgcuc

SEQ ID NO: 3578458 - RNA, 22 nt, Pseudomonas putida KT2440
cuggcaaauagcgcuuucuggu

SEQ ID NO: 3578459 - RNA, 20 nt, Pseudomonas putida KT2440
cuggcaacccgccuccugaa

SEQ ID NO: 3578460 - RNA, 16 nt, Pseudomonas putida KT2440
cuggcaaucagcucuu

SEQ ID NO: 3578461 - RNA, 23 nt, Pseudomonas putida KT2440
cuggcaaucagcucuucgaucuc

SEQ ID NO: 3578462 - RNA, 17 nt, Pseudomonas putida KT2440
cuggcaccaccagggcg

SEQ ID NO: 3578463 - RNA, 16 nt, Pseudomonas putida KT2440
cuggcacccacgcgcu

SEQ ID NO: 3578464 - RNA, 19 nt, Pseudomonas putida KT2440
cuggcaccggcgccaauca

SEQ ID NO: 3578465 - RNA, 15 nt, Pseudomonas putida KT2440
cuggcacgcccggca

SEQ ID NO: 3578466 - RNA, 21 nt, Pseudomonas putida KT2440
cuggcacgccuucagcagccg

SEQ ID NO: 3578467 - RNA, 17 nt, Pseudomonas putida KT2440
cuggcacuccacuugau

SEQ ID NO: 3578468 - RNA, 24 nt, Pseudomonas putida KT2440
cuggcacuccacuugauugggcuu

SEQ ID NO: 3578469 - RNA, 17 nt, Pseudomonas putida KT2440
cuggcacucucgcggug

SEQ ID NO: 3578470 - RNA, 12 nt, Pseudomonas putida KT2440
cuggcacugcgg

SEQ ID NO: 3578471 - RNA, 17 nt, Pseudomonas putida KT2440
cuggcacugcggcucau

SEQ ID NO: 3578472 - RNA, 15 nt, Pseudomonas putida KT2440
cuggcagcaaggcca

SEQ ID NO: 3578473 - RNA, 15 nt, Pseudomonas putida KT2440
cuggcagcacgauca

SEQ ID NO: 3578474 - RNA, 18 nt, Pseudomonas putida KT2440
cuggcagcacgaucagcg

SEQ ID NO: 3578475 - RNA, 19 nt, Pseudomonas putida KT2440
cuggcagcacgaucagcgc

SEQ ID NO: 3578476 - RNA, 14 nt, Pseudomonas putida KT2440
cuggcagcagugca

SEQ ID NO: 3578477 - RNA, 12 nt, Pseudomonas putida KT2440
cuggcagccgcc

SEQ ID NO: 3578478 - RNA, 16 nt, Pseudomonas putida KT2440
cuggcagcgggcugcc

SEQ ID NO: 3578479 - RNA, 14 nt, Pseudomonas putida KT2440
cuggcagcggguag

SEQ ID NO: 3578480 - RNA, 14 nt, Pseudomonas putida KT2440
cuggcagcuccagc

SEQ ID NO: 3578481 - RNA, 18 nt, Pseudomonas putida KT2440
cuggcagcuccagccaga

SEQ ID NO: 3578482 - RNA, 18 nt, Pseudomonas putida KT2440
cuggcagcuucucgcggc

SEQ ID NO: 3578483 - RNA, 19 nt, Pseudomonas putida KT2440
cuggcaggccuuguuccac

SEQ ID NO: 3578484 - RNA, 18 nt, Pseudomonas putida KT2440
cuggcaggcucagggcag

SEQ ID NO: 3578485 - RNA, 21 nt, Pseudomonas putida KT2440
cuggcaggcucagggcagcaa

SEQ ID NO: 3578486 - RNA, 19 nt, Pseudomonas putida KT2440
cuggcauagcaguccugca

SEQ ID NO: 3578487 - RNA, 18 nt, Pseudomonas putida KT2440
cuggcauaguccaggaag

SEQ ID NO: 3578488 - RNA, 22 nt, Pseudomonas putida KT2440
cuggcauaguccaggaagcagg

SEQ ID NO: 3578489 - RNA, 13 nt, Pseudomonas putida KT2440
cuggcaucaaugc

SEQ ID NO: 3578490 - RNA, 13 nt, Pseudomonas putida KT2440
cuggcauccagcg

SEQ ID NO: 3578491 - RNA, 15 nt, Pseudomonas putida KT2440
cuggcaucgccucgu

SEQ ID NO: 3578492 - RNA, 16 nt, Pseudomonas putida KT2440
cuggcaucggucaccg

SEQ ID NO: 3578493 - RNA, 18 nt, Pseudomonas putida KT2440
cuggccaacuccccaccc

SEQ ID NO: 3578494 - RNA, 19 nt, Pseudomonas putida KT2440
cuggccaacuccccaccca

SEQ ID NO: 3578495 - RNA, 19 nt, Pseudomonas putida KT2440
cuggccaagcggcucguca

SEQ ID NO: 3578496 - RNA, 23 nt, Pseudomonas putida KT2440
cuggccaaggguuugccaggcgc

SEQ ID NO: 3578497 - RNA, 19 nt, Pseudomonas putida KT2440
cuggccaaggucuccagca

SEQ ID NO: 3578498 - RNA, 22 nt, Pseudomonas putida KT2440
cuggccacauggaucagcucau

SEQ ID NO: 3578499 - RNA, 13 nt, Pseudomonas putida KT2440
cuggccaccacca

SEQ ID NO: 3578500 - RNA, 16 nt, Pseudomonas putida KT2440
cuggccaccaccaucu

SEQ ID NO: 3578501 - RNA, 15 nt, Pseudomonas putida KT2440
cuggccaccagcaug

SEQ ID NO: 3578502 - RNA, 19 nt, Pseudomonas putida KT2440
cuggccaccgaaguucagc

SEQ ID NO: 3578503 - RNA, 20 nt, Pseudomonas putida KT2440
cuggccaccgaaguucagca

SEQ ID NO: 3578504 - RNA, 21 nt, Pseudomonas putida KT2440
cuggccaccgaaguucagcac

SEQ ID NO: 3578505 - RNA, 22 nt, Pseudomonas putida KT2440
cuggccaccgaaguucagcacg

SEQ ID NO: 3578506 - RNA, 13 nt, Pseudomonas putida KT2440
cuggccaccgcgc

SEQ ID NO: 3578507 - RNA, 20 nt, Pseudomonas putida KT2440
cuggccacuguugcagcgcc

SEQ ID NO: 3578508 - RNA, 20 nt, Pseudomonas putida KT2440
cuggccagcaagugccccug

SEQ ID NO: 3578509 - RNA, 16 nt, Pseudomonas putida KT2440
cuggccagcagccccc

SEQ ID NO: 3578510 - RNA, 17 nt, Pseudomonas putida KT2440
cuggccagcagggccgc

SEQ ID NO: 3578511 - RNA, 11 nt, Pseudomonas putida KT2440
cuggccagcgg

SEQ ID NO: 3578512 - RNA, 24 nt, Pseudomonas putida KT2440
cuggccaguuguucgucgagcacc

SEQ ID NO: 3578513 - RNA, 20 nt, Pseudomonas putida KT2440
cuggccauaguugaccagca

SEQ ID NO: 3578514 - RNA, 23 nt, Pseudomonas putida KT2440
cuggccauaguugaccagcacca

SEQ ID NO: 3578515 - RNA, 22 nt, Pseudomonas putida KT2440
cuggccauccagucgaucagcg

SEQ ID NO: 3578516 - RNA, 20 nt, Pseudomonas putida KT2440
cuggccaucgacccgcugcc

SEQ ID NO: 3578517 - RNA, 12 nt, Pseudomonas putida KT2440
cuggcccacccg

SEQ ID NO: 3578518 - RNA, 14 nt, Pseudomonas putida KT2440
cuggcccacccggc

SEQ ID NO: 3578519 - RNA, 18 nt, Pseudomonas putida KT2440
cuggcccacgccuuccac

SEQ ID NO: 3578520 - RNA, 21 nt, Pseudomonas putida KT2440
cuggcccacgccuuccaccgg

SEQ ID NO: 3578521 - RNA, 22 nt, Pseudomonas putida KT2440
cuggcccacgccuuccaccggu

SEQ ID NO: 3578522 - RNA, 20 nt, Pseudomonas putida KT2440
cuggcccaguacgccaccca

SEQ ID NO: 3578523 - RNA, 13 nt, Pseudomonas putida KT2440
cuggccccaccca

SEQ ID NO: 3578524 - RNA, 14 nt, Pseudomonas putida KT2440
cuggcccgaacagc

SEQ ID NO: 3578525 - RNA, 15 nt, Pseudomonas putida KT2440
cuggcccgaacagca

SEQ ID NO: 3578526 - RNA, 16 nt, Pseudomonas putida KT2440
cuggcccgcgccaggc

SEQ ID NO: 3578527 - RNA, 17 nt, Pseudomonas putida KT2440
cuggcccgcuugcccga

SEQ ID NO: 3578528 - RNA, 14 nt, Pseudomonas putida KT2440
cuggcccggugcaa

SEQ ID NO: 3578529 - RNA, 15 nt, Pseudomonas putida KT2440
cuggcccggugcaag

SEQ ID NO: 3578530 - RNA, 21 nt, Pseudomonas putida KT2440
cuggcccgucuugcgucagcu

SEQ ID NO: 3578531 - RNA, 19 nt, Pseudomonas putida KT2440
cuggcccuauggggugagc

SEQ ID NO: 3578532 - RNA, 22 nt, Pseudomonas putida KT2440
cuggcccugcucacgcagcucg

SEQ ID NO: 3578533 - RNA, 13 nt, Pseudomonas putida KT2440
cuggcccuggcca

SEQ ID NO: 3578534 - RNA, 18 nt, Pseudomonas putida KT2440
cuggcccuuacaggucgu

SEQ ID NO: 3578535 - RNA, 11 nt, Pseudomonas putida KT2440
cuggcccuucg

SEQ ID NO: 3578536 - RNA, 13 nt, Pseudomonas putida KT2440
cuggcccuugcca

SEQ ID NO: 3578537 - RNA, 24 nt, Pseudomonas putida KT2440
cuggcccuuucgcgggagacccgu

SEQ ID NO: 3578538 - RNA, 19 nt, Pseudomonas putida KT2440
cuggcccuuucgcggguaa

SEQ ID NO: 3578539 - RNA, 21 nt, Pseudomonas putida KT2440
cuggccgacaucaucaucuuc

SEQ ID NO: 3578540 - RNA, 13 nt, Pseudomonas putida KT2440
cuggccgacguca

SEQ ID NO: 3578541 - RNA, 15 nt, Pseudomonas putida KT2440
cuggccgaugcccac

SEQ ID NO: 3578542 - RNA, 18 nt, Pseudomonas putida KT2440
cuggccgaugcccaccuu

SEQ ID NO: 3578543 - RNA, 18 nt, Pseudomonas putida KT2440
cuggccgcaaccugggca

SEQ ID NO: 3578544 - RNA, 19 nt, Pseudomonas putida KT2440
cuggccgcccgccucgaca

SEQ ID NO: 3578545 - RNA, 14 nt, Pseudomonas putida KT2440
cuggccgccuccca

SEQ ID NO: 3578546 - RNA, 17 nt, Pseudomonas putida KT2440
cuggccgcgcaggaaga

SEQ ID NO: 3578547 - RNA, 19 nt, Pseudomonas putida KT2440
cuggccgcugaaccucacc

SEQ ID NO: 3578548 - RNA, 19 nt, Pseudomonas putida KT2440
cuggccgcugcgcccgccu

SEQ ID NO: 3578549 - RNA, 22 nt, Pseudomonas putida KT2440
cuggccggggccgcuuggcggc

SEQ ID NO: 3578550 - RNA, 12 nt, Pseudomonas putida KT2440
cuggccgguggc

SEQ ID NO: 3578551 - RNA, 20 nt, Pseudomonas putida KT2440
cuggccgguguggccaaggc

SEQ ID NO: 3578552 - RNA, 24 nt, Pseudomonas putida KT2440
cuggccguccagcugagcgccauc

SEQ ID NO: 3578553 - RNA, 12 nt, Pseudomonas putida KT2440
cuggccgugccg

SEQ ID NO: 3578554 - RNA, 21 nt, Pseudomonas putida KT2440
cuggccguguucgacgaucga

SEQ ID NO: 3578555 - RNA, 15 nt, Pseudomonas putida KT2440
cuggccucacaucgc

SEQ ID NO: 3578556 - RNA, 23 nt, Pseudomonas putida KT2440
cuggccucacaucgcgcagggcg

SEQ ID NO: 3578557 - RNA, 17 nt, Pseudomonas putida KT2440
cuggccucuucgcgggu

SEQ ID NO: 3578558 - RNA, 19 nt, Pseudomonas putida KT2440
cuggccucuucgcggguaa

SEQ ID NO: 3578559 - RNA, 13 nt, Pseudomonas putida KT2440
cuggccugcagcc

SEQ ID NO: 3578560 - RNA, 15 nt, Pseudomonas putida KT2440
cuggccugcaugcuc

SEQ ID NO: 3578561 - RNA, 15 nt, Pseudomonas putida KT2440
cuggccugccccagc

SEQ ID NO: 3578562 - RNA, 16 nt, Pseudomonas putida KT2440
cuggccuggccaagcg

SEQ ID NO: 3578563 - RNA, 16 nt, Pseudomonas putida KT2440
cuggccuuccuugccc

SEQ ID NO: 3578564 - RNA, 17 nt, Pseudomonas putida KT2440
cuggccuugcggcaagc

SEQ ID NO: 3578565 - RNA, 17 nt, Pseudomonas putida KT2440
cuggccuuggacaccag

SEQ ID NO: 3578566 - RNA, 22 nt, Pseudomonas putida KT2440
cuggccuuggacaccaggcugg

SEQ ID NO: 3578567 - RNA, 16 nt, Pseudomonas putida KT2440
cuggccuuggcgugca

SEQ ID NO: 3578568 - RNA, 20 nt, Pseudomonas putida KT2440
cuggccuuggcgugcacgcu

SEQ ID NO: 3578569 - RNA, 15 nt, Pseudomonas putida KT2440
cuggcgaauacgcuc

SEQ ID NO: 3578570 - RNA, 19 nt, Pseudomonas putida KT2440
cuggcgaauacgcucagcc

SEQ ID NO: 3578571 - RNA, 20 nt, Pseudomonas putida KT2440
cuggcgaauacgcucagccg

SEQ ID NO: 3578572 - RNA, 20 nt, Pseudomonas putida KT2440
cuggcgacacuugguccagg

SEQ ID NO: 3578573 - RNA, 19 nt, Pseudomonas putida KT2440
cuggcgagaaggcguggug

SEQ ID NO: 3578574 - RNA, 21 nt, Pseudomonas putida KT2440
cuggcgagaaggcguggugca

SEQ ID NO: 3578575 - RNA, 15 nt, Pseudomonas putida KT2440
cuggcgaucaggcag

SEQ ID NO: 3578576 - RNA, 19 nt, Pseudomonas putida KT2440
cuggcgaucaggcaggcca

SEQ ID NO: 3578577 - RNA, 16 nt, Pseudomonas putida KT2440
cuggcgaucggcuggu

SEQ ID NO: 3578578 - RNA, 18 nt, Pseudomonas putida KT2440
cuggcgaugaagacgcuc

SEQ ID NO: 3578579 - RNA, 21 nt, Pseudomonas putida KT2440
cuggcgaugagguagaucaca

SEQ ID NO: 3578580 - RNA, 18 nt, Pseudomonas putida KT2440
cuggcgcaaucuugccac

SEQ ID NO: 3578581 - RNA, 14 nt, Pseudomonas putida KT2440
cuggcgcaccagcg

SEQ ID NO: 3578582 - RNA, 21 nt, Pseudomonas putida KT2440
cuggcgcaccagcggcuuggc

SEQ ID NO: 3578583 - RNA, 14 nt, Pseudomonas putida KT2440
cuggcgcagagggu

SEQ ID NO: 3578584 - RNA, 12 nt, Pseudomonas putida KT2440
cuggcgcagcag

SEQ ID NO: 3578585 - RNA, 17 nt, Pseudomonas putida KT2440
cuggcgcagcaggucca

SEQ ID NO: 3578586 - RNA, 23 nt, Pseudomonas putida KT2440
cuggcgcagcagguccagcuccg

SEQ ID NO: 3578587 - RNA, 16 nt, Pseudomonas putida KT2440
cuggcgcaggccgcug

SEQ ID NO: 3578588 - RNA, 19 nt, Pseudomonas putida KT2440
cuggcgcaguucguccagg

SEQ ID NO: 3578589 - RNA, 21 nt, Pseudomonas putida KT2440
cuggcgcaguucguccaggcu

SEQ ID NO: 3578590 - RNA, 19 nt, Pseudomonas putida KT2440
cuggcgcaucuuccagcac

SEQ ID NO: 3578591 - RNA, 20 nt, Pseudomonas putida KT2440
cuggcgcaucuuccagcaca

SEQ ID NO: 3578592 - RNA, 15 nt, Pseudomonas putida KT2440
cuggcgccagccgcc

SEQ ID NO: 3578593 - RNA, 12 nt, Pseudomonas putida KT2440
cuggcgccagcg

SEQ ID NO: 3578594 - RNA, 14 nt, Pseudomonas putida KT2440
cuggcgcccggcau

SEQ ID NO: 3578595 - RNA, 14 nt, Pseudomonas putida KT2440
cuggcgccugcggc

SEQ ID NO: 3578596 - RNA, 15 nt, Pseudomonas putida KT2440
cuggcgccugcggca

SEQ ID NO: 3578597 - RNA, 18 nt, Pseudomonas putida KT2440
cuggcgcgaaaagcuguc

SEQ ID NO: 3578598 - RNA, 18 nt, Pseudomonas putida KT2440
cuggcgcgaccaucaccg

SEQ ID NO: 3578599 - RNA, 19 nt, Pseudomonas putida KT2440
cuggcgcgaccaucaccgc

SEQ ID NO: 3578600 - RNA, 22 nt, Pseudomonas putida KT2440
cuggcgcgauuggacuguggga

SEQ ID NO: 3578601 - RNA, 16 nt, Pseudomonas putida KT2440
cuggcgcgcugugcuc

SEQ ID NO: 3578602 - RNA, 18 nt, Pseudomonas putida KT2440
cuggcgcgcugugcucag

SEQ ID NO: 3578603 - RNA, 18 nt, Pseudomonas putida KT2440
cuggcgcucaauggcacc

SEQ ID NO: 3578604 - RNA, 19 nt, Pseudomonas putida KT2440
cuggcgcucaauggcaccg

SEQ ID NO: 3578605 - RNA, 22 nt, Pseudomonas putida KT2440
cuggcgcuuccuuccuggaagc

SEQ ID NO: 3578606 - RNA, 17 nt, Pseudomonas putida KT2440
cuggcgcuugaucagcc

SEQ ID NO: 3578607 - RNA, 19 nt, Pseudomonas putida KT2440
cuggcgcuugaucagccug

SEQ ID NO: 3578608 - RNA, 20 nt, Pseudomonas putida KT2440
cuggcggaucugacggcgcu

SEQ ID NO: 3578609 - RNA, 17 nt, Pseudomonas putida KT2440
cuggcggccaaugcugc

SEQ ID NO: 3578610 - RNA, 19 nt, Pseudomonas putida KT2440
cuggcggccaaugcugccu

SEQ ID NO: 3578611 - RNA, 17 nt, Pseudomonas putida KT2440
cuggcggcccugacgcg

SEQ ID NO: 3578612 - RNA, 19 nt, Pseudomonas putida KT2440
cuggcggcugagccggcug

SEQ ID NO: 3578613 - RNA, 15 nt, Pseudomonas putida KT2440
cuggcggcugcccgu

SEQ ID NO: 3578614 - RNA, 17 nt, Pseudomonas putida KT2440
cuggcgggcaaacuggc

SEQ ID NO: 3578615 - RNA, 15 nt, Pseudomonas putida KT2440
cuggcgggguggccg

SEQ ID NO: 3578616 - RNA, 17 nt, Pseudomonas putida KT2440
cuggcgggguggccggc

SEQ ID NO: 3578617 - RNA, 19 nt, Pseudomonas putida KT2440
cuggcggguuuccucgguc

SEQ ID NO: 3578618 - RNA, 20 nt, Pseudomonas putida KT2440
cuggcgguguagaacggcag

SEQ ID NO: 3578619 - RNA, 14 nt, Pseudomonas putida KT2440
cuggcgguugacca

SEQ ID NO: 3578620 - RNA, 12 nt, Pseudomonas putida KT2440
cuggcgugcacc

SEQ ID NO: 3578621 - RNA, 17 nt, Pseudomonas putida KT2440
cuggcuacagaucagcc

SEQ ID NO: 3578622 - RNA, 19 nt, Pseudomonas putida KT2440
cuggcuacccgcucggccu

SEQ ID NO: 3578623 - RNA, 20 nt, Pseudomonas putida KT2440
cuggcuacccgcucggccuu

SEQ ID NO: 3578624 - RNA, 19 nt, Pseudomonas putida KT2440
cuggcuauccuucugccgu

SEQ ID NO: 3578625 - RNA, 24 nt, Pseudomonas putida KT2440
cuggcucgaucuuguuggucaggc

SEQ ID NO: 3578626 - RNA, 15 nt, Pseudomonas putida KT2440
cuggcucgcugcccc

SEQ ID NO: 3578627 - RNA, 19 nt, Pseudomonas putida KT2440
cuggcucgcugccccaguc

SEQ ID NO: 3578628 - RNA, 15 nt, Pseudomonas putida KT2440
cuggcucggcugggc

SEQ ID NO: 3578629 - RNA, 19 nt, Pseudomonas putida KT2440
cuggcucuucaacaccagc

SEQ ID NO: 3578630 - RNA, 18 nt, Pseudomonas putida KT2440
cuggcugaccagugucug

SEQ ID NO: 3578631 - RNA, 20 nt, Pseudomonas putida KT2440
cuggcugaucagcauguccc

SEQ ID NO: 3578632 - RNA, 15 nt, Pseudomonas putida KT2440
cuggcugaucgcgcc

SEQ ID NO: 3578633 - RNA, 22 nt, Pseudomonas putida KT2440
cuggcugcaagguccaggcgug

SEQ ID NO: 3578634 - RNA, 15 nt, Pseudomonas putida KT2440
cuggcugccgcgggu

SEQ ID NO: 3578635 - RNA, 23 nt, Pseudomonas putida KT2440
cuggcugccgcggguggcuucgu

SEQ ID NO: 3578636 - RNA, 12 nt, Pseudomonas putida KT2440
cuggcugccgcu

SEQ ID NO: 3578637 - RNA, 13 nt, Pseudomonas putida KT2440
cuggcugccgcug

SEQ ID NO: 3578638 - RNA, 20 nt, Pseudomonas putida KT2440
cuggcugccgcugaccaccg

SEQ ID NO: 3578639 - RNA, 19 nt, Pseudomonas putida KT2440
cuggcugccuucgcucagg

SEQ ID NO: 3578640 - RNA, 12 nt, Pseudomonas putida KT2440
cuggcugcgggu

SEQ ID NO: 3578641 - RNA, 23 nt, Pseudomonas putida KT2440
cuggcugcugugguuuggcccgg

SEQ ID NO: 3578642 - RNA, 12 nt, Pseudomonas putida KT2440
cuggcugggcuu

SEQ ID NO: 3578643 - RNA, 15 nt, Pseudomonas putida KT2440
cuggcugggcuucga

SEQ ID NO: 3578644 - RNA, 16 nt, Pseudomonas putida KT2440
cuggcugggcuucgac

SEQ ID NO: 3578645 - RNA, 17 nt, Pseudomonas putida KT2440
cuggcugggcuucgaca

SEQ ID NO: 3578646 - RNA, 20 nt, Pseudomonas putida KT2440
cuggcuguaccggccucuuc

SEQ ID NO: 3578647 - RNA, 21 nt, Pseudomonas putida KT2440
cuggcuguaccggccucuucg

SEQ ID NO: 3578648 - RNA, 15 nt, Pseudomonas putida KT2440
cuggcugucgaaggc

SEQ ID NO: 3578649 - RNA, 16 nt, Pseudomonas putida KT2440
cuggcugucgaaggcu

SEQ ID NO: 3578650 - RNA, 20 nt, Pseudomonas putida KT2440
cuggcugucgaaggcuugca

SEQ ID NO: 3578651 - RNA, 19 nt, Pseudomonas putida KT2440
cuggcuuacaucaugccgc

SEQ ID NO: 3578652 - RNA, 18 nt, Pseudomonas putida KT2440
cuggcuuagcgcgggccu

SEQ ID NO: 3578653 - RNA, 22 nt, Pseudomonas putida KT2440
cuggcuucaaguuuggcuuugc

SEQ ID NO: 3578654 - RNA, 16 nt, Pseudomonas putida KT2440
cuggcuuccucacggc

SEQ ID NO: 3578655 - RNA, 14 nt, Pseudomonas putida KT2440
cuggcuuccucuuc

SEQ ID NO: 3578656 - RNA, 15 nt, Pseudomonas putida KT2440
cuggcuuuccagguc

SEQ ID NO: 3578657 - RNA, 17 nt, Pseudomonas putida KT2440
cuggcuuucccccagcc

SEQ ID NO: 3578658 - RNA, 15 nt, Pseudomonas putida KT2440
cuggcuuuggagccu

SEQ ID NO: 3578659 - RNA, 20 nt, Pseudomonas putida KT2440
cugggaaaccgugucgggca

SEQ ID NO: 3578660 - RNA, 21 nt, Pseudomonas putida KT2440
cugggcaauguucgcugccag

SEQ ID NO: 3578661 - RNA, 14 nt, Pseudomonas putida KT2440
cugggcauccagcu

SEQ ID NO: 3578662 - RNA, 15 nt, Pseudomonas putida KT2440
cugggcaugagccug

SEQ ID NO: 3578663 - RNA, 20 nt, Pseudomonas putida KT2440
cugggcaugagccuggccgg

SEQ ID NO: 3578664 - RNA, 16 nt, Pseudomonas putida KT2440
cugggccccaggcggu

SEQ ID NO: 3578665 - RNA, 19 nt, Pseudomonas putida KT2440
cugggccccaggcggugca

SEQ ID NO: 3578666 - RNA, 18 nt, Pseudomonas putida KT2440
cugggcccgcccagcugg

SEQ ID NO: 3578667 - RNA, 19 nt, Pseudomonas putida KT2440
cugggcccgcccagcuggc

SEQ ID NO: 3578668 - RNA, 20 nt, Pseudomonas putida KT2440
cugggcccgcccagcuggcu

SEQ ID NO: 3578669 - RNA, 16 nt, Pseudomonas putida KT2440
cugggccgguccuuuc

SEQ ID NO: 3578670 - RNA, 23 nt, Pseudomonas putida KT2440
cugggccggugggcaacagcugc

SEQ ID NO: 3578671 - RNA, 12 nt, Pseudomonas putida KT2440
cugggccucauc

SEQ ID NO: 3578672 - RNA, 13 nt, Pseudomonas putida KT2440
cugggccucauca

SEQ ID NO: 3578673 - RNA, 18 nt, Pseudomonas putida KT2440
cugggcgaacgccugcag

SEQ ID NO: 3578674 - RNA, 14 nt, Pseudomonas putida KT2440
cugggcgagcaggu

SEQ ID NO: 3578675 - RNA, 22 nt, Pseudomonas putida KT2440
cugggcgaugaucgccuggccg

SEQ ID NO: 3578676 - RNA, 23 nt, Pseudomonas putida KT2440
cugggcgaugaucgccuggccgg

SEQ ID NO: 3578677 - RNA, 13 nt, Pseudomonas putida KT2440
cugggcgcuuugc

SEQ ID NO: 3578678 - RNA, 20 nt, Pseudomonas putida KT2440
cugggcgcuuugcacccgcg

SEQ ID NO: 3578679 - RNA, 17 nt, Pseudomonas putida KT2440
cugggcgucaucacccg

SEQ ID NO: 3578680 - RNA, 20 nt, Pseudomonas putida KT2440
cugggcgucaucacccggga

SEQ ID NO: 3578681 - RNA, 17 nt, Pseudomonas putida KT2440
cugggcgugaaagcagg

SEQ ID NO: 3578682 - RNA, 17 nt, Pseudomonas putida KT2440
cugggcgugacggcgau

SEQ ID NO: 3578683 - RNA, 18 nt, Pseudomonas putida KT2440
cugggcgugccaggcuug

SEQ ID NO: 3578684 - RNA, 19 nt, Pseudomonas putida KT2440
cugggcgugccaggcuugg

SEQ ID NO: 3578685 - RNA, 23 nt, Pseudomonas putida KT2440
cugggcguucugacaacuaucga

SEQ ID NO: 3578686 - RNA, 15 nt, Pseudomonas putida KT2440
cugggcuuacggucu

SEQ ID NO: 3578687 - RNA, 17 nt, Pseudomonas putida KT2440
cugggcuucgacaaccg

SEQ ID NO: 3578688 - RNA, 22 nt, Pseudomonas putida KT2440
cugggcuucgacaaccggggca

SEQ ID NO: 3578689 - RNA, 22 nt, Pseudomonas putida KT2440
cugggcuucuaccugagcuuca

SEQ ID NO: 3578690 - RNA, 21 nt, Pseudomonas putida KT2440
cugggcuucuucgugcgccuc

SEQ ID NO: 3578691 - RNA, 20 nt, Pseudomonas putida KT2440
cugggcuuugggagcagugg

SEQ ID NO: 3578692 - RNA, 24 nt, Pseudomonas putida KT2440
cuggggauggcaccggcucugccg

SEQ ID NO: 3578693 - RNA, 23 nt, Pseudomonas putida KT2440
cuggggcaggcccggcagguuga

SEQ ID NO: 3578694 - RNA, 18 nt, Pseudomonas putida KT2440
cuggggccagccggcgcu

SEQ ID NO: 3578695 - RNA, 12 nt, Pseudomonas putida KT2440
cuggggccgcaa

SEQ ID NO: 3578696 - RNA, 15 nt, Pseudomonas putida KT2440
cuggggccgcaaagc

SEQ ID NO: 3578697 - RNA, 12 nt, Pseudomonas putida KT2440
cuggggcugacg

SEQ ID NO: 3578698 - RNA, 17 nt, Pseudomonas putida KT2440
cuggggcugcaccgcag

SEQ ID NO: 3578699 - RNA, 20 nt, Pseudomonas putida KT2440
cuggggcugcaccgcagccc

SEQ ID NO: 3578700 - RNA, 14 nt, Pseudomonas putida KT2440
cuggggcuucugcc

SEQ ID NO: 3578701 - RNA, 16 nt, Pseudomonas putida KT2440
cuggggcuucugccgg

SEQ ID NO: 3578702 - RNA, 15 nt, Pseudomonas putida KT2440
cugggguuggaccca

SEQ ID NO: 3578703 - RNA, 17 nt, Pseudomonas putida KT2440
cuggguaccgugcugca

SEQ ID NO: 3578704 - RNA, 20 nt, Pseudomonas putida KT2440
cuggguaucguucuccagcu

SEQ ID NO: 3578705 - RNA, 15 nt, Pseudomonas putida KT2440
cugggucacccaggu

SEQ ID NO: 3578706 - RNA, 17 nt, Pseudomonas putida KT2440
cugggucacccagguga

SEQ ID NO: 3578707 - RNA, 21 nt, Pseudomonas putida KT2440
cugggucaggcguaugugcac

SEQ ID NO: 3578708 - RNA, 13 nt, Pseudomonas putida KT2440
cuggguccaggca

SEQ ID NO: 3578709 - RNA, 16 nt, Pseudomonas putida KT2440
cuggguccaggcacac

SEQ ID NO: 3578710 - RNA, 23 nt, Pseudomonas putida KT2440
cugggugaccaccagcaacaucg

SEQ ID NO: 3578711 - RNA, 19 nt, Pseudomonas putida KT2440
cugggugccaucagggcga

SEQ ID NO: 3578712 - RNA, 20 nt, Pseudomonas putida KT2440
cugggugugcgccgucacca

SEQ ID NO: 3578713 - RNA, 22 nt, Pseudomonas putida KT2440
cuggguuuuuuuaugggcagca

SEQ ID NO: 3578714 - RNA, 17 nt, Pseudomonas putida KT2440
cugguaaaguucuucuu

SEQ ID NO: 3578715 - RNA, 15 nt, Pseudomonas putida KT2440
cugguaacucaccac

SEQ ID NO: 3578716 - RNA, 13 nt, Pseudomonas putida KT2440
cugguaauccucg

SEQ ID NO: 3578717 - RNA, 19 nt, Pseudomonas putida KT2440
cugguaaugcucuccagcg

SEQ ID NO: 3578718 - RNA, 22 nt, Pseudomonas putida KT2440
cugguaaugcucuccagcgaug

SEQ ID NO: 3578719 - RNA, 20 nt, Pseudomonas putida KT2440
cugguacaacaacaaaaaaa

SEQ ID NO: 3578720 - RNA, 16 nt, Pseudomonas putida KT2440
cugguacagauggcac

SEQ ID NO: 3578721 - RNA, 14 nt, Pseudomonas putida KT2440
cugguacagcagga

SEQ ID NO: 3578722 - RNA, 19 nt, Pseudomonas putida KT2440
cugguacaugccgccgaug

SEQ ID NO: 3578723 - RNA, 22 nt, Pseudomonas putida KT2440
cugguagucauccucuucguug

SEQ ID NO: 3578724 - RNA, 18 nt, Pseudomonas putida KT2440
cugguaguucaucgccca

SEQ ID NO: 3578725 - RNA, 15 nt, Pseudomonas putida KT2440
cuggucaaacaaugc

SEQ ID NO: 3578726 - RNA, 16 nt, Pseudomonas putida KT2440
cuggucacccagcgcu

SEQ ID NO: 3578727 - RNA, 18 nt, Pseudomonas putida KT2440
cuggucacccugacgcug

SEQ ID NO: 3578728 - RNA, 20 nt, Pseudomonas putida KT2440
cuggucacccugacgcugca

SEQ ID NO: 3578729 - RNA, 15 nt, Pseudomonas putida KT2440
cuggucacggccacc

SEQ ID NO: 3578730 - RNA, 18 nt, Pseudomonas putida KT2440
cuggucacucugccgccc

SEQ ID NO: 3578731 - RNA, 22 nt, Pseudomonas putida KT2440
cuggucagucgagucgacagug

SEQ ID NO: 3578732 - RNA, 15 nt, Pseudomonas putida KT2440
cuggucauacuccag

SEQ ID NO: 3578733 - RNA, 17 nt, Pseudomonas putida KT2440
cuggucaucgaagccaa

SEQ ID NO: 3578734 - RNA, 15 nt, Pseudomonas putida KT2440
cuggucaugcagcgg

SEQ ID NO: 3578735 - RNA, 16 nt, Pseudomonas putida KT2440
cugguccacgguucug

SEQ ID NO: 3578736 - RNA, 18 nt, Pseudomonas putida KT2440
cugguccacgguucuggc

SEQ ID NO: 3578737 - RNA, 22 nt, Pseudomonas putida KT2440
cugguccacgguucuggcagcu

SEQ ID NO: 3578738 - RNA, 20 nt, Pseudomonas putida KT2440
cugguccgggcccaugccac

SEQ ID NO: 3578739 - RNA, 16 nt, Pseudomonas putida KT2440
cugguccgugagaaag

SEQ ID NO: 3578740 - RNA, 13 nt, Pseudomonas putida KT2440
cugguccuccccu

SEQ ID NO: 3578741 - RNA, 22 nt, Pseudomonas putida KT2440
cuggucgaaccaguacugggcg

SEQ ID NO: 3578742 - RNA, 17 nt, Pseudomonas putida KT2440
cuggucgaaggucaggc

SEQ ID NO: 3578743 - RNA, 11 nt, Pseudomonas putida KT2440
cuggucgaccg

SEQ ID NO: 3578744 - RNA, 20 nt, Pseudomonas putida KT2440
cuggucgccgccacccacca

SEQ ID NO: 3578745 - RNA, 22 nt, Pseudomonas putida KT2440
cuggucgccgugcagcaccgcu

SEQ ID NO: 3578746 - RNA, 22 nt, Pseudomonas putida KT2440
cuggucgcgugccgccaguucg

SEQ ID NO: 3578747 - RNA, 14 nt, Pseudomonas putida KT2440
cuggucggccaccc

SEQ ID NO: 3578748 - RNA, 22 nt, Pseudomonas putida KT2440
cuggucggccuugccgcuguug

SEQ ID NO: 3578749 - RNA, 18 nt, Pseudomonas putida KT2440
cuggucggcuauggcgcg

SEQ ID NO: 3578750 - RNA, 21 nt, Pseudomonas putida KT2440
cuggucuucguuacgcccggc

SEQ ID NO: 3578751 - RNA, 17 nt, Pseudomonas putida KT2440
cuggugaaggcagguca

SEQ ID NO: 3578752 - RNA, 22 nt, Pseudomonas putida KT2440
cuggugaaggcaggucagcgag

SEQ ID NO: 3578753 - RNA, 15 nt, Pseudomonas putida KT2440
cuggugaaucagccc

SEQ ID NO: 3578754 - RNA, 17 nt, Pseudomonas putida KT2440
cuggugaaucagcccca

SEQ ID NO: 3578755 - RNA, 19 nt, Pseudomonas putida KT2440
cuggugaaucagccccagc

SEQ ID NO: 3578756 - RNA, 19 nt, Pseudomonas putida KT2440
cuggugagcguccaucuug

SEQ ID NO: 3578757 - RNA, 23 nt, Pseudomonas putida KT2440
cuggugcaggcguucgucaagcu

SEQ ID NO: 3578758 - RNA, 14 nt, Pseudomonas putida KT2440
cuggugcagguuga

SEQ ID NO: 3578759 - RNA, 19 nt, Pseudomonas putida KT2440
cuggugcagguugauccag

SEQ ID NO: 3578760 - RNA, 21 nt, Pseudomonas putida KT2440
cuggugcucugcaggcacacc

SEQ ID NO: 3578761 - RNA, 14 nt, Pseudomonas putida KT2440
cugguggacacugc

SEQ ID NO: 3578762 - RNA, 15 nt, Pseudomonas putida KT2440
cugguggcaaugcca

SEQ ID NO: 3578763 - RNA, 12 nt, Pseudomonas putida KT2440
cugguggccacg

SEQ ID NO: 3578764 - RNA, 15 nt, Pseudomonas putida KT2440
cugguggccacgccg

SEQ ID NO: 3578765 - RNA, 17 nt, Pseudomonas putida KT2440
cugguggcguggcugcg

SEQ ID NO: 3578766 - RNA, 17 nt, Pseudomonas putida KT2440
cuggugguugaggcggg

SEQ ID NO: 3578767 - RNA, 15 nt, Pseudomonas putida KT2440
cuggugucggccagg

SEQ ID NO: 3578768 - RNA, 16 nt, Pseudomonas putida KT2440
cugguguggcgccagg

SEQ ID NO: 3578769 - RNA, 23 nt, Pseudomonas putida KT2440
cugguguugaccucugguuuugu

SEQ ID NO: 3578770 - RNA, 16 nt, Pseudomonas putida KT2440
cugguuagcgucgaug

SEQ ID NO: 3578771 - RNA, 14 nt, Pseudomonas putida KT2440
cugguuauccaggu

SEQ ID NO: 3578772 - RNA, 19 nt, Pseudomonas putida KT2440
cugguucucuucacucaac

SEQ ID NO: 3578773 - RNA, 14 nt, Pseudomonas putida KT2440
cugguucugcugca

SEQ ID NO: 3578774 - RNA, 17 nt, Pseudomonas putida KT2440
cugguucugcugcagcc

SEQ ID NO: 3578775 - RNA, 21 nt, Pseudomonas putida KT2440
cugguucuucgcuguaaccug

SEQ ID NO: 3578776 - RNA, 15 nt, Pseudomonas putida KT2440
cugguugaucaacug

SEQ ID NO: 3578777 - RNA, 18 nt, Pseudomonas putida KT2440
cugguugcccaugcacag

SEQ ID NO: 3578778 - RNA, 19 nt, Pseudomonas putida KT2440
cugguugcguucgucgaug

SEQ ID NO: 3578779 - RNA, 21 nt, Pseudomonas putida KT2440
cugguugcguucgucgauguc

SEQ ID NO: 3578780 - RNA, 18 nt, Pseudomonas putida KT2440
cugguuggugacaugcac

SEQ ID NO: 3578781 - RNA, 19 nt, Pseudomonas putida KT2440
cugguuguaagcgucugga

SEQ ID NO: 3578782 - RNA, 18 nt, Pseudomonas putida KT2440
cugguuguagcccgggca

SEQ ID NO: 3578783 - RNA, 16 nt, Pseudomonas putida KT2440
cugguuuggcagcacc

SEQ ID NO: 3578784 - RNA, 15 nt, Pseudomonas putida KT2440
cuguaagucguugaa

SEQ ID NO: 3578785 - RNA, 20 nt, Pseudomonas putida KT2440
cuguaaucaggcuguccaca

SEQ ID NO: 3578786 - RNA, 21 nt, Pseudomonas putida KT2440
cuguaaugucccgucggccuc

SEQ ID NO: 3578787 - RNA, 16 nt, Pseudomonas putida KT2440
cuguacaacgcagccg

SEQ ID NO: 3578788 - RNA, 18 nt, Pseudomonas putida KT2440
cuguacaacgcagccggc

SEQ ID NO: 3578789 - RNA, 19 nt, Pseudomonas putida KT2440
cuguacaacgcagccggca

SEQ ID NO: 3578790 - RNA, 13 nt, Pseudomonas putida KT2440
cuguacacagccc

SEQ ID NO: 3578791 - RNA, 15 nt, Pseudomonas putida KT2440
cuguacacagcccaa

SEQ ID NO: 3578792 - RNA, 18 nt, Pseudomonas putida KT2440
cuguacauccagcuccag

SEQ ID NO: 3578793 - RNA, 15 nt, Pseudomonas putida KT2440
cuguacccgcuggcu

SEQ ID NO: 3578794 - RNA, 14 nt, Pseudomonas putida KT2440
cuguaccgccguca

SEQ ID NO: 3578795 - RNA, 19 nt, Pseudomonas putida KT2440
cuguaccggccucuucgcg

SEQ ID NO: 3578796 - RNA, 14 nt, Pseudomonas putida KT2440
cuguacugcggcug

SEQ ID NO: 3578797 - RNA, 16 nt, Pseudomonas putida KT2440
cuguacuugucugcca

SEQ ID NO: 3578798 - RNA, 14 nt, Pseudomonas putida KT2440
cuguagagcgccuu

SEQ ID NO: 3578799 - RNA, 15 nt, Pseudomonas putida KT2440
cuguaggagcggguu

SEQ ID NO: 3578800 - RNA, 22 nt, Pseudomonas putida KT2440
cuguaggaucggguuuacccgc

SEQ ID NO: 3578801 - RNA, 14 nt, Pseudomonas putida KT2440
cuguaggcaaacag

SEQ ID NO: 3578802 - RNA, 21 nt, Pseudomonas putida KT2440
cuguaggcgcaacucagcgca

SEQ ID NO: 3578803 - RNA, 15 nt, Pseudomonas putida KT2440
cuguaggcgcggguu

SEQ ID NO: 3578804 - RNA, 16 nt, Pseudomonas putida KT2440
cuguaggcgcggguuu

SEQ ID NO: 3578805 - RNA, 13 nt, Pseudomonas putida KT2440
cuguaggggggcc

SEQ ID NO: 3578806 - RNA, 17 nt, Pseudomonas putida KT2440
cuguaugauucgccucc

SEQ ID NO: 3578807 - RNA, 19 nt, Pseudomonas putida KT2440
cuguaugauucgccucccg

SEQ ID NO: 3578808 - RNA, 17 nt, Pseudomonas putida KT2440
cuguauggcgucugcgu

SEQ ID NO: 3578809 - RNA, 22 nt, Pseudomonas putida KT2440
cuguauguguguguccgccacc

SEQ ID NO: 3578810 - RNA, 23 nt, Pseudomonas putida KT2440
cuguauguguguguccgccacca

SEQ ID NO: 3578811 - RNA, 17 nt, Pseudomonas putida KT2440
cugucaagcguuuuuug

SEQ ID NO: 3578812 - RNA, 19 nt, Pseudomonas putida KT2440
cugucaagcguuuuuugga

SEQ ID NO: 3578813 - RNA, 15 nt, Pseudomonas putida KT2440
cugucacccgcugca

SEQ ID NO: 3578814 - RNA, 19 nt, Pseudomonas putida KT2440
cugucacccgcugcacguc

SEQ ID NO: 3578815 - RNA, 16 nt, Pseudomonas putida KT2440
cugucacccuugggca

SEQ ID NO: 3578816 - RNA, 19 nt, Pseudomonas putida KT2440
cugucacccuugggcacca

SEQ ID NO: 3578817 - RNA, 23 nt, Pseudomonas putida KT2440
cugucacgacaggggcgcagagc

SEQ ID NO: 3578818 - RNA, 18 nt, Pseudomonas putida KT2440
cugucagaacgccgggag

SEQ ID NO: 3578819 - RNA, 13 nt, Pseudomonas putida KT2440
cugucagcgccag

SEQ ID NO: 3578820 - RNA, 22 nt, Pseudomonas putida KT2440
cuguccacaccaaagucagcca

SEQ ID NO: 3578821 - RNA, 14 nt, Pseudomonas putida KT2440
cuguccagacgccg

SEQ ID NO: 3578822 - RNA, 19 nt, Pseudomonas putida KT2440
cuguccagcaagggccugu

SEQ ID NO: 3578823 - RNA, 21 nt, Pseudomonas putida KT2440
cuguccagcaagggccugugc

SEQ ID NO: 3578824 - RNA, 13 nt, Pseudomonas putida KT2440
cuguccagcgcau

SEQ ID NO: 3578825 - RNA, 13 nt, Pseudomonas putida KT2440
cugucccccagcc

SEQ ID NO: 3578826 - RNA, 16 nt, Pseudomonas putida KT2440
cuguccccccagggcg

SEQ ID NO: 3578827 - RNA, 23 nt, Pseudomonas putida KT2440
cuguccccccagggcgcaacgcc

SEQ ID NO: 3578828 - RNA, 16 nt, Pseudomonas putida KT2440
cuguccccuuggcccu

SEQ ID NO: 3578829 - RNA, 18 nt, Pseudomonas putida KT2440
cuguccgggcucgucacg

SEQ ID NO: 3578830 - RNA, 14 nt, Pseudomonas putida KT2440
cuguccuccugccg

SEQ ID NO: 3578831 - RNA, 17 nt, Pseudomonas putida KT2440
cuguccuggguuacggc

SEQ ID NO: 3578832 - RNA, 14 nt, Pseudomonas putida KT2440
cuguccuuggccaa

SEQ ID NO: 3578833 - RNA, 18 nt, Pseudomonas putida KT2440
cugucgaacaggcugccg

SEQ ID NO: 3578834 - RNA, 19 nt, Pseudomonas putida KT2440
cugucgaagcgcucccagg

SEQ ID NO: 3578835 - RNA, 21 nt, Pseudomonas putida KT2440
cugucgaagcgcucccaggcc

SEQ ID NO: 3578836 - RNA, 18 nt, Pseudomonas putida KT2440
cugucgagcagguucagg

SEQ ID NO: 3578837 - RNA, 22 nt, Pseudomonas putida KT2440
cugucgagcagguucaggcgca

SEQ ID NO: 3578838 - RNA, 17 nt, Pseudomonas putida KT2440
cugucgagcauccaggu

SEQ ID NO: 3578839 - RNA, 18 nt, Pseudomonas putida KT2440
cugucgagcuuggcgucc

SEQ ID NO: 3578840 - RNA, 19 nt, Pseudomonas putida KT2440
cugucgagcuuggcgucca

SEQ ID NO: 3578841 - RNA, 17 nt, Pseudomonas putida KT2440
cugucgaucacgggcaa

SEQ ID NO: 3578842 - RNA, 17 nt, Pseudomonas putida KT2440
cugucgauuuccagugc

SEQ ID NO: 3578843 - RNA, 18 nt, Pseudomonas putida KT2440
cugucgauuuccagugcc

SEQ ID NO: 3578844 - RNA, 23 nt, Pseudomonas putida KT2440
cugucgauuuccagugccgccac

SEQ ID NO: 3578845 - RNA, 22 nt, Pseudomonas putida KT2440
cugucgcagaagcgugcgaagu

SEQ ID NO: 3578846 - RNA, 15 nt, Pseudomonas putida KT2440
cugucgcuacgcgcc

SEQ ID NO: 3578847 - RNA, 15 nt, Pseudomonas putida KT2440
cugucggggccucuu

SEQ ID NO: 3578848 - RNA, 18 nt, Pseudomonas putida KT2440
cugucggguuggucgcca

SEQ ID NO: 3578849 - RNA, 19 nt, Pseudomonas putida KT2440
cugucggguuggucgccag

SEQ ID NO: 3578850 - RNA, 13 nt, Pseudomonas putida KT2440
cugucggucagca

SEQ ID NO: 3578851 - RNA, 16 nt, Pseudomonas putida KT2440
cugucggucagccaga

SEQ ID NO: 3578852 - RNA, 17 nt, Pseudomonas putida KT2440
cugucggucagccagau

SEQ ID NO: 3578853 - RNA, 16 nt, Pseudomonas putida KT2440
cugucgguggggugcc

SEQ ID NO: 3578854 - RNA, 15 nt, Pseudomonas putida KT2440
cugucgucagcucag

SEQ ID NO: 3578855 - RNA, 13 nt, Pseudomonas putida KT2440
cugucguccagcu

SEQ ID NO: 3578856 - RNA, 20 nt, Pseudomonas putida KT2440
cugucguuauccugcagcac

SEQ ID NO: 3578857 - RNA, 13 nt, Pseudomonas putida KT2440
cugucguugaucc

SEQ ID NO: 3578858 - RNA, 17 nt, Pseudomonas putida KT2440
cugucuagccgccugcc

SEQ ID NO: 3578859 - RNA, 14 nt, Pseudomonas putida KT2440
cugucuccauucca

SEQ ID NO: 3578860 - RNA, 12 nt, Pseudomonas putida KT2440
cugucugcagcu

SEQ ID NO: 3578861 - RNA, 16 nt, Pseudomonas putida KT2440
cugucuuccagggcaa

SEQ ID NO: 3578862 - RNA, 12 nt, Pseudomonas putida KT2440
cugucuucuuuc

SEQ ID NO: 3578863 - RNA, 16 nt, Pseudomonas putida KT2440
cugugaagccagggca

SEQ ID NO: 3578864 - RNA, 17 nt, Pseudomonas putida KT2440
cugugaagccagggcaa

SEQ ID NO: 3578865 - RNA, 20 nt, Pseudomonas putida KT2440
cugugaaugcgaugguggcu

SEQ ID NO: 3578866 - RNA, 19 nt, Pseudomonas putida KT2440
cugugagauuccgggcugc

SEQ ID NO: 3578867 - RNA, 16 nt, Pseudomonas putida KT2440
cugugcaacagcgccu

SEQ ID NO: 3578868 - RNA, 18 nt, Pseudomonas putida KT2440
cugugcaacagcgccugg

SEQ ID NO: 3578869 - RNA, 20 nt, Pseudomonas putida KT2440
cugugcaacagcgccuggcg

SEQ ID NO: 3578870 - RNA, 20 nt, Pseudomonas putida KT2440
cugugcacccgugccugccu

SEQ ID NO: 3578871 - RNA, 21 nt, Pseudomonas putida KT2440
cugugcacccgugccugccug

SEQ ID NO: 3578872 - RNA, 19 nt, Pseudomonas putida KT2440
cugugcagcgaccaucacc

SEQ ID NO: 3578873 - RNA, 16 nt, Pseudomonas putida KT2440
cugugcagcgcucgcu

SEQ ID NO: 3578874 - RNA, 18 nt, Pseudomonas putida KT2440
cugugcauguccagucag

SEQ ID NO: 3578875 - RNA, 17 nt, Pseudomonas putida KT2440
cugugcccgccaggcgc

SEQ ID NO: 3578876 - RNA, 18 nt, Pseudomonas putida KT2440
cugugcccgccaggcgca

SEQ ID NO: 3578877 - RNA, 18 nt, Pseudomonas putida KT2440
cugugcccugaucgccuc

SEQ ID NO: 3578878 - RNA, 20 nt, Pseudomonas putida KT2440
cugugcccugaucgccucca

SEQ ID NO: 3578879 - RNA, 17 nt, Pseudomonas putida KT2440
cugugccgaaccaccga

SEQ ID NO: 3578880 - RNA, 17 nt, Pseudomonas putida KT2440
cugugccggcagcgagc

SEQ ID NO: 3578881 - RNA, 13 nt, Pseudomonas putida KT2440
cugugccggccgc

SEQ ID NO: 3578882 - RNA, 22 nt, Pseudomonas putida KT2440
cugugccggccucuucgcgggu

SEQ ID NO: 3578883 - RNA, 13 nt, Pseudomonas putida KT2440
cugugcggcguau

SEQ ID NO: 3578884 - RNA, 19 nt, Pseudomonas putida KT2440
cugugcggcuccggcgugu

SEQ ID NO: 3578885 - RNA, 20 nt, Pseudomonas putida KT2440
cugugcucgcccgggucccg

SEQ ID NO: 3578886 - RNA, 21 nt, Pseudomonas putida KT2440
cugugcuggggccagccggcg

SEQ ID NO: 3578887 - RNA, 20 nt, Pseudomonas putida KT2440
cugugcuuugagcaggcgcu

SEQ ID NO: 3578888 - RNA, 16 nt, Pseudomonas putida KT2440
cuguggaaaaccgcuc

SEQ ID NO: 3578889 - RNA, 14 nt, Pseudomonas putida KT2440
cuguggaagcgggc

SEQ ID NO: 3578890 - RNA, 20 nt, Pseudomonas putida KT2440
cuguggaagugggcuugccc

SEQ ID NO: 3578891 - RNA, 23 nt, Pseudomonas putida KT2440
cuguggcaauuggcggaagccuu

SEQ ID NO: 3578892 - RNA, 16 nt, Pseudomonas putida KT2440
cuguggcccaaggcga

SEQ ID NO: 3578893 - RNA, 23 nt, Pseudomonas putida KT2440
cugugggagcacaagcacgcgcu

SEQ ID NO: 3578894 - RNA, 18 nt, Pseudomonas putida KT2440
cugugggagcggccuugc

SEQ ID NO: 3578895 - RNA, 20 nt, Pseudomonas putida KT2440
cugugggagcgggcaugccc

SEQ ID NO: 3578896 - RNA, 16 nt, Pseudomonas putida KT2440
cugugggagcgggcgu

SEQ ID NO: 3578897 - RNA, 15 nt, Pseudomonas putida KT2440
cugugggagcgggcu

SEQ ID NO: 3578898 - RNA, 21 nt, Pseudomonas putida KT2440
cugugggagcgggcuugcccg

SEQ ID NO: 3578899 - RNA, 16 nt, Pseudomonas putida KT2440
cuguggggcaacugcg

SEQ ID NO: 3578900 - RNA, 13 nt, Pseudomonas putida KT2440
cuguggggcugac

SEQ ID NO: 3578901 - RNA, 16 nt, Pseudomonas putida KT2440
cuguggguaacccugc

SEQ ID NO: 3578902 - RNA, 17 nt, Pseudomonas putida KT2440
cuguguaggagcggguu

SEQ ID NO: 3578903 - RNA, 15 nt, Pseudomonas putida KT2440
cuguguccaacaccc

SEQ ID NO: 3578904 - RNA, 22 nt, Pseudomonas putida KT2440
cuguguccacccccgcuccuac

SEQ ID NO: 3578905 - RNA, 17 nt, Pseudomonas putida KT2440
cuguguucgcugcguga

SEQ ID NO: 3578906 - RNA, 23 nt, Pseudomonas putida KT2440
cuguguuuucccaauccucagcg

SEQ ID NO: 3578907 - RNA, 12 nt, Pseudomonas putida KT2440
cuguuaaucauu

SEQ ID NO: 3578908 - RNA, 20 nt, Pseudomonas putida KT2440
cuguuaccagagagcugaga

SEQ ID NO: 3578909 - RNA, 19 nt, Pseudomonas putida KT2440
cuguucagguguuccagca

SEQ ID NO: 3578910 - RNA, 15 nt, Pseudomonas putida KT2440
cuguuccacagcagu

SEQ ID NO: 3578911 - RNA, 16 nt, Pseudomonas putida KT2440
cuguuccacgaccgca

SEQ ID NO: 3578912 - RNA, 22 nt, Pseudomonas putida KT2440
cuguuccagaagcggcuaccgc

SEQ ID NO: 3578913 - RNA, 14 nt, Pseudomonas putida KT2440
cuguuccagcccgg

SEQ ID NO: 3578914 - RNA, 15 nt, Pseudomonas putida KT2440
cuguuccagcccggc

SEQ ID NO: 3578915 - RNA, 19 nt, Pseudomonas putida KT2440
cuguuccauuucacuggcu

SEQ ID NO: 3578916 - RNA, 23 nt, Pseudomonas putida KT2440
cuguucccccaccggccgccgcc

SEQ ID NO: 3578917 - RNA, 17 nt, Pseudomonas putida KT2440
cuguucccucaacaagc

SEQ ID NO: 3578918 - RNA, 22 nt, Pseudomonas putida KT2440
cuguuccggccgcuucgcggau

SEQ ID NO: 3578919 - RNA, 17 nt, Pseudomonas putida KT2440
cuguuccggccucuucg

SEQ ID NO: 3578920 - RNA, 16 nt, Pseudomonas putida KT2440
cuguuccucgccaugg

SEQ ID NO: 3578921 - RNA, 15 nt, Pseudomonas putida KT2440
cuguucgucggccuu

SEQ ID NO: 3578922 - RNA, 17 nt, Pseudomonas putida KT2440
cuguucgucggccuugu

SEQ ID NO: 3578923 - RNA, 15 nt, Pseudomonas putida KT2440
cuguucugcccggcu

SEQ ID NO: 3578924 - RNA, 15 nt, Pseudomonas putida KT2440
cuguugagcagcagc

SEQ ID NO: 3578925 - RNA, 16 nt, Pseudomonas putida KT2440
cuguugagcagcagcc

SEQ ID NO: 3578926 - RNA, 21 nt, Pseudomonas putida KT2440
cuguugagcagcagcccuucg

SEQ ID NO: 3578927 - RNA, 13 nt, Pseudomonas putida KT2440
cuguugcagcgcc

SEQ ID NO: 3578928 - RNA, 14 nt, Pseudomonas putida KT2440
cuguugccgcuucg

SEQ ID NO: 3578929 - RNA, 20 nt, Pseudomonas putida KT2440
cuguugcgcaccuugugcac

SEQ ID NO: 3578930 - RNA, 14 nt, Pseudomonas putida KT2440
cuguugcgcugggc

SEQ ID NO: 3578931 - RNA, 22 nt, Pseudomonas putida KT2440
cuguugcgucaacucaucacuc

SEQ ID NO: 3578932 - RNA, 12 nt, Pseudomonas putida KT2440
cuguugcugcag

SEQ ID NO: 3578933 - RNA, 14 nt, Pseudomonas putida KT2440
cuguugcugcaggu

SEQ ID NO: 3578934 - RNA, 16 nt, Pseudomonas putida KT2440
cuguuggcacggcuga

SEQ ID NO: 3578935 - RNA, 14 nt, Pseudomonas putida KT2440
cuguuggcagccac

SEQ ID NO: 3578936 - RNA, 15 nt, Pseudomonas putida KT2440
cuguuggcgcgacau

SEQ ID NO: 3578937 - RNA, 16 nt, Pseudomonas putida KT2440
cuguuggcgcgacaug

SEQ ID NO: 3578938 - RNA, 19 nt, Pseudomonas putida KT2440
cuguuguccccgccgugca

SEQ ID NO: 3578939 - RNA, 22 nt, Pseudomonas putida KT2440
cuguugucggccagaucggcca

SEQ ID NO: 3578940 - RNA, 12 nt, Pseudomonas putida KT2440
cuguuucaccag

SEQ ID NO: 3578941 - RNA, 19 nt, Pseudomonas putida KT2440
cuguuucgcccaaauguua

SEQ ID NO: 3578942 - RNA, 22 nt, Pseudomonas putida KT2440
cuguuucggguaggucaccauc

SEQ ID NO: 3578943 - RNA, 23 nt, Pseudomonas putida KT2440
cuguuucuucaaggccgccaccu

SEQ ID NO: 3578944 - RNA, 23 nt, Pseudomonas putida KT2440
cuguuugagccggcgcugggcuu

SEQ ID NO: 3578945 - RNA, 13 nt, Pseudomonas putida KT2440
cuguuugcugguc

SEQ ID NO: 3578946 - RNA, 14 nt, Pseudomonas putida KT2440
cuguuuggccgcau

SEQ ID NO: 3578947 - RNA, 14 nt, Pseudomonas putida KT2440
cuguuuucaaggcg

SEQ ID NO: 3578948 - RNA, 16 nt, Pseudomonas putida KT2440
cuuaacgcuuggccag

SEQ ID NO: 3578949 - RNA, 13 nt, Pseudomonas putida KT2440
cuuaaucccgcaa

SEQ ID NO: 3578950 - RNA, 22 nt, Pseudomonas putida KT2440
cuuacaaaucaguaaguugaau

SEQ ID NO: 3578951 - RNA, 15 nt, Pseudomonas putida KT2440
cuuacaacugcucca

SEQ ID NO: 3578952 - RNA, 17 nt, Pseudomonas putida KT2440
cuuacacgcaagccccc

SEQ ID NO: 3578953 - RNA, 16 nt, Pseudomonas putida KT2440
cuuacagaugcugcug

SEQ ID NO: 3578954 - RNA, 20 nt, Pseudomonas putida KT2440
cuuacagaugucuggcauca

SEQ ID NO: 3578955 - RNA, 22 nt, Pseudomonas putida KT2440
cuuaccaguaguucucgacagc

SEQ ID NO: 3578956 - RNA, 17 nt, Pseudomonas putida KT2440
cuuacgacgagggcagg

SEQ ID NO: 3578957 - RNA, 17 nt, Pseudomonas putida KT2440
cuuacuaucacgccuug

SEQ ID NO: 3578958 - RNA, 19 nt, Pseudomonas putida KT2440
cuuacuuggucaccgucac

SEQ ID NO: 3578959 - RNA, 22 nt, Pseudomonas putida KT2440
cuuagacgguuacgugcaggcg

SEQ ID NO: 3578960 - RNA, 18 nt, Pseudomonas putida KT2440
cuuagcgggcaaauccgc

SEQ ID NO: 3578961 - RNA, 23 nt, Pseudomonas putida KT2440
cuuaguauuuuuaccugcuccug

SEQ ID NO: 3578962 - RNA, 16 nt, Pseudomonas putida KT2440
cuuauaagcagcaagc

SEQ ID NO: 3578963 - RNA, 14 nt, Pseudomonas putida KT2440
cuucaaaaccagau

SEQ ID NO: 3578964 - RNA, 18 nt, Pseudomonas putida KT2440
cuucaaacacuucaucuc

SEQ ID NO: 3578965 - RNA, 12 nt, Pseudomonas putida KT2440
cuucaaacccgg

SEQ ID NO: 3578966 - RNA, 13 nt, Pseudomonas putida KT2440
cuucaaauagaag

SEQ ID NO: 3578967 - RNA, 23 nt, Pseudomonas putida KT2440
cuucaacagcuucuugcaccgcu

SEQ ID NO: 3578968 - RNA, 15 nt, Pseudomonas putida KT2440
cuucaaccaguucag

SEQ ID NO: 3578969 - RNA, 21 nt, Pseudomonas putida KT2440
cuucaaccgugguucuugccg

SEQ ID NO: 3578970 - RNA, 19 nt, Pseudomonas putida KT2440
cuucaacucggacaaccaa

SEQ ID NO: 3578971 - RNA, 14 nt, Pseudomonas putida KT2440
cuucaagcaccgcg

SEQ ID NO: 3578972 - RNA, 17 nt, Pseudomonas putida KT2440
cuucaagcaccgcgcac

SEQ ID NO: 3578973 - RNA, 22 nt, Pseudomonas putida KT2440
cuucaagcaccgcgcacacuuc

SEQ ID NO: 3578974 - RNA, 14 nt, Pseudomonas putida KT2440
cuucaagcacgccg

SEQ ID NO: 3578975 - RNA, 23 nt, Pseudomonas putida KT2440
cuucaagcagcgaaugcagcucg

SEQ ID NO: 3578976 - RNA, 13 nt, Pseudomonas putida KT2440
cuucaagcaggua

SEQ ID NO: 3578977 - RNA, 22 nt, Pseudomonas putida KT2440
cuucaagccauauucagcuuca

SEQ ID NO: 3578978 - RNA, 17 nt, Pseudomonas putida KT2440
cuucaagcuccccagca

SEQ ID NO: 3578979 - RNA, 15 nt, Pseudomonas putida KT2440
cuucaaggcugcucu

SEQ ID NO: 3578980 - RNA, 14 nt, Pseudomonas putida KT2440
cuucaaggggcccc

SEQ ID NO: 3578981 - RNA, 15 nt, Pseudomonas putida KT2440
cuucaagguuggggc

SEQ ID NO: 3578982 - RNA, 20 nt, Pseudomonas putida KT2440
cuucaaguuuggcuuugccc

SEQ ID NO: 3578983 - RNA, 13 nt, Pseudomonas putida KT2440
cuucaauggcacc

SEQ ID NO: 3578984 - RNA, 19 nt, Pseudomonas putida KT2440
cuucacagcguugcagaaa

SEQ ID NO: 3578985 - RNA, 14 nt, Pseudomonas putida KT2440
cuucacauccaccg

SEQ ID NO: 3578986 - RNA, 12 nt, Pseudomonas putida KT2440
cuucaccaccag

SEQ ID NO: 3578987 - RNA, 13 nt, Pseudomonas putida KT2440
cuucaccagcuuc

SEQ ID NO: 3578988 - RNA, 18 nt, Pseudomonas putida KT2440
cuucacccgcagcaacag

SEQ ID NO: 3578989 - RNA, 16 nt, Pseudomonas putida KT2440
cuucaccgcgcaccuc

SEQ ID NO: 3578990 - RNA, 17 nt, Pseudomonas putida KT2440
cuucaccgcgcaccucc

SEQ ID NO: 3578991 - RNA, 21 nt, Pseudomonas putida KT2440
cuucaccgcgcaccuccugcg

SEQ ID NO: 3578992 - RNA, 15 nt, Pseudomonas putida KT2440
cuucaccgucggcgc

SEQ ID NO: 3578993 - RNA, 13 nt, Pseudomonas putida KT2440
cuucaccuugccu

SEQ ID NO: 3578994 - RNA, 21 nt, Pseudomonas putida KT2440
cuucacgccagccguugaucc

SEQ ID NO: 3578995 - RNA, 18 nt, Pseudomonas putida KT2440
cuucacggauggcagcga

SEQ ID NO: 3578996 - RNA, 12 nt, Pseudomonas putida KT2440
cuucacggccaa

SEQ ID NO: 3578997 - RNA, 23 nt, Pseudomonas putida KT2440
cuucacggcuuuguuggauccgu

SEQ ID NO: 3578998 - RNA, 24 nt, Pseudomonas putida KT2440
cuucacgggucaggugcggggcaa

SEQ ID NO: 3578999 - RNA, 14 nt, Pseudomonas putida KT2440
cuucacguccagcc

SEQ ID NO: 3579000 - RNA, 24 nt, Pseudomonas putida KT2440
cuucacgucuggcaccaguuccag

SEQ ID NO: 3579001 - RNA, 12 nt, Pseudomonas putida KT2440
cuucagaagccu

SEQ ID NO: 3579002 - RNA, 15 nt, Pseudomonas putida KT2440
cuucagaagccuugg

SEQ ID NO: 3579003 - RNA, 21 nt, Pseudomonas putida KT2440
cuucagaagccuuggccuugg

SEQ ID NO: 3579004 - RNA, 15 nt, Pseudomonas putida KT2440
cuucagaucacccuu

SEQ ID NO: 3579005 - RNA, 19 nt, Pseudomonas putida KT2440
cuucagaucacccuuggcc

SEQ ID NO: 3579006 - RNA, 23 nt, Pseudomonas putida KT2440
cuucagaucacccuuggccaccu

SEQ ID NO: 3579007 - RNA, 13 nt, Pseudomonas putida KT2440
cuucagcaggaag

SEQ ID NO: 3579008 - RNA, 13 nt, Pseudomonas putida KT2440
cuucagcaguucg

SEQ ID NO: 3579009 - RNA, 24 nt, Pseudomonas putida KT2440
cuucagccaccgcacucugcugcu

SEQ ID NO: 3579010 - RNA, 14 nt, Pseudomonas putida KT2440
cuucagccagggcg

SEQ ID NO: 3579011 - RNA, 16 nt, Pseudomonas putida KT2440
cuucagccagggcgag

SEQ ID NO: 3579012 - RNA, 17 nt, Pseudomonas putida KT2440
cuucagccagggcgaga

SEQ ID NO: 3579013 - RNA, 16 nt, Pseudomonas putida KT2440
cuucagccgucgccgc

SEQ ID NO: 3579014 - RNA, 17 nt, Pseudomonas putida KT2440
cuucagccuuuuccagc

SEQ ID NO: 3579015 - RNA, 20 nt, Pseudomonas putida KT2440
cuucagccuuuuccagcucg

SEQ ID NO: 3579016 - RNA, 13 nt, Pseudomonas putida KT2440
cuucagcgaccga

SEQ ID NO: 3579017 - RNA, 14 nt, Pseudomonas putida KT2440
cuucagcgcaucga

SEQ ID NO: 3579018 - RNA, 20 nt, Pseudomonas putida KT2440
cuucagcgcggcaaccugcu

SEQ ID NO: 3579019 - RNA, 17 nt, Pseudomonas putida KT2440
cuucaggcgcucacccc

SEQ ID NO: 3579020 - RNA, 18 nt, Pseudomonas putida KT2440
cuucaggcgcucaccccg

SEQ ID NO: 3579021 - RNA, 17 nt, Pseudomonas putida KT2440
cuucaggcugcgccgcc

SEQ ID NO: 3579022 - RNA, 22 nt, Pseudomonas putida KT2440
cuucagggucgggcacaggccc

SEQ ID NO: 3579023 - RNA, 16 nt, Pseudomonas putida KT2440
cuucagguaagucagc

SEQ ID NO: 3579024 - RNA, 20 nt, Pseudomonas putida KT2440
cuucagguaauccaccagcc

SEQ ID NO: 3579025 - RNA, 18 nt, Pseudomonas putida KT2440
cuucagguucacuuccac

SEQ ID NO: 3579026 - RNA, 20 nt, Pseudomonas putida KT2440
cuucagguucacuuccacac

SEQ ID NO: 3579027 - RNA, 16 nt, Pseudomonas putida KT2440
cuucagguucugccgg

SEQ ID NO: 3579028 - RNA, 21 nt, Pseudomonas putida KT2440
cuucagguuuggggugagcga

SEQ ID NO: 3579029 - RNA, 17 nt, Pseudomonas putida KT2440
cuucauaggcggccacg

SEQ ID NO: 3579030 - RNA, 14 nt, Pseudomonas putida KT2440
cuucauaggcuggc

SEQ ID NO: 3579031 - RNA, 18 nt, Pseudomonas putida KT2440
cuucauccaucgcaaucc

SEQ ID NO: 3579032 - RNA, 23 nt, Pseudomonas putida KT2440
cuucaucgccggguccaccagcc

SEQ ID NO: 3579033 - RNA, 15 nt, Pseudomonas putida KT2440
cuucaucggcuggca

SEQ ID NO: 3579034 - RNA, 18 nt, Pseudomonas putida KT2440
cuucaucugucagcgcca

SEQ ID NO: 3579035 - RNA, 20 nt, Pseudomonas putida KT2440
cuucaugaaguacuuggcgc

SEQ ID NO: 3579036 - RNA, 21 nt, Pseudomonas putida KT2440
cuucaugcaauaaccaaucaa

SEQ ID NO: 3579037 - RNA, 22 nt, Pseudomonas putida KT2440
cuucaugcugcugcagcacugc

SEQ ID NO: 3579038 - RNA, 15 nt, Pseudomonas putida KT2440
cuuccaacacccgga

SEQ ID NO: 3579039 - RNA, 24 nt, Pseudomonas putida KT2440
cuuccaaccagccagccaccacca

SEQ ID NO: 3579040 - RNA, 14 nt, Pseudomonas putida KT2440
cuuccacacccagc

SEQ ID NO: 3579041 - RNA, 12 nt, Pseudomonas putida KT2440
cuuccaccaccu

SEQ ID NO: 3579042 - RNA, 18 nt, Pseudomonas putida KT2440
cuuccaccaccuccaucu

SEQ ID NO: 3579043 - RNA, 15 nt, Pseudomonas putida KT2440
cuuccacccgccugc

SEQ ID NO: 3579044 - RNA, 20 nt, Pseudomonas putida KT2440
cuuccaccgggaagcagguc

SEQ ID NO: 3579045 - RNA, 21 nt, Pseudomonas putida KT2440
cuuccaccgggaagcaggucu

SEQ ID NO: 3579046 - RNA, 22 nt, Pseudomonas putida KT2440
cuuccaccgguacauugcgcac

SEQ ID NO: 3579047 - RNA, 16 nt, Pseudomonas putida KT2440
cuuccaccugcgccuu

SEQ ID NO: 3579048 - RNA, 18 nt, Pseudomonas putida KT2440
cuuccaccugcgccuugc

SEQ ID NO: 3579049 - RNA, 15 nt, Pseudomonas putida KT2440
cuuccagcaucgccc

SEQ ID NO: 3579050 - RNA, 19 nt, Pseudomonas putida KT2440
cuuccagcgucucgaugca

SEQ ID NO: 3579051 - RNA, 20 nt, Pseudomonas putida KT2440
cuuccagcuccuucuucacc

SEQ ID NO: 3579052 - RNA, 14 nt, Pseudomonas putida KT2440
cuuccagcuucugc

SEQ ID NO: 3579053 - RNA, 15 nt, Pseudomonas putida KT2440
cuuccagcuucugcu

SEQ ID NO: 3579054 - RNA, 17 nt, Pseudomonas putida KT2440
cuuccaggcgacggaac

SEQ ID NO: 3579055 - RNA, 18 nt, Pseudomonas putida KT2440
cuuccagggcugguuccu

SEQ ID NO: 3579056 - RNA, 11 nt, Pseudomonas putida KT2440
cuuccaggucg

SEQ ID NO: 3579057 - RNA, 16 nt, Pseudomonas putida KT2440
cuuccagguggccgcc

SEQ ID NO: 3579058 - RNA, 14 nt, Pseudomonas putida KT2440
cuuccagucggccu

SEQ ID NO: 3579059 - RNA, 16 nt, Pseudomonas putida KT2440
cuuccagucggccuga

SEQ ID NO: 3579060 - RNA, 21 nt, Pseudomonas putida KT2440
cuuccaguuccauccaguccg

SEQ ID NO: 3579061 - RNA, 18 nt, Pseudomonas putida KT2440
cuuccaguuggccggcau

SEQ ID NO: 3579062 - RNA, 18 nt, Pseudomonas putida KT2440
cuuccauuugcgcuggcu

SEQ ID NO: 3579063 - RNA, 14 nt, Pseudomonas putida KT2440
cuucccacguaccu

SEQ ID NO: 3579064 - RNA, 15 nt, Pseudomonas putida KT2440
cuucccauccacuuc

SEQ ID NO: 3579065 - RNA, 12 nt, Pseudomonas putida KT2440
cuuccccagccu

SEQ ID NO: 3579066 - RNA, 13 nt, Pseudomonas putida KT2440
cuuccccaggccg

SEQ ID NO: 3579067 - RNA, 18 nt, Pseudomonas putida KT2440
cuucccccaaucuccagc

SEQ ID NO: 3579068 - RNA, 16 nt, Pseudomonas putida KT2440
cuuccccccuggccug

SEQ ID NO: 3579069 - RNA, 20 nt, Pseudomonas putida KT2440
cuuccccccuggccuggcca

SEQ ID NO: 3579070 - RNA, 13 nt, Pseudomonas putida KT2440
cuuccccgcccaa

SEQ ID NO: 3579071 - RNA, 18 nt, Pseudomonas putida KT2440
cuucccgccauugcacca

SEQ ID NO: 3579072 - RNA, 14 nt, Pseudomonas putida KT2440
cuucccgccuggcg

SEQ ID NO: 3579073 - RNA, 18 nt, Pseudomonas putida KT2440
cuucccgccuggcgccug

SEQ ID NO: 3579074 - RNA, 14 nt, Pseudomonas putida KT2440
cuucccgcguccag

SEQ ID NO: 3579075 - RNA, 15 nt, Pseudomonas putida KT2440
cuucccgcguccagg

SEQ ID NO: 3579076 - RNA, 16 nt, Pseudomonas putida KT2440
cuucccggcaccgcuu

SEQ ID NO: 3579077 - RNA, 22 nt, Pseudomonas putida KT2440
cuucccggccuggcgcagguac

SEQ ID NO: 3579078 - RNA, 17 nt, Pseudomonas putida KT2440
cuucccgggaaaagccu

SEQ ID NO: 3579079 - RNA, 18 nt, Pseudomonas putida KT2440
cuucccgggaaaagccug

SEQ ID NO: 3579080 - RNA, 17 nt, Pseudomonas putida KT2440
cuucccguucgcggucg

SEQ ID NO: 3579081 - RNA, 18 nt, Pseudomonas putida KT2440
cuuccgaccggucauaca

SEQ ID NO: 3579082 - RNA, 22 nt, Pseudomonas putida KT2440
cuuccggcaacuugcgggucag

SEQ ID NO: 3579083 - RNA, 20 nt, Pseudomonas putida KT2440
cuuccggcaccccuuucucc

SEQ ID NO: 3579084 - RNA, 15 nt, Pseudomonas putida KT2440
cuuccggcugcagca

SEQ ID NO: 3579085 - RNA, 21 nt, Pseudomonas putida KT2440
cuuccguuaguucgugcaccc

SEQ ID NO: 3579086 - RNA, 18 nt, Pseudomonas putida KT2440
cuuccuccgacagcgcag

SEQ ID NO: 3579087 - RNA, 16 nt, Pseudomonas putida KT2440
cuuccucgacccagcc

SEQ ID NO: 3579088 - RNA, 19 nt, Pseudomonas putida KT2440
cuuccucgacccagccacc

SEQ ID NO: 3579089 - RNA, 20 nt, Pseudomonas putida KT2440
cuuccucgacccagccaccc

SEQ ID NO: 3579090 - RNA, 19 nt, Pseudomonas putida KT2440
cuuccuggccuuccuugcc

SEQ ID NO: 3579091 - RNA, 20 nt, Pseudomonas putida KT2440
cuuccuggccuuccuugccc

SEQ ID NO: 3579092 - RNA, 15 nt, Pseudomonas putida KT2440
cuuccuggcuggcag

SEQ ID NO: 3579093 - RNA, 16 nt, Pseudomonas putida KT2440
cuuccuggcuggcagc

SEQ ID NO: 3579094 - RNA, 20 nt, Pseudomonas putida KT2440
cuuccuggcuggcagccggc

SEQ ID NO: 3579095 - RNA, 17 nt, Pseudomonas putida KT2440
cuuccugguuuucgcgg

SEQ ID NO: 3579096 - RNA, 14 nt, Pseudomonas putida KT2440
cuuccugugccgcu

SEQ ID NO: 3579097 - RNA, 22 nt, Pseudomonas putida KT2440
cuuccuugggggugaagcccug

SEQ ID NO: 3579098 - RNA, 20 nt, Pseudomonas putida KT2440
cuucgaacacccgcuugccu

SEQ ID NO: 3579099 - RNA, 18 nt, Pseudomonas putida KT2440
cuucgaagugccacgccg

SEQ ID NO: 3579100 - RNA, 17 nt, Pseudomonas putida KT2440
cuucgacaaccggggca

SEQ ID NO: 3579101 - RNA, 22 nt, Pseudomonas putida KT2440
cuucgacacugaucucgcgcau

SEQ ID NO: 3579102 - RNA, 16 nt, Pseudomonas putida KT2440
cuucgacauggcuggc

SEQ ID NO: 3579103 - RNA, 23 nt, Pseudomonas putida KT2440
cuucgaccauuggacgauuguaa

SEQ ID NO: 3579104 - RNA, 19 nt, Pseudomonas putida KT2440
cuucgauacuugcagcgga

SEQ ID NO: 3579105 - RNA, 12 nt, Pseudomonas putida KT2440
cuucgaucagcg

SEQ ID NO: 3579106 - RNA, 17 nt, Pseudomonas putida KT2440
cuucgaucggcgcgccu

SEQ ID NO: 3579107 - RNA, 21 nt, Pseudomonas putida KT2440
cuucgaucucggccagcaggc

SEQ ID NO: 3579108 - RNA, 20 nt, Pseudomonas putida KT2440
cuucgaucuggaucacugcc

SEQ ID NO: 3579109 - RNA, 21 nt, Pseudomonas putida KT2440
cuucgaucuggaucacugcca

SEQ ID NO: 3579110 - RNA, 14 nt, Pseudomonas putida KT2440
cuucgaugaaggcu

SEQ ID NO: 3579111 - RNA, 16 nt, Pseudomonas putida KT2440
cuucgauucaggccuu

SEQ ID NO: 3579112 - RNA, 17 nt, Pseudomonas putida KT2440
cuucgcagcacaaggcu

SEQ ID NO: 3579113 - RNA, 13 nt, Pseudomonas putida KT2440
cuucgcaggcacg

SEQ ID NO: 3579114 - RNA, 20 nt, Pseudomonas putida KT2440
cuucgcaggcacgcccgcuc

SEQ ID NO: 3579115 - RNA, 23 nt, Pseudomonas putida KT2440
cuucgccaagguccagccacgaa

SEQ ID NO: 3579116 - RNA, 20 nt, Pseudomonas putida KT2440
cuucgccacgaacaggcgcu

SEQ ID NO: 3579117 - RNA, 18 nt, Pseudomonas putida KT2440
cuucgccacugccacugg

SEQ ID NO: 3579118 - RNA, 22 nt, Pseudomonas putida KT2440
cuucgcccgaccgccagcccgc

SEQ ID NO: 3579119 - RNA, 19 nt, Pseudomonas putida KT2440
cuucgcccgguuccaauac

SEQ ID NO: 3579120 - RNA, 21 nt, Pseudomonas putida KT2440
cuucgcccguguucgcgggca

SEQ ID NO: 3579121 - RNA, 20 nt, Pseudomonas putida KT2440
cuucgcccucguucgcgggc

SEQ ID NO: 3579122 - RNA, 22 nt, Pseudomonas putida KT2440
cuucgcccucguucgcgggcac

SEQ ID NO: 3579123 - RNA, 14 nt, Pseudomonas putida KT2440
cuucgcccugggcg

SEQ ID NO: 3579124 - RNA, 20 nt, Pseudomonas putida KT2440
cuucgccgguguucgcgggu

SEQ ID NO: 3579125 - RNA, 23 nt, Pseudomonas putida KT2440
cuucgccguacuggcugcacugg

SEQ ID NO: 3579126 - RNA, 13 nt, Pseudomonas putida KT2440
cuucgccugcagc

SEQ ID NO: 3579127 - RNA, 16 nt, Pseudomonas putida KT2440
cuucgccuuccggggu

SEQ ID NO: 3579128 - RNA, 12 nt, Pseudomonas putida KT2440
cuucgcgaccca

SEQ ID NO: 3579129 - RNA, 21 nt, Pseudomonas putida KT2440
cuucgcgcauuucguccaggc

SEQ ID NO: 3579130 - RNA, 16 nt, Pseudomonas putida KT2440
cuucgcggaaggccuc

SEQ ID NO: 3579131 - RNA, 17 nt, Pseudomonas putida KT2440
cuucgcggaaggcgacc

SEQ ID NO: 3579132 - RNA, 19 nt, Pseudomonas putida KT2440
cuucgcggaucaacccgcg

SEQ ID NO: 3579133 - RNA, 19 nt, Pseudomonas putida KT2440
cuucgcggcaagcccgcuc

SEQ ID NO: 3579134 - RNA, 12 nt, Pseudomonas putida KT2440
cuucgcgggcaa

SEQ ID NO: 3579135 - RNA, 17 nt, Pseudomonas putida KT2440
cuucgcgggcaagcccg

SEQ ID NO: 3579136 - RNA, 18 nt, Pseudomonas putida KT2440
cuucgcgggcaagcccgc

SEQ ID NO: 3579137 - RNA, 14 nt, Pseudomonas putida KT2440
cuucgcgggcacgc

SEQ ID NO: 3579138 - RNA, 20 nt, Pseudomonas putida KT2440
cuucgcgggcacgcccgcuc

SEQ ID NO: 3579139 - RNA, 15 nt, Pseudomonas putida KT2440
cuucgcgggcucgcc

SEQ ID NO: 3579140 - RNA, 20 nt, Pseudomonas putida KT2440
cuucgcgggcucgcccacuc

SEQ ID NO: 3579141 - RNA, 12 nt, Pseudomonas putida KT2440
cuucgcggguaa

SEQ ID NO: 3579142 - RNA, 19 nt, Pseudomonas putida KT2440
cuucgcggguaaacccgcg

SEQ ID NO: 3579143 - RNA, 19 nt, Pseudomonas putida KT2440
cuucgcggguaaacccgcu

SEQ ID NO: 3579144 - RNA, 20 nt, Pseudomonas putida KT2440
cuucgcggguaaacccgcuc

SEQ ID NO: 3579145 - RNA, 23 nt, Pseudomonas putida KT2440
cuucgcggguaaacccgcuccua

SEQ ID NO: 3579146 - RNA, 19 nt, Pseudomonas putida KT2440
cuucgcgggugaacccgcu

SEQ ID NO: 3579147 - RNA, 18 nt, Pseudomonas putida KT2440
cuucgcucacaaagcccu

SEQ ID NO: 3579148 - RNA, 20 nt, Pseudomonas putida KT2440
cuucgcucagaaucagcuug

SEQ ID NO: 3579149 - RNA, 23 nt, Pseudomonas putida KT2440
cuucgcucaucacuacuccucgc

SEQ ID NO: 3579150 - RNA, 22 nt, Pseudomonas putida KT2440
cuucgcuggcgacgaagcugcu

SEQ ID NO: 3579151 - RNA, 23 nt, Pseudomonas putida KT2440
cuucgcuggcgacgaagcugcug

SEQ ID NO: 3579152 - RNA, 17 nt, Pseudomonas putida KT2440
cuucgcuguaaccuggu

SEQ ID NO: 3579153 - RNA, 18 nt, Pseudomonas putida KT2440
cuucgcugucuuccaggg

SEQ ID NO: 3579154 - RNA, 20 nt, Pseudomonas putida KT2440
cuucgcugucuuccagggca

SEQ ID NO: 3579155 - RNA, 16 nt, Pseudomonas putida KT2440
cuucgcuucgcgcacu

SEQ ID NO: 3579156 - RNA, 16 nt, Pseudomonas putida KT2440
cuucgcuuucaccuug

SEQ ID NO: 3579157 - RNA, 17 nt, Pseudomonas putida KT2440
cuucgcuuucaccuugc

SEQ ID NO: 3579158 - RNA, 14 nt, Pseudomonas putida KT2440
cuucggcaaucacc

SEQ ID NO: 3579159 - RNA, 19 nt, Pseudomonas putida KT2440
cuucggcaaucaccgccag

SEQ ID NO: 3579160 - RNA, 21 nt, Pseudomonas putida KT2440
cuucggccacgguguauccag

SEQ ID NO: 3579161 - RNA, 13 nt, Pseudomonas putida KT2440
cuucggccagcag

SEQ ID NO: 3579162 - RNA, 23 nt, Pseudomonas putida KT2440
cuucggccagcaguucgucgagc

SEQ ID NO: 3579163 - RNA, 12 nt, Pseudomonas putida KT2440
cuucggccaguu

SEQ ID NO: 3579164 - RNA, 22 nt, Pseudomonas putida KT2440
cuucggcgacaggugccucugc

SEQ ID NO: 3579165 - RNA, 18 nt, Pseudomonas putida KT2440
cuucggcgggguuuuuuc

SEQ ID NO: 3579166 - RNA, 20 nt, Pseudomonas putida KT2440
cuucggcgggguuuuuucua

SEQ ID NO: 3579167 - RNA, 15 nt, Pseudomonas putida KT2440
cuucggcguugaucc

SEQ ID NO: 3579168 - RNA, 19 nt, Pseudomonas putida KT2440
cuucggcucuucgccuucc

SEQ ID NO: 3579169 - RNA, 14 nt, Pseudomonas putida KT2440
cuucggcugaucuc

SEQ ID NO: 3579170 - RNA, 17 nt, Pseudomonas putida KT2440
cuucgguagacuucugc

SEQ ID NO: 3579171 - RNA, 13 nt, Pseudomonas putida KT2440
cuucggucagcug

SEQ ID NO: 3579172 - RNA, 13 nt, Pseudomonas putida KT2440
cuucgguggcuca

SEQ ID NO: 3579173 - RNA, 20 nt, Pseudomonas putida KT2440
cuucgguggugaucaucaga

SEQ ID NO: 3579174 - RNA, 23 nt, Pseudomonas putida KT2440
cuucgguggugaucaucagaccg

SEQ ID NO: 3579175 - RNA, 19 nt, Pseudomonas putida KT2440
cuucggugugcuccagcuc

SEQ ID NO: 3579176 - RNA, 21 nt, Pseudomonas putida KT2440
cuucggugugcuccagcucca

SEQ ID NO: 3579177 - RNA, 17 nt, Pseudomonas putida KT2440
cuucgucgauguccagc

SEQ ID NO: 3579178 - RNA, 17 nt, Pseudomonas putida KT2440
cuucgucggcgcggaau

SEQ ID NO: 3579179 - RNA, 14 nt, Pseudomonas putida KT2440
cuucgugcagguug

SEQ ID NO: 3579180 - RNA, 19 nt, Pseudomonas putida KT2440
cuucgugcucggcacugcu

SEQ ID NO: 3579181 - RNA, 14 nt, Pseudomonas putida KT2440
cuucuaccacuggg

SEQ ID NO: 3579182 - RNA, 22 nt, Pseudomonas putida KT2440
cuucuaccacuggggcuucugc

SEQ ID NO: 3579183 - RNA, 13 nt, Pseudomonas putida KT2440
cuucuagcaaugc

SEQ ID NO: 3579184 - RNA, 22 nt, Pseudomonas putida KT2440
cuucuagcaaugccagccgcag

SEQ ID NO: 3579185 - RNA, 21 nt, Pseudomonas putida KT2440
cuucucauaggguguugcccu

SEQ ID NO: 3579186 - RNA, 13 nt, Pseudomonas putida KT2440
cuucuccagcaag

SEQ ID NO: 3579187 - RNA, 14 nt, Pseudomonas putida KT2440
cuucuccagcucgc

SEQ ID NO: 3579188 - RNA, 14 nt, Pseudomonas putida KT2440
cuucucccgggcaa

SEQ ID NO: 3579189 - RNA, 18 nt, Pseudomonas putida KT2440
cuucucgaccagcgccag

SEQ ID NO: 3579190 - RNA, 22 nt, Pseudomonas putida KT2440
cuucucgccucagcgccaauac

SEQ ID NO: 3579191 - RNA, 16 nt, Pseudomonas putida KT2440
cuucucgcgcuuggcc

SEQ ID NO: 3579192 - RNA, 14 nt, Pseudomonas putida KT2440
cuucucgcucagca

SEQ ID NO: 3579193 - RNA, 20 nt, Pseudomonas putida KT2440
cuucucuuccggcagguaag

SEQ ID NO: 3579194 - RNA, 15 nt, Pseudomonas putida KT2440
cuucugaccaaucca

SEQ ID NO: 3579195 - RNA, 14 nt, Pseudomonas putida KT2440
cuucugcaacuccu

SEQ ID NO: 3579196 - RNA, 12 nt, Pseudomonas putida KT2440
cuucugcacucc

SEQ ID NO: 3579197 - RNA, 15 nt, Pseudomonas putida KT2440
cuucugccagaggcg

SEQ ID NO: 3579198 - RNA, 13 nt, Pseudomonas putida KT2440
cuucugccgguag

SEQ ID NO: 3579199 - RNA, 22 nt, Pseudomonas putida KT2440
cuucugccguuugcuggccugc

SEQ ID NO: 3579200 - RNA, 16 nt, Pseudomonas putida KT2440
cuucugcuucagcucg

SEQ ID NO: 3579201 - RNA, 22 nt, Pseudomonas putida KT2440
cuucugcuugcucugugcaugc

SEQ ID NO: 3579202 - RNA, 20 nt, Pseudomonas putida KT2440
cuucuggacaagaagcggcu

SEQ ID NO: 3579203 - RNA, 21 nt, Pseudomonas putida KT2440
cuucuggcuggagccguccag

SEQ ID NO: 3579204 - RNA, 13 nt, Pseudomonas putida KT2440
cuucuggcugggc

SEQ ID NO: 3579205 - RNA, 21 nt, Pseudomonas putida KT2440
cuucuggugaaagucgaccag

SEQ ID NO: 3579206 - RNA, 18 nt, Pseudomonas putida KT2440
cuucuguggaaaaccgcu

SEQ ID NO: 3579207 - RNA, 13 nt, Pseudomonas putida KT2440
cuucuucaagcac

SEQ ID NO: 3579208 - RNA, 17 nt, Pseudomonas putida KT2440
cuucuucacguccagcc

SEQ ID NO: 3579209 - RNA, 14 nt, Pseudomonas putida KT2440
cuucuucgugcgcc

SEQ ID NO: 3579210 - RNA, 12 nt, Pseudomonas putida KT2440
cuucuugcaaaa

SEQ ID NO: 3579211 - RNA, 13 nt, Pseudomonas putida KT2440
cuucuugcaguuc

SEQ ID NO: 3579212 - RNA, 17 nt, Pseudomonas putida KT2440
cuucuugccgguaccgc

SEQ ID NO: 3579213 - RNA, 16 nt, Pseudomonas putida KT2440
cuucuuuaagccccug

SEQ ID NO: 3579214 - RNA, 20 nt, Pseudomonas putida KT2440
cuucuuugaaaguggccaag

SEQ ID NO: 3579215 - RNA, 16 nt, Pseudomonas putida KT2440
cuugaacggccgucac

SEQ ID NO: 3579216 - RNA, 18 nt, Pseudomonas putida KT2440
cuugaacggccgucaccu

SEQ ID NO: 3579217 - RNA, 23 nt, Pseudomonas putida KT2440
cuugaacggccgucaccuuuucc

SEQ ID NO: 3579218 - RNA, 20 nt, Pseudomonas putida KT2440
cuugaacucagugccuggcg

SEQ ID NO: 3579219 - RNA, 21 nt, Pseudomonas putida KT2440
cuugaacugggcauccagcuu

SEQ ID NO: 3579220 - RNA, 15 nt, Pseudomonas putida KT2440
cuugaacuugcucuu

SEQ ID NO: 3579221 - RNA, 13 nt, Pseudomonas putida KT2440
cuugaagaagccu

SEQ ID NO: 3579222 - RNA, 18 nt, Pseudomonas putida KT2440
cuugaagaagcucccggc

SEQ ID NO: 3579223 - RNA, 15 nt, Pseudomonas putida KT2440
cuugaagacaucgau

SEQ ID NO: 3579224 - RNA, 13 nt, Pseudomonas putida KT2440
cuugaagcuggcc

SEQ ID NO: 3579225 - RNA, 21 nt, Pseudomonas putida KT2440
cuugaccaccagggacgaacc

SEQ ID NO: 3579226 - RNA, 19 nt, Pseudomonas putida KT2440
cuugaccacuucgacaugg

SEQ ID NO: 3579227 - RNA, 12 nt, Pseudomonas putida KT2440
cuugaccagcaa

SEQ ID NO: 3579228 - RNA, 19 nt, Pseudomonas putida KT2440
cuugaccauggcgaugaac

SEQ ID NO: 3579229 - RNA, 14 nt, Pseudomonas putida KT2440
cuugacccccuucg

SEQ ID NO: 3579230 - RNA, 16 nt, Pseudomonas putida KT2440
cuugacccgcuggacc

SEQ ID NO: 3579231 - RNA, 16 nt, Pseudomonas putida KT2440
cuugaccguuugcagc

SEQ ID NO: 3579232 - RNA, 18 nt, Pseudomonas putida KT2440
cuugaccguuugcagcgu

SEQ ID NO: 3579233 - RNA, 21 nt, Pseudomonas putida KT2440
cuugaccucgaccaggcgcuc

SEQ ID NO: 3579234 - RNA, 16 nt, Pseudomonas putida KT2440
cuugacgaucgccagc

SEQ ID NO: 3579235 - RNA, 19 nt, Pseudomonas putida KT2440
cuugacgaucgccagcccc

SEQ ID NO: 3579236 - RNA, 13 nt, Pseudomonas putida KT2440
cuugacgaugacc

SEQ ID NO: 3579237 - RNA, 21 nt, Pseudomonas putida KT2440
cuugacgggugaccaggccca

SEQ ID NO: 3579238 - RNA, 22 nt, Pseudomonas putida KT2440
cuugacguccagcucaacgcga

SEQ ID NO: 3579239 - RNA, 18 nt, Pseudomonas putida KT2440
cuugagccuugugcugug

SEQ ID NO: 3579240 - RNA, 20 nt, Pseudomonas putida KT2440
cuugagcgaaacccggcgca

SEQ ID NO: 3579241 - RNA, 13 nt, Pseudomonas putida KT2440
cuugagcgcagcg

SEQ ID NO: 3579242 - RNA, 14 nt, Pseudomonas putida KT2440
cuugagcgcagcga

SEQ ID NO: 3579243 - RNA, 15 nt, Pseudomonas putida KT2440
cuugagcgcagcgac

SEQ ID NO: 3579244 - RNA, 18 nt, Pseudomonas putida KT2440
cuugagcgcagcgacgac

SEQ ID NO: 3579245 - RNA, 15 nt, Pseudomonas putida KT2440
cuugagcgccgcgcc

SEQ ID NO: 3579246 - RNA, 17 nt, Pseudomonas putida KT2440
cuugagcuccgaagggu

SEQ ID NO: 3579247 - RNA, 14 nt, Pseudomonas putida KT2440
cuugagcucgaucu

SEQ ID NO: 3579248 - RNA, 23 nt, Pseudomonas putida KT2440
cuugagcuggccguccagcugag

SEQ ID NO: 3579249 - RNA, 19 nt, Pseudomonas putida KT2440
cuugagcuucagcgcgcca

SEQ ID NO: 3579250 - RNA, 16 nt, Pseudomonas putida KT2440
cuugaggcacaaaaaa

SEQ ID NO: 3579251 - RNA, 13 nt, Pseudomonas putida KT2440
cuugaggcuuuca

SEQ ID NO: 3579252 - RNA, 22 nt, Pseudomonas putida KT2440
cuugaggggcggcguuuucguu

SEQ ID NO: 3579253 - RNA, 16 nt, Pseudomonas putida KT2440
cuugagggucuugccc

SEQ ID NO: 3579254 - RNA, 19 nt, Pseudomonas putida KT2440
cuugagguccgccucgauc

SEQ ID NO: 3579255 - RNA, 16 nt, Pseudomonas putida KT2440
cuugaggucuucgauc

SEQ ID NO: 3579256 - RNA, 22 nt, Pseudomonas putida KT2440
cuugaggugccauagcaccagc

SEQ ID NO: 3579257 - RNA, 22 nt, Pseudomonas putida KT2440
cuugaguugagugggguggaag

SEQ ID NO: 3579258 - RNA, 15 nt, Pseudomonas putida KT2440
cuugaucaaugcccg

SEQ ID NO: 3579259 - RNA, 23 nt, Pseudomonas putida KT2440
cuugaucaggguuugcagcucac

SEQ ID NO: 3579260 - RNA, 18 nt, Pseudomonas putida KT2440
cuugauccgcgcuaccug

SEQ ID NO: 3579261 - RNA, 18 nt, Pseudomonas putida KT2440
cuugaucugccaggcacc

SEQ ID NO: 3579262 - RNA, 15 nt, Pseudomonas putida KT2440
cuugaucugcgcgcu

SEQ ID NO: 3579263 - RNA, 18 nt, Pseudomonas putida KT2440
cuugaucuugguggucag

SEQ ID NO: 3579264 - RNA, 15 nt, Pseudomonas putida KT2440
cuugaugaucagguc

SEQ ID NO: 3579265 - RNA, 21 nt, Pseudomonas putida KT2440
cuugaugcgcgagcugggcac

SEQ ID NO: 3579266 - RNA, 21 nt, Pseudomonas putida KT2440
cuugaugcugucgucaagcuc

SEQ ID NO: 3579267 - RNA, 19 nt, Pseudomonas putida KT2440
cuugauggcggcuucaaga

SEQ ID NO: 3579268 - RNA, 15 nt, Pseudomonas putida KT2440
cuugaugggccagaa

SEQ ID NO: 3579269 - RNA, 22 nt, Pseudomonas putida KT2440
cuugaugggccagaaauggugu

SEQ ID NO: 3579270 - RNA, 22 nt, Pseudomonas putida KT2440
cuugcacaguucgaaaaccugc

SEQ ID NO: 3579271 - RNA, 16 nt, Pseudomonas putida KT2440
cuugcaccgacaagcc

SEQ ID NO: 3579272 - RNA, 13 nt, Pseudomonas putida KT2440
cuugcagccccug

SEQ ID NO: 3579273 - RNA, 19 nt, Pseudomonas putida KT2440
cuugcagccccugcaauuu

SEQ ID NO: 3579274 - RNA, 18 nt, Pseudomonas putida KT2440
cuugcagcgccgcaucca

SEQ ID NO: 3579275 - RNA, 21 nt, Pseudomonas putida KT2440
cuugcagcgccgcauccagca

SEQ ID NO: 3579276 - RNA, 17 nt, Pseudomonas putida KT2440
cuugcaggaagcggcgc

SEQ ID NO: 3579277 - RNA, 15 nt, Pseudomonas putida KT2440
cuugcagucaccugg

SEQ ID NO: 3579278 - RNA, 17 nt, Pseudomonas putida KT2440
cuugcagucaccuggcc

SEQ ID NO: 3579279 - RNA, 20 nt, Pseudomonas putida KT2440
cuugcagucaccuggcccac

SEQ ID NO: 3579280 - RNA, 17 nt, Pseudomonas putida KT2440
cuugcaguuguccaggc

SEQ ID NO: 3579281 - RNA, 19 nt, Pseudomonas putida KT2440
cuugcaguuguccaggcug

SEQ ID NO: 3579282 - RNA, 16 nt, Pseudomonas putida KT2440
cuugcaucaaauuuag

SEQ ID NO: 3579283 - RNA, 14 nt, Pseudomonas putida KT2440
cuugccaacggcac

SEQ ID NO: 3579284 - RNA, 15 nt, Pseudomonas putida KT2440
cuugccaacggcacu

SEQ ID NO: 3579285 - RNA, 21 nt, Pseudomonas putida KT2440
cuugccaaggcuagccacggc

SEQ ID NO: 3579286 - RNA, 16 nt, Pseudomonas putida KT2440
cuugccaccagugccg

SEQ ID NO: 3579287 - RNA, 22 nt, Pseudomonas putida KT2440
cuugccaccaucgaccuggccc

SEQ ID NO: 3579288 - RNA, 20 nt, Pseudomonas putida KT2440
cuugccagcuuggucagggc

SEQ ID NO: 3579289 - RNA, 20 nt, Pseudomonas putida KT2440
cuugccauaacuccagcgcc

SEQ ID NO: 3579290 - RNA, 21 nt, Pseudomonas putida KT2440
cuugccauaacuccagcgcca

SEQ ID NO: 3579291 - RNA, 22 nt, Pseudomonas putida KT2440
cuugccauaacuccagcgccag

SEQ ID NO: 3579292 - RNA, 16 nt, Pseudomonas putida KT2440
cuugccauucuugucc

SEQ ID NO: 3579293 - RNA, 11 nt, Pseudomonas putida KT2440
cuugcccacca

SEQ ID NO: 3579294 - RNA, 13 nt, Pseudomonas putida KT2440
cuugcccagcucc

SEQ ID NO: 3579295 - RNA, 16 nt, Pseudomonas putida KT2440
cuugccccgcaggccg

SEQ ID NO: 3579296 - RNA, 17 nt, Pseudomonas putida KT2440
cuugcccgaagccacga

SEQ ID NO: 3579297 - RNA, 17 nt, Pseudomonas putida KT2440
cuugcccgcgaagaggc

SEQ ID NO: 3579298 - RNA, 21 nt, Pseudomonas putida KT2440
cuugcccgcgaagcagccacc

SEQ ID NO: 3579299 - RNA, 18 nt, Pseudomonas putida KT2440
cuugcccgcgaaucgccu

SEQ ID NO: 3579300 - RNA, 18 nt, Pseudomonas putida KT2440
cuugcccgcgaauggccu

SEQ ID NO: 3579301 - RNA, 13 nt, Pseudomonas putida KT2440
cuugcccggcgca

SEQ ID NO: 3579302 - RNA, 14 nt, Pseudomonas putida KT2440
cuugcccggcucca

SEQ ID NO: 3579303 - RNA, 20 nt, Pseudomonas putida KT2440
cuugcccggggugcagaucc

SEQ ID NO: 3579304 - RNA, 14 nt, Pseudomonas putida KT2440
cuugcccucgccca

SEQ ID NO: 3579305 - RNA, 12 nt, Pseudomonas putida KT2440
cuugcccugcuu

SEQ ID NO: 3579306 - RNA, 14 nt, Pseudomonas putida KT2440
cuugccgagcagcg

SEQ ID NO: 3579307 - RNA, 15 nt, Pseudomonas putida KT2440
cuugccgagcagcgc

SEQ ID NO: 3579308 - RNA, 22 nt, Pseudomonas putida KT2440
cuugccgccccgugcccgauca

SEQ ID NO: 3579309 - RNA, 20 nt, Pseudomonas putida KT2440
cuugccgcucaccaccaucu

SEQ ID NO: 3579310 - RNA, 18 nt, Pseudomonas putida KT2440
cuugccgcugcggaucau

SEQ ID NO: 3579311 - RNA, 11 nt, Pseudomonas putida KT2440
cuugccggcaa

SEQ ID NO: 3579312 - RNA, 14 nt, Pseudomonas putida KT2440
cuugccggccuuga

SEQ ID NO: 3579313 - RNA, 17 nt, Pseudomonas putida KT2440
cuugccgguaccgccac

SEQ ID NO: 3579314 - RNA, 18 nt, Pseudomonas putida KT2440
cuugccgguaccgccacc

SEQ ID NO: 3579315 - RNA, 17 nt, Pseudomonas putida KT2440
cuugccguaggugauca

SEQ ID NO: 3579316 - RNA, 16 nt, Pseudomonas putida KT2440
cuugccgucgcuggag

SEQ ID NO: 3579317 - RNA, 18 nt, Pseudomonas putida KT2440
cuugccgugcucguccuu

SEQ ID NO: 3579318 - RNA, 11 nt, Pseudomonas putida KT2440
cuugccuaccu

SEQ ID NO: 3579319 - RNA, 16 nt, Pseudomonas putida KT2440
cuugccuaccugauca

SEQ ID NO: 3579320 - RNA, 15 nt, Pseudomonas putida KT2440
cuugccugucaguuc

SEQ ID NO: 3579321 - RNA, 16 nt, Pseudomonas putida KT2440
cuugccuguccccuug

SEQ ID NO: 3579322 - RNA, 12 nt, Pseudomonas putida KT2440
cuugccuuccgg

SEQ ID NO: 3579323 - RNA, 13 nt, Pseudomonas putida KT2440
cuugccuuccucg

SEQ ID NO: 3579324 - RNA, 20 nt, Pseudomonas putida KT2440
cuugccuuccucggccaugc

SEQ ID NO: 3579325 - RNA, 20 nt, Pseudomonas putida KT2440
cuugcgcacggccuccacca

SEQ ID NO: 3579326 - RNA, 13 nt, Pseudomonas putida KT2440
cuugcgcacguag

SEQ ID NO: 3579327 - RNA, 20 nt, Pseudomonas putida KT2440
cuugcgcaguaacaggcgca

SEQ ID NO: 3579328 - RNA, 13 nt, Pseudomonas putida KT2440
cuugcgcaucuuu

SEQ ID NO: 3579329 - RNA, 14 nt, Pseudomonas putida KT2440
cuugcgcauggccg

SEQ ID NO: 3579330 - RNA, 18 nt, Pseudomonas putida KT2440
cuugcgcauggccgccac

SEQ ID NO: 3579331 - RNA, 16 nt, Pseudomonas putida KT2440
cuugcgcgccagcgca

SEQ ID NO: 3579332 - RNA, 17 nt, Pseudomonas putida KT2440
cuugcgcgccagcgcau

SEQ ID NO: 3579333 - RNA, 19 nt, Pseudomonas putida KT2440
cuugcgcgccagcgcaugc

SEQ ID NO: 3579334 - RNA, 19 nt, Pseudomonas putida KT2440
cuugcgcgccuugcgccag

SEQ ID NO: 3579335 - RNA, 11 nt, Pseudomonas putida KT2440
cuugcgcggcg

SEQ ID NO: 3579336 - RNA, 17 nt, Pseudomonas putida KT2440
cuugcgcugggcaucga

SEQ ID NO: 3579337 - RNA, 18 nt, Pseudomonas putida KT2440
cuugcggaacguuuccag

SEQ ID NO: 3579338 - RNA, 23 nt, Pseudomonas putida KT2440
cuugcggaccaccugggccagua

SEQ ID NO: 3579339 - RNA, 19 nt, Pseudomonas putida KT2440
cuugcggaucacuuccaug

SEQ ID NO: 3579340 - RNA, 20 nt, Pseudomonas putida KT2440
cuugcgggcccaguuccaug

SEQ ID NO: 3579341 - RNA, 17 nt, Pseudomonas putida KT2440
cuugcgguccugcacca

SEQ ID NO: 3579342 - RNA, 17 nt, Pseudomonas putida KT2440
cuugcggugcaugcgca

SEQ ID NO: 3579343 - RNA, 15 nt, Pseudomonas putida KT2440
cuugcguucgccgcu

SEQ ID NO: 3579344 - RNA, 14 nt, Pseudomonas putida KT2440
cuugcucaggcuca

SEQ ID NO: 3579345 - RNA, 14 nt, Pseudomonas putida KT2440
cuugcucaggucgu

SEQ ID NO: 3579346 - RNA, 17 nt, Pseudomonas putida KT2440
cuugcuccaccaggcca

SEQ ID NO: 3579347 - RNA, 18 nt, Pseudomonas putida KT2440
cuugcuccaccaggccac

SEQ ID NO: 3579348 - RNA, 16 nt, Pseudomonas putida KT2440
cuugcuccaguucauu

SEQ ID NO: 3579349 - RNA, 22 nt, Pseudomonas putida KT2440
cuugcuccaguucauucccggc

SEQ ID NO: 3579350 - RNA, 23 nt, Pseudomonas putida KT2440
cuugcucgaaugccgcugcuggc

SEQ ID NO: 3579351 - RNA, 18 nt, Pseudomonas putida KT2440
cuugcucugugcaugcgc

SEQ ID NO: 3579352 - RNA, 21 nt, Pseudomonas putida KT2440
cuugcugaugauauuugccac

SEQ ID NO: 3579353 - RNA, 23 nt, Pseudomonas putida KT2440
cuugcugaugauauuugccacuc

SEQ ID NO: 3579354 - RNA, 17 nt, Pseudomonas putida KT2440
cuugcugcaacagcucc

SEQ ID NO: 3579355 - RNA, 23 nt, Pseudomonas putida KT2440
cuugcugcaacagcuccagcaac

SEQ ID NO: 3579356 - RNA, 14 nt, Pseudomonas putida KT2440
cuugcugcagggca

SEQ ID NO: 3579357 - RNA, 16 nt, Pseudomonas putida KT2440
cuugcugcagggcacg

SEQ ID NO: 3579358 - RNA, 19 nt, Pseudomonas putida KT2440
cuugcugcucugcaaugcc

SEQ ID NO: 3579359 - RNA, 17 nt, Pseudomonas putida KT2440
cuugcuggccgguggcu

SEQ ID NO: 3579360 - RNA, 22 nt, Pseudomonas putida KT2440
cuugcuguagcccaccagguca

SEQ ID NO: 3579361 - RNA, 17 nt, Pseudomonas putida KT2440
cuuggacaccaggcugg

SEQ ID NO: 3579362 - RNA, 18 nt, Pseudomonas putida KT2440
cuuggacaccaggcuggu

SEQ ID NO: 3579363 - RNA, 13 nt, Pseudomonas putida KT2440
cuuggacgcuggc

SEQ ID NO: 3579364 - RNA, 16 nt, Pseudomonas putida KT2440
cuuggaguugcucgag

SEQ ID NO: 3579365 - RNA, 22 nt, Pseudomonas putida KT2440
cuuggaucuuuucgggcaaggc

SEQ ID NO: 3579366 - RNA, 18 nt, Pseudomonas putida KT2440
cuuggcaccggcagcagc

SEQ ID NO: 3579367 - RNA, 20 nt, Pseudomonas putida KT2440
cuuggcaccuaucgcugccg

SEQ ID NO: 3579368 - RNA, 22 nt, Pseudomonas putida KT2440
cuuggcaccuaucgcugccgcc

SEQ ID NO: 3579369 - RNA, 16 nt, Pseudomonas putida KT2440
cuuggcaccuccggua

SEQ ID NO: 3579370 - RNA, 17 nt, Pseudomonas putida KT2440
cuuggcacgcuggcugu

SEQ ID NO: 3579371 - RNA, 22 nt, Pseudomonas putida KT2440
cuuggcagcaccgcugccagcu

SEQ ID NO: 3579372 - RNA, 23 nt, Pseudomonas putida KT2440
cuuggcagcaccgcugccagcug

SEQ ID NO: 3579373 - RNA, 15 nt, Pseudomonas putida KT2440
cuuggcagccucguc

SEQ ID NO: 3579374 - RNA, 15 nt, Pseudomonas putida KT2440
cuuggcauagcgcuc

SEQ ID NO: 3579375 - RNA, 13 nt, Pseudomonas putida KT2440
cuuggcauuggcc

SEQ ID NO: 3579376 - RNA, 14 nt, Pseudomonas putida KT2440
cuuggccaaaccgg

SEQ ID NO: 3579377 - RNA, 15 nt, Pseudomonas putida KT2440
cuuggccaaugccag

SEQ ID NO: 3579378 - RNA, 14 nt, Pseudomonas putida KT2440
cuuggccagggccu

SEQ ID NO: 3579379 - RNA, 14 nt, Pseudomonas putida KT2440
cuuggccagggugc

SEQ ID NO: 3579380 - RNA, 13 nt, Pseudomonas putida KT2440
cuuggccaucagc

SEQ ID NO: 3579381 - RNA, 16 nt, Pseudomonas putida KT2440
cuuggcccagccaucg

SEQ ID NO: 3579382 - RNA, 19 nt, Pseudomonas putida KT2440
cuuggcccaguucuccggc

SEQ ID NO: 3579383 - RNA, 13 nt, Pseudomonas putida KT2440
cuuggcccuuccu

SEQ ID NO: 3579384 - RNA, 15 nt, Pseudomonas putida KT2440
cuuggccugcgggaa

SEQ ID NO: 3579385 - RNA, 15 nt, Pseudomonas putida KT2440
cuuggccuggggcuu

SEQ ID NO: 3579386 - RNA, 15 nt, Pseudomonas putida KT2440
cuuggccuuggcagc

SEQ ID NO: 3579387 - RNA, 15 nt, Pseudomonas putida KT2440
cuuggcgaacagaag

SEQ ID NO: 3579388 - RNA, 20 nt, Pseudomonas putida KT2440
cuuggcgcccuccaucaauc

SEQ ID NO: 3579389 - RNA, 20 nt, Pseudomonas putida KT2440
cuuggcgccgcccuggaugc

SEQ ID NO: 3579390 - RNA, 12 nt, Pseudomonas putida KT2440
cuuggcggcccu

SEQ ID NO: 3579391 - RNA, 21 nt, Pseudomonas putida KT2440
cuuggcggcggaucggcgugg

SEQ ID NO: 3579392 - RNA, 18 nt, Pseudomonas putida KT2440
cuuggcguaauccagcug

SEQ ID NO: 3579393 - RNA, 16 nt, Pseudomonas putida KT2440
cuuggcguccacagcc

SEQ ID NO: 3579394 - RNA, 14 nt, Pseudomonas putida KT2440
cuuggcguccaggu

SEQ ID NO: 3579395 - RNA, 16 nt, Pseudomonas putida KT2440
cuuggcgugcggcguc

SEQ ID NO: 3579396 - RNA, 17 nt, Pseudomonas putida KT2440
cuuggcugccggccugu

SEQ ID NO: 3579397 - RNA, 16 nt, Pseudomonas putida KT2440
cuuggcuuucggcgca

SEQ ID NO: 3579398 - RNA, 21 nt, Pseudomonas putida KT2440
cuuggcuuuugccacuucacc

SEQ ID NO: 3579399 - RNA, 12 nt, Pseudomonas putida KT2440
cuugggaucgau

SEQ ID NO: 3579400 - RNA, 17 nt, Pseudomonas putida KT2440
cuugggcgaggacagca

SEQ ID NO: 3579401 - RNA, 22 nt, Pseudomonas putida KT2440
cuuggguaacacggugaucgca

SEQ ID NO: 3579402 - RNA, 12 nt, Pseudomonas putida KT2440
cuuggguaacca

SEQ ID NO: 3579403 - RNA, 24 nt, Pseudomonas putida KT2440
cuugguaccgucgaucagcuucug

SEQ ID NO: 3579404 - RNA, 17 nt, Pseudomonas putida KT2440
cuuggucagcaucaccg

SEQ ID NO: 3579405 - RNA, 14 nt, Pseudomonas putida KT2440
cuuggucagggcaa

SEQ ID NO: 3579406 - RNA, 15 nt, Pseudomonas putida KT2440
cuugguccagggcca

SEQ ID NO: 3579407 - RNA, 18 nt, Pseudomonas putida KT2440
cuugguccagggccaugg

SEQ ID NO: 3579408 - RNA, 18 nt, Pseudomonas putida KT2440
cuuggucucgaucagcga

SEQ ID NO: 3579409 - RNA, 22 nt, Pseudomonas putida KT2440
cuuggucucguugcuuugaagu

SEQ ID NO: 3579410 - RNA, 14 nt, Pseudomonas putida KT2440
cuuggucugccggu

SEQ ID NO: 3579411 - RNA, 16 nt, Pseudomonas putida KT2440
cuuggugcucaugauc

SEQ ID NO: 3579412 - RNA, 22 nt, Pseudomonas putida KT2440
cuugguuuggccucuggcuugg

SEQ ID NO: 3579413 - RNA, 19 nt, Pseudomonas putida KT2440
cuuguagauauugaccagc

SEQ ID NO: 3579414 - RNA, 13 nt, Pseudomonas putida KT2440
cuuguagcucagg

SEQ ID NO: 3579415 - RNA, 16 nt, Pseudomonas putida KT2440
cuuguaggccauuucc

SEQ ID NO: 3579416 - RNA, 18 nt, Pseudomonas putida KT2440
cuuguaggcgcggguuug

SEQ ID NO: 3579417 - RNA, 12 nt, Pseudomonas putida KT2440
cuuguaguucau

SEQ ID NO: 3579418 - RNA, 16 nt, Pseudomonas putida KT2440
cuuguaucccaggcgc

SEQ ID NO: 3579419 - RNA, 17 nt, Pseudomonas putida KT2440
cuuguaucccaggcgcu

SEQ ID NO: 3579420 - RNA, 17 nt, Pseudomonas putida KT2440
cuuguauucgagcuuga

SEQ ID NO: 3579421 - RNA, 15 nt, Pseudomonas putida KT2440
cuuguauuggccaag

SEQ ID NO: 3579422 - RNA, 15 nt, Pseudomonas putida KT2440
cuugucagcaaccac

SEQ ID NO: 3579423 - RNA, 22 nt, Pseudomonas putida KT2440
cuugucagucucuuucaacagc

SEQ ID NO: 3579424 - RNA, 16 nt, Pseudomonas putida KT2440
cuugucaugccuuggc

SEQ ID NO: 3579425 - RNA, 16 nt, Pseudomonas putida KT2440
cuuguccagcaggcca

SEQ ID NO: 3579426 - RNA, 14 nt, Pseudomonas putida KT2440
cuuguccagguuug

SEQ ID NO: 3579427 - RNA, 14 nt, Pseudomonas putida KT2440
cuugucccaggcca

SEQ ID NO: 3579428 - RNA, 16 nt, Pseudomonas putida KT2440
cuugucccggcccagc

SEQ ID NO: 3579429 - RNA, 21 nt, Pseudomonas putida KT2440
cuuguccuggaucagccgcgc

SEQ ID NO: 3579430 - RNA, 16 nt, Pseudomonas putida KT2440
cuuguccuugagcgcc

SEQ ID NO: 3579431 - RNA, 15 nt, Pseudomonas putida KT2440
cuugucgacagugaa

SEQ ID NO: 3579432 - RNA, 21 nt, Pseudomonas putida KT2440
cuugucgaccugguccagcuu

SEQ ID NO: 3579433 - RNA, 22 nt, Pseudomonas putida KT2440
cuugucggcgaaggcuggccuc

SEQ ID NO: 3579434 - RNA, 18 nt, Pseudomonas putida KT2440
cuugucgguggugaucac

SEQ ID NO: 3579435 - RNA, 18 nt, Pseudomonas putida KT2440
cuugucucugaacacaug

SEQ ID NO: 3579436 - RNA, 14 nt, Pseudomonas putida KT2440
cuugucugacagca

SEQ ID NO: 3579437 - RNA, 17 nt, Pseudomonas putida KT2440
cuugucugacagcagga

SEQ ID NO: 3579438 - RNA, 17 nt, Pseudomonas putida KT2440
cuugucuguacugcggc

SEQ ID NO: 3579439 - RNA, 19 nt, Pseudomonas putida KT2440
cuugucuuuacgcauugcc

SEQ ID NO: 3579440 - RNA, 20 nt, Pseudomonas putida KT2440
cuugugcauccugcacugca

SEQ ID NO: 3579441 - RNA, 18 nt, Pseudomonas putida KT2440
cuugugcugcgaagaggc

SEQ ID NO: 3579442 - RNA, 20 nt, Pseudomonas putida KT2440
cuugugcuuccagcugucau

SEQ ID NO: 3579443 - RNA, 12 nt, Pseudomonas putida KT2440
cuugugugggcc

SEQ ID NO: 3579444 - RNA, 22 nt, Pseudomonas putida KT2440
cuuguuacccgcauaaccacca

SEQ ID NO: 3579445 - RNA, 17 nt, Pseudomonas putida KT2440
cuuguuauggcacugaa

SEQ ID NO: 3579446 - RNA, 13 nt, Pseudomonas putida KT2440
cuuguucagcugg

SEQ ID NO: 3579447 - RNA, 22 nt, Pseudomonas putida KT2440
cuuguucaucgcauucuucucc

SEQ ID NO: 3579448 - RNA, 17 nt, Pseudomonas putida KT2440
cuuguuccagccgcgcc

SEQ ID NO: 3579449 - RNA, 16 nt, Pseudomonas putida KT2440
cuuguuccgcccagcu

SEQ ID NO: 3579450 - RNA, 20 nt, Pseudomonas putida KT2440
cuuguucggguucagcuucu

SEQ ID NO: 3579451 - RNA, 15 nt, Pseudomonas putida KT2440
cuuguugccacccag

SEQ ID NO: 3579452 - RNA, 16 nt, Pseudomonas putida KT2440
cuuguuggccaccauc

SEQ ID NO: 3579453 - RNA, 14 nt, Pseudomonas putida KT2440
cuuguuggucaggc

SEQ ID NO: 3579454 - RNA, 12 nt, Pseudomonas putida KT2440
cuuuacggcuga

SEQ ID NO: 3579455 - RNA, 16 nt, Pseudomonas putida KT2440
cuuuacuggccaucca

SEQ ID NO: 3579456 - RNA, 20 nt, Pseudomonas putida KT2440
cuuuagcaggcaagcccgcu

SEQ ID NO: 3579457 - RNA, 22 nt, Pseudomonas putida KT2440
cuuuaucuccaagccgcuucac

SEQ ID NO: 3579458 - RNA, 15 nt, Pseudomonas putida KT2440
cuuucaacagcuggc

SEQ ID NO: 3579459 - RNA, 18 nt, Pseudomonas putida KT2440
cuuucacuucauccagcc

SEQ ID NO: 3579460 - RNA, 20 nt, Pseudomonas putida KT2440
cuuucagcgccgcuucagcc

SEQ ID NO: 3579461 - RNA, 14 nt, Pseudomonas putida KT2440
cuuucagcgccugc

SEQ ID NO: 3579462 - RNA, 16 nt, Pseudomonas putida KT2440
cuuucagcgccugccu

SEQ ID NO: 3579463 - RNA, 20 nt, Pseudomonas putida KT2440
cuuucagcucaaucagccaa

SEQ ID NO: 3579464 - RNA, 17 nt, Pseudomonas putida KT2440
cuuucaggcgcagcaca

SEQ ID NO: 3579465 - RNA, 21 nt, Pseudomonas putida KT2440
cuuucaggguauugaacggcg

SEQ ID NO: 3579466 - RNA, 16 nt, Pseudomonas putida KT2440
cuuucaggugcuucgg

SEQ ID NO: 3579467 - RNA, 20 nt, Pseudomonas putida KT2440
cuuucagguuccaagcgucg

SEQ ID NO: 3579468 - RNA, 19 nt, Pseudomonas putida KT2440
cuuucauaccccuccggcc

SEQ ID NO: 3579469 - RNA, 20 nt, Pseudomonas putida KT2440
cuuucauaccccuccggccc

SEQ ID NO: 3579470 - RNA, 14 nt, Pseudomonas putida KT2440
cuuucaugccuggc

SEQ ID NO: 3579471 - RNA, 13 nt, Pseudomonas putida KT2440
cuuuccaaaccug

SEQ ID NO: 3579472 - RNA, 15 nt, Pseudomonas putida KT2440
cuuuccaaaccugcg

SEQ ID NO: 3579473 - RNA, 16 nt, Pseudomonas putida KT2440
cuuuccaccuggccac

SEQ ID NO: 3579474 - RNA, 15 nt, Pseudomonas putida KT2440
cuuuccacgccucga

SEQ ID NO: 3579475 - RNA, 22 nt, Pseudomonas putida KT2440
cuuuccagcuguacgcuggcca

SEQ ID NO: 3579476 - RNA, 23 nt, Pseudomonas putida KT2440
cuuuccagcuguacgcuggccaa

SEQ ID NO: 3579477 - RNA, 18 nt, Pseudomonas putida KT2440
cuuuccagguccugcucc

SEQ ID NO: 3579478 - RNA, 16 nt, Pseudomonas putida KT2440
cuuuccagguccuugc

SEQ ID NO: 3579479 - RNA, 14 nt, Pseudomonas putida KT2440
cuuucccccagcca

SEQ ID NO: 3579480 - RNA, 18 nt, Pseudomonas putida KT2440
cuuuccugaaaccccgcc

SEQ ID NO: 3579481 - RNA, 15 nt, Pseudomonas putida KT2440
cuuucgaccucgauu

SEQ ID NO: 3579482 - RNA, 20 nt, Pseudomonas putida KT2440
cuuucgcgggcgcgcccgcu

SEQ ID NO: 3579483 - RNA, 23 nt, Pseudomonas putida KT2440
cuuucgcgggcgcgcccgcuccc

SEQ ID NO: 3579484 - RNA, 20 nt, Pseudomonas putida KT2440
cuuucgcgggugaacccgcu

SEQ ID NO: 3579485 - RNA, 21 nt, Pseudomonas putida KT2440
cuuucgcgggugaacccgcuc

SEQ ID NO: 3579486 - RNA, 16 nt, Pseudomonas putida KT2440
cuuucggcagcacccg

SEQ ID NO: 3579487 - RNA, 18 nt, Pseudomonas putida KT2440
cuuucggcagcacccgcu

SEQ ID NO: 3579488 - RNA, 15 nt, Pseudomonas putida KT2440
cuuucggccacccgg

SEQ ID NO: 3579489 - RNA, 21 nt, Pseudomonas putida KT2440
cuuucucaggcgcgccgauca

SEQ ID NO: 3579490 - RNA, 20 nt, Pseudomonas putida KT2440
cuuucuccagcaacaacgcc

SEQ ID NO: 3579491 - RNA, 14 nt, Pseudomonas putida KT2440
cuuucucccaggcc

SEQ ID NO: 3579492 - RNA, 17 nt, Pseudomonas putida KT2440
cuuucugcuucgcugcc

SEQ ID NO: 3579493 - RNA, 18 nt, Pseudomonas putida KT2440
cuuucugcuucgcugcca

SEQ ID NO: 3579494 - RNA, 22 nt, Pseudomonas putida KT2440
cuuucugcuucgcugccaggaa

SEQ ID NO: 3579495 - RNA, 23 nt, Pseudomonas putida KT2440
cuuucuggaggaguccagcugca

SEQ ID NO: 3579496 - RNA, 23 nt, Pseudomonas putida KT2440
cuuucuggggcuaaaagaugugu

SEQ ID NO: 3579497 - RNA, 19 nt, Pseudomonas putida KT2440
cuuucuuggcaugcgacgc

SEQ ID NO: 3579498 - RNA, 21 nt, Pseudomonas putida KT2440
cuuugaaaccggcaaacgcgg

SEQ ID NO: 3579499 - RNA, 21 nt, Pseudomonas putida KT2440
cuuugaaacggucagcggcag

SEQ ID NO: 3579500 - RNA, 21 nt, Pseudomonas putida KT2440
cuuugaaaguggccaagccac

SEQ ID NO: 3579501 - RNA, 23 nt, Pseudomonas putida KT2440
cuuugaacgagguuuugcagcgc

SEQ ID NO: 3579502 - RNA, 13 nt, Pseudomonas putida KT2440
cuuugagcaggcg

SEQ ID NO: 3579503 - RNA, 13 nt, Pseudomonas putida KT2440
cuuugcaccccuu

SEQ ID NO: 3579504 - RNA, 18 nt, Pseudomonas putida KT2440
cuuugcacugaagauuuu

SEQ ID NO: 3579505 - RNA, 23 nt, Pseudomonas putida KT2440
cuuugcagcccauucgcgggcaa

SEQ ID NO: 3579506 - RNA, 15 nt, Pseudomonas putida KT2440
cuuugcagcccuucg

SEQ ID NO: 3579507 - RNA, 19 nt, Pseudomonas putida KT2440
cuuugcagcccuucgccgg

SEQ ID NO: 3579508 - RNA, 21 nt, Pseudomonas putida KT2440
cuuugccacucagcggguccu

SEQ ID NO: 3579509 - RNA, 20 nt, Pseudomonas putida KT2440
cuuugccauucucgccgccg

SEQ ID NO: 3579510 - RNA, 14 nt, Pseudomonas putida KT2440
cuuugcggacgaac

SEQ ID NO: 3579511 - RNA, 15 nt, Pseudomonas putida KT2440
cuuugcggacgaacu

SEQ ID NO: 3579512 - RNA, 13 nt, Pseudomonas putida KT2440
cuuugcgggcaua

SEQ ID NO: 3579513 - RNA, 14 nt, Pseudomonas putida KT2440
cuuugcugcagguc

SEQ ID NO: 3579514 - RNA, 15 nt, Pseudomonas putida KT2440
cuuugcugcaggucc

SEQ ID NO: 3579515 - RNA, 18 nt, Pseudomonas putida KT2440
cuuugcugccugugccgg

SEQ ID NO: 3579516 - RNA, 21 nt, Pseudomonas putida KT2440
cuuuggcaggaucgcaagcug

SEQ ID NO: 3579517 - RNA, 17 nt, Pseudomonas putida KT2440
cuuuggccgccagcggc

SEQ ID NO: 3579518 - RNA, 16 nt, Pseudomonas putida KT2440
cuuuggccguagccag

SEQ ID NO: 3579519 - RNA, 15 nt, Pseudomonas putida KT2440
cuuuggcuaucagcc

SEQ ID NO: 3579520 - RNA, 16 nt, Pseudomonas putida KT2440
cuuuggcugcaggucg

SEQ ID NO: 3579521 - RNA, 20 nt, Pseudomonas putida KT2440
cuuugggagcaguggugcuc

SEQ ID NO: 3579522 - RNA, 20 nt, Pseudomonas putida KT2440
cuuuggguuuggucuguaca

SEQ ID NO: 3579523 - RNA, 18 nt, Pseudomonas putida KT2440
cuuuggucgcggcgcugg

SEQ ID NO: 3579524 - RNA, 21 nt, Pseudomonas putida KT2440
cuuuggucgcggcgcuggccg

SEQ ID NO: 3579525 - RNA, 13 nt, Pseudomonas putida KT2440
cuuugucgaugcc

SEQ ID NO: 3579526 - RNA, 18 nt, Pseudomonas putida KT2440
cuuugugcacaagcugcu

SEQ ID NO: 3579527 - RNA, 17 nt, Pseudomonas putida KT2440
cuuuguguugauucaga

SEQ ID NO: 3579528 - RNA, 15 nt, Pseudomonas putida KT2440
cuuuguucauggugg

SEQ ID NO: 3579529 - RNA, 14 nt, Pseudomonas putida KT2440
cuuuuccugcugca

SEQ ID NO: 3579530 - RNA, 16 nt, Pseudomonas putida KT2440
cuuuucuuuacaaccc

SEQ ID NO: 3579531 - RNA, 17 nt, Pseudomonas putida KT2440
cuuuucuuuacaaccca

SEQ ID NO: 3579532 - RNA, 15 nt, Pseudomonas putida KT2440
cuuuugcccuucugg

SEQ ID NO: 3579533 - RNA, 15 nt, Pseudomonas putida KT2440
cuuuuggcucaggug

SEQ ID NO: 3579534 - RNA, 18 nt, Pseudomonas putida KT2440
cuuuuggcugugcacccg

SEQ ID NO: 3579535 - RNA, 16 nt, Pseudomonas putida KT2440
cuuuuuuugccuguug

SEQ ID NO: 3579536 - RNA, 20 nt, Pseudomonas putida KT2440
cuuuuuuuugccuggaauuc

SEQ ID NO: 3579537 - RNA, 15 nt, Pseudomonas putida KT2440
gaaaaaaagggcacc

SEQ ID NO: 3579538 - RNA, 21 nt, Pseudomonas putida KT2440
gaaaaaaagggcaccuccaga

SEQ ID NO: 3579539 - RNA, 23 nt, Pseudomonas putida KT2440
gaaaaaaagugguugacaagcaa

SEQ ID NO: 3579540 - RNA, 20 nt, Pseudomonas putida KT2440
gaaaaacgccgggcacugcc

SEQ ID NO: 3579541 - RNA, 16 nt, Pseudomonas putida KT2440
gaaaaacgcggaucgu

SEQ ID NO: 3579542 - RNA, 13 nt, Pseudomonas putida KT2440
gaaaaagaacaga

SEQ ID NO: 3579543 - RNA, 15 nt, Pseudomonas putida KT2440
gaaaaagaacagacc

SEQ ID NO: 3579544 - RNA, 15 nt, Pseudomonas putida KT2440
gaaaaagcccaguuc

SEQ ID NO: 3579545 - RNA, 17 nt, Pseudomonas putida KT2440
gaaaaagccccgccagu

SEQ ID NO: 3579546 - RNA, 21 nt, Pseudomonas putida KT2440
gaaaaagccccgccagugcaa

SEQ ID NO: 3579547 - RNA, 15 nt, Pseudomonas putida KT2440
gaaaaagccggcaac

SEQ ID NO: 3579548 - RNA, 20 nt, Pseudomonas putida KT2440
gaaaacagcgcgcgaaucac

SEQ ID NO: 3579549 - RNA, 19 nt, Pseudomonas putida KT2440
gaaaacgaaacgccaggca

SEQ ID NO: 3579550 - RNA, 19 nt, Pseudomonas putida KT2440
gaaaacucggucaggcaga

SEQ ID NO: 3579551 - RNA, 17 nt, Pseudomonas putida KT2440
gaaaacugggcagcccu

SEQ ID NO: 3579552 - RNA, 13 nt, Pseudomonas putida KT2440
gaaaagcaaggcu

SEQ ID NO: 3579553 - RNA, 19 nt, Pseudomonas putida KT2440
gaaaagcaaggcucaggcc

SEQ ID NO: 3579554 - RNA, 15 nt, Pseudomonas putida KT2440
gaaaagccgcuggcc

SEQ ID NO: 3579555 - RNA, 17 nt, Pseudomonas putida KT2440
gaaaagccugccagguc

SEQ ID NO: 3579556 - RNA, 21 nt, Pseudomonas putida KT2440
gaaaagcgagguacggcaagg

SEQ ID NO: 3579557 - RNA, 17 nt, Pseudomonas putida KT2440
gaaaaggccaaccaccc

SEQ ID NO: 3579558 - RNA, 20 nt, Pseudomonas putida KT2440
gaaaaggccaaccacccggg

SEQ ID NO: 3579559 - RNA, 13 nt, Pseudomonas putida KT2440
gaaaaggcgcugu

SEQ ID NO: 3579560 - RNA, 20 nt, Pseudomonas putida KT2440
gaaaagguagugcaccaacg

SEQ ID NO: 3579561 - RNA, 12 nt, Pseudomonas putida KT2440
gaaaaucagcua

SEQ ID NO: 3579562 - RNA, 16 nt, Pseudomonas putida KT2440
gaaaaucagcuauuga

SEQ ID NO: 3579563 - RNA, 17 nt, Pseudomonas putida KT2440
gaaaaucgacccaccua

SEQ ID NO: 3579564 - RNA, 23 nt, Pseudomonas putida KT2440
gaaaauuaguuugacagcccugc

SEQ ID NO: 3579565 - RNA, 13 nt, Pseudomonas putida KT2440
gaaacacagcagg

SEQ ID NO: 3579566 - RNA, 14 nt, Pseudomonas putida KT2440
gaaacacagcaggc

SEQ ID NO: 3579567 - RNA, 15 nt, Pseudomonas putida KT2440
gaaacacagcaggcc

SEQ ID NO: 3579568 - RNA, 10 nt, Pseudomonas putida KT2440
gaaacaccac

SEQ ID NO: 3579569 - RNA, 12 nt, Pseudomonas putida KT2440
gaaacaccagca

SEQ ID NO: 3579570 - RNA, 21 nt, Pseudomonas putida KT2440
gaaacacccugcaccacggca

SEQ ID NO: 3579571 - RNA, 19 nt, Pseudomonas putida KT2440
gaaacagauagaucaugca

SEQ ID NO: 3579572 - RNA, 18 nt, Pseudomonas putida KT2440
gaaacagauuccguacca

SEQ ID NO: 3579573 - RNA, 15 nt, Pseudomonas putida KT2440
gaaacaguuucuuca

SEQ ID NO: 3579574 - RNA, 15 nt, Pseudomonas putida KT2440
gaaaccacugcuguu

SEQ ID NO: 3579575 - RNA, 17 nt, Pseudomonas putida KT2440
gaaaccaucaaucaacu

SEQ ID NO: 3579576 - RNA, 17 nt, Pseudomonas putida KT2440
gaaaccaugcaggucga

SEQ ID NO: 3579577 - RNA, 14 nt, Pseudomonas putida KT2440
gaaacccagggcag

SEQ ID NO: 3579578 - RNA, 11 nt, Pseudomonas putida KT2440
gaaacccagua

SEQ ID NO: 3579579 - RNA, 14 nt, Pseudomonas putida KT2440
gaaacccgcgccua

SEQ ID NO: 3579580 - RNA, 12 nt, Pseudomonas putida KT2440
gaaacccucacg

SEQ ID NO: 3579581 - RNA, 20 nt, Pseudomonas putida KT2440
gaaacccucacgcgccaggu

SEQ ID NO: 3579582 - RNA, 19 nt, Pseudomonas putida KT2440
gaaacccucuggguagcca

SEQ ID NO: 3579583 - RNA, 20 nt, Pseudomonas putida KT2440
gaaaccgacuugauugccga

SEQ ID NO: 3579584 - RNA, 13 nt, Pseudomonas putida KT2440
gaaaccgccagcc

SEQ ID NO: 3579585 - RNA, 14 nt, Pseudomonas putida KT2440
gaaaccgccagcca

SEQ ID NO: 3579586 - RNA, 12 nt, Pseudomonas putida KT2440
gaaaccggcaaa

SEQ ID NO: 3579587 - RNA, 23 nt, Pseudomonas putida KT2440
gaaacgccaggcacccagccagc

SEQ ID NO: 3579588 - RNA, 17 nt, Pseudomonas putida KT2440
gaaacgccgggucagcu

SEQ ID NO: 3579589 - RNA, 20 nt, Pseudomonas putida KT2440
gaaacgcggcaaccugcacu

SEQ ID NO: 3579590 - RNA, 21 nt, Pseudomonas putida KT2440
gaaacgcguuucggcggccug

SEQ ID NO: 3579591 - RNA, 14 nt, Pseudomonas putida KT2440
gaaacggcaaugac

SEQ ID NO: 3579592 - RNA, 17 nt, Pseudomonas putida KT2440
gaaacucacgcauggcc

SEQ ID NO: 3579593 - RNA, 19 nt, Pseudomonas putida KT2440
gaaacucacgcgccagggu

SEQ ID NO: 3579594 - RNA, 23 nt, Pseudomonas putida KT2440
gaaacugcgcugguacagcagga

SEQ ID NO: 3579595 - RNA, 16 nt, Pseudomonas putida KT2440
gaaagccuaccaggaa

SEQ ID NO: 3579596 - RNA, 18 nt, Pseudomonas putida KT2440
gaaagcgcaaucaaagca

SEQ ID NO: 3579597 - RNA, 17 nt, Pseudomonas putida KT2440
gaaaggccgcugugcca

SEQ ID NO: 3579598 - RNA, 13 nt, Pseudomonas putida KT2440
gaaaggcgcucga

SEQ ID NO: 3579599 - RNA, 16 nt, Pseudomonas putida KT2440
gaaagggccagcacaa

SEQ ID NO: 3579600 - RNA, 19 nt, Pseudomonas putida KT2440
gaaagggccaguacaggca

SEQ ID NO: 3579601 - RNA, 17 nt, Pseudomonas putida KT2440
gaaagggccgcaaagcg

SEQ ID NO: 3579602 - RNA, 15 nt, Pseudomonas putida KT2440
gaaagucgaccagca

SEQ ID NO: 3579603 - RNA, 16 nt, Pseudomonas putida KT2440
gaaagucgaccagcag

SEQ ID NO: 3579604 - RNA, 17 nt, Pseudomonas putida KT2440
gaaagucgaccagcagc

SEQ ID NO: 3579605 - RNA, 21 nt, Pseudomonas putida KT2440
gaaagugcguuggcugcugaa

SEQ ID NO: 3579606 - RNA, 22 nt, Pseudomonas putida KT2440
gaaauaacgcgggcaaugucca

SEQ ID NO: 3579607 - RNA, 14 nt, Pseudomonas putida KT2440
gaaauccagccgcc

SEQ ID NO: 3579608 - RNA, 17 nt, Pseudomonas putida KT2440
gaaauccagccgcccga

SEQ ID NO: 3579609 - RNA, 23 nt, Pseudomonas putida KT2440
gaaaucggggcugcuuugcagcc

SEQ ID NO: 3579610 - RNA, 20 nt, Pseudomonas putida KT2440
gaaaucugccugcugcaaca

SEQ ID NO: 3579611 - RNA, 22 nt, Pseudomonas putida KT2440
gaaaucugccugcugcaacagc

SEQ ID NO: 3579612 - RNA, 16 nt, Pseudomonas putida KT2440
gaaaugaacagccggc

SEQ ID NO: 3579613 - RNA, 18 nt, Pseudomonas putida KT2440
gaaauggcgaaucagcau

SEQ ID NO: 3579614 - RNA, 20 nt, Pseudomonas putida KT2440
gaaaugguugaagaucaggu

SEQ ID NO: 3579615 - RNA, 13 nt, Pseudomonas putida KT2440
gaaauguucaaca

SEQ ID NO: 3579616 - RNA, 16 nt, Pseudomonas putida KT2440
gaaauguucaacagcc

SEQ ID NO: 3579617 - RNA, 18 nt, Pseudomonas putida KT2440
gaaauguucacggcggcc

SEQ ID NO: 3579618 - RNA, 13 nt, Pseudomonas putida KT2440
gaaauucaaguac

SEQ ID NO: 3579619 - RNA, 14 nt, Pseudomonas putida KT2440
gaaauucaccugcc

SEQ ID NO: 3579620 - RNA, 23 nt, Pseudomonas putida KT2440
gaaauugcaggggcugcaaggca

SEQ ID NO: 3579621 - RNA, 15 nt, Pseudomonas putida KT2440
gaaauuggccagcag

SEQ ID NO: 3579622 - RNA, 21 nt, Pseudomonas putida KT2440
gaaauuggccagcaggucagg

SEQ ID NO: 3579623 - RNA, 22 nt, Pseudomonas putida KT2440
gaaauuggccagcaggucaggc

SEQ ID NO: 3579624 - RNA, 15 nt, Pseudomonas putida KT2440
gaaauuggcgagcag

SEQ ID NO: 3579625 - RNA, 18 nt, Pseudomonas putida KT2440
gaaauuggcgagcaggcc

SEQ ID NO: 3579626 - RNA, 17 nt, Pseudomonas putida KT2440
gaacaacaggucggcgc

SEQ ID NO: 3579627 - RNA, 22 nt, Pseudomonas putida KT2440
gaacaaccugaacaaggccugg

SEQ ID NO: 3579628 - RNA, 21 nt, Pseudomonas putida KT2440
gaacaacggcagcgacagcug

SEQ ID NO: 3579629 - RNA, 17 nt, Pseudomonas putida KT2440
gaacaacuguccugugc

SEQ ID NO: 3579630 - RNA, 19 nt, Pseudomonas putida KT2440
gaacaagcgcgacuggugc

SEQ ID NO: 3579631 - RNA, 16 nt, Pseudomonas putida KT2440
gaacaaggcucagcug

SEQ ID NO: 3579632 - RNA, 13 nt, Pseudomonas putida KT2440
gaacaagucgcgc

SEQ ID NO: 3579633 - RNA, 15 nt, Pseudomonas putida KT2440
gaacaagucgcgcac

SEQ ID NO: 3579634 - RNA, 17 nt, Pseudomonas putida KT2440
gaacaagucgcgcacca

SEQ ID NO: 3579635 - RNA, 16 nt, Pseudomonas putida KT2440
gaacaaucuucuucau

SEQ ID NO: 3579636 - RNA, 15 nt, Pseudomonas putida KT2440
gaacacagcggccuu

SEQ ID NO: 3579637 - RNA, 14 nt, Pseudomonas putida KT2440
gaacacaucgguac

SEQ ID NO: 3579638 - RNA, 19 nt, Pseudomonas putida KT2440
gaacacaucgguacgccgc

SEQ ID NO: 3579639 - RNA, 16 nt, Pseudomonas putida KT2440
gaacaccaccgcgaaa

SEQ ID NO: 3579640 - RNA, 19 nt, Pseudomonas putida KT2440
gaacaccacugucagccag

SEQ ID NO: 3579641 - RNA, 14 nt, Pseudomonas putida KT2440
gaacaccagcccca

SEQ ID NO: 3579642 - RNA, 18 nt, Pseudomonas putida KT2440
gaacaccaguucgccauc

SEQ ID NO: 3579643 - RNA, 19 nt, Pseudomonas putida KT2440
gaacaccaguucgccaucg

SEQ ID NO: 3579644 - RNA, 14 nt, Pseudomonas putida KT2440
gaacacccagcgca

SEQ ID NO: 3579645 - RNA, 14 nt, Pseudomonas putida KT2440
gaacaccugcagcg

SEQ ID NO: 3579646 - RNA, 18 nt, Pseudomonas putida KT2440
gaacacgaaaaagccagc

SEQ ID NO: 3579647 - RNA, 14 nt, Pseudomonas putida KT2440
gaacacgccgucga

SEQ ID NO: 3579648 - RNA, 18 nt, Pseudomonas putida KT2440
gaacacgcucaugaacag

SEQ ID NO: 3579649 - RNA, 19 nt, Pseudomonas putida KT2440
gaacacgcucaugaacagc

SEQ ID NO: 3579650 - RNA, 14 nt, Pseudomonas putida KT2440
gaacacggcguggu

SEQ ID NO: 3579651 - RNA, 16 nt, Pseudomonas putida KT2440
gaacacgggcgaagcc

SEQ ID NO: 3579652 - RNA, 14 nt, Pseudomonas putida KT2440
gaacacguccagcc

SEQ ID NO: 3579653 - RNA, 17 nt, Pseudomonas putida KT2440
gaacacgugggggaucu

SEQ ID NO: 3579654 - RNA, 16 nt, Pseudomonas putida KT2440
gaacacugccaacggg

SEQ ID NO: 3579655 - RNA, 18 nt, Pseudomonas putida KT2440
gaacacuggcaggcucag

SEQ ID NO: 3579656 - RNA, 19 nt, Pseudomonas putida KT2440
gaacacuggcaggcucagg

SEQ ID NO: 3579657 - RNA, 18 nt, Pseudomonas putida KT2440
gaacagacccaugauuga

SEQ ID NO: 3579658 - RNA, 22 nt, Pseudomonas putida KT2440
gaacagcaacacauacuccacc

SEQ ID NO: 3579659 - RNA, 23 nt, Pseudomonas putida KT2440
gaacagcaacacauacuccaccg

SEQ ID NO: 3579660 - RNA, 16 nt, Pseudomonas putida KT2440
gaacagcacgauggcg

SEQ ID NO: 3579661 - RNA, 18 nt, Pseudomonas putida KT2440
gaacagcacgcccaagcc

SEQ ID NO: 3579662 - RNA, 15 nt, Pseudomonas putida KT2440
gaacagcacugccag

SEQ ID NO: 3579663 - RNA, 11 nt, Pseudomonas putida KT2440
gaacagcagca

SEQ ID NO: 3579664 - RNA, 22 nt, Pseudomonas putida KT2440
gaacagccacagcugcugcagg

SEQ ID NO: 3579665 - RNA, 13 nt, Pseudomonas putida KT2440
gaacagccagaug

SEQ ID NO: 3579666 - RNA, 20 nt, Pseudomonas putida KT2440
gaacagccggcuaucggcca

SEQ ID NO: 3579667 - RNA, 14 nt, Pseudomonas putida KT2440
gaacagcgcagcca

SEQ ID NO: 3579668 - RNA, 20 nt, Pseudomonas putida KT2440
gaacagcgcagccaccagcu

SEQ ID NO: 3579669 - RNA, 15 nt, Pseudomonas putida KT2440
gaacagcgccacgcc

SEQ ID NO: 3579670 - RNA, 16 nt, Pseudomonas putida KT2440
gaacagcgccgcgauc

SEQ ID NO: 3579671 - RNA, 14 nt, Pseudomonas putida KT2440
gaacagcgccggca

SEQ ID NO: 3579672 - RNA, 14 nt, Pseudomonas putida KT2440
gaacagcggcagca

SEQ ID NO: 3579673 - RNA, 18 nt, Pseudomonas putida KT2440
gaacagcggcagcaacac

SEQ ID NO: 3579674 - RNA, 16 nt, Pseudomonas putida KT2440
gaacagcguggccagc

SEQ ID NO: 3579675 - RNA, 17 nt, Pseudomonas putida KT2440
gaacagcucgaucagug

SEQ ID NO: 3579676 - RNA, 17 nt, Pseudomonas putida KT2440
gaacagcucgauggcca

SEQ ID NO: 3579677 - RNA, 19 nt, Pseudomonas putida KT2440
gaacagcucgauggccagg

SEQ ID NO: 3579678 - RNA, 18 nt, Pseudomonas putida KT2440
gaacagcucuggcagcag

SEQ ID NO: 3579679 - RNA, 20 nt, Pseudomonas putida KT2440
gaacagcuggauggucacgc

SEQ ID NO: 3579680 - RNA, 20 nt, Pseudomonas putida KT2440
gaacagcuucaacaaggucu

SEQ ID NO: 3579681 - RNA, 19 nt, Pseudomonas putida KT2440
gaacaggaucagcggcuug

SEQ ID NO: 3579682 - RNA, 14 nt, Pseudomonas putida KT2440
gaacaggcagacca

SEQ ID NO: 3579683 - RNA, 13 nt, Pseudomonas putida KT2440
gaacaggccggcu

SEQ ID NO: 3579684 - RNA, 21 nt, Pseudomonas putida KT2440
gaacaggccugcggccaggcc

SEQ ID NO: 3579685 - RNA, 22 nt, Pseudomonas putida KT2440
gaacaggccugcggccaggccg

SEQ ID NO: 3579686 - RNA, 17 nt, Pseudomonas putida KT2440
gaacaggccugucacgc

SEQ ID NO: 3579687 - RNA, 23 nt, Pseudomonas putida KT2440
gaacaggcgcuugcccgccgaau

SEQ ID NO: 3579688 - RNA, 19 nt, Pseudomonas putida KT2440
gaacaggcggcuguccggc

SEQ ID NO: 3579689 - RNA, 22 nt, Pseudomonas putida KT2440
gaacaggcguacaucagccucg

SEQ ID NO: 3579690 - RNA, 19 nt, Pseudomonas putida KT2440
gaacagggccagguagacg

SEQ ID NO: 3579691 - RNA, 18 nt, Pseudomonas putida KT2440
gaacaggugcgcgcgcga

SEQ ID NO: 3579692 - RNA, 19 nt, Pseudomonas putida KT2440
gaacaggugcgcgcgcgac

SEQ ID NO: 3579693 - RNA, 21 nt, Pseudomonas putida KT2440
gaacaggugcgcgcgcgacag

SEQ ID NO: 3579694 - RNA, 14 nt, Pseudomonas putida KT2440
gaacagguugacca

SEQ ID NO: 3579695 - RNA, 17 nt, Pseudomonas putida KT2440
gaacagguugcgcgccg

SEQ ID NO: 3579696 - RNA, 18 nt, Pseudomonas putida KT2440
gaacagucauccagaaag

SEQ ID NO: 3579697 - RNA, 19 nt, Pseudomonas putida KT2440
gaacaguggcccgaugauc

SEQ ID NO: 3579698 - RNA, 18 nt, Pseudomonas putida KT2440
gaacauacgcaucagcgc

SEQ ID NO: 3579699 - RNA, 17 nt, Pseudomonas putida KT2440
gaacaucacgaaggugu

SEQ ID NO: 3579700 - RNA, 14 nt, Pseudomonas putida KT2440
gaacaugccacggc

SEQ ID NO: 3579701 - RNA, 15 nt, Pseudomonas putida KT2440
gaacauggccgagcu

SEQ ID NO: 3579702 - RNA, 16 nt, Pseudomonas putida KT2440
gaacauggccgagcug

SEQ ID NO: 3579703 - RNA, 15 nt, Pseudomonas putida KT2440
gaacauguuuucagu

SEQ ID NO: 3579704 - RNA, 20 nt, Pseudomonas putida KT2440
gaaccaaggugcuaccggcg

SEQ ID NO: 3579705 - RNA, 17 nt, Pseudomonas putida KT2440
gaaccacacagaugccg

SEQ ID NO: 3579706 - RNA, 12 nt, Pseudomonas putida KT2440
gaaccacaucac

SEQ ID NO: 3579707 - RNA, 20 nt, Pseudomonas putida KT2440
gaaccacaucacgaucaugc

SEQ ID NO: 3579708 - RNA, 19 nt, Pseudomonas putida KT2440
gaaccaggugcgguccggc

SEQ ID NO: 3579709 - RNA, 19 nt, Pseudomonas putida KT2440
gaaccaugcgccgcugcuc

SEQ ID NO: 3579710 - RNA, 21 nt, Pseudomonas putida KT2440
gaacccaaucauauacaucga

SEQ ID NO: 3579711 - RNA, 16 nt, Pseudomonas putida KT2440
gaacccagcuugaagc

SEQ ID NO: 3579712 - RNA, 18 nt, Pseudomonas putida KT2440
gaaccccaccagcacugc

SEQ ID NO: 3579713 - RNA, 14 nt, Pseudomonas putida KT2440
gaaccccacucucc

SEQ ID NO: 3579714 - RNA, 21 nt, Pseudomonas putida KT2440
gaaccccaguugaucaacccg

SEQ ID NO: 3579715 - RNA, 22 nt, Pseudomonas putida KT2440
gaaccccaguugaucaacccgu

SEQ ID NO: 3579716 - RNA, 22 nt, Pseudomonas putida KT2440
gaaccccccguaggagcgggcu

SEQ ID NO: 3579717 - RNA, 20 nt, Pseudomonas putida KT2440
gaacccgcuccuacaacggc

SEQ ID NO: 3579718 - RNA, 22 nt, Pseudomonas putida KT2440
gaacccgcuccuaccacguaca

SEQ ID NO: 3579719 - RNA, 13 nt, Pseudomonas putida KT2440
gaacccgcuggcg

SEQ ID NO: 3579720 - RNA, 18 nt, Pseudomonas putida KT2440
gaacccgcuggcgaucag

SEQ ID NO: 3579721 - RNA, 21 nt, Pseudomonas putida KT2440
gaacccgcuggcgaucaggca

SEQ ID NO: 3579722 - RNA, 18 nt, Pseudomonas putida KT2440
gaacccgugcaucugcuc

SEQ ID NO: 3579723 - RNA, 19 nt, Pseudomonas putida KT2440
gaaccgagcggucgcaggu

SEQ ID NO: 3579724 - RNA, 23 nt, Pseudomonas putida KT2440
gaaccgcaacuggcccgcgccag

SEQ ID NO: 3579725 - RNA, 14 nt, Pseudomonas putida KT2440
gaaccgccagcacc

SEQ ID NO: 3579726 - RNA, 14 nt, Pseudomonas putida KT2440
gaaccgcucccagg

SEQ ID NO: 3579727 - RNA, 20 nt, Pseudomonas putida KT2440
gaaccgcuguucugcccggc

SEQ ID NO: 3579728 - RNA, 15 nt, Pseudomonas putida KT2440
gaaccggcgcuggcc

SEQ ID NO: 3579729 - RNA, 14 nt, Pseudomonas putida KT2440
gaaccuacccggua

SEQ ID NO: 3579730 - RNA, 12 nt, Pseudomonas putida KT2440
gaaccuccgcca

SEQ ID NO: 3579731 - RNA, 20 nt, Pseudomonas putida KT2440
gaaccugaugcgagcuaccu

SEQ ID NO: 3579732 - RNA, 17 nt, Pseudomonas putida KT2440
gaaccuggaucgcucuc

SEQ ID NO: 3579733 - RNA, 20 nt, Pseudomonas putida KT2440
gaaccugugaagccagggca

SEQ ID NO: 3579734 - RNA, 20 nt, Pseudomonas putida KT2440
gaacgacaacccccacaggg

SEQ ID NO: 3579735 - RNA, 22 nt, Pseudomonas putida KT2440
gaacgacuucggcaacagccgg

SEQ ID NO: 3579736 - RNA, 15 nt, Pseudomonas putida KT2440
gaacgaggacugcac

SEQ ID NO: 3579737 - RNA, 16 nt, Pseudomonas putida KT2440
gaacgaggcguuggcc

SEQ ID NO: 3579738 - RNA, 23 nt, Pseudomonas putida KT2440
gaacgagguuuugcagcgcucga

SEQ ID NO: 3579739 - RNA, 21 nt, Pseudomonas putida KT2440
gaacgaugcccgggccuucaa

SEQ ID NO: 3579740 - RNA, 18 nt, Pseudomonas putida KT2440
gaacgauucugccagcuc

SEQ ID NO: 3579741 - RNA, 21 nt, Pseudomonas putida KT2440
gaacgcaaaaaaccgcaccca

SEQ ID NO: 3579742 - RNA, 17 nt, Pseudomonas putida KT2440
gaacgcaagaaggcugc

SEQ ID NO: 3579743 - RNA, 22 nt, Pseudomonas putida KT2440
gaacgcaaggguaauggcgaag

SEQ ID NO: 3579744 - RNA, 18 nt, Pseudomonas putida KT2440
gaacgcaauaugcaccuu

SEQ ID NO: 3579745 - RNA, 20 nt, Pseudomonas putida KT2440
gaacgcagcuuccgccacca

SEQ ID NO: 3579746 - RNA, 18 nt, Pseudomonas putida KT2440
gaacgccugcagggccug

SEQ ID NO: 3579747 - RNA, 22 nt, Pseudomonas putida KT2440
gaacgccuuggccucgcugacc

SEQ ID NO: 3579748 - RNA, 21 nt, Pseudomonas putida KT2440
gaacgcgaguaacgcccuuca

SEQ ID NO: 3579749 - RNA, 14 nt, Pseudomonas putida KT2440
gaacgcgguaagca

SEQ ID NO: 3579750 - RNA, 20 nt, Pseudomonas putida KT2440
gaacgcugccuccacaccga

SEQ ID NO: 3579751 - RNA, 12 nt, Pseudomonas putida KT2440
gaacgcugcgcg

SEQ ID NO: 3579752 - RNA, 13 nt, Pseudomonas putida KT2440
gaacgcugugccg

SEQ ID NO: 3579753 - RNA, 21 nt, Pseudomonas putida KT2440
gaacgcuguuggcagccacga

SEQ ID NO: 3579754 - RNA, 13 nt, Pseudomonas putida KT2440
gaacggaacaggu

SEQ ID NO: 3579755 - RNA, 14 nt, Pseudomonas putida KT2440
gaacggcccgcgga

SEQ ID NO: 3579756 - RNA, 15 nt, Pseudomonas putida KT2440
gaacggccgucaccu

SEQ ID NO: 3579757 - RNA, 22 nt, Pseudomonas putida KT2440
gaacggcgcauccaccacgaac

SEQ ID NO: 3579758 - RNA, 24 nt, Pseudomonas putida KT2440
gaacggcuguuccucgccauggcc

SEQ ID NO: 3579759 - RNA, 15 nt, Pseudomonas putida KT2440
gaacggcuucgaugu

SEQ ID NO: 3579760 - RNA, 23 nt, Pseudomonas putida KT2440
gaacgggccaccaaaggccuuga

SEQ ID NO: 3579761 - RNA, 16 nt, Pseudomonas putida KT2440
gaacggugaacggcgg

SEQ ID NO: 3579762 - RNA, 17 nt, Pseudomonas putida KT2440
gaacguacuggccgcug

SEQ ID NO: 3579763 - RNA, 19 nt, Pseudomonas putida KT2440
gaacguuuccagcaaccgc

SEQ ID NO: 3579764 - RNA, 23 nt, Pseudomonas putida KT2440
gaacguuucgucauccaccgccc

SEQ ID NO: 3579765 - RNA, 17 nt, Pseudomonas putida KT2440
gaacuacgcgccagcau

SEQ ID NO: 3579766 - RNA, 22 nt, Pseudomonas putida KT2440
gaacucaguuacagaggcauga

SEQ ID NO: 3579767 - RNA, 22 nt, Pseudomonas putida KT2440
gaacucaugcuccugcgccacc

SEQ ID NO: 3579768 - RNA, 15 nt, Pseudomonas putida KT2440
gaacuccaacgccgg

SEQ ID NO: 3579769 - RNA, 14 nt, Pseudomonas putida KT2440
gaacuccccaccag

SEQ ID NO: 3579770 - RNA, 15 nt, Pseudomonas putida KT2440
gaacucgaucacgaa

SEQ ID NO: 3579771 - RNA, 14 nt, Pseudomonas putida KT2440
gaacucgccgcgca

SEQ ID NO: 3579772 - RNA, 18 nt, Pseudomonas putida KT2440
gaacucggcgagccgcca

SEQ ID NO: 3579773 - RNA, 20 nt, Pseudomonas putida KT2440
gaacucgucaccgccccagc

SEQ ID NO: 3579774 - RNA, 16 nt, Pseudomonas putida KT2440
gaacucuggcaacagc

SEQ ID NO: 3579775 - RNA, 17 nt, Pseudomonas putida KT2440
gaacucuggcaacagcu

SEQ ID NO: 3579776 - RNA, 15 nt, Pseudomonas putida KT2440
gaacucuuccagcuc

SEQ ID NO: 3579777 - RNA, 18 nt, Pseudomonas putida KT2440
gaacucuuccagcucgcu

SEQ ID NO: 3579778 - RNA, 15 nt, Pseudomonas putida KT2440
gaacugcaagcucga

SEQ ID NO: 3579779 - RNA, 14 nt, Pseudomonas putida KT2440
gaacugcagagccu

SEQ ID NO: 3579780 - RNA, 17 nt, Pseudomonas putida KT2440
gaacugcagagccugca

SEQ ID NO: 3579781 - RNA, 16 nt, Pseudomonas putida KT2440
gaacugcugcacuggc

SEQ ID NO: 3579782 - RNA, 12 nt, Pseudomonas putida KT2440
gaacuggcugcc

SEQ ID NO: 3579783 - RNA, 15 nt, Pseudomonas putida KT2440
gaacuggcugccgcu

SEQ ID NO: 3579784 - RNA, 17 nt, Pseudomonas putida KT2440
gaacuggcugccgcuga

SEQ ID NO: 3579785 - RNA, 20 nt, Pseudomonas putida KT2440
gaacuggcugccgcugacca

SEQ ID NO: 3579786 - RNA, 15 nt, Pseudomonas putida KT2440
gaacugggcauccag

SEQ ID NO: 3579787 - RNA, 20 nt, Pseudomonas putida KT2440
gaacuuccaguccgccucgu

SEQ ID NO: 3579788 - RNA, 14 nt, Pseudomonas putida KT2440
gaacuucuccagcg

SEQ ID NO: 3579789 - RNA, 22 nt, Pseudomonas putida KT2440
gaacuugcccggggugcagauc

SEQ ID NO: 3579790 - RNA, 16 nt, Pseudomonas putida KT2440
gaacuuguuggccacc

SEQ ID NO: 3579791 - RNA, 14 nt, Pseudomonas putida KT2440
gaagaacaccugca

SEQ ID NO: 3579792 - RNA, 11 nt, Pseudomonas putida KT2440
gaagaacuccu

SEQ ID NO: 3579793 - RNA, 14 nt, Pseudomonas putida KT2440
gaagaagcucccgg

SEQ ID NO: 3579794 - RNA, 23 nt, Pseudomonas putida KT2440
gaagaagucauccggcgcggccu

SEQ ID NO: 3579795 - RNA, 13 nt, Pseudomonas putida KT2440
gaagaauguagaa

SEQ ID NO: 3579796 - RNA, 13 nt, Pseudomonas putida KT2440
gaagaauugcugg

SEQ ID NO: 3579797 - RNA, 14 nt, Pseudomonas putida KT2440
gaagaccgccgccc

SEQ ID NO: 3579798 - RNA, 23 nt, Pseudomonas putida KT2440
gaagacgaaauacuuacguacag

SEQ ID NO: 3579799 - RNA, 21 nt, Pseudomonas putida KT2440
gaagacgcacacuccccucga

SEQ ID NO: 3579800 - RNA, 18 nt, Pseudomonas putida KT2440
gaagacgcucgacagcaa

SEQ ID NO: 3579801 - RNA, 20 nt, Pseudomonas putida KT2440
gaagacggucuccccuuccc

SEQ ID NO: 3579802 - RNA, 18 nt, Pseudomonas putida KT2440
gaagagauauguccaucc

SEQ ID NO: 3579803 - RNA, 23 nt, Pseudomonas putida KT2440
gaagagauauguccauccaugca

SEQ ID NO: 3579804 - RNA, 21 nt, Pseudomonas putida KT2440
gaagagccccuaaagggugaa

SEQ ID NO: 3579805 - RNA, 20 nt, Pseudomonas putida KT2440
gaagaggccaguaccagcag

SEQ ID NO: 3579806 - RNA, 19 nt, Pseudomonas putida KT2440
gaagaggccccgacagcaa

SEQ ID NO: 3579807 - RNA, 20 nt, Pseudomonas putida KT2440
gaagaggcccgaacagacaa

SEQ ID NO: 3579808 - RNA, 19 nt, Pseudomonas putida KT2440
gaagaggcccgucaggcaa

SEQ ID NO: 3579809 - RNA, 14 nt, Pseudomonas putida KT2440
gaagaggccggcac

SEQ ID NO: 3579810 - RNA, 17 nt, Pseudomonas putida KT2440
gaagaggccggcacagg

SEQ ID NO: 3579811 - RNA, 14 nt, Pseudomonas putida KT2440
gaagagguccugac

SEQ ID NO: 3579812 - RNA, 20 nt, Pseudomonas putida KT2440
gaagagguccugacaggcuu

SEQ ID NO: 3579813 - RNA, 13 nt, Pseudomonas putida KT2440
gaagaguggaucg

SEQ ID NO: 3579814 - RNA, 21 nt, Pseudomonas putida KT2440
gaagauauugguccagccaca

SEQ ID NO: 3579815 - RNA, 16 nt, Pseudomonas putida KT2440
gaagaucaccuggucg

SEQ ID NO: 3579816 - RNA, 17 nt, Pseudomonas putida KT2440
gaagaucgguacaugcg

SEQ ID NO: 3579817 - RNA, 23 nt, Pseudomonas putida KT2440
gaagaucgguacaugcgaacgca

SEQ ID NO: 3579818 - RNA, 20 nt, Pseudomonas putida KT2440
gaagaugacuggccggagcu

SEQ ID NO: 3579819 - RNA, 17 nt, Pseudomonas putida KT2440
gaagcaagcgcauggug

SEQ ID NO: 3579820 - RNA, 14 nt, Pseudomonas putida KT2440
gaagcaccagguuu

SEQ ID NO: 3579821 - RNA, 15 nt, Pseudomonas putida KT2440
gaagcagaacaucag

SEQ ID NO: 3579822 - RNA, 13 nt, Pseudomonas putida KT2440
gaagcagaucauc

SEQ ID NO: 3579823 - RNA, 15 nt, Pseudomonas putida KT2440
gaagcagaucaucau

SEQ ID NO: 3579824 - RNA, 12 nt, Pseudomonas putida KT2440
gaagcagcagcu

SEQ ID NO: 3579825 - RNA, 18 nt, Pseudomonas putida KT2440
gaagcagccaccacggug

SEQ ID NO: 3579826 - RNA, 18 nt, Pseudomonas putida KT2440
gaagcagccgccgccugu

SEQ ID NO: 3579827 - RNA, 19 nt, Pseudomonas putida KT2440
gaagccaguacgcaggcau

SEQ ID NO: 3579828 - RNA, 20 nt, Pseudomonas putida KT2440
gaagccaguacgcgccugca

SEQ ID NO: 3579829 - RNA, 21 nt, Pseudomonas putida KT2440
gaagccauaucccgccagguc

SEQ ID NO: 3579830 - RNA, 15 nt, Pseudomonas putida KT2440
gaagccaugggcaga

SEQ ID NO: 3579831 - RNA, 13 nt, Pseudomonas putida KT2440
gaagccccgcgcg

SEQ ID NO: 3579832 - RNA, 20 nt, Pseudomonas putida KT2440
gaagcccguacagaccgccg

SEQ ID NO: 3579833 - RNA, 20 nt, Pseudomonas putida KT2440
gaagcccguggcccucagcc

SEQ ID NO: 3579834 - RNA, 15 nt, Pseudomonas putida KT2440
gaagcccugcugcug

SEQ ID NO: 3579835 - RNA, 18 nt, Pseudomonas putida KT2440
gaagcccugcugcuggca

SEQ ID NO: 3579836 - RNA, 15 nt, Pseudomonas putida KT2440
gaagccgaccacuuc

SEQ ID NO: 3579837 - RNA, 21 nt, Pseudomonas putida KT2440
gaagccgacccgggccagcca

SEQ ID NO: 3579838 - RNA, 22 nt, Pseudomonas putida KT2440
gaagccgaucuuggugaugcug

SEQ ID NO: 3579839 - RNA, 17 nt, Pseudomonas putida KT2440
gaagccggcauggcggu

SEQ ID NO: 3579840 - RNA, 22 nt, Pseudomonas putida KT2440
gaagccuacaaagcgcucgaag

SEQ ID NO: 3579841 - RNA, 14 nt, Pseudomonas putida KT2440
gaagccucaccgcc

SEQ ID NO: 3579842 - RNA, 22 nt, Pseudomonas putida KT2440
gaagccucaccgccgcauuagc

SEQ ID NO: 3579843 - RNA, 23 nt, Pseudomonas putida KT2440
gaagccuggugaguggcccugga

SEQ ID NO: 3579844 - RNA, 13 nt, Pseudomonas putida KT2440
gaagccuucacgg

SEQ ID NO: 3579845 - RNA, 14 nt, Pseudomonas putida KT2440
gaagccuucaucac

SEQ ID NO: 3579846 - RNA, 15 nt, Pseudomonas putida KT2440
gaagccuucaucacg

SEQ ID NO: 3579847 - RNA, 15 nt, Pseudomonas putida KT2440
gaagccuuggccuug

SEQ ID NO: 3579848 - RNA, 19 nt, Pseudomonas putida KT2440
gaagccuuggccuuggcag

SEQ ID NO: 3579849 - RNA, 13 nt, Pseudomonas putida KT2440
gaagcgaacacag

SEQ ID NO: 3579850 - RNA, 22 nt, Pseudomonas putida KT2440
gaagcgacagcggccagcucgg

SEQ ID NO: 3579851 - RNA, 14 nt, Pseudomonas putida KT2440
gaagcgccgcaggu

SEQ ID NO: 3579852 - RNA, 18 nt, Pseudomonas putida KT2440
gaagcgccuggagagccc

SEQ ID NO: 3579853 - RNA, 22 nt, Pseudomonas putida KT2440
gaagcgcuuggucccccacuuc

SEQ ID NO: 3579854 - RNA, 18 nt, Pseudomonas putida KT2440
gaagcggccgaggccgau

SEQ ID NO: 3579855 - RNA, 20 nt, Pseudomonas putida KT2440
gaagcggcuaccgcugcgca

SEQ ID NO: 3579856 - RNA, 19 nt, Pseudomonas putida KT2440
gaagcgggcgugcccgcga

SEQ ID NO: 3579857 - RNA, 20 nt, Pseudomonas putida KT2440
gaagcgggcgugcccgcgaa

SEQ ID NO: 3579858 - RNA, 23 nt, Pseudomonas putida KT2440
gaagcggucguuacccagguaga

SEQ ID NO: 3579859 - RNA, 19 nt, Pseudomonas putida KT2440
gaagcggucguugaugcgc

SEQ ID NO: 3579860 - RNA, 17 nt, Pseudomonas putida KT2440
gaagcgguugaccgccg

SEQ ID NO: 3579861 - RNA, 21 nt, Pseudomonas putida KT2440
gaagcgugcgaaguugguccc

SEQ ID NO: 3579862 - RNA, 22 nt, Pseudomonas putida KT2440
gaagcguuuacugcugaugcgg

SEQ ID NO: 3579863 - RNA, 15 nt, Pseudomonas putida KT2440
gaagcuaaagagucc

SEQ ID NO: 3579864 - RNA, 16 nt, Pseudomonas putida KT2440
gaagcuaaagaguccg

SEQ ID NO: 3579865 - RNA, 15 nt, Pseudomonas putida KT2440
gaagcuaacccgguc

SEQ ID NO: 3579866 - RNA, 16 nt, Pseudomonas putida KT2440
gaagcuaucgccagca

SEQ ID NO: 3579867 - RNA, 13 nt, Pseudomonas putida KT2440
gaagcuccaggcg

SEQ ID NO: 3579868 - RNA, 16 nt, Pseudomonas putida KT2440
gaagcucuggucgauc

SEQ ID NO: 3579869 - RNA, 22 nt, Pseudomonas putida KT2440
gaagcucuggucgaucuucagc

SEQ ID NO: 3579870 - RNA, 14 nt, Pseudomonas putida KT2440
gaagcugcagcagc

SEQ ID NO: 3579871 - RNA, 15 nt, Pseudomonas putida KT2440
gaagcugcagcagcu

SEQ ID NO: 3579872 - RNA, 23 nt, Pseudomonas putida KT2440
gaagcuggagucguugcgcuggu

SEQ ID NO: 3579873 - RNA, 24 nt, Pseudomonas putida KT2440
gaagcuggagucguugcgcugguu

SEQ ID NO: 3579874 - RNA, 14 nt, Pseudomonas putida KT2440
gaagcuggccagcc

SEQ ID NO: 3579875 - RNA, 11 nt, Pseudomonas putida KT2440
gaagcuggccg

SEQ ID NO: 3579876 - RNA, 17 nt, Pseudomonas putida KT2440
gaagcuguacagcgcau

SEQ ID NO: 3579877 - RNA, 19 nt, Pseudomonas putida KT2440
gaagcuguagucaccaccg

SEQ ID NO: 3579878 - RNA, 14 nt, Pseudomonas putida KT2440
gaagcuguggggcu

SEQ ID NO: 3579879 - RNA, 17 nt, Pseudomonas putida KT2440
gaagcuuggggcgaugu

SEQ ID NO: 3579880 - RNA, 13 nt, Pseudomonas putida KT2440
gaaggacaucacc

SEQ ID NO: 3579881 - RNA, 19 nt, Pseudomonas putida KT2440
gaaggcaaucgcgcccggu

SEQ ID NO: 3579882 - RNA, 20 nt, Pseudomonas putida KT2440
gaaggcaaucgcgcccggug

SEQ ID NO: 3579883 - RNA, 16 nt, Pseudomonas putida KT2440
gaaggcaggucagcga

SEQ ID NO: 3579884 - RNA, 14 nt, Pseudomonas putida KT2440
gaaggcauccaggg

SEQ ID NO: 3579885 - RNA, 17 nt, Pseudomonas putida KT2440
gaaggcauccagggcgu

SEQ ID NO: 3579886 - RNA, 22 nt, Pseudomonas putida KT2440
gaaggcaucgaacuccugcacc

SEQ ID NO: 3579887 - RNA, 13 nt, Pseudomonas putida KT2440
gaaggccagcaaa

SEQ ID NO: 3579888 - RNA, 19 nt, Pseudomonas putida KT2440
gaaggccagccgagccaag

SEQ ID NO: 3579889 - RNA, 20 nt, Pseudomonas putida KT2440
gaaggccgccggcaacuggc

SEQ ID NO: 3579890 - RNA, 21 nt, Pseudomonas putida KT2440
gaaggccgccggcaacuggca

SEQ ID NO: 3579891 - RNA, 17 nt, Pseudomonas putida KT2440
gaaggccguaggccagg

SEQ ID NO: 3579892 - RNA, 15 nt, Pseudomonas putida KT2440
gaaggccguggcaag

SEQ ID NO: 3579893 - RNA, 22 nt, Pseudomonas putida KT2440
gaaggccucacgcaucugcgcu

SEQ ID NO: 3579894 - RNA, 23 nt, Pseudomonas putida KT2440
gaaggcgacuuucgggucgccuu

SEQ ID NO: 3579895 - RNA, 15 nt, Pseudomonas putida KT2440
gaaggcgucacccgc

SEQ ID NO: 3579896 - RNA, 16 nt, Pseudomonas putida KT2440
gaaggcgucacccgcg

SEQ ID NO: 3579897 - RNA, 17 nt, Pseudomonas putida KT2440
gaaggcgucacccgcgc

SEQ ID NO: 3579898 - RNA, 15 nt, Pseudomonas putida KT2440
gaaggcuacauccag

SEQ ID NO: 3579899 - RNA, 15 nt, Pseudomonas putida KT2440
gaaggcugccuggcc

SEQ ID NO: 3579900 - RNA, 18 nt, Pseudomonas putida KT2440
gaaggcugccuggcccgc

SEQ ID NO: 3579901 - RNA, 20 nt, Pseudomonas putida KT2440
gaagggauguuggaauaaga

SEQ ID NO: 3579902 - RNA, 17 nt, Pseudomonas putida KT2440
gaagggcucaacaccag

SEQ ID NO: 3579903 - RNA, 21 nt, Pseudomonas putida KT2440
gaagggcucaacgccagggca

SEQ ID NO: 3579904 - RNA, 17 nt, Pseudomonas putida KT2440
gaaggggaucagcacgc

SEQ ID NO: 3579905 - RNA, 14 nt, Pseudomonas putida KT2440
gaaggggccgcaaa

SEQ ID NO: 3579906 - RNA, 15 nt, Pseudomonas putida KT2440
gaaggggccggcaca

SEQ ID NO: 3579907 - RNA, 18 nt, Pseudomonas putida KT2440
gaaggucaccaguucacc

SEQ ID NO: 3579908 - RNA, 19 nt, Pseudomonas putida KT2440
gaaggucacgcccaucagg

SEQ ID NO: 3579909 - RNA, 15 nt, Pseudomonas putida KT2440
gaaggucuucagcuc

SEQ ID NO: 3579910 - RNA, 22 nt, Pseudomonas putida KT2440
gaaggugauguugcccggcaug

SEQ ID NO: 3579911 - RNA, 14 nt, Pseudomonas putida KT2440
gaagguggccggca

SEQ ID NO: 3579912 - RNA, 16 nt, Pseudomonas putida KT2440
gaagguggccggcaac

SEQ ID NO: 3579913 - RNA, 14 nt, Pseudomonas putida KT2440
gaaggugguagccg

SEQ ID NO: 3579914 - RNA, 14 nt, Pseudomonas putida KT2440
gaaggugucgaugc

SEQ ID NO: 3579915 - RNA, 14 nt, Pseudomonas putida KT2440
gaagguugagcagu

SEQ ID NO: 3579916 - RNA, 15 nt, Pseudomonas putida KT2440
gaaguacucggcacg

SEQ ID NO: 3579917 - RNA, 22 nt, Pseudomonas putida KT2440
gaaguagaacuggcgcagcagg

SEQ ID NO: 3579918 - RNA, 17 nt, Pseudomonas putida KT2440
gaagucaaccaacuccu

SEQ ID NO: 3579919 - RNA, 18 nt, Pseudomonas putida KT2440
gaagucacaccaucggcc

SEQ ID NO: 3579920 - RNA, 23 nt, Pseudomonas putida KT2440
gaagucagccagguuuuugaugu

SEQ ID NO: 3579921 - RNA, 19 nt, Pseudomonas putida KT2440
gaagucaggggaaucccgc

SEQ ID NO: 3579922 - RNA, 21 nt, Pseudomonas putida KT2440
gaagucagguaggugcugacc

SEQ ID NO: 3579923 - RNA, 16 nt, Pseudomonas putida KT2440
gaaguccgggguuuuu

SEQ ID NO: 3579924 - RNA, 20 nt, Pseudomonas putida KT2440
gaagucgagcgccgcccgca

SEQ ID NO: 3579925 - RNA, 19 nt, Pseudomonas putida KT2440
gaagucgcacaugaagccg

SEQ ID NO: 3579926 - RNA, 13 nt, Pseudomonas putida KT2440
gaagucgccacac

SEQ ID NO: 3579927 - RNA, 23 nt, Pseudomonas putida KT2440
gaagucgccacaccacagcugca

SEQ ID NO: 3579928 - RNA, 23 nt, Pseudomonas putida KT2440
gaagucguccacgcgcaggccac

SEQ ID NO: 3579929 - RNA, 20 nt, Pseudomonas putida KT2440
gaagugaucaaugucgagca

SEQ ID NO: 3579930 - RNA, 21 nt, Pseudomonas putida KT2440
gaagugcacugccuggcucag

SEQ ID NO: 3579931 - RNA, 21 nt, Pseudomonas putida KT2440
gaagugccaaggcuuuuugau

SEQ ID NO: 3579932 - RNA, 20 nt, Pseudomonas putida KT2440
gaagugcgcaauccuugccc

SEQ ID NO: 3579933 - RNA, 17 nt, Pseudomonas putida KT2440
gaaguggagaucgucgu

SEQ ID NO: 3579934 - RNA, 16 nt, Pseudomonas putida KT2440
gaaguggauauccagc

SEQ ID NO: 3579935 - RNA, 14 nt, Pseudomonas putida KT2440
gaaguggcagaacu

SEQ ID NO: 3579936 - RNA, 19 nt, Pseudomonas putida KT2440
gaaguggcggcucgcugaa

SEQ ID NO: 3579937 - RNA, 20 nt, Pseudomonas putida KT2440
gaagugggcuugcccgcgaa

SEQ ID NO: 3579938 - RNA, 20 nt, Pseudomonas putida KT2440
gaaguguuaccucccgcaca

SEQ ID NO: 3579939 - RNA, 14 nt, Pseudomonas putida KT2440
gaaguguugccggu

SEQ ID NO: 3579940 - RNA, 21 nt, Pseudomonas putida KT2440
gaaguuaccgcccgcccgacg

SEQ ID NO: 3579941 - RNA, 15 nt, Pseudomonas putida KT2440
gaaguuccugcucuc

SEQ ID NO: 3579942 - RNA, 17 nt, Pseudomonas putida KT2440
gaaguugaagcgccggu

SEQ ID NO: 3579943 - RNA, 22 nt, Pseudomonas putida KT2440
gaauaauucuuauuaccagaau

SEQ ID NO: 3579944 - RNA, 22 nt, Pseudomonas putida KT2440
gaauaccaguaaugcagccggc

SEQ ID NO: 3579945 - RNA, 22 nt, Pseudomonas putida KT2440
gaauacgauauccgcagccccg

SEQ ID NO: 3579946 - RNA, 21 nt, Pseudomonas putida KT2440
gaauacgcucgaccagaucag

SEQ ID NO: 3579947 - RNA, 20 nt, Pseudomonas putida KT2440
gaauacgguagcggcagcaa

SEQ ID NO: 3579948 - RNA, 18 nt, Pseudomonas putida KT2440
gaauacggucgcggcggc

SEQ ID NO: 3579949 - RNA, 21 nt, Pseudomonas putida KT2440
gaauagaacacuggcaggcuc

SEQ ID NO: 3579950 - RNA, 17 nt, Pseudomonas putida KT2440
gaauagcaagcgccaau

SEQ ID NO: 3579951 - RNA, 12 nt, Pseudomonas putida KT2440
gaauagcaucgc

SEQ ID NO: 3579952 - RNA, 22 nt, Pseudomonas putida KT2440
gaauagccggcacagugccaag

SEQ ID NO: 3579953 - RNA, 19 nt, Pseudomonas putida KT2440
gaauagcgcacugagcaac

SEQ ID NO: 3579954 - RNA, 20 nt, Pseudomonas putida KT2440
gaauaggucacguuguagcc

SEQ ID NO: 3579955 - RNA, 23 nt, Pseudomonas putida KT2440
gaauaguagaagcagaucaucau

SEQ ID NO: 3579956 - RNA, 21 nt, Pseudomonas putida KT2440
gaauaugcucuuuccaacgga

SEQ ID NO: 3579957 - RNA, 13 nt, Pseudomonas putida KT2440
gaaucaagccugc

SEQ ID NO: 3579958 - RNA, 20 nt, Pseudomonas putida KT2440
gaaucagagcgaaaugggcc

SEQ ID NO: 3579959 - RNA, 22 nt, Pseudomonas putida KT2440
gaaucagcaaaccgaccaggca

SEQ ID NO: 3579960 - RNA, 23 nt, Pseudomonas putida KT2440
gaaucagcaaaccgaccaggcag

SEQ ID NO: 3579961 - RNA, 20 nt, Pseudomonas putida KT2440
gaaucagccagccuucgcca

SEQ ID NO: 3579962 - RNA, 22 nt, Pseudomonas putida KT2440
gaaucagccagccuucgccaac

SEQ ID NO: 3579963 - RNA, 18 nt, Pseudomonas putida KT2440
gaaucagccccagccggu

SEQ ID NO: 3579964 - RNA, 22 nt, Pseudomonas putida KT2440
gaauccagccggcccggcuggc

SEQ ID NO: 3579965 - RNA, 20 nt, Pseudomonas putida KT2440
gaauccccccuucaccgcca

SEQ ID NO: 3579966 - RNA, 21 nt, Pseudomonas putida KT2440
gaauccccuuauaaugcgccc

SEQ ID NO: 3579967 - RNA, 14 nt, Pseudomonas putida KT2440
gaauccugcugagu

SEQ ID NO: 3579968 - RNA, 19 nt, Pseudomonas putida KT2440
gaauccugcugaguccgcc

SEQ ID NO: 3579969 - RNA, 20 nt, Pseudomonas putida KT2440
gaauccugcugaguccgcca

SEQ ID NO: 3579970 - RNA, 14 nt, Pseudomonas putida KT2440
gaaucgcggucuug

SEQ ID NO: 3579971 - RNA, 19 nt, Pseudomonas putida KT2440
gaaucgcucaugccccgca

SEQ ID NO: 3579972 - RNA, 20 nt, Pseudomonas putida KT2440
gaaucgcucaugccccgcac

SEQ ID NO: 3579973 - RNA, 17 nt, Pseudomonas putida KT2440
gaaucggcuccaggcac

SEQ ID NO: 3579974 - RNA, 19 nt, Pseudomonas putida KT2440
gaaucggcuccaggcacag

SEQ ID NO: 3579975 - RNA, 16 nt, Pseudomonas putida KT2440
gaaucucaaccaccuc

SEQ ID NO: 3579976 - RNA, 17 nt, Pseudomonas putida KT2440
gaaucucccgggccaug

SEQ ID NO: 3579977 - RNA, 17 nt, Pseudomonas putida KT2440
gaaucuggcucugcagc

SEQ ID NO: 3579978 - RNA, 17 nt, Pseudomonas putida KT2440
gaaucuugcgcgccagc

SEQ ID NO: 3579979 - RNA, 20 nt, Pseudomonas putida KT2440
gaaucuugcgcgccagcgca

SEQ ID NO: 3579980 - RNA, 21 nt, Pseudomonas putida KT2440
gaaucuugcgcgccagcgcau

SEQ ID NO: 3579981 - RNA, 21 nt, Pseudomonas putida KT2440
gaaugcgcccggccaggucac

SEQ ID NO: 3579982 - RNA, 17 nt, Pseudomonas putida KT2440
gaaugcgcucauccagc

SEQ ID NO: 3579983 - RNA, 17 nt, Pseudomonas putida KT2440
gaaugcggauguaguuc

SEQ ID NO: 3579984 - RNA, 17 nt, Pseudomonas putida KT2440
gaaugcucgucaccauc

SEQ ID NO: 3579985 - RNA, 15 nt, Pseudomonas putida KT2440
gaauggcccagccag

SEQ ID NO: 3579986 - RNA, 18 nt, Pseudomonas putida KT2440
gaauggccuuuacaccga

SEQ ID NO: 3579987 - RNA, 16 nt, Pseudomonas putida KT2440
gaauggcgucuucgcc

SEQ ID NO: 3579988 - RNA, 19 nt, Pseudomonas putida KT2440
gaaugggcugcaaagcagc

SEQ ID NO: 3579989 - RNA, 14 nt, Pseudomonas putida KT2440
gaauggguggcagc

SEQ ID NO: 3579990 - RNA, 17 nt, Pseudomonas putida KT2440
gaauuauuggccagcaa

SEQ ID NO: 3579991 - RNA, 14 nt, Pseudomonas putida KT2440
gaauuggagcugaa

SEQ ID NO: 3579992 - RNA, 16 nt, Pseudomonas putida KT2440
gaauuucugcaccuug

SEQ ID NO: 3579993 - RNA, 18 nt, Pseudomonas putida KT2440
gaauuugccccuuccuug

SEQ ID NO: 3579994 - RNA, 23 nt, Pseudomonas putida KT2440
gaauuugccgggagcggguuuuc

SEQ ID NO: 3579995 - RNA, 12 nt, Pseudomonas putida KT2440
gacaaaccagcg

SEQ ID NO: 3579996 - RNA, 19 nt, Pseudomonas putida KT2440
gacaaaccagcggucugcu

SEQ ID NO: 3579997 - RNA, 19 nt, Pseudomonas putida KT2440
gacaaacguaccagccgca

SEQ ID NO: 3579998 - RNA, 22 nt, Pseudomonas putida KT2440
gacaaacuccuugaaauucaau

SEQ ID NO: 3579999 - RNA, 23 nt, Pseudomonas putida KT2440
gacaaacugcucgcugccacgca

SEQ ID NO: 3580000 - RNA, 15 nt, Pseudomonas putida KT2440
gacaaacugcugagu

SEQ ID NO: 3580001 - RNA, 13 nt, Pseudomonas putida KT2440
gacaaagccugca

SEQ ID NO: 3580002 - RNA, 17 nt, Pseudomonas putida KT2440
gacaaagcucaaaugcu

SEQ ID NO: 3580003 - RNA, 20 nt, Pseudomonas putida KT2440
gacaaagcucaaaugcuggc

SEQ ID NO: 3580004 - RNA, 12 nt, Pseudomonas putida KT2440
gacaaaggccgg

SEQ ID NO: 3580005 - RNA, 14 nt, Pseudomonas putida KT2440
gacaaaggccggca

SEQ ID NO: 3580006 - RNA, 15 nt, Pseudomonas putida KT2440
gacaaaggccggcac

SEQ ID NO: 3580007 - RNA, 16 nt, Pseudomonas putida KT2440
gacaacagcaugcuca

SEQ ID NO: 3580008 - RNA, 18 nt, Pseudomonas putida KT2440
gacaacauggucacaugu

SEQ ID NO: 3580009 - RNA, 21 nt, Pseudomonas putida KT2440
gacaaccaacaggcucuccau

SEQ ID NO: 3580010 - RNA, 14 nt, Pseudomonas putida KT2440
gacaaccccagccc

SEQ ID NO: 3580011 - RNA, 19 nt, Pseudomonas putida KT2440
gacaacccccacagggcaa

SEQ ID NO: 3580012 - RNA, 12 nt, Pseudomonas putida KT2440
gacaacccgcgc

SEQ ID NO: 3580013 - RNA, 15 nt, Pseudomonas putida KT2440
gacaacgaugugcga

SEQ ID NO: 3580014 - RNA, 20 nt, Pseudomonas putida KT2440
gacaacgcgaaagcgaagaa

SEQ ID NO: 3580015 - RNA, 21 nt, Pseudomonas putida KT2440
gacaacgguguggccagugcc

SEQ ID NO: 3580016 - RNA, 19 nt, Pseudomonas putida KT2440
gacaagccgacaaaaacaa

SEQ ID NO: 3580017 - RNA, 15 nt, Pseudomonas putida KT2440
gacaagccgcugggc

SEQ ID NO: 3580018 - RNA, 21 nt, Pseudomonas putida KT2440
gacaagcgcauugaucgccgc

SEQ ID NO: 3580019 - RNA, 15 nt, Pseudomonas putida KT2440
gacaagcugcgcccu

SEQ ID NO: 3580020 - RNA, 22 nt, Pseudomonas putida KT2440
gacaaggcauuuucaaugcuuu

SEQ ID NO: 3580021 - RNA, 19 nt, Pseudomonas putida KT2440
gacaagguacucagcggcu

SEQ ID NO: 3580022 - RNA, 23 nt, Pseudomonas putida KT2440
gacaaguucauuaccauccauca

SEQ ID NO: 3580023 - RNA, 14 nt, Pseudomonas putida KT2440
gacaaucgccaggu

SEQ ID NO: 3580024 - RNA, 21 nt, Pseudomonas putida KT2440
gacaaugcgacugagcaacga

SEQ ID NO: 3580025 - RNA, 16 nt, Pseudomonas putida KT2440
gacacaccaauggcca

SEQ ID NO: 3580026 - RNA, 12 nt, Pseudomonas putida KT2440
gacacaggccgu

SEQ ID NO: 3580027 - RNA, 15 nt, Pseudomonas putida KT2440
gacacaggccgucgu

SEQ ID NO: 3580028 - RNA, 15 nt, Pseudomonas putida KT2440
gacacaggcgcucgu

SEQ ID NO: 3580029 - RNA, 19 nt, Pseudomonas putida KT2440
gacacauaggcagccaccu

SEQ ID NO: 3580030 - RNA, 17 nt, Pseudomonas putida KT2440
gacaccagacggccuuc

SEQ ID NO: 3580031 - RNA, 19 nt, Pseudomonas putida KT2440
gacaccgggauacugcgca

SEQ ID NO: 3580032 - RNA, 13 nt, Pseudomonas putida KT2440
gacacgagcggcc

SEQ ID NO: 3580033 - RNA, 14 nt, Pseudomonas putida KT2440
gacacggacucaua

SEQ ID NO: 3580034 - RNA, 19 nt, Pseudomonas putida KT2440
gacacggcugccgacaggc

SEQ ID NO: 3580035 - RNA, 20 nt, Pseudomonas putida KT2440
gacacuaggagugucagcgu

SEQ ID NO: 3580036 - RNA, 23 nt, Pseudomonas putida KT2440
gacacuccgcuuucagccgagcc

SEQ ID NO: 3580037 - RNA, 20 nt, Pseudomonas putida KT2440
gacacugccaucucgccaag

SEQ ID NO: 3580038 - RNA, 21 nt, Pseudomonas putida KT2440
gacacugccaucucgccaagc

SEQ ID NO: 3580039 - RNA, 17 nt, Pseudomonas putida KT2440
gacagaaucgcggucuu

SEQ ID NO: 3580040 - RNA, 15 nt, Pseudomonas putida KT2440
gacagacagggccuu

SEQ ID NO: 3580041 - RNA, 12 nt, Pseudomonas putida KT2440
gacagcaccaug

SEQ ID NO: 3580042 - RNA, 13 nt, Pseudomonas putida KT2440
gacagcaggaaca

SEQ ID NO: 3580043 - RNA, 15 nt, Pseudomonas putida KT2440
gacagcaggaacagc

SEQ ID NO: 3580044 - RNA, 18 nt, Pseudomonas putida KT2440
gacagcaggaacagcggc

SEQ ID NO: 3580045 - RNA, 20 nt, Pseudomonas putida KT2440
gacagcaggaacagcggcag

SEQ ID NO: 3580046 - RNA, 20 nt, Pseudomonas putida KT2440
gacagcaucaucaggccgau

SEQ ID NO: 3580047 - RNA, 22 nt, Pseudomonas putida KT2440
gacagcaucucggucgacaggg

SEQ ID NO: 3580048 - RNA, 20 nt, Pseudomonas putida KT2440
gacagcaucugcaccaggaa

SEQ ID NO: 3580049 - RNA, 21 nt, Pseudomonas putida KT2440
gacagcaucugcaccaggaag

SEQ ID NO: 3580050 - RNA, 13 nt, Pseudomonas putida KT2440
gacagccacaugc

SEQ ID NO: 3580051 - RNA, 14 nt, Pseudomonas putida KT2440
gacagccacaugcc

SEQ ID NO: 3580052 - RNA, 19 nt, Pseudomonas putida KT2440
gacagccaccgcgagcugu

SEQ ID NO: 3580053 - RNA, 13 nt, Pseudomonas putida KT2440
gacagccaccugc

SEQ ID NO: 3580054 - RNA, 14 nt, Pseudomonas putida KT2440
gacagcccaaggcc

SEQ ID NO: 3580055 - RNA, 16 nt, Pseudomonas putida KT2440
gacagccucaaggccg

SEQ ID NO: 3580056 - RNA, 17 nt, Pseudomonas putida KT2440
gacagcgcccggcgcag

SEQ ID NO: 3580057 - RNA, 14 nt, Pseudomonas putida KT2440
gacagcgcuuccaa

SEQ ID NO: 3580058 - RNA, 23 nt, Pseudomonas putida KT2440
gacagcggcagcaucgaccugcc

SEQ ID NO: 3580059 - RNA, 13 nt, Pseudomonas putida KT2440
gacagcggccagc

SEQ ID NO: 3580060 - RNA, 18 nt, Pseudomonas putida KT2440
gacagcguugcuccagcu

SEQ ID NO: 3580061 - RNA, 18 nt, Pseudomonas putida KT2440
gacagcucaagcccugcc

SEQ ID NO: 3580062 - RNA, 22 nt, Pseudomonas putida KT2440
gacagcucucaacguucauccc

SEQ ID NO: 3580063 - RNA, 19 nt, Pseudomonas putida KT2440
gacagcugcggcaugaagg

SEQ ID NO: 3580064 - RNA, 14 nt, Pseudomonas putida KT2440
gacagcuugcccag

SEQ ID NO: 3580065 - RNA, 20 nt, Pseudomonas putida KT2440
gacagcuuguugccagcggc

SEQ ID NO: 3580066 - RNA, 22 nt, Pseudomonas putida KT2440
gacaggcagucaugggccaugc

SEQ ID NO: 3580067 - RNA, 18 nt, Pseudomonas putida KT2440
gacaggccccagucuucg

SEQ ID NO: 3580068 - RNA, 19 nt, Pseudomonas putida KT2440
gacaggccgugaaccaucc

SEQ ID NO: 3580069 - RNA, 19 nt, Pseudomonas putida KT2440
gacaggcuugaagcugcgc

SEQ ID NO: 3580070 - RNA, 14 nt, Pseudomonas putida KT2440
gacaggggcgcaga

SEQ ID NO: 3580071 - RNA, 18 nt, Pseudomonas putida KT2440
gacagguaggcgccacgc

SEQ ID NO: 3580072 - RNA, 16 nt, Pseudomonas putida KT2440
gacaggugccucugcu

SEQ ID NO: 3580073 - RNA, 22 nt, Pseudomonas putida KT2440
gacaggugcggcagcucgccgu

SEQ ID NO: 3580074 - RNA, 14 nt, Pseudomonas putida KT2440
gacagugcccgcug

SEQ ID NO: 3580075 - RNA, 15 nt, Pseudomonas putida KT2440
gacagugcccgcuga

SEQ ID NO: 3580076 - RNA, 19 nt, Pseudomonas putida KT2440
gacaguggaaacgacaagg

SEQ ID NO: 3580077 - RNA, 20 nt, Pseudomonas putida KT2440
gacaguggaaacgacaaggu

SEQ ID NO: 3580078 - RNA, 13 nt, Pseudomonas putida KT2440
gacaguucgccac

SEQ ID NO: 3580079 - RNA, 15 nt, Pseudomonas putida KT2440
gacaguucgccaccc

SEQ ID NO: 3580080 - RNA, 23 nt, Pseudomonas putida KT2440
gacauaccacacaccccagaacg

SEQ ID NO: 3580081 - RNA, 22 nt, Pseudomonas putida KT2440
gacauccagcgccgccaugcag

SEQ ID NO: 3580082 - RNA, 20 nt, Pseudomonas putida KT2440
gacauccugcucccaaagca

SEQ ID NO: 3580083 - RNA, 23 nt, Pseudomonas putida KT2440
gacaucgcgguauccaucaccau

SEQ ID NO: 3580084 - RNA, 22 nt, Pseudomonas putida KT2440
gacaugcaccacgccaccaugc

SEQ ID NO: 3580085 - RNA, 16 nt, Pseudomonas putida KT2440
gaccaacaggcuggca

SEQ ID NO: 3580086 - RNA, 13 nt, Pseudomonas putida KT2440
gaccaacgccagu

SEQ ID NO: 3580087 - RNA, 18 nt, Pseudomonas putida KT2440
gaccaagcaacgcaacaa

SEQ ID NO: 3580088 - RNA, 13 nt, Pseudomonas putida KT2440
gaccaaggccaac

SEQ ID NO: 3580089 - RNA, 14 nt, Pseudomonas putida KT2440
gaccacaaagccuu

SEQ ID NO: 3580090 - RNA, 12 nt, Pseudomonas putida KT2440
gaccacacugcu

SEQ ID NO: 3580091 - RNA, 13 nt, Pseudomonas putida KT2440
gaccacaggcgcu

SEQ ID NO: 3580092 - RNA, 12 nt, Pseudomonas putida KT2440
gaccaccagcaa

SEQ ID NO: 3580093 - RNA, 17 nt, Pseudomonas putida KT2440
gaccaccaucgccaggc

SEQ ID NO: 3580094 - RNA, 15 nt, Pseudomonas putida KT2440
gaccaccgcaggugc

SEQ ID NO: 3580095 - RNA, 19 nt, Pseudomonas putida KT2440
gaccaccgcaggugcaggc

SEQ ID NO: 3580096 - RNA, 19 nt, Pseudomonas putida KT2440
gaccaccgccaaggcacgg

SEQ ID NO: 3580097 - RNA, 13 nt, Pseudomonas putida KT2440
gaccaccucaucc

SEQ ID NO: 3580098 - RNA, 14 nt, Pseudomonas putida KT2440
gaccaccugcucgg

SEQ ID NO: 3580099 - RNA, 17 nt, Pseudomonas putida KT2440
gaccaccugcucggcgc

SEQ ID NO: 3580100 - RNA, 13 nt, Pseudomonas putida KT2440
gaccacgacguga

SEQ ID NO: 3580101 - RNA, 23 nt, Pseudomonas putida KT2440
gaccacgaugccuucgaccacca

SEQ ID NO: 3580102 - RNA, 22 nt, Pseudomonas putida KT2440
gaccacgccgaagcgcgccugg

SEQ ID NO: 3580103 - RNA, 16 nt, Pseudomonas putida KT2440
gaccacggccggggcc

SEQ ID NO: 3580104 - RNA, 17 nt, Pseudomonas putida KT2440
gaccacggccggggccu

SEQ ID NO: 3580105 - RNA, 20 nt, Pseudomonas putida KT2440
gaccacggccggggccuguu

SEQ ID NO: 3580106 - RNA, 15 nt, Pseudomonas putida KT2440
gaccacgguaccggc

SEQ ID NO: 3580107 - RNA, 15 nt, Pseudomonas putida KT2440
gaccacugcaggugc

SEQ ID NO: 3580108 - RNA, 16 nt, Pseudomonas putida KT2440
gaccacugcaggugca

SEQ ID NO: 3580109 - RNA, 19 nt, Pseudomonas putida KT2440
gaccacugcaggugcaggu

SEQ ID NO: 3580110 - RNA, 18 nt, Pseudomonas putida KT2440
gaccacuucaagcacgcc

SEQ ID NO: 3580111 - RNA, 20 nt, Pseudomonas putida KT2440
gaccacuucgacauggcugg

SEQ ID NO: 3580112 - RNA, 14 nt, Pseudomonas putida KT2440
gaccagacagcgcu

SEQ ID NO: 3580113 - RNA, 19 nt, Pseudomonas putida KT2440
gaccagacccgcuucgccg

SEQ ID NO: 3580114 - RNA, 14 nt, Pseudomonas putida KT2440
gaccagaucagccg

SEQ ID NO: 3580115 - RNA, 18 nt, Pseudomonas putida KT2440
gaccagaucaggccgcug

SEQ ID NO: 3580116 - RNA, 16 nt, Pseudomonas putida KT2440
gaccagcaccaccugu

SEQ ID NO: 3580117 - RNA, 16 nt, Pseudomonas putida KT2440
gaccagcagcaguggc

SEQ ID NO: 3580118 - RNA, 12 nt, Pseudomonas putida KT2440
gaccagcagugu

SEQ ID NO: 3580119 - RNA, 20 nt, Pseudomonas putida KT2440
gaccagcccggcuccgcgca

SEQ ID NO: 3580120 - RNA, 14 nt, Pseudomonas putida KT2440
gaccagccgggcug

SEQ ID NO: 3580121 - RNA, 15 nt, Pseudomonas putida KT2440
gaccagccgggcugc

SEQ ID NO: 3580122 - RNA, 12 nt, Pseudomonas putida KT2440
gaccagcgccgc

SEQ ID NO: 3580123 - RNA, 16 nt, Pseudomonas putida KT2440
gaccagcggcagcaag

SEQ ID NO: 3580124 - RNA, 17 nt, Pseudomonas putida KT2440
gaccagcugccauacag

SEQ ID NO: 3580125 - RNA, 18 nt, Pseudomonas putida KT2440
gaccaggcaguaggugca

SEQ ID NO: 3580126 - RNA, 14 nt, Pseudomonas putida KT2440
gaccaggcccagca

SEQ ID NO: 3580127 - RNA, 16 nt, Pseudomonas putida KT2440
gaccaggcccagcagg

SEQ ID NO: 3580128 - RNA, 22 nt, Pseudomonas putida KT2440
gaccaggcgcucgcuccagggc

SEQ ID NO: 3580129 - RNA, 15 nt, Pseudomonas putida KT2440
gaccagggccuuggc

SEQ ID NO: 3580130 - RNA, 20 nt, Pseudomonas putida KT2440
gaccagggccuuggccuggg

SEQ ID NO: 3580131 - RNA, 21 nt, Pseudomonas putida KT2440
gaccaggugguaacuggccag

SEQ ID NO: 3580132 - RNA, 15 nt, Pseudomonas putida KT2440
gaccaguaccgcgcc

SEQ ID NO: 3580133 - RNA, 14 nt, Pseudomonas putida KT2440
gaccagugucugca

SEQ ID NO: 3580134 - RNA, 13 nt, Pseudomonas putida KT2440
gaccaucacggaa

SEQ ID NO: 3580135 - RNA, 12 nt, Pseudomonas putida KT2440
gaccaucagccu

SEQ ID NO: 3580136 - RNA, 14 nt, Pseudomonas putida KT2440
gaccaucagccugu

SEQ ID NO: 3580137 - RNA, 22 nt, Pseudomonas putida KT2440
gaccaucggcaggcgguccagc

SEQ ID NO: 3580138 - RNA, 15 nt, Pseudomonas putida KT2440
gaccauggcgaugaa

SEQ ID NO: 3580139 - RNA, 17 nt, Pseudomonas putida KT2440
gacccaaucgcugugca

SEQ ID NO: 3580140 - RNA, 22 nt, Pseudomonas putida KT2440
gacccaaucgcugugcaacagc

SEQ ID NO: 3580141 - RNA, 12 nt, Pseudomonas putida KT2440
gacccacaggca

SEQ ID NO: 3580142 - RNA, 14 nt, Pseudomonas putida KT2440
gacccacaggcaca

SEQ ID NO: 3580143 - RNA, 15 nt, Pseudomonas putida KT2440
gacccacaggcacag

SEQ ID NO: 3580144 - RNA, 13 nt, Pseudomonas putida KT2440
gacccagccaccc

SEQ ID NO: 3580145 - RNA, 17 nt, Pseudomonas putida KT2440
gacccagccacccggcg

SEQ ID NO: 3580146 - RNA, 20 nt, Pseudomonas putida KT2440
gacccagccacccggcgcgc

SEQ ID NO: 3580147 - RNA, 16 nt, Pseudomonas putida KT2440
gacccagcggucagca

SEQ ID NO: 3580148 - RNA, 17 nt, Pseudomonas putida KT2440
gacccagucagucgccg

SEQ ID NO: 3580149 - RNA, 16 nt, Pseudomonas putida KT2440
gacccaguucgcggau

SEQ ID NO: 3580150 - RNA, 17 nt, Pseudomonas putida KT2440
gacccccuugccagcau

SEQ ID NO: 3580151 - RNA, 17 nt, Pseudomonas putida KT2440
gacccgcagcagguugc

SEQ ID NO: 3580152 - RNA, 21 nt, Pseudomonas putida KT2440
gacccgcagcagguugcuggu

SEQ ID NO: 3580153 - RNA, 22 nt, Pseudomonas putida KT2440
gacccgccuggugccagcggcc

SEQ ID NO: 3580154 - RNA, 22 nt, Pseudomonas putida KT2440
gacccgcgucagcucaagcgcu

SEQ ID NO: 3580155 - RNA, 12 nt, Pseudomonas putida KT2440
gacccgcugccc

SEQ ID NO: 3580156 - RNA, 14 nt, Pseudomonas putida KT2440
gacccgcuggaccu

SEQ ID NO: 3580157 - RNA, 19 nt, Pseudomonas putida KT2440
gacccgcuggcgaccggcg

SEQ ID NO: 3580158 - RNA, 19 nt, Pseudomonas putida KT2440
gacccggccgcuccagcuc

SEQ ID NO: 3580159 - RNA, 24 nt, Pseudomonas putida KT2440
gacccggccuuucgcgccaguucg

SEQ ID NO: 3580160 - RNA, 13 nt, Pseudomonas putida KT2440
gacccgggccagc

SEQ ID NO: 3580161 - RNA, 16 nt, Pseudomonas putida KT2440
gacccucaagugccgu

SEQ ID NO: 3580162 - RNA, 14 nt, Pseudomonas putida KT2440
gacccugaagcccu

SEQ ID NO: 3580163 - RNA, 15 nt, Pseudomonas putida KT2440
gacccugaagcccug

SEQ ID NO: 3580164 - RNA, 15 nt, Pseudomonas putida KT2440
gacccugacucaugc

SEQ ID NO: 3580165 - RNA, 19 nt, Pseudomonas putida KT2440
gacccugagucuggcgccu

SEQ ID NO: 3580166 - RNA, 19 nt, Pseudomonas putida KT2440
gacccuggcauagcagucc

SEQ ID NO: 3580167 - RNA, 20 nt, Pseudomonas putida KT2440
gacccuguagccccgcuggu

SEQ ID NO: 3580168 - RNA, 19 nt, Pseudomonas putida KT2440
gacccugugggagcgggcu

SEQ ID NO: 3580169 - RNA, 16 nt, Pseudomonas putida KT2440
gacccuuccagcccgc

SEQ ID NO: 3580170 - RNA, 19 nt, Pseudomonas putida KT2440
gacccuugugugggccuug

SEQ ID NO: 3580171 - RNA, 16 nt, Pseudomonas putida KT2440
gaccgaagucgcccuu

SEQ ID NO: 3580172 - RNA, 16 nt, Pseudomonas putida KT2440
gaccgaccaccugcuc

SEQ ID NO: 3580173 - RNA, 19 nt, Pseudomonas putida KT2440
gaccgagaacaggcggccc

SEQ ID NO: 3580174 - RNA, 19 nt, Pseudomonas putida KT2440
gaccgagcacucggcggcg

SEQ ID NO: 3580175 - RNA, 18 nt, Pseudomonas putida KT2440
gaccgauaaagagaagcu

SEQ ID NO: 3580176 - RNA, 20 nt, Pseudomonas putida KT2440
gaccgaugcccaacauaucg

SEQ ID NO: 3580177 - RNA, 15 nt, Pseudomonas putida KT2440
gaccgaugccgccgu

SEQ ID NO: 3580178 - RNA, 14 nt, Pseudomonas putida KT2440
gaccgcacucccca

SEQ ID NO: 3580179 - RNA, 15 nt, Pseudomonas putida KT2440
gaccgcacuccccau

SEQ ID NO: 3580180 - RNA, 23 nt, Pseudomonas putida KT2440
gaccgcacuccccaucagcagcu

SEQ ID NO: 3580181 - RNA, 19 nt, Pseudomonas putida KT2440
gaccgcaucuccaaaaggu

SEQ ID NO: 3580182 - RNA, 24 nt, Pseudomonas putida KT2440
gaccgcauugaucaugcccauggc

SEQ ID NO: 3580183 - RNA, 17 nt, Pseudomonas putida KT2440
gaccgccagcccgccac

SEQ ID NO: 3580184 - RNA, 23 nt, Pseudomonas putida KT2440
gaccgccauugacuaccagguag

SEQ ID NO: 3580185 - RNA, 23 nt, Pseudomonas putida KT2440
gaccgccgaucgaagcagcagcu

SEQ ID NO: 3580186 - RNA, 14 nt, Pseudomonas putida KT2440
gaccgccgccacca

SEQ ID NO: 3580187 - RNA, 15 nt, Pseudomonas putida KT2440
gaccgccgcccaggu

SEQ ID NO: 3580188 - RNA, 17 nt, Pseudomonas putida KT2440
gaccgccgcccagguca

SEQ ID NO: 3580189 - RNA, 18 nt, Pseudomonas putida KT2440
gaccgccgcccaggucau

SEQ ID NO: 3580190 - RNA, 17 nt, Pseudomonas putida KT2440
gaccgccgggcccaggc

SEQ ID NO: 3580191 - RNA, 19 nt, Pseudomonas putida KT2440
gaccgccgggcccaggcau

SEQ ID NO: 3580192 - RNA, 13 nt, Pseudomonas putida KT2440
gaccgccugcgca

SEQ ID NO: 3580193 - RNA, 14 nt, Pseudomonas putida KT2440
gaccgccugcgcac

SEQ ID NO: 3580194 - RNA, 20 nt, Pseudomonas putida KT2440
gaccgccugcgcacggcgcu

SEQ ID NO: 3580195 - RNA, 19 nt, Pseudomonas putida KT2440
gaccgcgcauuugcuccag

SEQ ID NO: 3580196 - RNA, 15 nt, Pseudomonas putida KT2440
gaccgcuguuaccag

SEQ ID NO: 3580197 - RNA, 14 nt, Pseudomonas putida KT2440
gaccggccgggcuu

SEQ ID NO: 3580198 - RNA, 15 nt, Pseudomonas putida KT2440
gaccggccgggcuuc

SEQ ID NO: 3580199 - RNA, 13 nt, Pseudomonas putida KT2440
gaccggcucaaca

SEQ ID NO: 3580200 - RNA, 18 nt, Pseudomonas putida KT2440
gaccgggacgcaggcgca

SEQ ID NO: 3580201 - RNA, 20 nt, Pseudomonas putida KT2440
gaccgggacgcaggcgcaac

SEQ ID NO: 3580202 - RNA, 14 nt, Pseudomonas putida KT2440
gaccggguccagca

SEQ ID NO: 3580203 - RNA, 16 nt, Pseudomonas putida KT2440
gaccggucagcccggc

SEQ ID NO: 3580204 - RNA, 20 nt, Pseudomonas putida KT2440
gaccggucggccaucgacgu

SEQ ID NO: 3580205 - RNA, 16 nt, Pseudomonas putida KT2440
gaccgguggcgccuug

SEQ ID NO: 3580206 - RNA, 17 nt, Pseudomonas putida KT2440
gaccgugaucaucagcg

SEQ ID NO: 3580207 - RNA, 18 nt, Pseudomonas putida KT2440
gaccgugaucaucagcgc

SEQ ID NO: 3580208 - RNA, 19 nt, Pseudomonas putida KT2440
gaccguguugcagcggguu

SEQ ID NO: 3580209 - RNA, 16 nt, Pseudomonas putida KT2440
gaccguuucauugccg

SEQ ID NO: 3580210 - RNA, 22 nt, Pseudomonas putida KT2440
gaccguuucauugccgugcucg

SEQ ID NO: 3580211 - RNA, 17 nt, Pseudomonas putida KT2440
gaccucacagccuucag

SEQ ID NO: 3580212 - RNA, 13 nt, Pseudomonas putida KT2440
gaccucacgcagg

SEQ ID NO: 3580213 - RNA, 16 nt, Pseudomonas putida KT2440
gaccucagccgugguu

SEQ ID NO: 3580214 - RNA, 24 nt, Pseudomonas putida KT2440
gaccuccgucugcucugccaucuc

SEQ ID NO: 3580215 - RNA, 21 nt, Pseudomonas putida KT2440
gaccucgaccaggcgcucgcu

SEQ ID NO: 3580216 - RNA, 17 nt, Pseudomonas putida KT2440
gaccucgacccgcccgc

SEQ ID NO: 3580217 - RNA, 15 nt, Pseudomonas putida KT2440
gaccucuggcgugca

SEQ ID NO: 3580218 - RNA, 16 nt, Pseudomonas putida KT2440
gaccucuuagcgggca

SEQ ID NO: 3580219 - RNA, 15 nt, Pseudomonas putida KT2440
gaccugauccaaauu

SEQ ID NO: 3580220 - RNA, 19 nt, Pseudomonas putida KT2440
gaccugauccaaauugcuc

SEQ ID NO: 3580221 - RNA, 15 nt, Pseudomonas putida KT2440
gaccugcguggugcc

SEQ ID NO: 3580222 - RNA, 19 nt, Pseudomonas putida KT2440
gaccugcguugggggccuu

SEQ ID NO: 3580223 - RNA, 16 nt, Pseudomonas putida KT2440
gaccugcuggcacugc

SEQ ID NO: 3580224 - RNA, 17 nt, Pseudomonas putida KT2440
gaccugcuggcacugcg

SEQ ID NO: 3580225 - RNA, 17 nt, Pseudomonas putida KT2440
gaccugcugggucagcg

SEQ ID NO: 3580226 - RNA, 14 nt, Pseudomonas putida KT2440
gaccuggaucgcca

SEQ ID NO: 3580227 - RNA, 16 nt, Pseudomonas putida KT2440
gaccuggaucgccagg

SEQ ID NO: 3580228 - RNA, 15 nt, Pseudomonas putida KT2440
gaccuggaucgcgcc

SEQ ID NO: 3580229 - RNA, 19 nt, Pseudomonas putida KT2440
gaccuggcccgaacgcagc

SEQ ID NO: 3580230 - RNA, 23 nt, Pseudomonas putida KT2440
gaccuggcucuucaacaccagca

SEQ ID NO: 3580231 - RNA, 15 nt, Pseudomonas putida KT2440
gaccugguccagcuu

SEQ ID NO: 3580232 - RNA, 17 nt, Pseudomonas putida KT2440
gaccuucuggcagccgc

SEQ ID NO: 3580233 - RNA, 19 nt, Pseudomonas putida KT2440
gaccuucuggcagccgccc

SEQ ID NO: 3580234 - RNA, 14 nt, Pseudomonas putida KT2440
gaccuugccagcgc

SEQ ID NO: 3580235 - RNA, 13 nt, Pseudomonas putida KT2440
gaccuugcugcuc

SEQ ID NO: 3580236 - RNA, 20 nt, Pseudomonas putida KT2440
gaccuugggccggcgcaggu

SEQ ID NO: 3580237 - RNA, 18 nt, Pseudomonas putida KT2440
gaccuuguucaucgcauu

SEQ ID NO: 3580238 - RNA, 13 nt, Pseudomonas putida KT2440
gacgaaacccagu

SEQ ID NO: 3580239 - RNA, 13 nt, Pseudomonas putida KT2440
gacgaacagcgcc

SEQ ID NO: 3580240 - RNA, 15 nt, Pseudomonas putida KT2440
gacgaacagcgccgc

SEQ ID NO: 3580241 - RNA, 14 nt, Pseudomonas putida KT2440
gacgaacagggccg

SEQ ID NO: 3580242 - RNA, 17 nt, Pseudomonas putida KT2440
gacgaacucaacgcaac

SEQ ID NO: 3580243 - RNA, 14 nt, Pseudomonas putida KT2440
gacgaccagcaugc

SEQ ID NO: 3580244 - RNA, 18 nt, Pseudomonas putida KT2440
gacgaccagcaugcgaag

SEQ ID NO: 3580245 - RNA, 11 nt, Pseudomonas putida KT2440
gacgagccagu

SEQ ID NO: 3580246 - RNA, 14 nt, Pseudomonas putida KT2440
gacgaggccgagcg

SEQ ID NO: 3580247 - RNA, 17 nt, Pseudomonas putida KT2440
gacgaguuuaccuccau

SEQ ID NO: 3580248 - RNA, 14 nt, Pseudomonas putida KT2440
gacgauaccgccca

SEQ ID NO: 3580249 - RNA, 17 nt, Pseudomonas putida KT2440
gacgaucgagccgguca

SEQ ID NO: 3580250 - RNA, 14 nt, Pseudomonas putida KT2440
gacgaucgccagcc

SEQ ID NO: 3580251 - RNA, 12 nt, Pseudomonas putida KT2440
gacgaucgccgc

SEQ ID NO: 3580252 - RNA, 13 nt, Pseudomonas putida KT2440
gacgaugauggcc

SEQ ID NO: 3580253 - RNA, 20 nt, Pseudomonas putida KT2440
gacgaugccguacaccaugc

SEQ ID NO: 3580254 - RNA, 23 nt, Pseudomonas putida KT2440
gacgaugccguuuucgguaauca

SEQ ID NO: 3580255 - RNA, 18 nt, Pseudomonas putida KT2440
gacgcaaaaaacccggcg

SEQ ID NO: 3580256 - RNA, 15 nt, Pseudomonas putida KT2440
gacgcaaggccgcuc

SEQ ID NO: 3580257 - RNA, 22 nt, Pseudomonas putida KT2440
gacgcaaggccguucccacaaa

SEQ ID NO: 3580258 - RNA, 12 nt, Pseudomonas putida KT2440
gacgcacacucc

SEQ ID NO: 3580259 - RNA, 21 nt, Pseudomonas putida KT2440
gacgcaccagguuggccgccg

SEQ ID NO: 3580260 - RNA, 12 nt, Pseudomonas putida KT2440
gacgcagcagcg

SEQ ID NO: 3580261 - RNA, 15 nt, Pseudomonas putida KT2440
gacgcagggccucga

SEQ ID NO: 3580262 - RNA, 18 nt, Pseudomonas putida KT2440
gacgcagggccucgaugc

SEQ ID NO: 3580263 - RNA, 15 nt, Pseudomonas putida KT2440
gacgcagugcagccg

SEQ ID NO: 3580264 - RNA, 17 nt, Pseudomonas putida KT2440
gacgccaccccggugca

SEQ ID NO: 3580265 - RNA, 13 nt, Pseudomonas putida KT2440
gacgccaccuucg

SEQ ID NO: 3580266 - RNA, 18 nt, Pseudomonas putida KT2440
gacgccaccuucgccagg

SEQ ID NO: 3580267 - RNA, 15 nt, Pseudomonas putida KT2440
gacgccagcgcuggg

SEQ ID NO: 3580268 - RNA, 15 nt, Pseudomonas putida KT2440
gacgccgccagcgcu

SEQ ID NO: 3580269 - RNA, 12 nt, Pseudomonas putida KT2440
gacgccgccauc

SEQ ID NO: 3580270 - RNA, 11 nt, Pseudomonas putida KT2440
gacgccuuggc

SEQ ID NO: 3580271 - RNA, 14 nt, Pseudomonas putida KT2440
gacgcgccgugcca

SEQ ID NO: 3580272 - RNA, 16 nt, Pseudomonas putida KT2440
gacgcgccgugccagg

SEQ ID NO: 3580273 - RNA, 13 nt, Pseudomonas putida KT2440
gacgcgcgcuggc

SEQ ID NO: 3580274 - RNA, 21 nt, Pseudomonas putida KT2440
gacgcggaacuggcugaccag

SEQ ID NO: 3580275 - RNA, 20 nt, Pseudomonas putida KT2440
gacgcgguggagggcaccgg

SEQ ID NO: 3580276 - RNA, 16 nt, Pseudomonas putida KT2440
gacgcgugguccugau

SEQ ID NO: 3580277 - RNA, 16 nt, Pseudomonas putida KT2440
gacgcucggacagcuu

SEQ ID NO: 3580278 - RNA, 15 nt, Pseudomonas putida KT2440
gacgcugcacuucca

SEQ ID NO: 3580279 - RNA, 21 nt, Pseudomonas putida KT2440
gacgcugcacuuccacacccg

SEQ ID NO: 3580280 - RNA, 19 nt, Pseudomonas putida KT2440
gacgcugcccagcaacggu

SEQ ID NO: 3580281 - RNA, 17 nt, Pseudomonas putida KT2440
gacgcugccgcaccugc

SEQ ID NO: 3580282 - RNA, 18 nt, Pseudomonas putida KT2440
gacggccaauggccggga

SEQ ID NO: 3580283 - RNA, 23 nt, Pseudomonas putida KT2440
gacggccuucgaagaacacggcu

SEQ ID NO: 3580284 - RNA, 24 nt, Pseudomonas putida KT2440
gacggccuucgaagaacacggcuu

SEQ ID NO: 3580285 - RNA, 22 nt, Pseudomonas putida KT2440
gacggcgaagucacaccaucgg

SEQ ID NO: 3580286 - RNA, 13 nt, Pseudomonas putida KT2440
gacggcgcugcug

SEQ ID NO: 3580287 - RNA, 17 nt, Pseudomonas putida KT2440
gacgggaagugcacugc

SEQ ID NO: 3580288 - RNA, 13 nt, Pseudomonas putida KT2440
gacgggcauggug

SEQ ID NO: 3580289 - RNA, 15 nt, Pseudomonas putida KT2440
gacgggcauggugga

SEQ ID NO: 3580290 - RNA, 19 nt, Pseudomonas putida KT2440
gacgggccucuucgcgggu

SEQ ID NO: 3580291 - RNA, 16 nt, Pseudomonas putida KT2440
gacgggcugcucccgc

SEQ ID NO: 3580292 - RNA, 21 nt, Pseudomonas putida KT2440
gacgggugaccaggcccagca

SEQ ID NO: 3580293 - RNA, 19 nt, Pseudomonas putida KT2440
gacggguuacccuggucau

SEQ ID NO: 3580294 - RNA, 12 nt, Pseudomonas putida KT2440
gacggucaugcu

SEQ ID NO: 3580295 - RNA, 18 nt, Pseudomonas putida KT2440
gacggucugccggcaccg

SEQ ID NO: 3580296 - RNA, 15 nt, Pseudomonas putida KT2440
gacggugccgguggc

SEQ ID NO: 3580297 - RNA, 19 nt, Pseudomonas putida KT2440
gacggugcgccugaacagc

SEQ ID NO: 3580298 - RNA, 16 nt, Pseudomonas putida KT2440
gacggugcgcgccagc

SEQ ID NO: 3580299 - RNA, 12 nt, Pseudomonas putida KT2440
gacggugguggc

SEQ ID NO: 3580300 - RNA, 17 nt, Pseudomonas putida KT2440
gacgguuacgugcaggc

SEQ ID NO: 3580301 - RNA, 18 nt, Pseudomonas putida KT2440
gacgguugacagcacggc

SEQ ID NO: 3580302 - RNA, 19 nt, Pseudomonas putida KT2440
gacgugcaaggaucaccaa

SEQ ID NO: 3580303 - RNA, 14 nt, Pseudomonas putida KT2440
gacgugcaggaucu

SEQ ID NO: 3580304 - RNA, 18 nt, Pseudomonas putida KT2440
gacgugcgcggggcccga

SEQ ID NO: 3580305 - RNA, 19 nt, Pseudomonas putida KT2440
gacgugcgcuccuggucau

SEQ ID NO: 3580306 - RNA, 13 nt, Pseudomonas putida KT2440
gacguuggccgcc

SEQ ID NO: 3580307 - RNA, 20 nt, Pseudomonas putida KT2440
gacguuggccgccagcggca

SEQ ID NO: 3580308 - RNA, 16 nt, Pseudomonas putida KT2440
gacguugguagcggug

SEQ ID NO: 3580309 - RNA, 22 nt, Pseudomonas putida KT2440
gacguuguucuuguagcugacc

SEQ ID NO: 3580310 - RNA, 16 nt, Pseudomonas putida KT2440
gacguuuaccugcagc

SEQ ID NO: 3580311 - RNA, 15 nt, Pseudomonas putida KT2440
gacuacaucuucgcg

SEQ ID NO: 3580312 - RNA, 23 nt, Pseudomonas putida KT2440
gacuagauaaccaaccccugcgg

SEQ ID NO: 3580313 - RNA, 14 nt, Pseudomonas putida KT2440
gacuaguggccacu

SEQ ID NO: 3580314 - RNA, 21 nt, Pseudomonas putida KT2440
gacucacgcucguuguccagc

SEQ ID NO: 3580315 - RNA, 15 nt, Pseudomonas putida KT2440
gacucagcugcugcu

SEQ ID NO: 3580316 - RNA, 14 nt, Pseudomonas putida KT2440
gacucauagcucag

SEQ ID NO: 3580317 - RNA, 16 nt, Pseudomonas putida KT2440
gacucauagcucagcu

SEQ ID NO: 3580318 - RNA, 20 nt, Pseudomonas putida KT2440
gacucauagcucagcuggau

SEQ ID NO: 3580319 - RNA, 13 nt, Pseudomonas putida KT2440
gacucaugccuuc

SEQ ID NO: 3580320 - RNA, 14 nt, Pseudomonas putida KT2440
gacucaugccuucg

SEQ ID NO: 3580321 - RNA, 14 nt, Pseudomonas putida KT2440
gacucccgcugccu

SEQ ID NO: 3580322 - RNA, 16 nt, Pseudomonas putida KT2440
gacuccgcuucaucag

SEQ ID NO: 3580323 - RNA, 23 nt, Pseudomonas putida KT2440
gacuccgcuucaucaggucgccu

SEQ ID NO: 3580324 - RNA, 23 nt, Pseudomonas putida KT2440
gacuccggcaaggcauccagaaa

SEQ ID NO: 3580325 - RNA, 21 nt, Pseudomonas putida KT2440
gacuccggccggggcucacag

SEQ ID NO: 3580326 - RNA, 22 nt, Pseudomonas putida KT2440
gacucgaucugugggagcggcc

SEQ ID NO: 3580327 - RNA, 22 nt, Pseudomonas putida KT2440
gacucguccgacaaugccagca

SEQ ID NO: 3580328 - RNA, 15 nt, Pseudomonas putida KT2440
gacugaacaccugcc

SEQ ID NO: 3580329 - RNA, 13 nt, Pseudomonas putida KT2440
gacugcaccaggu

SEQ ID NO: 3580330 - RNA, 14 nt, Pseudomonas putida KT2440
gacugcaccagguc

SEQ ID NO: 3580331 - RNA, 16 nt, Pseudomonas putida KT2440
gacugcaccaggucca

SEQ ID NO: 3580332 - RNA, 24 nt, Pseudomonas putida KT2440
gacugcaccagguccagcguggcg

SEQ ID NO: 3580333 - RNA, 13 nt, Pseudomonas putida KT2440
gacugcacugcca

SEQ ID NO: 3580334 - RNA, 18 nt, Pseudomonas putida KT2440
gacugcacugccagcgcc

SEQ ID NO: 3580335 - RNA, 18 nt, Pseudomonas putida KT2440
gacugcagguaguuuucc

SEQ ID NO: 3580336 - RNA, 13 nt, Pseudomonas putida KT2440
gacugccaggccu

SEQ ID NO: 3580337 - RNA, 15 nt, Pseudomonas putida KT2440
gacugcgcuacaccc

SEQ ID NO: 3580338 - RNA, 12 nt, Pseudomonas putida KT2440
gacugcugugga

SEQ ID NO: 3580339 - RNA, 15 nt, Pseudomonas putida KT2440
gacugcuucaggccu

SEQ ID NO: 3580340 - RNA, 19 nt, Pseudomonas putida KT2440
gacuggccggagcuggagc

SEQ ID NO: 3580341 - RNA, 15 nt, Pseudomonas putida KT2440
gacuggcgcaccagc

SEQ ID NO: 3580342 - RNA, 21 nt, Pseudomonas putida KT2440
gacuggcgcaccagcggcuug

SEQ ID NO: 3580343 - RNA, 15 nt, Pseudomonas putida KT2440
gacuggcuggccuug

SEQ ID NO: 3580344 - RNA, 18 nt, Pseudomonas putida KT2440
gacuggugcucugcaggc

SEQ ID NO: 3580345 - RNA, 23 nt, Pseudomonas putida KT2440
gacuggugguugaggcggguuug

SEQ ID NO: 3580346 - RNA, 16 nt, Pseudomonas putida KT2440
gacugugggagcgggc

SEQ ID NO: 3580347 - RNA, 19 nt, Pseudomonas putida KT2440
gacugugggagcgggcuug

SEQ ID NO: 3580348 - RNA, 22 nt, Pseudomonas putida KT2440
gacuucagcuucauggcgccga

SEQ ID NO: 3580349 - RNA, 15 nt, Pseudomonas putida KT2440
gacuucaucaccucc

SEQ ID NO: 3580350 - RNA, 20 nt, Pseudomonas putida KT2440
gacuucaucaccuccagugc

SEQ ID NO: 3580351 - RNA, 12 nt, Pseudomonas putida KT2440
gacuucaucgcg

SEQ ID NO: 3580352 - RNA, 17 nt, Pseudomonas putida KT2440
gacuucauggucgaccg

SEQ ID NO: 3580353 - RNA, 15 nt, Pseudomonas putida KT2440
gacuuccagcagcac

SEQ ID NO: 3580354 - RNA, 14 nt, Pseudomonas putida KT2440
gacuuccagguagc

SEQ ID NO: 3580355 - RNA, 14 nt, Pseudomonas putida KT2440
gacuucugcgugcg

SEQ ID NO: 3580356 - RNA, 17 nt, Pseudomonas putida KT2440
gacuugcgccccucauc

SEQ ID NO: 3580357 - RNA, 17 nt, Pseudomonas putida KT2440
gacuuuaaaacuaauau

SEQ ID NO: 3580358 - RNA, 22 nt, Pseudomonas putida KT2440
gacuuuccauuacuccagaaaa

SEQ ID NO: 3580359 - RNA, 21 nt, Pseudomonas putida KT2440
gacuuucccacauguaaugaa

SEQ ID NO: 3580360 - RNA, 18 nt, Pseudomonas putida KT2440
gagaaacucacgcauggc

SEQ ID NO: 3580361 - RNA, 13 nt, Pseudomonas putida KT2440
gagaacaggcggc

SEQ ID NO: 3580362 - RNA, 14 nt, Pseudomonas putida KT2440
gagaacaugaaagu

SEQ ID NO: 3580363 - RNA, 21 nt, Pseudomonas putida KT2440
gagaaccugaugcgagcuacc

SEQ ID NO: 3580364 - RNA, 16 nt, Pseudomonas putida KT2440
gagaacgggcugucga

SEQ ID NO: 3580365 - RNA, 13 nt, Pseudomonas putida KT2440
gagaaggcguggu

SEQ ID NO: 3580366 - RNA, 14 nt, Pseudomonas putida KT2440
gagaagguggccgu

SEQ ID NO: 3580367 - RNA, 17 nt, Pseudomonas putida KT2440
gagaaugcggauguagu

SEQ ID NO: 3580368 - RNA, 14 nt, Pseudomonas putida KT2440
gagaaugugcuucu

SEQ ID NO: 3580369 - RNA, 13 nt, Pseudomonas putida KT2440
gagacaucuccau

SEQ ID NO: 3580370 - RNA, 23 nt, Pseudomonas putida KT2440
gagacaucuccauagguuaucca

SEQ ID NO: 3580371 - RNA, 12 nt, Pseudomonas putida KT2440
gagaccaguucu

SEQ ID NO: 3580372 - RNA, 17 nt, Pseudomonas putida KT2440
gagaccgaggggccgcu

SEQ ID NO: 3580373 - RNA, 19 nt, Pseudomonas putida KT2440
gagaccgauuucaacccua

SEQ ID NO: 3580374 - RNA, 16 nt, Pseudomonas putida KT2440
gagacgaacagcgccg

SEQ ID NO: 3580375 - RNA, 15 nt, Pseudomonas putida KT2440
gagacgccaccaagc

SEQ ID NO: 3580376 - RNA, 21 nt, Pseudomonas putida KT2440
gagacgccaccaagcccuucu

SEQ ID NO: 3580377 - RNA, 18 nt, Pseudomonas putida KT2440
gagagccccaccaggaag

SEQ ID NO: 3580378 - RNA, 15 nt, Pseudomonas putida KT2440
gagagcuucagaccu

SEQ ID NO: 3580379 - RNA, 16 nt, Pseudomonas putida KT2440
gagaggcgggucaggu

SEQ ID NO: 3580380 - RNA, 17 nt, Pseudomonas putida KT2440
gagagggucggcgggcg

SEQ ID NO: 3580381 - RNA, 16 nt, Pseudomonas putida KT2440
gagaguccugcgcgcu

SEQ ID NO: 3580382 - RNA, 21 nt, Pseudomonas putida KT2440
gagaucgucguaggagcgggu

SEQ ID NO: 3580383 - RNA, 14 nt, Pseudomonas putida KT2440
gagaucuccuguag

SEQ ID NO: 3580384 - RNA, 23 nt, Pseudomonas putida KT2440
gagaucugcaggggugggaugcc

SEQ ID NO: 3580385 - RNA, 21 nt, Pseudomonas putida KT2440
gagaugaugguugacagcgcu

SEQ ID NO: 3580386 - RNA, 19 nt, Pseudomonas putida KT2440
gagauguaguccacccccg

SEQ ID NO: 3580387 - RNA, 14 nt, Pseudomonas putida KT2440
gagaugugcgcggu

SEQ ID NO: 3580388 - RNA, 18 nt, Pseudomonas putida KT2440
gagauuccgggcugcugc

SEQ ID NO: 3580389 - RNA, 13 nt, Pseudomonas putida KT2440
gagauuggccagc

SEQ ID NO: 3580390 - RNA, 18 nt, Pseudomonas putida KT2440
gagauuggucggcagggc

SEQ ID NO: 3580391 - RNA, 17 nt, Pseudomonas putida KT2440
gagcaacuugcgcagcu

SEQ ID NO: 3580392 - RNA, 23 nt, Pseudomonas putida KT2440
gagcaagaacgcuauuguggcaa

SEQ ID NO: 3580393 - RNA, 16 nt, Pseudomonas putida KT2440
gagcaauacauccagg

SEQ ID NO: 3580394 - RNA, 18 nt, Pseudomonas putida KT2440
gagcaauacauccaggcc

SEQ ID NO: 3580395 - RNA, 17 nt, Pseudomonas putida KT2440
gagcaccacauacggcg

SEQ ID NO: 3580396 - RNA, 17 nt, Pseudomonas putida KT2440
gagcaccacggcggcga

SEQ ID NO: 3580397 - RNA, 16 nt, Pseudomonas putida KT2440
gagcaccggcaguaca

SEQ ID NO: 3580398 - RNA, 19 nt, Pseudomonas putida KT2440
gagcaccgggcacuuggca

SEQ ID NO: 3580399 - RNA, 17 nt, Pseudomonas putida KT2440
gagcacgaaacugcgcu

SEQ ID NO: 3580400 - RNA, 17 nt, Pseudomonas putida KT2440
gagcacgaaguaacggc

SEQ ID NO: 3580401 - RNA, 22 nt, Pseudomonas putida KT2440
gagcacuuccuugaccauuucc

SEQ ID NO: 3580402 - RNA, 15 nt, Pseudomonas putida KT2440
gagcagcagcccuuc

SEQ ID NO: 3580403 - RNA, 17 nt, Pseudomonas putida KT2440
gagcagcggcaccuacc

SEQ ID NO: 3580404 - RNA, 13 nt, Pseudomonas putida KT2440
gagcagcgguggc

SEQ ID NO: 3580405 - RNA, 14 nt, Pseudomonas putida KT2440
gagcagcuggguga

SEQ ID NO: 3580406 - RNA, 13 nt, Pseudomonas putida KT2440
gagcaggcccgcc

SEQ ID NO: 3580407 - RNA, 22 nt, Pseudomonas putida KT2440
gagcaggcgcucgggggugcac

SEQ ID NO: 3580408 - RNA, 22 nt, Pseudomonas putida KT2440
gagcagggcugcgcgcccaggg

SEQ ID NO: 3580409 - RNA, 18 nt, Pseudomonas putida KT2440
gagcaggucgaacagccc

SEQ ID NO: 3580410 - RNA, 19 nt, Pseudomonas putida KT2440
gagcaggucgaacagcccc

SEQ ID NO: 3580411 - RNA, 14 nt, Pseudomonas putida KT2440
gagcagguugucca

SEQ ID NO: 3580412 - RNA, 20 nt, Pseudomonas putida KT2440
gagcaguucauccggcggca

SEQ ID NO: 3580413 - RNA, 16 nt, Pseudomonas putida KT2440
gagcaguuccuucagc

SEQ ID NO: 3580414 - RNA, 19 nt, Pseudomonas putida KT2440
gagcaguuccuucagcagu

SEQ ID NO: 3580415 - RNA, 16 nt, Pseudomonas putida KT2440
gagcaucccccuccua

SEQ ID NO: 3580416 - RNA, 23 nt, Pseudomonas putida KT2440
gagcaucccccuccuaaggggaa

SEQ ID NO: 3580417 - RNA, 15 nt, Pseudomonas putida KT2440
gagcaucggcguugc

SEQ ID NO: 3580418 - RNA, 14 nt, Pseudomonas putida KT2440
gagcaucugcugcg

SEQ ID NO: 3580419 - RNA, 20 nt, Pseudomonas putida KT2440
gagcaucugcugcggcaggc

SEQ ID NO: 3580420 - RNA, 23 nt, Pseudomonas putida KT2440
gagcaucugcugcggcaggcugg

SEQ ID NO: 3580421 - RNA, 18 nt, Pseudomonas putida KT2440
gagcaucuuccagccugc

SEQ ID NO: 3580422 - RNA, 16 nt, Pseudomonas putida KT2440
gagcaugaucaccgcc

SEQ ID NO: 3580423 - RNA, 18 nt, Pseudomonas putida KT2440
gagcaugaucaccgccag

SEQ ID NO: 3580424 - RNA, 12 nt, Pseudomonas putida KT2440
gagcaugccgag

SEQ ID NO: 3580425 - RNA, 17 nt, Pseudomonas putida KT2440
gagcauggccagccggc

SEQ ID NO: 3580426 - RNA, 22 nt, Pseudomonas putida KT2440
gagcauggccagccggcagcaa

SEQ ID NO: 3580427 - RNA, 17 nt, Pseudomonas putida KT2440
gagcauggucaugccau

SEQ ID NO: 3580428 - RNA, 22 nt, Pseudomonas putida KT2440
gagccaaccgcuucaccgcgca

SEQ ID NO: 3580429 - RNA, 14 nt, Pseudomonas putida KT2440
gagccaaggccgcc

SEQ ID NO: 3580430 - RNA, 20 nt, Pseudomonas putida KT2440
gagccaauuucaacgcucgc

SEQ ID NO: 3580431 - RNA, 21 nt, Pseudomonas putida KT2440
gagccacucggcaaucugcuu

SEQ ID NO: 3580432 - RNA, 22 nt, Pseudomonas putida KT2440
gagccagacauugaagaagccc

SEQ ID NO: 3580433 - RNA, 18 nt, Pseudomonas putida KT2440
gagccagaucauggcggu

SEQ ID NO: 3580434 - RNA, 12 nt, Pseudomonas putida KT2440
gagccagccgcg

SEQ ID NO: 3580435 - RNA, 22 nt, Pseudomonas putida KT2440
gagccaggagaacacccagcgc

SEQ ID NO: 3580436 - RNA, 14 nt, Pseudomonas putida KT2440
gagccccaccagga

SEQ ID NO: 3580437 - RNA, 16 nt, Pseudomonas putida KT2440
gagccccaccaggaag

SEQ ID NO: 3580438 - RNA, 15 nt, Pseudomonas putida KT2440
gagcccccgcugcuc

SEQ ID NO: 3580439 - RNA, 13 nt, Pseudomonas putida KT2440
gagcccgccagca

SEQ ID NO: 3580440 - RNA, 14 nt, Pseudomonas putida KT2440
gagcccgccagcag

SEQ ID NO: 3580441 - RNA, 16 nt, Pseudomonas putida KT2440
gagcccgccagcaggc

SEQ ID NO: 3580442 - RNA, 23 nt, Pseudomonas putida KT2440
gagcccgcucggucagggcggca

SEQ ID NO: 3580443 - RNA, 17 nt, Pseudomonas putida KT2440
gagcccggcgcagccgu

SEQ ID NO: 3580444 - RNA, 16 nt, Pseudomonas putida KT2440
gagcccggcgccaaac

SEQ ID NO: 3580445 - RNA, 15 nt, Pseudomonas putida KT2440
gagcccggguugacc

SEQ ID NO: 3580446 - RNA, 16 nt, Pseudomonas putida KT2440
gagcccugugggagcg

SEQ ID NO: 3580447 - RNA, 16 nt, Pseudomonas putida KT2440
gagccgaacagcaggc

SEQ ID NO: 3580448 - RNA, 15 nt, Pseudomonas putida KT2440
gagccgaucaggaag

SEQ ID NO: 3580449 - RNA, 12 nt, Pseudomonas putida KT2440
gagccgccagac

SEQ ID NO: 3580450 - RNA, 14 nt, Pseudomonas putida KT2440
gagccgcugccaaa

SEQ ID NO: 3580451 - RNA, 14 nt, Pseudomonas putida KT2440
gagccggcgcuggg

SEQ ID NO: 3580452 - RNA, 18 nt, Pseudomonas putida KT2440
gagccggucggagagacc

SEQ ID NO: 3580453 - RNA, 22 nt, Pseudomonas putida KT2440
gagccguccaggaacgcugccu

SEQ ID NO: 3580454 - RNA, 23 nt, Pseudomonas putida KT2440
gagccguccaggaacgcugccuc

SEQ ID NO: 3580455 - RNA, 17 nt, Pseudomonas putida KT2440
gagccucacacagcauu

SEQ ID NO: 3580456 - RNA, 18 nt, Pseudomonas putida KT2440
gagccugcacccaggcuc

SEQ ID NO: 3580457 - RNA, 17 nt, Pseudomonas putida KT2440
gagccugcagggccucc

SEQ ID NO: 3580458 - RNA, 18 nt, Pseudomonas putida KT2440
gagccugggucacggcau

SEQ ID NO: 3580459 - RNA, 22 nt, Pseudomonas putida KT2440
gagccuugccaacggcacucga

SEQ ID NO: 3580460 - RNA, 15 nt, Pseudomonas putida KT2440
gagcgaaacccggcg

SEQ ID NO: 3580461 - RNA, 16 nt, Pseudomonas putida KT2440
gagcgacuucgaccac

SEQ ID NO: 3580462 - RNA, 19 nt, Pseudomonas putida KT2440
gagcgacuucgaccacggc

SEQ ID NO: 3580463 - RNA, 12 nt, Pseudomonas putida KT2440
gagcgccagcau

SEQ ID NO: 3580464 - RNA, 15 nt, Pseudomonas putida KT2440
gagcgcccaccaauu

SEQ ID NO: 3580465 - RNA, 13 nt, Pseudomonas putida KT2440
gagcgccgcccgc

SEQ ID NO: 3580466 - RNA, 15 nt, Pseudomonas putida KT2440
gagcgccgcccgcgu

SEQ ID NO: 3580467 - RNA, 12 nt, Pseudomonas putida KT2440
gagcgccgcgau

SEQ ID NO: 3580468 - RNA, 19 nt, Pseudomonas putida KT2440
gagcgccgugcucggccuu

SEQ ID NO: 3580469 - RNA, 20 nt, Pseudomonas putida KT2440
gagcgccugauuacccugcg

SEQ ID NO: 3580470 - RNA, 23 nt, Pseudomonas putida KT2440
gagcgccugauuacccugcgcca

SEQ ID NO: 3580471 - RNA, 22 nt, Pseudomonas putida KT2440
gagcgcgauuaaauugucggua

SEQ ID NO: 3580472 - RNA, 14 nt, Pseudomonas putida KT2440
gagcgcgccgccuu

SEQ ID NO: 3580473 - RNA, 17 nt, Pseudomonas putida KT2440
gagcgcgugcggggcau

SEQ ID NO: 3580474 - RNA, 19 nt, Pseudomonas putida KT2440
gagcgcuuucagccguuca

SEQ ID NO: 3580475 - RNA, 14 nt, Pseudomonas putida KT2440
gagcggccuucagg

SEQ ID NO: 3580476 - RNA, 17 nt, Pseudomonas putida KT2440
gagcggccuugucgcga

SEQ ID NO: 3580477 - RNA, 17 nt, Pseudomonas putida KT2440
gagcgggacugcccgcc

SEQ ID NO: 3580478 - RNA, 19 nt, Pseudomonas putida KT2440
gagcgggauuugccgucgc

SEQ ID NO: 3580479 - RNA, 14 nt, Pseudomonas putida KT2440
gagcgggcaugccc

SEQ ID NO: 3580480 - RNA, 19 nt, Pseudomonas putida KT2440
gagcgggcaugcccgcgaa

SEQ ID NO: 3580481 - RNA, 20 nt, Pseudomonas putida KT2440
gagcgggcaugcccgcgaag

SEQ ID NO: 3580482 - RNA, 19 nt, Pseudomonas putida KT2440
gagcgggcgcgcccgcgaa

SEQ ID NO: 3580483 - RNA, 20 nt, Pseudomonas putida KT2440
gagcgggcgugcccgcgaau

SEQ ID NO: 3580484 - RNA, 19 nt, Pseudomonas putida KT2440
gagcgggcgugccugcgaa

SEQ ID NO: 3580485 - RNA, 20 nt, Pseudomonas putida KT2440
gagcgggcgugccugcgaau

SEQ ID NO: 3580486 - RNA, 19 nt, Pseudomonas putida KT2440
gagcgggcuuacccgcgaa

SEQ ID NO: 3580487 - RNA, 20 nt, Pseudomonas putida KT2440
gagcgggcuugcccgcgaac

SEQ ID NO: 3580488 - RNA, 19 nt, Pseudomonas putida KT2440
gagcgggggcgcgucagcc

SEQ ID NO: 3580489 - RNA, 17 nt, Pseudomonas putida KT2440
gagcgggucagccugcc

SEQ ID NO: 3580490 - RNA, 19 nt, Pseudomonas putida KT2440
gagcgggucuacccgcgaa

SEQ ID NO: 3580491 - RNA, 20 nt, Pseudomonas putida KT2440
gagcgggucuacccgcgaaa

SEQ ID NO: 3580492 - RNA, 19 nt, Pseudomonas putida KT2440
gagcggguucacccgcgaa

SEQ ID NO: 3580493 - RNA, 20 nt, Pseudomonas putida KT2440
gagcggguucacccgcgaaa

SEQ ID NO: 3580494 - RNA, 20 nt, Pseudomonas putida KT2440
gagcggguucacccgcgaag

SEQ ID NO: 3580495 - RNA, 17 nt, Pseudomonas putida KT2440
uagaagcagaucaucau

SEQ ID NO: 3580496 - RNA, 18 nt, Pseudomonas putida KT2440
uagacaaaaaaaucggcc

SEQ ID NO: 3580497 - RNA, 20 nt, Pseudomonas putida KT2440
uagaccauuucgcgcagggu

SEQ ID NO: 3580498 - RNA, 16 nt, Pseudomonas putida KT2440
uagaccuucuggcagc

SEQ ID NO: 3580499 - RNA, 18 nt, Pseudomonas putida KT2440
uagagcaguuggcuuuua

SEQ ID NO: 3580500 - RNA, 17 nt, Pseudomonas putida KT2440
uagagcaucccccuccu

SEQ ID NO: 3580501 - RNA, 14 nt, Pseudomonas putida KT2440
uagaggaucugaau

SEQ ID NO: 3580502 - RNA, 15 nt, Pseudomonas putida KT2440
uagauaucggccgug

SEQ ID NO: 3580503 - RNA, 14 nt, Pseudomonas putida KT2440
uagaucagcgaugc

SEQ ID NO: 3580504 - RNA, 12 nt, Pseudomonas putida KT2440
uagaucaucagc

SEQ ID NO: 3580505 - RNA, 16 nt, Pseudomonas putida KT2440
uagauuucgaagggau

SEQ ID NO: 3580506 - RNA, 16 nt, Pseudomonas putida KT2440
uagcaauggcccugga

SEQ ID NO: 3580507 - RNA, 16 nt, Pseudomonas putida KT2440
uagcacaagggccagg

SEQ ID NO: 3580508 - RNA, 23 nt, Pseudomonas putida KT2440
uagcaccagcgggcccagcaggu

SEQ ID NO: 3580509 - RNA, 17 nt, Pseudomonas putida KT2440
uagcagcaucaccgcgu

SEQ ID NO: 3580510 - RNA, 14 nt, Pseudomonas putida KT2440
uagcagcgcuaugc

SEQ ID NO: 3580511 - RNA, 14 nt, Pseudomonas putida KT2440
uagcaggaacacca

SEQ ID NO: 3580512 - RNA, 17 nt, Pseudomonas putida KT2440
uagcagguaaacccgcg

SEQ ID NO: 3580513 - RNA, 18 nt, Pseudomonas putida KT2440
uagcagguaaacccgcgc

SEQ ID NO: 3580514 - RNA, 22 nt, Pseudomonas putida KT2440
uagcagguacgcgcaggcagcu

SEQ ID NO: 3580515 - RNA, 13 nt, Pseudomonas putida KT2440
uagccaaucccua

SEQ ID NO: 3580516 - RNA, 21 nt, Pseudomonas putida KT2440
uagccaaucugauuugcgcua

SEQ ID NO: 3580517 - RNA, 16 nt, Pseudomonas putida KT2440
uagccacaauggcgca

SEQ ID NO: 3580518 - RNA, 22 nt, Pseudomonas putida KT2440
uagccaccugauguacaaggac

SEQ ID NO: 3580519 - RNA, 17 nt, Pseudomonas putida KT2440
uagccacgcugccagga

SEQ ID NO: 3580520 - RNA, 17 nt, Pseudomonas putida KT2440
uagccagcccaggcugg

SEQ ID NO: 3580521 - RNA, 11 nt, Pseudomonas putida KT2440
uagccagcccg

SEQ ID NO: 3580522 - RNA, 17 nt, Pseudomonas putida KT2440
uagccaggcauugcccg

SEQ ID NO: 3580523 - RNA, 18 nt, Pseudomonas putida KT2440
uagccagggccuguagga

SEQ ID NO: 3580524 - RNA, 13 nt, Pseudomonas putida KT2440
uagccauugcggc

SEQ ID NO: 3580525 - RNA, 15 nt, Pseudomonas putida KT2440
uagccauugcggcug

SEQ ID NO: 3580526 - RNA, 20 nt, Pseudomonas putida KT2440
uagccauugcggcugaaucc

SEQ ID NO: 3580527 - RNA, 12 nt, Pseudomonas putida KT2440
uagcccaccacc

SEQ ID NO: 3580528 - RNA, 23 nt, Pseudomonas putida KT2440
uagcccaccaccuucucacugau

SEQ ID NO: 3580529 - RNA, 14 nt, Pseudomonas putida KT2440
uagcccaccgucag

SEQ ID NO: 3580530 - RNA, 17 nt, Pseudomonas putida KT2440
uagccccgcccagcagc

SEQ ID NO: 3580531 - RNA, 20 nt, Pseudomonas putida KT2440
uagcccgaaaccgccagcca

SEQ ID NO: 3580532 - RNA, 20 nt, Pseudomonas putida KT2440
uagcccguauucgcggguaa

SEQ ID NO: 3580533 - RNA, 12 nt, Pseudomonas putida KT2440
uagcccugcccu

SEQ ID NO: 3580534 - RNA, 12 nt, Pseudomonas putida KT2440
uagccgccagca

SEQ ID NO: 3580535 - RNA, 21 nt, Pseudomonas putida KT2440
uagccggcacagugccaagga

SEQ ID NO: 3580536 - RNA, 22 nt, Pseudomonas putida KT2440
uagccggcacagugccaaggac

SEQ ID NO: 3580537 - RNA, 18 nt, Pseudomonas putida KT2440
uagccggccucagcagcg

SEQ ID NO: 3580538 - RNA, 22 nt, Pseudomonas putida KT2440
uagccggugccgaagucaucca

SEQ ID NO: 3580539 - RNA, 15 nt, Pseudomonas putida KT2440
uagccgugcggccaa

SEQ ID NO: 3580540 - RNA, 19 nt, Pseudomonas putida KT2440
uagccugcacuggccucuu

SEQ ID NO: 3580541 - RNA, 22 nt, Pseudomonas putida KT2440
uagccugcugcuccccaaccac

SEQ ID NO: 3580542 - RNA, 13 nt, Pseudomonas putida KT2440
uagccuguggggc

SEQ ID NO: 3580543 - RNA, 14 nt, Pseudomonas putida KT2440
uagccuucagcggc

SEQ ID NO: 3580544 - RNA, 20 nt, Pseudomonas putida KT2440
uagccuuccagcuccuucuu

SEQ ID NO: 3580545 - RNA, 21 nt, Pseudomonas putida KT2440
uagccuucuucggucagcugg

SEQ ID NO: 3580546 - RNA, 19 nt, Pseudomonas putida KT2440
uagcgagcaccggcaguac

SEQ ID NO: 3580547 - RNA, 18 nt, Pseudomonas putida KT2440
uagcgagccgcauuggcc

SEQ ID NO: 3580548 - RNA, 18 nt, Pseudomonas putida KT2440
uagcgcagccuugucucu

SEQ ID NO: 3580549 - RNA, 19 nt, Pseudomonas putida KT2440
uagcgcaucuuccggcacc

SEQ ID NO: 3580550 - RNA, 21 nt, Pseudomonas putida KT2440
uagcgcccgggcaucaucaaa

SEQ ID NO: 3580551 - RNA, 23 nt, Pseudomonas putida KT2440
uagcgcucgcgcaggguuuucag

SEQ ID NO: 3580552 - RNA, 22 nt, Pseudomonas putida KT2440
uagcgcuggcuuuggagccugc

SEQ ID NO: 3580553 - RNA, 14 nt, Pseudomonas putida KT2440
uagcgcuucagcuc

SEQ ID NO: 3580554 - RNA, 14 nt, Pseudomonas putida KT2440
uagcgcuuucuggu

SEQ ID NO: 3580555 - RNA, 15 nt, Pseudomonas putida KT2440
uagcgcuuucuggua

SEQ ID NO: 3580556 - RNA, 22 nt, Pseudomonas putida KT2440
uagcgguaaacgucggcagcca

SEQ ID NO: 3580557 - RNA, 16 nt, Pseudomonas putida KT2440
uagcgguacagcaccc

SEQ ID NO: 3580558 - RNA, 18 nt, Pseudomonas putida KT2440
uagcgguacagcacccag

SEQ ID NO: 3580559 - RNA, 18 nt, Pseudomonas putida KT2440
uagcguagugcaggcgca

SEQ ID NO: 3580560 - RNA, 21 nt, Pseudomonas putida KT2440
uagcgucaacugccaggcugg

SEQ ID NO: 3580561 - RNA, 17 nt, Pseudomonas putida KT2440
uagcgugcuuccaccuc

SEQ ID NO: 3580562 - RNA, 15 nt, Pseudomonas putida KT2440
uagcucagcuggaua

SEQ ID NO: 3580563 - RNA, 17 nt, Pseudomonas putida KT2440
uagcuccaccagcggcu

SEQ ID NO: 3580564 - RNA, 20 nt, Pseudomonas putida KT2440
uagcuccagcccagcgccag

SEQ ID NO: 3580565 - RNA, 15 nt, Pseudomonas putida KT2440
uauggcucaguguca

SEQ ID NO: 3580566 - RNA, 18 nt, Pseudomonas putida KT2440
uaugggaagucgccgcgg

SEQ ID NO: 3580567 - RNA, 21 nt, Pseudomonas putida KT2440
uaugggcuucggaacuaaacc

SEQ ID NO: 3580568 - RNA, 21 nt, Pseudomonas putida KT2440
uaugguugucgaacagcaucc

SEQ ID NO: 3580569 - RNA, 18 nt, Pseudomonas putida KT2440
uauguggggcgugcucgg

SEQ ID NO: 3580570 - RNA, 19 nt, Pseudomonas putida KT2440
uauuaaggcaaguggaagc

SEQ ID NO: 3580571 - RNA, 21 nt, Pseudomonas putida KT2440
uauucaccgguagcggcguug

SEQ ID NO: 3580572 - RNA, 20 nt, Pseudomonas putida KT2440
uauucgcggguaaacccgcg

SEQ ID NO: 3580573 - RNA, 20 nt, Pseudomonas putida KT2440
uauucgcggguaaacccgcu

SEQ ID NO: 3580574 - RNA, 18 nt, Pseudomonas putida KT2440
uauucgcuaaccucugca

SEQ ID NO: 3580575 - RNA, 20 nt, Pseudomonas putida KT2440
uauucuucuggcuuucuggc

SEQ ID NO: 3580576 - RNA, 14 nt, Pseudomonas putida KT2440
uauugagcuucguc

SEQ ID NO: 3580577 - RNA, 13 nt, Pseudomonas putida KT2440
uauugccugccag

SEQ ID NO: 3580578 - RNA, 13 nt, Pseudomonas putida KT2440
uauuggccagcaa

SEQ ID NO: 3580579 - RNA, 21 nt, Pseudomonas putida KT2440
uauuuaugccgcguuccuuuc

SEQ ID NO: 3580580 - RNA, 21 nt, Pseudomonas putida KT2440
uauuucaaagaucucgggugc

SEQ ID NO: 3580581 - RNA, 11 nt, Pseudomonas putida KT2440
uauuugaccag

SEQ ID NO: 3580582 - RNA, 23 nt, Pseudomonas putida KT2440
uauuuguacgggugcuccaccaa

SEQ ID NO: 3580583 - RNA, 21 nt, Pseudomonas putida KT2440
uauuuuccugaguuagacauu

SEQ ID NO: 3580584 - RNA, 16 nt, Pseudomonas putida KT2440
uauuuuuaccugcucc

SEQ ID NO: 3580585 - RNA, 14 nt, Pseudomonas putida KT2440
ucaaaaugcuuuua

SEQ ID NO: 3580586 - RNA, 21 nt, Pseudomonas putida KT2440
ucaaacccggcagccaccgcc

SEQ ID NO: 3580587 - RNA, 21 nt, Pseudomonas putida KT2440
ucaaacguauccgccgcaaug

SEQ ID NO: 3580588 - RNA, 21 nt, Pseudomonas putida KT2440
ucaaagccauaccgcauccca

SEQ ID NO: 3580589 - RNA, 16 nt, Pseudomonas putida KT2440
ucaaagcgcaaaacca

SEQ ID NO: 3580590 - RNA, 22 nt, Pseudomonas putida KT2440
ucaaagcgcaaaaccaccagcc

SEQ ID NO: 3580591 - RNA, 19 nt, Pseudomonas putida KT2440
ucaaagcgguacgccgucu

SEQ ID NO: 3580592 - RNA, 20 nt, Pseudomonas putida KT2440
ucaaaguuuugcaucaagag

SEQ ID NO: 3580593 - RNA, 12 nt, Pseudomonas putida KT2440
ucaaaugccccc

SEQ ID NO: 3580594 - RNA, 13 nt, Pseudomonas putida KT2440
ucaaaugcuggca

SEQ ID NO: 3580595 - RNA, 16 nt, Pseudomonas putida KT2440
ucaaaugggucguuag

SEQ ID NO: 3580596 - RNA, 18 nt, Pseudomonas putida KT2440
ucaaauuuagagugcccc

SEQ ID NO: 3580597 - RNA, 12 nt, Pseudomonas putida KT2440
ucaacaccaacu

SEQ ID NO: 3580598 - RNA, 15 nt, Pseudomonas putida KT2440
ucaacaccagacuca

SEQ ID NO: 3580599 - RNA, 14 nt, Pseudomonas putida KT2440
ucaacaccaucuuc

SEQ ID NO: 3580600 - RNA, 16 nt, Pseudomonas putida KT2440
ucaacaccaucuucau

SEQ ID NO: 3580601 - RNA, 17 nt, Pseudomonas putida KT2440
ucaacaccuucucggcc

SEQ ID NO: 3580602 - RNA, 15 nt, Pseudomonas putida KT2440
ucaacacgucggcug

SEQ ID NO: 3580603 - RNA, 14 nt, Pseudomonas putida KT2440
ucaacacugucccg

SEQ ID NO: 3580604 - RNA, 14 nt, Pseudomonas putida KT2440
ucaacagcaggugc

SEQ ID NO: 3580605 - RNA, 16 nt, Pseudomonas putida KT2440
ucaacagccacgcccg

SEQ ID NO: 3580606 - RNA, 20 nt, Pseudomonas putida KT2440
ucaacagcgcgacgcagcag

SEQ ID NO: 3580607 - RNA, 22 nt, Pseudomonas putida KT2440
ucaacagcgcgacgcagcagcg

SEQ ID NO: 3580608 - RNA, 19 nt, Pseudomonas putida KT2440
ucaacaggcuggccgacgu

SEQ ID NO: 3580609 - RNA, 15 nt, Pseudomonas putida KT2440
ucaaccaccgcucaa

SEQ ID NO: 3580610 - RNA, 16 nt, Pseudomonas putida KT2440
ucaaccaggcgcagca

SEQ ID NO: 3580611 - RNA, 19 nt, Pseudomonas putida KT2440
ucaaccaggcgcagcagcu

SEQ ID NO: 3580612 - RNA, 21 nt, Pseudomonas putida KT2440
ucaaccaguucagcgcccgca

SEQ ID NO: 3580613 - RNA, 21 nt, Pseudomonas putida KT2440
ucaaccauggccccugucggu

SEQ ID NO: 3580614 - RNA, 19 nt, Pseudomonas putida KT2440
ucaaccgaccagcggauca

SEQ ID NO: 3580615 - RNA, 15 nt, Pseudomonas putida KT2440
ucaaccgcacccgca

SEQ ID NO: 3580616 - RNA, 13 nt, Pseudomonas putida KT2440
ucaaccgccucca

SEQ ID NO: 3580617 - RNA, 22 nt, Pseudomonas putida KT2440
ucaaccgccuccacggucagca

SEQ ID NO: 3580618 - RNA, 21 nt, Pseudomonas putida KT2440
ucaaccgugguucuugccgag

SEQ ID NO: 3580619 - RNA, 19 nt, Pseudomonas putida KT2440
ucaaccuguuccggccucu

SEQ ID NO: 3580620 - RNA, 17 nt, Pseudomonas putida KT2440
ucaaccuuugcggcaca

SEQ ID NO: 3580621 - RNA, 21 nt, Pseudomonas putida KT2440
ucaaccuuugcggcacaucuc

SEQ ID NO: 3580622 - RNA, 14 nt, Pseudomonas putida KT2440
ucaacgaggccgcc

SEQ ID NO: 3580623 - RNA, 15 nt, Pseudomonas putida KT2440
ucaacgcaacugcgg

SEQ ID NO: 3580624 - RNA, 13 nt, Pseudomonas putida KT2440
ucaacgccagggc

SEQ ID NO: 3580625 - RNA, 19 nt, Pseudomonas putida KT2440
ucaacgccaucaggcagcu

SEQ ID NO: 3580626 - RNA, 21 nt, Pseudomonas putida KT2440
ucaacgccaucaggcagcuca

SEQ ID NO: 3580627 - RNA, 23 nt, Pseudomonas putida KT2440
ucaacgccccaggguguuguuca

SEQ ID NO: 3580628 - RNA, 18 nt, Pseudomonas putida KT2440
ucaacgccgccagcggcu

SEQ ID NO: 3580629 - RNA, 21 nt, Pseudomonas putida KT2440
ucaacgccguacggcccaugu

SEQ ID NO: 3580630 - RNA, 12 nt, Pseudomonas putida KT2440
ucaacgccuccc

SEQ ID NO: 3580631 - RNA, 18 nt, Pseudomonas putida KT2440
ucaacgcuucggccauga

SEQ ID NO: 3580632 - RNA, 20 nt, Pseudomonas putida KT2440
ucaacggcaacgccagcaau

SEQ ID NO: 3580633 - RNA, 18 nt, Pseudomonas putida KT2440
ucaacggcgcccgggcca

SEQ ID NO: 3580634 - RNA, 18 nt, Pseudomonas putida KT2440
ucaacggguaguugcccg

SEQ ID NO: 3580635 - RNA, 18 nt, Pseudomonas putida KT2440
ucaacgguaacguuggcc

SEQ ID NO: 3580636 - RNA, 16 nt, Pseudomonas putida KT2440
ucaacgguggccagca

SEQ ID NO: 3580637 - RNA, 17 nt, Pseudomonas putida KT2440
ucaacguucauccccuc

SEQ ID NO: 3580638 - RNA, 17 nt, Pseudomonas putida KT2440
ucaacucaucacucuug

SEQ ID NO: 3580639 - RNA, 14 nt, Pseudomonas putida KT2440
ucaacuccauggcc

SEQ ID NO: 3580640 - RNA, 16 nt, Pseudomonas putida KT2440
ucaacuccauggccag

SEQ ID NO: 3580641 - RNA, 17 nt, Pseudomonas putida KT2440
ucaacuccauggccagg

SEQ ID NO: 3580642 - RNA, 14 nt, Pseudomonas putida KT2440
ucaacugccaggcu

SEQ ID NO: 3580643 - RNA, 16 nt, Pseudomonas putida KT2440
ucaacuggcaggguuc

SEQ ID NO: 3580644 - RNA, 22 nt, Pseudomonas putida KT2440
ucaacuggcaggguucgcuguc

SEQ ID NO: 3580645 - RNA, 16 nt, Pseudomonas putida KT2440
ucaacuucccucugcc

SEQ ID NO: 3580646 - RNA, 14 nt, Pseudomonas putida KT2440
ucaagaaauugcag

SEQ ID NO: 3580647 - RNA, 14 nt, Pseudomonas putida KT2440
ucaagaaugcccgg

SEQ ID NO: 3580648 - RNA, 13 nt, Pseudomonas putida KT2440
ucaagcacguugu

SEQ ID NO: 3580649 - RNA, 16 nt, Pseudomonas putida KT2440
ucaagcacuacaucua

SEQ ID NO: 3580650 - RNA, 21 nt, Pseudomonas putida KT2440
ucaagcagguaaccgcugcca

SEQ ID NO: 3580651 - RNA, 16 nt, Pseudomonas putida KT2440
ucaagcccgcucgcca

SEQ ID NO: 3580652 - RNA, 24 nt, Pseudomonas putida KT2440
ucaagccucgcgcaacaccgccag

SEQ ID NO: 3580653 - RNA, 16 nt, Pseudomonas putida KT2440
ucaagccuugcugauc

SEQ ID NO: 3580654 - RNA, 14 nt, Pseudomonas putida KT2440
ucaagcgccagggc

SEQ ID NO: 3580655 - RNA, 16 nt, Pseudomonas putida KT2440
ucaagcgccagggcau

SEQ ID NO: 3580656 - RNA, 17 nt, Pseudomonas putida KT2440
ucaagcgccagggcauc

SEQ ID NO: 3580657 - RNA, 13 nt, Pseudomonas putida KT2440
ucaagcuccccag

SEQ ID NO: 3580658 - RNA, 16 nt, Pseudomonas putida KT2440
ucaagcucgacccgcg

SEQ ID NO: 3580659 - RNA, 22 nt, Pseudomonas putida KT2440
ucaaggaagcuccaggcgacca

SEQ ID NO: 3580660 - RNA, 16 nt, Pseudomonas putida KT2440
ucaaggccagcgccug

SEQ ID NO: 3580661 - RNA, 13 nt, Pseudomonas putida KT2440
ucaaggcccaguu

SEQ ID NO: 3580662 - RNA, 15 nt, Pseudomonas putida KT2440
ucaaggcgccgauga

SEQ ID NO: 3580663 - RNA, 11 nt, Pseudomonas putida KT2440
ucaaggcugcu

SEQ ID NO: 3580664 - RNA, 16 nt, Pseudomonas putida KT2440
ucaagguuucagcagc

SEQ ID NO: 3580665 - RNA, 13 nt, Pseudomonas putida KT2440
ucaauauccagcc

SEQ ID NO: 3580666 - RNA, 18 nt, Pseudomonas putida KT2440
ucaaucacauccacagcc

SEQ ID NO: 3580667 - RNA, 21 nt, Pseudomonas putida KT2440
ucaaucagggauacugcugaa

SEQ ID NO: 3580668 - RNA, 15 nt, Pseudomonas putida KT2440
ucaaugcugccuccg

SEQ ID NO: 3580669 - RNA, 21 nt, Pseudomonas putida KT2440
ucaauggcacccucaccaacu

SEQ ID NO: 3580670 - RNA, 15 nt, Pseudomonas putida KT2440
ucaauggcugggggc

SEQ ID NO: 3580671 - RNA, 18 nt, Pseudomonas putida KT2440
ucaauuggagcggccuug

SEQ ID NO: 3580672 - RNA, 20 nt, Pseudomonas putida KT2440
ucacaacgcgcaucccuugu

SEQ ID NO: 3580673 - RNA, 21 nt, Pseudomonas putida KT2440
ucacacagcggcagacacagg

SEQ ID NO: 3580674 - RNA, 22 nt, Pseudomonas putida KT2440
ucacacagcggcagacacaggc

SEQ ID NO: 3580675 - RNA, 16 nt, Pseudomonas putida KT2440
ucacacauaucagcca

SEQ ID NO: 3580676 - RNA, 17 nt, Pseudomonas putida KT2440
ucacacauaucagccaa

SEQ ID NO: 3580677 - RNA, 12 nt, Pseudomonas putida KT2440
ucacaccggccg

SEQ ID NO: 3580678 - RNA, 19 nt, Pseudomonas putida KT2440
ucacaccggccuuggccag

SEQ ID NO: 3580679 - RNA, 14 nt, Pseudomonas putida KT2440
ucacacucgccagg

SEQ ID NO: 3580680 - RNA, 22 nt, Pseudomonas putida KT2440
ucacacucgcccccaucgcagg

SEQ ID NO: 3580681 - RNA, 16 nt, Pseudomonas putida KT2440
ucacagaaaagcugca

SEQ ID NO: 3580682 - RNA, 12 nt, Pseudomonas putida KT2440
ucacagccaagc

SEQ ID NO: 3580683 - RNA, 14 nt, Pseudomonas putida KT2440
ucacagcccgggca

SEQ ID NO: 3580684 - RNA, 18 nt, Pseudomonas putida KT2440
ucacagccuucaggguug

SEQ ID NO: 3580685 - RNA, 18 nt, Pseudomonas putida KT2440
ucacaggccauagcccuc

SEQ ID NO: 3580686 - RNA, 20 nt, Pseudomonas putida KT2440
ucacaugcgccacacccgcu

SEQ ID NO: 3580687 - RNA, 18 nt, Pseudomonas putida KT2440
ucaccacaaaaccuucca

SEQ ID NO: 3580688 - RNA, 15 nt, Pseudomonas putida KT2440
ucaccacaucggcgg

SEQ ID NO: 3580689 - RNA, 11 nt, Pseudomonas putida KT2440
ucaccaccauc

SEQ ID NO: 3580690 - RNA, 23 nt, Pseudomonas putida KT2440
ucaccacccccagcgaccagcug

SEQ ID NO: 3580691 - RNA, 12 nt, Pseudomonas putida KT2440
ucaccacgcccu

SEQ ID NO: 3580692 - RNA, 14 nt, Pseudomonas putida KT2440
ucaccagcagcuuc

SEQ ID NO: 3580693 - RNA, 19 nt, Pseudomonas putida KT2440
ucaccagcagcuucuucac

SEQ ID NO: 3580694 - RNA, 14 nt, Pseudomonas putida KT2440
ucaccagccaggca

SEQ ID NO: 3580695 - RNA, 16 nt, Pseudomonas putida KT2440
ucaccagccaggcaca

SEQ ID NO: 3580696 - RNA, 12 nt, Pseudomonas putida KT2440
ucaccagccccu

SEQ ID NO: 3580697 - RNA, 20 nt, Pseudomonas putida KT2440
ucaccagccccucaggcaca

SEQ ID NO: 3580698 - RNA, 20 nt, Pseudomonas putida KT2440
ucaccagcccgaagcgcagg

SEQ ID NO: 3580699 - RNA, 12 nt, Pseudomonas putida KT2440
ucaccagcuuca

SEQ ID NO: 3580700 - RNA, 18 nt, Pseudomonas putida KT2440
ucaccagguuguggccca

SEQ ID NO: 3580701 - RNA, 20 nt, Pseudomonas putida KT2440
ucaccagguuguggcccaug

SEQ ID NO: 3580702 - RNA, 21 nt, Pseudomonas putida KT2440
ucaccaguauugcgucaggcu

SEQ ID NO: 3580703 - RNA, 13 nt, Pseudomonas putida KT2440
ucaccaucaagcc

SEQ ID NO: 3580704 - RNA, 14 nt, Pseudomonas putida KT2440
ucaccaucaagccc

SEQ ID NO: 3580705 - RNA, 13 nt, Pseudomonas putida KT2440
ucaccaucagccg

SEQ ID NO: 3580706 - RNA, 19 nt, Pseudomonas putida KT2440
ucaccaucagccgcgggcu

SEQ ID NO: 3580707 - RNA, 21 nt, Pseudomonas putida KT2440
ucaccauggcuaagccaagcc

SEQ ID NO: 3580708 - RNA, 14 nt, Pseudomonas putida KT2440
ucaccaugggccug

SEQ ID NO: 3580709 - RNA, 13 nt, Pseudomonas putida KT2440
ucacccaccagcc

SEQ ID NO: 3580710 - RNA, 12 nt, Pseudomonas putida KT2440
ucacccagguga

SEQ ID NO: 3580711 - RNA, 13 nt, Pseudomonas putida KT2440
ucacccagucacc

SEQ ID NO: 3580712 - RNA, 15 nt, Pseudomonas putida KT2440
ucacccagucaccuu

SEQ ID NO: 3580713 - RNA, 15 nt, Pseudomonas putida KT2440
ucacccccaucagcg

SEQ ID NO: 3580714 - RNA, 17 nt, Pseudomonas putida KT2440
ucacccccaucagcggg

SEQ ID NO: 3580715 - RNA, 15 nt, Pseudomonas putida KT2440
ucaccccgccccugc

SEQ ID NO: 3580716 - RNA, 16 nt, Pseudomonas putida KT2440
ucaccccgccccugcu

SEQ ID NO: 3580717 - RNA, 17 nt, Pseudomonas putida KT2440
ucaccccguacacccgc

SEQ ID NO: 3580718 - RNA, 17 nt, Pseudomonas putida KT2440
ucaccccguagcgcuuc

SEQ ID NO: 3580719 - RNA, 19 nt, Pseudomonas putida KT2440
ucaccccuuuacuggccau

SEQ ID NO: 3580720 - RNA, 17 nt, Pseudomonas putida KT2440
ucacccgcaccucacaa

SEQ ID NO: 3580721 - RNA, 17 nt, Pseudomonas putida KT2440
ucacccgccccacgccc

SEQ ID NO: 3580722 - RNA, 17 nt, Pseudomonas putida KT2440
ucacccgcgaaagggcc

SEQ ID NO: 3580723 - RNA, 23 nt, Pseudomonas putida KT2440
ucacccgcgaaugcuacagaagc

SEQ ID NO: 3580724 - RNA, 19 nt, Pseudomonas putida KT2440
ucacccgcgccaccagccc

SEQ ID NO: 3580725 - RNA, 16 nt, Pseudomonas putida KT2440
ucacccgcuugccacg

SEQ ID NO: 3580726 - RNA, 20 nt, Pseudomonas putida KT2440
ucacccgggaacagcagcac

SEQ ID NO: 3580727 - RNA, 18 nt, Pseudomonas putida KT2440
ucacccguggcagccccc

SEQ ID NO: 3580728 - RNA, 22 nt, Pseudomonas putida KT2440
ucacccuggucacgcaguucgu

SEQ ID NO: 3580729 - RNA, 15 nt, Pseudomonas putida KT2440
ucacccuuggccacc

SEQ ID NO: 3580730 - RNA, 21 nt, Pseudomonas putida KT2440
ucacccuuggcgcaagcgcuc

SEQ ID NO: 3580731 - RNA, 12 nt, Pseudomonas putida KT2440
ucacccuugggc

SEQ ID NO: 3580732 - RNA, 15 nt, Pseudomonas putida KT2440
ucaccgacgugcagg

SEQ ID NO: 3580733 - RNA, 20 nt, Pseudomonas putida KT2440
ucaccgacgugugcccacug

SEQ ID NO: 3580734 - RNA, 21 nt, Pseudomonas putida KT2440
ucaccgagugcccgcgcagga

SEQ ID NO: 3580735 - RNA, 15 nt, Pseudomonas putida KT2440
ucaccgaugcgcccg

SEQ ID NO: 3580736 - RNA, 15 nt, Pseudomonas putida KT2440
ucaccgcaagcugca

SEQ ID NO: 3580737 - RNA, 19 nt, Pseudomonas putida KT2440
ucaccgcagcccagcgccg

SEQ ID NO: 3580738 - RNA, 17 nt, Pseudomonas putida KT2440
ucaccgccagcauggcc

SEQ ID NO: 3580739 - RNA, 17 nt, Pseudomonas putida KT2440
ucaccgccccagcgcgc

SEQ ID NO: 3580740 - RNA, 12 nt, Pseudomonas putida KT2440
ucaccgccgcca

SEQ ID NO: 3580741 - RNA, 12 nt, Pseudomonas putida KT2440
ucaccgccgccc

SEQ ID NO: 3580742 - RNA, 12 nt, Pseudomonas putida KT2440
ucaccgccgccu

SEQ ID NO: 3580743 - RNA, 19 nt, Pseudomonas putida KT2440
ucaccgcgaccuucacgcc

SEQ ID NO: 3580744 - RNA, 15 nt, Pseudomonas putida KT2440
ucaccgcgcaccucc

SEQ ID NO: 3580745 - RNA, 17 nt, Pseudomonas putida KT2440
ucaccgcgcccaagguc

SEQ ID NO: 3580746 - RNA, 17 nt, Pseudomonas putida KT2440
ucaccgcguaaccaguc

SEQ ID NO: 3580747 - RNA, 21 nt, Pseudomonas putida KT2440
ucaccgcgucgauacgcugcu

SEQ ID NO: 3580748 - RNA, 23 nt, Pseudomonas putida KT2440
ucaccgcugccgaucagcacgcc

SEQ ID NO: 3580749 - RNA, 18 nt, Pseudomonas putida KT2440
ucaccggcaaagcugauc

SEQ ID NO: 3580750 - RNA, 15 nt, Pseudomonas putida KT2440
ucaccggcaccugcu

SEQ ID NO: 3580751 - RNA, 16 nt, Pseudomonas putida KT2440
ucaccggccagcacuu

SEQ ID NO: 3580752 - RNA, 20 nt, Pseudomonas putida KT2440
ucaccggcgaguccugccuu

SEQ ID NO: 3580753 - RNA, 16 nt, Pseudomonas putida KT2440
ucaccgguaccggcgu

SEQ ID NO: 3580754 - RNA, 22 nt, Pseudomonas putida KT2440
ucaccgguaucgaugcacagcu

SEQ ID NO: 3580755 - RNA, 14 nt, Pseudomonas putida KT2440
ucaccgucggcgcu

SEQ ID NO: 3580756 - RNA, 23 nt, Pseudomonas putida KT2440
ucaccguguuguucgccaacuuc

SEQ ID NO: 3580757 - RNA, 19 nt, Pseudomonas putida KT2440
ucaccguucuugauccagc

SEQ ID NO: 3580758 - RNA, 20 nt, Pseudomonas putida KT2440
ucaccucaucgacccuggca

SEQ ID NO: 3580759 - RNA, 16 nt, Pseudomonas putida KT2440
ucaccucggcaccgca

SEQ ID NO: 3580760 - RNA, 18 nt, Pseudomonas putida KT2440
ucaccugaugaaagcgca

SEQ ID NO: 3580761 - RNA, 17 nt, Pseudomonas putida KT2440
ucaccugcacaucggcc

SEQ ID NO: 3580762 - RNA, 14 nt, Pseudomonas putida KT2440
ucaccugccgggca

SEQ ID NO: 3580763 - RNA, 14 nt, Pseudomonas putida KT2440
ucaccugcggccug

SEQ ID NO: 3580764 - RNA, 16 nt, Pseudomonas putida KT2440
ucaccugcucuggccc

SEQ ID NO: 3580765 - RNA, 17 nt, Pseudomonas putida KT2440
ucaccuggcccacgccu

SEQ ID NO: 3580766 - RNA, 16 nt, Pseudomonas putida KT2440
ucaccuguucccccac

SEQ ID NO: 3580767 - RNA, 22 nt, Pseudomonas putida KT2440
ucaccuugaugcgcgagcuggg

SEQ ID NO: 3580768 - RNA, 15 nt, Pseudomonas putida KT2440
ucaccuuguccagca

SEQ ID NO: 3580769 - RNA, 18 nt, Pseudomonas putida KT2440
ucacgaacaccagcccca

SEQ ID NO: 3580770 - RNA, 19 nt, Pseudomonas putida KT2440
ucacgaagguguucaccac

SEQ ID NO: 3580771 - RNA, 19 nt, Pseudomonas putida KT2440
ucacgagacauccgcaaca

SEQ ID NO: 3580772 - RNA, 16 nt, Pseudomonas putida KT2440
ucacgaucaugcuggc

SEQ ID NO: 3580773 - RNA, 21 nt, Pseudomonas putida KT2440
ucacgaucaugcuggccagga

SEQ ID NO: 3580774 - RNA, 23 nt, Pseudomonas putida KT2440
ucacgcaacucuaccucacugac

SEQ ID NO: 3580775 - RNA, 12 nt, Pseudomonas putida KT2440
ucacgcaccaug

SEQ ID NO: 3580776 - RNA, 22 nt, Pseudomonas putida KT2440
ucacgcagagcauggucaugcc

SEQ ID NO: 3580777 - RNA, 21 nt, Pseudomonas putida KT2440
ucacgcagcccuuucagggua

SEQ ID NO: 3580778 - RNA, 15 nt, Pseudomonas putida KT2440
ucacgcaggcccagc

SEQ ID NO: 3580779 - RNA, 17 nt, Pseudomonas putida KT2440
ucacgccauccccccag

SEQ ID NO: 3580780 - RNA, 18 nt, Pseudomonas putida KT2440
ucacgcccaucaggaaca

SEQ ID NO: 3580781 - RNA, 19 nt, Pseudomonas putida KT2440
ucacgcccaucaggaacag

SEQ ID NO: 3580782 - RNA, 16 nt, Pseudomonas putida KT2440
ucacgcccgggccagg

SEQ ID NO: 3580783 - RNA, 19 nt, Pseudomonas putida KT2440
ucacgcggcgucaccggcc

SEQ ID NO: 3580784 - RNA, 17 nt, Pseudomonas putida KT2440
ucacgcuccuucgccac

SEQ ID NO: 3580785 - RNA, 14 nt, Pseudomonas putida KT2440
ucacgcucggccag

SEQ ID NO: 3580786 - RNA, 15 nt, Pseudomonas putida KT2440
ucacgcucggccagu

SEQ ID NO: 3580787 - RNA, 22 nt, Pseudomonas putida KT2440
ucacgcucguuguccagcagca

SEQ ID NO: 3580788 - RNA, 17 nt, Pseudomonas putida KT2440
ucacggaucagccgcgg

SEQ ID NO: 3580789 - RNA, 16 nt, Pseudomonas putida KT2440
ucacggaucgccagga

SEQ ID NO: 3580790 - RNA, 12 nt, Pseudomonas putida KT2440
ucacggcauccc

SEQ ID NO: 3580791 - RNA, 18 nt, Pseudomonas putida KT2440
ucacggccacccauggcg

SEQ ID NO: 3580792 - RNA, 16 nt, Pseudomonas putida KT2440
ucacggccauccugcu

SEQ ID NO: 3580793 - RNA, 22 nt, Pseudomonas putida KT2440
ucacggcgcaggccgacaacag

SEQ ID NO: 3580794 - RNA, 15 nt, Pseudomonas putida KT2440
ucacggcugaagaag

SEQ ID NO: 3580795 - RNA, 17 nt, Pseudomonas putida KT2440
ucacggcugaagaagcu

SEQ ID NO: 3580796 - RNA, 13 nt, Pseudomonas putida KT2440
ucacgggcaggcc

SEQ ID NO: 3580797 - RNA, 18 nt, Pseudomonas putida KT2440
ucacggguaagccggcgg

SEQ ID NO: 3580798 - RNA, 19 nt, Pseudomonas putida KT2440
ucacggguauagccaugca

SEQ ID NO: 3580799 - RNA, 12 nt, Pseudomonas putida KT2440
ucacggucaggc

SEQ ID NO: 3580800 - RNA, 14 nt, Pseudomonas putida KT2440
ucacggucuuggcc

SEQ ID NO: 3580801 - RNA, 16 nt, Pseudomonas putida KT2440
ucacggucuuggccgc

SEQ ID NO: 3580802 - RNA, 20 nt, Pseudomonas putida KT2440
ucacgguguccgccgccguc

SEQ ID NO: 3580803 - RNA, 16 nt, Pseudomonas putida KT2440
ucacgguuucacccuu

SEQ ID NO: 3580804 - RNA, 19 nt, Pseudomonas putida KT2440
ucacguagaacaggccugc

SEQ ID NO: 3580805 - RNA, 16 nt, Pseudomonas putida KT2440
ucacguccagccacuu

SEQ ID NO: 3580806 - RNA, 14 nt, Pseudomonas putida KT2440
ucacgucggccugc

SEQ ID NO: 3580807 - RNA, 14 nt, Pseudomonas putida KT2440
ucacgucuggcacc

SEQ ID NO: 3580808 - RNA, 21 nt, Pseudomonas putida KT2440
ucacgucuggcaccaguucca

SEQ ID NO: 3580809 - RNA, 17 nt, Pseudomonas putida KT2440
ucacguuguagcccacc

SEQ ID NO: 3580810 - RNA, 19 nt, Pseudomonas putida KT2440
ucacguuguagcccaccac

SEQ ID NO: 3580811 - RNA, 13 nt, Pseudomonas putida KT2440
ucacguuugcaaa

SEQ ID NO: 3580812 - RNA, 18 nt, Pseudomonas putida KT2440
ucacguuuggcagugcca

SEQ ID NO: 3580813 - RNA, 15 nt, Pseudomonas putida KT2440
ucacuacaugcggcc

SEQ ID NO: 3580814 - RNA, 17 nt, Pseudomonas putida KT2440
ucacuacaugcggcccu

SEQ ID NO: 3580815 - RNA, 15 nt, Pseudomonas putida KT2440
ucacuacccaggcca

SEQ ID NO: 3580816 - RNA, 17 nt, Pseudomonas putida KT2440
ucacucaaccaccgcuc

SEQ ID NO: 3580817 - RNA, 12 nt, Pseudomonas putida KT2440
ucacucaccgca

SEQ ID NO: 3580818 - RNA, 14 nt, Pseudomonas putida KT2440
ucacugaacgcaau

SEQ ID NO: 3580819 - RNA, 22 nt, Pseudomonas putida KT2440
ucacugacaaagccugcaccca

SEQ ID NO: 3580820 - RNA, 17 nt, Pseudomonas putida KT2440
ucacugcaccucccgcc

SEQ ID NO: 3580821 - RNA, 19 nt, Pseudomonas putida KT2440
ucacugcagaucaccagcu

SEQ ID NO: 3580822 - RNA, 22 nt, Pseudomonas putida KT2440
ucacugcagaucaccagcucgc

SEQ ID NO: 3580823 - RNA, 21 nt, Pseudomonas putida KT2440
ucacugccaccgugagcaugg

SEQ ID NO: 3580824 - RNA, 15 nt, Pseudomonas putida KT2440
ucacugccagcaccu

SEQ ID NO: 3580825 - RNA, 21 nt, Pseudomonas putida KT2440
ucacugcguauuuuugcgcca

SEQ ID NO: 3580826 - RNA, 13 nt, Pseudomonas putida KT2440
ucacuggccaacu

SEQ ID NO: 3580827 - RNA, 17 nt, Pseudomonas putida KT2440
ucacuggccagcagggc

SEQ ID NO: 3580828 - RNA, 19 nt, Pseudomonas putida KT2440
ucacuggccagcagggccg

SEQ ID NO: 3580829 - RNA, 20 nt, Pseudomonas putida KT2440
ucacuggccucuucacggcu

SEQ ID NO: 3580830 - RNA, 15 nt, Pseudomonas putida KT2440
ucacuggcugcugcg

SEQ ID NO: 3580831 - RNA, 15 nt, Pseudomonas putida KT2440
ucacuggcuuccucu

SEQ ID NO: 3580832 - RNA, 22 nt, Pseudomonas putida KT2440
ucacuggcuuccucuucaaggc

SEQ ID NO: 3580833 - RNA, 14 nt, Pseudomonas putida KT2440
ucacuguugccgcc

SEQ ID NO: 3580834 - RNA, 13 nt, Pseudomonas putida KT2440
ucacuucauccag

SEQ ID NO: 3580835 - RNA, 14 nt, Pseudomonas putida KT2440
ucacuuccaccugc

SEQ ID NO: 3580836 - RNA, 19 nt, Pseudomonas putida KT2440
ucacuuccaccugcgccuu

SEQ ID NO: 3580837 - RNA, 13 nt, Pseudomonas putida KT2440
ucacuuccaggcc

SEQ ID NO: 3580838 - RNA, 18 nt, Pseudomonas putida KT2440
ucacuuccggcugcagca

SEQ ID NO: 3580839 - RNA, 22 nt, Pseudomonas putida KT2440
ucacuugcagcucguugugcac

SEQ ID NO: 3580840 - RNA, 14 nt, Pseudomonas putida KT2440
ucacuuucugcgcu

SEQ ID NO: 3580841 - RNA, 18 nt, Pseudomonas putida KT2440
ucagaccuccgucugcuc

SEQ ID NO: 3580842 - RNA, 20 nt, Pseudomonas putida KT2440
ucagaccuccgucugcucug

SEQ ID NO: 3580843 - RNA, 22 nt, Pseudomonas putida KT2440
ucagaccuccgucugcucugcc

SEQ ID NO: 3580844 - RNA, 22 nt, Pseudomonas putida KT2440
ucagacgcggaacuggcugacc

SEQ ID NO: 3580845 - RNA, 14 nt, Pseudomonas putida KT2440
ucagacuccuuuga

SEQ ID NO: 3580846 - RNA, 13 nt, Pseudomonas putida KT2440
ucagacuuuccug

SEQ ID NO: 3580847 - RNA, 15 nt, Pseudomonas putida KT2440
ucagacuuuccugaa

SEQ ID NO: 3580848 - RNA, 18 nt, Pseudomonas putida KT2440
ucagagcgaaaugggccg

SEQ ID NO: 3580849 - RNA, 12 nt, Pseudomonas putida KT2440
ucagagcgccag

SEQ ID NO: 3580850 - RNA, 19 nt, Pseudomonas putida KT2440
ucagagcgccagcaagcgc

SEQ ID NO: 3580851 - RNA, 23 nt, Pseudomonas putida KT2440
ucagagcgguagggcguucagca

SEQ ID NO: 3580852 - RNA, 18 nt, Pseudomonas putida KT2440
ucagaucacccuuggcca

SEQ ID NO: 3580853 - RNA, 23 nt, Pseudomonas putida KT2440
ucagaucacccuuggccaccuuc

SEQ ID NO: 3580854 - RNA, 23 nt, Pseudomonas putida KT2440
ucagauggcccggucccgcugcc

SEQ ID NO: 3580855 - RNA, 16 nt, Pseudomonas putida KT2440
ucagauuacgcgucau

SEQ ID NO: 3580856 - RNA, 20 nt, Pseudomonas putida KT2440
ucagcaaccacgcuuggcuc

SEQ ID NO: 3580857 - RNA, 19 nt, Pseudomonas putida KT2440
ucagcaacccggccaggcc

SEQ ID NO: 3580858 - RNA, 22 nt, Pseudomonas putida KT2440
ucagcaaccucgagguacgagu

SEQ ID NO: 3580859 - RNA, 19 nt, Pseudomonas putida KT2440
ucagcaaccugcugggcaa

SEQ ID NO: 3580860 - RNA, 15 nt, Pseudomonas putida KT2440
ucagcaacgccacca

SEQ ID NO: 3580861 - RNA, 18 nt, Pseudomonas putida KT2440
ucagcaagccgccgacca

SEQ ID NO: 3580862 - RNA, 15 nt, Pseudomonas putida KT2440
ucagcaaucccgccc

SEQ ID NO: 3580863 - RNA, 21 nt, Pseudomonas putida KT2440
ucagcaaucccgccccaaagg

SEQ ID NO: 3580864 - RNA, 13 nt, Pseudomonas putida KT2440
ucagcacacccag

SEQ ID NO: 3580865 - RNA, 15 nt, Pseudomonas putida KT2440
ucagcacacccagca

SEQ ID NO: 3580866 - RNA, 13 nt, Pseudomonas putida KT2440
ucagcacaccgcu

SEQ ID NO: 3580867 - RNA, 19 nt, Pseudomonas putida KT2440
ucagcacaccgcucaaccu

SEQ ID NO: 3580868 - RNA, 20 nt, Pseudomonas putida KT2440
ucagcacaccgcucaaccuu

SEQ ID NO: 3580869 - RNA, 19 nt, Pseudomonas putida KT2440
ucagcaccagcucauccau

SEQ ID NO: 3580870 - RNA, 18 nt, Pseudomonas putida KT2440
ucagcaccggcaguagaa

SEQ ID NO: 3580871 - RNA, 21 nt, Pseudomonas putida KT2440
ucagcaccugggcgucaucac

SEQ ID NO: 3580872 - RNA, 14 nt, Pseudomonas putida KT2440
ucagcacgcccauc

SEQ ID NO: 3580873 - RNA, 17 nt, Pseudomonas putida KT2440
ucagcacgccgccgaua

SEQ ID NO: 3580874 - RNA, 18 nt, Pseudomonas putida KT2440
ucagcacgcgaucggcag

SEQ ID NO: 3580875 - RNA, 19 nt, Pseudomonas putida KT2440
ucagcacgcgaucggcagc

SEQ ID NO: 3580876 - RNA, 14 nt, Pseudomonas putida KT2440
ucagcacgggcagc

SEQ ID NO: 3580877 - RNA, 18 nt, Pseudomonas putida KT2440
ucagcacugugcucgccc

SEQ ID NO: 3580878 - RNA, 18 nt, Pseudomonas putida KT2440
ucagcagcaccgccacca

SEQ ID NO: 3580879 - RNA, 21 nt, Pseudomonas putida KT2440
ucagcagcaccgccaccaugc

SEQ ID NO: 3580880 - RNA, 23 nt, Pseudomonas putida KT2440
ucagcagcaggcgcgagccuugc

SEQ ID NO: 3580881 - RNA, 20 nt, Pseudomonas putida KT2440
ucagcagcuucagccagggc

SEQ ID NO: 3580882 - RNA, 19 nt, Pseudomonas putida KT2440
ucagcaggaaauacgccgc

SEQ ID NO: 3580883 - RNA, 22 nt, Pseudomonas putida KT2440
ucagcaggauggccaugaucgc

SEQ ID NO: 3580884 - RNA, 18 nt, Pseudomonas putida KT2440
ucagcaggcgcggcgugg

SEQ ID NO: 3580885 - RNA, 16 nt, Pseudomonas putida KT2440
ucagcaggucggcguc

SEQ ID NO: 3580886 - RNA, 19 nt, Pseudomonas putida KT2440
ucagcaggucggcgucagc

SEQ ID NO: 3580887 - RNA, 19 nt, Pseudomonas putida KT2440
ucagcagguugaacagcag

SEQ ID NO: 3580888 - RNA, 15 nt, Pseudomonas putida KT2440
ucagcaguggcucca

SEQ ID NO: 3580889 - RNA, 16 nt, Pseudomonas putida KT2440
ucagcaucaccgcgcc

SEQ ID NO: 3580890 - RNA, 15 nt, Pseudomonas putida KT2440
ucagcaucagugcag

SEQ ID NO: 3580891 - RNA, 21 nt, Pseudomonas putida KT2440
ucagcaucgggucacgcuccu

SEQ ID NO: 3580892 - RNA, 17 nt, Pseudomonas putida KT2440
ucagcaugcccagcgcc

SEQ ID NO: 3580893 - RNA, 22 nt, Pseudomonas putida KT2440
ucagcauggccaguuccuggca

SEQ ID NO: 3580894 - RNA, 16 nt, Pseudomonas putida KT2440
ucagccaaaucagcug

SEQ ID NO: 3580895 - RNA, 21 nt, Pseudomonas putida KT2440
ucagccaaccgccccacccau

SEQ ID NO: 3580896 - RNA, 22 nt, Pseudomonas putida KT2440
ucagccaaccgccccacccauu

SEQ ID NO: 3580897 - RNA, 20 nt, Pseudomonas putida KT2440
ucagccaaggcgcauccucg

SEQ ID NO: 3580898 - RNA, 14 nt, Pseudomonas putida KT2440
ucagccacauugau

SEQ ID NO: 3580899 - RNA, 22 nt, Pseudomonas putida KT2440
ucagccaccgcacucugcugcu

SEQ ID NO: 3580900 - RNA, 15 nt, Pseudomonas putida KT2440
ucagccacgucgcca

SEQ ID NO: 3580901 - RNA, 18 nt, Pseudomonas putida KT2440
ucagccacgucgccagcg

SEQ ID NO: 3580902 - RNA, 13 nt, Pseudomonas putida KT2440
ucagccagacgac

SEQ ID NO: 3580903 - RNA, 17 nt, Pseudomonas putida KT2440
ucagccagacgaccagc

SEQ ID NO: 3580904 - RNA, 18 nt, Pseudomonas putida KT2440
ucagccagacgaccagca

SEQ ID NO: 3580905 - RNA, 12 nt, Pseudomonas putida KT2440
ucagccagcaag

SEQ ID NO: 3580906 - RNA, 19 nt, Pseudomonas putida KT2440
ucagccagcgguccggccc

SEQ ID NO: 3580907 - RNA, 18 nt, Pseudomonas putida KT2440
ucagccaggcugagcccg

SEQ ID NO: 3580908 - RNA, 23 nt, Pseudomonas putida KT2440
ucagccagggcgagagcggcuuc

SEQ ID NO: 3580909 - RNA, 20 nt, Pseudomonas putida KT2440
ucagccagugcugccugcug

SEQ ID NO: 3580910 - RNA, 22 nt, Pseudomonas putida KT2440
ucagccaugggcaggucgaccc

SEQ ID NO: 3580911 - RNA, 22 nt, Pseudomonas putida KT2440
ucagcccauuucaccugcucug

SEQ ID NO: 3580912 - RNA, 20 nt, Pseudomonas putida KT2440
ucagcccugagggcucaucc

SEQ ID NO: 3580913 - RNA, 21 nt, Pseudomonas putida KT2440
ucagcccuugccagugauccg

SEQ ID NO: 3580914 - RNA, 17 nt, Pseudomonas putida KT2440
ucagcccuugcucggcc

SEQ ID NO: 3580915 - RNA, 19 nt, Pseudomonas putida KT2440
ucagcccuugcucggccag

SEQ ID NO: 3580916 - RNA, 15 nt, Pseudomonas putida KT2440
ucagcccuugcugca

SEQ ID NO: 3580917 - RNA, 19 nt, Pseudomonas putida KT2440
ucagcccuugcugcagcag

SEQ ID NO: 3580918 - RNA, 22 nt, Pseudomonas putida KT2440
ucagcccuugcugcagcaggcu

SEQ ID NO: 3580919 - RNA, 16 nt, Pseudomonas putida KT2440
ucagccgacagauagg

SEQ ID NO: 3580920 - RNA, 14 nt, Pseudomonas putida KT2440
ucagccgagccaac

SEQ ID NO: 3580921 - RNA, 12 nt, Pseudomonas putida KT2440
ucagccgccaca

SEQ ID NO: 3580922 - RNA, 13 nt, Pseudomonas putida KT2440
ucagccgcgcccu

SEQ ID NO: 3580923 - RNA, 16 nt, Pseudomonas putida KT2440
ucagccgcgcccucuu

SEQ ID NO: 3580924 - RNA, 14 nt, Pseudomonas putida KT2440
ucagccgcgcugac

SEQ ID NO: 3580925 - RNA, 18 nt, Pseudomonas putida KT2440
ucagccgcugcgccugcc

SEQ ID NO: 3580926 - RNA, 18 nt, Pseudomonas putida KT2440
ucagccguuggagcagcc

SEQ ID NO: 3580927 - RNA, 13 nt, Pseudomonas putida KT2440
ucagccucgguca

SEQ ID NO: 3580928 - RNA, 23 nt, Pseudomonas putida KT2440
ucagccucggucagguacucgcc

SEQ ID NO: 3580929 - RNA, 12 nt, Pseudomonas putida KT2440
ucagccuucaga

SEQ ID NO: 3580930 - RNA, 20 nt, Pseudomonas putida KT2440
ucagccuucagugcuucaca

SEQ ID NO: 3580931 - RNA, 19 nt, Pseudomonas putida KT2440
ucagcgaauaguagaagca

SEQ ID NO: 3580932 - RNA, 22 nt, Pseudomonas putida KT2440
ucagcgaggggacgaucugcag

SEQ ID NO: 3580933 - RNA, 22 nt, Pseudomonas putida KT2440
ucagcgagucguaguucggcgg

SEQ ID NO: 3580934 - RNA, 16 nt, Pseudomonas putida KT2440
ucagcgaguugaacuu

SEQ ID NO: 3580935 - RNA, 18 nt, Pseudomonas putida KT2440
ucagcgaugccuuuguac

SEQ ID NO: 3580936 - RNA, 14 nt, Pseudomonas putida KT2440
ucagcgcacccuuu

SEQ ID NO: 3580937 - RNA, 13 nt, Pseudomonas putida KT2440
ucagcgcaccgcu

SEQ ID NO: 3580938 - RNA, 20 nt, Pseudomonas putida KT2440
ucagcgcacugaacagcgcc

SEQ ID NO: 3580939 - RNA, 17 nt, Pseudomonas putida KT2440
ucagcgcagcaucuucc

SEQ ID NO: 3580940 - RNA, 13 nt, Pseudomonas putida KT2440
ucagcgccaauac

SEQ ID NO: 3580941 - RNA, 22 nt, Pseudomonas putida KT2440
ucagcgccagcacgcaggccag

SEQ ID NO: 3580942 - RNA, 19 nt, Pseudomonas putida KT2440
ucagcgccgcuucagccuu

SEQ ID NO: 3580943 - RNA, 15 nt, Pseudomonas putida KT2440
ucagcgccucgcccu

SEQ ID NO: 3580944 - RNA, 22 nt, Pseudomonas putida KT2440
ucagcgccugcucauccaccac

SEQ ID NO: 3580945 - RNA, 19 nt, Pseudomonas putida KT2440
ucagcgccuucuugucucc

SEQ ID NO: 3580946 - RNA, 21 nt, Pseudomonas putida KT2440
ucagcgcgccaucuucacggc

SEQ ID NO: 3580947 - RNA, 12 nt, Pseudomonas putida KT2440
ucagcgcggcaa

SEQ ID NO: 3580948 - RNA, 13 nt, Pseudomonas putida KT2440
ucagcgcggugac

SEQ ID NO: 3580949 - RNA, 14 nt, Pseudomonas putida KT2440
ucagcgcguccagc

SEQ ID NO: 3580950 - RNA, 21 nt, Pseudomonas putida KT2440
ucagcgcguccagcaacagcu

SEQ ID NO: 3580951 - RNA, 18 nt, Pseudomonas putida KT2440
ucagcggcaacaccagca

SEQ ID NO: 3580952 - RNA, 12 nt, Pseudomonas putida KT2440
ucagcggcaguu

SEQ ID NO: 3580953 - RNA, 18 nt, Pseudomonas putida KT2440
ucagcggccuuucugcuu

SEQ ID NO: 3580954 - RNA, 23 nt, Pseudomonas putida KT2440
ucagcgggcgauugccagggugc

SEQ ID NO: 3580955 - RNA, 18 nt, Pseudomonas putida KT2440
ucagcguacacugcagga

SEQ ID NO: 3580956 - RNA, 14 nt, Pseudomonas putida KT2440
ucagcucacaggcu

SEQ ID NO: 3580957 - RNA, 20 nt, Pseudomonas putida KT2440
ucagcucaggccuugcucga

SEQ ID NO: 3580958 - RNA, 13 nt, Pseudomonas putida KT2440
ucagcuccaugcg

SEQ ID NO: 3580959 - RNA, 14 nt, Pseudomonas putida KT2440
ucagcuccucugcc

SEQ ID NO: 3580960 - RNA, 22 nt, Pseudomonas putida KT2440
ucagcucggaaaggucggcggc

SEQ ID NO: 3580961 - RNA, 23 nt, Pseudomonas putida KT2440
ucagcucggcaacgauggucgcc

SEQ ID NO: 3580962 - RNA, 19 nt, Pseudomonas putida KT2440
ucagcucgugggucaucuu

SEQ ID NO: 3580963 - RNA, 19 nt, Pseudomonas putida KT2440
ucagcucuucgaucucuuc

SEQ ID NO: 3580964 - RNA, 22 nt, Pseudomonas putida KT2440
ucagcugauguuacggacgggc

SEQ ID NO: 3580965 - RNA, 20 nt, Pseudomonas putida KT2440
ucagcuggaacgcuuggcca

SEQ ID NO: 3580966 - RNA, 15 nt, Pseudomonas putida KT2440
ucagcuggccuucga

SEQ ID NO: 3580967 - RNA, 21 nt, Pseudomonas putida KT2440
ucagcugggagagcgccugca

SEQ ID NO: 3580968 - RNA, 23 nt, Pseudomonas putida KT2440
ucagcugggcguuuccagguucc

SEQ ID NO: 3580969 - RNA, 17 nt, Pseudomonas putida KT2440
ucagcugguucugcugc

SEQ ID NO: 3580970 - RNA, 13 nt, Pseudomonas putida KT2440
ucagcuguucuuc

SEQ ID NO: 3580971 - RNA, 20 nt, Pseudomonas putida KT2440
ucagcuuaacgcuuggccag

SEQ ID NO: 3580972 - RNA, 19 nt, Pseudomonas putida KT2440
ucagcuucauggcgccgau

SEQ ID NO: 3580973 - RNA, 20 nt, Pseudomonas putida KT2440
ucagcuucucgcgcuuggcc

SEQ ID NO: 3580974 - RNA, 22 nt, Pseudomonas putida KT2440
ucagcuucucgcgcuuggccag

SEQ ID NO: 3580975 - RNA, 14 nt, Pseudomonas putida KT2440
ucagcuugaacacg

SEQ ID NO: 3580976 - RNA, 16 nt, Pseudomonas putida KT2440
ucagcuugaucugguc

SEQ ID NO: 3580977 - RNA, 16 nt, Pseudomonas putida KT2440
ucagcuugugccgcgg

SEQ ID NO: 3580978 - RNA, 13 nt, Pseudomonas putida KT2440
ucaggaacagcuc

SEQ ID NO: 3580979 - RNA, 14 nt, Pseudomonas putida KT2440
ucaggaaggcacca

SEQ ID NO: 3580980 - RNA, 22 nt, Pseudomonas putida KT2440
ucaggaccugguccccauagcu

SEQ ID NO: 3580981 - RNA, 23 nt, Pseudomonas putida KT2440
ucaggacggucaugcucagcugg

SEQ ID NO: 3580982 - RNA, 23 nt, Pseudomonas putida KT2440
ucaggagggccguaggacagugc

SEQ ID NO: 3580983 - RNA, 13 nt, Pseudomonas putida KT2440
ucaggaucacguc

SEQ ID NO: 3580984 - RNA, 13 nt, Pseudomonas putida KT2440
ucaggauugccgc

SEQ ID NO: 3580985 - RNA, 21 nt, Pseudomonas putida KT2440
ucaggcaaucacgaucacucg

SEQ ID NO: 3580986 - RNA, 21 nt, Pseudomonas putida KT2440
ucaggcaauggcgaaccgcug

SEQ ID NO: 3580987 - RNA, 12 nt, Pseudomonas putida KT2440
ucaggcacagca

SEQ ID NO: 3580988 - RNA, 21 nt, Pseudomonas putida KT2440
ucaggcagaagguaggcaccc

SEQ ID NO: 3580989 - RNA, 17 nt, Pseudomonas putida KT2440
ucaggcaggaacuggcu

SEQ ID NO: 3580990 - RNA, 15 nt, Pseudomonas putida KT2440
ucaggcaggccagca

SEQ ID NO: 3580991 - RNA, 19 nt, Pseudomonas putida KT2440
ucaggcaggccagcacggc

SEQ ID NO: 3580992 - RNA, 20 nt, Pseudomonas putida KT2440
ucaggcaggccagcacggcc

SEQ ID NO: 3580993 - RNA, 20 nt, Pseudomonas putida KT2440
ucaggcaucacgucacagcc

SEQ ID NO: 3580994 - RNA, 22 nt, Pseudomonas putida KT2440
ucaggcaugacaaacgccagca

SEQ ID NO: 3580995 - RNA, 17 nt, Pseudomonas putida KT2440
ucaggcaugccagcagc

SEQ ID NO: 3580996 - RNA, 18 nt, Pseudomonas putida KT2440
ucaggcaugccagcagcu

SEQ ID NO: 3580997 - RNA, 17 nt, Pseudomonas putida KT2440
ucaggccaugcugcgcc

SEQ ID NO: 3580998 - RNA, 20 nt, Pseudomonas putida KT2440
ucaggccaugcugcgccagg

SEQ ID NO: 3580999 - RNA, 14 nt, Pseudomonas putida KT2440
ucaggccccaggcc

SEQ ID NO: 3581000 - RNA, 14 nt, Pseudomonas putida KT2440
ucaggccgaaggcc

SEQ ID NO: 3581001 - RNA, 13 nt, Pseudomonas putida KT2440
ucaggccgaugcg

SEQ ID NO: 3581002 - RNA, 17 nt, Pseudomonas putida KT2440
ucaggccgaugggcagg

SEQ ID NO: 3581003 - RNA, 12 nt, Pseudomonas putida KT2440
ucaggccgccuu

SEQ ID NO: 3581004 - RNA, 15 nt, Pseudomonas putida KT2440
ucaggccuccccgcu

SEQ ID NO: 3581005 - RNA, 12 nt, Pseudomonas putida KT2440
ucaggccuucga

SEQ ID NO: 3581006 - RNA, 15 nt, Pseudomonas putida KT2440
ucaggccuucgccac

SEQ ID NO: 3581007 - RNA, 15 nt, Pseudomonas putida KT2440
ucaggccuugccgcu

SEQ ID NO: 3581008 - RNA, 20 nt, Pseudomonas putida KT2440
ucaggccuugccgcucacca

SEQ ID NO: 3581009 - RNA, 17 nt, Pseudomonas putida KT2440
ucaggccuuuucacaca

SEQ ID NO: 3581010 - RNA, 16 nt, Pseudomonas putida KT2440
ucaggcgcgcaccggu

SEQ ID NO: 3581011 - RNA, 21 nt, Pseudomonas putida KT2440
ucaggcgcgugccugagccuu

SEQ ID NO: 3581012 - RNA, 22 nt, Pseudomonas putida KT2440
ucaggcgcucaccccgccccug

SEQ ID NO: 3581013 - RNA, 12 nt, Pseudomonas putida KT2440
ucaggcgcucca

SEQ ID NO: 3581014 - RNA, 12 nt, Pseudomonas putida KT2440
ucaggcgcuggu

SEQ ID NO: 3581015 - RNA, 20 nt, Pseudomonas putida KT2440
ucaggcgucaggcuugcuuc

SEQ ID NO: 3581016 - RNA, 23 nt, Pseudomonas putida KT2440
ucaggcguggaaaaggcgcuguc

SEQ ID NO: 3581017 - RNA, 20 nt, Pseudomonas putida KT2440
ucaggcugagcagaccagcc

SEQ ID NO: 3581018 - RNA, 13 nt, Pseudomonas putida KT2440
ucaggcuggcgac

SEQ ID NO: 3581019 - RNA, 14 nt, Pseudomonas putida KT2440
ucaggcuggcgacg

SEQ ID NO: 3581020 - RNA, 16 nt, Pseudomonas putida KT2440
ucaggcuguccacacc

SEQ ID NO: 3581021 - RNA, 17 nt, Pseudomonas putida KT2440
ucaggcuguccacacca

SEQ ID NO: 3581022 - RNA, 17 nt, Pseudomonas putida KT2440
ucaggcuucagaagccu

SEQ ID NO: 3581023 - RNA, 16 nt, Pseudomonas putida KT2440
ucaggcuuugcugcag

SEQ ID NO: 3581024 - RNA, 18 nt, Pseudomonas putida KT2440
ucagggaaggcuacaucc

SEQ ID NO: 3581025 - RNA, 16 nt, Pseudomonas putida KT2440
ucagggauacugcuga

SEQ ID NO: 3581026 - RNA, 13 nt, Pseudomonas putida KT2440
ucagggcacggcu

SEQ ID NO: 3581027 - RNA, 16 nt, Pseudomonas putida KT2440
ucagggcacggcugcc

SEQ ID NO: 3581028 - RNA, 15 nt, Pseudomonas putida KT2440
ucagggcccgggcac

SEQ ID NO: 3581029 - RNA, 11 nt, Pseudomonas putida KT2440
ucagggcugcg

SEQ ID NO: 3581030 - RNA, 18 nt, Pseudomonas putida KT2440
ucagggcuuuuuccagcg

SEQ ID NO: 3581031 - RNA, 12 nt, Pseudomonas putida KT2440
ucagggucaggg

SEQ ID NO: 3581032 - RNA, 18 nt, Pseudomonas putida KT2440
ucagggucgggcacaggc

SEQ ID NO: 3581033 - RNA, 18 nt, Pseudomonas putida KT2440
ucaggguuugcagcucac

SEQ ID NO: 3581034 - RNA, 18 nt, Pseudomonas putida KT2440
ucagguaauccaccagcc

SEQ ID NO: 3581035 - RNA, 15 nt, Pseudomonas putida KT2440
ucagguacagcagcu

SEQ ID NO: 3581036 - RNA, 17 nt, Pseudomonas putida KT2440
ucagguacucgcccgcc

SEQ ID NO: 3581037 - RNA, 15 nt, Pseudomonas putida KT2440
ucagguagccuucca

SEQ ID NO: 3581038 - RNA, 14 nt, Pseudomonas putida KT2440
ucagguaggcagca

SEQ ID NO: 3581039 - RNA, 23 nt, Pseudomonas putida KT2440
ucagguauugcgcaaggccgcgg

SEQ ID NO: 3581040 - RNA, 18 nt, Pseudomonas putida KT2440
ucaggucaaagcguucgc

SEQ ID NO: 3581041 - RNA, 16 nt, Pseudomonas putida KT2440
ucaggucgacacccag

SEQ ID NO: 3581042 - RNA, 16 nt, Pseudomonas putida KT2440
ucaggucgccuugaaa

SEQ ID NO: 3581043 - RNA, 20 nt, Pseudomonas putida KT2440
ucaggugcaucgucacaucc

SEQ ID NO: 3581044 - RNA, 21 nt, Pseudomonas putida KT2440
ucaggugcuucggcucuucgc

SEQ ID NO: 3581045 - RNA, 14 nt, Pseudomonas putida KT2440
ucagguguggcuca

SEQ ID NO: 3581046 - RNA, 18 nt, Pseudomonas putida KT2440
ucagguuacgcaccagcu

SEQ ID NO: 3581047 - RNA, 21 nt, Pseudomonas putida KT2440
ucagguuacgcaccagcucca

SEQ ID NO: 3581048 - RNA, 14 nt, Pseudomonas putida KT2440
ucagguuacuggcc

SEQ ID NO: 3581049 - RNA, 16 nt, Pseudomonas putida KT2440
ucagguucacuuccac

SEQ ID NO: 3581050 - RNA, 13 nt, Pseudomonas putida KT2440
ucagguuguucac

SEQ ID NO: 3581051 - RNA, 22 nt, Pseudomonas putida KT2440
ucagguuuggggugagcgaauc

SEQ ID NO: 3581052 - RNA, 17 nt, Pseudomonas putida KT2440
ucaguaccuggccgcgu

SEQ ID NO: 3581053 - RNA, 21 nt, Pseudomonas putida KT2440
ucaguauuauacgcgccauca

SEQ ID NO: 3581054 - RNA, 17 nt, Pseudomonas putida KT2440
ucagucgguagagcaaa

SEQ ID NO: 3581055 - RNA, 20 nt, Pseudomonas putida KT2440
ucagucgguagagcaaauga

SEQ ID NO: 3581056 - RNA, 13 nt, Pseudomonas putida KT2440
ucagugcggucag

SEQ ID NO: 3581057 - RNA, 17 nt, Pseudomonas putida KT2440
ucagugcgucggccacc

SEQ ID NO: 3581058 - RNA, 17 nt, Pseudomonas putida KT2440
ucagugcugucacccuu

SEQ ID NO: 3581059 - RNA, 18 nt, Pseudomonas putida KT2440
ucaguggucuucaaggcc

SEQ ID NO: 3581060 - RNA, 18 nt, Pseudomonas putida KT2440
ucaguguccucguucagc

SEQ ID NO: 3581061 - RNA, 14 nt, Pseudomonas putida KT2440
ucagugugaccuuc

SEQ ID NO: 3581062 - RNA, 18 nt, Pseudomonas putida KT2440
ucagugugaccuucaacc

SEQ ID NO: 3581063 - RNA, 19 nt, Pseudomonas putida KT2440
ucagugugggggcggccuc

SEQ ID NO: 3581064 - RNA, 20 nt, Pseudomonas putida KT2440
ucaguuccgcguccuugacg

SEQ ID NO: 3581065 - RNA, 23 nt, Pseudomonas putida KT2440
ucaguugcucgcccgcaacauaa

SEQ ID NO: 3581066 - RNA, 21 nt, Pseudomonas putida KT2440
ucaguuugacggugaauuccu

SEQ ID NO: 3581067 - RNA, 17 nt, Pseudomonas putida KT2440
ucaguuuuucuccgccc

SEQ ID NO: 3581068 - RNA, 16 nt, Pseudomonas putida KT2440
ucauaaugaaaacccu

SEQ ID NO: 3581069 - RNA, 21 nt, Pseudomonas putida KT2440
ucauaaugcuccgccaccaga

SEQ ID NO: 3581070 - RNA, 16 nt, Pseudomonas putida KT2440
ucauacagcgccucca

SEQ ID NO: 3581071 - RNA, 21 nt, Pseudomonas putida KT2440
ucauacggguguuuccacccc

SEQ ID NO: 3581072 - RNA, 22 nt, Pseudomonas putida KT2440
ucauagaaauggcuuccggcgc

SEQ ID NO: 3581073 - RNA, 18 nt, Pseudomonas putida KT2440
ucauagcuuucaggcgca

SEQ ID NO: 3581074 - RNA, 22 nt, Pseudomonas putida KT2440
ucauaguucuggcugccuucgc

SEQ ID NO: 3581075 - RNA, 14 nt, Pseudomonas putida KT2440
ucaucacacucgcc

SEQ ID NO: 3581076 - RNA, 16 nt, Pseudomonas putida KT2440
ucaucaccacuucacu

SEQ ID NO: 3581077 - RNA, 13 nt, Pseudomonas putida KT2440
ucaucaccagccc

SEQ ID NO: 3581078 - RNA, 22 nt, Pseudomonas putida KT2440
ucaucaccggccagcacuuccu

SEQ ID NO: 3581079 - RNA, 12 nt, Pseudomonas putida KT2440
ucaucaccggcg

SEQ ID NO: 3581080 - RNA, 19 nt, Pseudomonas putida KT2440
ucaucacgcgacgggaagu

SEQ ID NO: 3581081 - RNA, 23 nt, Pseudomonas putida KT2440
ucaucacgcgacgggaagugcac

SEQ ID NO: 3581082 - RNA, 17 nt, Pseudomonas putida KT2440
ucaucacguuacgccag

SEQ ID NO: 3581083 - RNA, 21 nt, Pseudomonas putida KT2440
ucaucacuacuccucgcaggu

SEQ ID NO: 3581084 - RNA, 22 nt, Pseudomonas putida KT2440
ucaucacuagaucucgcuucau

SEQ ID NO: 3581085 - RNA, 22 nt, Pseudomonas putida KT2440
ucaucagcaggcagucuugaaa

SEQ ID NO: 3581086 - RNA, 23 nt, Pseudomonas putida KT2440
ucaucaggacggucaugcucagc

SEQ ID NO: 3581087 - RNA, 17 nt, Pseudomonas putida KT2440
ucaucaggccgaaggcc

SEQ ID NO: 3581088 - RNA, 15 nt, Pseudomonas putida KT2440
ucaucaggucgccuu

SEQ ID NO: 3581089 - RNA, 19 nt, Pseudomonas putida KT2440
ucaucaggucgccuugaaa

SEQ ID NO: 3581090 - RNA, 14 nt, Pseudomonas putida KT2440
ucaucaucggcaug

SEQ ID NO: 3581091 - RNA, 19 nt, Pseudomonas putida KT2440
ucaucaucggcaugcagcg

SEQ ID NO: 3581092 - RNA, 15 nt, Pseudomonas putida KT2440
ucauccacaccuucg

SEQ ID NO: 3581093 - RNA, 21 nt, Pseudomonas putida KT2440
ucauccacauaggccagcucc

SEQ ID NO: 3581094 - RNA, 17 nt, Pseudomonas putida KT2440
ucauccaccacccuggc

SEQ ID NO: 3581095 - RNA, 13 nt, Pseudomonas putida KT2440
ucauccaccgccc

SEQ ID NO: 3581096 - RNA, 21 nt, Pseudomonas putida KT2440
ucauccagaucggcagugccg

SEQ ID NO: 3581097 - RNA, 13 nt, Pseudomonas putida KT2440
ucauccagcagcu

SEQ ID NO: 3581098 - RNA, 20 nt, Pseudomonas putida KT2440
ucauccagcagcucggacaa

SEQ ID NO: 3581099 - RNA, 18 nt, Pseudomonas putida KT2440
ucauccagcgggaugcag

SEQ ID NO: 3581100 - RNA, 14 nt, Pseudomonas putida KT2440
ucauccaggcugca

SEQ ID NO: 3581101 - RNA, 19 nt, Pseudomonas putida KT2440
ucauccaggcuggccagca

SEQ ID NO: 3581102 - RNA, 24 nt, Pseudomonas putida KT2440
ucauccaggcuggccagcaagugc

SEQ ID NO: 3581103 - RNA, 16 nt, Pseudomonas putida KT2440
ucauccaucaccugcc

SEQ ID NO: 3581104 - RNA, 21 nt, Pseudomonas putida KT2440
ucaucccucauuucaggcuuc

SEQ ID NO: 3581105 - RNA, 18 nt, Pseudomonas putida KT2440
ucauccgagcugagcagc

SEQ ID NO: 3581106 - RNA, 13 nt, Pseudomonas putida KT2440
ucauccgcacgca

SEQ ID NO: 3581107 - RNA, 14 nt, Pseudomonas putida KT2440
ucauccgccaggcu

SEQ ID NO: 3581108 - RNA, 23 nt, Pseudomonas putida KT2440
ucauccggccgacucuucaccag

SEQ ID NO: 3581109 - RNA, 18 nt, Pseudomonas putida KT2440
ucauccggcgcggccugc

SEQ ID NO: 3581110 - RNA, 20 nt, Pseudomonas putida KT2440
ucauccgggccgucaccgcu

SEQ ID NO: 3581111 - RNA, 15 nt, Pseudomonas putida KT2440
ucauccucaccggca

SEQ ID NO: 3581112 - RNA, 22 nt, Pseudomonas putida KT2440
ucauccucgacacccagucgcc

SEQ ID NO: 3581113 - RNA, 13 nt, Pseudomonas putida KT2440
ucauccucgccca

SEQ ID NO: 3581114 - RNA, 17 nt, Pseudomonas putida KT2440
ucauccucgcccaccag

SEQ ID NO: 3581115 - RNA, 14 nt, Pseudomonas putida KT2440
ucaucgaagaucag

SEQ ID NO: 3581116 - RNA, 15 nt, Pseudomonas putida KT2440
ucaucgaagaucagc

SEQ ID NO: 3581117 - RNA, 17 nt, Pseudomonas putida KT2440
ucaucgaagaucagcuc

SEQ ID NO: 3581118 - RNA, 18 nt, Pseudomonas putida KT2440
ucaucgaagccaagcgcc

SEQ ID NO: 3581119 - RNA, 17 nt, Pseudomonas putida KT2440
ucaucgagauguggccc

SEQ ID NO: 3581120 - RNA, 13 nt, Pseudomonas putida KT2440
ucaucgccagcag

SEQ ID NO: 3581121 - RNA, 15 nt, Pseudomonas putida KT2440
ucaucgcgguacacc

SEQ ID NO: 3581122 - RNA, 22 nt, Pseudomonas putida KT2440
ucaucggcaaacacauccagcg

SEQ ID NO: 3581123 - RNA, 17 nt, Pseudomonas putida KT2440
ucaucggcaugcagcgg

SEQ ID NO: 3581124 - RNA, 19 nt, Pseudomonas putida KT2440
ucaucggcaugcagcggcc

SEQ ID NO: 3581125 - RNA, 15 nt, Pseudomonas putida KT2440
ucaucguaauggccu

SEQ ID NO: 3581126 - RNA, 14 nt, Pseudomonas putida KT2440
ucaucguccaccca

SEQ ID NO: 3581127 - RNA, 21 nt, Pseudomonas putida KT2440
ucaucguccaccgcgccauca

SEQ ID NO: 3581128 - RNA, 22 nt, Pseudomonas putida KT2440
ucaucugcgcacggaaggcauc

SEQ ID NO: 3581129 - RNA, 11 nt, Pseudomonas putida KT2440
ucaucugcuga

SEQ ID NO: 3581130 - RNA, 22 nt, Pseudomonas putida KT2440
ucaucuucaucgcgaggcccga

SEQ ID NO: 3581131 - RNA, 15 nt, Pseudomonas putida KT2440
ucaucuugccggccu

SEQ ID NO: 3581132 - RNA, 11 nt, Pseudomonas putida KT2440
ucaugaacagc

SEQ ID NO: 3581133 - RNA, 13 nt, Pseudomonas putida KT2440
ucaugaacagcgc

SEQ ID NO: 3581134 - RNA, 12 nt, Pseudomonas putida KT2440
ucaugaagcuuc

SEQ ID NO: 3581135 - RNA, 15 nt, Pseudomonas putida KT2440
ucaugaagcuucaaa

SEQ ID NO: 3581136 - RNA, 16 nt, Pseudomonas putida KT2440
ucaugaagcuucaaac

SEQ ID NO: 3581137 - RNA, 16 nt, Pseudomonas putida KT2440
ucaugaagucagccag

SEQ ID NO: 3581138 - RNA, 18 nt, Pseudomonas putida KT2440
ucaugcaacaacccgccc

SEQ ID NO: 3581139 - RNA, 14 nt, Pseudomonas putida KT2440
ucaugcacgcagca

SEQ ID NO: 3581140 - RNA, 13 nt, Pseudomonas putida KT2440
ucaugcagcaccu

SEQ ID NO: 3581141 - RNA, 14 nt, Pseudomonas putida KT2440
ucaugcagcaccuc

SEQ ID NO: 3581142 - RNA, 13 nt, Pseudomonas putida KT2440
ucaugcagcgggu

SEQ ID NO: 3581143 - RNA, 20 nt, Pseudomonas putida KT2440
ucaugcagcgucggcagagc

SEQ ID NO: 3581144 - RNA, 16 nt, Pseudomonas putida KT2440
ucaugcaggucaucga

SEQ ID NO: 3581145 - RNA, 20 nt, Pseudomonas putida KT2440
ucaugcaguucuaccagcag

SEQ ID NO: 3581146 - RNA, 21 nt, Pseudomonas putida KT2440
ucaugccauccucggccaggc

SEQ ID NO: 3581147 - RNA, 17 nt, Pseudomonas putida KT2440
ucaugcccaccgcugca

SEQ ID NO: 3581148 - RNA, 17 nt, Pseudomonas putida KT2440
ucaugcccauggccagc

SEQ ID NO: 3581149 - RNA, 13 nt, Pseudomonas putida KT2440
ucaugccuucggu

SEQ ID NO: 3581150 - RNA, 20 nt, Pseudomonas putida KT2440
ucaugcgcccuggcggccac

SEQ ID NO: 3581151 - RNA, 15 nt, Pseudomonas putida KT2440
ucaugcgcuggccac

SEQ ID NO: 3581152 - RNA, 15 nt, Pseudomonas putida KT2440
ucaugcucgccggcc

SEQ ID NO: 3581153 - RNA, 18 nt, Pseudomonas putida KT2440
ucaugcucgccggccuug

SEQ ID NO: 3581154 - RNA, 22 nt, Pseudomonas putida KT2440
ucaugcucgccggccuuggcgc

SEQ ID NO: 3581155 - RNA, 14 nt, Pseudomonas putida KT2440
ucaugcugcugcag

SEQ ID NO: 3581156 - RNA, 15 nt, Pseudomonas putida KT2440
ucaugcuggccagga

SEQ ID NO: 3581157 - RNA, 18 nt, Pseudomonas putida KT2440
ucaugcugguuuggcagc

SEQ ID NO: 3581158 - RNA, 21 nt, Pseudomonas putida KT2440
ucaugcugguuuggcagcacc

SEQ ID NO: 3581159 - RNA, 20 nt, Pseudomonas putida KT2440
ucauggcgccgaugccgucg

SEQ ID NO: 3581160 - RNA, 17 nt, Pseudomonas putida KT2440
ucauggcuauucuccuu

SEQ ID NO: 3581161 - RNA, 20 nt, Pseudomonas putida KT2440
ucauggcucacacccaggcu

SEQ ID NO: 3581162 - RNA, 22 nt, Pseudomonas putida KT2440
ucaugggugucggcauacagcu

SEQ ID NO: 3581163 - RNA, 15 nt, Pseudomonas putida KT2440
ucaugguccuugaac

SEQ ID NO: 3581164 - RNA, 16 nt, Pseudomonas putida KT2440
ucaugguccuugaacg

SEQ ID NO: 3581165 - RNA, 14 nt, Pseudomonas putida KT2440
ucauggucgaccgc

SEQ ID NO: 3581166 - RNA, 13 nt, Pseudomonas putida KT2440
ucauguaggcaua

SEQ ID NO: 3581167 - RNA, 14 nt, Pseudomonas putida KT2440
ucauguccuugcug

SEQ ID NO: 3581168 - RNA, 16 nt, Pseudomonas putida KT2440
ucauguccuugcugcg

SEQ ID NO: 3581169 - RNA, 22 nt, Pseudomonas putida KT2440
ucaugucgccguauucaccggu

SEQ ID NO: 3581170 - RNA, 10 nt, Pseudomonas putida KT2440
ucaugugugc

SEQ ID NO: 3581171 - RNA, 14 nt, Pseudomonas putida KT2440
ucauuagccuucau

SEQ ID NO: 3581172 - RNA, 14 nt, Pseudomonas putida KT2440
ucauucaaagccug

SEQ ID NO: 3581173 - RNA, 16 nt, Pseudomonas putida KT2440
ucauucaaagccugcu

SEQ ID NO: 3581174 - RNA, 17 nt, Pseudomonas putida KT2440
ucauucaaggucagcuu

SEQ ID NO: 3581175 - RNA, 20 nt, Pseudomonas putida KT2440
ucauucgcccgcaccgccgc

SEQ ID NO: 3581176 - RNA, 18 nt, Pseudomonas putida KT2440
ucauugacggucagugaa

SEQ ID NO: 3581177 - RNA, 20 nt, Pseudomonas putida KT2440
ucauugacggucagugaagc

SEQ ID NO: 3581178 - RNA, 14 nt, Pseudomonas putida KT2440
ucauugaguuggug

SEQ ID NO: 3581179 - RNA, 16 nt, Pseudomonas putida KT2440
ucauugccgugcucgu

SEQ ID NO: 3581180 - RNA, 16 nt, Pseudomonas putida KT2440
ucauuggcgccaucgc

SEQ ID NO: 3581181 - RNA, 16 nt, Pseudomonas putida KT2440
ucauuguucuggccac

SEQ ID NO: 3581182 - RNA, 13 nt, Pseudomonas putida KT2440
uccaaagccagcg

SEQ ID NO: 3581183 - RNA, 13 nt, Pseudomonas putida KT2440
uccaaccagccag

SEQ ID NO: 3581184 - RNA, 14 nt, Pseudomonas putida KT2440
uccaaccagccagc

SEQ ID NO: 3581185 - RNA, 12 nt, Pseudomonas putida KT2440
uccaaccccagc

SEQ ID NO: 3581186 - RNA, 14 nt, Pseudomonas putida KT2440
uccaaccgcaagcg

SEQ ID NO: 3581187 - RNA, 22 nt, Pseudomonas putida KT2440
uccaacgcugccuugcccagcu

SEQ ID NO: 3581188 - RNA, 14 nt, Pseudomonas putida KT2440
uccaacgggcggaa

SEQ ID NO: 3581189 - RNA, 20 nt, Pseudomonas putida KT2440
uccaacgggcggaacuggcc

SEQ ID NO: 3581190 - RNA, 17 nt, Pseudomonas putida KT2440
uccaacuccacgcggaa

SEQ ID NO: 3581191 - RNA, 20 nt, Pseudomonas putida KT2440
uccaacucgcgcauccagcc

SEQ ID NO: 3581192 - RNA, 23 nt, Pseudomonas putida KT2440
uccaacucgcgcauccagccaga

SEQ ID NO: 3581193 - RNA, 20 nt, Pseudomonas putida KT2440
uccaacuggaccaucacgga

SEQ ID NO: 3581194 - RNA, 22 nt, Pseudomonas putida KT2440
uccaacuggcgcaucuuccagc

SEQ ID NO: 3581195 - RNA, 15 nt, Pseudomonas putida KT2440
uccaagcgucggcca

SEQ ID NO: 3581196 - RNA, 14 nt, Pseudomonas putida KT2440
uccaauccgcagcu

SEQ ID NO: 3581197 - RNA, 15 nt, Pseudomonas putida KT2440
uccaaugcgucaucg

SEQ ID NO: 3581198 - RNA, 16 nt, Pseudomonas putida KT2440
uccaaugcgucaucga

SEQ ID NO: 3581199 - RNA, 18 nt, Pseudomonas putida KT2440
uccaauguuagcccgacg

SEQ ID NO: 3581200 - RNA, 15 nt, Pseudomonas putida KT2440
uccacaaucagcacu

SEQ ID NO: 3581201 - RNA, 16 nt, Pseudomonas putida KT2440
uccacaaucagcacug

SEQ ID NO: 3581202 - RNA, 19 nt, Pseudomonas putida KT2440
uccacaaucucgcccuugu

SEQ ID NO: 3581203 - RNA, 20 nt, Pseudomonas putida KT2440
uccacaccaaagucagccag

SEQ ID NO: 3581204 - RNA, 19 nt, Pseudomonas putida KT2440
uccacacccagcgcggcaa

SEQ ID NO: 3581205 - RNA, 15 nt, Pseudomonas putida KT2440
uccacacccugcgaa

SEQ ID NO: 3581206 - RNA, 16 nt, Pseudomonas putida KT2440
uccacaccgacaucca

SEQ ID NO: 3581207 - RNA, 15 nt, Pseudomonas putida KT2440
uccacaccguacugc

SEQ ID NO: 3581208 - RNA, 18 nt, Pseudomonas putida KT2440
uccacacgcugcugcgua

SEQ ID NO: 3581209 - RNA, 23 nt, Pseudomonas putida KT2440
uccacacgcugcugcguaccauc

SEQ ID NO: 3581210 - RNA, 21 nt, Pseudomonas putida KT2440
uccacacucgacgcugccguc

SEQ ID NO: 3581211 - RNA, 13 nt, Pseudomonas putida KT2440
uccacagcagucu

SEQ ID NO: 3581212 - RNA, 18 nt, Pseudomonas putida KT2440
uccacagguaccaggcug

SEQ ID NO: 3581213 - RNA, 13 nt, Pseudomonas putida KT2440
uccacauacugcu

SEQ ID NO: 3581214 - RNA, 16 nt, Pseudomonas putida KT2440
uccacauaggccagcu

SEQ ID NO: 3581215 - RNA, 22 nt, Pseudomonas putida KT2440
uccacauaggccagcuccuucg

SEQ ID NO: 3581216 - RNA, 14 nt, Pseudomonas putida KT2440
uccacaucuugccc

SEQ ID NO: 3581217 - RNA, 16 nt, Pseudomonas putida KT2440
uccacaucuugccccg

SEQ ID NO: 3581218 - RNA, 21 nt, Pseudomonas putida KT2440
uccaccacacgcccgcgugag

SEQ ID NO: 3581219 - RNA, 12 nt, Pseudomonas putida KT2440
uccaccacagcu

SEQ ID NO: 3581220 - RNA, 21 nt, Pseudomonas putida KT2440
uccaccacagcugcgccagcc

SEQ ID NO: 3581221 - RNA, 12 nt, Pseudomonas putida KT2440
uccaccaccacu

SEQ ID NO: 3581222 - RNA, 14 nt, Pseudomonas putida KT2440
uccaccagcaggcu

SEQ ID NO: 3581223 - RNA, 15 nt, Pseudomonas putida KT2440
uccaccagccccagc

SEQ ID NO: 3581224 - RNA, 20 nt, Pseudomonas putida KT2440
uccaccaggccgaucaccag

SEQ ID NO: 3581225 - RNA, 21 nt, Pseudomonas putida KT2440
uccaccaggccgaucaccagc

SEQ ID NO: 3581226 - RNA, 22 nt, Pseudomonas putida KT2440
uccaccaggcuggccaccacca

SEQ ID NO: 3581227 - RNA, 18 nt, Pseudomonas putida KT2440
uccaccaguugguaaaac

SEQ ID NO: 3581228 - RNA, 16 nt, Pseudomonas putida KT2440
uccaccauucccugca

SEQ ID NO: 3581229 - RNA, 13 nt, Pseudomonas putida KT2440
uccacccacccuc

SEQ ID NO: 3581230 - RNA, 14 nt, Pseudomonas putida KT2440
uccacccacccucg

SEQ ID NO: 3581231 - RNA, 17 nt, Pseudomonas putida KT2440
uccacccaccuuggccc

SEQ ID NO: 3581232 - RNA, 14 nt, Pseudomonas putida KT2440
uccacccccgcacc

SEQ ID NO: 3581233 - RNA, 16 nt, Pseudomonas putida KT2440
uccacccccgcuccua

SEQ ID NO: 3581234 - RNA, 22 nt, Pseudomonas putida KT2440
uccacccccgucucggcaauca

SEQ ID NO: 3581235 - RNA, 16 nt, Pseudomonas putida KT2440
uccaccccgcaggccg

SEQ ID NO: 3581236 - RNA, 18 nt, Pseudomonas putida KT2440
uccaccccgcaggccgca

SEQ ID NO: 3581237 - RNA, 13 nt, Pseudomonas putida KT2440
uccaccccuucca

SEQ ID NO: 3581238 - RNA, 22 nt, Pseudomonas putida KT2440
uccaccccuuccagcuucugca

SEQ ID NO: 3581239 - RNA, 22 nt, Pseudomonas putida KT2440
uccacccgccugcaaccaguca

SEQ ID NO: 3581240 - RNA, 17 nt, Pseudomonas putida KT2440
uccacccggucccgccc

SEQ ID NO: 3581241 - RNA, 14 nt, Pseudomonas putida KT2440
uccacccgugcagg

SEQ ID NO: 3581242 - RNA, 19 nt, Pseudomonas putida KT2440
uccaccgaaaucagcaacg

SEQ ID NO: 3581243 - RNA, 19 nt, Pseudomonas putida KT2440
uccaccgccccaagcgccu

SEQ ID NO: 3581244 - RNA, 15 nt, Pseudomonas putida KT2440
uccaccgcgccagcc

SEQ ID NO: 3581245 - RNA, 22 nt, Pseudomonas putida KT2440
uccaccgcgccaucaaggccga

SEQ ID NO: 3581246 - RNA, 12 nt, Pseudomonas putida KT2440
uccaccggcacg

SEQ ID NO: 3581247 - RNA, 16 nt, Pseudomonas putida KT2440
uccaccggcuugcccg

SEQ ID NO: 3581248 - RNA, 17 nt, Pseudomonas putida KT2440
uccaccgggaagcaggu

SEQ ID NO: 3581249 - RNA, 22 nt, Pseudomonas putida KT2440
uccaccucgggcuuggcacgcu

SEQ ID NO: 3581250 - RNA, 18 nt, Pseudomonas putida KT2440
uccaccucgucaugcagc

SEQ ID NO: 3581251 - RNA, 22 nt, Pseudomonas putida KT2440
uccaccucgucaugcagcgcca

SEQ ID NO: 3581252 - RNA, 16 nt, Pseudomonas putida KT2440
uccaccugacgcgcca

SEQ ID NO: 3581253 - RNA, 12 nt, Pseudomonas putida KT2440
uccaccugccac

SEQ ID NO: 3581254 - RNA, 16 nt, Pseudomonas putida KT2440
uccaccugcgccuugc

SEQ ID NO: 3581255 - RNA, 19 nt, Pseudomonas putida KT2440
uccaccugcuccagcaccu

SEQ ID NO: 3581256 - RNA, 13 nt, Pseudomonas putida KT2440
uccaccuggccac

SEQ ID NO: 3581257 - RNA, 20 nt, Pseudomonas putida KT2440
uccaccuuccacucuuccac

SEQ ID NO: 3581258 - RNA, 20 nt, Pseudomonas putida KT2440
uccacgaaccugugcacagc

SEQ ID NO: 3581259 - RNA, 18 nt, Pseudomonas putida KT2440
uccacgcgcaggcgcugc

SEQ ID NO: 3581260 - RNA, 22 nt, Pseudomonas putida KT2440
uccacguccacuaccuccagcc

SEQ ID NO: 3581261 - RNA, 14 nt, Pseudomonas putida KT2440
uccacguucccgcc

SEQ ID NO: 3581262 - RNA, 15 nt, Pseudomonas putida KT2440
uccacguucccgcca

SEQ ID NO: 3581263 - RNA, 16 nt, Pseudomonas putida KT2440
uccacugugcccgcca

SEQ ID NO: 3581264 - RNA, 13 nt, Pseudomonas putida KT2440
uccacuuccagca

SEQ ID NO: 3581265 - RNA, 14 nt, Pseudomonas putida KT2440
uccacuuccagcag

SEQ ID NO: 3581266 - RNA, 16 nt, Pseudomonas putida KT2440
uccacuuccagcagcu

SEQ ID NO: 3581267 - RNA, 17 nt, Pseudomonas putida KT2440
uccacuucgcaacgcuu

SEQ ID NO: 3581268 - RNA, 13 nt, Pseudomonas putida KT2440
uccacuugucccg

SEQ ID NO: 3581269 - RNA, 19 nt, Pseudomonas putida KT2440
uccagaaacggcuugaacc

SEQ ID NO: 3581270 - RNA, 17 nt, Pseudomonas putida KT2440
uccagaaagcgauugcc

SEQ ID NO: 3581271 - RNA, 12 nt, Pseudomonas putida KT2440
uccagaagcggc

SEQ ID NO: 3581272 - RNA, 18 nt, Pseudomonas putida KT2440
uccagaccagacagcgcu

SEQ ID NO: 3581273 - RNA, 22 nt, Pseudomonas putida KT2440
uccagaccagacagcgcuaucu

SEQ ID NO: 3581274 - RNA, 21 nt, Pseudomonas putida KT2440
uccagcaaagugcgcaugccc

SEQ ID NO: 3581275 - RNA, 20 nt, Pseudomonas putida KT2440
uccagcaacaacgccuuggc

SEQ ID NO: 3581276 - RNA, 14 nt, Pseudomonas putida KT2440
uccagcaacagcug

SEQ ID NO: 3581277 - RNA, 16 nt, Pseudomonas putida KT2440
uccagcaacagcugcc

SEQ ID NO: 3581278 - RNA, 22 nt, Pseudomonas putida KT2440
uccagcaacggacgucccagca

SEQ ID NO: 3581279 - RNA, 22 nt, Pseudomonas putida KT2440
uccagcaagcucaucaccaggc

SEQ ID NO: 3581280 - RNA, 20 nt, Pseudomonas putida KT2440
uccagcaagggccugugccg

SEQ ID NO: 3581281 - RNA, 13 nt, Pseudomonas putida KT2440
uccagcacccgcu

SEQ ID NO: 3581282 - RNA, 14 nt, Pseudomonas putida KT2440
uccagcacccgcuu

SEQ ID NO: 3581283 - RNA, 13 nt, Pseudomonas putida KT2440
uccagcaccggcg

SEQ ID NO: 3581284 - RNA, 17 nt, Pseudomonas putida KT2440
uccagcaccggcgugcc

SEQ ID NO: 3581285 - RNA, 19 nt, Pseudomonas putida KT2440
uccagcaccucgcucagcu

SEQ ID NO: 3581286 - RNA, 15 nt, Pseudomonas putida KT2440
uccagcacugccugg

SEQ ID NO: 3581287 - RNA, 19 nt, Pseudomonas putida KT2440
uccagcacugccuggccac

SEQ ID NO: 3581288 - RNA, 16 nt, Pseudomonas putida KT2440
uccagcagcacacgcu

SEQ ID NO: 3581289 - RNA, 19 nt, Pseudomonas putida KT2440
uccagcagcgacaccagcg

SEQ ID NO: 3581290 - RNA, 20 nt, Pseudomonas putida KT2440
uccagcagcgcauccaccuc

SEQ ID NO: 3581291 - RNA, 22 nt, Pseudomonas putida KT2440
uccagcagguuggacagcgccc

SEQ ID NO: 3581292 - RNA, 19 nt, Pseudomonas putida KT2440
uccagcagguuuuccagcc

SEQ ID NO: 3581293 - RNA, 21 nt, Pseudomonas putida KT2440
uccagcagguuuuccagcccg

SEQ ID NO: 3581294 - RNA, 12 nt, Pseudomonas putida KT2440
uccagcagugcc

SEQ ID NO: 3581295 - RNA, 20 nt, Pseudomonas putida KT2440
uccagcagugccaucgccuc

SEQ ID NO: 3581296 - RNA, 13 nt, Pseudomonas putida KT2440
uccagcagugccg

SEQ ID NO: 3581297 - RNA, 22 nt, Pseudomonas putida KT2440
uccagcagugccgccugguugc

SEQ ID NO: 3581298 - RNA, 21 nt, Pseudomonas putida KT2440
uccagcagugccguggcaggc

SEQ ID NO: 3581299 - RNA, 23 nt, Pseudomonas putida KT2440
uccagcauguaagcuucagcgac

SEQ ID NO: 3581300 - RNA, 17 nt, Pseudomonas putida KT2440
uccagccacuuggcccc

SEQ ID NO: 3581301 - RNA, 10 nt, Pseudomonas putida KT2440
uccagccagg

SEQ ID NO: 3581302 - RNA, 15 nt, Pseudomonas putida KT2440
uccagcccaccacga

SEQ ID NO: 3581303 - RNA, 17 nt, Pseudomonas putida KT2440
uccagcccaccacgaac

SEQ ID NO: 3581304 - RNA, 19 nt, Pseudomonas putida KT2440
uccagcccgaaaccaugca

SEQ ID NO: 3581305 - RNA, 17 nt, Pseudomonas putida KT2440
uccagcccgauggccuu

SEQ ID NO: 3581306 - RNA, 20 nt, Pseudomonas putida KT2440
uccagcccgauuucgugcac

SEQ ID NO: 3581307 - RNA, 14 nt, Pseudomonas putida KT2440
uccagcccggucca

SEQ ID NO: 3581308 - RNA, 22 nt, Pseudomonas putida KT2440
uccagcccguucuggccuuggc

SEQ ID NO: 3581309 - RNA, 14 nt, Pseudomonas putida KT2440
uccagcccugcucg

SEQ ID NO: 3581310 - RNA, 14 nt, Pseudomonas putida KT2440
uccagcccuuccac

SEQ ID NO: 3581311 - RNA, 15 nt, Pseudomonas putida KT2440
uccagcccuuccacc

SEQ ID NO: 3581312 - RNA, 20 nt, Pseudomonas putida KT2440
uccagcccuuccaccacauc

SEQ ID NO: 3581313 - RNA, 19 nt, Pseudomonas putida KT2440
uccagccgcgccacuccca

SEQ ID NO: 3581314 - RNA, 13 nt, Pseudomonas putida KT2440
uccagccugcagc

SEQ ID NO: 3581315 - RNA, 14 nt, Pseudomonas putida KT2440
uccagccugcagca

SEQ ID NO: 3581316 - RNA, 14 nt, Pseudomonas putida KT2440
uccagcgaggguuc

SEQ ID NO: 3581317 - RNA, 16 nt, Pseudomonas putida KT2440
uccagcgcaggcuuca

SEQ ID NO: 3581318 - RNA, 22 nt, Pseudomonas putida KT2440
uccagcgccacccaggcauaca

SEQ ID NO: 3581319 - RNA, 13 nt, Pseudomonas putida KT2440
uccagcgccagca

SEQ ID NO: 3581320 - RNA, 17 nt, Pseudomonas putida KT2440
uccagcgccagcagccg

SEQ ID NO: 3581321 - RNA, 19 nt, Pseudomonas putida KT2440
uccagcgccgccaugcagc

SEQ ID NO: 3581322 - RNA, 17 nt, Pseudomonas putida KT2440
uccagcgccgcgccacc

SEQ ID NO: 3581323 - RNA, 22 nt, Pseudomonas putida KT2440
uccagcgccucccccagcgcgg

SEQ ID NO: 3581324 - RNA, 19 nt, Pseudomonas putida KT2440
uccagcggcgacaggugcc

SEQ ID NO: 3581325 - RNA, 22 nt, Pseudomonas putida KT2440
uccagcggcgacaggugccccu

SEQ ID NO: 3581326 - RNA, 16 nt, Pseudomonas putida KT2440
uccagcgucccgguca

SEQ ID NO: 3581327 - RNA, 15 nt, Pseudomonas putida KT2440
uccagcguggcgagg

SEQ ID NO: 3581328 - RNA, 15 nt, Pseudomonas putida KT2440
uccagcucacagcac

SEQ ID NO: 3581329 - RNA, 13 nt, Pseudomonas putida KT2440
uccagcuccagca

SEQ ID NO: 3581330 - RNA, 17 nt, Pseudomonas putida KT2440
uccagcuccuggcccgc

SEQ ID NO: 3581331 - RNA, 19 nt, Pseudomonas putida KT2440
uccagcuccuucuucaccc

SEQ ID NO: 3581332 - RNA, 21 nt, Pseudomonas putida KT2440
uccagcuccuucuucacccgc

SEQ ID NO: 3581333 - RNA, 13 nt, Pseudomonas putida KT2440
uccagcucggcaa

SEQ ID NO: 3581334 - RNA, 15 nt, Pseudomonas putida KT2440
uccagcucggcaagg

SEQ ID NO: 3581335 - RNA, 16 nt, Pseudomonas putida KT2440
uccagcucggcaaggc

SEQ ID NO: 3581336 - RNA, 19 nt, Pseudomonas putida KT2440
uccagcucggcuggcuguc

SEQ ID NO: 3581337 - RNA, 18 nt, Pseudomonas putida KT2440
uccagcucuggucaccuu

SEQ ID NO: 3581338 - RNA, 21 nt, Pseudomonas putida KT2440
uccagcucuggucaccuucgu

SEQ ID NO: 3581339 - RNA, 18 nt, Pseudomonas putida KT2440
uccagcugaaagucgucg

SEQ ID NO: 3581340 - RNA, 14 nt, Pseudomonas putida KT2440
uccagcugagcgcc

SEQ ID NO: 3581341 - RNA, 18 nt, Pseudomonas putida KT2440
uccagcugcucguacgag

SEQ ID NO: 3581342 - RNA, 22 nt, Pseudomonas putida KT2440
uccagcuggccaucgacccgcu

SEQ ID NO: 3581343 - RNA, 20 nt, Pseudomonas putida KT2440
uccagcuguacgcuggccaa

SEQ ID NO: 3581344 - RNA, 20 nt, Pseudomonas putida KT2440
uccagcuucaccucaucggc

SEQ ID NO: 3581345 - RNA, 19 nt, Pseudomonas putida KT2440
uccagcuucugcaacuccu

SEQ ID NO: 3581346 - RNA, 14 nt, Pseudomonas putida KT2440
uccagcuucugcug

SEQ ID NO: 3581347 - RNA, 15 nt, Pseudomonas putida KT2440
uccagcuucugcugg

SEQ ID NO: 3581348 - RNA, 21 nt, Pseudomonas putida KT2440
uccagcuucuugugcuuccag

SEQ ID NO: 3581349 - RNA, 16 nt, Pseudomonas putida KT2440
uccagcuugccaccau

SEQ ID NO: 3581350 - RNA, 19 nt, Pseudomonas putida KT2440
uccagcuugccaccaucga

SEQ ID NO: 3581351 - RNA, 15 nt, Pseudomonas putida KT2440
uccaggaacgcugcc

SEQ ID NO: 3581352 - RNA, 13 nt, Pseudomonas putida KT2440
uccaggcacaccg

SEQ ID NO: 3581353 - RNA, 22 nt, Pseudomonas putida KT2440
uccaggcacaggcgcacacgcu

SEQ ID NO: 3581354 - RNA, 16 nt, Pseudomonas putida KT2440
uccaggcccauuucgc

SEQ ID NO: 3581355 - RNA, 21 nt, Pseudomonas putida KT2440
uccaggcccauuucgcggguc

SEQ ID NO: 3581356 - RNA, 15 nt, Pseudomonas putida KT2440
uccaggcccugcagc

SEQ ID NO: 3581357 - RNA, 17 nt, Pseudomonas putida KT2440
uccaggccugcggcagc

SEQ ID NO: 3581358 - RNA, 19 nt, Pseudomonas putida KT2440
uccaggcgaccaugcggcu

SEQ ID NO: 3581359 - RNA, 17 nt, Pseudomonas putida KT2440
uccaggcgcaaguagaa

SEQ ID NO: 3581360 - RNA, 13 nt, Pseudomonas putida KT2440
uccaggcggccag

SEQ ID NO: 3581361 - RNA, 22 nt, Pseudomonas putida KT2440
uccaggcggccagccaacggca

SEQ ID NO: 3581362 - RNA, 21 nt, Pseudomonas putida KT2440
uccaggcguucaucgaaggcc

SEQ ID NO: 3581363 - RNA, 23 nt, Pseudomonas putida KT2440
uccaggcucagcucgucgagcau

SEQ ID NO: 3581364 - RNA, 17 nt, Pseudomonas putida KT2440
uccaggcugcacuggca

SEQ ID NO: 3581365 - RNA, 16 nt, Pseudomonas putida KT2440
uccaggcugcgcauca

SEQ ID NO: 3581366 - RNA, 16 nt, Pseudomonas putida KT2440
uccaggcuggccagca

SEQ ID NO: 3581367 - RNA, 17 nt, Pseudomonas putida KT2440
uccaggcuggccagcaa

SEQ ID NO: 3581368 - RNA, 15 nt, Pseudomonas putida KT2440
uccaggcuggcgcuu

SEQ ID NO: 3581369 - RNA, 16 nt, Pseudomonas putida KT2440
uccaggcuuucgaccu

SEQ ID NO: 3581370 - RNA, 15 nt, Pseudomonas putida KT2440
uccagggcaggcuga

SEQ ID NO: 3581371 - RNA, 13 nt, Pseudomonas putida KT2440
uccagggccaugg

SEQ ID NO: 3581372 - RNA, 16 nt, Pseudomonas putida KT2440
uccagggcgucggcau

SEQ ID NO: 3581373 - RNA, 14 nt, Pseudomonas putida KT2440
uccagguaaaccug

SEQ ID NO: 3581374 - RNA, 23 nt, Pseudomonas putida KT2440
uccagguacucgcgacugaagcg

SEQ ID NO: 3581375 - RNA, 19 nt, Pseudomonas putida KT2440
uccaggucauccgcacgca

SEQ ID NO: 3581376 - RNA, 18 nt, Pseudomonas putida KT2440
uccaggucgaucgcaacg

SEQ ID NO: 3581377 - RNA, 22 nt, Pseudomonas putida KT2440
uccaggucgcggagccagacau

SEQ ID NO: 3581378 - RNA, 19 nt, Pseudomonas putida KT2440
uccaggugaaucagcggca

SEQ ID NO: 3581379 - RNA, 20 nt, Pseudomonas putida KT2440
uccaggugaaucagcggcag

SEQ ID NO: 3581380 - RNA, 16 nt, Pseudomonas putida KT2440
uccaggugcucgauga

SEQ ID NO: 3581381 - RNA, 14 nt, Pseudomonas putida KT2440
uccaggugcugcga

SEQ ID NO: 3581382 - RNA, 15 nt, Pseudomonas putida KT2440
uccagguggccgcca

SEQ ID NO: 3581383 - RNA, 16 nt, Pseudomonas putida KT2440
uccagguuaucuagca

SEQ ID NO: 3581384 - RNA, 20 nt, Pseudomonas putida KT2440
uccagguuuggguuggcuuu

SEQ ID NO: 3581385 - RNA, 23 nt, Pseudomonas putida KT2440
uccagucaggccguagcgcugac

SEQ ID NO: 3581386 - RNA, 14 nt, Pseudomonas putida KT2440
uccagucggcaucc

SEQ ID NO: 3581387 - RNA, 23 nt, Pseudomonas putida KT2440
uccagucggcauccucaagcugc

SEQ ID NO: 3581388 - RNA, 11 nt, Pseudomonas putida KT2440
uccagucggcc

SEQ ID NO: 3581389 - RNA, 21 nt, Pseudomonas putida KT2440
uccagucggccugaugccuca

SEQ ID NO: 3581390 - RNA, 18 nt, Pseudomonas putida KT2440
uccagugcuucacugccg

SEQ ID NO: 3581391 - RNA, 15 nt, Pseudomonas putida KT2440
uccaguugcaagccu

SEQ ID NO: 3581392 - RNA, 19 nt, Pseudomonas putida KT2440
uccaguugcuccaccugcc

SEQ ID NO: 3581393 - RNA, 17 nt, Pseudomonas putida KT2440
uccaguuggcagggcac

SEQ ID NO: 3581394 - RNA, 15 nt, Pseudomonas putida KT2440
uccauaccaauggca

SEQ ID NO: 3581395 - RNA, 18 nt, Pseudomonas putida KT2440
uccauacgugcaccggcc

SEQ ID NO: 3581396 - RNA, 16 nt, Pseudomonas putida KT2440
uccauacuuggccgac

SEQ ID NO: 3581397 - RNA, 21 nt, Pseudomonas putida KT2440
uccauacuuggccgacauggc

SEQ ID NO: 3581398 - RNA, 20 nt, Pseudomonas putida KT2440
uccauagguuauccacaccc

SEQ ID NO: 3581399 - RNA, 21 nt, Pseudomonas putida KT2440
uccauagugugcucacgguga

SEQ ID NO: 3581400 - RNA, 22 nt, Pseudomonas putida KT2440
uccaucaccggcgaguccugcc

SEQ ID NO: 3581401 - RNA, 11 nt, Pseudomonas putida KT2440
uccaucaccug

SEQ ID NO: 3581402 - RNA, 13 nt, Pseudomonas putida KT2440
uccaucaccugcc

SEQ ID NO: 3581403 - RNA, 15 nt, Pseudomonas putida KT2440
uccaucaccugccca

SEQ ID NO: 3581404 - RNA, 20 nt, Pseudomonas putida KT2440
uccauccagucggcgcugga

SEQ ID NO: 3581405 - RNA, 16 nt, Pseudomonas putida KT2440
uccaucuccagcucaa

SEQ ID NO: 3581406 - RNA, 17 nt, Pseudomonas putida KT2440
uccaucugcuucuggug

SEQ ID NO: 3581407 - RNA, 15 nt, Pseudomonas putida KT2440
uccaucuucaccuug

SEQ ID NO: 3581408 - RNA, 17 nt, Pseudomonas putida KT2440
uccaucuucaccuugcc

SEQ ID NO: 3581409 - RNA, 14 nt, Pseudomonas putida KT2440
uccaucuugcugcu

SEQ ID NO: 3581410 - RNA, 19 nt, Pseudomonas putida KT2440
uccaucuugcugcucugca

SEQ ID NO: 3581411 - RNA, 15 nt, Pseudomonas putida KT2440
uccaucuugguuggc

SEQ ID NO: 3581412 - RNA, 23 nt, Pseudomonas putida KT2440
uccaugccuagauaagcgacaaa

SEQ ID NO: 3581413 - RNA, 14 nt, Pseudomonas putida KT2440
uccaugcgcgcagc

SEQ ID NO: 3581414 - RNA, 20 nt, Pseudomonas putida KT2440
uccauggcaauuggcuucca

SEQ ID NO: 3581415 - RNA, 17 nt, Pseudomonas putida KT2440
uccauggccagggcaaa

SEQ ID NO: 3581416 - RNA, 21 nt, Pseudomonas putida KT2440
uccauguaggagcggguuuac

SEQ ID NO: 3581417 - RNA, 20 nt, Pseudomonas putida KT2440
uccaugucggaagccugcau

SEQ ID NO: 3581418 - RNA, 16 nt, Pseudomonas putida KT2440
uccaugucgugcugcc

SEQ ID NO: 3581419 - RNA, 17 nt, Pseudomonas putida KT2440
uccauguuacggcccag

SEQ ID NO: 3581420 - RNA, 23 nt, Pseudomonas putida KT2440
uccauguuacggcccaggggcag

SEQ ID NO: 3581421 - RNA, 15 nt, Pseudomonas putida KT2440
uccauguucaccgua

SEQ ID NO: 3581422 - RNA, 21 nt, Pseudomonas putida KT2440
uccauguucaccguacccgcc

SEQ ID NO: 3581423 - RNA, 18 nt, Pseudomonas putida KT2440
uccauucggugcagcggc

SEQ ID NO: 3581424 - RNA, 15 nt, Pseudomonas putida KT2440
uccauugaagguuga

SEQ ID NO: 3581425 - RNA, 17 nt, Pseudomonas putida KT2440
uccauuucacuggcuuc

SEQ ID NO: 3581426 - RNA, 15 nt, Pseudomonas putida KT2440
uccauuugcgcuggc

SEQ ID NO: 3581427 - RNA, 23 nt, Pseudomonas putida KT2440
ucccaaagauaccccugcgccug

SEQ ID NO: 3581428 - RNA, 20 nt, Pseudomonas putida KT2440
ucccaacgcaaauccuccug

SEQ ID NO: 3581429 - RNA, 18 nt, Pseudomonas putida KT2440
ucccaauaauaaaaaaag

SEQ ID NO: 3581430 - RNA, 19 nt, Pseudomonas putida KT2440
ucccacaggaaucaccaga

SEQ ID NO: 3581431 - RNA, 19 nt, Pseudomonas putida KT2440
ucccacagggaccucacag

SEQ ID NO: 3581432 - RNA, 19 nt, Pseudomonas putida KT2440
ucccacagggaucgcgcca

SEQ ID NO: 3581433 - RNA, 20 nt, Pseudomonas putida KT2440
ucccacagguaagucacagg

SEQ ID NO: 3581434 - RNA, 14 nt, Pseudomonas putida KT2440
ucccacagguaaua

SEQ ID NO: 3581435 - RNA, 21 nt, Pseudomonas putida KT2440
ucccacaggugcagcacaggu

SEQ ID NO: 3581436 - RNA, 21 nt, Pseudomonas putida KT2440
ucccacagguuuagcgcuggc

SEQ ID NO: 3581437 - RNA, 19 nt, Pseudomonas putida KT2440
ucccacgaggaccugcguu

SEQ ID NO: 3581438 - RNA, 16 nt, Pseudomonas putida KT2440
ucccacggccgcgcag

SEQ ID NO: 3581439 - RNA, 15 nt, Pseudomonas putida KT2440
ucccagcaccgcgac

SEQ ID NO: 3581440 - RNA, 14 nt, Pseudomonas putida KT2440
ucccagcaggcaca

SEQ ID NO: 3581441 - RNA, 22 nt, Pseudomonas putida KT2440
ucccagcuggcaaugcaacucg

SEQ ID NO: 3581442 - RNA, 23 nt, Pseudomonas putida KT2440
ucccaggcgcuugagcucggcaa

SEQ ID NO: 3581443 - RNA, 21 nt, Pseudomonas putida KT2440
ucccaguugugacuagaggau

SEQ ID NO: 3581444 - RNA, 22 nt, Pseudomonas putida KT2440
ucccaugcugcagaaccgccag

SEQ ID NO: 3581445 - RNA, 18 nt, Pseudomonas putida KT2440
uccccaaccaccucccca

SEQ ID NO: 3581446 - RNA, 14 nt, Pseudomonas putida KT2440
uccccaaucaccag

SEQ ID NO: 3581447 - RNA, 18 nt, Pseudomonas putida KT2440
uccccaccagcaucagcg

SEQ ID NO: 3581448 - RNA, 14 nt, Pseudomonas putida KT2440
uccccaccggcacc

SEQ ID NO: 3581449 - RNA, 15 nt, Pseudomonas putida KT2440
uccccaccggcacca

SEQ ID NO: 3581450 - RNA, 22 nt, Pseudomonas putida KT2440
uccccagcauuggauacugccc

SEQ ID NO: 3581451 - RNA, 16 nt, Pseudomonas putida KT2440
uccccaguucacgcag

SEQ ID NO: 3581452 - RNA, 22 nt, Pseudomonas putida KT2440
uccccaucacgcagcgcggaaa

SEQ ID NO: 3581453 - RNA, 15 nt, Pseudomonas putida KT2440
uccccaucagcagcu

SEQ ID NO: 3581454 - RNA, 16 nt, Pseudomonas putida KT2440
uccccaucagcagcug

SEQ ID NO: 3581455 - RNA, 14 nt, Pseudomonas putida KT2440
ucccccaccggccg

SEQ ID NO: 3581456 - RNA, 16 nt, Pseudomonas putida KT2440
ucccccacuucugccg

SEQ ID NO: 3581457 - RNA, 12 nt, Pseudomonas putida KT2440
ucccccagcccu

SEQ ID NO: 3581458 - RNA, 17 nt, Pseudomonas putida KT2440
ucccccaucaguugcag

SEQ ID NO: 3581459 - RNA, 22 nt, Pseudomonas putida KT2440
ucccccaucggcacccgcacau

SEQ ID NO: 3581460 - RNA, 14 nt, Pseudomonas putida KT2440
ucccccccaaucgc

SEQ ID NO: 3581461 - RNA, 16 nt, Pseudomonas putida KT2440
ucccccggcccagccc

SEQ ID NO: 3581462 - RNA, 14 nt, Pseudomonas putida KT2440
ucccccuccacugu

SEQ ID NO: 3581463 - RNA, 20 nt, Pseudomonas putida KT2440
uccccgaguauccccaccac

SEQ ID NO: 3581464 - RNA, 18 nt, Pseudomonas putida KT2440
uccccgccagugaccgcu

SEQ ID NO: 3581465 - RNA, 18 nt, Pseudomonas putida KT2440
uccccgcccaagcggcag

SEQ ID NO: 3581466 - RNA, 18 nt, Pseudomonas putida KT2440
uccccgccgccagcagcg

SEQ ID NO: 3581467 - RNA, 15 nt, Pseudomonas putida KT2440
uccccgccgugcagu

SEQ ID NO: 3581468 - RNA, 14 nt, Pseudomonas putida KT2440
uccccgcgccgccg

SEQ ID NO: 3581469 - RNA, 21 nt, Pseudomonas putida KT2440
uccccggccuccucgcgggca

SEQ ID NO: 3581470 - RNA, 19 nt, Pseudomonas putida KT2440
uccccggcgacggcgaggu

SEQ ID NO: 3581471 - RNA, 21 nt, Pseudomonas putida KT2440
uccccggcgacggcgagguga

SEQ ID NO: 3581472 - RNA, 23 nt, Pseudomonas putida KT2440
uccccggcgacggcgaggugauu

SEQ ID NO: 3581473 - RNA, 18 nt, Pseudomonas putida KT2440
uccccgguaaugcuggug

SEQ ID NO: 3581474 - RNA, 17 nt, Pseudomonas putida KT2440
uccccguugguguccuu

SEQ ID NO: 3581475 - RNA, 13 nt, Pseudomonas putida KT2440
uccccucagacag

SEQ ID NO: 3581476 - RNA, 13 nt, Pseudomonas putida KT2440
uccccuuggcccu

SEQ ID NO: 3581477 - RNA, 16 nt, Pseudomonas putida KT2440
ucccgaggucagcagu

SEQ ID NO: 3581478 - RNA, 16 nt, Pseudomonas putida KT2440
ucccgcaagccagccu

SEQ ID NO: 3581479 - RNA, 19 nt, Pseudomonas putida KT2440
ucccgcaagccagccuccg

SEQ ID NO: 3581480 - RNA, 19 nt, Pseudomonas putida KT2440
ucccgcauuggguggcccc

SEQ ID NO: 3581481 - RNA, 16 nt, Pseudomonas putida KT2440
ucccgccauguugcgc

SEQ ID NO: 3581482 - RNA, 15 nt, Pseudomonas putida KT2440
ucccgcccuccagcc

SEQ ID NO: 3581483 - RNA, 19 nt, Pseudomonas putida KT2440
ucccgcccugagccaaggc

SEQ ID NO: 3581484 - RNA, 22 nt, Pseudomonas putida KT2440
ucccgcccugagccaaggccgc

SEQ ID NO: 3581485 - RNA, 20 nt, Pseudomonas putida KT2440
ucccgccgagcauccgcgcc

SEQ ID NO: 3581486 - RNA, 15 nt, Pseudomonas putida KT2440
ucccgccgccagacc

SEQ ID NO: 3581487 - RNA, 15 nt, Pseudomonas putida KT2440
ucccgcgcauccucc

SEQ ID NO: 3581488 - RNA, 17 nt, Pseudomonas putida KT2440
ucccgcgcaugcugcca

SEQ ID NO: 3581489 - RNA, 17 nt, Pseudomonas putida KT2440
ucccgcguccagggcag

SEQ ID NO: 3581490 - RNA, 22 nt, Pseudomonas putida KT2440
ucccgcuacgagagaucgcagc

SEQ ID NO: 3581491 - RNA, 17 nt, Pseudomonas putida KT2440
ucccgcuucgccagcgc

SEQ ID NO: 3581492 - RNA, 18 nt, Pseudomonas putida KT2440
ucccgcuucgccagcgcc

SEQ ID NO: 3581493 - RNA, 17 nt, Pseudomonas putida KT2440
ucccggcagaagcgcug

SEQ ID NO: 3581494 - RNA, 18 nt, Pseudomonas putida KT2440
ucccggccagcgacccug

SEQ ID NO: 3581495 - RNA, 16 nt, Pseudomonas putida KT2440
ucccggcgccaugccc

SEQ ID NO: 3581496 - RNA, 20 nt, Pseudomonas putida KT2440
ucccgguaacgggccagccg

SEQ ID NO: 3581497 - RNA, 15 nt, Pseudomonas putida KT2440
ucccggucaccugca

SEQ ID NO: 3581498 - RNA, 23 nt, Pseudomonas putida KT2440
ucccggugcuggcugaucagcau

SEQ ID NO: 3581499 - RNA, 21 nt, Pseudomonas putida KT2440
ucccguucgcggucggucagc

SEQ ID NO: 3581500 - RNA, 23 nt, Pseudomonas putida KT2440
ucccuaacggggggcucagcccg

SEQ ID NO: 3581501 - RNA, 15 nt, Pseudomonas putida KT2440
ucccuccugugcccg

SEQ ID NO: 3581502 - RNA, 18 nt, Pseudomonas putida KT2440
ucccucugccugcccauu

SEQ ID NO: 3581503 - RNA, 21 nt, Pseudomonas putida KT2440
ucccugagcuucaaucaugaa

SEQ ID NO: 3581504 - RNA, 17 nt, Pseudomonas putida KT2440
ucccugcccccaaagcc

SEQ ID NO: 3581505 - RNA, 20 nt, Pseudomonas putida KT2440
ucccugcccgaucgccucgc

SEQ ID NO: 3581506 - RNA, 14 nt, Pseudomonas putida KT2440
ucccuguaggagcg

SEQ ID NO: 3581507 - RNA, 19 nt, Pseudomonas putida KT2440
ucccuguaggcgcaacuca

SEQ ID NO: 3581508 - RNA, 19 nt, Pseudomonas putida KT2440
ucccugugggagcgggcuu

SEQ ID NO: 3581509 - RNA, 20 nt, Pseudomonas putida KT2440
ucccugugggagcgggcuug

SEQ ID NO: 3581510 - RNA, 21 nt, Pseudomonas putida KT2440
uccgaacuccccaccaggcaa

SEQ ID NO: 3581511 - RNA, 20 nt, Pseudomonas putida KT2440
uccgacagcuugcccagcug

SEQ ID NO: 3581512 - RNA, 21 nt, Pseudomonas putida KT2440
uccgaccggucauacauccag

SEQ ID NO: 3581513 - RNA, 19 nt, Pseudomonas putida KT2440
uccgaggucagcaccagcu

SEQ ID NO: 3581514 - RNA, 15 nt, Pseudomonas putida KT2440
uccgauacgccgccc

SEQ ID NO: 3581515 - RNA, 20 nt, Pseudomonas putida KT2440
uccgauccgguggccuugcc

SEQ ID NO: 3581516 - RNA, 14 nt, Pseudomonas putida KT2440
uccgcaaaucccug

SEQ ID NO: 3581517 - RNA, 20 nt, Pseudomonas putida KT2440
uccgcaaauucucgagcuga

SEQ ID NO: 3581518 - RNA, 21 nt, Pseudomonas putida KT2440
uccgcacacgcuccagguagu

SEQ ID NO: 3581519 - RNA, 14 nt, Pseudomonas putida KT2440
uccgcaccgggcaa

SEQ ID NO: 3581520 - RNA, 19 nt, Pseudomonas putida KT2440
uccgcaccgggcaaaaaag

SEQ ID NO: 3581521 - RNA, 14 nt, Pseudomonas putida KT2440
uccgcaugcuuggc

SEQ ID NO: 3581522 - RNA, 16 nt, Pseudomonas putida KT2440
uccgccaacaccaccu

SEQ ID NO: 3581523 - RNA, 17 nt, Pseudomonas putida KT2440
uccgccaacaccaccuc

SEQ ID NO: 3581524 - RNA, 15 nt, Pseudomonas putida KT2440
uccgccaagcacgca

SEQ ID NO: 3581525 - RNA, 21 nt, Pseudomonas putida KT2440
uccgccaagguaaucuggcug

SEQ ID NO: 3581526 - RNA, 18 nt, Pseudomonas putida KT2440
uccgccacaacccuugca

SEQ ID NO: 3581527 - RNA, 13 nt, Pseudomonas putida KT2440
uccgccaccagau

SEQ ID NO: 3581528 - RNA, 18 nt, Pseudomonas putida KT2440
uccgccccaaaccaggcc

SEQ ID NO: 3581529 - RNA, 17 nt, Pseudomonas putida KT2440
uccgccccauagccugc

SEQ ID NO: 3581530 - RNA, 20 nt, Pseudomonas putida KT2440
uccgccccauagccugcugc

SEQ ID NO: 3581531 - RNA, 21 nt, Pseudomonas putida KT2440
uccgccccauagccugcugcu

SEQ ID NO: 3581532 - RNA, 22 nt, Pseudomonas putida KT2440
uccgccccuacgcugguucuga

SEQ ID NO: 3581533 - RNA, 19 nt, Pseudomonas putida KT2440
uccgcccgguaauagcggc

SEQ ID NO: 3581534 - RNA, 18 nt, Pseudomonas putida KT2440
uccgcccuugccaccagu

SEQ ID NO: 3581535 - RNA, 22 nt, Pseudomonas putida KT2440
uccgcccuugccaccagugccg

SEQ ID NO: 3581536 - RNA, 13 nt, Pseudomonas putida KT2440
uccgccgggaugg

SEQ ID NO: 3581537 - RNA, 12 nt, Pseudomonas putida KT2440
uccgccgucacc

SEQ ID NO: 3581538 - RNA, 16 nt, Pseudomonas putida KT2440
uccgccgucaccgccg

SEQ ID NO: 3581539 - RNA, 15 nt, Pseudomonas putida KT2440
uccgccuaccgcguc

SEQ ID NO: 3581540 - RNA, 13 nt, Pseudomonas putida KT2440
uccgccucauccu

SEQ ID NO: 3581541 - RNA, 13 nt, Pseudomonas putida KT2440
uccgccucgucga

SEQ ID NO: 3581542 - RNA, 13 nt, Pseudomonas putida KT2440
uccgccuggcccg

SEQ ID NO: 3581543 - RNA, 15 nt, Pseudomonas putida KT2440
uccgccuggccgcug

SEQ ID NO: 3581544 - RNA, 21 nt, Pseudomonas putida KT2440
uccgccuggccgcugcgcccg

SEQ ID NO: 3581545 - RNA, 14 nt, Pseudomonas putida KT2440
uccgcgagggcauc

SEQ ID NO: 3581546 - RNA, 16 nt, Pseudomonas putida KT2440
uccgcgcaagcgguug

SEQ ID NO: 3581547 - RNA, 23 nt, Pseudomonas putida KT2440
uccgcgcaagcgguugcccgcug

SEQ ID NO: 3581548 - RNA, 22 nt, Pseudomonas putida KT2440
uccgcgccagcggccagcgccu

SEQ ID NO: 3581549 - RNA, 16 nt, Pseudomonas putida KT2440
uccgcgccaucagcug

SEQ ID NO: 3581550 - RNA, 18 nt, Pseudomonas putida KT2440
uccgcgccgaucacaccg

SEQ ID NO: 3581551 - RNA, 15 nt, Pseudomonas putida KT2440
uccgcguccccuuca

SEQ ID NO: 3581552 - RNA, 16 nt, Pseudomonas putida KT2440
uccgcucauuggaaaa

SEQ ID NO: 3581553 - RNA, 13 nt, Pseudomonas putida KT2440
uccgcuggaaugg

SEQ ID NO: 3581554 - RNA, 23 nt, Pseudomonas putida KT2440
uccgcuugacgaucgccagcccc

SEQ ID NO: 3581555 - RNA, 21 nt, Pseudomonas putida KT2440
uccggaauccgcacacgcucc

SEQ ID NO: 3581556 - RNA, 15 nt, Pseudomonas putida KT2440
uccggcaacuggcac

SEQ ID NO: 3581557 - RNA, 17 nt, Pseudomonas putida KT2440
uccggcaaucugcccac

SEQ ID NO: 3581558 - RNA, 22 nt, Pseudomonas putida KT2440
uccggcaccccuuucuccagca

SEQ ID NO: 3581559 - RNA, 18 nt, Pseudomonas putida KT2440
uccggcacuccagcgagu

SEQ ID NO: 3581560 - RNA, 21 nt, Pseudomonas putida KT2440
uccggcagggugaaguugauc

SEQ ID NO: 3581561 - RNA, 19 nt, Pseudomonas putida KT2440
uccggcaugugcacuggca

SEQ ID NO: 3581562 - RNA, 13 nt, Pseudomonas putida KT2440
uccggccagcaac

SEQ ID NO: 3581563 - RNA, 15 nt, Pseudomonas putida KT2440
uccggcccaucccgc

SEQ ID NO: 3581564 - RNA, 18 nt, Pseudomonas putida KT2440
uccggccccggugcaucc

SEQ ID NO: 3581565 - RNA, 19 nt, Pseudomonas putida KT2440
uccggcccuuucgcgggua

SEQ ID NO: 3581566 - RNA, 16 nt, Pseudomonas putida KT2440
uccggccgacucuuca

SEQ ID NO: 3581567 - RNA, 13 nt, Pseudomonas putida KT2440
uccggcgcggccu

SEQ ID NO: 3581568 - RNA, 18 nt, Pseudomonas putida KT2440
uccggcgcggccugcucc

SEQ ID NO: 3581569 - RNA, 13 nt, Pseudomonas putida KT2440
uccggcgcuuugc

SEQ ID NO: 3581570 - RNA, 17 nt, Pseudomonas putida KT2440
uccggcgcuuugcgcaa

SEQ ID NO: 3581571 - RNA, 16 nt, Pseudomonas putida KT2440
uccggcguguccagca

SEQ ID NO: 3581572 - RNA, 15 nt, Pseudomonas putida KT2440
uccggcuccuugaug

SEQ ID NO: 3581573 - RNA, 22 nt, Pseudomonas putida KT2440
uccgggcgguacuggaagagca

SEQ ID NO: 3581574 - RNA, 11 nt, Pseudomonas putida KT2440
uccgggcugcu

SEQ ID NO: 3581575 - RNA, 21 nt, Pseudomonas putida KT2440
uccggguuaccgcacagcauc

SEQ ID NO: 3581576 - RNA, 16 nt, Pseudomonas putida KT2440
uccgguaacuggccca

SEQ ID NO: 3581577 - RNA, 23 nt, Pseudomonas putida KT2440
uccgguauauaucucgggcuucc

SEQ ID NO: 3581578 - RNA, 17 nt, Pseudomonas putida KT2440
uccgguggcaucaccgg

SEQ ID NO: 3581579 - RNA, 15 nt, Pseudomonas putida KT2440
uccguaccaguuccu

SEQ ID NO: 3581580 - RNA, 19 nt, Pseudomonas putida KT2440
uccguagugaaugcuguug

SEQ ID NO: 3581581 - RNA, 18 nt, Pseudomonas putida KT2440
uccgucgccggccggcuc

SEQ ID NO: 3581582 - RNA, 16 nt, Pseudomonas putida KT2440
uccgugcaccgcucag

SEQ ID NO: 3581583 - RNA, 17 nt, Pseudomonas putida KT2440
uccguggguugaucucu

SEQ ID NO: 3581584 - RNA, 16 nt, Pseudomonas putida KT2440
uccguucggcgcgcug

SEQ ID NO: 3581585 - RNA, 22 nt, Pseudomonas putida KT2440
uccguuggccaccaccagcaac

SEQ ID NO: 3581586 - RNA, 14 nt, Pseudomonas putida KT2440
uccuacaaagcggc

SEQ ID NO: 3581587 - RNA, 15 nt, Pseudomonas putida KT2440
uccuacaaagcggcg

SEQ ID NO: 3581588 - RNA, 14 nt, Pseudomonas putida KT2440
uccuacaacgaucu

SEQ ID NO: 3581589 - RNA, 14 nt, Pseudomonas putida KT2440
uccuacaagguacc

SEQ ID NO: 3581590 - RNA, 13 nt, Pseudomonas putida KT2440
uccuacacgaccc

SEQ ID NO: 3581591 - RNA, 18 nt, Pseudomonas putida KT2440
uccuacacgacccaccau

SEQ ID NO: 3581592 - RNA, 21 nt, Pseudomonas putida KT2440
uccuacauggaucgcauugcc

SEQ ID NO: 3581593 - RNA, 15 nt, Pseudomonas putida KT2440
uccuacgacggccug

SEQ ID NO: 3581594 - RNA, 19 nt, Pseudomonas putida KT2440
uccuacgacggucugcgua

SEQ ID NO: 3581595 - RNA, 19 nt, Pseudomonas putida KT2440
uccuacgcaggcaccgcac

SEQ ID NO: 3581596 - RNA, 12 nt, Pseudomonas putida KT2440
uccuacgcgcca

SEQ ID NO: 3581597 - RNA, 13 nt, Pseudomonas putida KT2440
uccuacgggcaac

SEQ ID NO: 3581598 - RNA, 16 nt, Pseudomonas putida KT2440
uccuacgggcaaccgc

SEQ ID NO: 3581599 - RNA, 21 nt, Pseudomonas putida KT2440
uccuacggggguucacagccg

SEQ ID NO: 3581600 - RNA, 14 nt, Pseudomonas putida KT2440
uccuagguaguaaa

SEQ ID NO: 3581601 - RNA, 18 nt, Pseudomonas putida KT2440
uccuauguuguguuaagu

SEQ ID NO: 3581602 - RNA, 13 nt, Pseudomonas putida KT2440
uccucaucgaugc

SEQ ID NO: 3581603 - RNA, 19 nt, Pseudomonas putida KT2440
uccucaugggugucggcau

SEQ ID NO: 3581604 - RNA, 13 nt, Pseudomonas putida KT2440
uccuccccuuccc

SEQ ID NO: 3581605 - RNA, 17 nt, Pseudomonas putida KT2440
uccuccccuucccgcca

SEQ ID NO: 3581606 - RNA, 15 nt, Pseudomonas putida KT2440
uccucgacccaguca

SEQ ID NO: 3581607 - RNA, 20 nt, Pseudomonas putida KT2440
uccucgacgccauauacgca

SEQ ID NO: 3581608 - RNA, 16 nt, Pseudomonas putida KT2440
uccucgaucaccugcg

SEQ ID NO: 3581609 - RNA, 13 nt, Pseudomonas putida KT2440
uccucgcgggcaa

SEQ ID NO: 3581610 - RNA, 14 nt, Pseudomonas putida KT2440
uccucgcgggcaaa

SEQ ID NO: 3581611 - RNA, 18 nt, Pseudomonas putida KT2440
uccucggcagaaauguuu

SEQ ID NO: 3581612 - RNA, 16 nt, Pseudomonas putida KT2440
uccucggccagcggcc

SEQ ID NO: 3581613 - RNA, 13 nt, Pseudomonas putida KT2440
uccucggccaugc

SEQ ID NO: 3581614 - RNA, 19 nt, Pseudomonas putida KT2440
uccucggccguaaaguccg

SEQ ID NO: 3581615 - RNA, 13 nt, Pseudomonas putida KT2440
uccucguccagcu

SEQ ID NO: 3581616 - RNA, 12 nt, Pseudomonas putida KT2440
uccucgugaccg

SEQ ID NO: 3581617 - RNA, 20 nt, Pseudomonas putida KT2440
uccucugcccgcagcuucaa

SEQ ID NO: 3581618 - RNA, 18 nt, Pseudomonas putida KT2440
uccucugugggagcggcc

SEQ ID NO: 3581619 - RNA, 21 nt, Pseudomonas putida KT2440
uccucugugggagcggccuug

SEQ ID NO: 3581620 - RNA, 21 nt, Pseudomonas putida KT2440
uccucuucaaggcccaguucg

SEQ ID NO: 3581621 - RNA, 22 nt, Pseudomonas putida KT2440
uccugaaccaccaguggguuau

SEQ ID NO: 3581622 - RNA, 21 nt, Pseudomonas putida KT2440
uccugaacgaugcccgggccu

SEQ ID NO: 3581623 - RNA, 19 nt, Pseudomonas putida KT2440
uccugaacggugaagucaa

SEQ ID NO: 3581624 - RNA, 14 nt, Pseudomonas putida KT2440
uccugaccaacuuu

SEQ ID NO: 3581625 - RNA, 22 nt, Pseudomonas putida KT2440
uccugaguuagacauuagaaaa

SEQ ID NO: 3581626 - RNA, 13 nt, Pseudomonas putida KT2440
uccugcaaaggcc

SEQ ID NO: 3581627 - RNA, 15 nt, Pseudomonas putida KT2440
uccugcaacccguca

SEQ ID NO: 3581628 - RNA, 18 nt, Pseudomonas putida KT2440
uccugcaacucggccuug

SEQ ID NO: 3581629 - RNA, 19 nt, Pseudomonas putida KT2440
uccugcaaggcaaugccca

SEQ ID NO: 3581630 - RNA, 22 nt, Pseudomonas putida KT2440
uccugcacaacccuaucagggc

SEQ ID NO: 3581631 - RNA, 12 nt, Pseudomonas putida KT2440
uccugcaccaca

SEQ ID NO: 3581632 - RNA, 17 nt, Pseudomonas putida KT2440
uccugcaccuuguuacc

SEQ ID NO: 3581633 - RNA, 21 nt, Pseudomonas putida KT2440
uccugcaccuuguuacccgca

SEQ ID NO: 3581634 - RNA, 13 nt, Pseudomonas putida KT2440
uccugcagcacca

SEQ ID NO: 3581635 - RNA, 14 nt, Pseudomonas putida KT2440
uccugcagcaccag

SEQ ID NO: 3581636 - RNA, 15 nt, Pseudomonas putida KT2440
uccugcagcaccagc

SEQ ID NO: 3581637 - RNA, 16 nt, Pseudomonas putida KT2440
uccugcagcaccagcu

SEQ ID NO: 3581638 - RNA, 13 nt, Pseudomonas putida KT2440
uccugcagcggca

SEQ ID NO: 3581639 - RNA, 12 nt, Pseudomonas putida KT2440
uccugcagggcg

SEQ ID NO: 3581640 - RNA, 21 nt, Pseudomonas putida KT2440
uccugcagggcgagcacaccc

SEQ ID NO: 3581641 - RNA, 16 nt, Pseudomonas putida KT2440
uccugcauacgcaucg

SEQ ID NO: 3581642 - RNA, 20 nt, Pseudomonas putida KT2440
uccugcggcagauccugcag

SEQ ID NO: 3581643 - RNA, 14 nt, Pseudomonas putida KT2440
uccugcguacccag

SEQ ID NO: 3581644 - RNA, 17 nt, Pseudomonas putida KT2440
uccugcguacccagccc

SEQ ID NO: 3581645 - RNA, 16 nt, Pseudomonas putida KT2440
uccugcgugcugugca

SEQ ID NO: 3581646 - RNA, 19 nt, Pseudomonas putida KT2440
uccugcgugcugugcacug

SEQ ID NO: 3581647 - RNA, 10 nt, Pseudomonas putida KT2440
uccugcucuc

SEQ ID NO: 3581648 - RNA, 14 nt, Pseudomonas putida KT2440
uccugcugcaacaa

SEQ ID NO: 3581649 - RNA, 16 nt, Pseudomonas putida KT2440
uccugcugcaggcucu

SEQ ID NO: 3581650 - RNA, 23 nt, Pseudomonas putida KT2440
uccuggaaaagcaaggcucaggc

SEQ ID NO: 3581651 - RNA, 20 nt, Pseudomonas putida KT2440
uccuggaacgugcgggcuug

SEQ ID NO: 3581652 - RNA, 15 nt, Pseudomonas putida KT2440
uccuggaucagccgc

SEQ ID NO: 3581653 - RNA, 21 nt, Pseudomonas putida KT2440
uccuggcacucucgcggugcc

SEQ ID NO: 3581654 - RNA, 18 nt, Pseudomonas putida KT2440
uccuggcccgcgcccuug

SEQ ID NO: 3581655 - RNA, 22 nt, Pseudomonas putida KT2440
uccuggccgcccgccucgacaa

SEQ ID NO: 3581656 - RNA, 15 nt, Pseudomonas putida KT2440
uccuggcgcuccucc

SEQ ID NO: 3581657 - RNA, 23 nt, Pseudomonas putida KT2440
uccugggggcguaaagcgcccca

SEQ ID NO: 3581658 - RNA, 20 nt, Pseudomonas putida KT2440
uccuggguaacccgcuaacg

SEQ ID NO: 3581659 - RNA, 20 nt, Pseudomonas putida KT2440
uccuggguaaucaguaccag

SEQ ID NO: 3581660 - RNA, 19 nt, Pseudomonas putida KT2440
uccugggugaccaccagca

SEQ ID NO: 3581661 - RNA, 17 nt, Pseudomonas putida KT2440
uccuggucaucgaagcc

SEQ ID NO: 3581662 - RNA, 18 nt, Pseudomonas putida KT2440
uccugguccgaggucagc

SEQ ID NO: 3581663 - RNA, 16 nt, Pseudomonas putida KT2440
uccugguuauccaggu

SEQ ID NO: 3581664 - RNA, 15 nt, Pseudomonas putida KT2440
uccugguuggccagu

SEQ ID NO: 3581665 - RNA, 19 nt, Pseudomonas putida KT2440
uccugugggagcggccuug

SEQ ID NO: 3581666 - RNA, 18 nt, Pseudomonas putida KT2440
uccugugggagcgggcgu

SEQ ID NO: 3581667 - RNA, 17 nt, Pseudomonas putida KT2440
uccugugggagcgggcu

SEQ ID NO: 3581668 - RNA, 18 nt, Pseudomonas putida KT2440
uccugugggagcgggcuu

SEQ ID NO: 3581669 - RNA, 21 nt, Pseudomonas putida KT2440
uccuucaucugucagcgccag

SEQ ID NO: 3581670 - RNA, 22 nt, Pseudomonas putida KT2440
uccuucugcgucgacucuuccc

SEQ ID NO: 3581671 - RNA, 23 nt, Pseudomonas putida KT2440
uccuucuuugaaaguggccaagc

SEQ ID NO: 3581672 - RNA, 13 nt, Pseudomonas putida KT2440
uccuugaaauuca

SEQ ID NO: 3581673 - RNA, 17 nt, Pseudomonas putida KT2440
uccuugaagaacaccug

SEQ ID NO: 3581674 - RNA, 19 nt, Pseudomonas putida KT2440
uccuugaagaacaccugca

SEQ ID NO: 3581675 - RNA, 21 nt, Pseudomonas putida KT2440
uccuugaaguaguccccauca

SEQ ID NO: 3581676 - RNA, 21 nt, Pseudomonas putida KT2440
uccuugacggggcacaacccg

SEQ ID NO: 3581677 - RNA, 15 nt, Pseudomonas putida KT2440
uccuugcacuccccc

SEQ ID NO: 3581678 - RNA, 21 nt, Pseudomonas putida KT2440
uccuugcagcgccgcauccag

SEQ ID NO: 3581679 - RNA, 14 nt, Pseudomonas putida KT2440
uccuugcagggcac

SEQ ID NO: 3581680 - RNA, 21 nt, Pseudomonas putida KT2440
uccuugcccucgcccacucac

SEQ ID NO: 3581681 - RNA, 19 nt, Pseudomonas putida KT2440
uccuugccguccaggucca

SEQ ID NO: 3581682 - RNA, 18 nt, Pseudomonas putida KT2440
uccuugcguugcaacaag

SEQ ID NO: 3581683 - RNA, 15 nt, Pseudomonas putida KT2440
uccuugcuggccacc

SEQ ID NO: 3581684 - RNA, 19 nt, Pseudomonas putida KT2440
uccuugcugguguaggaca

SEQ ID NO: 3581685 - RNA, 19 nt, Pseudomonas putida KT2440
uccuugcuguugcugcagu

SEQ ID NO: 3581686 - RNA, 20 nt, Pseudomonas putida KT2440
uccuuggacagcaauuccaa

SEQ ID NO: 3581687 - RNA, 21 nt, Pseudomonas putida KT2440
uccuuggcgaaggcugccugg

SEQ ID NO: 3581688 - RNA, 19 nt, Pseudomonas putida KT2440
uccuuguagauauugacca

SEQ ID NO: 3581689 - RNA, 20 nt, Pseudomonas putida KT2440
uccuuguugaccccgggcac

SEQ ID NO: 3581690 - RNA, 24 nt, Pseudomonas putida KT2440
ucgaaaacgauaucgacuucggcc

SEQ ID NO: 3581691 - RNA, 13 nt, Pseudomonas putida KT2440
ucgaaaccaucaa

SEQ ID NO: 3581692 - RNA, 15 nt, Pseudomonas putida KT2440
ucgaaaccaucaauc

SEQ ID NO: 3581693 - RNA, 19 nt, Pseudomonas putida KT2440
ucgaaaccaucaaucaacu

SEQ ID NO: 3581694 - RNA, 12 nt, Pseudomonas putida KT2440
ucgaaaccggcc

SEQ ID NO: 3581695 - RNA, 19 nt, Pseudomonas putida KT2440
ucgaaaggcgacuccugaa

SEQ ID NO: 3581696 - RNA, 18 nt, Pseudomonas putida KT2440
ucgaacaacggcagcgac

SEQ ID NO: 3581697 - RNA, 14 nt, Pseudomonas putida KT2440
ucgaacaacugucc

SEQ ID NO: 3581698 - RNA, 16 nt, Pseudomonas putida KT2440
ucgaacaacuguccug

SEQ ID NO: 3581699 - RNA, 17 nt, Pseudomonas putida KT2440
ucgaacaauucuuccag

SEQ ID NO: 3581700 - RNA, 23 nt, Pseudomonas putida KT2440
ucgaacacggcguggugcugcau

SEQ ID NO: 3581701 - RNA, 11 nt, Pseudomonas putida KT2440
ucgaacagcug

SEQ ID NO: 3581702 - RNA, 14 nt, Pseudomonas putida KT2440
ucgaacauggccac

SEQ ID NO: 3581703 - RNA, 19 nt, Pseudomonas putida KT2440
ucgaacauuuccagcauga

SEQ ID NO: 3581704 - RNA, 19 nt, Pseudomonas putida KT2440
ucgaaccaaggugcuaccg

SEQ ID NO: 3581705 - RNA, 14 nt, Pseudomonas putida KT2440
ucgaaccagcagca

SEQ ID NO: 3581706 - RNA, 13 nt, Pseudomonas putida KT2440
ucgaaccugcccg

SEQ ID NO: 3581707 - RNA, 16 nt, Pseudomonas putida KT2440
ucgaacgcugccugca

SEQ ID NO: 3581708 - RNA, 14 nt, Pseudomonas putida KT2440
ucgaacgcugugcc

SEQ ID NO: 3581709 - RNA, 13 nt, Pseudomonas putida KT2440
ucgaacuccugca

SEQ ID NO: 3581710 - RNA, 19 nt, Pseudomonas putida KT2440
ucgaacugaugaccggccu

SEQ ID NO: 3581711 - RNA, 16 nt, Pseudomonas putida KT2440
ucgaagauauccgccu

SEQ ID NO: 3581712 - RNA, 23 nt, Pseudomonas putida KT2440
ucgaagaucagcucaugggcuuc

SEQ ID NO: 3581713 - RNA, 20 nt, Pseudomonas putida KT2440
ucgaagcgcaccucggccag

SEQ ID NO: 3581714 - RNA, 20 nt, Pseudomonas putida KT2440
ucgaaggucaggcgcgugcc

SEQ ID NO: 3581715 - RNA, 15 nt, Pseudomonas putida KT2440
ucgaaguagcgcucu

SEQ ID NO: 3581716 - RNA, 15 nt, Pseudomonas putida KT2440
ucgaaguaggcauuc

SEQ ID NO: 3581717 - RNA, 21 nt, Pseudomonas putida KT2440
ucgaauacaccgccgcauucg

SEQ ID NO: 3581718 - RNA, 18 nt, Pseudomonas putida KT2440
ucgaaucaagccugcgca

SEQ ID NO: 3581719 - RNA, 13 nt, Pseudomonas putida KT2440
ucgaauccccuua

SEQ ID NO: 3581720 - RNA, 22 nt, Pseudomonas putida KT2440
ucgaauucagcccgcucauguc

SEQ ID NO: 3581721 - RNA, 19 nt, Pseudomonas putida KT2440
ucgacaaagcucaaaugcu

SEQ ID NO: 3581722 - RNA, 19 nt, Pseudomonas putida KT2440
ucgacaaccccagcccgaa

SEQ ID NO: 3581723 - RNA, 18 nt, Pseudomonas putida KT2440
ucgacagugaauuccuug

SEQ ID NO: 3581724 - RNA, 21 nt, Pseudomonas putida KT2440
ucgauguaggcagcugccuug

SEQ ID NO: 3581725 - RNA, 22 nt, Pseudomonas putida KT2440
ucgauguaggcagcugccuugg

SEQ ID NO: 3581726 - RNA, 17 nt, Pseudomonas putida KT2440
ucgauguccaggccgaa

SEQ ID NO: 3581727 - RNA, 18 nt, Pseudomonas putida KT2440
ucgaugucgguggcaacc

SEQ ID NO: 3581728 - RNA, 16 nt, Pseudomonas putida KT2440
ucgaugucuuucgcgu

SEQ ID NO: 3581729 - RNA, 23 nt, Pseudomonas putida KT2440
ucgauuacaaacggcuuggcugc

SEQ ID NO: 3581730 - RNA, 13 nt, Pseudomonas putida KT2440
ucgauuagcucca

SEQ ID NO: 3581731 - RNA, 19 nt, Pseudomonas putida KT2440
ucgauuagcuccaccagcg

SEQ ID NO: 3581732 - RNA, 12 nt, Pseudomonas putida KT2440
ucgauucaggcc

SEQ ID NO: 3581733 - RNA, 16 nt, Pseudomonas putida KT2440
ucgauuuccaccggcu

SEQ ID NO: 3581734 - RNA, 15 nt, Pseudomonas putida KT2440
ucgauuuccagugcc

SEQ ID NO: 3581735 - RNA, 19 nt, Pseudomonas putida KT2440
ucgauuucgccaucgcccg

SEQ ID NO: 3581736 - RNA, 15 nt, Pseudomonas putida KT2440
ucgcaauugaugcaa

SEQ ID NO: 3581737 - RNA, 12 nt, Pseudomonas putida KT2440
ucgcacacccug

SEQ ID NO: 3581738 - RNA, 16 nt, Pseudomonas putida KT2440
ucgcacaggcggaugu

SEQ ID NO: 3581739 - RNA, 21 nt, Pseudomonas putida KT2440
ucgcacagguccagccgccau

SEQ ID NO: 3581740 - RNA, 20 nt, Pseudomonas putida KT2440
ucgcaccacguccggccagc

SEQ ID NO: 3581741 - RNA, 21 nt, Pseudomonas putida KT2440
ucgcaccacguccggccagca

SEQ ID NO: 3581742 - RNA, 12 nt, Pseudomonas putida KT2440
ucgcacucggca

SEQ ID NO: 3581743 - RNA, 21 nt, Pseudomonas putida KT2440
ucgcagacuucgaagugccac

SEQ ID NO: 3581744 - RNA, 23 nt, Pseudomonas putida KT2440
ucgcagagggccgcgcaggcggc

SEQ ID NO: 3581745 - RNA, 16 nt, Pseudomonas putida KT2440
ucgcagauuuugucau

SEQ ID NO: 3581746 - RNA, 12 nt, Pseudomonas putida KT2440
ucgcagcacaag

SEQ ID NO: 3581747 - RNA, 14 nt, Pseudomonas putida KT2440
ucgcaggcacgccc

SEQ ID NO: 3581748 - RNA, 18 nt, Pseudomonas putida KT2440
ucgcagguaaucggccug

SEQ ID NO: 3581749 - RNA, 11 nt, Pseudomonas putida KT2440
ucgcagguucg

SEQ ID NO: 3581750 - RNA, 22 nt, Pseudomonas putida KT2440
ucgcagguucgaauccugcuga

SEQ ID NO: 3581751 - RNA, 14 nt, Pseudomonas putida KT2440
ucgcauacagcgca

SEQ ID NO: 3581752 - RNA, 15 nt, Pseudomonas putida KT2440
ucgcauacagcgcac

SEQ ID NO: 3581753 - RNA, 19 nt, Pseudomonas putida KT2440
ucgcauuaccagcaccauc

SEQ ID NO: 3581754 - RNA, 13 nt, Pseudomonas putida KT2440
ucgcauuucuagc

SEQ ID NO: 3581755 - RNA, 20 nt, Pseudomonas putida KT2440
ucgccaaauucgaccagcag

SEQ ID NO: 3581756 - RNA, 21 nt, Pseudomonas putida KT2440
ucgccaaauucgaccagcagu

SEQ ID NO: 3581757 - RNA, 14 nt, Pseudomonas putida KT2440
ucgccaaccccacg

SEQ ID NO: 3581758 - RNA, 15 nt, Pseudomonas putida KT2440
ucgccaaggccucga

SEQ ID NO: 3581759 - RNA, 16 nt, Pseudomonas putida KT2440
ucgccaagguccagcc

SEQ ID NO: 3581760 - RNA, 19 nt, Pseudomonas putida KT2440
ucgccaaucucguugcgcc

SEQ ID NO: 3581761 - RNA, 24 nt, Pseudomonas putida KT2440
ucgccaaucucguugcgccaggca

SEQ ID NO: 3581762 - RNA, 20 nt, Pseudomonas putida KT2440
ucgccacaacccaucacggc

SEQ ID NO: 3581763 - RNA, 16 nt, Pseudomonas putida KT2440
ucgccacaccacagcu

SEQ ID NO: 3581764 - RNA, 22 nt, Pseudomonas putida KT2440
ucgccacaccacagcugcacau

SEQ ID NO: 3581765 - RNA, 21 nt, Pseudomonas putida KT2440
ucgccacauaguaggcaaugc

SEQ ID NO: 3581766 - RNA, 21 nt, Pseudomonas putida KT2440
ucgccacccgacgccaccuuc

SEQ ID NO: 3581767 - RNA, 14 nt, Pseudomonas putida KT2440
ucgccacgaacagg

SEQ ID NO: 3581768 - RNA, 23 nt, Pseudomonas putida KT2440
ucgccacgguacgggcaaagccc

SEQ ID NO: 3581769 - RNA, 16 nt, Pseudomonas putida KT2440
ucgccacuggcgacuu

SEQ ID NO: 3581770 - RNA, 23 nt, Pseudomonas putida KT2440
ucgccacuggcgacuucggcgau

SEQ ID NO: 3581771 - RNA, 12 nt, Pseudomonas putida KT2440
ucgccagcacca

SEQ ID NO: 3581772 - RNA, 14 nt, Pseudomonas putida KT2440
ucgccagcaccauc

SEQ ID NO: 3581773 - RNA, 23 nt, Pseudomonas putida KT2440
ucgccagcaccaucaggcacagg

SEQ ID NO: 3581774 - RNA, 23 nt, Pseudomonas putida KT2440
ucgccagccugcagcgcggcgau

SEQ ID NO: 3581775 - RNA, 15 nt, Pseudomonas putida KT2440
ucgccaggaucaccu

SEQ ID NO: 3581776 - RNA, 18 nt, Pseudomonas putida KT2440
ucgccaggcccagccccg

SEQ ID NO: 3581777 - RNA, 20 nt, Pseudomonas putida KT2440
ucgccaggccuucaucggcc

SEQ ID NO: 3581778 - RNA, 21 nt, Pseudomonas putida KT2440
ucgccaggccuucaucggccu

SEQ ID NO: 3581779 - RNA, 12 nt, Pseudomonas putida KT2440
ucgccaggcuuc

SEQ ID NO: 3581780 - RNA, 21 nt, Pseudomonas putida KT2440
ucgccagguacaguucccggu

SEQ ID NO: 3581781 - RNA, 18 nt, Pseudomonas putida KT2440
ucgccaggugcgcgucga

SEQ ID NO: 3581782 - RNA, 21 nt, Pseudomonas putida KT2440
ucgccaggugcucagccacgc

SEQ ID NO: 3581783 - RNA, 16 nt, Pseudomonas putida KT2440
ucgccagguuggcccu

SEQ ID NO: 3581784 - RNA, 18 nt, Pseudomonas putida KT2440
ucgccagugaacaccacu

SEQ ID NO: 3581785 - RNA, 21 nt, Pseudomonas putida KT2440
ucgccauaagcugucagcacc

SEQ ID NO: 3581786 - RNA, 22 nt, Pseudomonas putida KT2440
ucgccauaagcugucagcaccu

SEQ ID NO: 3581787 - RNA, 16 nt, Pseudomonas putida KT2440
ucgccauaggccgccu

SEQ ID NO: 3581788 - RNA, 21 nt, Pseudomonas putida KT2440
ucgccaucgccccgcgccgcc

SEQ ID NO: 3581789 - RNA, 16 nt, Pseudomonas putida KT2440
ucgccaucgcgcaggu

SEQ ID NO: 3581790 - RNA, 19 nt, Pseudomonas putida KT2440
ucgccauucaccagcuuca

SEQ ID NO: 3581791 - RNA, 18 nt, Pseudomonas putida KT2440
ucgccauucucgaucaac

SEQ ID NO: 3581792 - RNA, 15 nt, Pseudomonas putida KT2440
ucgcccaaauguuac

SEQ ID NO: 3581793 - RNA, 16 nt, Pseudomonas putida KT2440
ucgcccaccagcugca

SEQ ID NO: 3581794 - RNA, 17 nt, Pseudomonas putida KT2440
ucgcccacggcgauggu

SEQ ID NO: 3581795 - RNA, 15 nt, Pseudomonas putida KT2440
ucgcccagcagccaa

SEQ ID NO: 3581796 - RNA, 22 nt, Pseudomonas putida KT2440
ucgcccaucccggucaccugca

SEQ ID NO: 3581797 - RNA, 21 nt, Pseudomonas putida KT2440
ucgcccaugcgcgugcguguc

SEQ ID NO: 3581798 - RNA, 19 nt, Pseudomonas putida KT2440
ucgccccaggagggcuggu

SEQ ID NO: 3581799 - RNA, 20 nt, Pseudomonas putida KT2440
ucgccccaggagggcuggug

SEQ ID NO: 3581800 - RNA, 19 nt, Pseudomonas putida KT2440
ucgccccgccagcgccugg

SEQ ID NO: 3581801 - RNA, 21 nt, Pseudomonas putida KT2440
ucgccccgcggucuggcacag

SEQ ID NO: 3581802 - RNA, 15 nt, Pseudomonas putida KT2440
ucgcccgaccgccag

SEQ ID NO: 3581803 - RNA, 14 nt, Pseudomonas putida KT2440
ucgcccgcccagcc

SEQ ID NO: 3581804 - RNA, 12 nt, Pseudomonas putida KT2440
ucgcccgcgaag

SEQ ID NO: 3581805 - RNA, 14 nt, Pseudomonas putida KT2440
ucgcccgcugcuuc

SEQ ID NO: 3581806 - RNA, 19 nt, Pseudomonas putida KT2440
ucgcccgguuuggccugac

SEQ ID NO: 3581807 - RNA, 20 nt, Pseudomonas putida KT2440
ucgcccucgagugcgcugau

SEQ ID NO: 3581808 - RNA, 20 nt, Pseudomonas putida KT2440
ucgcccucguucgcgggcac

SEQ ID NO: 3581809 - RNA, 14 nt, Pseudomonas putida KT2440
ucgcccugcgccug

SEQ ID NO: 3581810 - RNA, 23 nt, Pseudomonas putida KT2440
ucgcccuguaccgccucgggggc

SEQ ID NO: 3581811 - RNA, 17 nt, Pseudomonas putida KT2440
ucgcccuugucagccgc

SEQ ID NO: 3581812 - RNA, 14 nt, Pseudomonas putida KT2440
ucgccgaaccccac

SEQ ID NO: 3581813 - RNA, 19 nt, Pseudomonas putida KT2440
ucgccgaaccccaccagca

SEQ ID NO: 3581814 - RNA, 18 nt, Pseudomonas putida KT2440
ucgccgaacgggccacca

SEQ ID NO: 3581815 - RNA, 21 nt, Pseudomonas putida KT2440
ucgccgacggcauggccgaag

SEQ ID NO: 3581816 - RNA, 23 nt, Pseudomonas putida KT2440
ucgccgagccgauaugcgggguc

SEQ ID NO: 3581817 - RNA, 22 nt, Pseudomonas putida KT2440
ucgccgcaucguuauccagcac

SEQ ID NO: 3581818 - RNA, 16 nt, Pseudomonas putida KT2440
ucgccgccacgaucga

SEQ ID NO: 3581819 - RNA, 21 nt, Pseudomonas putida KT2440
ucgccgcccaguggcacacca

SEQ ID NO: 3581820 - RNA, 15 nt, Pseudomonas putida KT2440
ucgccgccgcugacc

SEQ ID NO: 3581821 - RNA, 18 nt, Pseudomonas putida KT2440
ucgccgccgcugaccacg

SEQ ID NO: 3581822 - RNA, 20 nt, Pseudomonas putida KT2440
ucgccgccgcugaccacgcc

SEQ ID NO: 3581823 - RNA, 22 nt, Pseudomonas putida KT2440
ucgccgccgguuucucgcagca

SEQ ID NO: 3581824 - RNA, 18 nt, Pseudomonas putida KT2440
ucgccgcgcaugaaggac

SEQ ID NO: 3581825 - RNA, 20 nt, Pseudomonas putida KT2440
ucgccgcuguacaccaggac

SEQ ID NO: 3581826 - RNA, 19 nt, Pseudomonas putida KT2440
ucgccggcaagcuggucag

SEQ ID NO: 3581827 - RNA, 21 nt, Pseudomonas putida KT2440
ucgccggcaagcuggucaggu

SEQ ID NO: 3581828 - RNA, 16 nt, Pseudomonas putida KT2440
ucgcuaaccucugcau

SEQ ID NO: 3581829 - RNA, 21 nt, Pseudomonas putida KT2440
ucgcuaaccucugcaugccag

SEQ ID NO: 3581830 - RNA, 17 nt, Pseudomonas putida KT2440
ucgcuacugccgucguu

SEQ ID NO: 3581831 - RNA, 16 nt, Pseudomonas putida KT2440
ucgcuaucguccuggg

SEQ ID NO: 3581832 - RNA, 21 nt, Pseudomonas putida KT2440
ucgcuaucguccugggugugc

SEQ ID NO: 3581833 - RNA, 15 nt, Pseudomonas putida KT2440
ucgcucaaaugggua

SEQ ID NO: 3581834 - RNA, 14 nt, Pseudomonas putida KT2440
ucgcucaacuggcu

SEQ ID NO: 3581835 - RNA, 13 nt, Pseudomonas putida KT2440
ucgcucaccguuc

SEQ ID NO: 3581836 - RNA, 18 nt, Pseudomonas putida KT2440
ucgcucagcaacugggca

SEQ ID NO: 3581837 - RNA, 15 nt, Pseudomonas putida KT2440
ucgcucaggccaugc

SEQ ID NO: 3581838 - RNA, 15 nt, Pseudomonas putida KT2440
ucgcucaggcucuug

SEQ ID NO: 3581839 - RNA, 19 nt, Pseudomonas putida KT2440
ucgcucagguaggcagcaa

SEQ ID NO: 3581840 - RNA, 22 nt, Pseudomonas putida KT2440
ucgcucagguaggcagcaacgc

SEQ ID NO: 3581841 - RNA, 15 nt, Pseudomonas putida KT2440
ucgcuccaggcggcc

SEQ ID NO: 3581842 - RNA, 12 nt, Pseudomonas putida KT2440
ucgcuccagggc

SEQ ID NO: 3581843 - RNA, 15 nt, Pseudomonas putida KT2440
ucgcucuggcacuca

SEQ ID NO: 3581844 - RNA, 14 nt, Pseudomonas putida KT2440
ucgcugacuuccag

SEQ ID NO: 3581845 - RNA, 18 nt, Pseudomonas putida KT2440
ucgcugacuuccagcagc

SEQ ID NO: 3581846 - RNA, 16 nt, Pseudomonas putida KT2440
ucgcugaugcgccgcu

SEQ ID NO: 3581847 - RNA, 20 nt, Pseudomonas putida KT2440
ucgcugauuucgucaccgau

SEQ ID NO: 3581848 - RNA, 16 nt, Pseudomonas putida KT2440
ucgcugcccgagcguu

SEQ ID NO: 3581849 - RNA, 14 nt, Pseudomonas putida KT2440
ucgcugccgccuug

SEQ ID NO: 3581850 - RNA, 17 nt, Pseudomonas putida KT2440
ucgcugccgccuuggca

SEQ ID NO: 3581851 - RNA, 22 nt, Pseudomonas putida KT2440
ucgcugcgaaccuguugaagcg

SEQ ID NO: 3581852 - RNA, 19 nt, Pseudomonas putida KT2440
ucgcugcgcaucacccgcc

SEQ ID NO: 3581853 - RNA, 14 nt, Pseudomonas putida KT2440
ucgcuggagcggga

SEQ ID NO: 3581854 - RNA, 10 nt, Pseudomonas putida KT2440
ucgcuggcuu

SEQ ID NO: 3581855 - RNA, 18 nt, Pseudomonas putida KT2440
ucgcuguaaccugguugu

SEQ ID NO: 3581856 - RNA, 17 nt, Pseudomonas putida KT2440
ucgcugucaccgguauc

SEQ ID NO: 3581857 - RNA, 22 nt, Pseudomonas putida KT2440
ucgcugucaccgguaucgaugc

SEQ ID NO: 3581858 - RNA, 15 nt, Pseudomonas putida KT2440
ucgcugucguccagc

SEQ ID NO: 3581859 - RNA, 17 nt, Pseudomonas putida KT2440
ucgcugucguccagcuc

SEQ ID NO: 3581860 - RNA, 20 nt, Pseudomonas putida KT2440
ucgcugucguccagcucgcg

SEQ ID NO: 3581861 - RNA, 14 nt, Pseudomonas putida KT2440
ucgcugucuuccag

SEQ ID NO: 3581862 - RNA, 13 nt, Pseudomonas putida KT2440
ucgcugugcaaca

SEQ ID NO: 3581863 - RNA, 19 nt, Pseudomonas putida KT2440
ucgcugugcaacagcgccu

SEQ ID NO: 3581864 - RNA, 22 nt, Pseudomonas putida KT2440
ucgcugugcggcguauacccgg

SEQ ID NO: 3581865 - RNA, 13 nt, Pseudomonas putida KT2440
ucgcugugcguga

SEQ ID NO: 3581866 - RNA, 16 nt, Pseudomonas putida KT2440
ucgcuguugcgcaccu

SEQ ID NO: 3581867 - RNA, 19 nt, Pseudomonas putida KT2440
ucgcuguugcgcaccuugu

SEQ ID NO: 3581868 - RNA, 16 nt, Pseudomonas putida KT2440
ucgcuuacagaugucu

SEQ ID NO: 3581869 - RNA, 16 nt, Pseudomonas putida KT2440
ucgcuucugcacuccc

SEQ ID NO: 3581870 - RNA, 15 nt, Pseudomonas putida KT2440
ucggacacgucacug

SEQ ID NO: 3581871 - RNA, 20 nt, Pseudomonas putida KT2440
ucggacaggcgcuugacccg

SEQ ID NO: 3581872 - RNA, 15 nt, Pseudomonas putida KT2440
ucggagguagccacc

SEQ ID NO: 3581873 - RNA, 17 nt, Pseudomonas putida KT2440
ucggauuggcgcggcug

SEQ ID NO: 3581874 - RNA, 14 nt, Pseudomonas putida KT2440
ucggcaaagcggcu

SEQ ID NO: 3581875 - RNA, 15 nt, Pseudomonas putida KT2440
ucggcaaagcggcug

SEQ ID NO: 3581876 - RNA, 17 nt, Pseudomonas putida KT2440
ucggcaacauucaccag

SEQ ID NO: 3581877 - RNA, 19 nt, Pseudomonas putida KT2440
ucggcaacauucaccagcc

SEQ ID NO: 3581878 - RNA, 18 nt, Pseudomonas putida KT2440
ucggcaacggccgugcgc

SEQ ID NO: 3581879 - RNA, 16 nt, Pseudomonas putida KT2440
ucggcaaggcgaccug

SEQ ID NO: 3581880 - RNA, 14 nt, Pseudomonas putida KT2440
ucggcaaucacccg

SEQ ID NO: 3581881 - RNA, 22 nt, Pseudomonas putida KT2440
ucggcaaucaccgccaggucca

SEQ ID NO: 3581882 - RNA, 14 nt, Pseudomonas putida KT2440
ucggcaaucagcau

SEQ ID NO: 3581883 - RNA, 23 nt, Pseudomonas putida KT2440
ucggcaaucagcaucagugcagg

SEQ ID NO: 3581884 - RNA, 15 nt, Pseudomonas putida KT2440
ucggcaaucugcagc

SEQ ID NO: 3581885 - RNA, 16 nt, Pseudomonas putida KT2440
ucggcaaucugcagca

SEQ ID NO: 3581886 - RNA, 18 nt, Pseudomonas putida KT2440
ucggcaaucugcagcagc

SEQ ID NO: 3581887 - RNA, 19 nt, Pseudomonas putida KT2440
ucggcaaucugcagcagca

SEQ ID NO: 3581888 - RNA, 21 nt, Pseudomonas putida KT2440
ucggcaaugcgcgcgaaggcc

SEQ ID NO: 3581889 - RNA, 21 nt, Pseudomonas putida KT2440
ucggcacacgguuuccaggcg

SEQ ID NO: 3581890 - RNA, 15 nt, Pseudomonas putida KT2440
ucggcaccgacggcg

SEQ ID NO: 3581891 - RNA, 22 nt, Pseudomonas putida KT2440
ucggcaccuuucuccaggugga

SEQ ID NO: 3581892 - RNA, 15 nt, Pseudomonas putida KT2440
ucggcacgaagccca

SEQ ID NO: 3581893 - RNA, 21 nt, Pseudomonas putida KT2440
ucggcacgagcaugccgagga

SEQ ID NO: 3581894 - RNA, 19 nt, Pseudomonas putida KT2440
ucggcacgcgccagcagcg

SEQ ID NO: 3581895 - RNA, 15 nt, Pseudomonas putida KT2440
ucggcacugcuaucc

SEQ ID NO: 3581896 - RNA, 13 nt, Pseudomonas putida KT2440
ucggcacuguugu

SEQ ID NO: 3581897 - RNA, 17 nt, Pseudomonas putida KT2440
ucggcagagcgccagca

SEQ ID NO: 3581898 - RNA, 19 nt, Pseudomonas putida KT2440
ucggcagagcgccagcauc

SEQ ID NO: 3581899 - RNA, 22 nt, Pseudomonas putida KT2440
ucggcagcacccgcuuggccac

SEQ ID NO: 3581900 - RNA, 11 nt, Pseudomonas putida KT2440
ucggcagccau

SEQ ID NO: 3581901 - RNA, 20 nt, Pseudomonas putida KT2440
ucggcagccaugcugucgau

SEQ ID NO: 3581902 - RNA, 16 nt, Pseudomonas putida KT2440
ucggcagcgaucagcg

SEQ ID NO: 3581903 - RNA, 17 nt, Pseudomonas putida KT2440
ucggcagcgaucagcgc

SEQ ID NO: 3581904 - RNA, 18 nt, Pseudomonas putida KT2440
ucggcagcgaucagcgca

SEQ ID NO: 3581905 - RNA, 10 nt, Pseudomonas putida KT2440
ucggcagcuc

SEQ ID NO: 3581906 - RNA, 18 nt, Pseudomonas putida KT2440
ucggcaggcgguccagca

SEQ ID NO: 3581907 - RNA, 21 nt, Pseudomonas putida KT2440
ucggcaguagagcccccagca

SEQ ID NO: 3581908 - RNA, 13 nt, Pseudomonas putida KT2440
ucggcagucuugc

SEQ ID NO: 3581909 - RNA, 19 nt, Pseudomonas putida KT2440
ucggcaguggcucgugcac

SEQ ID NO: 3581910 - RNA, 23 nt, Pseudomonas putida KT2440
ucggcaguuugccgaugaucgaa

SEQ ID NO: 3581911 - RNA, 15 nt, Pseudomonas putida KT2440
ucggcaucgaacagc

SEQ ID NO: 3581912 - RNA, 20 nt, Pseudomonas putida KT2440
ucggcaucggccuggggcag

SEQ ID NO: 3581913 - RNA, 16 nt, Pseudomonas putida KT2440
ucggcaugcacggcag

SEQ ID NO: 3581914 - RNA, 17 nt, Pseudomonas putida KT2440
ucggcaugcacggcagc

SEQ ID NO: 3581915 - RNA, 18 nt, Pseudomonas putida KT2440
ucggcaugcacggcagca

SEQ ID NO: 3581916 - RNA, 16 nt, Pseudomonas putida KT2440
ucggcaugcagcggcc

SEQ ID NO: 3581917 - RNA, 19 nt, Pseudomonas putida KT2440
ucggcaugcagcggccagu

SEQ ID NO: 3581918 - RNA, 18 nt, Pseudomonas putida KT2440
ucggcauguucaucaccg

SEQ ID NO: 3581919 - RNA, 23 nt, Pseudomonas putida KT2440
ucggcauguucaucaccggccag

SEQ ID NO: 3581920 - RNA, 16 nt, Pseudomonas putida KT2440
ucggccaccacccgcu

SEQ ID NO: 3581921 - RNA, 15 nt, Pseudomonas putida KT2440
ucggccaccagcccg

SEQ ID NO: 3581922 - RNA, 22 nt, Pseudomonas putida KT2440
ucggccacccggaccagcgccg

SEQ ID NO: 3581923 - RNA, 21 nt, Pseudomonas putida KT2440
ucggccacccuccgggucagg

SEQ ID NO: 3581924 - RNA, 13 nt, Pseudomonas putida KT2440
ucggccaccgccg

SEQ ID NO: 3581925 - RNA, 20 nt, Pseudomonas putida KT2440
ucggccaccuggucgaaugc

SEQ ID NO: 3581926 - RNA, 18 nt, Pseudomonas putida KT2440
ucggccacuucgcggaag

SEQ ID NO: 3581927 - RNA, 22 nt, Pseudomonas putida KT2440
ucggccagcaguucgucgagca

SEQ ID NO: 3581928 - RNA, 19 nt, Pseudomonas putida KT2440
ucggccagccgccgccgag

SEQ ID NO: 3581929 - RNA, 16 nt, Pseudomonas putida KT2440
ucggccagcucggcag

SEQ ID NO: 3581930 - RNA, 18 nt, Pseudomonas putida KT2440
ucggccagcucggcagug

SEQ ID NO: 3581931 - RNA, 20 nt, Pseudomonas putida KT2440
ucggccagcucggcaguggc

SEQ ID NO: 3581932 - RNA, 15 nt, Pseudomonas putida KT2440
ucggccagcugcgca

SEQ ID NO: 3581933 - RNA, 20 nt, Pseudomonas putida KT2440
ucggccagcugcugcggcac

SEQ ID NO: 3581934 - RNA, 16 nt, Pseudomonas putida KT2440
ucgucaaguacuugca

SEQ ID NO: 3581935 - RNA, 22 nt, Pseudomonas putida KT2440
ucgucacauccugcucgucguc

SEQ ID NO: 3581936 - RNA, 21 nt, Pseudomonas putida KT2440
ucgucaccgccccagcgcgcc

SEQ ID NO: 3581937 - RNA, 22 nt, Pseudomonas putida KT2440
ucgucaccgccccagcgcgcca

SEQ ID NO: 3581938 - RNA, 21 nt, Pseudomonas putida KT2440
ucgucacguuuuuugggagcg

SEQ ID NO: 3581939 - RNA, 14 nt, Pseudomonas putida KT2440
ucguccagcucgcg

SEQ ID NO: 3581940 - RNA, 17 nt, Pseudomonas putida KT2440
ucguccagcucgcgcag

SEQ ID NO: 3581941 - RNA, 19 nt, Pseudomonas putida KT2440
ucguccagcucgucgagca

SEQ ID NO: 3581942 - RNA, 18 nt, Pseudomonas putida KT2440
ucguccaggcccugcagc

SEQ ID NO: 3581943 - RNA, 21 nt, Pseudomonas putida KT2440
ucguccaggcccugcagcgcu

SEQ ID NO: 3581944 - RNA, 13 nt, Pseudomonas putida KT2440
ucguccaggcuca

SEQ ID NO: 3581945 - RNA, 21 nt, Pseudomonas putida KT2440
ucguccaggcucagcucgucg

SEQ ID NO: 3581946 - RNA, 12 nt, Pseudomonas putida KT2440
ucguccaggcuu

SEQ ID NO: 3581947 - RNA, 20 nt, Pseudomonas putida KT2440
ucguccaucuugcugcucug

SEQ ID NO: 3581948 - RNA, 20 nt, Pseudomonas putida KT2440
ucgucccucggcaaggugcu

SEQ ID NO: 3581949 - RNA, 19 nt, Pseudomonas putida KT2440
ucguccgacaaugccagca

SEQ ID NO: 3581950 - RNA, 15 nt, Pseudomonas putida KT2440
ucguccugcccccaa

SEQ ID NO: 3581951 - RNA, 22 nt, Pseudomonas putida KT2440
ucguccuggaaaagcaaggcuc

SEQ ID NO: 3581952 - RNA, 12 nt, Pseudomonas putida KT2440
ucguccuugccg

SEQ ID NO: 3581953 - RNA, 17 nt, Pseudomonas putida KT2440
ucgucgaacaccagggu

SEQ ID NO: 3581954 - RNA, 14 nt, Pseudomonas putida KT2440
ucgucgaacagcau

SEQ ID NO: 3581955 - RNA, 22 nt, Pseudomonas putida KT2440
ucgucgacaacgcacccgccuc

SEQ ID NO: 3581956 - RNA, 18 nt, Pseudomonas putida KT2440
ucgucgagcaacuugcgc

SEQ ID NO: 3581957 - RNA, 17 nt, Pseudomonas putida KT2440
ucgucgagcaucugcug

SEQ ID NO: 3581958 - RNA, 17 nt, Pseudomonas putida KT2440
ucgucgaucccgaugcg

SEQ ID NO: 3581959 - RNA, 12 nt, Pseudomonas putida KT2440
ucgucgaugucu

SEQ ID NO: 3581960 - RNA, 21 nt, Pseudomonas putida KT2440
ucgucgaugucugccgcuucg

SEQ ID NO: 3581961 - RNA, 15 nt, Pseudomonas putida KT2440
ucgucggcaagcuug

SEQ ID NO: 3581962 - RNA, 18 nt, Pseudomonas putida KT2440
ucgucggcaagcuugcca

SEQ ID NO: 3581963 - RNA, 17 nt, Pseudomonas putida KT2440
ucgucggugcccuucac

SEQ ID NO: 3581964 - RNA, 18 nt, Pseudomonas putida KT2440
ucgucguaggcgcggguu

SEQ ID NO: 3581965 - RNA, 18 nt, Pseudomonas putida KT2440
ucgugaucauccccagca

SEQ ID NO: 3581966 - RNA, 21 nt, Pseudomonas putida KT2440
ucgugcaaggcgaugugcgca

SEQ ID NO: 3581967 - RNA, 18 nt, Pseudomonas putida KT2440
ucgugcaccgucuggacu

SEQ ID NO: 3581968 - RNA, 19 nt, Pseudomonas putida KT2440
ucgugcgccucaugcagca

SEQ ID NO: 3581969 - RNA, 15 nt, Pseudomonas putida KT2440
ucgugcucacgcccc

SEQ ID NO: 3581970 - RNA, 22 nt, Pseudomonas putida KT2440
ucgugcucacgccccuuggcac

SEQ ID NO: 3581971 - RNA, 22 nt, Pseudomonas putida KT2440
ucgugcugccggucggccugca

SEQ ID NO: 3581972 - RNA, 22 nt, Pseudomonas putida KT2440
ucguggucgccgucgcacaggc

SEQ ID NO: 3581973 - RNA, 17 nt, Pseudomonas putida KT2440
ucguguucgccuguccg

SEQ ID NO: 3581974 - RNA, 17 nt, Pseudomonas putida KT2440
ucguucaacaccuucuc

SEQ ID NO: 3581975 - RNA, 22 nt, Pseudomonas putida KT2440
ucguucggaucgucuggcacug

SEQ ID NO: 3581976 - RNA, 21 nt, Pseudomonas putida KT2440
ucguucggcaucgacgaugcc

SEQ ID NO: 3581977 - RNA, 17 nt, Pseudomonas putida KT2440
ucguucgggcacucggg

SEQ ID NO: 3581978 - RNA, 17 nt, Pseudomonas putida KT2440
ucguucuugaagaugac

SEQ ID NO: 3581979 - RNA, 20 nt, Pseudomonas putida KT2440
ucguugaagcgguugaccgc

SEQ ID NO: 3581980 - RNA, 17 nt, Pseudomonas putida KT2440
ucguugaaguagcgggu

SEQ ID NO: 3581981 - RNA, 18 nt, Pseudomonas putida KT2440
ucguugaccccgccgcug

SEQ ID NO: 3581982 - RNA, 17 nt, Pseudomonas putida KT2440
ucguugcgagcgaacag

SEQ ID NO: 3581983 - RNA, 19 nt, Pseudomonas putida KT2440
ucguugcgcgccagggcaa

SEQ ID NO: 3581984 - RNA, 18 nt, Pseudomonas putida KT2440
ucguugggccgccuugcg

SEQ ID NO: 3581985 - RNA, 21 nt, Pseudomonas putida KT2440
ucguugguggugcgcccggcg

SEQ ID NO: 3581986 - RNA, 14 nt, Pseudomonas putida KT2440
ucuaaaucgaccug

SEQ ID NO: 3581987 - RNA, 17 nt, Pseudomonas putida KT2440
ucuaaaucgaccugcag

SEQ ID NO: 3581988 - RNA, 16 nt, Pseudomonas putida KT2440
ucuaccaacugagcua

SEQ ID NO: 3581989 - RNA, 17 nt, Pseudomonas putida KT2440
ucuaccacgccgcugcc

SEQ ID NO: 3581990 - RNA, 17 nt, Pseudomonas putida KT2440
ucuaccacuggggcuuc

SEQ ID NO: 3581991 - RNA, 22 nt, Pseudomonas putida KT2440
ucuacccgccgcuucgcggcca

SEQ ID NO: 3581992 - RNA, 15 nt, Pseudomonas putida KT2440
ucuacgcccauggcc

SEQ ID NO: 3581993 - RNA, 14 nt, Pseudomonas putida KT2440
ucuagaacucggcg

SEQ ID NO: 3581994 - RNA, 21 nt, Pseudomonas putida KT2440
ucuaucaccuguucccccacc

SEQ ID NO: 3581995 - RNA, 15 nt, Pseudomonas putida KT2440
ucuaucuucaggcau

SEQ ID NO: 3581996 - RNA, 15 nt, Pseudomonas putida KT2440
ucuauucgacccgcg

SEQ ID NO: 3581997 - RNA, 21 nt, Pseudomonas putida KT2440
ucucaaccaccucuaucaccu

SEQ ID NO: 3581998 - RNA, 22 nt, Pseudomonas putida KT2440
ucucaaccaccucuaucaccug

SEQ ID NO: 3581999 - RNA, 21 nt, Pseudomonas putida KT2440
ucucaacguucauccccucga

SEQ ID NO: 3582000 - RNA, 14 nt, Pseudomonas putida KT2440
ucucaagcaaucca

SEQ ID NO: 3582001 - RNA, 17 nt, Pseudomonas putida KT2440
ucucacgcgccacauag

SEQ ID NO: 3582002 - RNA, 22 nt, Pseudomonas putida KT2440
ucucagcuggaacgcuuggcca

SEQ ID NO: 3582003 - RNA, 15 nt, Pseudomonas putida KT2440
ucucaggcaccagcg

SEQ ID NO: 3582004 - RNA, 20 nt, Pseudomonas putida KT2440
ucuccaacgucaaccgugcc

SEQ ID NO: 3582005 - RNA, 21 nt, Pseudomonas putida KT2440
ucuccaacuggcgaauacgcu

SEQ ID NO: 3582006 - RNA, 22 nt, Pseudomonas putida KT2440
ucuccaacuggcgaauacgcuc

SEQ ID NO: 3582007 - RNA, 17 nt, Pseudomonas putida KT2440
ucuccaagccgcuucac

SEQ ID NO: 3582008 - RNA, 22 nt, Pseudomonas putida KT2440
ucuccagcaacaacgccuuggc

SEQ ID NO: 3582009 - RNA, 19 nt, Pseudomonas putida KT2440
ucuccagcaccgccccggc

SEQ ID NO: 3582010 - RNA, 20 nt, Pseudomonas putida KT2440
ucuccagcaccgccccggcc

SEQ ID NO: 3582011 - RNA, 22 nt, Pseudomonas putida KT2440
ucuccagcaccgccccggccag

SEQ ID NO: 3582012 - RNA, 20 nt, Pseudomonas putida KT2440
ucuccagccgcugcugcagu

SEQ ID NO: 3582013 - RNA, 16 nt, Pseudomonas putida KT2440
ucuccagcgaugaccc

SEQ ID NO: 3582014 - RNA, 17 nt, Pseudomonas putida KT2440
ucuccagcuccuggccc

SEQ ID NO: 3582015 - RNA, 18 nt, Pseudomonas putida KT2440
ucuccagcuccuggcccg

SEQ ID NO: 3582016 - RNA, 17 nt, Pseudomonas putida KT2440
ucuccagcucgccauuc

SEQ ID NO: 3582017 - RNA, 21 nt, Pseudomonas putida KT2440
ucuccaguuguugggcagcca

SEQ ID NO: 3582018 - RNA, 16 nt, Pseudomonas putida KT2440
ucuccaugcugcugcc

SEQ ID NO: 3582019 - RNA, 16 nt, Pseudomonas putida KT2440
ucucccaggccgacac

SEQ ID NO: 3582020 - RNA, 12 nt, Pseudomonas putida KT2440
ucuccccagucc

SEQ ID NO: 3582021 - RNA, 20 nt, Pseudomonas putida KT2440
ucucccgcgaacgcccgacc

SEQ ID NO: 3582022 - RNA, 21 nt, Pseudomonas putida KT2440
ucuccgggaagguuuccagcc

SEQ ID NO: 3582023 - RNA, 17 nt, Pseudomonas putida KT2440
ucuccgggcgcccuggc

SEQ ID NO: 3582024 - RNA, 19 nt, Pseudomonas putida KT2440
ucuccgugcucaggcggcc

SEQ ID NO: 3582025 - RNA, 14 nt, Pseudomonas putida KT2440
ucuccucggccagc

SEQ ID NO: 3582026 - RNA, 20 nt, Pseudomonas putida KT2440
ucuccugcagggaacugcgc

SEQ ID NO: 3582027 - RNA, 18 nt, Pseudomonas putida KT2440
ucuccuggguaacccgcu

SEQ ID NO: 3582028 - RNA, 21 nt, Pseudomonas putida KT2440
ucuccuuggacagcaauucca

SEQ ID NO: 3582029 - RNA, 15 nt, Pseudomonas putida KT2440
ucucgaacagcuggc

SEQ ID NO: 3582030 - RNA, 20 nt, Pseudomonas putida KT2440
ucucgaacauuuccagcaug

SEQ ID NO: 3582031 - RNA, 21 nt, Pseudomonas putida KT2440
ucucgaacggcgccagcagug

SEQ ID NO: 3582032 - RNA, 14 nt, Pseudomonas putida KT2440
ucucgacaagcgca

SEQ ID NO: 3582033 - RNA, 16 nt, Pseudomonas putida KT2440
ucucgaccacuuccca

SEQ ID NO: 3582034 - RNA, 18 nt, Pseudomonas putida KT2440
ucucgaccagcgccagcc

SEQ ID NO: 3582035 - RNA, 19 nt, Pseudomonas putida KT2440
ucucgaucuaugcccggcu

SEQ ID NO: 3582036 - RNA, 20 nt, Pseudomonas putida KT2440
ucucgaugaugcuggucggc

SEQ ID NO: 3582037 - RNA, 17 nt, Pseudomonas putida KT2440
ucucgaugcaauccgcc

SEQ ID NO: 3582038 - RNA, 20 nt, Pseudomonas putida KT2440
ucuggucuaaaacugccaau

SEQ ID NO: 3582039 - RNA, 21 nt, Pseudomonas putida KT2440
ucuggugaaagucgaccagca

SEQ ID NO: 3582040 - RNA, 23 nt, Pseudomonas putida KT2440
ucugguuaccagaguugccacca

SEQ ID NO: 3582041 - RNA, 21 nt, Pseudomonas putida KT2440
ucugguugaccgagaacaggc

SEQ ID NO: 3582042 - RNA, 15 nt, Pseudomonas putida KT2440
ucugguugccgccag

SEQ ID NO: 3582043 - RNA, 19 nt, Pseudomonas putida KT2440
ucugguugccgccagcccc

SEQ ID NO: 3582044 - RNA, 17 nt, Pseudomonas putida KT2440
ucugguugcuggcgcca

SEQ ID NO: 3582045 - RNA, 20 nt, Pseudomonas putida KT2440
ucugguugcuggcgccagcg

SEQ ID NO: 3582046 - RNA, 20 nt, Pseudomonas putida KT2440
ucuguaagugaugaucacau

SEQ ID NO: 3582047 - RNA, 13 nt, Pseudomonas putida KT2440
ucuguacaguggc

SEQ ID NO: 3582048 - RNA, 16 nt, Pseudomonas putida KT2440
ucuguaugacgaugcc

SEQ ID NO: 3582049 - RNA, 20 nt, Pseudomonas putida KT2440
ucuguccagauuacaaaagc

SEQ ID NO: 3582050 - RNA, 16 nt, Pseudomonas putida KT2440
ucuguccccccagggc

SEQ ID NO: 3582051 - RNA, 15 nt, Pseudomonas putida KT2440
ucuguccuccugccg

SEQ ID NO: 3582052 - RNA, 20 nt, Pseudomonas putida KT2440
ucugugaggccagcgggaag

SEQ ID NO: 3582053 - RNA, 22 nt, Pseudomonas putida KT2440
ucugugauuuccagcgucagca

SEQ ID NO: 3582054 - RNA, 21 nt, Pseudomonas putida KT2440
ucugugggagcgggcuugccc

SEQ ID NO: 3582055 - RNA, 23 nt, Pseudomonas putida KT2440
ucuguuucugccccuggcccauc

SEQ ID NO: 3582056 - RNA, 16 nt, Pseudomonas putida KT2440
ucuuaacucauuaauu

SEQ ID NO: 3582057 - RNA, 22 nt, Pseudomonas putida KT2440
ucuuaauucauaaggaucauga

SEQ ID NO: 3582058 - RNA, 20 nt, Pseudomonas putida KT2440
ucuuacgggcuugugcauca

SEQ ID NO: 3582059 - RNA, 12 nt, Pseudomonas putida KT2440
ucuuagcgggca

SEQ ID NO: 3582060 - RNA, 13 nt, Pseudomonas putida KT2440
ucuuaugccuggg

SEQ ID NO: 3582061 - RNA, 21 nt, Pseudomonas putida KT2440
ucuucaaccaguucagcgccc

SEQ ID NO: 3582062 - RNA, 22 nt, Pseudomonas putida KT2440
ucuucacaccggccuuggccag

SEQ ID NO: 3582063 - RNA, 17 nt, Pseudomonas putida KT2440
ucuucaccuugccuacc

SEQ ID NO: 3582064 - RNA, 23 nt, Pseudomonas putida KT2440
ucuucacguccagccacuuguuc

SEQ ID NO: 3582065 - RNA, 22 nt, Pseudomonas putida KT2440
ucuucacucaaccaccgcucaa

SEQ ID NO: 3582066 - RNA, 14 nt, Pseudomonas putida KT2440
ucuucacugcucau

SEQ ID NO: 3582067 - RNA, 16 nt, Pseudomonas putida KT2440
ucuucaggcaauggcg

SEQ ID NO: 3582068 - RNA, 19 nt, Pseudomonas putida KT2440
ucuucaucccuguacagau

SEQ ID NO: 3582069 - RNA, 19 nt, Pseudomonas putida KT2440
ucuucaugaaguacuuggc

SEQ ID NO: 3582070 - RNA, 22 nt, Pseudomonas putida KT2440
ucuucaugaaguacuuggcgcc

SEQ ID NO: 3582071 - RNA, 17 nt, Pseudomonas putida KT2440
ucuuccacgcccaggcg

SEQ ID NO: 3582072 - RNA, 20 nt, Pseudomonas putida KT2440
ucuuccagcggcaaggucaa

SEQ ID NO: 3582073 - RNA, 20 nt, Pseudomonas putida KT2440
ucuuccagcucgcuuuccuu

SEQ ID NO: 3582074 - RNA, 21 nt, Pseudomonas putida KT2440
ucuuccauuugcgcuggcugc

SEQ ID NO: 3582075 - RNA, 16 nt, Pseudomonas putida KT2440
ucuucccccgggcuug

SEQ ID NO: 3582076 - RNA, 21 nt, Pseudomonas putida KT2440
ucuucccccgggcuuggugau

SEQ ID NO: 3582077 - RNA, 23 nt, Pseudomonas putida KT2440
ucuuccccgcccaagcggcagaa

SEQ ID NO: 3582078 - RNA, 19 nt, Pseudomonas putida KT2440
ucuuccggcaggucggcaa

SEQ ID NO: 3582079 - RNA, 20 nt, Pseudomonas putida KT2440
ucuuccucgacccagccacc

SEQ ID NO: 3582080 - RNA, 20 nt, Pseudomonas putida KT2440
ucuuccugccgcagcgcaug

SEQ ID NO: 3582081 - RNA, 17 nt, Pseudomonas putida KT2440
ucuuccuggcuggcagc

SEQ ID NO: 3582082 - RNA, 19 nt, Pseudomonas putida KT2440
ucuuccuggcuggcagccg

SEQ ID NO: 3582083 - RNA, 20 nt, Pseudomonas putida KT2440
ucuucgaauaccaguaaugc

SEQ ID NO: 3582084 - RNA, 19 nt, Pseudomonas putida KT2440
ucuucgauccgcgccauca

SEQ ID NO: 3582085 - RNA, 22 nt, Pseudomonas putida KT2440
ucuucgauccgcgccaucagcu

SEQ ID NO: 3582086 - RNA, 16 nt, Pseudomonas putida KT2440
ucuucgaucucggcca

SEQ ID NO: 3582087 - RNA, 23 nt, Pseudomonas putida KT2440
ucuucgauguacggcagaacggc

SEQ ID NO: 3582088 - RNA, 13 nt, Pseudomonas putida KT2440
ucuucgccggcau

SEQ ID NO: 3582089 - RNA, 13 nt, Pseudomonas putida KT2440
ucuucgccugcag

SEQ ID NO: 3582090 - RNA, 23 nt, Pseudomonas putida KT2440
ucuucgcgcucgaacaacgccuc

SEQ ID NO: 3582091 - RNA, 14 nt, Pseudomonas putida KT2440
ucuucgcggccuug

SEQ ID NO: 3582092 - RNA, 13 nt, Pseudomonas putida KT2440
ucuucgcgggcaa

SEQ ID NO: 3582093 - RNA, 17 nt, Pseudomonas putida KT2440
ucuucgcgggcaagccc

SEQ ID NO: 3582094 - RNA, 14 nt, Pseudomonas putida KT2440
ucuucgcgggcaug

SEQ ID NO: 3582095 - RNA, 15 nt, Pseudomonas putida KT2440
ucuucgcgggcaugc

SEQ ID NO: 3582096 - RNA, 18 nt, Pseudomonas putida KT2440
ucuucgcgggcaugcccg

SEQ ID NO: 3582097 - RNA, 23 nt, Pseudomonas putida KT2440
ucuucgcgggcaugcccgcuccc

SEQ ID NO: 3582098 - RNA, 22 nt, Pseudomonas putida KT2440
ucuucggcuuugaacagcucga

SEQ ID NO: 3582099 - RNA, 16 nt, Pseudomonas putida KT2440
ucuucggugucggcca

SEQ ID NO: 3582100 - RNA, 18 nt, Pseudomonas putida KT2440
ucuucgucaguccaucac

SEQ ID NO: 3582101 - RNA, 12 nt, Pseudomonas putida KT2440
ucuucucuucca

SEQ ID NO: 3582102 - RNA, 15 nt, Pseudomonas putida KT2440
ucuucugcagccacc

SEQ ID NO: 3582103 - RNA, 18 nt, Pseudomonas putida KT2440
ucuucuggggugauuuuu

SEQ ID NO: 3582104 - RNA, 23 nt, Pseudomonas putida KT2440
ucuucuuuaagccccugcggcug

SEQ ID NO: 3582105 - RNA, 16 nt, Pseudomonas putida KT2440
ucuucuuucagguaac

SEQ ID NO: 3582106 - RNA, 19 nt, Pseudomonas putida KT2440
ucuucuuucgacaugcagu

SEQ ID NO: 3582107 - RNA, 17 nt, Pseudomonas putida KT2440
ucuugaagaagcucccg

SEQ ID NO: 3582108 - RNA, 22 nt, Pseudomonas putida KT2440
ucuugagcuggccguccagcug

SEQ ID NO: 3582109 - RNA, 15 nt, Pseudomonas putida KT2440
ucuugaggcacaaaa

SEQ ID NO: 3582110 - RNA, 21 nt, Pseudomonas putida KT2440
ucuugcaccugucccagcugg

SEQ ID NO: 3582111 - RNA, 18 nt, Pseudomonas putida KT2440
ucuugcaguucuugaucc

SEQ ID NO: 3582112 - RNA, 13 nt, Pseudomonas putida KT2440
ucuugccgugcuc

SEQ ID NO: 3582113 - RNA, 14 nt, Pseudomonas putida KT2440
ucuugccuuccacc

SEQ ID NO: 3582114 - RNA, 16 nt, Pseudomonas putida KT2440
ucuugccuucggccac

SEQ ID NO: 3582115 - RNA, 13 nt, Pseudomonas putida KT2440
ucuugcgcacgcg

SEQ ID NO: 3582116 - RNA, 20 nt, Pseudomonas putida KT2440
ucuugcgccccagcagcgcu

SEQ ID NO: 3582117 - RNA, 13 nt, Pseudomonas putida KT2440
ucuugcugccguc

SEQ ID NO: 3582118 - RNA, 19 nt, Pseudomonas putida KT2440
ucuuggccagggccuuuuc

SEQ ID NO: 3582119 - RNA, 14 nt, Pseudomonas putida KT2440
ucuuggcggcuggg

SEQ ID NO: 3582120 - RNA, 19 nt, Pseudomonas putida KT2440
ucuuguagcugaccuugga

SEQ ID NO: 3582121 - RNA, 16 nt, Pseudomonas putida KT2440
ucuugucgacagugaa

SEQ ID NO: 3582122 - RNA, 18 nt, Pseudomonas putida KT2440
ucuugucuccgaacgccu

SEQ ID NO: 3582123 - RNA, 15 nt, Pseudomonas putida KT2440
ucuuguggcucaugu

SEQ ID NO: 3582124 - RNA, 21 nt, Pseudomonas putida KT2440
ucuuguguuuugccuccagcu

SEQ ID NO: 3582125 - RNA, 16 nt, Pseudomonas putida KT2440
ucuuuacgcauugccg

SEQ ID NO: 3582126 - RNA, 15 nt, Pseudomonas putida KT2440
ucuuucaacagcugg

SEQ ID NO: 3582127 - RNA, 17 nt, Pseudomonas putida KT2440
ucuuucaacagcuggcu

SEQ ID NO: 3582128 - RNA, 21 nt, Pseudomonas putida KT2440
ucuuucagcucaaucagccaa

SEQ ID NO: 3582129 - RNA, 16 nt, Pseudomonas putida KT2440
ucuuucggcagcaccc

SEQ ID NO: 3582130 - RNA, 18 nt, Pseudomonas putida KT2440
ucuuucggcagcacccgc

SEQ ID NO: 3582131 - RNA, 14 nt, Pseudomonas putida KT2440
ucuuugaacgaggu

SEQ ID NO: 3582132 - RNA, 20 nt, Pseudomonas putida KT2440
ucuuugaacgagguuuugca

SEQ ID NO: 3582133 - RNA, 17 nt, Pseudomonas putida KT2440
ucuuugagggucagcug

SEQ ID NO: 3582134 - RNA, 21 nt, Pseudomonas putida KT2440
ucuuugagggucagcuggccu

SEQ ID NO: 3582135 - RNA, 13 nt, Pseudomonas putida KT2440
ugaaaaacaacaa

SEQ ID NO: 3582136 - RNA, 19 nt, Pseudomonas putida KT2440
ugaaaaacgccgggcacug

SEQ ID NO: 3582137 - RNA, 22 nt, Pseudomonas putida KT2440
ugaaaacauugcuaauuucagg

SEQ ID NO: 3582138 - RNA, 15 nt, Pseudomonas putida KT2440
ugaaacaucagccgg

SEQ ID NO: 3582139 - RNA, 22 nt, Pseudomonas putida KT2440
ugaaaccguuggucagcgacug

SEQ ID NO: 3582140 - RNA, 13 nt, Pseudomonas putida KT2440
ugaaacuccaucg

SEQ ID NO: 3582141 - RNA, 15 nt, Pseudomonas putida KT2440
ugaaacuuuucauug

SEQ ID NO: 3582142 - RNA, 18 nt, Pseudomonas putida KT2440
ugacaacgcccgccguca

SEQ ID NO: 3582143 - RNA, 17 nt, Pseudomonas putida KT2440
ugacaagauaguaggca

SEQ ID NO: 3582144 - RNA, 18 nt, Pseudomonas putida KT2440
ugacaaugcgacugagca

SEQ ID NO: 3582145 - RNA, 23 nt, Pseudomonas putida KT2440
ugacaauugucgguacuggcuau

SEQ ID NO: 3582146 - RNA, 19 nt, Pseudomonas putida KT2440
ugacacauaggcagccacc

SEQ ID NO: 3582147 - RNA, 21 nt, Pseudomonas putida KT2440
ugacagagguauuggucaccg

SEQ ID NO: 3582148 - RNA, 15 nt, Pseudomonas putida KT2440
ugacagcacggccuu

SEQ ID NO: 3582149 - RNA, 19 nt, Pseudomonas putida KT2440
ugacagcaggaacagcggc

SEQ ID NO: 3582150 - RNA, 20 nt, Pseudomonas putida KT2440
ugacagcaggaacagcggca

SEQ ID NO: 3582151 - RNA, 13 nt, Pseudomonas putida KT2440
ugacagcgcuucc

SEQ ID NO: 3582152 - RNA, 15 nt, Pseudomonas putida KT2440
ugacagcgcuuccaa

SEQ ID NO: 3582153 - RNA, 13 nt, Pseudomonas putida KT2440
ugacaguggcagg

SEQ ID NO: 3582154 - RNA, 17 nt, Pseudomonas putida KT2440
ugacaguggcagguucg

SEQ ID NO: 3582155 - RNA, 22 nt, Pseudomonas putida KT2440
ugacaguggcagguucgaccac

SEQ ID NO: 3582156 - RNA, 18 nt, Pseudomonas putida KT2440
ugacauaacaagaacaac

SEQ ID NO: 3582157 - RNA, 12 nt, Pseudomonas putida KT2440
ugacaugcacaa

SEQ ID NO: 3582158 - RNA, 15 nt, Pseudomonas putida KT2440
ugaccaacaggcugg

SEQ ID NO: 3582159 - RNA, 17 nt, Pseudomonas putida KT2440
ugaccaauccagcccuc

SEQ ID NO: 3582160 - RNA, 14 nt, Pseudomonas putida KT2440
ugaccacaaagccu

SEQ ID NO: 3582161 - RNA, 23 nt, Pseudomonas putida KT2440
ugaccaccagacgggcauggugg

SEQ ID NO: 3582162 - RNA, 13 nt, Pseudomonas putida KT2440
ugaccacgaaggc

SEQ ID NO: 3582163 - RNA, 17 nt, Pseudomonas putida KT2440
ugaccagcaccagcgac

SEQ ID NO: 3582164 - RNA, 13 nt, Pseudomonas putida KT2440
ugaccagcggcag

SEQ ID NO: 3582165 - RNA, 19 nt, Pseudomonas putida KT2440
ugaccaggcccagcaggua

SEQ ID NO: 3582166 - RNA, 22 nt, Pseudomonas putida KT2440
ugaccagugucugcaacugccc

SEQ ID NO: 3582167 - RNA, 13 nt, Pseudomonas putida KT2440
ugaccaucagccu

SEQ ID NO: 3582168 - RNA, 15 nt, Pseudomonas putida KT2440
ugaccaucagccugu

SEQ ID NO: 3582169 - RNA, 14 nt, Pseudomonas putida KT2440
ugaccauuuccggg

SEQ ID NO: 3582170 - RNA, 14 nt, Pseudomonas putida KT2440
ugaccccgccgcug

SEQ ID NO: 3582171 - RNA, 19 nt, Pseudomonas putida KT2440
ugaccccuucaucacccag

SEQ ID NO: 3582172 - RNA, 14 nt, Pseudomonas putida KT2440
ugacccgcuugcag

SEQ ID NO: 3582173 - RNA, 21 nt, Pseudomonas putida KT2440
ugacccggugcacccacuggc

SEQ ID NO: 3582174 - RNA, 20 nt, Pseudomonas putida KT2440
ugacccguguaggagcgggu

SEQ ID NO: 3582175 - RNA, 22 nt, Pseudomonas putida KT2440
ugacccucaagugccguccgcu

SEQ ID NO: 3582176 - RNA, 19 nt, Pseudomonas putida KT2440
ugaccgagaacaggcggcc

SEQ ID NO: 3582177 - RNA, 16 nt, Pseudomonas putida KT2440
ugaccgaugaucugcc

SEQ ID NO: 3582178 - RNA, 19 nt, Pseudomonas putida KT2440
ugaccgaugaucugccggg

SEQ ID NO: 3582179 - RNA, 11 nt, Pseudomonas putida KT2440
ugaccgcccag

SEQ ID NO: 3582180 - RNA, 17 nt, Pseudomonas putida KT2440
ugaccgcccagcgucgu

SEQ ID NO: 3582181 - RNA, 13 nt, Pseudomonas putida KT2440
ugaccgccugcgc

SEQ ID NO: 3582182 - RNA, 14 nt, Pseudomonas putida KT2440
ugaccgccugcgca

SEQ ID NO: 3582183 - RNA, 17 nt, Pseudomonas putida KT2440
ugaccgcggugcugacc

SEQ ID NO: 3582184 - RNA, 18 nt, Pseudomonas putida KT2440
ugaccgcggugcugacca

SEQ ID NO: 3582185 - RNA, 15 nt, Pseudomonas putida KT2440
ugaccggcacugcac

SEQ ID NO: 3582186 - RNA, 16 nt, Pseudomonas putida KT2440
ugaccggccgggcuuc

SEQ ID NO: 3582187 - RNA, 15 nt, Pseudomonas putida KT2440
ugaccggccugguca

SEQ ID NO: 3582188 - RNA, 15 nt, Pseudomonas putida KT2440
ugaccgggucgacgc

SEQ ID NO: 3582189 - RNA, 17 nt, Pseudomonas putida KT2440
ugaccgggugugagaac

SEQ ID NO: 3582190 - RNA, 19 nt, Pseudomonas putida KT2440
ugaccgguuuuggcaggcc

SEQ ID NO: 3582191 - RNA, 15 nt, Pseudomonas putida KT2440
ugaccguccacaccg

SEQ ID NO: 3582192 - RNA, 15 nt, Pseudomonas putida KT2440
ugaccguccacguug

SEQ ID NO: 3582193 - RNA, 18 nt, Pseudomonas putida KT2440
ugaccgugaucaucagcg

SEQ ID NO: 3582194 - RNA, 20 nt, Pseudomonas putida KT2440
ugaccgugaucaucagcgcc

SEQ ID NO: 3582195 - RNA, 18 nt, Pseudomonas putida KT2440
ugaccucgaccaggcgcu

SEQ ID NO: 3582196 - RNA, 20 nt, Pseudomonas putida KT2440
ugaccucgaccaggcgcucg

SEQ ID NO: 3582197 - RNA, 22 nt, Pseudomonas putida KT2440
ugaccucgaccaggcgcucgcu

SEQ ID NO: 3582198 - RNA, 23 nt, Pseudomonas putida KT2440
ugaccucugguuuugucggccau

SEQ ID NO: 3582199 - RNA, 14 nt, Pseudomonas putida KT2440
ugaccugcuggguc

SEQ ID NO: 3582200 - RNA, 16 nt, Pseudomonas putida KT2440
ugaccugugcugaauu

SEQ ID NO: 3582201 - RNA, 19 nt, Pseudomonas putida KT2440
ugaccuguucgcgcaacac

SEQ ID NO: 3582202 - RNA, 14 nt, Pseudomonas putida KT2440
ugaccuucaaccac

SEQ ID NO: 3582203 - RNA, 14 nt, Pseudomonas putida KT2440
ugaccuugcugcuc

SEQ ID NO: 3582204 - RNA, 23 nt, Pseudomonas putida KT2440
ugaccuuuucuaaguccuugguu

SEQ ID NO: 3582205 - RNA, 18 nt, Pseudomonas putida KT2440
ugacgaccucggccaggu

SEQ ID NO: 3582206 - RNA, 17 nt, Pseudomonas putida KT2440
ugacgacguugcgcuca

SEQ ID NO: 3582207 - RNA, 19 nt, Pseudomonas putida KT2440
ugacgauaugcccgucauc

SEQ ID NO: 3582208 - RNA, 15 nt, Pseudomonas putida KT2440
ugacgaucgccagcc

SEQ ID NO: 3582209 - RNA, 19 nt, Pseudomonas putida KT2440
ugacgaucgccagccccag

SEQ ID NO: 3582210 - RNA, 13 nt, Pseudomonas putida KT2440
ugacgauggccac

SEQ ID NO: 3582211 - RNA, 15 nt, Pseudomonas putida KT2440
ugacgcaagcgcgcc

SEQ ID NO: 3582212 - RNA, 19 nt, Pseudomonas putida KT2440
ugacgcaagcgcgccgcca

SEQ ID NO: 3582213 - RNA, 20 nt, Pseudomonas putida KT2440
ugacgcagggccucgaugcg

SEQ ID NO: 3582214 - RNA, 16 nt, Pseudomonas putida KT2440
ugacgccaguugguca

SEQ ID NO: 3582215 - RNA, 16 nt, Pseudomonas putida KT2440
ugacgcggagccggcu

SEQ ID NO: 3582216 - RNA, 19 nt, Pseudomonas putida KT2440
ugacgcggauagcgcgcca

SEQ ID NO: 3582217 - RNA, 22 nt, Pseudomonas putida KT2440
ugacgcggauccgugcaccgcu

SEQ ID NO: 3582218 - RNA, 21 nt, Pseudomonas putida KT2440
ugacggcgauggcgucgacuc

SEQ ID NO: 3582219 - RNA, 15 nt, Pseudomonas putida KT2440
ugacggcgcugcugg

SEQ ID NO: 3582220 - RNA, 17 nt, Pseudomonas putida KT2440
ugacggcgcugcuggcc

SEQ ID NO: 3582221 - RNA, 18 nt, Pseudomonas putida KT2440
ugacgggugaccaggccc

SEQ ID NO: 3582222 - RNA, 18 nt, Pseudomonas putida KT2440
ugacggucugccggcacc

SEQ ID NO: 3582223 - RNA, 21 nt, Pseudomonas putida KT2440
ugacggugaauuccuugcagc

SEQ ID NO: 3582224 - RNA, 15 nt, Pseudomonas putida KT2440
ugacguccagcucaa

SEQ ID NO: 3582225 - RNA, 23 nt, Pseudomonas putida KT2440
ugacgugcgcggggcccgaccuc

SEQ ID NO: 3582226 - RNA, 19 nt, Pseudomonas putida KT2440
ugacguuguagcggccauc

SEQ ID NO: 3582227 - RNA, 15 nt, Pseudomonas putida KT2440
ugacuaguggccacu

SEQ ID NO: 3582228 - RNA, 14 nt, Pseudomonas putida KT2440
ugacucaugccuuc

SEQ ID NO: 3582229 - RNA, 19 nt, Pseudomonas putida KT2440
ugacuccgccccaaaccag

SEQ ID NO: 3582230 - RNA, 16 nt, Pseudomonas putida KT2440
ugacucgaccgccgca

SEQ ID NO: 3582231 - RNA, 23 nt, Pseudomonas putida KT2440
ugacucgaccgccgcacaggaaa

SEQ ID NO: 3582232 - RNA, 14 nt, Pseudomonas putida KT2440
ugacuggcagcaag

SEQ ID NO: 3582233 - RNA, 14 nt, Pseudomonas putida KT2440
ugacuucgcugccc

SEQ ID NO: 3582234 - RNA, 17 nt, Pseudomonas putida KT2440
ugagaaagaucugcgug

SEQ ID NO: 3582235 - RNA, 22 nt, Pseudomonas putida KT2440
ugagaaagaucugcguggcagu

SEQ ID NO: 3582236 - RNA, 19 nt, Pseudomonas putida KT2440
ugagaccgaggggccgcua

SEQ ID NO: 3582237 - RNA, 21 nt, Pseudomonas putida KT2440
ugagaccguagggggccgcuu

SEQ ID NO: 3582238 - RNA, 21 nt, Pseudomonas putida KT2440
ugagacgcauguugaaacacc

SEQ ID NO: 3582239 - RNA, 16 nt, Pseudomonas putida KT2440
ugagacuuagucucga

SEQ ID NO: 3582240 - RNA, 16 nt, Pseudomonas putida KT2440
ugagaucgagcgccgc

SEQ ID NO: 3582241 - RNA, 22 nt, Pseudomonas putida KT2440
ugagcaagacgggaucaccgug

SEQ ID NO: 3582242 - RNA, 16 nt, Pseudomonas putida KT2440
ugagcaagcgcgcgcc

SEQ ID NO: 3582243 - RNA, 23 nt, Pseudomonas putida KT2440
ugagcacacgguaguccugccau

SEQ ID NO: 3582244 - RNA, 12 nt, Pseudomonas putida KT2440
ugagcaccggca

SEQ ID NO: 3582245 - RNA, 20 nt, Pseudomonas putida KT2440
ugagcacgaaacugcgcugg

SEQ ID NO: 3582246 - RNA, 21 nt, Pseudomonas putida KT2440
ugagcacgaaguaacggccac

SEQ ID NO: 3582247 - RNA, 17 nt, Pseudomonas putida KT2440
ugaucuguccuccugcc

SEQ ID NO: 3582248 - RNA, 15 nt, Pseudomonas putida KT2440
ugaucuuuacuuucu

SEQ ID NO: 3582249 - RNA, 16 nt, Pseudomonas putida KT2440
ugaugauaccgaacag

SEQ ID NO: 3582250 - RNA, 20 nt, Pseudomonas putida KT2440
ugaugauaccgaacagcacc

SEQ ID NO: 3582251 - RNA, 20 nt, Pseudomonas putida KT2440
ugaugaucagggacaugggg

SEQ ID NO: 3582252 - RNA, 17 nt, Pseudomonas putida KT2440
ugaugaugcaguagcca

SEQ ID NO: 3582253 - RNA, 15 nt, Pseudomonas putida KT2440
ugaugcagcagugcc

SEQ ID NO: 3582254 - RNA, 17 nt, Pseudomonas putida KT2440
ugaugcagccagccucu

SEQ ID NO: 3582255 - RNA, 17 nt, Pseudomonas putida KT2440
ugaugcccgucggcgua

SEQ ID NO: 3582256 - RNA, 15 nt, Pseudomonas putida KT2440
ugaugcgcacccgac

SEQ ID NO: 3582257 - RNA, 14 nt, Pseudomonas putida KT2440
ugaugcgccgcucg

SEQ ID NO: 3582258 - RNA, 19 nt, Pseudomonas putida KT2440
ugaugcgcuggcccuugcc

SEQ ID NO: 3582259 - RNA, 14 nt, Pseudomonas putida KT2440
ugaugcgcuugcca

SEQ ID NO: 3582260 - RNA, 22 nt, Pseudomonas putida KT2440
ugaugcgggaccagcaccaccu

SEQ ID NO: 3582261 - RNA, 22 nt, Pseudomonas putida KT2440
ugaugcguacggccuuggcgcc

SEQ ID NO: 3582262 - RNA, 14 nt, Pseudomonas putida KT2440
ugauggcaaucacg

SEQ ID NO: 3582263 - RNA, 15 nt, Pseudomonas putida KT2440
ugauggcgcauggcc

SEQ ID NO: 3582264 - RNA, 14 nt, Pseudomonas putida KT2440
ugauggcugccagg

SEQ ID NO: 3582265 - RNA, 13 nt, Pseudomonas putida KT2440
ugauggggccgcu

SEQ ID NO: 3582266 - RNA, 21 nt, Pseudomonas putida KT2440
ugauggggccgcugugggagu

SEQ ID NO: 3582267 - RNA, 22 nt, Pseudomonas putida KT2440
ugauggggcgcuggaagugcug

SEQ ID NO: 3582268 - RNA, 20 nt, Pseudomonas putida KT2440
ugaugguaucugccagcacg

SEQ ID NO: 3582269 - RNA, 17 nt, Pseudomonas putida KT2440
ugauggugucuuccagg

SEQ ID NO: 3582270 - RNA, 21 nt, Pseudomonas putida KT2440
ugauggugucuuccagguucu

SEQ ID NO: 3582271 - RNA, 15 nt, Pseudomonas putida KT2440
ugauguaccagaacc

SEQ ID NO: 3582272 - RNA, 14 nt, Pseudomonas putida KT2440
ugauguagucgucg

SEQ ID NO: 3582273 - RNA, 17 nt, Pseudomonas putida KT2440
ugauguagucgucgcug

SEQ ID NO: 3582274 - RNA, 15 nt, Pseudomonas putida KT2440
ugauguccgcgccag

SEQ ID NO: 3582275 - RNA, 23 nt, Pseudomonas putida KT2440
ugaugucuacccacaagcgcagg

SEQ ID NO: 3582276 - RNA, 23 nt, Pseudomonas putida KT2440
ugauguugaagaagaucaggucg

SEQ ID NO: 3582277 - RNA, 18 nt, Pseudomonas putida KT2440
ugauuacccugcgccagg

SEQ ID NO: 3582278 - RNA, 18 nt, Pseudomonas putida KT2440
ugauuggcaucgcugccc

SEQ ID NO: 3582279 - RNA, 21 nt, Pseudomonas putida KT2440
ugauuucagggucugucggug

SEQ ID NO: 3582280 - RNA, 12 nt, Pseudomonas putida KT2440
ugauuuccugca

SEQ ID NO: 3582281 - RNA, 19 nt, Pseudomonas putida KT2440
ugauuugcgcuacagcuuu

SEQ ID NO: 3582282 - RNA, 20 nt, Pseudomonas putida KT2440
ugcaaaaauguuucagcgac

SEQ ID NO: 3582283 - RNA, 13 nt, Pseudomonas putida KT2440
ugcaaacacccag

SEQ ID NO: 3582284 - RNA, 22 nt, Pseudomonas putida KT2440
ugcaaacgcaggugcgcacgcu

SEQ ID NO: 3582285 - RNA, 22 nt, Pseudomonas putida KT2440
ugcaaagcugucgcuacgcgcc

SEQ ID NO: 3582286 - RNA, 14 nt, Pseudomonas putida KT2440
ugcaaauacggcca

SEQ ID NO: 3582287 - RNA, 23 nt, Pseudomonas putida KT2440
ugcaaaugccccgggcaggccau

SEQ ID NO: 3582288 - RNA, 19 nt, Pseudomonas putida KT2440
ugcaacagaaguggagauc

SEQ ID NO: 3582289 - RNA, 16 nt, Pseudomonas putida KT2440
ugcaacagcucaucca

SEQ ID NO: 3582290 - RNA, 14 nt, Pseudomonas putida KT2440
ugcaacauguccac

SEQ ID NO: 3582291 - RNA, 19 nt, Pseudomonas putida KT2440
ugcaacccggccuuggccg

SEQ ID NO: 3582292 - RNA, 20 nt, Pseudomonas putida KT2440
ugcaacccgucagugcucgg

SEQ ID NO: 3582293 - RNA, 22 nt, Pseudomonas putida KT2440
ugcaacggcacacgcaccaccc

SEQ ID NO: 3582294 - RNA, 14 nt, Pseudomonas putida KT2440
ugcaacugccacgc

SEQ ID NO: 3582295 - RNA, 15 nt, Pseudomonas putida KT2440
ugcaacugccacgcc

SEQ ID NO: 3582296 - RNA, 22 nt, Pseudomonas putida KT2440
ugcaacugccacgcccgcugca

SEQ ID NO: 3582297 - RNA, 15 nt, Pseudomonas putida KT2440
ugcaagcagccaccc

SEQ ID NO: 3582298 - RNA, 20 nt, Pseudomonas putida KT2440
ugcaagccggcgaacagcac

SEQ ID NO: 3582299 - RNA, 11 nt, Pseudomonas putida KT2440
ugcaagccuug

SEQ ID NO: 3582300 - RNA, 19 nt, Pseudomonas putida KT2440
ugcaagccuugugggagcg

SEQ ID NO: 3582301 - RNA, 14 nt, Pseudomonas putida KT2440
ugcaaggaucacca

SEQ ID NO: 3582302 - RNA, 18 nt, Pseudomonas putida KT2440
ugcaaggaucaccaaggc

SEQ ID NO: 3582303 - RNA, 14 nt, Pseudomonas putida KT2440
ugcaaggaucauuu

SEQ ID NO: 3582304 - RNA, 16 nt, Pseudomonas putida KT2440
ugcaagguccaggcgu

SEQ ID NO: 3582305 - RNA, 17 nt, Pseudomonas putida KT2440
ugcaagucucgcgccuu

SEQ ID NO: 3582306 - RNA, 16 nt, Pseudomonas putida KT2440
ugcaagucugaaaaca

SEQ ID NO: 3582307 - RNA, 18 nt, Pseudomonas putida KT2440
ugcaauaaccaaucaacg

SEQ ID NO: 3582308 - RNA, 21 nt, Pseudomonas putida KT2440
ugcaaucagcucacaggcuca

SEQ ID NO: 3582309 - RNA, 18 nt, Pseudomonas putida KT2440
ugcaauccgaacuuaaua

SEQ ID NO: 3582310 - RNA, 22 nt, Pseudomonas putida KT2440
ugcaaucgagccgaacagcagg

SEQ ID NO: 3582311 - RNA, 23 nt, Pseudomonas putida KT2440
ugcaauggucauugaaggccagu

SEQ ID NO: 3582312 - RNA, 12 nt, Pseudomonas putida KT2440
ugcacaaagccc

SEQ ID NO: 3582313 - RNA, 18 nt, Pseudomonas putida KT2440
ugcacaacgcgcgggcaa

SEQ ID NO: 3582314 - RNA, 21 nt, Pseudomonas putida KT2440
ugcacaacgcgcgggcaaugg

SEQ ID NO: 3582315 - RNA, 14 nt, Pseudomonas putida KT2440
ugcacaaguuucaa

SEQ ID NO: 3582316 - RNA, 14 nt, Pseudomonas putida KT2440
ugcacacgcaacug

SEQ ID NO: 3582317 - RNA, 15 nt, Pseudomonas putida KT2440
ugcacacgcaacuga

SEQ ID NO: 3582318 - RNA, 15 nt, Pseudomonas putida KT2440
ugcacacgucgccug

SEQ ID NO: 3582319 - RNA, 18 nt, Pseudomonas putida KT2440
ugcacacgucgccugggc

SEQ ID NO: 3582320 - RNA, 19 nt, Pseudomonas putida KT2440
ugcacacgucgccugggca

SEQ ID NO: 3582321 - RNA, 16 nt, Pseudomonas putida KT2440
ugcacacugcccagca

SEQ ID NO: 3582322 - RNA, 21 nt, Pseudomonas putida KT2440
ugcacacugcccagcagcccc

SEQ ID NO: 3582323 - RNA, 17 nt, Pseudomonas putida KT2440
ugcacagcaucagcaca

SEQ ID NO: 3582324 - RNA, 14 nt, Pseudomonas putida KT2440
ugcacagccgugcc

SEQ ID NO: 3582325 - RNA, 21 nt, Pseudomonas putida KT2440
ugcacagccgugccuuccagc

SEQ ID NO: 3582326 - RNA, 15 nt, Pseudomonas putida KT2440
ugcacagcgagcagc

SEQ ID NO: 3582327 - RNA, 19 nt, Pseudomonas putida KT2440
ugcacagcgagcagccugg

SEQ ID NO: 3582328 - RNA, 13 nt, Pseudomonas putida KT2440
ugcacagcucccu

SEQ ID NO: 3582329 - RNA, 21 nt, Pseudomonas putida KT2440
ugcacagcucccucguaggag

SEQ ID NO: 3582330 - RNA, 23 nt, Pseudomonas putida KT2440
ugcacagcucccucguaggagcg

SEQ ID NO: 3582331 - RNA, 22 nt, Pseudomonas putida KT2440
ugcacagcucgcgcugccaggc

SEQ ID NO: 3582332 - RNA, 23 nt, Pseudomonas putida KT2440
ugcacaggccagccccagcggca

SEQ ID NO: 3582333 - RNA, 16 nt, Pseudomonas putida KT2440
ugcacagguaucgccg

SEQ ID NO: 3582334 - RNA, 17 nt, Pseudomonas putida KT2440
ugcacagguaucgccgc

SEQ ID NO: 3582335 - RNA, 21 nt, Pseudomonas putida KT2440
ugcacauacaaaaugugccgg

SEQ ID NO: 3582336 - RNA, 22 nt, Pseudomonas putida KT2440
ugcacauacaaaaugugccggc

SEQ ID NO: 3582337 - RNA, 23 nt, Pseudomonas putida KT2440
ugcacaucacgcgaccucagccg

SEQ ID NO: 3582338 - RNA, 13 nt, Pseudomonas putida KT2440
ugcaccaacacuu

SEQ ID NO: 3582339 - RNA, 10 nt, Pseudomonas putida KT2440
ugcaccaacg

SEQ ID NO: 3582340 - RNA, 21 nt, Pseudomonas putida KT2440
ugcaccaacgccgauagccag

SEQ ID NO: 3582341 - RNA, 18 nt, Pseudomonas putida KT2440
ugcaccaaugacuccgcc

SEQ ID NO: 3582342 - RNA, 19 nt, Pseudomonas putida KT2440
ugcaccaaugacuccgccc

SEQ ID NO: 3582343 - RNA, 14 nt, Pseudomonas putida KT2440
ugcaccacaugcac

SEQ ID NO: 3582344 - RNA, 18 nt, Pseudomonas putida KT2440
ugcaccacaugcacggcg

SEQ ID NO: 3582345 - RNA, 17 nt, Pseudomonas putida KT2440
ugcaccacccccagcgc

SEQ ID NO: 3582346 - RNA, 22 nt, Pseudomonas putida KT2440
ugcaccacccccagcgccucca

SEQ ID NO: 3582347 - RNA, 13 nt, Pseudomonas putida KT2440
ugcaccaccugcu

SEQ ID NO: 3582348 - RNA, 22 nt, Pseudomonas putida KT2440
ugcaccaccugcuccugguccu

SEQ ID NO: 3582349 - RNA, 20 nt, Pseudomonas putida KT2440
ugcaccacgcgcaaaugcuu

SEQ ID NO: 3582350 - RNA, 23 nt, Pseudomonas putida KT2440
ugcaccacgcgcaaaugcuugcc

SEQ ID NO: 3582351 - RNA, 18 nt, Pseudomonas putida KT2440
ugcaccacggucggccug

SEQ ID NO: 3582352 - RNA, 13 nt, Pseudomonas putida KT2440
ugcagcgccaguu

SEQ ID NO: 3582353 - RNA, 20 nt, Pseudomonas putida KT2440
ugcagcgccgcauccagcac

SEQ ID NO: 3582354 - RNA, 17 nt, Pseudomonas putida KT2440
ugcagcgccugugagau

SEQ ID NO: 3582355 - RNA, 22 nt, Pseudomonas putida KT2440
ugcagcgcgucauccgccaaca

SEQ ID NO: 3582356 - RNA, 21 nt, Pseudomonas putida KT2440
ugcagcggauugaaacugccc

SEQ ID NO: 3582357 - RNA, 20 nt, Pseudomonas putida KT2440
ugcagcgucgccucggggua

SEQ ID NO: 3582358 - RNA, 22 nt, Pseudomonas putida KT2440
ugcagcgucgccucgggguaga

SEQ ID NO: 3582359 - RNA, 13 nt, Pseudomonas putida KT2440
ugcagcguggccu

SEQ ID NO: 3582360 - RNA, 16 nt, Pseudomonas putida KT2440
ugcagcucagccagca

SEQ ID NO: 3582361 - RNA, 14 nt, Pseudomonas putida KT2440
ugcagcucuugucg

SEQ ID NO: 3582362 - RNA, 19 nt, Pseudomonas putida KT2440
ugcagcuucccggccuggc

SEQ ID NO: 3582363 - RNA, 16 nt, Pseudomonas putida KT2440
ugcagcuuugaggcuc

SEQ ID NO: 3582364 - RNA, 14 nt, Pseudomonas putida KT2440
ugcaggagcggcuu

SEQ ID NO: 3582365 - RNA, 13 nt, Pseudomonas putida KT2440
ugcaggagcgggc

SEQ ID NO: 3582366 - RNA, 18 nt, Pseudomonas putida KT2440
ugcaggcaguaggccacc

SEQ ID NO: 3582367 - RNA, 14 nt, Pseudomonas putida KT2440
ugcaggccagcguc

SEQ ID NO: 3582368 - RNA, 13 nt, Pseudomonas putida KT2440
ugcaggcccaggu

SEQ ID NO: 3582369 - RNA, 19 nt, Pseudomonas putida KT2440
ugcaggcgcacauccacau

SEQ ID NO: 3582370 - RNA, 19 nt, Pseudomonas putida KT2440
ugcaggcgcaggcucucca

SEQ ID NO: 3582371 - RNA, 22 nt, Pseudomonas putida KT2440
ugcaggcgcggugccggcagcu

SEQ ID NO: 3582372 - RNA, 17 nt, Pseudomonas putida KT2440
ugcaggcgcuccaucau

SEQ ID NO: 3582373 - RNA, 19 nt, Pseudomonas putida KT2440
ugcaggcggcgacaaccga

SEQ ID NO: 3582374 - RNA, 21 nt, Pseudomonas putida KT2440
ugcaggcguaacucagcaacg

SEQ ID NO: 3582375 - RNA, 12 nt, Pseudomonas putida KT2440
ugcaggcguucg

SEQ ID NO: 3582376 - RNA, 14 nt, Pseudomonas putida KT2440
ugcaggcucggcca

SEQ ID NO: 3582377 - RNA, 19 nt, Pseudomonas putida KT2440
ugcaggcucggccaccacu

SEQ ID NO: 3582378 - RNA, 17 nt, Pseudomonas putida KT2440
ugcagggaacugcgcga

SEQ ID NO: 3582379 - RNA, 14 nt, Pseudomonas putida KT2440
ugcagggaagggca

SEQ ID NO: 3582380 - RNA, 13 nt, Pseudomonas putida KT2440
ugcagggccugga

SEQ ID NO: 3582381 - RNA, 20 nt, Pseudomonas putida KT2440
ugcagggccuggacgcgugc

SEQ ID NO: 3582382 - RNA, 21 nt, Pseudomonas putida KT2440
ugcagggcgccgaugaguugu

SEQ ID NO: 3582383 - RNA, 23 nt, Pseudomonas putida KT2440
ugcagggggguaaggcuggcuua

SEQ ID NO: 3582384 - RNA, 20 nt, Pseudomonas putida KT2440
ugcagguaaugcgccgcacc

SEQ ID NO: 3582385 - RNA, 15 nt, Pseudomonas putida KT2440
ugcagguacagcagc

SEQ ID NO: 3582386 - RNA, 19 nt, Pseudomonas putida KT2440
ugcaggucgaccugccagu

SEQ ID NO: 3582387 - RNA, 15 nt, Pseudomonas putida KT2440
ugcaggucgacgauc

SEQ ID NO: 3582388 - RNA, 22 nt, Pseudomonas putida KT2440
ugcaggucgacgaucgccgcca

SEQ ID NO: 3582389 - RNA, 17 nt, Pseudomonas putida KT2440
ugcaggucgauguccag

SEQ ID NO: 3582390 - RNA, 19 nt, Pseudomonas putida KT2440
ugcaggucgauguccaggc

SEQ ID NO: 3582391 - RNA, 14 nt, Pseudomonas putida KT2440
ugcaggucggccag

SEQ ID NO: 3582392 - RNA, 15 nt, Pseudomonas putida KT2440
ugcaggucggccagc

SEQ ID NO: 3582393 - RNA, 17 nt, Pseudomonas putida KT2440
ugcaggugcagggugcc

SEQ ID NO: 3582394 - RNA, 22 nt, Pseudomonas putida KT2440
ugcagguggugguccccuucgu

SEQ ID NO: 3582395 - RNA, 14 nt, Pseudomonas putida KT2440
ugcagguucugaau

SEQ ID NO: 3582396 - RNA, 12 nt, Pseudomonas putida KT2440
ugcaguaucgcc

SEQ ID NO: 3582397 - RNA, 14 nt, Pseudomonas putida KT2440
ugcaguaucgcccc

SEQ ID NO: 3582398 - RNA, 22 nt, Pseudomonas putida KT2440
ugcaguaucgccccggucagca

SEQ ID NO: 3582399 - RNA, 16 nt, Pseudomonas putida KT2440
ugcagucaaagccuuu

SEQ ID NO: 3582400 - RNA, 17 nt, Pseudomonas putida KT2440
ugcagucaccuggccca

SEQ ID NO: 3582401 - RNA, 18 nt, Pseudomonas putida KT2440
ugcagucgaccgggcaga

SEQ ID NO: 3582402 - RNA, 17 nt, Pseudomonas putida KT2440
ugcagucguuguccagg

SEQ ID NO: 3582403 - RNA, 20 nt, Pseudomonas putida KT2440
ugcagugaagaauucaggca

SEQ ID NO: 3582404 - RNA, 14 nt, Pseudomonas putida KT2440
ugcagugcccgcga

SEQ ID NO: 3582405 - RNA, 16 nt, Pseudomonas putida KT2440
ugcagugccucacgca

SEQ ID NO: 3582406 - RNA, 19 nt, Pseudomonas putida KT2440
ugcagugguugugcuggcc

SEQ ID NO: 3582407 - RNA, 22 nt, Pseudomonas putida KT2440
ugcaguucgcugcgcaaggcau

SEQ ID NO: 3582408 - RNA, 22 nt, Pseudomonas putida KT2440
ugcaguucuugauccaguagcc

SEQ ID NO: 3582409 - RNA, 11 nt, Pseudomonas putida KT2440
ugcaguugagc

SEQ ID NO: 3582410 - RNA, 18 nt, Pseudomonas putida KT2440
ugcauaagcgacacccug

SEQ ID NO: 3582411 - RNA, 23 nt, Pseudomonas putida KT2440
ugcauaggugucgaacaccaccg

SEQ ID NO: 3582412 - RNA, 14 nt, Pseudomonas putida KT2440
ugcaucaaauuuag

SEQ ID NO: 3582413 - RNA, 16 nt, Pseudomonas putida KT2440
ugcaucauucgcgcca

SEQ ID NO: 3582414 - RNA, 17 nt, Pseudomonas putida KT2440
ugcauccacaccagcgg

SEQ ID NO: 3582415 - RNA, 21 nt, Pseudomonas putida KT2440
ugcauccgccaugggccugca

SEQ ID NO: 3582416 - RNA, 15 nt, Pseudomonas putida KT2440
ugcauccugcacugc

SEQ ID NO: 3582417 - RNA, 16 nt, Pseudomonas putida KT2440
ugcauccugcacugca

SEQ ID NO: 3582418 - RNA, 22 nt, Pseudomonas putida KT2440
ugcauccugcacugcaacaccg

SEQ ID NO: 3582419 - RNA, 18 nt, Pseudomonas putida KT2440
ugcaucgcgcacuugcca

SEQ ID NO: 3582420 - RNA, 17 nt, Pseudomonas putida KT2440
ugcaucgucacauccug

SEQ ID NO: 3582421 - RNA, 19 nt, Pseudomonas putida KT2440
ugcaucugcgccccgcucg

SEQ ID NO: 3582422 - RNA, 15 nt, Pseudomonas putida KT2440
ugcaugcaagcagcc

SEQ ID NO: 3582423 - RNA, 17 nt, Pseudomonas putida KT2440
ugcaugcaagcagccac

SEQ ID NO: 3582424 - RNA, 18 nt, Pseudomonas putida KT2440
ugcaugcaagcagccacc

SEQ ID NO: 3582425 - RNA, 19 nt, Pseudomonas putida KT2440
ugcaugcguugcacgugca

SEQ ID NO: 3582426 - RNA, 21 nt, Pseudomonas putida KT2440
ugcaugcucaucgcggccgaa

SEQ ID NO: 3582427 - RNA, 17 nt, Pseudomonas putida KT2440
ugcauggcucgcagcca

SEQ ID NO: 3582428 - RNA, 15 nt, Pseudomonas putida KT2440
ugcaugggccaggga

SEQ ID NO: 3582429 - RNA, 18 nt, Pseudomonas putida KT2440
ugcauggguuguggcuug

SEQ ID NO: 3582430 - RNA, 14 nt, Pseudomonas putida KT2440
ugcauguccaguca

SEQ ID NO: 3582431 - RNA, 15 nt, Pseudomonas putida KT2440
ugcauguccugaagc

SEQ ID NO: 3582432 - RNA, 15 nt, Pseudomonas putida KT2440
ugcaugugccgcucg

SEQ ID NO: 3582433 - RNA, 18 nt, Pseudomonas putida KT2440
ugcauucugccucaauac

SEQ ID NO: 3582434 - RNA, 14 nt, Pseudomonas putida KT2440
ugcauugcagcccc

SEQ ID NO: 3582435 - RNA, 22 nt, Pseudomonas putida KT2440
ugcauugcgcgucacugcaccu

SEQ ID NO: 3582436 - RNA, 21 nt, Pseudomonas putida KT2440
ugcauuggcggcaggcgcagc

SEQ ID NO: 3582437 - RNA, 15 nt, Pseudomonas putida KT2440
ugcauuuaacggcug

SEQ ID NO: 3582438 - RNA, 19 nt, Pseudomonas putida KT2440
ugcauuucgucgagcucga

SEQ ID NO: 3582439 - RNA, 22 nt, Pseudomonas putida KT2440
ugcauuuucggcaaggcgaccu

SEQ ID NO: 3582440 - RNA, 19 nt, Pseudomonas putida KT2440
ugccaaagaaggacucggc

SEQ ID NO: 3582441 - RNA, 22 nt, Pseudomonas putida KT2440
ugccaaaucccuuugcccgcca

SEQ ID NO: 3582442 - RNA, 21 nt, Pseudomonas putida KT2440
ugccaacagcaguugcugcug

SEQ ID NO: 3582443 - RNA, 15 nt, Pseudomonas putida KT2440
ugccaacaggcagca

SEQ ID NO: 3582444 - RNA, 16 nt, Pseudomonas putida KT2440
ugccaacaggcagcau

SEQ ID NO: 3582445 - RNA, 13 nt, Pseudomonas putida KT2440
ugccaacgcaccg

SEQ ID NO: 3582446 - RNA, 13 nt, Pseudomonas putida KT2440
ugccaacgggaua

SEQ ID NO: 3582447 - RNA, 23 nt, Pseudomonas putida KT2440
ugccaaggaucagcucggcaacg

SEQ ID NO: 3582448 - RNA, 20 nt, Pseudomonas putida KT2440
ugccaauaaccggcacaagc

SEQ ID NO: 3582449 - RNA, 14 nt, Pseudomonas putida KT2440
ugccaauuuccaua

SEQ ID NO: 3582450 - RNA, 20 nt, Pseudomonas putida KT2440
ugccaauuuccauaccaaug

SEQ ID NO: 3582451 - RNA, 18 nt, Pseudomonas putida KT2440
ugccacacacccgggccc

SEQ ID NO: 3582452 - RNA, 20 nt, Pseudomonas putida KT2440
ugccaccacccggggcagca

SEQ ID NO: 3582453 - RNA, 22 nt, Pseudomonas putida KT2440
ugccaccacccggggcagcauc

SEQ ID NO: 3582454 - RNA, 13 nt, Pseudomonas putida KT2440
ugccaccagcauc

SEQ ID NO: 3582455 - RNA, 19 nt, Pseudomonas putida KT2440
ugccaccagcaucaacagg

SEQ ID NO: 3582456 - RNA, 16 nt, Pseudomonas putida KT2440
ugccaccaucgaccug

SEQ ID NO: 3582457 - RNA, 22 nt, Pseudomonas putida KT2440
ugcccagcgccaccggcagcaa

SEQ ID NO: 3582458 - RNA, 12 nt, Pseudomonas putida KT2440
ugcccagcucca

SEQ ID NO: 3582459 - RNA, 18 nt, Pseudomonas putida KT2440
ugcccagcuccagcaccu

SEQ ID NO: 3582460 - RNA, 14 nt, Pseudomonas putida KT2440
ugcccagcucgcug

SEQ ID NO: 3582461 - RNA, 16 nt, Pseudomonas putida KT2440
ugcccagcucgcuggc

SEQ ID NO: 3582462 - RNA, 23 nt, Pseudomonas putida KT2440
ugcccagcugaagugccaaggcu

SEQ ID NO: 3582463 - RNA, 17 nt, Pseudomonas putida KT2440
ugcccaggaucacuggc

SEQ ID NO: 3582464 - RNA, 18 nt, Pseudomonas putida KT2440
ugcccaggaucacuggcc

SEQ ID NO: 3582465 - RNA, 19 nt, Pseudomonas putida KT2440
ugcccaggaucacuggccu

SEQ ID NO: 3582466 - RNA, 17 nt, Pseudomonas putida KT2440
ugcccagggcugcuuca

SEQ ID NO: 3582467 - RNA, 16 nt, Pseudomonas putida KT2440
ugcccaggugccaggc

SEQ ID NO: 3582468 - RNA, 22 nt, Pseudomonas putida KT2440
ugcccauaaaagccucagcgcc

SEQ ID NO: 3582469 - RNA, 22 nt, Pseudomonas putida KT2440
ugcccaugaucuugcugccguc

SEQ ID NO: 3582470 - RNA, 14 nt, Pseudomonas putida KT2440
ugcccaugccaagc

SEQ ID NO: 3582471 - RNA, 19 nt, Pseudomonas putida KT2440
ugcccaugccaagcccaca

SEQ ID NO: 3582472 - RNA, 13 nt, Pseudomonas putida KT2440
ugcccauggccag

SEQ ID NO: 3582473 - RNA, 14 nt, Pseudomonas putida KT2440
ugcccauggccagg

SEQ ID NO: 3582474 - RNA, 18 nt, Pseudomonas putida KT2440
ugcccauuccugaaguga

SEQ ID NO: 3582475 - RNA, 23 nt, Pseudomonas putida KT2440
ugcccauuucugcauguccagcc

SEQ ID NO: 3582476 - RNA, 20 nt, Pseudomonas putida KT2440
ugccccaaacggaccgcaua

SEQ ID NO: 3582477 - RNA, 14 nt, Pseudomonas putida KT2440
ugccccacucggcg

SEQ ID NO: 3582478 - RNA, 21 nt, Pseudomonas putida KT2440
ugccccagcaucaacgcugcc

SEQ ID NO: 3582479 - RNA, 22 nt, Pseudomonas putida KT2440
ugccccagcaucaacgcugcca

SEQ ID NO: 3582480 - RNA, 13 nt, Pseudomonas putida KT2440
ugccccaggccca

SEQ ID NO: 3582481 - RNA, 14 nt, Pseudomonas putida KT2440
ugcccccgccgaag

SEQ ID NO: 3582482 - RNA, 17 nt, Pseudomonas putida KT2440
ugcccccgccgaagcca

SEQ ID NO: 3582483 - RNA, 21 nt, Pseudomonas putida KT2440
ugccccgaauugguaguuccu

SEQ ID NO: 3582484 - RNA, 20 nt, Pseudomonas putida KT2440
ugccccgaccaccgccucga

SEQ ID NO: 3582485 - RNA, 19 nt, Pseudomonas putida KT2440
ugccccgaguaacccuggc

SEQ ID NO: 3582486 - RNA, 15 nt, Pseudomonas putida KT2440
ugccccgggcaggcc

SEQ ID NO: 3582487 - RNA, 16 nt, Pseudomonas putida KT2440
ugccccgguccagcac

SEQ ID NO: 3582488 - RNA, 19 nt, Pseudomonas putida KT2440
ugccccgguccagcacacu

SEQ ID NO: 3582489 - RNA, 19 nt, Pseudomonas putida KT2440
ugccccuaccgccaacgaa

SEQ ID NO: 3582490 - RNA, 18 nt, Pseudomonas putida KT2440
ugccccucaaugcugccu

SEQ ID NO: 3582491 - RNA, 23 nt, Pseudomonas putida KT2440
ugccccugaucauccacaaucag

SEQ ID NO: 3582492 - RNA, 12 nt, Pseudomonas putida KT2440
ugccccuggccc

SEQ ID NO: 3582493 - RNA, 22 nt, Pseudomonas putida KT2440
ugccccuggcccaucucaauga

SEQ ID NO: 3582494 - RNA, 19 nt, Pseudomonas putida KT2440
ugccccuguaggaucgggu

SEQ ID NO: 3582495 - RNA, 13 nt, Pseudomonas putida KT2440
ugccccuguucca

SEQ ID NO: 3582496 - RNA, 21 nt, Pseudomonas putida KT2440
ugcccgacaccggccuugcgc

SEQ ID NO: 3582497 - RNA, 14 nt, Pseudomonas putida KT2440
ugcccgacaccuca

SEQ ID NO: 3582498 - RNA, 13 nt, Pseudomonas putida KT2440
ugcccgaucaccg

SEQ ID NO: 3582499 - RNA, 18 nt, Pseudomonas putida KT2440
ugcccgaucgccucgcug

SEQ ID NO: 3582500 - RNA, 13 nt, Pseudomonas putida KT2440
ugcccgaucgggu

SEQ ID NO: 3582501 - RNA, 24 nt, Pseudomonas putida KT2440
ugcccgcagcaacugugucucgaa

SEQ ID NO: 3582502 - RNA, 23 nt, Pseudomonas putida KT2440
ugcccgcagcuucaacuccacca

SEQ ID NO: 3582503 - RNA, 16 nt, Pseudomonas putida KT2440
ugcccgcaggugcggc

SEQ ID NO: 3582504 - RNA, 19 nt, Pseudomonas putida KT2440
ugcccgcaugcaacccgca

SEQ ID NO: 3582505 - RNA, 13 nt, Pseudomonas putida KT2440
ugcccgccacacc

SEQ ID NO: 3582506 - RNA, 16 nt, Pseudomonas putida KT2440
ugcccgccaggcgcaa

SEQ ID NO: 3582507 - RNA, 17 nt, Pseudomonas putida KT2440
ugcccgcccacgccgcu

SEQ ID NO: 3582508 - RNA, 18 nt, Pseudomonas putida KT2440
ugcccgcccacgccgcug

SEQ ID NO: 3582509 - RNA, 14 nt, Pseudomonas putida KT2440
ugcccgccccugcc

SEQ ID NO: 3582510 - RNA, 21 nt, Pseudomonas putida KT2440
ugcccgccccugccagcacca

SEQ ID NO: 3582511 - RNA, 22 nt, Pseudomonas putida KT2440
ugcccgccccugccagcaccag

SEQ ID NO: 3582512 - RNA, 15 nt, Pseudomonas putida KT2440
ugcccgcgaacacgg

SEQ ID NO: 3582513 - RNA, 15 nt, Pseudomonas putida KT2440
ugcccgcgaagaauu

SEQ ID NO: 3582514 - RNA, 22 nt, Pseudomonas putida KT2440
ugcccgcgaagaggccagcaca

SEQ ID NO: 3582515 - RNA, 22 nt, Pseudomonas putida KT2440
ugcccgcgaagaggccggcaca

SEQ ID NO: 3582516 - RNA, 22 nt, Pseudomonas putida KT2440
ugcccgcgaagaggccgguaca

SEQ ID NO: 3582517 - RNA, 17 nt, Pseudomonas putida KT2440
ugcccgcgaaggcucca

SEQ ID NO: 3582518 - RNA, 14 nt, Pseudomonas putida KT2440
ugcccgcgaagggc

SEQ ID NO: 3582519 - RNA, 18 nt, Pseudomonas putida KT2440
ugcccgcgaagggccgca

SEQ ID NO: 3582520 - RNA, 21 nt, Pseudomonas putida KT2440
ugcccgcgaagggcucaacac

SEQ ID NO: 3582521 - RNA, 21 nt, Pseudomonas putida KT2440
ugcccgcgaagggcugccgcg

SEQ ID NO: 3582522 - RNA, 22 nt, Pseudomonas putida KT2440
ugcccgcgaaggggccggcaca

SEQ ID NO: 3582523 - RNA, 16 nt, Pseudomonas putida KT2440
ugcccgcgaauagccg

SEQ ID NO: 3582524 - RNA, 20 nt, Pseudomonas putida KT2440
ugcccgcgaauggccuuuac

SEQ ID NO: 3582525 - RNA, 15 nt, Pseudomonas putida KT2440
ugcccgcgaguccuc

SEQ ID NO: 3582526 - RNA, 19 nt, Pseudomonas putida KT2440
ugcccgcgauagcaaaccg

SEQ ID NO: 3582527 - RNA, 21 nt, Pseudomonas putida KT2440
ugcccgcggcucacccaccag

SEQ ID NO: 3582528 - RNA, 18 nt, Pseudomonas putida KT2440
ugcccgcguacucggcca

SEQ ID NO: 3582529 - RNA, 20 nt, Pseudomonas putida KT2440
ugcccgcucccacaggucca

SEQ ID NO: 3582530 - RNA, 22 nt, Pseudomonas putida KT2440
ugcccgcucccacagguccagc

SEQ ID NO: 3582531 - RNA, 15 nt, Pseudomonas putida KT2440
ugcccgcucgcugcg

SEQ ID NO: 3582532 - RNA, 18 nt, Pseudomonas putida KT2440
ugcccgcucucacaggga

SEQ ID NO: 3582533 - RNA, 15 nt, Pseudomonas putida KT2440
ugcccgcugcauagg

SEQ ID NO: 3582534 - RNA, 17 nt, Pseudomonas putida KT2440
ugcccgcuguugagcag

SEQ ID NO: 3582535 - RNA, 19 nt, Pseudomonas putida KT2440
ugcccgcuguugagcagca

SEQ ID NO: 3582536 - RNA, 19 nt, Pseudomonas putida KT2440
ugcccggcaaucgccaggc

SEQ ID NO: 3582537 - RNA, 21 nt, Pseudomonas putida KT2440
ugcccggcagguugcuggccu

SEQ ID NO: 3582538 - RNA, 13 nt, Pseudomonas putida KT2440
ugcccggccagca

SEQ ID NO: 3582539 - RNA, 15 nt, Pseudomonas putida KT2440
ugcccggccagcagg

SEQ ID NO: 3582540 - RNA, 15 nt, Pseudomonas putida KT2440
ugcccggccagcgau

SEQ ID NO: 3582541 - RNA, 16 nt, Pseudomonas putida KT2440
ugcccggccagcgaua

SEQ ID NO: 3582542 - RNA, 15 nt, Pseudomonas putida KT2440
ugcccggcgcgcgcg

SEQ ID NO: 3582543 - RNA, 19 nt, Pseudomonas putida KT2440
ugcccggcgcgcgcgaccg

SEQ ID NO: 3582544 - RNA, 20 nt, Pseudomonas putida KT2440
ugcccggcguucaggcgcgu

SEQ ID NO: 3582545 - RNA, 16 nt, Pseudomonas putida KT2440
ugcccggcucaccgca

SEQ ID NO: 3582546 - RNA, 19 nt, Pseudomonas putida KT2440
ugcccggcucaccgcagcc

SEQ ID NO: 3582547 - RNA, 18 nt, Pseudomonas putida KT2440
ugcccgggaacggcugcc

SEQ ID NO: 3582548 - RNA, 19 nt, Pseudomonas putida KT2440
ugcccgggccgcuugcuca

SEQ ID NO: 3582549 - RNA, 20 nt, Pseudomonas putida KT2440
ugcccgggccgcuugcucag

SEQ ID NO: 3582550 - RNA, 22 nt, Pseudomonas putida KT2440
ugcccgggccgcuugcucaggc

SEQ ID NO: 3582551 - RNA, 14 nt, Pseudomonas putida KT2440
ugcccgggcgcggu

SEQ ID NO: 3582552 - RNA, 14 nt, Pseudomonas putida KT2440
ugcccguaggagcg

SEQ ID NO: 3582553 - RNA, 17 nt, Pseudomonas putida KT2440
ugcccguaggagcgggu

SEQ ID NO: 3582554 - RNA, 13 nt, Pseudomonas putida KT2440
ugcccgucaucga

SEQ ID NO: 3582555 - RNA, 21 nt, Pseudomonas putida KT2440
ugcccgugacuaguggccacu

SEQ ID NO: 3582556 - RNA, 15 nt, Pseudomonas putida KT2440
ugcccgugguacacg

SEQ ID NO: 3582557 - RNA, 23 nt, Pseudomonas putida KT2440
ugcccguugaggguggcaaugcu

SEQ ID NO: 3582558 - RNA, 21 nt, Pseudomonas putida KT2440
ugcccucauucgcccgcaccg

SEQ ID NO: 3582559 - RNA, 17 nt, Pseudomonas putida KT2440
ugcccucggccaccugg

SEQ ID NO: 3582560 - RNA, 17 nt, Pseudomonas putida KT2440
ugcccucggccggggcc

SEQ ID NO: 3582561 - RNA, 17 nt, Pseudomonas putida KT2440
ugcccugaucgccucca

SEQ ID NO: 3582562 - RNA, 15 nt, Pseudomonas putida KT2440
ugccgucgagcaggu

SEQ ID NO: 3582563 - RNA, 13 nt, Pseudomonas putida KT2440
ugccgucucguca

SEQ ID NO: 3582564 - RNA, 22 nt, Pseudomonas putida KT2440
ugccgugaagacgcacacuccc

SEQ ID NO: 3582565 - RNA, 17 nt, Pseudomonas putida KT2440
ugccgugaguggccucg

SEQ ID NO: 3582566 - RNA, 18 nt, Pseudomonas putida KT2440
ugccgugaucgccgggcg

SEQ ID NO: 3582567 - RNA, 20 nt, Pseudomonas putida KT2440
ugccgugaucgccgggcgca

SEQ ID NO: 3582568 - RNA, 16 nt, Pseudomonas putida KT2440
ugccgugcaggucagc

SEQ ID NO: 3582569 - RNA, 17 nt, Pseudomonas putida KT2440
ugccgugcaggucagcg

SEQ ID NO: 3582570 - RNA, 23 nt, Pseudomonas putida KT2440
ugccguuguucggcaaaggccuc

SEQ ID NO: 3582571 - RNA, 23 nt, Pseudomonas putida KT2440
ugccguuuauugguuugacgcug

SEQ ID NO: 3582572 - RNA, 14 nt, Pseudomonas putida KT2440
ugccguuugcuggc

SEQ ID NO: 3582573 - RNA, 23 nt, Pseudomonas putida KT2440
ugccguuuuuuuugcccgugacu

SEQ ID NO: 3582574 - RNA, 15 nt, Pseudomonas putida KT2440
ugccuacccaggcaa

SEQ ID NO: 3582575 - RNA, 23 nt, Pseudomonas putida KT2440
ugccuagauaagcgacaaaggcg

SEQ ID NO: 3582576 - RNA, 20 nt, Pseudomonas putida KT2440
ugccucaagaaauugcaggg

SEQ ID NO: 3582577 - RNA, 16 nt, Pseudomonas putida KT2440
ugccucgcccagguca

SEQ ID NO: 3582578 - RNA, 16 nt, Pseudomonas putida KT2440
ugccucgcgcauggcc

SEQ ID NO: 3582579 - RNA, 14 nt, Pseudomonas putida KT2440
ugccugaccgguca

SEQ ID NO: 3582580 - RNA, 19 nt, Pseudomonas putida KT2440
ugccugaccggucagcccg

SEQ ID NO: 3582581 - RNA, 16 nt, Pseudomonas putida KT2440
ugccugauugccuggc

SEQ ID NO: 3582582 - RNA, 23 nt, Pseudomonas putida KT2440
ugccugcacggcaaaguccagca

SEQ ID NO: 3582583 - RNA, 17 nt, Pseudomonas putida KT2440
ugccugcacugggcgaa

SEQ ID NO: 3582584 - RNA, 23 nt, Pseudomonas putida KT2440
ugccugcagcccggcaaacucca

SEQ ID NO: 3582585 - RNA, 14 nt, Pseudomonas putida KT2440
ugccugccagaauc

SEQ ID NO: 3582586 - RNA, 17 nt, Pseudomonas putida KT2440
ugccugcgaauggccgc

SEQ ID NO: 3582587 - RNA, 16 nt, Pseudomonas putida KT2440
ugccugcugcaacagc

SEQ ID NO: 3582588 - RNA, 17 nt, Pseudomonas putida KT2440
ugccugcugcaacagcu

SEQ ID NO: 3582589 - RNA, 23 nt, Pseudomonas putida KT2440
ugccugcugcaacagcucaucca

SEQ ID NO: 3582590 - RNA, 12 nt, Pseudomonas putida KT2440
ugccugcugcuc

SEQ ID NO: 3582591 - RNA, 17 nt, Pseudomonas putida KT2440
ugccuggaauuccugcc

SEQ ID NO: 3582592 - RNA, 21 nt, Pseudomonas putida KT2440
ugccuggccacuguugcagcg

SEQ ID NO: 3582593 - RNA, 18 nt, Pseudomonas putida KT2440
ugccuggcccucugcgug

SEQ ID NO: 3582594 - RNA, 16 nt, Pseudomonas putida KT2440
ugccuggcgcuugauc

SEQ ID NO: 3582595 - RNA, 17 nt, Pseudomonas putida KT2440
ugccugggauuugugca

SEQ ID NO: 3582596 - RNA, 24 nt, Pseudomonas putida KT2440
ugccugggccggugggcaacagcu

SEQ ID NO: 3582597 - RNA, 14 nt, Pseudomonas putida KT2440
ugccuggggcucga

SEQ ID NO: 3582598 - RNA, 19 nt, Pseudomonas putida KT2440
ugccuggggguggguugac

SEQ ID NO: 3582599 - RNA, 15 nt, Pseudomonas putida KT2440
ugccugggucagcuc

SEQ ID NO: 3582600 - RNA, 21 nt, Pseudomonas putida KT2440
ugccugggugguaucugccga

SEQ ID NO: 3582601 - RNA, 14 nt, Pseudomonas putida KT2440
ugccuguaggcgcg

SEQ ID NO: 3582602 - RNA, 17 nt, Pseudomonas putida KT2440
ugccuguaggcgcgggu

SEQ ID NO: 3582603 - RNA, 15 nt, Pseudomonas putida KT2440
ugccugucaguuccu

SEQ ID NO: 3582604 - RNA, 18 nt, Pseudomonas putida KT2440
ugccugucgucagcucag

SEQ ID NO: 3582605 - RNA, 15 nt, Pseudomonas putida KT2440
ugccugugcuggccu

SEQ ID NO: 3582606 - RNA, 13 nt, Pseudomonas putida KT2440
ugccugugucgaa

SEQ ID NO: 3582607 - RNA, 17 nt, Pseudomonas putida KT2440
ugccuucaggcgcuggu

SEQ ID NO: 3582608 - RNA, 12 nt, Pseudomonas putida KT2440
ugccuucagggg

SEQ ID NO: 3582609 - RNA, 14 nt, Pseudomonas putida KT2440
ugccuuccgccauu

SEQ ID NO: 3582610 - RNA, 14 nt, Pseudomonas putida KT2440
ugccuuccucggcc

SEQ ID NO: 3582611 - RNA, 16 nt, Pseudomonas putida KT2440
ugccuuccucggccau

SEQ ID NO: 3582612 - RNA, 18 nt, Pseudomonas putida KT2440
ugccuuccugcaccuugu

SEQ ID NO: 3582613 - RNA, 22 nt, Pseudomonas putida KT2440
ugccuucggccacacgggcguu

SEQ ID NO: 3582614 - RNA, 17 nt, Pseudomonas putida KT2440
ugccuugcccagcucca

SEQ ID NO: 3582615 - RNA, 18 nt, Pseudomonas putida KT2440
ugccuugcccagcuccag

SEQ ID NO: 3582616 - RNA, 12 nt, Pseudomonas putida KT2440
ugccuugcccug

SEQ ID NO: 3582617 - RNA, 13 nt, Pseudomonas putida KT2440
ugccuugcccugc

SEQ ID NO: 3582618 - RNA, 14 nt, Pseudomonas putida KT2440
ugccuugcccugca

SEQ ID NO: 3582619 - RNA, 24 nt, Pseudomonas putida KT2440
ugccuugcgauaccccgcugccug

SEQ ID NO: 3582620 - RNA, 17 nt, Pseudomonas putida KT2440
ugccuuuuuuugccgca

SEQ ID NO: 3582621 - RNA, 22 nt, Pseudomonas putida KT2440
ugcgaaacgaaacccugcuggg

SEQ ID NO: 3582622 - RNA, 13 nt, Pseudomonas putida KT2440
ugcgaacugcaga

SEQ ID NO: 3582623 - RNA, 16 nt, Pseudomonas putida KT2440
ugcgaacugcagagcc

SEQ ID NO: 3582624 - RNA, 18 nt, Pseudomonas putida KT2440
ugcgaacugcagagccug

SEQ ID NO: 3582625 - RNA, 12 nt, Pseudomonas putida KT2440
ugcgaagcggcc

SEQ ID NO: 3582626 - RNA, 15 nt, Pseudomonas putida KT2440
ugcgaagcggccuga

SEQ ID NO: 3582627 - RNA, 13 nt, Pseudomonas putida KT2440
ugcgaaucugcau

SEQ ID NO: 3582628 - RNA, 16 nt, Pseudomonas putida KT2440
ugcgaaucugcauggc

SEQ ID NO: 3582629 - RNA, 23 nt, Pseudomonas putida KT2440
ugcgacacgcgaaucgccagggc

SEQ ID NO: 3582630 - RNA, 22 nt, Pseudomonas putida KT2440
ugcgaccaguaccgcgccucca

SEQ ID NO: 3582631 - RNA, 15 nt, Pseudomonas putida KT2440
ugcgacccgcuggcc

SEQ ID NO: 3582632 - RNA, 13 nt, Pseudomonas putida KT2440
ugcgaccgaugcc

SEQ ID NO: 3582633 - RNA, 24 nt, Pseudomonas putida KT2440
ugcgaccgaugcccaacauaucgc

SEQ ID NO: 3582634 - RNA, 16 nt, Pseudomonas putida KT2440
ugcgacugaggcaccg

SEQ ID NO: 3582635 - RNA, 20 nt, Pseudomonas putida KT2440
ugcgagacgcaaaaaacccg

SEQ ID NO: 3582636 - RNA, 23 nt, Pseudomonas putida KT2440
ugcgagacgccaccaagcccuuc

SEQ ID NO: 3582637 - RNA, 15 nt, Pseudomonas putida KT2440
ugcgagaggcgcuuu

SEQ ID NO: 3582638 - RNA, 15 nt, Pseudomonas putida KT2440
ugcgagcgcgggcag

SEQ ID NO: 3582639 - RNA, 17 nt, Pseudomonas putida KT2440
ugcgaggaucagcgcau

SEQ ID NO: 3582640 - RNA, 14 nt, Pseudomonas putida KT2440
ugcgagucgaucga

SEQ ID NO: 3582641 - RNA, 20 nt, Pseudomonas putida KT2440
ugcgaguucaggcgcccugc

SEQ ID NO: 3582642 - RNA, 18 nt, Pseudomonas putida KT2440
ugcgauagauguccagcg

SEQ ID NO: 3582643 - RNA, 19 nt, Pseudomonas putida KT2440
ugcgaucaguaaucugccg

SEQ ID NO: 3582644 - RNA, 20 nt, Pseudomonas putida KT2440
ugcgauccgccccauagccu

SEQ ID NO: 3582645 - RNA, 15 nt, Pseudomonas putida KT2440
ugcgaucgaaaucag

SEQ ID NO: 3582646 - RNA, 21 nt, Pseudomonas putida KT2440
ugcgauggaggcgccgggcuc

SEQ ID NO: 3582647 - RNA, 17 nt, Pseudomonas putida KT2440
ugcgaugggcugcaaag

SEQ ID NO: 3582648 - RNA, 18 nt, Pseudomonas putida KT2440
ugcgaugguacagcucac

SEQ ID NO: 3582649 - RNA, 21 nt, Pseudomonas putida KT2440
ugcgauguaucagcgccucca

SEQ ID NO: 3582650 - RNA, 15 nt, Pseudomonas putida KT2440
ugcgauguugaucag

SEQ ID NO: 3582651 - RNA, 19 nt, Pseudomonas putida KT2440
ugcgcaaaucuuguaggcg

SEQ ID NO: 3582652 - RNA, 15 nt, Pseudomonas putida KT2440
ugcgcaaccgauagc

SEQ ID NO: 3582653 - RNA, 15 nt, Pseudomonas putida KT2440
ugcgcaagcaaccgg

SEQ ID NO: 3582654 - RNA, 16 nt, Pseudomonas putida KT2440
ugcgcaagccucaggc

SEQ ID NO: 3582655 - RNA, 14 nt, Pseudomonas putida KT2440
ugcgcaaggccgcg

SEQ ID NO: 3582656 - RNA, 17 nt, Pseudomonas putida KT2440
ugcgcaaggccgcggcu

SEQ ID NO: 3582657 - RNA, 13 nt, Pseudomonas putida KT2440
ugcgcaaucccug

SEQ ID NO: 3582658 - RNA, 15 nt, Pseudomonas putida KT2440
ugcgcaauccuugcc

SEQ ID NO: 3582659 - RNA, 16 nt, Pseudomonas putida KT2440
ugcgcaauccuugccc

SEQ ID NO: 3582660 - RNA, 17 nt, Pseudomonas putida KT2440
ugcgcaauccuugcccu

SEQ ID NO: 3582661 - RNA, 21 nt, Pseudomonas putida KT2440
ugcgcacauugacgucugucc

SEQ ID NO: 3582662 - RNA, 19 nt, Pseudomonas putida KT2440
ugcgcaccaaggcggcaua

SEQ ID NO: 3582663 - RNA, 16 nt, Pseudomonas putida KT2440
ugcgcaccccuugcca

SEQ ID NO: 3582664 - RNA, 19 nt, Pseudomonas putida KT2440
ugcgcacccgaccacccuc

SEQ ID NO: 3582665 - RNA, 23 nt, Pseudomonas putida KT2440
ugcgcaccggaguccccaccggc

SEQ ID NO: 3582666 - RNA, 18 nt, Pseudomonas putida KT2440
ugcgcacgaagaucaccg

SEQ ID NO: 3582667 - RNA, 23 nt, Pseudomonas putida KT2440
ugcgcucaaccagccgccuuugc

SEQ ID NO: 3582668 - RNA, 21 nt, Pseudomonas putida KT2440
ugcgcucaaccgaccugcaac

SEQ ID NO: 3582669 - RNA, 16 nt, Pseudomonas putida KT2440
ugcgcuccaacuggcg

SEQ ID NO: 3582670 - RNA, 15 nt, Pseudomonas putida KT2440
ugcgcuccagcagcu

SEQ ID NO: 3582671 - RNA, 15 nt, Pseudomonas putida KT2440
ugcgcuccuggucau

SEQ ID NO: 3582672 - RNA, 22 nt, Pseudomonas putida KT2440
ugcgcucgacgcgcgcagccug

SEQ ID NO: 3582673 - RNA, 21 nt, Pseudomonas putida KT2440
ugcgcucgagcccgccagcag

SEQ ID NO: 3582674 - RNA, 17 nt, Pseudomonas putida KT2440
ugcgcucgauccugugg

SEQ ID NO: 3582675 - RNA, 17 nt, Pseudomonas putida KT2440
ugcgcucguaggcugca

SEQ ID NO: 3582676 - RNA, 19 nt, Pseudomonas putida KT2440
ugcgcugaucgugcaccgu

SEQ ID NO: 3582677 - RNA, 14 nt, Pseudomonas putida KT2440
ugcgcugauucaac

SEQ ID NO: 3582678 - RNA, 17 nt, Pseudomonas putida KT2440
ugcgcugccugcuggcg

SEQ ID NO: 3582679 - RNA, 21 nt, Pseudomonas putida KT2440
ugcgcugcugguacaugccgc

SEQ ID NO: 3582680 - RNA, 12 nt, Pseudomonas putida KT2440
ugcgcuggcaca

SEQ ID NO: 3582681 - RNA, 14 nt, Pseudomonas putida KT2440
ugcgcuggccaaug

SEQ ID NO: 3582682 - RNA, 11 nt, Pseudomonas putida KT2440
ugcgcuggcug

SEQ ID NO: 3582683 - RNA, 16 nt, Pseudomonas putida KT2440
ugcgcuggcugccgcg

SEQ ID NO: 3582684 - RNA, 16 nt, Pseudomonas putida KT2440
ugcgcuucauccagcg

SEQ ID NO: 3582685 - RNA, 17 nt, Pseudomonas putida KT2440
ugcgcuugagcaggucg

SEQ ID NO: 3582686 - RNA, 15 nt, Pseudomonas putida KT2440
ugcgcuuugcguggc

SEQ ID NO: 3582687 - RNA, 18 nt, Pseudomonas putida KT2440
ugcggaacaggaucagcg

SEQ ID NO: 3582688 - RNA, 21 nt, Pseudomonas putida KT2440
ugcggaacauacgcaucagcg

SEQ ID NO: 3582689 - RNA, 18 nt, Pseudomonas putida KT2440
ugcggaacguuuccaggc

SEQ ID NO: 3582690 - RNA, 13 nt, Pseudomonas putida KT2440
ugcggaccaccug

SEQ ID NO: 3582691 - RNA, 20 nt, Pseudomonas putida KT2440
ugcggaccaccugggccagu

SEQ ID NO: 3582692 - RNA, 21 nt, Pseudomonas putida KT2440
ugcggaccaccugggccagua

SEQ ID NO: 3582693 - RNA, 18 nt, Pseudomonas putida KT2440
ugcggacucauagcucag

SEQ ID NO: 3582694 - RNA, 15 nt, Pseudomonas putida KT2440
ugcggauacagcgcc

SEQ ID NO: 3582695 - RNA, 17 nt, Pseudomonas putida KT2440
ugcggauacagcgccca

SEQ ID NO: 3582696 - RNA, 18 nt, Pseudomonas putida KT2440
ugcggauaccgcuggccg

SEQ ID NO: 3582697 - RNA, 22 nt, Pseudomonas putida KT2440
ugcggauaccgcuggccgccac

SEQ ID NO: 3582698 - RNA, 18 nt, Pseudomonas putida KT2440
ugcggaucacuuccaugg

SEQ ID NO: 3582699 - RNA, 22 nt, Pseudomonas putida KT2440
ugcggaucuuguauuggccaag

SEQ ID NO: 3582700 - RNA, 23 nt, Pseudomonas putida KT2440
ugcggaucuuguauuggccaaga

SEQ ID NO: 3582701 - RNA, 22 nt, Pseudomonas putida KT2440
ugcggcaaccaccaacagcacc

SEQ ID NO: 3582702 - RNA, 15 nt, Pseudomonas putida KT2440
ugcggcaagcucagg

SEQ ID NO: 3582703 - RNA, 22 nt, Pseudomonas putida KT2440
ugcggcaaucgggaucaugccg

SEQ ID NO: 3582704 - RNA, 22 nt, Pseudomonas putida KT2440
ugcggcagauccugcagccgca

SEQ ID NO: 3582705 - RNA, 17 nt, Pseudomonas putida KT2440
ugcggcagguaggccca

SEQ ID NO: 3582706 - RNA, 15 nt, Pseudomonas putida KT2440
ugcggcaucagggcc

SEQ ID NO: 3582707 - RNA, 13 nt, Pseudomonas putida KT2440
ugcggccaaugca

SEQ ID NO: 3582708 - RNA, 21 nt, Pseudomonas putida KT2440
ugcggccaaugcacgccuguc

SEQ ID NO: 3582709 - RNA, 13 nt, Pseudomonas putida KT2440
ugcggccacagcc

SEQ ID NO: 3582710 - RNA, 14 nt, Pseudomonas putida KT2440
ugcggccacagccg

SEQ ID NO: 3582711 - RNA, 16 nt, Pseudomonas putida KT2440
ugcggccccuuccgac

SEQ ID NO: 3582712 - RNA, 23 nt, Pseudomonas putida KT2440
ugcggccccuuccgaccggucau

SEQ ID NO: 3582713 - RNA, 19 nt, Pseudomonas putida KT2440
ugcggcccuucgcgggcac

SEQ ID NO: 3582714 - RNA, 21 nt, Pseudomonas putida KT2440
ugcggcccuucgcgggcacgc

SEQ ID NO: 3582715 - RNA, 15 nt, Pseudomonas putida KT2440
ugcggcccuugcuca

SEQ ID NO: 3582716 - RNA, 16 nt, Pseudomonas putida KT2440
ugcggcccuugcucag

SEQ ID NO: 3582717 - RNA, 22 nt, Pseudomonas putida KT2440
ugcggccuucguaguaauggcc

SEQ ID NO: 3582718 - RNA, 16 nt, Pseudomonas putida KT2440
ugcggcgaaagccagc

SEQ ID NO: 3582719 - RNA, 18 nt, Pseudomonas putida KT2440
ugcggcgaaagccagcag

SEQ ID NO: 3582720 - RNA, 21 nt, Pseudomonas putida KT2440
ugcggcgccaucggcacgcca

SEQ ID NO: 3582721 - RNA, 22 nt, Pseudomonas putida KT2440
ugcggcgccaucggcacgccag

SEQ ID NO: 3582722 - RNA, 14 nt, Pseudomonas putida KT2440
ugcggcgcgggcgc

SEQ ID NO: 3582723 - RNA, 20 nt, Pseudomonas putida KT2440
ugcggcgcgggcgcaggcaa

SEQ ID NO: 3582724 - RNA, 15 nt, Pseudomonas putida KT2440
ugcggcggcacugau

SEQ ID NO: 3582725 - RNA, 15 nt, Pseudomonas putida KT2440
ugcggcuccggcgug

SEQ ID NO: 3582726 - RNA, 19 nt, Pseudomonas putida KT2440
ugcggcucuguuucugccc

SEQ ID NO: 3582727 - RNA, 22 nt, Pseudomonas putida KT2440
ugcggcucuguuucugccccug

SEQ ID NO: 3582728 - RNA, 15 nt, Pseudomonas putida KT2440
ugcggcugaauccua

SEQ ID NO: 3582729 - RNA, 22 nt, Pseudomonas putida KT2440
ugcggcugccccaacugcaucc

SEQ ID NO: 3582730 - RNA, 18 nt, Pseudomonas putida KT2440
ugcggcugggucacccag

SEQ ID NO: 3582731 - RNA, 16 nt, Pseudomonas putida KT2440
ugcgggaagccaugca

SEQ ID NO: 3582732 - RNA, 19 nt, Pseudomonas putida KT2440
ugcgggaaguccgccagga

SEQ ID NO: 3582733 - RNA, 19 nt, Pseudomonas putida KT2440
ugcgggaccagcaccaccu

SEQ ID NO: 3582734 - RNA, 23 nt, Pseudomonas putida KT2440
ugcgggaccagcaccaccugugc

SEQ ID NO: 3582735 - RNA, 19 nt, Pseudomonas putida KT2440
ugcgggauuguucccacag

SEQ ID NO: 3582736 - RNA, 23 nt, Pseudomonas putida KT2440
ugcgggcaaggucgaugcugcug

SEQ ID NO: 3582737 - RNA, 12 nt, Pseudomonas putida KT2440
ugcgggccacca

SEQ ID NO: 3582738 - RNA, 13 nt, Pseudomonas putida KT2440
ugcgggcccccuc

SEQ ID NO: 3582739 - RNA, 16 nt, Pseudomonas putida KT2440
ugcgggcgucuuccag

SEQ ID NO: 3582740 - RNA, 20 nt, Pseudomonas putida KT2440
ugcgggcgucuuccaggugg

SEQ ID NO: 3582741 - RNA, 17 nt, Pseudomonas putida KT2440
ugcgggcguuguguugc

SEQ ID NO: 3582742 - RNA, 18 nt, Pseudomonas putida KT2440
ugcgggcugaggaaguug

SEQ ID NO: 3582743 - RNA, 13 nt, Pseudomonas putida KT2440
ugcgggcuugucc

SEQ ID NO: 3582744 - RNA, 21 nt, Pseudomonas putida KT2440
ugcgggcuuuccacgccucga

SEQ ID NO: 3582745 - RNA, 15 nt, Pseudomonas putida KT2440
ugcgggcuuucuggu

SEQ ID NO: 3582746 - RNA, 20 nt, Pseudomonas putida KT2440
ugcgggggccccaccaggca

SEQ ID NO: 3582747 - RNA, 21 nt, Pseudomonas putida KT2440
ugcggguaaagcccgcaguga

SEQ ID NO: 3582748 - RNA, 17 nt, Pseudomonas putida KT2440
ugcggguaaugccaccu

SEQ ID NO: 3582749 - RNA, 21 nt, Pseudomonas putida KT2440
ugcgggucagcagcaccgcca

SEQ ID NO: 3582750 - RNA, 12 nt, Pseudomonas putida KT2440
ugcgggucagcu

SEQ ID NO: 3582751 - RNA, 18 nt, Pseudomonas putida KT2440
ugcggguucucccccauc

SEQ ID NO: 3582752 - RNA, 21 nt, Pseudomonas putida KT2440
ugcgguaaccggaauagaaca

SEQ ID NO: 3582753 - RNA, 16 nt, Pseudomonas putida KT2440
ugcgguaccggccagc

SEQ ID NO: 3582754 - RNA, 19 nt, Pseudomonas putida KT2440
ugcgguaccggccagcugc

SEQ ID NO: 3582755 - RNA, 13 nt, Pseudomonas putida KT2440
ugcgguagcggcu

SEQ ID NO: 3582756 - RNA, 14 nt, Pseudomonas putida KT2440
ugcgguagcggcug

SEQ ID NO: 3582757 - RNA, 15 nt, Pseudomonas putida KT2440
ugcgguagugcaggc

SEQ ID NO: 3582758 - RNA, 21 nt, Pseudomonas putida KT2440
ugcgguauaggccgcaagccc

SEQ ID NO: 3582759 - RNA, 15 nt, Pseudomonas putida KT2440
ugcggucaucaccac

SEQ ID NO: 3582760 - RNA, 23 nt, Pseudomonas putida KT2440
ugcggucgaaguauuccagaauc

SEQ ID NO: 3582761 - RNA, 19 nt, Pseudomonas putida KT2440
ugcggugggcacacaccgg

SEQ ID NO: 3582762 - RNA, 20 nt, Pseudomonas putida KT2440
ugcgguugcccguaggagcg

SEQ ID NO: 3582763 - RNA, 18 nt, Pseudomonas putida KT2440
ugcgguuugcucugacac

SEQ ID NO: 3582764 - RNA, 15 nt, Pseudomonas putida KT2440
ugcguaaggccggga

SEQ ID NO: 3582765 - RNA, 15 nt, Pseudomonas putida KT2440
ugcguacccagcccc

SEQ ID NO: 3582766 - RNA, 19 nt, Pseudomonas putida KT2440
ugcguaggagcgggucuac

SEQ ID NO: 3582767 - RNA, 16 nt, Pseudomonas putida KT2440
ugcgucaacucaucac

SEQ ID NO: 3582768 - RNA, 21 nt, Pseudomonas putida KT2440
ugcgucaucaucagcaggcag

SEQ ID NO: 3582769 - RNA, 20 nt, Pseudomonas putida KT2440
ugcguccccggguccaccuc

SEQ ID NO: 3582770 - RNA, 20 nt, Pseudomonas putida KT2440
ugcgucccgaaagggccgca

SEQ ID NO: 3582771 - RNA, 17 nt, Pseudomonas putida KT2440
ugcgucgacucuuccca

SEQ ID NO: 3582772 - RNA, 15 nt, Pseudomonas putida KT2440
ugcugcaggcucuga

SEQ ID NO: 3582773 - RNA, 13 nt, Pseudomonas putida KT2440
ugcugcagggcac

SEQ ID NO: 3582774 - RNA, 21 nt, Pseudomonas putida KT2440
ugcugcagggcccagccaccg

SEQ ID NO: 3582775 - RNA, 11 nt, Pseudomonas putida KT2440
ugcugcagguu

SEQ ID NO: 3582776 - RNA, 15 nt, Pseudomonas putida KT2440
ugcugcagguucuga

SEQ ID NO: 3582777 - RNA, 14 nt, Pseudomonas putida KT2440
ugcugcaguucagg

SEQ ID NO: 3582778 - RNA, 17 nt, Pseudomonas putida KT2440
ugcugcaguucuuccag

SEQ ID NO: 3582779 - RNA, 17 nt, Pseudomonas putida KT2440
ugcugcauaugggcgaa

SEQ ID NO: 3582780 - RNA, 11 nt, Pseudomonas putida KT2440
ugcugccaggc

SEQ ID NO: 3582781 - RNA, 12 nt, Pseudomonas putida KT2440
ugcugccaggca

SEQ ID NO: 3582782 - RNA, 22 nt, Pseudomonas putida KT2440
ugcugccaggccgcacgcgccu

SEQ ID NO: 3582783 - RNA, 21 nt, Pseudomonas putida KT2440
ugcugccauccuugaagaaca

SEQ ID NO: 3582784 - RNA, 21 nt, Pseudomonas putida KT2440
ugcugccccaugcgaacugca

SEQ ID NO: 3582785 - RNA, 18 nt, Pseudomonas putida KT2440
ugcugcccguugcgcauc

SEQ ID NO: 3582786 - RNA, 20 nt, Pseudomonas putida KT2440
ugcugccgaccugcgccggg

SEQ ID NO: 3582787 - RNA, 19 nt, Pseudomonas putida KT2440
ugcugccgcccucuugcug

SEQ ID NO: 3582788 - RNA, 17 nt, Pseudomonas putida KT2440
ugcugccugugccggug

SEQ ID NO: 3582789 - RNA, 16 nt, Pseudomonas putida KT2440
ugcugccuucucugug

SEQ ID NO: 3582790 - RNA, 18 nt, Pseudomonas putida KT2440
ugcugccuuuuccugcug

SEQ ID NO: 3582791 - RNA, 13 nt, Pseudomonas putida KT2440
ugcugcgaagagg

SEQ ID NO: 3582792 - RNA, 14 nt, Pseudomonas putida KT2440
ugcugcgaguucag

SEQ ID NO: 3582793 - RNA, 13 nt, Pseudomonas putida KT2440
ugcugcggcaggc

SEQ ID NO: 3582794 - RNA, 20 nt, Pseudomonas putida KT2440
ugcugcggccgcgccggguu

SEQ ID NO: 3582795 - RNA, 17 nt, Pseudomonas putida KT2440
ugcugcgguaccggcca

SEQ ID NO: 3582796 - RNA, 18 nt, Pseudomonas putida KT2440
ugcugcgguaccggccag

SEQ ID NO: 3582797 - RNA, 15 nt, Pseudomonas putida KT2440
ugcugcgucagcauc

SEQ ID NO: 3582798 - RNA, 16 nt, Pseudomonas putida KT2440
ugcugcgucagcaucc

SEQ ID NO: 3582799 - RNA, 22 nt, Pseudomonas putida KT2440
ugcugcgucagcauccaacccu

SEQ ID NO: 3582800 - RNA, 17 nt, Pseudomonas putida KT2440
ugcugcgucucuuccuc

SEQ ID NO: 3582801 - RNA, 20 nt, Pseudomonas putida KT2440
ugcugcgugccuugccuggg

SEQ ID NO: 3582802 - RNA, 18 nt, Pseudomonas putida KT2440
ugcugcucauacugcuga

SEQ ID NO: 3582803 - RNA, 21 nt, Pseudomonas putida KT2440
ugcugcucauacugcugaccc

SEQ ID NO: 3582804 - RNA, 12 nt, Pseudomonas putida KT2440
ugcugcucugca

SEQ ID NO: 3582805 - RNA, 18 nt, Pseudomonas putida KT2440
ugcugcucuuucggcagc

SEQ ID NO: 3582806 - RNA, 13 nt, Pseudomonas putida KT2440
ugcugcuggccgc

SEQ ID NO: 3582807 - RNA, 16 nt, Pseudomonas putida KT2440
ugcuggaacugcugca

SEQ ID NO: 3582808 - RNA, 18 nt, Pseudomonas putida KT2440
ugcuggcaauccagcgug

SEQ ID NO: 3582809 - RNA, 14 nt, Pseudomonas putida KT2440
ugcuggcacgccuu

SEQ ID NO: 3582810 - RNA, 15 nt, Pseudomonas putida KT2440
ugcuggccaaggucu

SEQ ID NO: 3582811 - RNA, 12 nt, Pseudomonas putida KT2440
ugcuggccaauc

SEQ ID NO: 3582812 - RNA, 12 nt, Pseudomonas putida KT2440
ugcuggccagga

SEQ ID NO: 3582813 - RNA, 19 nt, Pseudomonas putida KT2440
ugcuggccaucccgcugug

SEQ ID NO: 3582814 - RNA, 20 nt, Pseudomonas putida KT2440
ugcuggcccuuucgcgggua

SEQ ID NO: 3582815 - RNA, 22 nt, Pseudomonas putida KT2440
ugcuggccgccagacaacuggc

SEQ ID NO: 3582816 - RNA, 18 nt, Pseudomonas putida KT2440
ugcuggccgcgcaggaag

SEQ ID NO: 3582817 - RNA, 20 nt, Pseudomonas putida KT2440
ugcuggccgcgcaggaagaa

SEQ ID NO: 3582818 - RNA, 20 nt, Pseudomonas putida KT2440
ugcuggccucuucgcgggua

SEQ ID NO: 3582819 - RNA, 16 nt, Pseudomonas putida KT2440
ugcuggcggcugagcc

SEQ ID NO: 3582820 - RNA, 13 nt, Pseudomonas putida KT2440
ugcuggggccgca

SEQ ID NO: 3582821 - RNA, 14 nt, Pseudomonas putida KT2440
ugcuggggccgcaa

SEQ ID NO: 3582822 - RNA, 19 nt, Pseudomonas putida KT2440
ugcuggggccgcaaagcgg

SEQ ID NO: 3582823 - RNA, 15 nt, Pseudomonas putida KT2440
ugcugggucagcacu

SEQ ID NO: 3582824 - RNA, 17 nt, Pseudomonas putida KT2440
ugcugggucagcgcuga

SEQ ID NO: 3582825 - RNA, 17 nt, Pseudomonas putida KT2440
ugcugguacagccggcu

SEQ ID NO: 3582826 - RNA, 16 nt, Pseudomonas putida KT2440
ugcuggucagugcacu

SEQ ID NO: 3582827 - RNA, 20 nt, Pseudomonas putida KT2440
ugcugguccuccccuucccg

SEQ ID NO: 3582828 - RNA, 22 nt, Pseudomonas putida KT2440
ugcugguccucgacgggcaggc

SEQ ID NO: 3582829 - RNA, 18 nt, Pseudomonas putida KT2440
ugcugguggccacgccga

SEQ ID NO: 3582830 - RNA, 23 nt, Pseudomonas putida KT2440
ugcugguguaggacaucugguca

SEQ ID NO: 3582831 - RNA, 21 nt, Pseudomonas putida KT2440
ugcugguguggcgccagggca

SEQ ID NO: 3582832 - RNA, 21 nt, Pseudomonas putida KT2440
ugcugguuaacaugcuggcca

SEQ ID NO: 3582833 - RNA, 17 nt, Pseudomonas putida KT2440
ugcugguucgauuccag

SEQ ID NO: 3582834 - RNA, 15 nt, Pseudomonas putida KT2440
ugcugguuuggcagc

SEQ ID NO: 3582835 - RNA, 18 nt, Pseudomonas putida KT2440
ugcugguuuggcagcacc

SEQ ID NO: 3582836 - RNA, 18 nt, Pseudomonas putida KT2440
ugcuguaaucggcgcuga

SEQ ID NO: 3582837 - RNA, 19 nt, Pseudomonas putida KT2440
ugcuguagcccaccagguc

SEQ ID NO: 3582838 - RNA, 20 nt, Pseudomonas putida KT2440
ugcuguagcccaccagguca

SEQ ID NO: 3582839 - RNA, 19 nt, Pseudomonas putida KT2440
ugcugucacccuugggcac

SEQ ID NO: 3582840 - RNA, 22 nt, Pseudomonas putida KT2440
ugcugucgguaccuggccgugc

SEQ ID NO: 3582841 - RNA, 20 nt, Pseudomonas putida KT2440
ugcugucggugaagccgacc

SEQ ID NO: 3582842 - RNA, 15 nt, Pseudomonas putida KT2440
ugcugugaaacgagu

SEQ ID NO: 3582843 - RNA, 13 nt, Pseudomonas putida KT2440
ugcugugcacugc

SEQ ID NO: 3582844 - RNA, 14 nt, Pseudomonas putida KT2440
ugcuguggcgcaca

SEQ ID NO: 3582845 - RNA, 18 nt, Pseudomonas putida KT2440
ugcugugguuuggcccgg

SEQ ID NO: 3582846 - RNA, 19 nt, Pseudomonas putida KT2440
ugcuuaccagcuuggcgcc

SEQ ID NO: 3582847 - RNA, 23 nt, Pseudomonas putida KT2440
ugcuucaaccgugguucuugccg

SEQ ID NO: 3582848 - RNA, 19 nt, Pseudomonas putida KT2440
ugcuucaaucaaccagcgg

SEQ ID NO: 3582849 - RNA, 14 nt, Pseudomonas putida KT2440
ugcuucaccuugcc

SEQ ID NO: 3582850 - RNA, 15 nt, Pseudomonas putida KT2440
ugcuucaccuugccu

SEQ ID NO: 3582851 - RNA, 15 nt, Pseudomonas putida KT2440
ugcuucauagccauc

SEQ ID NO: 3582852 - RNA, 16 nt, Pseudomonas putida KT2440
ugcuucaucugcgccu

SEQ ID NO: 3582853 - RNA, 16 nt, Pseudomonas putida KT2440
ugcuuccagcugucau

SEQ ID NO: 3582854 - RNA, 13 nt, Pseudomonas putida KT2440
ugcuuccaggucg

SEQ ID NO: 3582855 - RNA, 14 nt, Pseudomonas putida KT2440
ugcuucgcgggcac

SEQ ID NO: 3582856 - RNA, 22 nt, Pseudomonas putida KT2440
ugcuucugccguucacugaugu

SEQ ID NO: 3582857 - RNA, 16 nt, Pseudomonas putida KT2440
ugcuugacccccuucg

SEQ ID NO: 3582858 - RNA, 14 nt, Pseudomonas putida KT2440
ugcuugagcgcagc

SEQ ID NO: 3582859 - RNA, 15 nt, Pseudomonas putida KT2440
ugcuugaggccgcca

SEQ ID NO: 3582860 - RNA, 21 nt, Pseudomonas putida KT2440
ugcuugccgggugcaucggca

SEQ ID NO: 3582861 - RNA, 21 nt, Pseudomonas putida KT2440
ugcuugcggaacaggaucagc

SEQ ID NO: 3582862 - RNA, 18 nt, Pseudomonas putida KT2440
ugcuugcgggcaaggucg

SEQ ID NO: 3582863 - RNA, 22 nt, Pseudomonas putida KT2440
ugcuuggcagcggcuggcgcuc

SEQ ID NO: 3582864 - RNA, 18 nt, Pseudomonas putida KT2440
ugcuuggcagugaugccg

SEQ ID NO: 3582865 - RNA, 23 nt, Pseudomonas putida KT2440
ugcuugucauaagccuuucaucg

SEQ ID NO: 3582866 - RNA, 17 nt, Pseudomonas putida KT2440
ugcuuugaagucacuuu

SEQ ID NO: 3582867 - RNA, 14 nt, Pseudomonas putida KT2440
ugcuuugcgggcau

SEQ ID NO: 3582868 - RNA, 15 nt, Pseudomonas putida KT2440
ugcuuuuuugugccu

SEQ ID NO: 3582869 - RNA, 13 nt, Pseudomonas putida KT2440
uggaaaacagcgc

SEQ ID NO: 3582870 - RNA, 14 nt, Pseudomonas putida KT2440
uggaaaauccgcuu

SEQ ID NO: 3582871 - RNA, 14 nt, Pseudomonas putida KT2440
uggaaauggaauuu

SEQ ID NO: 3582872 - RNA, 13 nt, Pseudomonas putida KT2440
uggaaauguucaa

SEQ ID NO: 3582873 - RNA, 15 nt, Pseudomonas putida KT2440
uggaaauuggccagc

SEQ ID NO: 3582874 - RNA, 15 nt, Pseudomonas putida KT2440
uggaaccccauccac

SEQ ID NO: 3582875 - RNA, 16 nt, Pseudomonas putida KT2440
uggaagauggucucga

SEQ ID NO: 3582876 - RNA, 19 nt, Pseudomonas putida KT2440
uggaagucgcgagucaggc

SEQ ID NO: 3582877 - RNA, 19 nt, Pseudomonas putida KT2440
uggaaguugccauuuugga

SEQ ID NO: 3582878 - RNA, 18 nt, Pseudomonas putida KT2440
uggcaucggacgcguggu

SEQ ID NO: 3582879 - RNA, 11 nt, Pseudomonas putida KT2440
uggcaugcccc

SEQ ID NO: 3582880 - RNA, 22 nt, Pseudomonas putida KT2440
uggcaugccccucgaacagcgc

SEQ ID NO: 3582881 - RNA, 17 nt, Pseudomonas putida KT2440
uggcaugggugagcacg

SEQ ID NO: 3582882 - RNA, 13 nt, Pseudomonas putida KT2440
uggcauuggcgug

SEQ ID NO: 3582883 - RNA, 19 nt, Pseudomonas putida KT2440
uggcauuggugccagcgcc

SEQ ID NO: 3582884 - RNA, 16 nt, Pseudomonas putida KT2440
uggccaaaccguccag

SEQ ID NO: 3582885 - RNA, 18 nt, Pseudomonas putida KT2440
uggccaaaccguccaggu

SEQ ID NO: 3582886 - RNA, 13 nt, Pseudomonas putida KT2440
uggccaacggcau

SEQ ID NO: 3582887 - RNA, 20 nt, Pseudomonas putida KT2440
uggccaacggcaucacgcug

SEQ ID NO: 3582888 - RNA, 24 nt, Pseudomonas putida KT2440
uggccaacggcaucacgcuggcca

SEQ ID NO: 3582889 - RNA, 19 nt, Pseudomonas putida KT2440
uggccaacuccccacccag

SEQ ID NO: 3582890 - RNA, 20 nt, Pseudomonas putida KT2440
uggccaagccaccgccacca

SEQ ID NO: 3582891 - RNA, 13 nt, Pseudomonas putida KT2440
uggccaaggccuc

SEQ ID NO: 3582892 - RNA, 16 nt, Pseudomonas putida KT2440
uggccaaggcggcgau

SEQ ID NO: 3582893 - RNA, 15 nt, Pseudomonas putida KT2440
uggccaauaccgcug

SEQ ID NO: 3582894 - RNA, 22 nt, Pseudomonas putida KT2440
uggccaauggcgaugaacacgc

SEQ ID NO: 3582895 - RNA, 16 nt, Pseudomonas putida KT2440
uggccacacgcugcug

SEQ ID NO: 3582896 - RNA, 19 nt, Pseudomonas putida KT2440
uggccacacgcugcugcug

SEQ ID NO: 3582897 - RNA, 15 nt, Pseudomonas putida KT2440
uggccacacugcuca

SEQ ID NO: 3582898 - RNA, 22 nt, Pseudomonas putida KT2440
uggccaccacguagugcuucug

SEQ ID NO: 3582899 - RNA, 12 nt, Pseudomonas putida KT2440
uggccaccagca

SEQ ID NO: 3582900 - RNA, 15 nt, Pseudomonas putida KT2440
uggccaccagggugg

SEQ ID NO: 3582901 - RNA, 20 nt, Pseudomonas putida KT2440
uggccaccaucgccggcacg

SEQ ID NO: 3582902 - RNA, 17 nt, Pseudomonas putida KT2440
uggccaccaugaacagc

SEQ ID NO: 3582903 - RNA, 21 nt, Pseudomonas putida KT2440
uggccaccgaaguucagcacg

SEQ ID NO: 3582904 - RNA, 13 nt, Pseudomonas putida KT2440
uggccacuguugc

SEQ ID NO: 3582905 - RNA, 23 nt, Pseudomonas putida KT2440
uggccagaaacggcggcagauac

SEQ ID NO: 3582906 - RNA, 19 nt, Pseudomonas putida KT2440
uggccagacucagcugcug

SEQ ID NO: 3582907 - RNA, 16 nt, Pseudomonas putida KT2440
uggccagagcgcgcca

SEQ ID NO: 3582908 - RNA, 20 nt, Pseudomonas putida KT2440
uggccagcaggcccggccca

SEQ ID NO: 3582909 - RNA, 16 nt, Pseudomonas putida KT2440
uggccagccggcagca

SEQ ID NO: 3582910 - RNA, 22 nt, Pseudomonas putida KT2440
uggccagcggcgcggccucguc

SEQ ID NO: 3582911 - RNA, 16 nt, Pseudomonas putida KT2440
uggccagcucauccag

SEQ ID NO: 3582912 - RNA, 19 nt, Pseudomonas putida KT2440
uggccagcucauccagccg

SEQ ID NO: 3582913 - RNA, 17 nt, Pseudomonas putida KT2440
uggccagcuucucggca

SEQ ID NO: 3582914 - RNA, 16 nt, Pseudomonas putida KT2440
uggccaggaacagcgc

SEQ ID NO: 3582915 - RNA, 14 nt, Pseudomonas putida KT2440
uggccagggcaaac

SEQ ID NO: 3582916 - RNA, 12 nt, Pseudomonas putida KT2440
uggccagggccu

SEQ ID NO: 3582917 - RNA, 22 nt, Pseudomonas putida KT2440
uggccaggguacuugugugccu

SEQ ID NO: 3582918 - RNA, 16 nt, Pseudomonas putida KT2440
uggccagugccaugaa

SEQ ID NO: 3582919 - RNA, 12 nt, Pseudomonas putida KT2440
uggccaguuccu

SEQ ID NO: 3582920 - RNA, 22 nt, Pseudomonas putida KT2440
uggccaguuccuggcacucucg

SEQ ID NO: 3582921 - RNA, 20 nt, Pseudomonas putida KT2440
uggccaucaauaccggcaug

SEQ ID NO: 3582922 - RNA, 19 nt, Pseudomonas putida KT2440
uggccaucacuucacgggu

SEQ ID NO: 3582923 - RNA, 13 nt, Pseudomonas putida KT2440
uggccaucagcug

SEQ ID NO: 3582924 - RNA, 20 nt, Pseudomonas putida KT2440
uggccaucagcuguucuucg

SEQ ID NO: 3582925 - RNA, 16 nt, Pseudomonas putida KT2440
uggccauguugucgaa

SEQ ID NO: 3582926 - RNA, 19 nt, Pseudomonas putida KT2440
uggccauugaccuugguga

SEQ ID NO: 3582927 - RNA, 11 nt, Pseudomonas putida KT2440
uggcccacccg

SEQ ID NO: 3582928 - RNA, 19 nt, Pseudomonas putida KT2440
uggcccagccagcgugggc

SEQ ID NO: 3582929 - RNA, 19 nt, Pseudomonas putida KT2440
uggcccaguacgccaccca

SEQ ID NO: 3582930 - RNA, 20 nt, Pseudomonas putida KT2440
uggcccaguacgccacccag

SEQ ID NO: 3582931 - RNA, 22 nt, Pseudomonas putida KT2440
uggcccaguacgccucgaagua

SEQ ID NO: 3582932 - RNA, 12 nt, Pseudomonas putida KT2440
uggccccaccca

SEQ ID NO: 3582933 - RNA, 13 nt, Pseudomonas putida KT2440
uggccccgcccag

SEQ ID NO: 3582934 - RNA, 14 nt, Pseudomonas putida KT2440
uggcccgcagcgcu

SEQ ID NO: 3582935 - RNA, 13 nt, Pseudomonas putida KT2440
uggcccgccgcca

SEQ ID NO: 3582936 - RNA, 19 nt, Pseudomonas putida KT2440
uggcccgccgccaccagcg

SEQ ID NO: 3582937 - RNA, 18 nt, Pseudomonas putida KT2440
uggcccggucccgcugcc

SEQ ID NO: 3582938 - RNA, 19 nt, Pseudomonas putida KT2440
uggcccggucccgcugccg

SEQ ID NO: 3582939 - RNA, 16 nt, Pseudomonas putida KT2440
uggcccucugcguggu

SEQ ID NO: 3582940 - RNA, 16 nt, Pseudomonas putida KT2440
uggcccugaucugccc

SEQ ID NO: 3582941 - RNA, 17 nt, Pseudomonas putida KT2440
uggcccugaucugcccc

SEQ ID NO: 3582942 - RNA, 12 nt, Pseudomonas putida KT2440
uggcccuggcca

SEQ ID NO: 3582943 - RNA, 17 nt, Pseudomonas putida KT2440
uggcccuguacauccag

SEQ ID NO: 3582944 - RNA, 21 nt, Pseudomonas putida KT2440
uggcccugugcuuugagcagg

SEQ ID NO: 3582945 - RNA, 23 nt, Pseudomonas putida KT2440
uggcccugugcuuugagcaggcg

SEQ ID NO: 3582946 - RNA, 14 nt, Pseudomonas putida KT2440
uggccgaaggccgu

SEQ ID NO: 3582947 - RNA, 17 nt, Pseudomonas putida KT2440
uggccgaaggccguggc

SEQ ID NO: 3582948 - RNA, 23 nt, Pseudomonas putida KT2440
uggccgaaggccguggcaaggcc

SEQ ID NO: 3582949 - RNA, 14 nt, Pseudomonas putida KT2440
uggccgacauggcg

SEQ ID NO: 3582950 - RNA, 15 nt, Pseudomonas putida KT2440
uggccgagcugaucc

SEQ ID NO: 3582951 - RNA, 20 nt, Pseudomonas putida KT2440
uggccgaugcccaccuuggc

SEQ ID NO: 3582952 - RNA, 15 nt, Pseudomonas putida KT2440
uggccgcaauggcgc

SEQ ID NO: 3582953 - RNA, 16 nt, Pseudomonas putida KT2440
uggccgcaauggcgcc

SEQ ID NO: 3582954 - RNA, 15 nt, Pseudomonas putida KT2440
uggccgcacccagca

SEQ ID NO: 3582955 - RNA, 17 nt, Pseudomonas putida KT2440
uggccgcauauacgccg

SEQ ID NO: 3582956 - RNA, 14 nt, Pseudomonas putida KT2440
uggccgccaacagc

SEQ ID NO: 3582957 - RNA, 17 nt, Pseudomonas putida KT2440
uggccgccaacagcgca

SEQ ID NO: 3582958 - RNA, 13 nt, Pseudomonas putida KT2440
uggccgccaaggc

SEQ ID NO: 3582959 - RNA, 15 nt, Pseudomonas putida KT2440
uggccgccaaggcga

SEQ ID NO: 3582960 - RNA, 19 nt, Pseudomonas putida KT2440
uggccgccaaggcgaugcu

SEQ ID NO: 3582961 - RNA, 14 nt, Pseudomonas putida KT2440
uggccgccagcggc

SEQ ID NO: 3582962 - RNA, 23 nt, Pseudomonas putida KT2440
uggccgcccgccucgacaaacug

SEQ ID NO: 3582963 - RNA, 13 nt, Pseudomonas putida KT2440
uggccgccuccca

SEQ ID NO: 3582964 - RNA, 18 nt, Pseudomonas putida KT2440
uggccgcgcaggaagaag

SEQ ID NO: 3582965 - RNA, 13 nt, Pseudomonas putida KT2440
uggccgcgcgggu

SEQ ID NO: 3582966 - RNA, 18 nt, Pseudomonas putida KT2440
uggccgcgcgggugcgag

SEQ ID NO: 3582967 - RNA, 23 nt, Pseudomonas putida KT2440
uggccgcgcgggugcgagaggcg

SEQ ID NO: 3582968 - RNA, 16 nt, Pseudomonas putida KT2440
uggccgcguucgccca

SEQ ID NO: 3582969 - RNA, 21 nt, Pseudomonas putida KT2440
uggccgcuggcccuucgcgga

SEQ ID NO: 3582970 - RNA, 13 nt, Pseudomonas putida KT2440
uggccgcuugcug

SEQ ID NO: 3582971 - RNA, 14 nt, Pseudomonas putida KT2440
uggccggagcugga

SEQ ID NO: 3582972 - RNA, 14 nt, Pseudomonas putida KT2440
uggccggcaacggc

SEQ ID NO: 3582973 - RNA, 19 nt, Pseudomonas putida KT2440
uggccggcaacggccacgc

SEQ ID NO: 3582974 - RNA, 16 nt, Pseudomonas putida KT2440
uggccggcgcgucuca

SEQ ID NO: 3582975 - RNA, 21 nt, Pseudomonas putida KT2440
uggccggcgcugagcgacagc

SEQ ID NO: 3582976 - RNA, 22 nt, Pseudomonas putida KT2440
uggccggggccgcuuggcggcc

SEQ ID NO: 3582977 - RNA, 13 nt, Pseudomonas putida KT2440
uggccgguggcuu

SEQ ID NO: 3582978 - RNA, 22 nt, Pseudomonas putida KT2440
uggccgguggcuucguggugcu

SEQ ID NO: 3582979 - RNA, 21 nt, Pseudomonas putida KT2440
uggccgguuucagucagccag

SEQ ID NO: 3582980 - RNA, 15 nt, Pseudomonas putida KT2440
uggccguagccaggc

SEQ ID NO: 3582981 - RNA, 14 nt, Pseudomonas putida KT2440
uggccgugacgccg

SEQ ID NO: 3582982 - RNA, 16 nt, Pseudomonas putida KT2440
uggccguguucgacga

SEQ ID NO: 3582983 - RNA, 21 nt, Pseudomonas putida KT2440
uggccucacauucaccgccac

SEQ ID NO: 3582984 - RNA, 17 nt, Pseudomonas putida KT2440
uggcuacagaucagcca

SEQ ID NO: 3582985 - RNA, 22 nt, Pseudomonas putida KT2440
uggcuacgugauugacccgacg

SEQ ID NO: 3582986 - RNA, 17 nt, Pseudomonas putida KT2440
uggcuagccucaucaga

SEQ ID NO: 3582987 - RNA, 13 nt, Pseudomonas putida KT2440
uggcuaucagccg

SEQ ID NO: 3582988 - RNA, 16 nt, Pseudomonas putida KT2440
uggcucaacuggcagg

SEQ ID NO: 3582989 - RNA, 14 nt, Pseudomonas putida KT2440
uggcucacacccag

SEQ ID NO: 3582990 - RNA, 14 nt, Pseudomonas putida KT2440
uggcucacaucauc

SEQ ID NO: 3582991 - RNA, 19 nt, Pseudomonas putida KT2440
uggcucaccuuaucggccg

SEQ ID NO: 3582992 - RNA, 12 nt, Pseudomonas putida KT2440
uggcuccaccac

SEQ ID NO: 3582993 - RNA, 22 nt, Pseudomonas putida KT2440
uggcuccaugguaaagcccgaa

SEQ ID NO: 3582994 - RNA, 18 nt, Pseudomonas putida KT2440
uggcucgaaucaagccug

SEQ ID NO: 3582995 - RNA, 21 nt, Pseudomonas putida KT2440
uggcucgaaucaagccugcgc

SEQ ID NO: 3582996 - RNA, 23 nt, Pseudomonas putida KT2440
uggcucgacacgcuugcgaagga

SEQ ID NO: 3582997 - RNA, 18 nt, Pseudomonas putida KT2440
uggcucgcugccccaguc

SEQ ID NO: 3582998 - RNA, 21 nt, Pseudomonas putida KT2440
uggcucuucaacaccagcaug

SEQ ID NO: 3582999 - RNA, 15 nt, Pseudomonas putida KT2440
uggcugauagccgcc

SEQ ID NO: 3583000 - RNA, 22 nt, Pseudomonas putida KT2440
uggcugauagccgccagcauca

SEQ ID NO: 3583001 - RNA, 21 nt, Pseudomonas putida KT2440
uggcugcacugggcgauggcg

SEQ ID NO: 3583002 - RNA, 23 nt, Pseudomonas putida KT2440
uggcugccgcggguggcuucguc

SEQ ID NO: 3583003 - RNA, 16 nt, Pseudomonas putida KT2440
uggcugccggccucga

SEQ ID NO: 3583004 - RNA, 16 nt, Pseudomonas putida KT2440
uggcugccggccuguu

SEQ ID NO: 3583005 - RNA, 16 nt, Pseudomonas putida KT2440
uggcugcguucaggca

SEQ ID NO: 3583006 - RNA, 20 nt, Pseudomonas putida KT2440
uggcugcguuuaccggcacc

SEQ ID NO: 3583007 - RNA, 15 nt, Pseudomonas putida KT2440
uggcuggcaccggcu

SEQ ID NO: 3583008 - RNA, 20 nt, Pseudomonas putida KT2440
uggcuggcaccggcugcgcc

SEQ ID NO: 3583009 - RNA, 12 nt, Pseudomonas putida KT2440
uggcuggcagca

SEQ ID NO: 3583010 - RNA, 15 nt, Pseudomonas putida KT2440
uggcuggugaaggca

SEQ ID NO: 3583011 - RNA, 15 nt, Pseudomonas putida KT2440
uggcuguaccggccu

SEQ ID NO: 3583012 - RNA, 14 nt, Pseudomonas putida KT2440
uggcugucugcagc

SEQ ID NO: 3583013 - RNA, 23 nt, Pseudomonas putida KT2440
uggcugugcacccgugccugccu

SEQ ID NO: 3583014 - RNA, 17 nt, Pseudomonas putida KT2440
uggcuguucgucggccu

SEQ ID NO: 3583015 - RNA, 19 nt, Pseudomonas putida KT2440
uggcuguucgucggccuug

SEQ ID NO: 3583016 - RNA, 13 nt, Pseudomonas putida KT2440
uggcuuacaucau

SEQ ID NO: 3583017 - RNA, 23 nt, Pseudomonas putida KT2440
uggcuuacaucaugccgcccaug

SEQ ID NO: 3583018 - RNA, 18 nt, Pseudomonas putida KT2440
uggcuuagcgcgggccuu

SEQ ID NO: 3583019 - RNA, 20 nt, Pseudomonas putida KT2440
uggcuuccacggcgcgcuuc

SEQ ID NO: 3583020 - RNA, 23 nt, Pseudomonas putida KT2440
uggcuucccgguaacgggccagc

SEQ ID NO: 3583021 - RNA, 17 nt, Pseudomonas putida KT2440
uggcuuccggcgcuggu

SEQ ID NO: 3583022 - RNA, 18 nt, Pseudomonas putida KT2440
uggcuuccugcuggcuca

SEQ ID NO: 3583023 - RNA, 22 nt, Pseudomonas putida KT2440
uggcuucgguggugaucaucag

SEQ ID NO: 3583024 - RNA, 11 nt, Pseudomonas putida KT2440
uggcuugcguu

SEQ ID NO: 3583025 - RNA, 23 nt, Pseudomonas putida KT2440
uggcuuggcccaguucuccggca

SEQ ID NO: 3583026 - RNA, 15 nt, Pseudomonas putida KT2440
uggcuuguccagcca

SEQ ID NO: 3583027 - RNA, 23 nt, Pseudomonas putida KT2440
uggcuuguccuuguugaccccgg

SEQ ID NO: 3583028 - RNA, 19 nt, Pseudomonas putida KT2440
uggcuugucuuccggcagg

SEQ ID NO: 3583029 - RNA, 15 nt, Pseudomonas putida KT2440
uggcuuuccaggucc

SEQ ID NO: 3583030 - RNA, 17 nt, Pseudomonas putida KT2440
uggcuuucccccagcca

SEQ ID NO: 3583031 - RNA, 21 nt, Pseudomonas putida KT2440
uggcuuuugccacuucaccca

SEQ ID NO: 3583032 - RNA, 22 nt, Pseudomonas putida KT2440
ugggaaaccgugucgggcaguu

SEQ ID NO: 3583033 - RNA, 19 nt, Pseudomonas putida KT2440
ugggaaaccuccggcauca

SEQ ID NO: 3583034 - RNA, 22 nt, Pseudomonas putida KT2440
ugggaaaccuccggcaucaucc

SEQ ID NO: 3583035 - RNA, 17 nt, Pseudomonas putida KT2440
ugggaagcugcagcagc

SEQ ID NO: 3583036 - RNA, 18 nt, Pseudomonas putida KT2440
ugggaagcugcagcagcu

SEQ ID NO: 3583037 - RNA, 20 nt, Pseudomonas putida KT2440
ugggaccgcuguuaccagag

SEQ ID NO: 3583038 - RNA, 14 nt, Pseudomonas putida KT2440
ugggagcaggcaug

SEQ ID NO: 3583039 - RNA, 13 nt, Pseudomonas putida KT2440
ugggagcggccuu

SEQ ID NO: 3583040 - RNA, 20 nt, Pseudomonas putida KT2440
ugggagcggccuugcgucgc

SEQ ID NO: 3583041 - RNA, 22 nt, Pseudomonas putida KT2440
ugggagcggccuugugcggccc

SEQ ID NO: 3583042 - RNA, 19 nt, Pseudomonas putida KT2440
ugggagcgggacugcccgc

SEQ ID NO: 3583043 - RNA, 13 nt, Pseudomonas putida KT2440
ugggagcgggcau

SEQ ID NO: 3583044 - RNA, 19 nt, Pseudomonas putida KT2440
ugggagcgggcgugcccgc

SEQ ID NO: 3583045 - RNA, 15 nt, Pseudomonas putida KT2440
ugggagcgggcuugc

SEQ ID NO: 3583046 - RNA, 20 nt, Pseudomonas putida KT2440
ugggagcgggcuugcccgcg

SEQ ID NO: 3583047 - RNA, 21 nt, Pseudomonas putida KT2440
ugggagcgggcuugcccgcga

SEQ ID NO: 3583048 - RNA, 19 nt, Pseudomonas putida KT2440
ugggagcgggucagccugc

SEQ ID NO: 3583049 - RNA, 22 nt, Pseudomonas putida KT2440
ugggcaaaaucgaccagggccu

SEQ ID NO: 3583050 - RNA, 14 nt, Pseudomonas putida KT2440
ugggcaacagcugc

SEQ ID NO: 3583051 - RNA, 19 nt, Pseudomonas putida KT2440
ugggcaaccacauggccgu

SEQ ID NO: 3583052 - RNA, 13 nt, Pseudomonas putida KT2440
ugggcaaccaggu

SEQ ID NO: 3583053 - RNA, 14 nt, Pseudomonas putida KT2440
ugggcaaggccguu

SEQ ID NO: 3583054 - RNA, 20 nt, Pseudomonas putida KT2440
ugggcaagggccugcaggca

SEQ ID NO: 3583055 - RNA, 23 nt, Pseudomonas putida KT2440
ugggcaagggccugcaggcagca

SEQ ID NO: 3583056 - RNA, 22 nt, Pseudomonas putida KT2440
ugggcaaugcgagacgccacca

SEQ ID NO: 3583057 - RNA, 22 nt, Pseudomonas putida KT2440
ugggcaauggcguauccacaua

SEQ ID NO: 3583058 - RNA, 17 nt, Pseudomonas putida KT2440
ugggcacaauugugccg

SEQ ID NO: 3583059 - RNA, 19 nt, Pseudomonas putida KT2440
ugggcagaguaaccgcggc

SEQ ID NO: 3583060 - RNA, 23 nt, Pseudomonas putida KT2440
ugggcagcaccgcguaucaggca

SEQ ID NO: 3583061 - RNA, 22 nt, Pseudomonas putida KT2440
ugggcaggcccagguaacugcc

SEQ ID NO: 3583062 - RNA, 18 nt, Pseudomonas putida KT2440
ugggcaggucgacccgcg

SEQ ID NO: 3583063 - RNA, 17 nt, Pseudomonas putida KT2440
ugggcauccagcuugcc

SEQ ID NO: 3583064 - RNA, 23 nt, Pseudomonas putida KT2440
ugggcauccagcuugccaccauc

SEQ ID NO: 3583065 - RNA, 20 nt, Pseudomonas putida KT2440
ugggccacggucuggcgcag

SEQ ID NO: 3583066 - RNA, 13 nt, Pseudomonas putida KT2440
ugggccacuucgc

SEQ ID NO: 3583067 - RNA, 22 nt, Pseudomonas putida KT2440
ugggccaggguaccgccgucca

SEQ ID NO: 3583068 - RNA, 18 nt, Pseudomonas putida KT2440
ugggccaguaccuucugg

SEQ ID NO: 3583069 - RNA, 17 nt, Pseudomonas putida KT2440
ugggccccaggcggugc

SEQ ID NO: 3583070 - RNA, 22 nt, Pseudomonas putida KT2440
ugggcccgccauucuucuccag

SEQ ID NO: 3583071 - RNA, 16 nt, Pseudomonas putida KT2440
ugggccgaucacgaag

SEQ ID NO: 3583072 - RNA, 16 nt, Pseudomonas putida KT2440
ugggccgccaagcggc

SEQ ID NO: 3583073 - RNA, 17 nt, Pseudomonas putida KT2440
ugggccggcgcccugca

SEQ ID NO: 3583074 - RNA, 22 nt, Pseudomonas putida KT2440
ugggccgguccuuucgcgggua

SEQ ID NO: 3583075 - RNA, 16 nt, Pseudomonas putida KT2440
ugggccugcacgaucg

SEQ ID NO: 3583076 - RNA, 13 nt, Pseudomonas putida KT2440
ugggccugugccg

SEQ ID NO: 3583077 - RNA, 22 nt, Pseudomonas putida KT2440
ugggcgaacgccugcagggccu

SEQ ID NO: 3583078 - RNA, 23 nt, Pseudomonas putida KT2440
ugggcgaacgccugcagggccug

SEQ ID NO: 3583079 - RNA, 18 nt, Pseudomonas putida KT2440
ugggcgaagucccgacag

SEQ ID NO: 3583080 - RNA, 21 nt, Pseudomonas putida KT2440
ugggcgagcaggugacccugg

SEQ ID NO: 3583081 - RNA, 21 nt, Pseudomonas putida KT2440
ugggcgaucacauaaggcagc

SEQ ID NO: 3583082 - RNA, 23 nt, Pseudomonas putida KT2440
ugggcgaugaucgcggcguuguc

SEQ ID NO: 3583083 - RNA, 19 nt, Pseudomonas putida KT2440
ugggcgcuuugcacccgcg

SEQ ID NO: 3583084 - RNA, 20 nt, Pseudomonas putida KT2440
ugggcgcuuugcacccgcgc

SEQ ID NO: 3583085 - RNA, 17 nt, Pseudomonas putida KT2440
ugggcgggccgccgaac

SEQ ID NO: 3583086 - RNA, 22 nt, Pseudomonas putida KT2440
ugggcgggccgccgaacaggcc

SEQ ID NO: 3583087 - RNA, 22 nt, Pseudomonas putida KT2440
ugggcggggugaucgacagguu

SEQ ID NO: 3583088 - RNA, 17 nt, Pseudomonas putida KT2440
uggucuagagaucugca

SEQ ID NO: 3583089 - RNA, 15 nt, Pseudomonas putida KT2440
uggucuucgccgcca

SEQ ID NO: 3583090 - RNA, 23 nt, Pseudomonas putida KT2440
uggucuucgccgccaugguuuug

SEQ ID NO: 3583091 - RNA, 19 nt, Pseudomonas putida KT2440
uggugaaagucgaccagca

SEQ ID NO: 3583092 - RNA, 19 nt, Pseudomonas putida KT2440
uggugaacuuaugguuguc

SEQ ID NO: 3583093 - RNA, 15 nt, Pseudomonas putida KT2440
uggugaaggccagga

SEQ ID NO: 3583094 - RNA, 19 nt, Pseudomonas putida KT2440
uggugaaucagccccagcc

SEQ ID NO: 3583095 - RNA, 22 nt, Pseudomonas putida KT2440
uggugaccucgaugcccuccag

SEQ ID NO: 3583096 - RNA, 23 nt, Pseudomonas putida KT2440
uggugaccucgaugcccuccagc

SEQ ID NO: 3583097 - RNA, 20 nt, Pseudomonas putida KT2440
uggugaguggcccuggagcg

SEQ ID NO: 3583098 - RNA, 22 nt, Pseudomonas putida KT2440
uggugcaauggucauugaaggc

SEQ ID NO: 3583099 - RNA, 21 nt, Pseudomonas putida KT2440
uggugcagguugauccagccc

SEQ ID NO: 3583100 - RNA, 16 nt, Pseudomonas putida KT2440
uggugccaucaccgcc

SEQ ID NO: 3583101 - RNA, 16 nt, Pseudomonas putida KT2440
uggugcccuugaugau

SEQ ID NO: 3583102 - RNA, 17 nt, Pseudomonas putida KT2440
uggugccugucgucagc

SEQ ID NO: 3583103 - RNA, 13 nt, Pseudomonas putida KT2440
uggugcgcccggc

SEQ ID NO: 3583104 - RNA, 15 nt, Pseudomonas putida KT2440
uggugcgggccacca

SEQ ID NO: 3583105 - RNA, 14 nt, Pseudomonas putida KT2440
uggugcucagcggc

SEQ ID NO: 3583106 - RNA, 15 nt, Pseudomonas putida KT2440
uggugcucaugaucc

SEQ ID NO: 3583107 - RNA, 11 nt, Pseudomonas putida KT2440
uggugcuggcg

SEQ ID NO: 3583108 - RNA, 12 nt, Pseudomonas putida KT2440
uggugcuggcgg

SEQ ID NO: 3583109 - RNA, 15 nt, Pseudomonas putida KT2440
ugguggcccugaccg

SEQ ID NO: 3583110 - RNA, 19 nt, Pseudomonas putida KT2440
ugguggucacguuugcaaa

SEQ ID NO: 3583111 - RNA, 15 nt, Pseudomonas putida KT2440
ugguggugcugggca

SEQ ID NO: 3583112 - RNA, 16 nt, Pseudomonas putida KT2440
ugguggugcugggcau

SEQ ID NO: 3583113 - RNA, 20 nt, Pseudomonas putida KT2440
ugguguaauccaucaccaca

SEQ ID NO: 3583114 - RNA, 18 nt, Pseudomonas putida KT2440
ugguguacagcaacaccg

SEQ ID NO: 3583115 - RNA, 13 nt, Pseudomonas putida KT2440
ugguguccggcau

SEQ ID NO: 3583116 - RNA, 17 nt, Pseudomonas putida KT2440
ugguguccggcaugugc

SEQ ID NO: 3583117 - RNA, 13 nt, Pseudomonas putida KT2440
ugguguccuuguc

SEQ ID NO: 3583118 - RNA, 20 nt, Pseudomonas putida KT2440
uggugucggccagggcccgc

SEQ ID NO: 3583119 - RNA, 20 nt, Pseudomonas putida KT2440
uggugucguucgaacuccgc

SEQ ID NO: 3583120 - RNA, 22 nt, Pseudomonas putida KT2440
uggugugaaauagccacgcauc

SEQ ID NO: 3583121 - RNA, 13 nt, Pseudomonas putida KT2440
ugguguggcagcu

SEQ ID NO: 3583122 - RNA, 13 nt, Pseudomonas putida KT2440
ugguuaucuucuc

SEQ ID NO: 3583123 - RNA, 16 nt, Pseudomonas putida KT2440
ugguucaucaccagcc

SEQ ID NO: 3583124 - RNA, 15 nt, Pseudomonas putida KT2440
ugguucaucgacugg

SEQ ID NO: 3583125 - RNA, 19 nt, Pseudomonas putida KT2440
ugguucaucgacuugcguc

SEQ ID NO: 3583126 - RNA, 20 nt, Pseudomonas putida KT2440
ugguucaucgacuugcgucc

SEQ ID NO: 3583127 - RNA, 16 nt, Pseudomonas putida KT2440
ugguucugaaaccagu

SEQ ID NO: 3583128 - RNA, 15 nt, Pseudomonas putida KT2440
ugguucugcugcagc

SEQ ID NO: 3583129 - RNA, 12 nt, Pseudomonas putida KT2440
ugguucuugccg

SEQ ID NO: 3583130 - RNA, 17 nt, Pseudomonas putida KT2440
ugguucuugccgagcag

SEQ ID NO: 3583131 - RNA, 18 nt, Pseudomonas putida KT2440
ugguucuugccgagcagc

SEQ ID NO: 3583132 - RNA, 17 nt, Pseudomonas putida KT2440
ugguugaccgagaacag

SEQ ID NO: 3583133 - RNA, 21 nt, Pseudomonas putida KT2440
ugguugaucaacugugccugg

SEQ ID NO: 3583134 - RNA, 15 nt, Pseudomonas putida KT2440
ugguugcccaugcac

SEQ ID NO: 3583135 - RNA, 22 nt, Pseudomonas putida KT2440
ugguugcccaugcacagcgagc

SEQ ID NO: 3583136 - RNA, 12 nt, Pseudomonas putida KT2440
ugguuguagccc

SEQ ID NO: 3583137 - RNA, 16 nt, Pseudomonas putida KT2440
ugguuguagcccgggc

SEQ ID NO: 3583138 - RNA, 19 nt, Pseudomonas putida KT2440
ugguugucgaacagcaucc

SEQ ID NO: 3583139 - RNA, 16 nt, Pseudomonas putida KT2440
ugguugugcuggcccu

SEQ ID NO: 3583140 - RNA, 22 nt, Pseudomonas putida KT2440
ugguuugccgugcccaccagcg

SEQ ID NO: 3583141 - RNA, 16 nt, Pseudomonas putida KT2440
ugguuuggccucuggc

SEQ ID NO: 3583142 - RNA, 13 nt, Pseudomonas putida KT2440
ugguuugugggua

SEQ ID NO: 3583143 - RNA, 21 nt, Pseudomonas putida KT2440
ugguuuguggguacugcuuca

SEQ ID NO: 3583144 - RNA, 18 nt, Pseudomonas putida KT2440
ugguuuuccaccggcacg

SEQ ID NO: 3583145 - RNA, 13 nt, Pseudomonas putida KT2440
ugguuuucgcggu

SEQ ID NO: 3583146 - RNA, 21 nt, Pseudomonas putida KT2440
uguacaacgcagccggcaccg

SEQ ID NO: 3583147 - RNA, 19 nt, Pseudomonas putida KT2440
uguacagaucgauccccug

SEQ ID NO: 3583148 - RNA, 12 nt, Pseudomonas putida KT2440
uguacagcaaca

SEQ ID NO: 3583149 - RNA, 16 nt, Pseudomonas putida KT2440
uguacagcacaccuuc

SEQ ID NO: 3583150 - RNA, 19 nt, Pseudomonas putida KT2440
uguacaguggcacuggcgc

SEQ ID NO: 3583151 - RNA, 16 nt, Pseudomonas putida KT2440
uguacccgcuggcuga

SEQ ID NO: 3583152 - RNA, 13 nt, Pseudomonas putida KT2440
uguaccgccguca

SEQ ID NO: 3583153 - RNA, 22 nt, Pseudomonas putida KT2440
uguaccgccgucaacucgccaa

SEQ ID NO: 3583154 - RNA, 14 nt, Pseudomonas putida KT2440
uguacgacugccgc

SEQ ID NO: 3583155 - RNA, 14 nt, Pseudomonas putida KT2440
uguacgcuggccaa

SEQ ID NO: 3583156 - RNA, 14 nt, Pseudomonas putida KT2440
uguacguugccaga

SEQ ID NO: 3583157 - RNA, 19 nt, Pseudomonas putida KT2440
uguacucaggggcauugcg

SEQ ID NO: 3583158 - RNA, 19 nt, Pseudomonas putida KT2440
uguagaacggcagcaggcc

SEQ ID NO: 3583159 - RNA, 21 nt, Pseudomonas putida KT2440
uguagaacggcagcaggccaa

SEQ ID NO: 3583160 - RNA, 15 nt, Pseudomonas putida KT2440
uguagaccaccagcg

SEQ ID NO: 3583161 - RNA, 19 nt, Pseudomonas putida KT2440
uguagauauugaccagcga

SEQ ID NO: 3583162 - RNA, 13 nt, Pseudomonas putida KT2440
uguagaucgccgg

SEQ ID NO: 3583163 - RNA, 19 nt, Pseudomonas putida KT2440
uguagaucgccggcagcac

SEQ ID NO: 3583164 - RNA, 17 nt, Pseudomonas putida KT2440
uguagcaauggcccugg

SEQ ID NO: 3583165 - RNA, 15 nt, Pseudomonas putida KT2440
uguagcccaccaccu

SEQ ID NO: 3583166 - RNA, 14 nt, Pseudomonas putida KT2440
uguagccggcaguc

SEQ ID NO: 3583167 - RNA, 23 nt, Pseudomonas putida KT2440
uguagcgggucacugcgcgccgu

SEQ ID NO: 3583168 - RNA, 20 nt, Pseudomonas putida KT2440
uguagcggucgaacauguag

SEQ ID NO: 3583169 - RNA, 20 nt, Pseudomonas putida KT2440
uguagcucagguagaccugc

SEQ ID NO: 3583170 - RNA, 22 nt, Pseudomonas putida KT2440
uguagcucccucgguuucucac

SEQ ID NO: 3583171 - RNA, 21 nt, Pseudomonas putida KT2440
uguaggacaucuggucagucg

SEQ ID NO: 3583172 - RNA, 20 nt, Pseudomonas putida KT2440
uguaggagcgggcuuacccg

SEQ ID NO: 3583173 - RNA, 23 nt, Pseudomonas putida KT2440
uguaggagcgggcuuacccgcga

SEQ ID NO: 3583174 - RNA, 13 nt, Pseudomonas putida KT2440
uguaggagcgggu

SEQ ID NO: 3583175 - RNA, 14 nt, Pseudomonas putida KT2440
uguaggagcggguu

SEQ ID NO: 3583176 - RNA, 23 nt, Pseudomonas putida KT2440
uguaggagcggguuuacccgcga

SEQ ID NO: 3583177 - RNA, 14 nt, Pseudomonas putida KT2440
uguaggcagcugcc

SEQ ID NO: 3583178 - RNA, 20 nt, Pseudomonas putida KT2440
uguaggcgcaacucagcgca

SEQ ID NO: 3583179 - RNA, 13 nt, Pseudomonas putida KT2440
uguaggcgcgggu

SEQ ID NO: 3583180 - RNA, 14 nt, Pseudomonas putida KT2440
uguaggcgcggguu

SEQ ID NO: 3583181 - RNA, 20 nt, Pseudomonas putida KT2440
uguaggcgcggguuuacccg

SEQ ID NO: 3583182 - RNA, 20 nt, Pseudomonas putida KT2440
uguaggugcggcuuuagccg

SEQ ID NO: 3583183 - RNA, 20 nt, Pseudomonas putida KT2440
uguaucggauuggcgcggcu

SEQ ID NO: 3583184 - RNA, 13 nt, Pseudomonas putida KT2440
uguauuuagucag

SEQ ID NO: 3583185 - RNA, 16 nt, Pseudomonas putida KT2440
ugucaacaggcuggcc

SEQ ID NO: 3583186 - RNA, 11 nt, Pseudomonas putida KT2440
ugucacauugg

SEQ ID NO: 3583187 - RNA, 17 nt, Pseudomonas putida KT2440
ugucacccagcacuucg

SEQ ID NO: 3583188 - RNA, 22 nt, Pseudomonas putida KT2440
ugucaccccguucgcccugcgc

SEQ ID NO: 3583189 - RNA, 21 nt, Pseudomonas putida KT2440
ugucacccuugggcaccagcu

SEQ ID NO: 3583190 - RNA, 15 nt, Pseudomonas putida KT2440
ugucacccuugguca

SEQ ID NO: 3583191 - RNA, 22 nt, Pseudomonas putida KT2440
ugucaccgagacgaucaccagg

SEQ ID NO: 3583192 - RNA, 20 nt, Pseudomonas putida KT2440
ugucaccgcgagcagcguuc

SEQ ID NO: 3583193 - RNA, 20 nt, Pseudomonas putida KT2440
ugugcuccagcuccaggcga

SEQ ID NO: 3583194 - RNA, 13 nt, Pseudomonas putida KT2440
ugugcucccacag

SEQ ID NO: 3583195 - RNA, 13 nt, Pseudomonas putida KT2440
ugugcuggcgcgc

SEQ ID NO: 3583196 - RNA, 14 nt, Pseudomonas putida KT2440
uguggauuucaauu

SEQ ID NO: 3583197 - RNA, 19 nt, Pseudomonas putida KT2440
uguggcaauugcacccgcg

SEQ ID NO: 3583198 - RNA, 18 nt, Pseudomonas putida KT2440
uguggcagcggcuuggcc

SEQ ID NO: 3583199 - RNA, 20 nt, Pseudomonas putida KT2440
uguggcagcucugcgacuga

SEQ ID NO: 3583200 - RNA, 16 nt, Pseudomonas putida KT2440
uguggcgccagggcau

SEQ ID NO: 3583201 - RNA, 14 nt, Pseudomonas putida KT2440
ugugggagcggccu

SEQ ID NO: 3583202 - RNA, 20 nt, Pseudomonas putida KT2440
ugugggagcggccuugcguc

SEQ ID NO: 3583203 - RNA, 20 nt, Pseudomonas putida KT2440
ugugggagcggccuuguguc

SEQ ID NO: 3583204 - RNA, 20 nt, Pseudomonas putida KT2440
ugugggagcgggacugcccg

SEQ ID NO: 3583205 - RNA, 20 nt, Pseudomonas putida KT2440
ugugggagcgggcgugcccg

SEQ ID NO: 3583206 - RNA, 18 nt, Pseudomonas putida KT2440
ugugggagcgggcuugcc

SEQ ID NO: 3583207 - RNA, 19 nt, Pseudomonas putida KT2440
ugugggagcgggucagccu

SEQ ID NO: 3583208 - RNA, 16 nt, Pseudomonas putida KT2440
uguggggcaacugcgc

SEQ ID NO: 3583209 - RNA, 21 nt, Pseudomonas putida KT2440
uguggugagcccugugggagc

SEQ ID NO: 3583210 - RNA, 22 nt, Pseudomonas putida KT2440
ugugguugacguuggccgccag

SEQ ID NO: 3583211 - RNA, 22 nt, Pseudomonas putida KT2440
ugugguuucacacucgccagga

SEQ ID NO: 3583212 - RNA, 23 nt, Pseudomonas putida KT2440
uguguacgggacaaggcauuuuc

SEQ ID NO: 3583213 - RNA, 13 nt, Pseudomonas putida KT2440
uguguccaccacc

SEQ ID NO: 3583214 - RNA, 16 nt, Pseudomonas putida KT2440
ugugucgaaccacuga

SEQ ID NO: 3583215 - RNA, 17 nt, Pseudomonas putida KT2440
ugugugaacggcgccug

SEQ ID NO: 3583216 - RNA, 20 nt, Pseudomonas putida KT2440
ugugugcaagucugaaaaca

SEQ ID NO: 3583217 - RNA, 13 nt, Pseudomonas putida KT2440
uguguucgcugcg

SEQ ID NO: 3583218 - RNA, 13 nt, Pseudomonas putida KT2440
uguuaaguauuaa

SEQ ID NO: 3583219 - RNA, 15 nt, Pseudomonas putida KT2440
uguuaccggccuggc

SEQ ID NO: 3583220 - RNA, 18 nt, Pseudomonas putida KT2440
uguuacggacgggcguug

SEQ ID NO: 3583221 - RNA, 22 nt, Pseudomonas putida KT2440
uguuagaaaacugggcagcccu

SEQ ID NO: 3583222 - RNA, 14 nt, Pseudomonas putida KT2440
uguuauugggacca

SEQ ID NO: 3583223 - RNA, 22 nt, Pseudomonas putida KT2440
uguucaaccggaaucugcucgg

SEQ ID NO: 3583224 - RNA, 18 nt, Pseudomonas putida KT2440
uguucaacgcaaugggca

SEQ ID NO: 3583225 - RNA, 15 nt, Pseudomonas putida KT2440
uguucaccuugggcg

SEQ ID NO: 3583226 - RNA, 19 nt, Pseudomonas putida KT2440
uguucacggucaggccuga

SEQ ID NO: 3583227 - RNA, 16 nt, Pseudomonas putida KT2440
uguucagauacgccug

SEQ ID NO: 3583228 - RNA, 19 nt, Pseudomonas putida KT2440
uguucagcaccuucuugcc

SEQ ID NO: 3583229 - RNA, 20 nt, Pseudomonas putida KT2440
uguucagcaccuucuugccc

SEQ ID NO: 3583230 - RNA, 22 nt, Pseudomonas putida KT2440
uguucagcagcgaagggcucaa

SEQ ID NO: 3583231 - RNA, 23 nt, Pseudomonas putida KT2440
uguucagcccuugcugcagcagg

SEQ ID NO: 3583232 - RNA, 19 nt, Pseudomonas putida KT2440
uguucagguguuccagcac

SEQ ID NO: 3583233 - RNA, 22 nt, Pseudomonas putida KT2440
uguuccacgcgcaggcgcugca

SEQ ID NO: 3583234 - RNA, 20 nt, Pseudomonas putida KT2440
uguuccagccgcgccacucc

SEQ ID NO: 3583235 - RNA, 22 nt, Pseudomonas putida KT2440
uguuccagccgcgccacuccca

SEQ ID NO: 3583236 - RNA, 18 nt, Pseudomonas putida KT2440
uguuccauuucacuggcu

SEQ ID NO: 3583237 - RNA, 14 nt, Pseudomonas putida KT2440
uguucccagcaccc

SEQ ID NO: 3583238 - RNA, 17 nt, Pseudomonas putida KT2440
uguucccagcaccccag

SEQ ID NO: 3583239 - RNA, 14 nt, Pseudomonas putida KT2440
uguucccccaccgg

SEQ ID NO: 3583240 - RNA, 15 nt, Pseudomonas putida KT2440
uguucccccaccggc

SEQ ID NO: 3583241 - RNA, 23 nt, Pseudomonas putida KT2440
uguucccccaccggccgccgcca

SEQ ID NO: 3583242 - RNA, 22 nt, Pseudomonas putida KT2440
uguuccggccucuucgcgggca

SEQ ID NO: 3583243 - RNA, 18 nt, Pseudomonas putida KT2440
uguucgauuucaccggcu

SEQ ID NO: 3583244 - RNA, 20 nt, Pseudomonas putida KT2440
uguucgcgaggaaacccgcg

SEQ ID NO: 3583245 - RNA, 22 nt, Pseudomonas putida KT2440
uguucgcgcaggauccacgccu

SEQ ID NO: 3583246 - RNA, 20 nt, Pseudomonas putida KT2440
uguucgcgggugaacccgcu

SEQ ID NO: 3583247 - RNA, 16 nt, Pseudomonas putida KT2440
uguucggugcucaggc

SEQ ID NO: 3583248 - RNA, 18 nt, Pseudomonas putida KT2440
uguucguaggucaggucg

SEQ ID NO: 3583249 - RNA, 15 nt, Pseudomonas putida KT2440
uguucguucccacaa

SEQ ID NO: 3583250 - RNA, 17 nt, Pseudomonas putida KT2440
uguucugcccggcugga

SEQ ID NO: 3583251 - RNA, 13 nt, Pseudomonas putida KT2440
uguucuggccacc

SEQ ID NO: 3583252 - RNA, 18 nt, Pseudomonas putida KT2440
uguucuugaacucgccgc

SEQ ID NO: 3583253 - RNA, 14 nt, Pseudomonas putida KT2440
uguucuuguagcug

SEQ ID NO: 3583254 - RNA, 13 nt, Pseudomonas putida KT2440
uguugagcaacag

SEQ ID NO: 3583255 - RNA, 19 nt, Pseudomonas putida KT2440
uguugaugccacgggcaaa

SEQ ID NO: 3583256 - RNA, 19 nt, Pseudomonas putida KT2440
uguugccaaugccggcaca

SEQ ID NO: 3583257 - RNA, 22 nt, Pseudomonas putida KT2440
uguugccacccagaucaucauc

SEQ ID NO: 3583258 - RNA, 14 nt, Pseudomonas putida KT2440
uguugccacccggc

SEQ ID NO: 3583259 - RNA, 19 nt, Pseudomonas putida KT2440
uguugccugcgauuuaugc

SEQ ID NO: 3583260 - RNA, 22 nt, Pseudomonas putida KT2440
uguugcgguggaagcuggcuac

SEQ ID NO: 3583261 - RNA, 20 nt, Pseudomonas putida KT2440
uguugcugcagguucugaau

SEQ ID NO: 3583262 - RNA, 13 nt, Pseudomonas putida KT2440
uguugcugggcga

SEQ ID NO: 3583263 - RNA, 12 nt, Pseudomonas putida KT2440
uguugcuugucc

SEQ ID NO: 3583264 - RNA, 19 nt, Pseudomonas putida KT2440
uguuggaugcuucgcgggu

SEQ ID NO: 3583265 - RNA, 23 nt, Pseudomonas putida KT2440
uguuggcacggcugaaaugcccg

SEQ ID NO: 3583266 - RNA, 22 nt, Pseudomonas putida KT2440
uguuggccaccaucgccggcac

SEQ ID NO: 3583267 - RNA, 17 nt, Pseudomonas putida KT2440
uguuggcgcgacauguu

SEQ ID NO: 3583268 - RNA, 15 nt, Pseudomonas putida KT2440
uguugggcgggccgc

SEQ ID NO: 3583269 - RNA, 18 nt, Pseudomonas putida KT2440
uguugggcgggccgccga

SEQ ID NO: 3583270 - RNA, 15 nt, Pseudomonas putida KT2440
uguugguguggcagc

SEQ ID NO: 3583271 - RNA, 16 nt, Pseudomonas putida KT2440
uguugucgaagcgcac

SEQ ID NO: 3583272 - RNA, 15 nt, Pseudomonas putida KT2440
uguuguuugggccug

SEQ ID NO: 3583273 - RNA, 19 nt, Pseudomonas putida KT2440
uguuuacaaccuguaacuc

SEQ ID NO: 3583274 - RNA, 14 nt, Pseudomonas putida KT2440
uguuucagcccuug

SEQ ID NO: 3583275 - RNA, 15 nt, Pseudomonas putida KT2440
uguuucagccuuggc

SEQ ID NO: 3583276 - RNA, 20 nt, Pseudomonas putida KT2440
uguuuccaccccggcagugc

SEQ ID NO: 3583277 - RNA, 18 nt, Pseudomonas putida KT2440
uguuucugccccuggccc

SEQ ID NO: 3583278 - RNA, 22 nt, Pseudomonas putida KT2440
uguuugaccaccagacgggcau

SEQ ID NO: 3583279 - RNA, 16 nt, Pseudomonas putida KT2440
uguuugggccugugcc

SEQ ID NO: 3583280 - RNA, 22 nt, Pseudomonas putida KT2440
uguuugggccugugccggccgc

SEQ ID NO: 3583281 - RNA, 15 nt, Pseudomonas putida KT2440
uguuugggcuugagc

SEQ ID NO: 3583282 - RNA, 18 nt, Pseudomonas putida KT2440
uguuuggguugacgguga

SEQ ID NO: 3583283 - RNA, 11 nt, Pseudomonas putida KT2440
uguuuugagag

SEQ ID NO: 3583284 - RNA, 18 nt, Pseudomonas putida KT2440
uguuuugccuccagcuuu

SEQ ID NO: 3583285 - RNA, 13 nt, Pseudomonas putida KT2440
uuaacaaggcacg

SEQ ID NO: 3583286 - RNA, 21 nt, Pseudomonas putida KT2440
uuaacacagguaguucacugg

SEQ ID NO: 3583287 - RNA, 12 nt, Pseudomonas putida KT2440
uuaacaugcugg

SEQ ID NO: 3583288 - RNA, 21 nt, Pseudomonas putida KT2440
uuaagaagccgacccacuugu

SEQ ID NO: 3583289 - RNA, 16 nt, Pseudomonas putida KT2440
uuaagcgccggcgggg

SEQ ID NO: 3583290 - RNA, 14 nt, Pseudomonas putida KT2440
uuaagcggucucgg

SEQ ID NO: 3583291 - RNA, 21 nt, Pseudomonas putida KT2440
uuaaguauuaauuugaacaau

SEQ ID NO: 3583292 - RNA, 21 nt, Pseudomonas putida KT2440
uuaauccugccggcuucacua

SEQ ID NO: 3583293 - RNA, 12 nt, Pseudomonas putida KT2440
uuaaugcacgcc

SEQ ID NO: 3583294 - RNA, 19 nt, Pseudomonas putida KT2440
uuacagaugucuggcauca

SEQ ID NO: 3583295 - RNA, 16 nt, Pseudomonas putida KT2440
uuaccacauaacugcc

SEQ ID NO: 3583296 - RNA, 17 nt, Pseudomonas putida KT2440
uuaccacauaacugccg

SEQ ID NO: 3583297 - RNA, 11 nt, Pseudomonas putida KT2440
uuaccaccggg

SEQ ID NO: 3583298 - RNA, 14 nt, Pseudomonas putida KT2440
uuccaccugcgccu

SEQ ID NO: 3583299 - RNA, 15 nt, Pseudomonas putida KT2440
uuccagcagcgacac

SEQ ID NO: 3583300 - RNA, 12 nt, Pseudomonas putida KT2440
uuccagcaucgg

SEQ ID NO: 3583301 - RNA, 18 nt, Pseudomonas putida KT2440
uuccagcccgccugcuca

SEQ ID NO: 3583302 - RNA, 18 nt, Pseudomonas putida KT2440
uuccagccugcagcaccc

SEQ ID NO: 3583303 - RNA, 13 nt, Pseudomonas putida KT2440
uuccagcugucau

SEQ ID NO: 3583304 - RNA, 16 nt, Pseudomonas putida KT2440
uuccagcuucugcugg

SEQ ID NO: 3583305 - RNA, 20 nt, Pseudomonas putida KT2440
uuccagcuucugcugguccu

SEQ ID NO: 3583306 - RNA, 18 nt, Pseudomonas putida KT2440
uuccaggcuuuugaaguc

SEQ ID NO: 3583307 - RNA, 14 nt, Pseudomonas putida KT2440
uuccagucggccug

SEQ ID NO: 3583308 - RNA, 15 nt, Pseudomonas putida KT2440
uuccagucggccuga

SEQ ID NO: 3583309 - RNA, 22 nt, Pseudomonas putida KT2440
uuccagucggccugaugccuca

SEQ ID NO: 3583310 - RNA, 23 nt, Pseudomonas putida KT2440
uuccagugccgccaccuggcugc

SEQ ID NO: 3583311 - RNA, 17 nt, Pseudomonas putida KT2440
uuccaguuggcagggca

SEQ ID NO: 3583312 - RNA, 21 nt, Pseudomonas putida KT2440
uuccaguuggccggcauggcg

SEQ ID NO: 3583313 - RNA, 22 nt, Pseudomonas putida KT2440
uuccauagugugcucacgguga

SEQ ID NO: 3583314 - RNA, 18 nt, Pseudomonas putida KT2440
uuccaucgaaguguugcc

SEQ ID NO: 3583315 - RNA, 21 nt, Pseudomonas putida KT2440
uuccaugcgcgcgcgguucac

SEQ ID NO: 3583316 - RNA, 16 nt, Pseudomonas putida KT2440
uuccauuucacuggcu

SEQ ID NO: 3583317 - RNA, 18 nt, Pseudomonas putida KT2440
uucccaauccucagcgcg

SEQ ID NO: 3583318 - RNA, 20 nt, Pseudomonas putida KT2440
uucccagcaccccagcacca

SEQ ID NO: 3583319 - RNA, 23 nt, Pseudomonas putida KT2440
uucccagcaccccagcaccaccc

SEQ ID NO: 3583320 - RNA, 17 nt, Pseudomonas putida KT2440
uucccauccacuucgca

SEQ ID NO: 3583321 - RNA, 18 nt, Pseudomonas putida KT2440
uucccauccacuucgcaa

SEQ ID NO: 3583322 - RNA, 21 nt, Pseudomonas putida KT2440
uucccgccauguugcgcagca

SEQ ID NO: 3583323 - RNA, 21 nt, Pseudomonas putida KT2440
uucccgccauugcaccacgcc

SEQ ID NO: 3583324 - RNA, 17 nt, Pseudomonas putida KT2440
uucccggccuggcgcag

SEQ ID NO: 3583325 - RNA, 15 nt, Pseudomonas putida KT2440
uucccggugcuggcu

SEQ ID NO: 3583326 - RNA, 19 nt, Pseudomonas putida KT2440
uuccgcacgucagacuuuc

SEQ ID NO: 3583327 - RNA, 16 nt, Pseudomonas putida KT2440
uuccgccaccacgaac

SEQ ID NO: 3583328 - RNA, 20 nt, Pseudomonas putida KT2440
uuccgccgcuuuguuugcug

SEQ ID NO: 3583329 - RNA, 23 nt, Pseudomonas putida KT2440
uuccgccgggaugguaacgggca

SEQ ID NO: 3583330 - RNA, 13 nt, Pseudomonas putida KT2440
uuccgccgucacc

SEQ ID NO: 3583331 - RNA, 18 nt, Pseudomonas putida KT2440
uuccgcgugcccccccaa

SEQ ID NO: 3583332 - RNA, 20 nt, Pseudomonas putida KT2440
uuccgcuggggauggcaccg

SEQ ID NO: 3583333 - RNA, 19 nt, Pseudomonas putida KT2440
uuccggcacggugcuacca

SEQ ID NO: 3583334 - RNA, 18 nt, Pseudomonas putida KT2440
uuccggcaugaacacaua

SEQ ID NO: 3583335 - RNA, 21 nt, Pseudomonas putida KT2440
uuccggcccuuucgcggguaa

SEQ ID NO: 3583336 - RNA, 14 nt, Pseudomonas putida KT2440
uuccggcugcagca

SEQ ID NO: 3583337 - RNA, 18 nt, Pseudomonas putida KT2440
uuccgggcaaugcaggca

SEQ ID NO: 3583338 - RNA, 19 nt, Pseudomonas putida KT2440
uuccgggcaaugcaggcag

SEQ ID NO: 3583339 - RNA, 20 nt, Pseudomonas putida KT2440
uuccgggcugcugcgcagcc

SEQ ID NO: 3583340 - RNA, 21 nt, Pseudomonas putida KT2440
uuccggggugaugaugcagua

SEQ ID NO: 3583341 - RNA, 13 nt, Pseudomonas putida KT2440
uuccggguccagu

SEQ ID NO: 3583342 - RNA, 15 nt, Pseudomonas putida KT2440
uuccguuggccacca

SEQ ID NO: 3583343 - RNA, 12 nt, Pseudomonas putida KT2440
uuccuccaucuc

SEQ ID NO: 3583344 - RNA, 23 nt, Pseudomonas putida KT2440
uuccucgaacgacagcugcaaca

SEQ ID NO: 3583345 - RNA, 22 nt, Pseudomonas putida KT2440
uuccugaguauucuccuucuuc

SEQ ID NO: 3583346 - RNA, 22 nt, Pseudomonas putida KT2440
uuccugaguuagacauuagaaa

SEQ ID NO: 3583347 - RNA, 20 nt, Pseudomonas putida KT2440
uuccuggaagcggaaguuca

SEQ ID NO: 3583348 - RNA, 20 nt, Pseudomonas putida KT2440
uuccuggccuuccuugccca

SEQ ID NO: 3583349 - RNA, 20 nt, Pseudomonas putida KT2440
uuccugggaagcugcagcag

SEQ ID NO: 3583350 - RNA, 13 nt, Pseudomonas putida KT2440
uuccuuggucagg

SEQ ID NO: 3583351 - RNA, 18 nt, Pseudomonas putida KT2440
uucgaaaaccugcugaca

SEQ ID NO: 3583352 - RNA, 15 nt, Pseudomonas putida KT2440
uucgaaaccacccug

SEQ ID NO: 3583353 - RNA, 19 nt, Pseudomonas putida KT2440
uucgaacacccgcuugccu

SEQ ID NO: 3583354 - RNA, 20 nt, Pseudomonas putida KT2440
uucgaagugccacgccgaaa

SEQ ID NO: 3583355 - RNA, 14 nt, Pseudomonas putida KT2440
uucgaauccugcug

SEQ ID NO: 3583356 - RNA, 19 nt, Pseudomonas putida KT2440
uucgaauccugcugagucc

SEQ ID NO: 3583357 - RNA, 19 nt, Pseudomonas putida KT2440
uucgaaucgcucaugcccc

SEQ ID NO: 3583358 - RNA, 20 nt, Pseudomonas putida KT2440
uucgacaugcaguugagccc

SEQ ID NO: 3583359 - RNA, 17 nt, Pseudomonas putida KT2440
uucgaccaccgcaggug

SEQ ID NO: 3583360 - RNA, 17 nt, Pseudomonas putida KT2440
uucgaccacugcaggug

SEQ ID NO: 3583361 - RNA, 13 nt, Pseudomonas putida KT2440
uucgacgcagagg

SEQ ID NO: 3583362 - RNA, 19 nt, Pseudomonas putida KT2440
uucgacgcugcuguccaga

SEQ ID NO: 3583363 - RNA, 23 nt, Pseudomonas putida KT2440
uucgacggucggcaguuugccga

SEQ ID NO: 3583364 - RNA, 12 nt, Pseudomonas putida KT2440
uucgacugccgc

SEQ ID NO: 3583365 - RNA, 23 nt, Pseudomonas putida KT2440
uucgagagccgggcaaugauccg

SEQ ID NO: 3583366 - RNA, 13 nt, Pseudomonas putida KT2440
uucgagccaccgg

SEQ ID NO: 3583367 - RNA, 21 nt, Pseudomonas putida KT2440
uucgaucggcgcgccuggcuc

SEQ ID NO: 3583368 - RNA, 18 nt, Pseudomonas putida KT2440
uucgaugguguucugguu

SEQ ID NO: 3583369 - RNA, 15 nt, Pseudomonas putida KT2440
uucgcaggcacgccc

SEQ ID NO: 3583370 - RNA, 19 nt, Pseudomonas putida KT2440
uucgcaggcacgcccgcuc

SEQ ID NO: 3583371 - RNA, 18 nt, Pseudomonas putida KT2440
uucgcauuaccagcacca

SEQ ID NO: 3583372 - RNA, 17 nt, Pseudomonas putida KT2440
uucgccaacuucgccga

SEQ ID NO: 3583373 - RNA, 23 nt, Pseudomonas putida KT2440
uucgccaaggccucgaacagcag

SEQ ID NO: 3583374 - RNA, 21 nt, Pseudomonas putida KT2440
uucgccacaacccaucacggc

SEQ ID NO: 3583375 - RNA, 16 nt, Pseudomonas putida KT2440
uucgccaucgcccguc

SEQ ID NO: 3583376 - RNA, 19 nt, Pseudomonas putida KT2440
uucgccaucgcccgucagc

SEQ ID NO: 3583377 - RNA, 13 nt, Pseudomonas putida KT2440
uucgcccaggcgc

SEQ ID NO: 3583378 - RNA, 13 nt, Pseudomonas putida KT2440
uucgcccgcaccg

SEQ ID NO: 3583379 - RNA, 23 nt, Pseudomonas putida KT2440
uucgcccugggcgagcaggugac

SEQ ID NO: 3583380 - RNA, 19 nt, Pseudomonas putida KT2440
uucgccgcgcuguggcgcc

SEQ ID NO: 3583381 - RNA, 19 nt, Pseudomonas putida KT2440
uucgccggcaagcugguca

SEQ ID NO: 3583382 - RNA, 19 nt, Pseudomonas putida KT2440
uucgccguuguucacgguc

SEQ ID NO: 3583383 - RNA, 16 nt, Pseudomonas putida KT2440
uucgcgcaagcaggug

SEQ ID NO: 3583384 - RNA, 15 nt, Pseudomonas putida KT2440
uucgcgcccgcagug

SEQ ID NO: 3583385 - RNA, 18 nt, Pseudomonas putida KT2440
uucgcgcccgcagugcac

SEQ ID NO: 3583386 - RNA, 19 nt, Pseudomonas putida KT2440
uucgcggaagauacccgcc

SEQ ID NO: 3583387 - RNA, 15 nt, Pseudomonas putida KT2440
uucgcggaaggcgac

SEQ ID NO: 3583388 - RNA, 16 nt, Pseudomonas putida KT2440
uucgcggccaagccgc

SEQ ID NO: 3583389 - RNA, 17 nt, Pseudomonas putida KT2440
uucgcggccaagccgcu

SEQ ID NO: 3583390 - RNA, 13 nt, Pseudomonas putida KT2440
uucgcgggcaagc

SEQ ID NO: 3583391 - RNA, 20 nt, Pseudomonas putida KT2440
uucgcgggcaagcccgcacc

SEQ ID NO: 3583392 - RNA, 18 nt, Pseudomonas putida KT2440
uucgcgggcaagcccgcg

SEQ ID NO: 3583393 - RNA, 18 nt, Pseudomonas putida KT2440
uucgcgggcaagcccgcu

SEQ ID NO: 3583394 - RNA, 19 nt, Pseudomonas putida KT2440
uucgcgggcacgcccgcuc

SEQ ID NO: 3583395 - RNA, 11 nt, Pseudomonas putida KT2440
uucgcgggcau

SEQ ID NO: 3583396 - RNA, 15 nt, Pseudomonas putida KT2440
uucgcgggcaugccc

SEQ ID NO: 3583397 - RNA, 14 nt, Pseudomonas putida KT2440
uucgcggguaaacc

SEQ ID NO: 3583398 - RNA, 19 nt, Pseudomonas putida KT2440
uucgcggguaaacccccuc

SEQ ID NO: 3583399 - RNA, 19 nt, Pseudomonas putida KT2440
uucgcggguaaacccgcuc

SEQ ID NO: 3583400 - RNA, 19 nt, Pseudomonas putida KT2440
uucgcggguagacccgcuc

SEQ ID NO: 3583401 - RNA, 23 nt, Pseudomonas putida KT2440
uucgcggucggucagcaccuggc

SEQ ID NO: 3583402 - RNA, 14 nt, Pseudomonas putida KT2440
uucgcucaaccguu

SEQ ID NO: 3583403 - RNA, 22 nt, Pseudomonas putida KT2440
uugauccagcugcugucgagca

SEQ ID NO: 3583404 - RNA, 17 nt, Pseudomonas putida KT2440
uugaucucaagcuucau

SEQ ID NO: 3583405 - RNA, 14 nt, Pseudomonas putida KT2440
uugaucuugcgccc

SEQ ID NO: 3583406 - RNA, 15 nt, Pseudomonas putida KT2440
uugaugaaauccacc

SEQ ID NO: 3583407 - RNA, 15 nt, Pseudomonas putida KT2440
uugaugaucugcucc

SEQ ID NO: 3583408 - RNA, 23 nt, Pseudomonas putida KT2440
uugaugugcaggucgauguccag

SEQ ID NO: 3583409 - RNA, 18 nt, Pseudomonas putida KT2440
uugcaaauacggccaaua

SEQ ID NO: 3583410 - RNA, 15 nt, Pseudomonas putida KT2440
uugcaacuggcgcag

SEQ ID NO: 3583411 - RNA, 18 nt, Pseudomonas putida KT2440
uugcaagccuucgucgcu

SEQ ID NO: 3583412 - RNA, 19 nt, Pseudomonas putida KT2440
uugcaaggaucauuugaaa

SEQ ID NO: 3583413 - RNA, 20 nt, Pseudomonas putida KT2440
uugcaccaacggcuucacau

SEQ ID NO: 3583414 - RNA, 23 nt, Pseudomonas putida KT2440
uugcacucccccuuggugcaaug

SEQ ID NO: 3583415 - RNA, 12 nt, Pseudomonas putida KT2440
uugcacuuccac

SEQ ID NO: 3583416 - RNA, 23 nt, Pseudomonas putida KT2440
uugcagaaacucguuuucgcuga

SEQ ID NO: 3583417 - RNA, 19 nt, Pseudomonas putida KT2440
uugcagcaacgccuuggcc

SEQ ID NO: 3583418 - RNA, 19 nt, Pseudomonas putida KT2440
uugcagcaagcgacauaaa

SEQ ID NO: 3583419 - RNA, 14 nt, Pseudomonas putida KT2440
uugcagcacaaggc

SEQ ID NO: 3583420 - RNA, 14 nt, Pseudomonas putida KT2440
uugcagccccagcc

SEQ ID NO: 3583421 - RNA, 17 nt, Pseudomonas putida KT2440
uugcagccccagccuca

SEQ ID NO: 3583422 - RNA, 21 nt, Pseudomonas putida KT2440
uugcagccccagccucagcug

SEQ ID NO: 3583423 - RNA, 23 nt, Pseudomonas putida KT2440
uugcagcucuugucgacagugaa

SEQ ID NO: 3583424 - RNA, 16 nt, Pseudomonas putida KT2440
uugcaggaacaaccug

SEQ ID NO: 3583425 - RNA, 14 nt, Pseudomonas putida KT2440
uugcaggccagcgu

SEQ ID NO: 3583426 - RNA, 19 nt, Pseudomonas putida KT2440
uugcaggggcugcaaggca

SEQ ID NO: 3583427 - RNA, 15 nt, Pseudomonas putida KT2440
uugcaguaucgcccc

SEQ ID NO: 3583428 - RNA, 18 nt, Pseudomonas putida KT2440
uugcagugccugugagau

SEQ ID NO: 3583429 - RNA, 20 nt, Pseudomonas putida KT2440
uugcaguugaaugccgccau

SEQ ID NO: 3583430 - RNA, 20 nt, Pseudomonas putida KT2440
uugcaucgcgcacuugccag

SEQ ID NO: 3583431 - RNA, 22 nt, Pseudomonas putida KT2440
uugcaucggugguuggacacag

SEQ ID NO: 3583432 - RNA, 16 nt, Pseudomonas putida KT2440
uugccaccacccgggg

SEQ ID NO: 3583433 - RNA, 15 nt, Pseudomonas putida KT2440
uugccaccagcauca

SEQ ID NO: 3583434 - RNA, 15 nt, Pseudomonas putida KT2440
uugccacccagauca

SEQ ID NO: 3583435 - RNA, 13 nt, Pseudomonas putida KT2440
uugccaccggcgc

SEQ ID NO: 3583436 - RNA, 21 nt, Pseudomonas putida KT2440
uugccagagugggucaguuug

SEQ ID NO: 3583437 - RNA, 15 nt, Pseudomonas putida KT2440
uugccagcauggugc

SEQ ID NO: 3583438 - RNA, 20 nt, Pseudomonas putida KT2440
uugccagcgucuuuggccug

SEQ ID NO: 3583439 - RNA, 17 nt, Pseudomonas putida KT2440
uugccagugauccggcg

SEQ ID NO: 3583440 - RNA, 19 nt, Pseudomonas putida KT2440
uugccauaacuccagcgcc

SEQ ID NO: 3583441 - RNA, 16 nt, Pseudomonas putida KT2440
uugcccaacucugccg

SEQ ID NO: 3583442 - RNA, 15 nt, Pseudomonas putida KT2440
uugcccagcaugcgc

SEQ ID NO: 3583443 - RNA, 15 nt, Pseudomonas putida KT2440
uugcccagcgcugca

SEQ ID NO: 3583444 - RNA, 14 nt, Pseudomonas putida KT2440
uugccccacucggc

SEQ ID NO: 3583445 - RNA, 19 nt, Pseudomonas putida KT2440
uugccccaggcccacggcg

SEQ ID NO: 3583446 - RNA, 15 nt, Pseudomonas putida KT2440
uugcccgacaagcca

SEQ ID NO: 3583447 - RNA, 20 nt, Pseudomonas putida KT2440
uugcccgcgaagaggccggu

SEQ ID NO: 3583448 - RNA, 14 nt, Pseudomonas putida KT2440
uugcccgcgaagca

SEQ ID NO: 3583449 - RNA, 23 nt, Pseudomonas putida KT2440
uugcccgcgaaugggccgcagag

SEQ ID NO: 3583450 - RNA, 19 nt, Pseudomonas putida KT2440
uugcccgcgacgaaaccca

SEQ ID NO: 3583451 - RNA, 21 nt, Pseudomonas putida KT2440
uugcccgcgacgaaacccagu

SEQ ID NO: 3583452 - RNA, 20 nt, Pseudomonas putida KT2440
uugcccgcgguaaugcgcac

SEQ ID NO: 3583453 - RNA, 16 nt, Pseudomonas putida KT2440
uugcccggcgagcgca

SEQ ID NO: 3583454 - RNA, 21 nt, Pseudomonas putida KT2440
uugcccgugacuaguggccac

SEQ ID NO: 3583455 - RNA, 23 nt, Pseudomonas putida KT2440
uugcccgugacuaguggccacuu

SEQ ID NO: 3583456 - RNA, 15 nt, Pseudomonas putida KT2440
uugcccuguggcugu

SEQ ID NO: 3583457 - RNA, 18 nt, Pseudomonas putida KT2440
uugcccuguuucuucaag

SEQ ID NO: 3583458 - RNA, 13 nt, Pseudomonas putida KT2440
uugccgaucagcg

SEQ ID NO: 3583459 - RNA, 19 nt, Pseudomonas putida KT2440
uugccgaugaugcgggcaa

SEQ ID NO: 3583460 - RNA, 18 nt, Pseudomonas putida KT2440
uugccgcgccgcaaagac

SEQ ID NO: 3583461 - RNA, 22 nt, Pseudomonas putida KT2440
uugccggccucuucgcggguaa

SEQ ID NO: 3583462 - RNA, 19 nt, Pseudomonas putida KT2440
uugccggccuugaccucga

SEQ ID NO: 3583463 - RNA, 21 nt, Pseudomonas putida KT2440
uugccgggagcggguuuucuc

SEQ ID NO: 3583464 - RNA, 20 nt, Pseudomonas putida KT2440
uugccggggcugcuuugcag

SEQ ID NO: 3583465 - RNA, 21 nt, Pseudomonas putida KT2440
uugccgggugcaucggcaccg

SEQ ID NO: 3583466 - RNA, 20 nt, Pseudomonas putida KT2440
uugccggucacuggcgacag

SEQ ID NO: 3583467 - RNA, 14 nt, Pseudomonas putida KT2440
uugccgguggugac

SEQ ID NO: 3583468 - RNA, 18 nt, Pseudomonas putida KT2440
uugccgugcccaccagcg

SEQ ID NO: 3583469 - RNA, 17 nt, Pseudomonas putida KT2440
uugccucaggugcacag

SEQ ID NO: 3583470 - RNA, 22 nt, Pseudomonas putida KT2440
uugccugccagaaucuggggcc

SEQ ID NO: 3583471 - RNA, 13 nt, Pseudomonas putida KT2440
uugccuggaauuc

SEQ ID NO: 3583472 - RNA, 20 nt, Pseudomonas putida KT2440
uugccugggccggugggcaa

SEQ ID NO: 3583473 - RNA, 16 nt, Pseudomonas putida KT2440
uugcgagcgcgggcag

SEQ ID NO: 3583474 - RNA, 16 nt, Pseudomonas putida KT2440
uugcgauccgccccau

SEQ ID NO: 3583475 - RNA, 15 nt, Pseudomonas putida KT2440
uugcgcaaggggucg

SEQ ID NO: 3583476 - RNA, 14 nt, Pseudomonas putida KT2440
uugcgcacgcgcuc

SEQ ID NO: 3583477 - RNA, 12 nt, Pseudomonas putida KT2440
uugcgcacggcc

SEQ ID NO: 3583478 - RNA, 17 nt, Pseudomonas putida KT2440
uugcgcagcaauccgcu

SEQ ID NO: 3583479 - RNA, 22 nt, Pseudomonas putida KT2440
uugcgcagcggcgucaccuucc

SEQ ID NO: 3583480 - RNA, 14 nt, Pseudomonas putida KT2440
uugcgcaucaagcg

SEQ ID NO: 3583481 - RNA, 15 nt, Pseudomonas putida KT2440
uugcgccagccgcuc

SEQ ID NO: 3583482 - RNA, 18 nt, Pseudomonas putida KT2440
uugcgcccggcgucgaac

SEQ ID NO: 3583483 - RNA, 14 nt, Pseudomonas putida KT2440
uugcgcgccagggc

SEQ ID NO: 3583484 - RNA, 19 nt, Pseudomonas putida KT2440
uugcgcuugagcguggcaa

SEQ ID NO: 3583485 - RNA, 20 nt, Pseudomonas putida KT2440
uugcggauagaacgggucau

SEQ ID NO: 3583486 - RNA, 16 nt, Pseudomonas putida KT2440
uugcggaucacuucca

SEQ ID NO: 3583487 - RNA, 17 nt, Pseudomonas putida KT2440
uugcggaucacuuccau

SEQ ID NO: 3583488 - RNA, 20 nt, Pseudomonas putida KT2440
uugcggcccuucgcgggcac

SEQ ID NO: 3583489 - RNA, 17 nt, Pseudomonas putida KT2440
uugcgggcuuucugguu

SEQ ID NO: 3583490 - RNA, 22 nt, Pseudomonas putida KT2440
uugcggguguggccacacugcu

SEQ ID NO: 3583491 - RNA, 16 nt, Pseudomonas putida KT2440
uugcggguuucgucga

SEQ ID NO: 3583492 - RNA, 22 nt, Pseudomonas putida KT2440
uugcgucaacucaucacucuug

SEQ ID NO: 3583493 - RNA, 24 nt, Pseudomonas putida KT2440
uugcgucgcgaugggcugcaaagc

SEQ ID NO: 3583494 - RNA, 16 nt, Pseudomonas putida KT2440
uugcgugccucagcca

SEQ ID NO: 3583495 - RNA, 23 nt, Pseudomonas putida KT2440
uugcuaauuucagguuucgggca

SEQ ID NO: 3583496 - RNA, 19 nt, Pseudomonas putida KT2440
uugcucauccacaccuucg

SEQ ID NO: 3583497 - RNA, 22 nt, Pseudomonas putida KT2440
uugcuccaguucauucccggcc

SEQ ID NO: 3583498 - RNA, 19 nt, Pseudomonas putida KT2440
uugcuccgcgaggcucuug

SEQ ID NO: 3583499 - RNA, 18 nt, Pseudomonas putida KT2440
uugcucgcagacuucgaa

SEQ ID NO: 3583500 - RNA, 17 nt, Pseudomonas putida KT2440
uugcucgcccgcaacau

SEQ ID NO: 3583501 - RNA, 16 nt, Pseudomonas putida KT2440
uugcucggugcugcug

SEQ ID NO: 3583502 - RNA, 15 nt, Pseudomonas putida KT2440
uugcucuuguuccgc

SEQ ID NO: 3583503 - RNA, 24 nt, Pseudomonas putida KT2440
uugcugaaauccagccgcccgaac

SEQ ID NO: 3583504 - RNA, 14 nt, Pseudomonas putida KT2440
uugcugaagucaua

SEQ ID NO: 3583505 - RNA, 15 nt, Pseudomonas putida KT2440
uugcugccgaccugc

SEQ ID NO: 3583506 - RNA, 19 nt, Pseudomonas putida KT2440
uugcugcucauacugcuga

SEQ ID NO: 3583507 - RNA, 13 nt, Pseudomonas putida KT2440
uugcugcucugca

SEQ ID NO: 3583508 - RNA, 17 nt, Pseudomonas putida KT2440
uugucugacagcaggaa

SEQ ID NO: 3583509 - RNA, 20 nt, Pseudomonas putida KT2440
uugucugacagcaggaacag

SEQ ID NO: 3583510 - RNA, 17 nt, Pseudomonas putida KT2440
uugucuguacugcggcu

SEQ ID NO: 3583511 - RNA, 13 nt, Pseudomonas putida KT2440
uugucuuccagcu

SEQ ID NO: 3583512 - RNA, 23 nt, Pseudomonas putida KT2440
uugugcagcacuucgaucaggca

SEQ ID NO: 3583513 - RNA, 23 nt, Pseudomonas putida KT2440
uugugcaucagcgugugacccag

SEQ ID NO: 3583514 - RNA, 19 nt, Pseudomonas putida KT2440
uugugccgcgccagcuccg

SEQ ID NO: 3583515 - RNA, 23 nt, Pseudomonas putida KT2440
uugugccuggcgcuugaucagcc

SEQ ID NO: 3583516 - RNA, 19 nt, Pseudomonas putida KT2440
uugugguagucgcucaggc

SEQ ID NO: 3583517 - RNA, 13 nt, Pseudomonas putida KT2440
uuguggucuuccu

SEQ ID NO: 3583518 - RNA, 15 nt, Pseudomonas putida KT2440
uuguucaccacaccc

SEQ ID NO: 3583519 - RNA, 13 nt, Pseudomonas putida KT2440
uuguuccaucaug

SEQ ID NO: 3583520 - RNA, 14 nt, Pseudomonas putida KT2440
uuguucgcgcagga

SEQ ID NO: 3583521 - RNA, 15 nt, Pseudomonas putida KT2440
uuguucggcaggcuc

SEQ ID NO: 3583522 - RNA, 19 nt, Pseudomonas putida KT2440
uuguucggcaggcucugcu

SEQ ID NO: 3583523 - RNA, 22 nt, Pseudomonas putida KT2440
uuguucggcaucggugcuuucu

SEQ ID NO: 3583524 - RNA, 13 nt, Pseudomonas putida KT2440
uuguugcaaccag

SEQ ID NO: 3583525 - RNA, 20 nt, Pseudomonas putida KT2440
uuguuggggucugcuuugca

SEQ ID NO: 3583526 - RNA, 20 nt, Pseudomonas putida KT2440
uuguuucgggccagucccuc

SEQ ID NO: 3583527 - RNA, 14 nt, Pseudomonas putida KT2440
uuuacagccagcau

SEQ ID NO: 3583528 - RNA, 22 nt, Pseudomonas putida KT2440
uuuaccggccgcucaccggcca

SEQ ID NO: 3583529 - RNA, 21 nt, Pseudomonas putida KT2440
uuuaccgguugcaggcgagcu

SEQ ID NO: 3583530 - RNA, 12 nt, Pseudomonas putida KT2440
uuuaccugcagc

SEQ ID NO: 3583531 - RNA, 19 nt, Pseudomonas putida KT2440
uuuaccugcagcucagcca

SEQ ID NO: 3583532 - RNA, 13 nt, Pseudomonas putida KT2440
uuuacgcauugcc

SEQ ID NO: 3583533 - RNA, 18 nt, Pseudomonas putida KT2440
uuuacgcugggcgugcca

SEQ ID NO: 3583534 - RNA, 15 nt, Pseudomonas putida KT2440
uuuacuggccaucca

SEQ ID NO: 3583535 - RNA, 21 nt, Pseudomonas putida KT2440
uuuaguauggaaauggaauuu

SEQ ID NO: 3583536 - RNA, 18 nt, Pseudomonas putida KT2440
uuuaguccugcagcggca

SEQ ID NO: 3583537 - RNA, 22 nt, Pseudomonas putida KT2440
uuucaaaaaaaggguugcaaag

SEQ ID NO: 3583538 - RNA, 20 nt, Pseudomonas putida KT2440
uuucaaaaacggugcagacc

SEQ ID NO: 3583539 - RNA, 19 nt, Pseudomonas putida KT2440
uuucaaaaguuggcacgca

SEQ ID NO: 3583540 - RNA, 20 nt, Pseudomonas putida KT2440
uuucaauuuccggcuuugau

SEQ ID NO: 3583541 - RNA, 15 nt, Pseudomonas putida KT2440
uuucacagcaaaaaa

SEQ ID NO: 3583542 - RNA, 18 nt, Pseudomonas putida KT2440
uuucaccacuaccgcaaa

SEQ ID NO: 3583543 - RNA, 20 nt, Pseudomonas putida KT2440
uuucaccccuuuacuggcca

SEQ ID NO: 3583544 - RNA, 15 nt, Pseudomonas putida KT2440
uuucacguuugcuca

SEQ ID NO: 3583545 - RNA, 16 nt, Pseudomonas putida KT2440
uuucacucaugguuuu

SEQ ID NO: 3583546 - RNA, 15 nt, Pseudomonas putida KT2440
uuucagauacugcac

SEQ ID NO: 3583547 - RNA, 16 nt, Pseudomonas putida KT2440
uuucagccuuggccgc

SEQ ID NO: 3583548 - RNA, 19 nt, Pseudomonas putida KT2440
uuucagcgccugccuggcc

SEQ ID NO: 3583549 - RNA, 20 nt, Pseudomonas putida KT2440
uuucaggcgcucaccuacug

SEQ ID NO: 3583550 - RNA, 17 nt, Pseudomonas putida KT2440
uuucaggguauugaacg

SEQ ID NO: 3583551 - RNA, 19 nt, Pseudomonas putida KT2440
uuucagggucugucggugg

SEQ ID NO: 3583552 - RNA, 21 nt, Pseudomonas putida KT2440
uuucaggucgaugauggcugc

SEQ ID NO: 3583553 - RNA, 14 nt, Pseudomonas putida KT2440
uuucagguuuacca

SEQ ID NO: 3583554 - RNA, 22 nt, Pseudomonas putida KT2440
uuucagguuuaccauuuuccuu

SEQ ID NO: 3583555 - RNA, 22 nt, Pseudomonas putida KT2440
uuucauccacauaggccagcuc

SEQ ID NO: 3583556 - RNA, 15 nt, Pseudomonas putida KT2440
uuuccaaaccugcga

SEQ ID NO: 3583557 - RNA, 20 nt, Pseudomonas putida KT2440
uuuccaccccggcagugccu

SEQ ID NO: 3583558 - RNA, 12 nt, Pseudomonas putida KT2440
uuuccaccggca

SEQ ID NO: 3583559 - RNA, 21 nt, Pseudomonas putida KT2440
uuuccaccuggccacccggcu

SEQ ID NO: 3583560 - RNA, 21 nt, Pseudomonas putida KT2440
uuuccagcgccacccaggcau

SEQ ID NO: 3583561 - RNA, 16 nt, Pseudomonas putida KT2440
uuuccagguccuugcu

SEQ ID NO: 3583562 - RNA, 22 nt, Pseudomonas putida KT2440
uuuccggcccgguuggcgcuuc

SEQ ID NO: 3583563 - RNA, 20 nt, Pseudomonas putida KT2440
uuuccgggcaaugcaggcag

SEQ ID NO: 3583564 - RNA, 16 nt, Pseudomonas putida KT2440
uuuccgugcaaccgcu

SEQ ID NO: 3583565 - RNA, 19 nt, Pseudomonas putida KT2440
uuuccugcgcggccuugcc

SEQ ID NO: 3583566 - RNA, 14 nt, Pseudomonas putida KT2440
uuucgaccaaggcu

SEQ ID NO: 3583567 - RNA, 14 nt, Pseudomonas putida KT2440
uuucgaucucgcca

SEQ ID NO: 3583568 - RNA, 20 nt, Pseudomonas putida KT2440
uuucgccguagccaaccgag

SEQ ID NO: 3583569 - RNA, 17 nt, Pseudomonas putida KT2440
uuucgcgcucugcgccu

SEQ ID NO: 3583570 - RNA, 17 nt, Pseudomonas putida KT2440
uuucgcggcccagccca

SEQ ID NO: 3583571 - RNA, 19 nt, Pseudomonas putida KT2440
uuucgcgggagacccguuc

SEQ ID NO: 3583572 - RNA, 20 nt, Pseudomonas putida KT2440
uuucgcgggcgcgcccgcuc

SEQ ID NO: 3583573 - RNA, 15 nt, Pseudomonas putida KT2440
uuucgcggguaaacc

SEQ ID NO: 3583574 - RNA, 19 nt, Pseudomonas putida KT2440
uuucgcggguaaacccgcc

SEQ ID NO: 3583575 - RNA, 20 nt, Pseudomonas putida KT2440
uuucgcggguaaacccgcuc

SEQ ID NO: 3583576 - RNA, 20 nt, Pseudomonas putida KT2440
uuucgcggguagacccgcuc

SEQ ID NO: 3583577 - RNA, 19 nt, Pseudomonas putida KT2440
uuucgcgggugaacccgcu

SEQ ID NO: 3583578 - RNA, 14 nt, Pseudomonas putida KT2440
uuucgcuggggcug

SEQ ID NO: 3583579 - RNA, 18 nt, Pseudomonas putida KT2440
uuucggcagcacccgcuu

SEQ ID NO: 3583580 - RNA, 19 nt, Pseudomonas putida KT2440
uuucguccaggcucagcuc

SEQ ID NO: 3583581 - RNA, 14 nt, Pseudomonas putida KT2440
uuucguuugcgcua

SEQ ID NO: 3583582 - RNA, 16 nt, Pseudomonas putida KT2440
uuucuauuuaccuguc

SEQ ID NO: 3583583 - RNA, 20 nt, Pseudomonas putida KT2440
uuucucaggcgcgccgauca

SEQ ID NO: 3583584 - RNA, 14 nt, Pseudomonas putida KT2440
uuucugcuuccacu

SEQ ID NO: 3583585 - RNA, 23 nt, Pseudomonas putida KT2440
uuucuucgaccugcguggugccu

SEQ ID NO: 3583586 - RNA, 14 nt, Pseudomonas putida KT2440
uuugaaaaaaagau

SEQ ID NO: 3583587 - RNA, 23 nt, Pseudomonas putida KT2440
uuugaaaauuaguuugacagccc

SEQ ID NO: 3583588 - RNA, 13 nt, Pseudomonas putida KT2440
uuugaaaccggca

SEQ ID NO: 3583589 - RNA, 13 nt, Pseudomonas putida KT2440
uuugaacaauuua

SEQ ID NO: 3583590 - RNA, 16 nt, Pseudomonas putida KT2440
uuugaauuggagcuga

SEQ ID NO: 3583591 - RNA, 16 nt, Pseudomonas putida KT2440
uuugaugccaacuucc

SEQ ID NO: 3583592 - RNA, 17 nt, Pseudomonas putida KT2440
uuugaugccaacuucca

SEQ ID NO: 3583593 - RNA, 14 nt, Pseudomonas putida KT2440
uuugcaaaacuugg

SEQ ID NO: 3583594 - RNA, 20 nt, Pseudomonas putida KT2440
uuugcaagccuugugggagc

SEQ ID NO: 3583595 - RNA, 23 nt, Pseudomonas putida KT2440
uuugcagcacaaggcuguuccac

SEQ ID NO: 3583596 - RNA, 15 nt, Pseudomonas putida KT2440
uuugcauaucuacuc

SEQ ID NO: 3583597 - RNA, 23 nt, Pseudomonas putida KT2440
uuugccaccacccggggcagcau

SEQ ID NO: 3583598 - RNA, 20 nt, Pseudomonas putida KT2440
uuugccagcgugaaccggcu

SEQ ID NO: 3583599 - RNA, 15 nt, Pseudomonas putida KT2440
uuugcgcuggcugcc

SEQ ID NO: 3583600 - RNA, 19 nt, Pseudomonas putida KT2440
uuugcuggucagugcacuu

SEQ ID NO: 3583601 - RNA, 15 nt, Pseudomonas putida KT2440
uuuggccuguccagg

SEQ ID NO: 3583602 - RNA, 12 nt, Pseudomonas putida KT2440
uuuggcucaggu

SEQ ID NO: 3583603 - RNA, 18 nt, Pseudomonas putida KT2440
uuuggcuggugaaggcag

SEQ ID NO: 3583604 - RNA, 15 nt, Pseudomonas putida KT2440
uuuggcugugcaccc

SEQ ID NO: 3583605 - RNA, 15 nt, Pseudomonas putida KT2440
uuugggcuugagcuc

SEQ ID NO: 3583606 - RNA, 22 nt, Pseudomonas putida KT2440
uuuggggcgcccggcagaucga

SEQ ID NO: 3583607 - RNA, 21 nt, Pseudomonas putida KT2440
uuuggggugagcgaaucccgc

SEQ ID NO: 3583608 - RNA, 20 nt, Pseudomonas putida KT2440
uuuggucacccgugcugcuc

SEQ ID NO: 3583609 - RNA, 18 nt, Pseudomonas putida KT2440
uuugguucaagcacuaca

SEQ ID NO: 3583610 - RNA, 17 nt, Pseudomonas putida KT2440
uuugguuuuuucacuca

SEQ ID NO: 3583611 - RNA, 20 nt, Pseudomonas putida KT2440
uuugucgcccgccucgccau

SEQ ID NO: 3583612 - RNA, 12 nt, Pseudomonas putida KT2440
uuuuaaaagaac

SEQ ID NO: 3583613 - RNA, 18 nt, Pseudomonas putida KT2440
gccacaccugccaggcca

SEQ ID NO: 3583614 - RNA, 19 nt, Pseudomonas putida KT2440
gccacaccugccaggccaa

SEQ ID NO: 3583615 - RNA, 19 nt, Pseudomonas putida KT2440
gccacacugucccggcaca

SEQ ID NO: 3583616 - RNA, 14 nt, Pseudomonas putida KT2440
gccacagccgaggg

SEQ ID NO: 3583617 - RNA, 22 nt, Pseudomonas putida KT2440
gccacagccgagggcaugggcc

SEQ ID NO: 3583618 - RNA, 13 nt, Pseudomonas putida KT2440
gccacagcugcug

SEQ ID NO: 3583619 - RNA, 17 nt, Pseudomonas putida KT2440
gccacagguacugcgca

SEQ ID NO: 3583620 - RNA, 23 nt, Pseudomonas putida KT2440
gccacaggugacaagcugcgccc

SEQ ID NO: 3583621 - RNA, 18 nt, Pseudomonas putida KT2440
gccacauagcuggcacug

SEQ ID NO: 3583622 - RNA, 19 nt, Pseudomonas putida KT2440
gccacauagcuggcacugc

SEQ ID NO: 3583623 - RNA, 21 nt, Pseudomonas putida KT2440
gccacauaguaggcaaugccu

SEQ ID NO: 3583624 - RNA, 14 nt, Pseudomonas putida KT2440
gccacauccagcgc

SEQ ID NO: 3583625 - RNA, 15 nt, Pseudomonas putida KT2440
gccacauccagcgcc

SEQ ID NO: 3583626 - RNA, 18 nt, Pseudomonas putida KT2440
gccacauccagcgccucc

SEQ ID NO: 3583627 - RNA, 15 nt, Pseudomonas putida KT2440
gccacauccgcgcau

SEQ ID NO: 3583628 - RNA, 14 nt, Pseudomonas putida KT2440
gccacaucggcaag

SEQ ID NO: 3583629 - RNA, 15 nt, Pseudomonas putida KT2440
gccacaugaaggccg

SEQ ID NO: 3583630 - RNA, 22 nt, Pseudomonas putida KT2440
gccacaugaaggccguaggcca

SEQ ID NO: 3583631 - RNA, 16 nt, Pseudomonas putida KT2440
gccacaugcugcgccc

SEQ ID NO: 3583632 - RNA, 22 nt, Pseudomonas putida KT2440
gccacauugauaguagccgcca

SEQ ID NO: 3583633 - RNA, 13 nt, Pseudomonas putida KT2440
gccaccaagcccu

SEQ ID NO: 3583634 - RNA, 16 nt, Pseudomonas putida KT2440
gccaccaagcccuucu

SEQ ID NO: 3583635 - RNA, 14 nt, Pseudomonas putida KT2440
gccaccaagucacu

SEQ ID NO: 3583636 - RNA, 21 nt, Pseudomonas putida KT2440
gccaccaauacccgcaacgau

SEQ ID NO: 3583637 - RNA, 22 nt, Pseudomonas putida KT2440
gccaccaaucugguuacccaac

SEQ ID NO: 3583638 - RNA, 17 nt, Pseudomonas putida KT2440
gccaccacacuggucac

SEQ ID NO: 3583639 - RNA, 18 nt, Pseudomonas putida KT2440
gccaccacacuggucacg

SEQ ID NO: 3583640 - RNA, 19 nt, Pseudomonas putida KT2440
gccaccacacuggucacgc

SEQ ID NO: 3583641 - RNA, 15 nt, Pseudomonas putida KT2440
gccaccaccagcaac

SEQ ID NO: 3583642 - RNA, 17 nt, Pseudomonas putida KT2440
gccaccaccaugcgaug

SEQ ID NO: 3583643 - RNA, 19 nt, Pseudomonas putida KT2440
gccaccaccgcguacagcu

SEQ ID NO: 3583644 - RNA, 22 nt, Pseudomonas putida KT2440
gccaccacgguacuuggcgcug

SEQ ID NO: 3583645 - RNA, 12 nt, Pseudomonas putida KT2440
gccaccagcacc

SEQ ID NO: 3583646 - RNA, 15 nt, Pseudomonas putida KT2440
gccaccagcaccugc

SEQ ID NO: 3583647 - RNA, 20 nt, Pseudomonas putida KT2440
gccaccagcaccugcaggua

SEQ ID NO: 3583648 - RNA, 16 nt, Pseudomonas putida KT2440
gccaccagcaucaaca

SEQ ID NO: 3583649 - RNA, 19 nt, Pseudomonas putida KT2440
gccaccagcaucaacaggu

SEQ ID NO: 3583650 - RNA, 18 nt, Pseudomonas putida KT2440
gccaccaggccuuugacu

SEQ ID NO: 3583651 - RNA, 14 nt, Pseudomonas putida KT2440
gccaccaggcgcgg

SEQ ID NO: 3583652 - RNA, 17 nt, Pseudomonas putida KT2440
gccaccaggcgcggcag

SEQ ID NO: 3583653 - RNA, 19 nt, Pseudomonas putida KT2440
gccaccaggcgcggcagca

SEQ ID NO: 3583654 - RNA, 21 nt, Pseudomonas putida KT2440
gccaccaggcgcggcagcaug

SEQ ID NO: 3583655 - RNA, 13 nt, Pseudomonas putida KT2440
gccaccagggugg

SEQ ID NO: 3583656 - RNA, 18 nt, Pseudomonas putida KT2440
gccaccaguuccaccggc

SEQ ID NO: 3583657 - RNA, 20 nt, Pseudomonas putida KT2440
gccaccaguuccaccggcaa

SEQ ID NO: 3583658 - RNA, 22 nt, Pseudomonas putida KT2440
gccaccaguuccaccggcaagc

SEQ ID NO: 3583659 - RNA, 14 nt, Pseudomonas putida KT2440
gccaccaucgaccu

SEQ ID NO: 3583660 - RNA, 17 nt, Pseudomonas putida KT2440
gccaccaucgaccuggc

SEQ ID NO: 3583661 - RNA, 20 nt, Pseudomonas putida KT2440
gccaccaucgccggcacgcu

SEQ ID NO: 3583662 - RNA, 20 nt, Pseudomonas putida KT2440
gccaccaucuugcccagggc

SEQ ID NO: 3583663 - RNA, 21 nt, Pseudomonas putida KT2440
gccaccaugaacagcacgccc

SEQ ID NO: 3583664 - RNA, 19 nt, Pseudomonas putida KT2440
gccaccaugcucaccgcca

SEQ ID NO: 3583665 - RNA, 16 nt, Pseudomonas putida KT2440
gccaccaugcucggcc

SEQ ID NO: 3583666 - RNA, 20 nt, Pseudomonas putida KT2440
gccaccaugcucggccagcu

SEQ ID NO: 3583667 - RNA, 18 nt, Pseudomonas putida KT2440
gccacccaaggcauccag

SEQ ID NO: 3583668 - RNA, 20 nt, Pseudomonas putida KT2440
gccacccaccacggccuggc

SEQ ID NO: 3583669 - RNA, 21 nt, Pseudomonas putida KT2440
gccacccaccacggccuggcc

SEQ ID NO: 3583670 - RNA, 23 nt, Pseudomonas putida KT2440
gccacccagaucaucaucggcau

SEQ ID NO: 3583671 - RNA, 23 nt, Pseudomonas putida KT2440
gccacccaggcauacagcuggcc

SEQ ID NO: 3583672 - RNA, 12 nt, Pseudomonas putida KT2440
gccaccccaggc

SEQ ID NO: 3583673 - RNA, 15 nt, Pseudomonas putida KT2440
gccaccccgcaaagc

SEQ ID NO: 3583674 - RNA, 16 nt, Pseudomonas putida KT2440
gccaccccgcaaagcc

SEQ ID NO: 3583675 - RNA, 21 nt, Pseudomonas putida KT2440
gccacccgaacaaaacccuuc

SEQ ID NO: 3583676 - RNA, 14 nt, Pseudomonas putida KT2440
gccacccgacgcca

SEQ ID NO: 3583677 - RNA, 16 nt, Pseudomonas putida KT2440
gccacccggaccagcg

SEQ ID NO: 3583678 - RNA, 17 nt, Pseudomonas putida KT2440
gccacccggaccagcgc

SEQ ID NO: 3583679 - RNA, 20 nt, Pseudomonas putida KT2440
gccacccggaccagcgccgc

SEQ ID NO: 3583680 - RNA, 21 nt, Pseudomonas putida KT2440
gccacccggaccagcgccgca

SEQ ID NO: 3583681 - RNA, 20 nt, Pseudomonas putida KT2440
gccacccuccgggucaggcc

SEQ ID NO: 3583682 - RNA, 14 nt, Pseudomonas putida KT2440
gccacccucgcacc

SEQ ID NO: 3583683 - RNA, 15 nt, Pseudomonas putida KT2440
gccacccucgcacca

SEQ ID NO: 3583684 - RNA, 13 nt, Pseudomonas putida KT2440
gccaccgaaggcg

SEQ ID NO: 3583685 - RNA, 20 nt, Pseudomonas putida KT2440
gccaccgaaggcgucacccg

SEQ ID NO: 3583686 - RNA, 23 nt, Pseudomonas putida KT2440
gccaccgacauuguaggcggcaa

SEQ ID NO: 3583687 - RNA, 16 nt, Pseudomonas putida KT2440
gccaccgacgaacagg

SEQ ID NO: 3583688 - RNA, 21 nt, Pseudomonas putida KT2440
ggcaagcccgcuccuacaggu

SEQ ID NO: 3583689 - RNA, 18 nt, Pseudomonas putida KT2440
ggcaagcccgcuccuacg

SEQ ID NO: 3583690 - RNA, 13 nt, Pseudomonas putida KT2440
ggcaagccgagca

SEQ ID NO: 3583691 - RNA, 16 nt, Pseudomonas putida KT2440
ggcaagcuggucaggu

SEQ ID NO: 3583692 - RNA, 18 nt, Pseudomonas putida KT2440
ggcaaggcuggcaacccg

SEQ ID NO: 3583693 - RNA, 17 nt, Pseudomonas putida KT2440
ggcaagggccugcaggc

SEQ ID NO: 3583694 - RNA, 21 nt, Pseudomonas putida KT2440
ggcaagggccugcaggcagca

SEQ ID NO: 3583695 - RNA, 20 nt, Pseudomonas putida KT2440
ggcaagggcggaggcuucga

SEQ ID NO: 3583696 - RNA, 14 nt, Pseudomonas putida KT2440
ggcaagguauucga

SEQ ID NO: 3583697 - RNA, 17 nt, Pseudomonas putida KT2440
ggcaaggugggguugac

SEQ ID NO: 3583698 - RNA, 16 nt, Pseudomonas putida KT2440
ggcaaguugacccuga

SEQ ID NO: 3583699 - RNA, 22 nt, Pseudomonas putida KT2440
ggcaaguugacccugaaucagc

SEQ ID NO: 3583700 - RNA, 23 nt, Pseudomonas putida KT2440
ggcaauaaaaaaccccggcacag

SEQ ID NO: 3583701 - RNA, 23 nt, Pseudomonas putida KT2440
ggcaauaaaaaaccggcgcuugg

SEQ ID NO: 3583702 - RNA, 19 nt, Pseudomonas putida KT2440
ggcaauaugggucgacuga

SEQ ID NO: 3583703 - RNA, 14 nt, Pseudomonas putida KT2440
ggcaaucacccgca

SEQ ID NO: 3583704 - RNA, 23 nt, Pseudomonas putida KT2440
ggcaaucacgaacaccagcccca

SEQ ID NO: 3583705 - RNA, 16 nt, Pseudomonas putida KT2440
ggcaaucacgaucacu

SEQ ID NO: 3583706 - RNA, 14 nt, Pseudomonas putida KT2440
ggcaaucagcaggu

SEQ ID NO: 3583707 - RNA, 22 nt, Pseudomonas putida KT2440
ggcaaucagcaggucggcguca

SEQ ID NO: 3583708 - RNA, 14 nt, Pseudomonas putida KT2440
ggcaaucagcgaca

SEQ ID NO: 3583709 - RNA, 16 nt, Pseudomonas putida KT2440
ggcaaucagcgacaac

SEQ ID NO: 3583710 - RNA, 13 nt, Pseudomonas putida KT2440
ggcaaucaggcug

SEQ ID NO: 3583711 - RNA, 20 nt, Pseudomonas putida KT2440
ggcaaucaggcugaucaccg

SEQ ID NO: 3583712 - RNA, 15 nt, Pseudomonas putida KT2440
ggcaauccuggguga

SEQ ID NO: 3583713 - RNA, 13 nt, Pseudomonas putida KT2440
ggcaaucgacaac

SEQ ID NO: 3583714 - RNA, 19 nt, Pseudomonas putida KT2440
ggcaaucgccaggcgcacc

SEQ ID NO: 3583715 - RNA, 22 nt, Pseudomonas putida KT2440
ggcaaucgcgcccgguggcgcg

SEQ ID NO: 3583716 - RNA, 22 nt, Pseudomonas putida KT2440
ggcaaucggcaggccggccacc

SEQ ID NO: 3583717 - RNA, 19 nt, Pseudomonas putida KT2440
ggcaaucgggaucaugccg

SEQ ID NO: 3583718 - RNA, 22 nt, Pseudomonas putida KT2440
ggcaaucucacuuucugcgcug

SEQ ID NO: 3583719 - RNA, 20 nt, Pseudomonas putida KT2440
ggcaaucuucuugccgguac

SEQ ID NO: 3583720 - RNA, 15 nt, Pseudomonas putida KT2440
ggcaaugaucagccc

SEQ ID NO: 3583721 - RNA, 17 nt, Pseudomonas putida KT2440
ggcaaugauccggucca

SEQ ID NO: 3583722 - RNA, 13 nt, Pseudomonas putida KT2440
ggcaaugcaggca

SEQ ID NO: 3583723 - RNA, 17 nt, Pseudomonas putida KT2440
ggcaaugcccauggcca

SEQ ID NO: 3583724 - RNA, 19 nt, Pseudomonas putida KT2440
ggcaaugcgccggucgcgu

SEQ ID NO: 3583725 - RNA, 15 nt, Pseudomonas putida KT2440
ggcaaugcgcgcgaa

SEQ ID NO: 3583726 - RNA, 14 nt, Pseudomonas putida KT2440
ggcaaugcucgccu

SEQ ID NO: 3583727 - RNA, 23 nt, Pseudomonas putida KT2440
ggcaauggcccgcuccaguguag

SEQ ID NO: 3583728 - RNA, 15 nt, Pseudomonas putida KT2440
ggcaauggcgaaccg

SEQ ID NO: 3583729 - RNA, 21 nt, Pseudomonas putida KT2440
ggcaauggcguauccacauac

SEQ ID NO: 3583730 - RNA, 13 nt, Pseudomonas putida KT2440
ggcaauggcguca

SEQ ID NO: 3583731 - RNA, 21 nt, Pseudomonas putida KT2440
ggcaauuuccugcgcggccuu

SEQ ID NO: 3583732 - RNA, 19 nt, Pseudomonas putida KT2440
ggcacaacgcgccaccgcc

SEQ ID NO: 3583733 - RNA, 13 nt, Pseudomonas putida KT2440
ggcacaacuccac

SEQ ID NO: 3583734 - RNA, 20 nt, Pseudomonas putida KT2440
ggcacacaccggguguugga

SEQ ID NO: 3583735 - RNA, 19 nt, Pseudomonas putida KT2440
ggcacaccacgccaaccug

SEQ ID NO: 3583736 - RNA, 19 nt, Pseudomonas putida KT2440
ggcacaccuggugcgccuu

SEQ ID NO: 3583737 - RNA, 13 nt, Pseudomonas putida KT2440
ggcacacgcacca

SEQ ID NO: 3583738 - RNA, 13 nt, Pseudomonas putida KT2440
ggcacacuggcca

SEQ ID NO: 3583739 - RNA, 10 nt, Pseudomonas putida KT2440
ggcacaggcc

SEQ ID NO: 3583740 - RNA, 14 nt, Pseudomonas putida KT2440
ggcacaggccagcc

SEQ ID NO: 3583741 - RNA, 17 nt, Pseudomonas putida KT2440
ggcacaggccagccagg

SEQ ID NO: 3583742 - RNA, 18 nt, Pseudomonas putida KT2440
ggcacaggccagccaggu

SEQ ID NO: 3583743 - RNA, 12 nt, Pseudomonas putida KT2440
ggcacaggccca

SEQ ID NO: 3583744 - RNA, 14 nt, Pseudomonas putida KT2440
ggcacaggcccaaa

SEQ ID NO: 3583745 - RNA, 15 nt, Pseudomonas putida KT2440
ggcacaggcccagca

SEQ ID NO: 3583746 - RNA, 17 nt, Pseudomonas putida KT2440
ggcacaggcccagcaac

SEQ ID NO: 3583747 - RNA, 20 nt, Pseudomonas putida KT2440
ggcacaggcuacgcagcacc

SEQ ID NO: 3583748 - RNA, 13 nt, Pseudomonas putida KT2440
ggcacaucaccag

SEQ ID NO: 3583749 - RNA, 20 nt, Pseudomonas putida KT2440
ggcacaucaccagcagcuuc

SEQ ID NO: 3583750 - RNA, 19 nt, Pseudomonas putida KT2440
ggcaccaacugcacccgcc

SEQ ID NO: 3583751 - RNA, 21 nt, Pseudomonas putida KT2440
ggcaccacaagaacugcgacg

SEQ ID NO: 3583752 - RNA, 22 nt, Pseudomonas putida KT2440
ggcaccaccagggcgcgcuggc

SEQ ID NO: 3583753 - RNA, 19 nt, Pseudomonas putida KT2440
ggcaccagcaccagcuccu

SEQ ID NO: 3583754 - RNA, 16 nt, Pseudomonas putida KT2440
ggcaccagcgcugccg

SEQ ID NO: 3583755 - RNA, 19 nt, Pseudomonas putida KT2440
ggcaccagcgcugccgccu

SEQ ID NO: 3583756 - RNA, 18 nt, Pseudomonas putida KT2440
ggcaccaguuccagggcg

SEQ ID NO: 3583757 - RNA, 17 nt, Pseudomonas putida KT2440
ggcacccagccagcgau

SEQ ID NO: 3583758 - RNA, 20 nt, Pseudomonas putida KT2440
ggcacccaucacgacgcggg

SEQ ID NO: 3583759 - RNA, 16 nt, Pseudomonas putida KT2440
ggcaccccagccgcuc

SEQ ID NO: 3583760 - RNA, 17 nt, Pseudomonas putida KT2440
ggcaccccuuucuccag

SEQ ID NO: 3583761 - RNA, 19 nt, Pseudomonas putida KT2440
ggcaccccuuucuccagca

SEQ ID NO: 3583762 - RNA, 21 nt, Pseudomonas putida KT2440
ggcaccccuuucuccagcaac

SEQ ID NO: 3583763 - RNA, 19 nt, Pseudomonas putida KT2440
ggcacccuggcgguugacc

SEQ ID NO: 3583764 - RNA, 21 nt, Pseudomonas putida KT2440
ggcaccgacagcaacgcgaua

SEQ ID NO: 3583765 - RNA, 14 nt, Pseudomonas putida KT2440
ggcaccgacccggc

SEQ ID NO: 3583766 - RNA, 18 nt, Pseudomonas putida KT2440
ggcaccgacccggccgcu

SEQ ID NO: 3583767 - RNA, 21 nt, Pseudomonas putida KT2440
ggcaccgacccggccgcucca

SEQ ID NO: 3583768 - RNA, 18 nt, Pseudomonas putida KT2440
ggcaccgacggcggugau

SEQ ID NO: 3583769 - RNA, 21 nt, Pseudomonas putida KT2440
ggcaccgacuuccccggcgcc

SEQ ID NO: 3583770 - RNA, 22 nt, Pseudomonas putida KT2440
ggcaccgacuuccccggcgccg

SEQ ID NO: 3583771 - RNA, 20 nt, Pseudomonas putida KT2440
ggcaccgaucaccugggcga

SEQ ID NO: 3583772 - RNA, 15 nt, Pseudomonas putida KT2440
ggcaccgcacccggc

SEQ ID NO: 3583773 - RNA, 16 nt, Pseudomonas putida KT2440
ggcaccgcacccggcg

SEQ ID NO: 3583774 - RNA, 13 nt, Pseudomonas putida KT2440
ggcaccgccagcu

SEQ ID NO: 3583775 - RNA, 20 nt, Pseudomonas putida KT2440
ggcaccggcaccgggcggcg

SEQ ID NO: 3583776 - RNA, 14 nt, Pseudomonas putida KT2440
ggcaccggcagcag

SEQ ID NO: 3583777 - RNA, 15 nt, Pseudomonas putida KT2440
ggcaccggcagcagc

SEQ ID NO: 3583778 - RNA, 16 nt, Pseudomonas putida KT2440
ggcaccggcagcagca

SEQ ID NO: 3583779 - RNA, 17 nt, Pseudomonas putida KT2440
ggcaccggcagcagcaa

SEQ ID NO: 3583780 - RNA, 17 nt, Pseudomonas putida KT2440
ggcaccggccaccaggc

SEQ ID NO: 3583781 - RNA, 20 nt, Pseudomonas putida KT2440
ggcaccggccaccaggcgcg

SEQ ID NO: 3583782 - RNA, 16 nt, Pseudomonas putida KT2440
ggcaccggcgaacagc

SEQ ID NO: 3583783 - RNA, 18 nt, Pseudomonas putida KT2440
ggcaccggcgaacagcaa

SEQ ID NO: 3583784 - RNA, 20 nt, Pseudomonas putida KT2440
ggcaccggcgaagacggcag

SEQ ID NO: 3583785 - RNA, 18 nt, Pseudomonas putida KT2440
ggcaccuccagaggugcc

SEQ ID NO: 3583786 - RNA, 14 nt, Pseudomonas putida KT2440
ggcaccuuucucca

SEQ ID NO: 3583787 - RNA, 16 nt, Pseudomonas putida KT2440
ggcacgaaacgccacg

SEQ ID NO: 3583788 - RNA, 23 nt, Pseudomonas putida KT2440
ggcacgaaacgccacgcccaacc

SEQ ID NO: 3583789 - RNA, 19 nt, Pseudomonas putida KT2440
ggcacgacgcucggacagc

SEQ ID NO: 3583790 - RNA, 16 nt, Pseudomonas putida KT2440
ggcacgacugaacacc

SEQ ID NO: 3583791 - RNA, 20 nt, Pseudomonas putida KT2440
ggcacgacugaacaccugcc

SEQ ID NO: 3583792 - RNA, 19 nt, Pseudomonas putida KT2440
ggcacgauccugugggagc

SEQ ID NO: 3583793 - RNA, 17 nt, Pseudomonas putida KT2440
ggcuucaaacagcucac

SEQ ID NO: 3583794 - RNA, 22 nt, Pseudomonas putida KT2440
ggcuucaaacagcucacuggca

SEQ ID NO: 3583795 - RNA, 20 nt, Pseudomonas putida KT2440
ggcuucagaagccuuggccu

SEQ ID NO: 3583796 - RNA, 14 nt, Pseudomonas putida KT2440
ggcuucaggccgcc

SEQ ID NO: 3583797 - RNA, 16 nt, Pseudomonas putida KT2440
ggcuucaugcugcugc

SEQ ID NO: 3583798 - RNA, 17 nt, Pseudomonas putida KT2440
ggcuucaugcugcugca

SEQ ID NO: 3583799 - RNA, 13 nt, Pseudomonas putida KT2440
ggcuuccagcuug

SEQ ID NO: 3583800 - RNA, 20 nt, Pseudomonas putida KT2440
ggcuuccucuucaaggccca

SEQ ID NO: 3583801 - RNA, 19 nt, Pseudomonas putida KT2440
ggcuucgacaaccggggca

SEQ ID NO: 3583802 - RNA, 14 nt, Pseudomonas putida KT2440
ggcuucgagcagcu

SEQ ID NO: 3583803 - RNA, 21 nt, Pseudomonas putida KT2440
ggcuucguccguguucgcgag

SEQ ID NO: 3583804 - RNA, 17 nt, Pseudomonas putida KT2440
ggcuucguggugcuggc

SEQ ID NO: 3583805 - RNA, 16 nt, Pseudomonas putida KT2440
ggcuucuaccacuggg

SEQ ID NO: 3583806 - RNA, 22 nt, Pseudomonas putida KT2440
ggcuucuucgcgggcaugcccg

SEQ ID NO: 3583807 - RNA, 17 nt, Pseudomonas putida KT2440
ggcuucuuugcaagccu

SEQ ID NO: 3583808 - RNA, 16 nt, Pseudomonas putida KT2440
ggcuugaaucagccuu

SEQ ID NO: 3583809 - RNA, 18 nt, Pseudomonas putida KT2440
ggcuugaaucccugagcc

SEQ ID NO: 3583810 - RNA, 23 nt, Pseudomonas putida KT2440
ggcuugaccguuugcagcgucca

SEQ ID NO: 3583811 - RNA, 23 nt, Pseudomonas putida KT2440
ggcuugagcuuagcgcgcacggu

SEQ ID NO: 3583812 - RNA, 22 nt, Pseudomonas putida KT2440
ggcuugauccgcgcuaccuggu

SEQ ID NO: 3583813 - RNA, 19 nt, Pseudomonas putida KT2440
ggcuugcccgcgaagaggc

SEQ ID NO: 3583814 - RNA, 12 nt, Pseudomonas putida KT2440
ggcuugcccggg

SEQ ID NO: 3583815 - RNA, 12 nt, Pseudomonas putida KT2440
ggcuuggcacgc

SEQ ID NO: 3583816 - RNA, 21 nt, Pseudomonas putida KT2440
ggcuuggcagcaccgcugcca

SEQ ID NO: 3583817 - RNA, 23 nt, Pseudomonas putida KT2440
ggcuuggcagcaccgcugccagc

SEQ ID NO: 3583818 - RNA, 15 nt, Pseudomonas putida KT2440
ggcuuggcugccggc

SEQ ID NO: 3583819 - RNA, 12 nt, Pseudomonas putida KT2440
ggcuuguagccg

SEQ ID NO: 3583820 - RNA, 18 nt, Pseudomonas putida KT2440
ggcuugucaugccuuggc

SEQ ID NO: 3583821 - RNA, 18 nt, Pseudomonas putida KT2440
ggcuuguccuuguugacc

SEQ ID NO: 3583822 - RNA, 19 nt, Pseudomonas putida KT2440
ggcuugucuuccggcaggu

SEQ ID NO: 3583823 - RNA, 16 nt, Pseudomonas putida KT2440
ggcuugugcaucagcg

SEQ ID NO: 3583824 - RNA, 21 nt, Pseudomonas putida KT2440
ggcuuguucggcaucggugcu

SEQ ID NO: 3583825 - RNA, 15 nt, Pseudomonas putida KT2440
ggcuuuccaccuggc

SEQ ID NO: 3583826 - RNA, 19 nt, Pseudomonas putida KT2440
ggcuuuccagguccugcuc

SEQ ID NO: 3583827 - RNA, 17 nt, Pseudomonas putida KT2440
ggcuuucguaggagcgg

SEQ ID NO: 3583828 - RNA, 21 nt, Pseudomonas putida KT2440
ggcuuugaaagguuuauugua

SEQ ID NO: 3583829 - RNA, 13 nt, Pseudomonas putida KT2440
ggcuuugauacug

SEQ ID NO: 3583830 - RNA, 16 nt, Pseudomonas putida KT2440
ggcuuugccauucucg

SEQ ID NO: 3583831 - RNA, 12 nt, Pseudomonas putida KT2440
ggcuuugccggc

SEQ ID NO: 3583832 - RNA, 18 nt, Pseudomonas putida KT2440
ggcuuugcgucaucauca

SEQ ID NO: 3583833 - RNA, 13 nt, Pseudomonas putida KT2440
ggcuuugggagca

SEQ ID NO: 3583834 - RNA, 19 nt, Pseudomonas putida KT2440
ggcuuuguuguuugggccu

SEQ ID NO: 3583835 - RNA, 21 nt, Pseudomonas putida KT2440
ggcuuuucguuggccagcuug

SEQ ID NO: 3583836 - RNA, 18 nt, Pseudomonas putida KT2440
ggcuuuugaagucggcgu

SEQ ID NO: 3583837 - RNA, 14 nt, Pseudomonas putida KT2440
ggcuuuuuccagcg

SEQ ID NO: 3583838 - RNA, 16 nt, Pseudomonas putida KT2440
ggcuuuuuccagcgcc

SEQ ID NO: 3583839 - RNA, 20 nt, Pseudomonas putida KT2440
ggcuuuuucguuauggaagg

SEQ ID NO: 3583840 - RNA, 15 nt, Pseudomonas putida KT2440
ggcuuuuugauugug

SEQ ID NO: 3583841 - RNA, 23 nt, Pseudomonas putida KT2440
ggcuuuuuuugguuugccugacg

SEQ ID NO: 3583842 - RNA, 22 nt, Pseudomonas putida KT2440
ggcuuuuuuuugccuggaauuc

SEQ ID NO: 3583843 - RNA, 18 nt, Pseudomonas putida KT2440
gggaaaccgugucgggca

SEQ ID NO: 3583844 - RNA, 19 nt, Pseudomonas putida KT2440
gggaaaccuccggcaucau

SEQ ID NO: 3583845 - RNA, 14 nt, Pseudomonas putida KT2440
gggaacagcagcac

SEQ ID NO: 3583846 - RNA, 12 nt, Pseudomonas putida KT2440
gggaacagcucu

SEQ ID NO: 3583847 - RNA, 16 nt, Pseudomonas putida KT2440
gggaacagcucuggca

SEQ ID NO: 3583848 - RNA, 23 nt, Pseudomonas putida KT2440
gggaacagcucuggcagcagugc

SEQ ID NO: 3583849 - RNA, 20 nt, Pseudomonas putida KT2440
gggaagaugcacaccaguuc

SEQ ID NO: 3583850 - RNA, 16 nt, Pseudomonas putida KT2440
gggaagcugcagcagc

SEQ ID NO: 3583851 - RNA, 14 nt, Pseudomonas putida KT2440
gggaagguggccgg

SEQ ID NO: 3583852 - RNA, 16 nt, Pseudomonas putida KT2440
gggaagguggccggca

SEQ ID NO: 3583853 - RNA, 22 nt, Pseudomonas putida KT2440
gggaaguggugguagaaggucg

SEQ ID NO: 3583854 - RNA, 17 nt, Pseudomonas putida KT2440
gggaaguuacgggucga

SEQ ID NO: 3583855 - RNA, 20 nt, Pseudomonas putida KT2440
gggacagccacaugccagcu

SEQ ID NO: 3583856 - RNA, 17 nt, Pseudomonas putida KT2440
gggaccacuaucgccag

SEQ ID NO: 3583857 - RNA, 18 nt, Pseudomonas putida KT2440
gggacgaucugcagcacc

SEQ ID NO: 3583858 - RNA, 19 nt, Pseudomonas putida KT2440
gggagaguccugcgcgcuu

SEQ ID NO: 3583859 - RNA, 19 nt, Pseudomonas putida KT2440
gggagcaggcaugcccgcu

SEQ ID NO: 3583860 - RNA, 20 nt, Pseudomonas putida KT2440
gggagcaggcaugcccgcuc

SEQ ID NO: 3583861 - RNA, 21 nt, Pseudomonas putida KT2440
gggagcggccuugugcggccc

SEQ ID NO: 3583862 - RNA, 13 nt, Pseudomonas putida KT2440
gggagcgggcaug

SEQ ID NO: 3583863 - RNA, 15 nt, Pseudomonas putida KT2440
gggagcgggcgcgcc

SEQ ID NO: 3583864 - RNA, 16 nt, Pseudomonas putida KT2440
gggagcgggcgugccc

SEQ ID NO: 3583865 - RNA, 15 nt, Pseudomonas putida KT2440
gggagcgggcuugcc

SEQ ID NO: 3583866 - RNA, 20 nt, Pseudomonas putida KT2440
gggagcgggcuugcccgcga

SEQ ID NO: 3583867 - RNA, 13 nt, Pseudomonas putida KT2440
gggagcguagaac

SEQ ID NO: 3583868 - RNA, 19 nt, Pseudomonas putida KT2440
gggagggcuuugcccuccu

SEQ ID NO: 3583869 - RNA, 18 nt, Pseudomonas putida KT2440
gggagucgaaccugcccg

SEQ ID NO: 3583870 - RNA, 19 nt, Pseudomonas putida KT2440
gggagugcucgccucacag

SEQ ID NO: 3583871 - RNA, 22 nt, Pseudomonas putida KT2440
gggaucaccgcaagcugcaccg

SEQ ID NO: 3583872 - RNA, 18 nt, Pseudomonas putida KT2440
gggaucaccgccagcagc

SEQ ID NO: 3583873 - RNA, 23 nt, Pseudomonas putida KT2440
gggaucaccucguaaggccugag

SEQ ID NO: 3583874 - RNA, 12 nt, Pseudomonas putida KT2440
gggaucagcacg

SEQ ID NO: 3583875 - RNA, 16 nt, Pseudomonas putida KT2440
gggaucagcacgccca

SEQ ID NO: 3583876 - RNA, 17 nt, Pseudomonas putida KT2440
gggaucuugcuggccgg

SEQ ID NO: 3583877 - RNA, 18 nt, Pseudomonas putida KT2440
gggaucuugcuggccggu

SEQ ID NO: 3583878 - RNA, 22 nt, Pseudomonas putida KT2440
gggauggcaccggcagugcgaa

SEQ ID NO: 3583879 - RNA, 17 nt, Pseudomonas putida KT2440
gggauguugugggcaau

SEQ ID NO: 3583880 - RNA, 12 nt, Pseudomonas putida KT2440
gggcaaaaaagu

SEQ ID NO: 3583881 - RNA, 20 nt, Pseudomonas putida KT2440
gggcaaaaaaguggcgugga

SEQ ID NO: 3583882 - RNA, 15 nt, Pseudomonas putida KT2440
gggcaaaaucgacca

SEQ ID NO: 3583883 - RNA, 21 nt, Pseudomonas putida KT2440
gggcaaaaucgaccagggccu

SEQ ID NO: 3583884 - RNA, 14 nt, Pseudomonas putida KT2440
gggcaaacaggcug

SEQ ID NO: 3583885 - RNA, 19 nt, Pseudomonas putida KT2440
gggcaaacccgcgccuaca

SEQ ID NO: 3583886 - RNA, 13 nt, Pseudomonas putida KT2440
gggcaaagcccau

SEQ ID NO: 3583887 - RNA, 14 nt, Pseudomonas putida KT2440
gggcaacaccgcca

SEQ ID NO: 3583888 - RNA, 15 nt, Pseudomonas putida KT2440
gggcaaccugggugu

SEQ ID NO: 3583889 - RNA, 17 nt, Pseudomonas putida KT2440
gggcaacugcgccuggg

SEQ ID NO: 3583890 - RNA, 14 nt, Pseudomonas putida KT2440
gggcaagcccgcga

SEQ ID NO: 3583891 - RNA, 19 nt, Pseudomonas putida KT2440
gggcaagcccgcucccaca

SEQ ID NO: 3583892 - RNA, 20 nt, Pseudomonas putida KT2440
gggcaagcccgcucccacag

SEQ ID NO: 3583893 - RNA, 22 nt, Pseudomonas putida KT2440
gggcaagcccgcucccacaggg

SEQ ID NO: 3583894 - RNA, 19 nt, Pseudomonas putida KT2440
gggcaagcccgcuccuaca

SEQ ID NO: 3583895 - RNA, 12 nt, Pseudomonas putida KT2440
gggcaaggcugg

SEQ ID NO: 3583896 - RNA, 20 nt, Pseudomonas putida KT2440
gggcaagggccugcaggcag

SEQ ID NO: 3583897 - RNA, 14 nt, Pseudomonas putida KT2440
gggcaagugcgugc

SEQ ID NO: 3583898 - RNA, 19 nt, Pseudomonas putida KT2440
gggcgcuuugcacccgcgc

SEQ ID NO: 3583899 - RNA, 19 nt, Pseudomonas putida KT2440
gggcggagauuggccagca

SEQ ID NO: 3583900 - RNA, 15 nt, Pseudomonas putida KT2440
gggcgggccgccgaa

SEQ ID NO: 3583901 - RNA, 13 nt, Pseudomonas putida KT2440
gggcgggccugcu

SEQ ID NO: 3583902 - RNA, 18 nt, Pseudomonas putida KT2440
gggcggguugcacagggu

SEQ ID NO: 3583903 - RNA, 19 nt, Pseudomonas putida KT2440
gggcgguugucgaccuggc

SEQ ID NO: 3583904 - RNA, 18 nt, Pseudomonas putida KT2440
gggcguaaagcgccccag

SEQ ID NO: 3583905 - RNA, 17 nt, Pseudomonas putida KT2440
gggcguaccuggcugcu

SEQ ID NO: 3583906 - RNA, 16 nt, Pseudomonas putida KT2440
gggcgucaucacccgg

SEQ ID NO: 3583907 - RNA, 14 nt, Pseudomonas putida KT2440
gggcgucgccugca

SEQ ID NO: 3583908 - RNA, 17 nt, Pseudomonas putida KT2440
gggcgucugcuccgcga

SEQ ID NO: 3583909 - RNA, 18 nt, Pseudomonas putida KT2440
gggcgucugcuccgcgau

SEQ ID NO: 3583910 - RNA, 14 nt, Pseudomonas putida KT2440
gggcgucuuccagg

SEQ ID NO: 3583911 - RNA, 17 nt, Pseudomonas putida KT2440
gggcgucuuccaggugg

SEQ ID NO: 3583912 - RNA, 13 nt, Pseudomonas putida KT2440
gggcgugccaggc

SEQ ID NO: 3583913 - RNA, 16 nt, Pseudomonas putida KT2440
gggcgugccaggcuug

SEQ ID NO: 3583914 - RNA, 14 nt, Pseudomonas putida KT2440
gggcgugcccgcga

SEQ ID NO: 3583915 - RNA, 16 nt, Pseudomonas putida KT2440
gggcgugcccgcgaag

SEQ ID NO: 3583916 - RNA, 14 nt, Pseudomonas putida KT2440
gggcgugcgcugca

SEQ ID NO: 3583917 - RNA, 21 nt, Pseudomonas putida KT2440
gggcguuuuuugugccuggcg

SEQ ID NO: 3583918 - RNA, 14 nt, Pseudomonas putida KT2440
gggcuaaaaccggu

SEQ ID NO: 3583919 - RNA, 22 nt, Pseudomonas putida KT2440
gggcuacacgcgcccuguggga

SEQ ID NO: 3583920 - RNA, 13 nt, Pseudomonas putida KT2440
gggcuaugcgauu

SEQ ID NO: 3583921 - RNA, 12 nt, Pseudomonas putida KT2440
gggcucaacgcc

SEQ ID NO: 3583922 - RNA, 17 nt, Pseudomonas putida KT2440
gggcucaauagcggcgg

SEQ ID NO: 3583923 - RNA, 13 nt, Pseudomonas putida KT2440
gggcucagccgcc

SEQ ID NO: 3583924 - RNA, 23 nt, Pseudomonas putida KT2440
gggcuccggcgaauccagcaggc

SEQ ID NO: 3583925 - RNA, 13 nt, Pseudomonas putida KT2440
gggcucgggauga

SEQ ID NO: 3583926 - RNA, 20 nt, Pseudomonas putida KT2440
gggcucugugggagcgggcu

SEQ ID NO: 3583927 - RNA, 17 nt, Pseudomonas putida KT2440
gggcucuucgcggguga

SEQ ID NO: 3583928 - RNA, 18 nt, Pseudomonas putida KT2440
gggcugcaaagcagcccc

SEQ ID NO: 3583929 - RNA, 19 nt, Pseudomonas putida KT2440
gggcugcaaagcagcccca

SEQ ID NO: 3583930 - RNA, 20 nt, Pseudomonas putida KT2440
gggcugcaaugcagccccuu

SEQ ID NO: 3583931 - RNA, 19 nt, Pseudomonas putida KT2440
gggcugcauugcagcccca

SEQ ID NO: 3583932 - RNA, 13 nt, Pseudomonas putida KT2440
gggcugccgcgca

SEQ ID NO: 3583933 - RNA, 17 nt, Pseudomonas putida KT2440
gggcugcgcggcagccc

SEQ ID NO: 3583934 - RNA, 18 nt, Pseudomonas putida KT2440
gggcugcggggcagcccc

SEQ ID NO: 3583935 - RNA, 12 nt, Pseudomonas putida KT2440
gggcugcguugc

SEQ ID NO: 3583936 - RNA, 18 nt, Pseudomonas putida KT2440
gggcugcugcgcagcccu

SEQ ID NO: 3583937 - RNA, 20 nt, Pseudomonas putida KT2440
gggcugcugcgcagcccugu

SEQ ID NO: 3583938 - RNA, 19 nt, Pseudomonas putida KT2440
gggcugcuuugcagcccuu

SEQ ID NO: 3583939 - RNA, 18 nt, Pseudomonas putida KT2440
gggcuguauagcccugcc

SEQ ID NO: 3583940 - RNA, 17 nt, Pseudomonas putida KT2440
gggcuguuccagcagcg

SEQ ID NO: 3583941 - RNA, 18 nt, Pseudomonas putida KT2440
gggcuguuccagcagcga

SEQ ID NO: 3583942 - RNA, 24 nt, Pseudomonas putida KT2440
gggcuucaugcacaacgcgcgggc

SEQ ID NO: 3583943 - RNA, 21 nt, Pseudomonas putida KT2440
gggcuucaugcugcugcagca

SEQ ID NO: 3583944 - RNA, 13 nt, Pseudomonas putida KT2440
gggcuucgagcag

SEQ ID NO: 3583945 - RNA, 15 nt, Pseudomonas putida KT2440
gggcuucgagcagcu

SEQ ID NO: 3583946 - RNA, 21 nt, Pseudomonas putida KT2440
gggcuucuaccugagcuucaa

SEQ ID NO: 3583947 - RNA, 14 nt, Pseudomonas putida KT2440
gggcuugcccgcga

SEQ ID NO: 3583948 - RNA, 23 nt, Pseudomonas putida KT2440
gggcuugcccgcgaaugggcugc

SEQ ID NO: 3583949 - RNA, 15 nt, Pseudomonas putida KT2440
gggcuuguccgcgaa

SEQ ID NO: 3583950 - RNA, 10 nt, Pseudomonas putida KT2440
gggcuuugaa

SEQ ID NO: 3583951 - RNA, 14 nt, Pseudomonas putida KT2440
gggcuuugggagca

SEQ ID NO: 3583952 - RNA, 18 nt, Pseudomonas putida KT2440
gggcuuuuuccagcgcca

SEQ ID NO: 3583953 - RNA, 12 nt, Pseudomonas putida KT2440
ggggaaaugccu

SEQ ID NO: 3583954 - RNA, 14 nt, Pseudomonas putida KT2440
ggggacggcagccg

SEQ ID NO: 3583955 - RNA, 16 nt, Pseudomonas putida KT2440
ggggacuccggccggg

SEQ ID NO: 3583956 - RNA, 24 nt, Pseudomonas putida KT2440
ggggcaaacuucucgaugaagucg

SEQ ID NO: 3583957 - RNA, 12 nt, Pseudomonas putida KT2440
ggggcaacugcg

SEQ ID NO: 3583958 - RNA, 23 nt, Pseudomonas putida KT2440
ggggcaacugcgcgauagccugu

SEQ ID NO: 3583959 - RNA, 21 nt, Pseudomonas putida KT2440
ggggcaggcccggcagguuga

SEQ ID NO: 3583960 - RNA, 13 nt, Pseudomonas putida KT2440
ggggccaggcgcg

SEQ ID NO: 3583961 - RNA, 16 nt, Pseudomonas putida KT2440
ggggccgcgcagccuu

SEQ ID NO: 3583962 - RNA, 15 nt, Pseudomonas putida KT2440
ggggccgcgcagcgg

SEQ ID NO: 3583963 - RNA, 13 nt, Pseudomonas putida KT2440
ggggccgcucugc

SEQ ID NO: 3583964 - RNA, 18 nt, Pseudomonas putida KT2440
ggggccgcuuugcgucgc

SEQ ID NO: 3583965 - RNA, 14 nt, Pseudomonas putida KT2440
ggggccggcacagg

SEQ ID NO: 3583966 - RNA, 12 nt, Pseudomonas putida KT2440
ggggcgcccggc

SEQ ID NO: 3583967 - RNA, 14 nt, Pseudomonas putida KT2440
ggggcgcuccagca

SEQ ID NO: 3583968 - RNA, 20 nt, Pseudomonas putida KT2440
ggggcggauuugcccgcuaa

SEQ ID NO: 3583969 - RNA, 17 nt, Pseudomonas putida KT2440
ggggcggguggaggugc

SEQ ID NO: 3583970 - RNA, 16 nt, Pseudomonas putida KT2440
ggggcgugcucggcau

SEQ ID NO: 3583971 - RNA, 14 nt, Pseudomonas putida KT2440
ggggcucacagccc

SEQ ID NO: 3583972 - RNA, 19 nt, Pseudomonas putida KT2440
ggggcugcaaggcagcccc

SEQ ID NO: 3583973 - RNA, 23 nt, Pseudomonas putida KT2440
ggggcugcaaggcagccccugca

SEQ ID NO: 3583974 - RNA, 19 nt, Pseudomonas putida KT2440
ggggcugcaaugcagcccc

SEQ ID NO: 3583975 - RNA, 17 nt, Pseudomonas putida KT2440
ggggcugcugcgcagcc

SEQ ID NO: 3583976 - RNA, 19 nt, Pseudomonas putida KT2440
ggggcugcugcgcagcccc

SEQ ID NO: 3583977 - RNA, 18 nt, Pseudomonas putida KT2440
ggggcugcuuugcagccc

SEQ ID NO: 3583978 - RNA, 20 nt, Pseudomonas putida KT2440
ggggcugcuuugcagcccuu

SEQ ID NO: 3583979 - RNA, 22 nt, Pseudomonas putida KT2440
ggggcugcuuugcagcccuucg

SEQ ID NO: 3583980 - RNA, 14 nt, Pseudomonas putida KT2440
ggggcuuguguggc

SEQ ID NO: 3583981 - RNA, 16 nt, Pseudomonas putida KT2440
gggggauuugaggaag

SEQ ID NO: 3583982 - RNA, 18 nt, Pseudomonas putida KT2440
gggggcaaagaacagcgc

SEQ ID NO: 3583983 - RNA, 16 nt, Pseudomonas putida KT2440
gggggccccaccaggc

SEQ ID NO: 3583984 - RNA, 20 nt, Pseudomonas putida KT2440
gggggcgacagacagggccu

SEQ ID NO: 3583985 - RNA, 20 nt, Pseudomonas putida KT2440
gggggcucaauagcggcggu

SEQ ID NO: 3583986 - RNA, 13 nt, Pseudomonas putida KT2440
gggggcucagccc

SEQ ID NO: 3583987 - RNA, 16 nt, Pseudomonas putida KT2440
ggggggcucagcccgc

SEQ ID NO: 3583988 - RNA, 23 nt, Pseudomonas putida KT2440
ggggguauuaagggcauggccgc

SEQ ID NO: 3583989 - RNA, 15 nt, Pseudomonas putida KT2440
ggggucgaucuccag

SEQ ID NO: 3583990 - RNA, 20 nt, Pseudomonas putida KT2440
ggggucgcccgcaacaccag

SEQ ID NO: 3583991 - RNA, 15 nt, Pseudomonas putida KT2440
ggggucugcccggcc

SEQ ID NO: 3583992 - RNA, 18 nt, Pseudomonas putida KT2440
ggggucugcccggccagc

SEQ ID NO: 3583993 - RNA, 19 nt, Pseudomonas putida KT2440
ggggucugcccggccagca

SEQ ID NO: 3583994 - RNA, 21 nt, Pseudomonas putida KT2440
ggggucugcuuugcagcccuu

SEQ ID NO: 3583995 - RNA, 18 nt, Pseudomonas putida KT2440
ggggucuuuucgccacug

SEQ ID NO: 3583996 - RNA, 12 nt, Pseudomonas putida KT2440
ggggugagcggc

SEQ ID NO: 3583997 - RNA, 13 nt, Pseudomonas putida KT2440
ggggugagcggcu

SEQ ID NO: 3583998 - RNA, 13 nt, Pseudomonas putida KT2440
ggggugaggggau

SEQ ID NO: 3583999 - RNA, 16 nt, Pseudomonas putida KT2440
ggggugauugcaguca

SEQ ID NO: 3584000 - RNA, 20 nt, Pseudomonas putida KT2440
ggggugcugcgcacguagcg

SEQ ID NO: 3584001 - RNA, 13 nt, Pseudomonas putida KT2440
ggggugguuggca

SEQ ID NO: 3584002 - RNA, 19 nt, Pseudomonas putida KT2440
gggguguuacgccaggcgu

SEQ ID NO: 3584003 - RNA, 14 nt, Pseudomonas putida KT2440
gggguugacgcugu

SEQ ID NO: 3584004 - RNA, 19 nt, Pseudomonas putida KT2440
gguaaacccgcuccuacgg

SEQ ID NO: 3584005 - RNA, 18 nt, Pseudomonas putida KT2440
gguaaacccgggucaggc

SEQ ID NO: 3584006 - RNA, 18 nt, Pseudomonas putida KT2440
gguaaacguggucagcca

SEQ ID NO: 3584007 - RNA, 20 nt, Pseudomonas putida KT2440
gguaaagcgcgccuccagcu

SEQ ID NO: 3584008 - RNA, 16 nt, Pseudomonas putida KT2440
gguaaagcucgguauc

SEQ ID NO: 3584009 - RNA, 14 nt, Pseudomonas putida KT2440
gguaacacggugau

SEQ ID NO: 3584010 - RNA, 18 nt, Pseudomonas putida KT2440
gguaaccgccugaaauuu

SEQ ID NO: 3584011 - RNA, 16 nt, Pseudomonas putida KT2440
gguaacggcucugaca

SEQ ID NO: 3584012 - RNA, 17 nt, Pseudomonas putida KT2440
gguaacgggcaaggcug

SEQ ID NO: 3584013 - RNA, 17 nt, Pseudomonas putida KT2440
gguaacguggacagcag

SEQ ID NO: 3584014 - RNA, 24 nt, Pseudomonas putida KT2440
gguaagccaugcgcaggcagcgau

SEQ ID NO: 3584015 - RNA, 22 nt, Pseudomonas putida KT2440
gguaauagcggcgguucuucaa

SEQ ID NO: 3584016 - RNA, 12 nt, Pseudomonas putida KT2440
gguaaucagcuu

SEQ ID NO: 3584017 - RNA, 12 nt, Pseudomonas putida KT2440
gguaauccacca

SEQ ID NO: 3584018 - RNA, 14 nt, Pseudomonas putida KT2440
gguaauccaccagc

SEQ ID NO: 3584019 - RNA, 23 nt, Pseudomonas putida KT2440
gguaauccaccagccgccguacc

SEQ ID NO: 3584020 - RNA, 13 nt, Pseudomonas putida KT2440
gguaaugccaccu

SEQ ID NO: 3584021 - RNA, 14 nt, Pseudomonas putida KT2440
gguaaugcccgcag

SEQ ID NO: 3584022 - RNA, 19 nt, Pseudomonas putida KT2440
gguaaugcuggugguggcc

SEQ ID NO: 3584023 - RNA, 12 nt, Pseudomonas putida KT2440
gguaauuggccg

SEQ ID NO: 3584024 - RNA, 15 nt, Pseudomonas putida KT2440
gguaauuggccggca

SEQ ID NO: 3584025 - RNA, 14 nt, Pseudomonas putida KT2440
gguaauugguggug

SEQ ID NO: 3584026 - RNA, 16 nt, Pseudomonas putida KT2440
gguacagcacccaggu

SEQ ID NO: 3584027 - RNA, 21 nt, Pseudomonas putida KT2440
gguacagcacugcauuggcca

SEQ ID NO: 3584028 - RNA, 14 nt, Pseudomonas putida KT2440
gguacagccagcaa

SEQ ID NO: 3584029 - RNA, 15 nt, Pseudomonas putida KT2440
gguacagccagcaaa

SEQ ID NO: 3584030 - RNA, 18 nt, Pseudomonas putida KT2440
gguacagcucacuggcca

SEQ ID NO: 3584031 - RNA, 17 nt, Pseudomonas putida KT2440
gguacaggcaaagaaac

SEQ ID NO: 3584032 - RNA, 16 nt, Pseudomonas putida KT2440
gguacauguuggucag

SEQ ID NO: 3584033 - RNA, 13 nt, Pseudomonas putida KT2440
gguaccagcaggc

SEQ ID NO: 3584034 - RNA, 15 nt, Pseudomonas putida KT2440
gguaccaggcugcca

SEQ ID NO: 3584035 - RNA, 21 nt, Pseudomonas putida KT2440
gguaccccaccggccuggaac

SEQ ID NO: 3584036 - RNA, 15 nt, Pseudomonas putida KT2440
gguacccgccagcaa

SEQ ID NO: 3584037 - RNA, 17 nt, Pseudomonas putida KT2440
gguaccgcucugcgcca

SEQ ID NO: 3584038 - RNA, 17 nt, Pseudomonas putida KT2440
gguaccggccagcugcg

SEQ ID NO: 3584039 - RNA, 20 nt, Pseudomonas putida KT2440
gguaccgucgaucagcuucu

SEQ ID NO: 3584040 - RNA, 17 nt, Pseudomonas putida KT2440
gguaccgugcugcaggc

SEQ ID NO: 3584041 - RNA, 11 nt, Pseudomonas putida KT2440
gguacgcucac

SEQ ID NO: 3584042 - RNA, 19 nt, Pseudomonas putida KT2440
gguacucgcccgccaggua

SEQ ID NO: 3584043 - RNA, 19 nt, Pseudomonas putida KT2440
gguacucgcgacugaagcg

SEQ ID NO: 3584044 - RNA, 15 nt, Pseudomonas putida KT2440
gguacugcuucauga

SEQ ID NO: 3584045 - RNA, 16 nt, Pseudomonas putida KT2440
gguacuucucgaccag

SEQ ID NO: 3584046 - RNA, 18 nt, Pseudomonas putida KT2440
gguacuugugugccugcu

SEQ ID NO: 3584047 - RNA, 13 nt, Pseudomonas putida KT2440
gguagacccgcuc

SEQ ID NO: 3584048 - RNA, 18 nt, Pseudomonas putida KT2440
gguagaccuucuggcagc

SEQ ID NO: 3584049 - RNA, 20 nt, Pseudomonas putida KT2440
gguagagcacgaccuugcca

SEQ ID NO: 3584050 - RNA, 19 nt, Pseudomonas putida KT2440
gguagaucacaccggccgc

SEQ ID NO: 3584051 - RNA, 22 nt, Pseudomonas putida KT2440
gguagcacgggcgcugaagcca

SEQ ID NO: 3584052 - RNA, 23 nt, Pseudomonas putida KT2440
gguagcacgggcgcugaagccag

SEQ ID NO: 3584053 - RNA, 18 nt, Pseudomonas putida KT2440
gguagccucgacccgcug

SEQ ID NO: 3584054 - RNA, 17 nt, Pseudomonas putida KT2440
gguagccugcugacgca

SEQ ID NO: 3584055 - RNA, 16 nt, Pseudomonas putida KT2440
gguagccuuccagcuc

SEQ ID NO: 3584056 - RNA, 11 nt, Pseudomonas putida KT2440
gguagcggcag

SEQ ID NO: 3584057 - RNA, 13 nt, Pseudomonas putida KT2440
gguagcggccagc

SEQ ID NO: 3584058 - RNA, 14 nt, Pseudomonas putida KT2440
gguagcggccagcc

SEQ ID NO: 3584059 - RNA, 12 nt, Pseudomonas putida KT2440
gguagcggcggc

SEQ ID NO: 3584060 - RNA, 15 nt, Pseudomonas putida KT2440
gguagcggcugggcg

SEQ ID NO: 3584061 - RNA, 22 nt, Pseudomonas putida KT2440
gguagcgucaacugccaggcug

SEQ ID NO: 3584062 - RNA, 17 nt, Pseudomonas putida KT2440
gguagcgucgcgcgccc

SEQ ID NO: 3584063 - RNA, 15 nt, Pseudomonas putida KT2440
gguagcucgacgccg

SEQ ID NO: 3584064 - RNA, 18 nt, Pseudomonas putida KT2440
gguagcugcgcagguugg

SEQ ID NO: 3584065 - RNA, 21 nt, Pseudomonas putida KT2440
gguaggcaccccggccgcuug

SEQ ID NO: 3584066 - RNA, 17 nt, Pseudomonas putida KT2440
gguaggcccagcccagc

SEQ ID NO: 3584067 - RNA, 16 nt, Pseudomonas putida KT2440
gguagugcggccgggu

SEQ ID NO: 3584068 - RNA, 21 nt, Pseudomonas putida KT2440
gguaguggcggcaacggugaa

SEQ ID NO: 3584069 - RNA, 13 nt, Pseudomonas putida KT2440
gguauagcgacag

SEQ ID NO: 3584070 - RNA, 22 nt, Pseudomonas putida KT2440
gguauaggccccgaaugcacgg

SEQ ID NO: 3584071 - RNA, 23 nt, Pseudomonas putida KT2440
gguauagguccagcucuggucac

SEQ ID NO: 3584072 - RNA, 14 nt, Pseudomonas putida KT2440
gguauccaucacca

SEQ ID NO: 3584073 - RNA, 15 nt, Pseudomonas putida KT2440
gguauccaucaccau

SEQ ID NO: 3584074 - RNA, 14 nt, Pseudomonas putida KT2440
gguaucugccagca

SEQ ID NO: 3584075 - RNA, 18 nt, Pseudomonas putida KT2440
gguaugaugcgcggcauu

SEQ ID NO: 3584076 - RNA, 22 nt, Pseudomonas putida KT2440
gguaugcgcccaucucaggccc

SEQ ID NO: 3584077 - RNA, 23 nt, Pseudomonas putida KT2440
gguaugcgcccaucucaggccca

SEQ ID NO: 3584078 - RNA, 17 nt, Pseudomonas putida KT2440
gguauggccuuucugcu

SEQ ID NO: 3584079 - RNA, 19 nt, Pseudomonas putida KT2440
gguauucacaccugccgcg

SEQ ID NO: 3584080 - RNA, 21 nt, Pseudomonas putida KT2440
gguauucgaggaucagcgcag

SEQ ID NO: 3584081 - RNA, 19 nt, Pseudomonas putida KT2440
gguauugaacggcgcaucc

SEQ ID NO: 3584082 - RNA, 16 nt, Pseudomonas putida KT2440
ggucaaacaaugcaca

SEQ ID NO: 3584083 - RNA, 21 nt, Pseudomonas putida KT2440
ggucaagacgaagcgcuuggu

SEQ ID NO: 3584084 - RNA, 20 nt, Pseudomonas putida KT2440
ggucaaggccagcgccugcu

SEQ ID NO: 3584085 - RNA, 22 nt, Pseudomonas putida KT2440
ggucaaucugugaggccagcgg

SEQ ID NO: 3584086 - RNA, 18 nt, Pseudomonas putida KT2440
ggucaauuggagcggccu

SEQ ID NO: 3584087 - RNA, 13 nt, Pseudomonas putida KT2440
ggucaccaguuca

SEQ ID NO: 3584088 - RNA, 17 nt, Pseudomonas putida KT2440
ggucaccaucagccgcg

SEQ ID NO: 3584089 - RNA, 15 nt, Pseudomonas putida KT2440
ggucaccgcccagcu

SEQ ID NO: 3584090 - RNA, 14 nt, Pseudomonas putida KT2440
ggucaccuugucca

SEQ ID NO: 3584091 - RNA, 16 nt, Pseudomonas putida KT2440
ggucaccuuguccagc

SEQ ID NO: 3584092 - RNA, 19 nt, Pseudomonas putida KT2440
ggucaccuuguccagcagg

SEQ ID NO: 3584093 - RNA, 20 nt, Pseudomonas putida KT2440
ggucacgauccccaccagca

SEQ ID NO: 3584094 - RNA, 16 nt, Pseudomonas putida KT2440
ggucacgcagagcaug

SEQ ID NO: 3584095 - RNA, 23 nt, Pseudomonas putida KT2440
ggucacgcuccuucgccacgaac

SEQ ID NO: 3584096 - RNA, 18 nt, Pseudomonas putida KT2440
ggucacggcauccccgcc

SEQ ID NO: 3584097 - RNA, 15 nt, Pseudomonas putida KT2440
ggucacggcugucac

SEQ ID NO: 3584098 - RNA, 15 nt, Pseudomonas putida KT2440
ggucacguagaacag

SEQ ID NO: 3584099 - RNA, 16 nt, Pseudomonas putida KT2440
ggucacguagaacagg

SEQ ID NO: 3584100 - RNA, 13 nt, Pseudomonas putida KT2440
ggucacucccggg

SEQ ID NO: 3584101 - RNA, 14 nt, Pseudomonas putida KT2440
ggucacugagccag

SEQ ID NO: 3584102 - RNA, 17 nt, Pseudomonas putida KT2440
ggucacugagccaggcc

SEQ ID NO: 3584103 - RNA, 17 nt, Pseudomonas putida KT2440
ggucacugcgcggccgg

SEQ ID NO: 3584104 - RNA, 16 nt, Pseudomonas putida KT2440
ggucacuucagugcug

SEQ ID NO: 3584105 - RNA, 22 nt, Pseudomonas putida KT2440
ggucagcaagccgccgaccagg

SEQ ID NO: 3584106 - RNA, 14 nt, Pseudomonas putida KT2440
ggucagcaccagcu

SEQ ID NO: 3584107 - RNA, 17 nt, Pseudomonas putida KT2440
ggucagcaccagcucau

SEQ ID NO: 3584108 - RNA, 15 nt, Pseudomonas putida KT2440
ggucagcacuugcuu

SEQ ID NO: 3584109 - RNA, 20 nt, Pseudomonas putida KT2440
ggucagcagcaccgccacca

SEQ ID NO: 3584110 - RNA, 13 nt, Pseudomonas putida KT2440
ggucugguaaucc

SEQ ID NO: 3584111 - RNA, 22 nt, Pseudomonas putida KT2440
ggucuucgaucucggccagcag

SEQ ID NO: 3584112 - RNA, 17 nt, Pseudomonas putida KT2440
ggucuucucaggcacca

SEQ ID NO: 3584113 - RNA, 13 nt, Pseudomonas putida KT2440
ggucuugccgguc

SEQ ID NO: 3584114 - RNA, 16 nt, Pseudomonas putida KT2440
ggucuugucugacagc

SEQ ID NO: 3584115 - RNA, 23 nt, Pseudomonas putida KT2440
ggucuugucugacagcaggaaca

SEQ ID NO: 3584116 - RNA, 16 nt, Pseudomonas putida KT2440
ggucuuuuggcucagg

SEQ ID NO: 3584117 - RNA, 13 nt, Pseudomonas putida KT2440
ggugaaacggcaa

SEQ ID NO: 3584118 - RNA, 17 nt, Pseudomonas putida KT2440
ggugaaagucgaccagc

SEQ ID NO: 3584119 - RNA, 19 nt, Pseudomonas putida KT2440
ggugaaagucgaccagcag

SEQ ID NO: 3584120 - RNA, 21 nt, Pseudomonas putida KT2440
ggugaacccgcuccugcaggg

SEQ ID NO: 3584121 - RNA, 15 nt, Pseudomonas putida KT2440
ggugaacgaucaggg

SEQ ID NO: 3584122 - RNA, 19 nt, Pseudomonas putida KT2440
ggugaacggcggguggaaa

SEQ ID NO: 3584123 - RNA, 20 nt, Pseudomonas putida KT2440
ggugaacggcggguggaaau

SEQ ID NO: 3584124 - RNA, 16 nt, Pseudomonas putida KT2440
ggugaagcccugcugc

SEQ ID NO: 3584125 - RNA, 16 nt, Pseudomonas putida KT2440
ggugaaggcaggucag

SEQ ID NO: 3584126 - RNA, 15 nt, Pseudomonas putida KT2440
ggugaaucagcccca

SEQ ID NO: 3584127 - RNA, 23 nt, Pseudomonas putida KT2440
ggugaaucagccccagccgguca

SEQ ID NO: 3584128 - RNA, 18 nt, Pseudomonas putida KT2440
ggugaauggcgagcccgg

SEQ ID NO: 3584129 - RNA, 19 nt, Pseudomonas putida KT2440
ggugacaaaggccggcacc

SEQ ID NO: 3584130 - RNA, 16 nt, Pseudomonas putida KT2440
ggugacaacgcccgcc

SEQ ID NO: 3584131 - RNA, 15 nt, Pseudomonas putida KT2440
ggugacaugcacugc

SEQ ID NO: 3584132 - RNA, 17 nt, Pseudomonas putida KT2440
ggugaccagcggcagca

SEQ ID NO: 3584133 - RNA, 18 nt, Pseudomonas putida KT2440
ggugaccagcggcagcaa

SEQ ID NO: 3584134 - RNA, 16 nt, Pseudomonas putida KT2440
ggugaccaggcccagc

SEQ ID NO: 3584135 - RNA, 18 nt, Pseudomonas putida KT2440
ggugacgaccucggccag

SEQ ID NO: 3584136 - RNA, 21 nt, Pseudomonas putida KT2440
ggugacgaucaccagggcauc

SEQ ID NO: 3584137 - RNA, 13 nt, Pseudomonas putida KT2440
ggugacugccagc

SEQ ID NO: 3584138 - RNA, 15 nt, Pseudomonas putida KT2440
ggugacugccagcac

SEQ ID NO: 3584139 - RNA, 12 nt, Pseudomonas putida KT2440
ggugagcggcuu

SEQ ID NO: 3584140 - RNA, 19 nt, Pseudomonas putida KT2440
ggugaguggcccuggagcg

SEQ ID NO: 3584141 - RNA, 15 nt, Pseudomonas putida KT2440
ggugauaccgaggag

SEQ ID NO: 3584142 - RNA, 23 nt, Pseudomonas putida KT2440
ggugaucaacaaaccgacccugc

SEQ ID NO: 3584143 - RNA, 14 nt, Pseudomonas putida KT2440
ggugaucagcaaug

SEQ ID NO: 3584144 - RNA, 23 nt, Pseudomonas putida KT2440
ggugaucagugcggucaggccaa

SEQ ID NO: 3584145 - RNA, 22 nt, Pseudomonas putida KT2440
ggugauggucaccuuguccagc

SEQ ID NO: 3584146 - RNA, 17 nt, Pseudomonas putida KT2440
ggugauguugcccggca

SEQ ID NO: 3584147 - RNA, 12 nt, Pseudomonas putida KT2440
ggugauugcagu

SEQ ID NO: 3584148 - RNA, 14 nt, Pseudomonas putida KT2440
ggugauuuccugca

SEQ ID NO: 3584149 - RNA, 18 nt, Pseudomonas putida KT2440
ggugcaaaaccugccggu

SEQ ID NO: 3584150 - RNA, 16 nt, Pseudomonas putida KT2440
ggugcaaagcgcccgu

SEQ ID NO: 3584151 - RNA, 12 nt, Pseudomonas putida KT2440
ggugcaacugcc

SEQ ID NO: 3584152 - RNA, 22 nt, Pseudomonas putida KT2440
ggugcaacugccacgcccgcug

SEQ ID NO: 3584153 - RNA, 19 nt, Pseudomonas putida KT2440
ggugcaaggucaaacuccc

SEQ ID NO: 3584154 - RNA, 12 nt, Pseudomonas putida KT2440
ggugcaccagcu

SEQ ID NO: 3584155 - RNA, 18 nt, Pseudomonas putida KT2440
ggugcacgacgucgucga

SEQ ID NO: 3584156 - RNA, 14 nt, Pseudomonas putida KT2440
ggugcacgccagcc

SEQ ID NO: 3584157 - RNA, 16 nt, Pseudomonas putida KT2440
ggugcacgccagccag

SEQ ID NO: 3584158 - RNA, 13 nt, Pseudomonas putida KT2440
ggugcacgggccg

SEQ ID NO: 3584159 - RNA, 21 nt, Pseudomonas putida KT2440
ggugcacguagucgucagggu

SEQ ID NO: 3584160 - RNA, 17 nt, Pseudomonas putida KT2440
ggugcagcaacagguac

SEQ ID NO: 3584161 - RNA, 23 nt, Pseudomonas putida KT2440
ggugcaucggcaccgacggcggu

SEQ ID NO: 3584162 - RNA, 15 nt, Pseudomonas putida KT2440
ggugcaugcaagcag

SEQ ID NO: 3584163 - RNA, 16 nt, Pseudomonas putida KT2440
ggugcauggcucgcag

SEQ ID NO: 3584164 - RNA, 15 nt, Pseudomonas putida KT2440
ggugccaacaggcag

SEQ ID NO: 3584165 - RNA, 17 nt, Pseudomonas putida KT2440
ggugccaacaggcagca

SEQ ID NO: 3584166 - RNA, 18 nt, Pseudomonas putida KT2440
ggugccaacaggcagcau

SEQ ID NO: 3584167 - RNA, 15 nt, Pseudomonas putida KT2440
ggugccaccgauggu

SEQ ID NO: 3584168 - RNA, 13 nt, Pseudomonas putida KT2440
ggugccagcgcca

SEQ ID NO: 3584169 - RNA, 14 nt, Pseudomonas putida KT2440
ggugccagcggcca

SEQ ID NO: 3584170 - RNA, 11 nt, Pseudomonas putida KT2440
ggugccaggcu

SEQ ID NO: 3584171 - RNA, 17 nt, Pseudomonas putida KT2440
ggugccaggcucaggcc

SEQ ID NO: 3584172 - RNA, 21 nt, Pseudomonas putida KT2440
ggugccaggcucaggccuucg

SEQ ID NO: 3584173 - RNA, 20 nt, Pseudomonas putida KT2440
ggugccauagcaccagcggg

SEQ ID NO: 3584174 - RNA, 22 nt, Pseudomonas putida KT2440
ggugccauagcaccagcgggcc

SEQ ID NO: 3584175 - RNA, 20 nt, Pseudomonas putida KT2440
ggugccaucaccgcccgcgc

SEQ ID NO: 3584176 - RNA, 15 nt, Pseudomonas putida KT2440
ggugcccaagcggca

SEQ ID NO: 3584177 - RNA, 16 nt, Pseudomonas putida KT2440
ggugcccacugcagcc

SEQ ID NO: 3584178 - RNA, 16 nt, Pseudomonas putida KT2440
ggugcccugcucuucg

SEQ ID NO: 3584179 - RNA, 13 nt, Pseudomonas putida KT2440
ggugccgaaguca

SEQ ID NO: 3584180 - RNA, 12 nt, Pseudomonas putida KT2440
ggugccgccaug

SEQ ID NO: 3584181 - RNA, 13 nt, Pseudomonas putida KT2440
ggugccggccucu

SEQ ID NO: 3584182 - RNA, 20 nt, Pseudomonas putida KT2440
ggugccguggguugaacagg

SEQ ID NO: 3584183 - RNA, 16 nt, Pseudomonas putida KT2440
ggugccguuccggcaa

SEQ ID NO: 3584184 - RNA, 19 nt, Pseudomonas putida KT2440
ggugccuaucgcucuggca

SEQ ID NO: 3584185 - RNA, 14 nt, Pseudomonas putida KT2440
ggugccuucgagca

SEQ ID NO: 3584186 - RNA, 17 nt, Pseudomonas putida KT2440
ggugcgaaucgacgcgu

SEQ ID NO: 3584187 - RNA, 19 nt, Pseudomonas putida KT2440
ggugcgauagauguccagc

SEQ ID NO: 3584188 - RNA, 19 nt, Pseudomonas putida KT2440
ggugcgcacgcugcccagg

SEQ ID NO: 3584189 - RNA, 22 nt, Pseudomonas putida KT2440
ggugcgccaguggcacccacag

SEQ ID NO: 3584190 - RNA, 15 nt, Pseudomonas putida KT2440
ggugcgccuccagca

SEQ ID NO: 3584191 - RNA, 16 nt, Pseudomonas putida KT2440
ggugcgccugaacagc

SEQ ID NO: 3584192 - RNA, 17 nt, Pseudomonas putida KT2440
ggugcgcgcauccagca

SEQ ID NO: 3584193 - RNA, 20 nt, Pseudomonas putida KT2440
ggugcgcgggucauccagga

SEQ ID NO: 3584194 - RNA, 16 nt, Pseudomonas putida KT2440
ggugcgcgguaccugg

SEQ ID NO: 3584195 - RNA, 17 nt, Pseudomonas putida KT2440
ggugcgcgguaccugga

SEQ ID NO: 3584196 - RNA, 20 nt, Pseudomonas putida KT2440
ggugcggauaccgcuggccg

SEQ ID NO: 3584197 - RNA, 17 nt, Pseudomonas putida KT2440
ggugcggcagcucgccg

SEQ ID NO: 3584198 - RNA, 22 nt, Pseudomonas putida KT2440
ggugcuaccaaccuccagguca

SEQ ID NO: 3584199 - RNA, 12 nt, Pseudomonas putida KT2440
ggugcucagcca

SEQ ID NO: 3584200 - RNA, 14 nt, Pseudomonas putida KT2440
ggugcucagccacg

SEQ ID NO: 3584201 - RNA, 16 nt, Pseudomonas putida KT2440
ggugcucaggcucagc

SEQ ID NO: 3584202 - RNA, 14 nt, Pseudomonas putida KT2440
ggugcuccaggccu

SEQ ID NO: 3584203 - RNA, 23 nt, Pseudomonas putida KT2440
ggugcucgaugaucaucccggcg

SEQ ID NO: 3584204 - RNA, 14 nt, Pseudomonas putida KT2440
ggugcucugccgca

SEQ ID NO: 3584205 - RNA, 17 nt, Pseudomonas putida KT2440
ggugcucugccgcacca

SEQ ID NO: 3584206 - RNA, 15 nt, Pseudomonas putida KT2440
ggugcuggcucgcug

SEQ ID NO: 3584207 - RNA, 23 nt, Pseudomonas putida KT2440
ggugcuuuuccugcgggucaucc

SEQ ID NO: 3584208 - RNA, 15 nt, Pseudomonas putida KT2440
gguggaaauuggcca

SEQ ID NO: 3584209 - RNA, 21 nt, Pseudomonas putida KT2440
gguggaaauuggccagcaggc

SEQ ID NO: 3584210 - RNA, 15 nt, Pseudomonas putida KT2440
gguggaacaggaugg

SEQ ID NO: 3584211 - RNA, 23 nt, Pseudomonas putida KT2440
gguggaguaccugugggagcggg

SEQ ID NO: 3584212 - RNA, 16 nt, Pseudomonas putida KT2440
gguggcaaugcucgcc

SEQ ID NO: 3584213 - RNA, 12 nt, Pseudomonas putida KT2440
gguggcagaaca

SEQ ID NO: 3584214 - RNA, 12 nt, Pseudomonas putida KT2440
gguggcaucacc

SEQ ID NO: 3584215 - RNA, 18 nt, Pseudomonas putida KT2440
gguggccgcgcgggugcg

SEQ ID NO: 3584216 - RNA, 12 nt, Pseudomonas putida KT2440
gguuuggugguu

SEQ ID NO: 3584217 - RNA, 19 nt, Pseudomonas putida KT2440
gguuuguggguacugcuuc

SEQ ID NO: 3584218 - RNA, 16 nt, Pseudomonas putida KT2440
gguuuucagcgccgca

SEQ ID NO: 3584219 - RNA, 12 nt, Pseudomonas putida KT2440
gguuuucgcggu

SEQ ID NO: 3584220 - RNA, 15 nt, Pseudomonas putida KT2440
gguuuuggcaggccg

SEQ ID NO: 3584221 - RNA, 19 nt, Pseudomonas putida KT2440
gguuuuuucuauugcucag

SEQ ID NO: 3584222 - RNA, 17 nt, Pseudomonas putida KT2440
gguuuuuugccugauca

SEQ ID NO: 3584223 - RNA, 23 nt, Pseudomonas putida KT2440
guaaaaacuggccagcagccccc

SEQ ID NO: 3584224 - RNA, 12 nt, Pseudomonas putida KT2440
guaaacccgcgc

SEQ ID NO: 3584225 - RNA, 18 nt, Pseudomonas putida KT2440
guaaacccgcuccuacag

SEQ ID NO: 3584226 - RNA, 18 nt, Pseudomonas putida KT2440
guaaacccgcuccuacgg

SEQ ID NO: 3584227 - RNA, 23 nt, Pseudomonas putida KT2440
guaaaccugccugauugccuggc

SEQ ID NO: 3584228 - RNA, 15 nt, Pseudomonas putida KT2440
guaaagccagcagcc

SEQ ID NO: 3584229 - RNA, 18 nt, Pseudomonas putida KT2440
guaaagccagcagccugu

SEQ ID NO: 3584230 - RNA, 15 nt, Pseudomonas putida KT2440
guaaagcgccccagg

SEQ ID NO: 3584231 - RNA, 16 nt, Pseudomonas putida KT2440
guaaaggugcccugcu

SEQ ID NO: 3584232 - RNA, 14 nt, Pseudomonas putida KT2440
guaacaggcgcaca

SEQ ID NO: 3584233 - RNA, 17 nt, Pseudomonas putida KT2440
guaaccgcugccauagc

SEQ ID NO: 3584234 - RNA, 19 nt, Pseudomonas putida KT2440
guaacgagccuuggccagc

SEQ ID NO: 3584235 - RNA, 16 nt, Pseudomonas putida KT2440
guaacgauugcaucuc

SEQ ID NO: 3584236 - RNA, 21 nt, Pseudomonas putida KT2440
guaacggcggauguuggccac

SEQ ID NO: 3584237 - RNA, 23 nt, Pseudomonas putida KT2440
guaacggcucugacauaacaaga

SEQ ID NO: 3584238 - RNA, 23 nt, Pseudomonas putida KT2440
guaacgggcaaaguccaucgguu

SEQ ID NO: 3584239 - RNA, 17 nt, Pseudomonas putida KT2440
guaacgggccagccgcg

SEQ ID NO: 3584240 - RNA, 18 nt, Pseudomonas putida KT2440
guaacguggacagcagcu

SEQ ID NO: 3584241 - RNA, 14 nt, Pseudomonas putida KT2440
guaagauugcaggc

SEQ ID NO: 3584242 - RNA, 17 nt, Pseudomonas putida KT2440
guaagauugcaggccau

SEQ ID NO: 3584243 - RNA, 16 nt, Pseudomonas putida KT2440
guaagccagcccugcc

SEQ ID NO: 3584244 - RNA, 18 nt, Pseudomonas putida KT2440
guaagccaugcgcaggca

SEQ ID NO: 3584245 - RNA, 19 nt, Pseudomonas putida KT2440
guaagccggcggccaucgc

SEQ ID NO: 3584246 - RNA, 19 nt, Pseudomonas putida KT2440
guaagucggcucuucuuuc

SEQ ID NO: 3584247 - RNA, 16 nt, Pseudomonas putida KT2440
guaaguugaaugaaaa

SEQ ID NO: 3584248 - RNA, 13 nt, Pseudomonas putida KT2440
guaauacgcugug

SEQ ID NO: 3584249 - RNA, 17 nt, Pseudomonas putida KT2440
guaauacgcugugcucu

SEQ ID NO: 3584250 - RNA, 16 nt, Pseudomonas putida KT2440
guaauacggcgccgac

SEQ ID NO: 3584251 - RNA, 17 nt, Pseudomonas putida KT2440
guaaucaguaccaggcc

SEQ ID NO: 3584252 - RNA, 17 nt, Pseudomonas putida KT2440
guaauccggcaacuggc

SEQ ID NO: 3584253 - RNA, 18 nt, Pseudomonas putida KT2440
guaauccucguccagcuc

SEQ ID NO: 3584254 - RNA, 22 nt, Pseudomonas putida KT2440
guaaucgaugaaauucaccugc

SEQ ID NO: 3584255 - RNA, 23 nt, Pseudomonas putida KT2440
guaaucugccggcgccuccagca

SEQ ID NO: 3584256 - RNA, 13 nt, Pseudomonas putida KT2440
guaaucuggcugu

SEQ ID NO: 3584257 - RNA, 15 nt, Pseudomonas putida KT2440
guaaugcagccggcc

SEQ ID NO: 3584258 - RNA, 22 nt, Pseudomonas putida KT2440
guaaugcuggugguggcccuga

SEQ ID NO: 3584259 - RNA, 20 nt, Pseudomonas putida KT2440
guaauggcgcuggaucuugc

SEQ ID NO: 3584260 - RNA, 12 nt, Pseudomonas putida KT2440
guaauuggccgg

SEQ ID NO: 3584261 - RNA, 23 nt, Pseudomonas putida KT2440
guaauugguggugcugggcauga

SEQ ID NO: 3584262 - RNA, 19 nt, Pseudomonas putida KT2440
guacaacaacaaaaaaaac

SEQ ID NO: 3584263 - RNA, 14 nt, Pseudomonas putida KT2440
guacaacgcagccg

SEQ ID NO: 3584264 - RNA, 16 nt, Pseudomonas putida KT2440
guacaacgcagccggc

SEQ ID NO: 3584265 - RNA, 17 nt, Pseudomonas putida KT2440
guacacagcccaaggcu

SEQ ID NO: 3584266 - RNA, 19 nt, Pseudomonas putida KT2440
guacaccccgaccaaggcc

SEQ ID NO: 3584267 - RNA, 20 nt, Pseudomonas putida KT2440
guacaccccgaccaaggcca

SEQ ID NO: 3584268 - RNA, 14 nt, Pseudomonas putida KT2440
guacaccgggaaca

SEQ ID NO: 3584269 - RNA, 20 nt, Pseudomonas putida KT2440
guacaccuuggugcgcgcau

SEQ ID NO: 3584270 - RNA, 14 nt, Pseudomonas putida KT2440
guacacgccacgga

SEQ ID NO: 3584271 - RNA, 21 nt, Pseudomonas putida KT2440
guacacgccuuaguucaccca

SEQ ID NO: 3584272 - RNA, 14 nt, Pseudomonas putida KT2440
guacagcacccagg

SEQ ID NO: 3584273 - RNA, 13 nt, Pseudomonas putida KT2440
guacagcagcuca

SEQ ID NO: 3584274 - RNA, 12 nt, Pseudomonas putida KT2440
guacagccagca

SEQ ID NO: 3584275 - RNA, 18 nt, Pseudomonas putida KT2440
guacagccuaccaacgca

SEQ ID NO: 3584276 - RNA, 23 nt, Pseudomonas putida KT2440
guacagccuaccaacgcagcaug

SEQ ID NO: 3584277 - RNA, 18 nt, Pseudomonas putida KT2440
guacagcucacgcagcca

SEQ ID NO: 3584278 - RNA, 13 nt, Pseudomonas putida KT2440
guacagcugcuca

SEQ ID NO: 3584279 - RNA, 14 nt, Pseudomonas putida KT2440
guacaggcaaagaa

SEQ ID NO: 3584280 - RNA, 14 nt, Pseudomonas putida KT2440
guacaggcugccgc

SEQ ID NO: 3584281 - RNA, 19 nt, Pseudomonas putida KT2440
guacauagaacagcaucaa

SEQ ID NO: 3584282 - RNA, 14 nt, Pseudomonas putida KT2440
guacauagcaggau

SEQ ID NO: 3584283 - RNA, 19 nt, Pseudomonas putida KT2440
guacauagcaggaucuagc

SEQ ID NO: 3584284 - RNA, 21 nt, Pseudomonas putida KT2440
guacaucggguaagccaugcg

SEQ ID NO: 3584285 - RNA, 16 nt, Pseudomonas putida KT2440
guacaugaucggguuc

SEQ ID NO: 3584286 - RNA, 19 nt, Pseudomonas putida KT2440
guacauggccgccaaggcg

SEQ ID NO: 3584287 - RNA, 20 nt, Pseudomonas putida KT2440
guacauguuggucagcgccu

SEQ ID NO: 3584288 - RNA, 14 nt, Pseudomonas putida KT2440
guacauugcgcacc

SEQ ID NO: 3584289 - RNA, 17 nt, Pseudomonas putida KT2440
guaccacacauccgggu

SEQ ID NO: 3584290 - RNA, 21 nt, Pseudomonas putida KT2440
guaccacgcuagucaagcugc

SEQ ID NO: 3584291 - RNA, 19 nt, Pseudomonas putida KT2440
guaccacuuccaacacccg

SEQ ID NO: 3584292 - RNA, 20 nt, Pseudomonas putida KT2440
guaccaggccuuucugcucg

SEQ ID NO: 3584293 - RNA, 16 nt, Pseudomonas putida KT2440
guaccaggcugccacg

SEQ ID NO: 3584294 - RNA, 19 nt, Pseudomonas putida KT2440
guaccaggcugccacggcg

SEQ ID NO: 3584295 - RNA, 19 nt, Pseudomonas putida KT2440
guaccaggucgccagcacc

SEQ ID NO: 3584296 - RNA, 22 nt, Pseudomonas putida KT2440
guacccaggugaugcaggcaau

SEQ ID NO: 3584297 - RNA, 22 nt, Pseudomonas putida KT2440
guaccccucgcugcccaacgcc

SEQ ID NO: 3584298 - RNA, 23 nt, Pseudomonas putida KT2440
guaccccuggcgcuuuccagcug

SEQ ID NO: 3584299 - RNA, 12 nt, Pseudomonas putida KT2440
guacccgcuggc

SEQ ID NO: 3584300 - RNA, 13 nt, Pseudomonas putida KT2440
guacccggcugga

SEQ ID NO: 3584301 - RNA, 15 nt, Pseudomonas putida KT2440
guaccgcucugcgcc

SEQ ID NO: 3584302 - RNA, 17 nt, Pseudomonas putida KT2440
guaccgggcggccaccg

SEQ ID NO: 3584303 - RNA, 16 nt, Pseudomonas putida KT2440
guaccgggguagaccu

SEQ ID NO: 3584304 - RNA, 18 nt, Pseudomonas putida KT2440
guaccggucauggcgcgc

SEQ ID NO: 3584305 - RNA, 22 nt, Pseudomonas putida KT2440
guaccgucggcacgagcaugcc

SEQ ID NO: 3584306 - RNA, 13 nt, Pseudomonas putida KT2440
guaccgugcugca

SEQ ID NO: 3584307 - RNA, 16 nt, Pseudomonas putida KT2440
guaccguugcggauca

SEQ ID NO: 3584308 - RNA, 20 nt, Pseudomonas putida KT2440
guaccucauaguaaggcugg

SEQ ID NO: 3584309 - RNA, 14 nt, Pseudomonas putida KT2440
guaccugccccccc

SEQ ID NO: 3584310 - RNA, 13 nt, Pseudomonas putida KT2440
guaccuguggggc

SEQ ID NO: 3584311 - RNA, 20 nt, Pseudomonas putida KT2440
guaccuguggggcaacugcg

SEQ ID NO: 3584312 - RNA, 19 nt, Pseudomonas putida KT2440
guaccuucaagguuggggc

SEQ ID NO: 3584313 - RNA, 13 nt, Pseudomonas putida KT2440
guaccuucggcga

SEQ ID NO: 3584314 - RNA, 18 nt, Pseudomonas putida KT2440
guaccuucuggcuggagc

SEQ ID NO: 3584315 - RNA, 21 nt, Pseudomonas putida KT2440
guacgaagccaugucuucacg

SEQ ID NO: 3584316 - RNA, 16 nt, Pseudomonas putida KT2440
guacgcaaucgcucag

SEQ ID NO: 3584317 - RNA, 18 nt, Pseudomonas putida KT2440
guacgcaaucgcucaggg

SEQ ID NO: 3584318 - RNA, 12 nt, Pseudomonas putida KT2440
guacgcaggcau

SEQ ID NO: 3584319 - RNA, 22 nt, Pseudomonas putida KT2440
guacgccagcagcgcauggcuc

SEQ ID NO: 3584320 - RNA, 21 nt, Pseudomonas putida KT2440
guacgccgcaaacgcugagcg

SEQ ID NO: 3584321 - RNA, 21 nt, Pseudomonas putida KT2440
guauagugguaugauuucagg

SEQ ID NO: 3584322 - RNA, 20 nt, Pseudomonas putida KT2440
guauauaucucgggcuucca

SEQ ID NO: 3584323 - RNA, 21 nt, Pseudomonas putida KT2440
guaucacgcuccugcaugccu

SEQ ID NO: 3584324 - RNA, 19 nt, Pseudomonas putida KT2440
guauccacauacugcuucu

SEQ ID NO: 3584325 - RNA, 13 nt, Pseudomonas putida KT2440
guaucccaggcgc

SEQ ID NO: 3584326 - RNA, 20 nt, Pseudomonas putida KT2440
guauccuccagcccugcucg

SEQ ID NO: 3584327 - RNA, 16 nt, Pseudomonas putida KT2440
guaucgccccggucag

SEQ ID NO: 3584328 - RNA, 20 nt, Pseudomonas putida KT2440
guaucugccgaugcgcgugc

SEQ ID NO: 3584329 - RNA, 20 nt, Pseudomonas putida KT2440
guauggcaggcugacccgcu

SEQ ID NO: 3584330 - RNA, 16 nt, Pseudomonas putida KT2440
guauggccgagcagga

SEQ ID NO: 3584331 - RNA, 14 nt, Pseudomonas putida KT2440
guauuaauuugaac

SEQ ID NO: 3584332 - RNA, 15 nt, Pseudomonas putida KT2440
guauucacaccugcc

SEQ ID NO: 3584333 - RNA, 20 nt, Pseudomonas putida KT2440
guauuccagaaucugcacac

SEQ ID NO: 3584334 - RNA, 22 nt, Pseudomonas putida KT2440
guauucgcggguaaacccgcuc

SEQ ID NO: 3584335 - RNA, 11 nt, Pseudomonas putida KT2440
guauucggcgg

SEQ ID NO: 3584336 - RNA, 16 nt, Pseudomonas putida KT2440
guauugccccggccag

SEQ ID NO: 3584337 - RNA, 19 nt, Pseudomonas putida KT2440
guauugccugugcuggccu

SEQ ID NO: 3584338 - RNA, 22 nt, Pseudomonas putida KT2440
guauuugaccagcccgcugcag

SEQ ID NO: 3584339 - RNA, 18 nt, Pseudomonas putida KT2440
guauuuuugcgccaggcg

SEQ ID NO: 3584340 - RNA, 15 nt, Pseudomonas putida KT2440
gucaaacagccgccc

SEQ ID NO: 3584341 - RNA, 17 nt, Pseudomonas putida KT2440
gucaaccaggcgcagca

SEQ ID NO: 3584342 - RNA, 17 nt, Pseudomonas putida KT2440
gucaacgaggccgccau

SEQ ID NO: 3584343 - RNA, 21 nt, Pseudomonas putida KT2440
gucaacggcaacgccagcaau

SEQ ID NO: 3584344 - RNA, 15 nt, Pseudomonas putida KT2440
gucaacgguaacguu

SEQ ID NO: 3584345 - RNA, 22 nt, Pseudomonas putida KT2440
gucaacucaggcugagcagacc

SEQ ID NO: 3584346 - RNA, 19 nt, Pseudomonas putida KT2440
gucaagacgaagcgcuugg

SEQ ID NO: 3584347 - RNA, 21 nt, Pseudomonas putida KT2440
gucaagcuggcgcaaucuugc

SEQ ID NO: 3584348 - RNA, 20 nt, Pseudomonas putida KT2440
gucaaggccagcgccugcug

SEQ ID NO: 3584349 - RNA, 22 nt, Pseudomonas putida KT2440
gucaagguugcucagggcggca

SEQ ID NO: 3584350 - RNA, 16 nt, Pseudomonas putida KT2440
gucaaucuugcgcacg

SEQ ID NO: 3584351 - RNA, 18 nt, Pseudomonas putida KT2440
gucaaucuuguggcggau

SEQ ID NO: 3584352 - RNA, 16 nt, Pseudomonas putida KT2440
gucaauuggagcggcc

SEQ ID NO: 3584353 - RNA, 20 nt, Pseudomonas putida KT2440
gucaauuggagcggccuugu

SEQ ID NO: 3584354 - RNA, 21 nt, Pseudomonas putida KT2440
gucaccaccggcuuccagcuu

SEQ ID NO: 3584355 - RNA, 17 nt, Pseudomonas putida KT2440
gucaccacgcccgccgg

SEQ ID NO: 3584356 - RNA, 19 nt, Pseudomonas putida KT2440
gucaccagcgucaccccuc

SEQ ID NO: 3584357 - RNA, 19 nt, Pseudomonas putida KT2440
gucaccaucggugcggccc

SEQ ID NO: 3584358 - RNA, 18 nt, Pseudomonas putida KT2440
gucaccauugcuccauau

SEQ ID NO: 3584359 - RNA, 13 nt, Pseudomonas putida KT2440
gucacccaccggc

SEQ ID NO: 3584360 - RNA, 17 nt, Pseudomonas putida KT2440
gucacccaccggcucca

SEQ ID NO: 3584361 - RNA, 20 nt, Pseudomonas putida KT2440
gucaccccucggcucacgcc

SEQ ID NO: 3584362 - RNA, 19 nt, Pseudomonas putida KT2440
gucacccguggcagccccc

SEQ ID NO: 3584363 - RNA, 13 nt, Pseudomonas putida KT2440
gucacccuccacg

SEQ ID NO: 3584364 - RNA, 23 nt, Pseudomonas putida KT2440
gucacccugacgcugcacuucca

SEQ ID NO: 3584365 - RNA, 20 nt, Pseudomonas putida KT2440
gucaccgaacucguugacca

SEQ ID NO: 3584366 - RNA, 12 nt, Pseudomonas putida KT2440
gucaccgcccag

SEQ ID NO: 3584367 - RNA, 17 nt, Pseudomonas putida KT2440
gucaccgcccagcuucu

SEQ ID NO: 3584368 - RNA, 13 nt, Pseudomonas putida KT2440
gucaccgcggcaa

SEQ ID NO: 3584369 - RNA, 17 nt, Pseudomonas putida KT2440
gucaccggccaugccga

SEQ ID NO: 3584370 - RNA, 17 nt, Pseudomonas putida KT2440
gucaccuugcuccacca

SEQ ID NO: 3584371 - RNA, 20 nt, Pseudomonas putida KT2440
gucaccuugcuccaccaggc

SEQ ID NO: 3584372 - RNA, 21 nt, Pseudomonas putida KT2440
gucaccuuguccagcaggcca

SEQ ID NO: 3584373 - RNA, 19 nt, Pseudomonas putida KT2440
gucaccuuuuccacuugca

SEQ ID NO: 3584374 - RNA, 18 nt, Pseudomonas putida KT2440
gucacgacaggggcgcag

SEQ ID NO: 3584375 - RNA, 22 nt, Pseudomonas putida KT2440
gucacgccauccccccagcccu

SEQ ID NO: 3584376 - RNA, 19 nt, Pseudomonas putida KT2440
gucacgcccaucaggaaca

SEQ ID NO: 3584377 - RNA, 20 nt, Pseudomonas putida KT2440
gucacgcccaucaggaacag

SEQ ID NO: 3584378 - RNA, 13 nt, Pseudomonas putida KT2440
gucacggccaccc

SEQ ID NO: 3584379 - RNA, 17 nt, Pseudomonas putida KT2440
gucacggcugaagaagc

SEQ ID NO: 3584380 - RNA, 19 nt, Pseudomonas putida KT2440
gucacggguauagccaugc

SEQ ID NO: 3584381 - RNA, 16 nt, Pseudomonas putida KT2440
gucacgugccuucacc

SEQ ID NO: 3584382 - RNA, 13 nt, Pseudomonas putida KT2440
gucacguugcccg

SEQ ID NO: 3584383 - RNA, 19 nt, Pseudomonas putida KT2440
gucacguuuuuugggagcg

SEQ ID NO: 3584384 - RNA, 22 nt, Pseudomonas putida KT2440
gucacucugccgccccuccacc

SEQ ID NO: 3584385 - RNA, 14 nt, Pseudomonas putida KT2440
gucacugagccagg

SEQ ID NO: 3584386 - RNA, 16 nt, Pseudomonas putida KT2440
gucacugagccaggcc

SEQ ID NO: 3584387 - RNA, 18 nt, Pseudomonas putida KT2440
gucacugcagaucaccag

SEQ ID NO: 3584388 - RNA, 14 nt, Pseudomonas putida KT2440
gucacugcgcgccg

SEQ ID NO: 3584389 - RNA, 12 nt, Pseudomonas putida KT2440
gucacuggcugc

SEQ ID NO: 3584390 - RNA, 18 nt, Pseudomonas putida KT2440
gucacuucuuucagcuca

SEQ ID NO: 3584391 - RNA, 19 nt, Pseudomonas putida KT2440
gucagaaaaaacagugccg

SEQ ID NO: 3584392 - RNA, 14 nt, Pseudomonas putida KT2440
gucagaaagaaugg

SEQ ID NO: 3584393 - RNA, 21 nt, Pseudomonas putida KT2440
gucagacgcggaacuggcuga

SEQ ID NO: 3584394 - RNA, 19 nt, Pseudomonas putida KT2440
gucagacuuucccacaugu

SEQ ID NO: 3584395 - RNA, 15 nt, Pseudomonas putida KT2440
gucagacuuuccuga

SEQ ID NO: 3584396 - RNA, 19 nt, Pseudomonas putida KT2440
gucagauaacccuuggcgu

SEQ ID NO: 3584397 - RNA, 12 nt, Pseudomonas putida KT2440
gucagcaaccac

SEQ ID NO: 3584398 - RNA, 15 nt, Pseudomonas putida KT2440
gucagcaccuggcag

SEQ ID NO: 3584399 - RNA, 21 nt, Pseudomonas putida KT2440
gucagcaccugggcgucauca

SEQ ID NO: 3584400 - RNA, 13 nt, Pseudomonas putida KT2440
gucagcagcaggc

SEQ ID NO: 3584401 - RNA, 14 nt, Pseudomonas putida KT2440
gucagcagcaugaa

SEQ ID NO: 3584402 - RNA, 14 nt, Pseudomonas putida KT2440
gucagcagggccaa

SEQ ID NO: 3584403 - RNA, 17 nt, Pseudomonas putida KT2440
gucagcaucaccgcgcc

SEQ ID NO: 3584404 - RNA, 23 nt, Pseudomonas putida KT2440
gucagccacauccucugcccgca

SEQ ID NO: 3584405 - RNA, 21 nt, Pseudomonas putida KT2440
gucagccaccaccagcuccac

SEQ ID NO: 3584406 - RNA, 20 nt, Pseudomonas putida KT2440
gucagccagugcugccugcu

SEQ ID NO: 3584407 - RNA, 15 nt, Pseudomonas putida KT2440
gucagcccauccaga

SEQ ID NO: 3584408 - RNA, 20 nt, Pseudomonas putida KT2440
gucagccgcggugaagacca

SEQ ID NO: 3584409 - RNA, 13 nt, Pseudomonas putida KT2440
gucagccggcagu

SEQ ID NO: 3584410 - RNA, 16 nt, Pseudomonas putida KT2440
gucagccguugaccag

SEQ ID NO: 3584411 - RNA, 21 nt, Pseudomonas putida KT2440
gucagccugccauaccugcuu

SEQ ID NO: 3584412 - RNA, 18 nt, Pseudomonas putida KT2440
gucagccuuucgagagcc

SEQ ID NO: 3584413 - RNA, 16 nt, Pseudomonas putida KT2440
gucagcgacugccaau

SEQ ID NO: 3584414 - RNA, 18 nt, Pseudomonas putida KT2440
gucagcgccgauggccaa

SEQ ID NO: 3584415 - RNA, 16 nt, Pseudomonas putida KT2440
gucagcgcucggguug

SEQ ID NO: 3584416 - RNA, 21 nt, Pseudomonas putida KT2440
gucagcgcugacucagcggcc

SEQ ID NO: 3584417 - RNA, 13 nt, Pseudomonas putida KT2440
gucagcggcaguu

SEQ ID NO: 3584418 - RNA, 13 nt, Pseudomonas putida KT2440
gucagcgguucga

SEQ ID NO: 3584419 - RNA, 19 nt, Pseudomonas putida KT2440
gucagcguacacugcagga

SEQ ID NO: 3584420 - RNA, 14 nt, Pseudomonas putida KT2440
gucagcucaggccu

SEQ ID NO: 3584421 - RNA, 19 nt, Pseudomonas putida KT2440
gucagcucgaucaggcucu

SEQ ID NO: 3584422 - RNA, 16 nt, Pseudomonas putida KT2440
gucagcuggccuucga

SEQ ID NO: 3584423 - RNA, 23 nt, Pseudomonas putida KT2440
gucagcugguucugcugcagcca

SEQ ID NO: 3584424 - RNA, 14 nt, Pseudomonas putida KT2440
gucagcuucugggu

SEQ ID NO: 3584425 - RNA, 21 nt, Pseudomonas putida KT2440
gucagcuugccuuccgggaag

SEQ ID NO: 3584426 - RNA, 15 nt, Pseudomonas putida KT2440
gucccccaucggcac

SEQ ID NO: 3584427 - RNA, 17 nt, Pseudomonas putida KT2440
guccccuucgucgaugu

SEQ ID NO: 3584428 - RNA, 18 nt, Pseudomonas putida KT2440
gucccgaaagggccgcaa

SEQ ID NO: 3584429 - RNA, 22 nt, Pseudomonas putida KT2440
gucccgaaagggccgcaaagcg

SEQ ID NO: 3584430 - RNA, 23 nt, Pseudomonas putida KT2440
gucccgccauauucgcggcggcc

SEQ ID NO: 3584431 - RNA, 16 nt, Pseudomonas putida KT2440
gucccggcacaaccga

SEQ ID NO: 3584432 - RNA, 22 nt, Pseudomonas putida KT2440
gucccggcacaaccgaacccgc

SEQ ID NO: 3584433 - RNA, 20 nt, Pseudomonas putida KT2440
gucccugacucgaccgccgc

SEQ ID NO: 3584434 - RNA, 24 nt, Pseudomonas putida KT2440
gucccugacucgaccgccgcacag

SEQ ID NO: 3584435 - RNA, 17 nt, Pseudomonas putida KT2440
gucccugcccgaucgcc

SEQ ID NO: 3584436 - RNA, 14 nt, Pseudomonas putida KT2440
gucccuguaggcgc

SEQ ID NO: 3584437 - RNA, 14 nt, Pseudomonas putida KT2440
guccgacaaugcca

SEQ ID NO: 3584438 - RNA, 24 nt, Pseudomonas putida KT2440
guccgacaaugccagcaaaugccc

SEQ ID NO: 3584439 - RNA, 23 nt, Pseudomonas putida KT2440
guccgacagcuugcccagcugcg

SEQ ID NO: 3584440 - RNA, 16 nt, Pseudomonas putida KT2440
guccgaggucagcacc

SEQ ID NO: 3584441 - RNA, 13 nt, Pseudomonas putida KT2440
guccgccagcaca

SEQ ID NO: 3584442 - RNA, 13 nt, Pseudomonas putida KT2440
guccgccaggaag

SEQ ID NO: 3584443 - RNA, 17 nt, Pseudomonas putida KT2440
guccgcccuugccacca

SEQ ID NO: 3584444 - RNA, 18 nt, Pseudomonas putida KT2440
guccgccgccgucagguu

SEQ ID NO: 3584445 - RNA, 17 nt, Pseudomonas putida KT2440
guccgcgaagcagacaa

SEQ ID NO: 3584446 - RNA, 16 nt, Pseudomonas putida KT2440
guccgcgccagcggcc

SEQ ID NO: 3584447 - RNA, 20 nt, Pseudomonas putida KT2440
guccggacuuggaccccgaa

SEQ ID NO: 3584448 - RNA, 18 nt, Pseudomonas putida KT2440
guccggcaucacuaccca

SEQ ID NO: 3584449 - RNA, 19 nt, Pseudomonas putida KT2440
guccggccuauucgcgggu

SEQ ID NO: 3584450 - RNA, 18 nt, Pseudomonas putida KT2440
guccgggcccaugccacg

SEQ ID NO: 3584451 - RNA, 14 nt, Pseudomonas putida KT2440
guccgggucgccgu

SEQ ID NO: 3584452 - RNA, 16 nt, Pseudomonas putida KT2440
guccgguaacuggccc

SEQ ID NO: 3584453 - RNA, 21 nt, Pseudomonas putida KT2440
guccgucucuucagccgucgc

SEQ ID NO: 3584454 - RNA, 21 nt, Pseudomonas putida KT2440
guccuccugccgggguaaaac

SEQ ID NO: 3584455 - RNA, 15 nt, Pseudomonas putida KT2440
guccucgaacucaug

SEQ ID NO: 3584456 - RNA, 18 nt, Pseudomonas putida KT2440
guccucgaacucaugcuc

SEQ ID NO: 3584457 - RNA, 18 nt, Pseudomonas putida KT2440
guccucgacgggcaggcg

SEQ ID NO: 3584458 - RNA, 21 nt, Pseudomonas putida KT2440
guccucguucagccaacggcg

SEQ ID NO: 3584459 - RNA, 14 nt, Pseudomonas putida KT2440
guccugcaaaggcc

SEQ ID NO: 3584460 - RNA, 18 nt, Pseudomonas putida KT2440
guccugcaaaggcccuuu

SEQ ID NO: 3584461 - RNA, 17 nt, Pseudomonas putida KT2440
guccugcaacucggccu

SEQ ID NO: 3584462 - RNA, 21 nt, Pseudomonas putida KT2440
guccugcaacugggcaauguu

SEQ ID NO: 3584463 - RNA, 15 nt, Pseudomonas putida KT2440
guccugcagcggcaa

SEQ ID NO: 3584464 - RNA, 19 nt, Pseudomonas putida KT2440
guccugcagcggcaaggua

SEQ ID NO: 3584465 - RNA, 21 nt, Pseudomonas putida KT2440
guccugccgacgccgcuucuc

SEQ ID NO: 3584466 - RNA, 16 nt, Pseudomonas putida KT2440
guccugcgcgcuugaa

SEQ ID NO: 3584467 - RNA, 23 nt, Pseudomonas putida KT2440
guccugcuccacccgugcagggg

SEQ ID NO: 3584468 - RNA, 13 nt, Pseudomonas putida KT2440
guccugcugcagg

SEQ ID NO: 3584469 - RNA, 17 nt, Pseudomonas putida KT2440
guccugcugcaggcucu

SEQ ID NO: 3584470 - RNA, 14 nt, Pseudomonas putida KT2440
guccuggacccgca

SEQ ID NO: 3584471 - RNA, 17 nt, Pseudomonas putida KT2440
guccuggacccgcagca

SEQ ID NO: 3584472 - RNA, 19 nt, Pseudomonas putida KT2440
guccuggacccgcagcagg

SEQ ID NO: 3584473 - RNA, 20 nt, Pseudomonas putida KT2440
guccuggacccgcagcaggu

SEQ ID NO: 3584474 - RNA, 18 nt, Pseudomonas putida KT2440
guccuggucacggccacc

SEQ ID NO: 3584475 - RNA, 21 nt, Pseudomonas putida KT2440
guccuggucacggccacccau

SEQ ID NO: 3584476 - RNA, 15 nt, Pseudomonas putida KT2440
guccuggucgcgggc

SEQ ID NO: 3584477 - RNA, 23 nt, Pseudomonas putida KT2440
guccuucggagguagccaccuga

SEQ ID NO: 3584478 - RNA, 14 nt, Pseudomonas putida KT2440
guccuugagcgccg

SEQ ID NO: 3584479 - RNA, 16 nt, Pseudomonas putida KT2440
guccuugcuggccacc

SEQ ID NO: 3584480 - RNA, 21 nt, Pseudomonas putida KT2440
guccuugcuggccaccgcgcu

SEQ ID NO: 3584481 - RNA, 13 nt, Pseudomonas putida KT2440
guccuuggccaau

SEQ ID NO: 3584482 - RNA, 17 nt, Pseudomonas putida KT2440
guccuuggcccagccau

SEQ ID NO: 3584483 - RNA, 19 nt, Pseudomonas putida KT2440
guccuugucggcgaaggcu

SEQ ID NO: 3584484 - RNA, 15 nt, Pseudomonas putida KT2440
guccuuucgcgacac

SEQ ID NO: 3584485 - RNA, 22 nt, Pseudomonas putida KT2440
gucgaaaccgaaaccacugcug

SEQ ID NO: 3584486 - RNA, 23 nt, Pseudomonas putida KT2440
gucgaaaccgaaaccacugcugu

SEQ ID NO: 3584487 - RNA, 21 nt, Pseudomonas putida KT2440
gucgaacaccaguucgccauc

SEQ ID NO: 3584488 - RNA, 16 nt, Pseudomonas putida KT2440
gucgaacaggcugccg

SEQ ID NO: 3584489 - RNA, 22 nt, Pseudomonas putida KT2440
gucgaaccacaucggcgcgccc

SEQ ID NO: 3584490 - RNA, 22 nt, Pseudomonas putida KT2440
gucgaaccacugaugcgcgucc

SEQ ID NO: 3584491 - RNA, 15 nt, Pseudomonas putida KT2440
gucgaacccagcuug

SEQ ID NO: 3584492 - RNA, 22 nt, Pseudomonas putida KT2440
gucgaaccccugauguggcugc

SEQ ID NO: 3584493 - RNA, 19 nt, Pseudomonas putida KT2440
gucgaacuccuugucgcaa

SEQ ID NO: 3584494 - RNA, 12 nt, Pseudomonas putida KT2440
gucgaagcccgc

SEQ ID NO: 3584495 - RNA, 14 nt, Pseudomonas putida KT2440
gucgaagcccgcgg

SEQ ID NO: 3584496 - RNA, 22 nt, Pseudomonas putida KT2440
gucgaaggucaggcgcgugccu

SEQ ID NO: 3584497 - RNA, 18 nt, Pseudomonas putida KT2440
gucgaaggugucgaugcc

SEQ ID NO: 3584498 - RNA, 15 nt, Pseudomonas putida KT2440
gucgaauacaccgcc

SEQ ID NO: 3584499 - RNA, 20 nt, Pseudomonas putida KT2440
gucgacaaaguugccgauga

SEQ ID NO: 3584500 - RNA, 12 nt, Pseudomonas putida KT2440
gucgacagugac

SEQ ID NO: 3584501 - RNA, 20 nt, Pseudomonas putida KT2440
gucgaccgggcagaccugcu

SEQ ID NO: 3584502 - RNA, 22 nt, Pseudomonas putida KT2440
gucgacgauacccagcgcgcgc

SEQ ID NO: 3584503 - RNA, 14 nt, Pseudomonas putida KT2440
gucgacgaucgccg

SEQ ID NO: 3584504 - RNA, 13 nt, Pseudomonas putida KT2440
gucgacucgaugc

SEQ ID NO: 3584505 - RNA, 13 nt, Pseudomonas putida KT2440
gucgagcaaggca

SEQ ID NO: 3584506 - RNA, 17 nt, Pseudomonas putida KT2440
gucgagccggguccacc

SEQ ID NO: 3584507 - RNA, 16 nt, Pseudomonas putida KT2440
gucgagcugcccacca

SEQ ID NO: 3584508 - RNA, 14 nt, Pseudomonas putida KT2440
gucgaggaugucgu

SEQ ID NO: 3584509 - RNA, 17 nt, Pseudomonas putida KT2440
gucgagguugcgcucca

SEQ ID NO: 3584510 - RNA, 21 nt, Pseudomonas putida KT2440
gucgauaaaccgugcaaacaa

SEQ ID NO: 3584511 - RNA, 16 nt, Pseudomonas putida KT2440
gucgauacccaggcgc

SEQ ID NO: 3584512 - RNA, 19 nt, Pseudomonas putida KT2440
gucgauagccagcccggua

SEQ ID NO: 3584513 - RNA, 20 nt, Pseudomonas putida KT2440
gucgaucacaugcggcaccg

SEQ ID NO: 3584514 - RNA, 15 nt, Pseudomonas putida KT2440
gucgaucacgggcaa

SEQ ID NO: 3584515 - RNA, 14 nt, Pseudomonas putida KT2440
gucgaucagcgaca

SEQ ID NO: 3584516 - RNA, 14 nt, Pseudomonas putida KT2440
gucgaucagcggcu

SEQ ID NO: 3584517 - RNA, 17 nt, Pseudomonas putida KT2440
gucgaucauuuccgggu

SEQ ID NO: 3584518 - RNA, 14 nt, Pseudomonas putida KT2440
gucgaucccgaggu

SEQ ID NO: 3584519 - RNA, 17 nt, Pseudomonas putida KT2440
gucgaucuggaugaagu

SEQ ID NO: 3584520 - RNA, 23 nt, Pseudomonas putida KT2440
gucgaucuucagcgcaucgaccg

SEQ ID NO: 3584521 - RNA, 14 nt, Pseudomonas putida KT2440
gucgaugaucgccg

SEQ ID NO: 3584522 - RNA, 15 nt, Pseudomonas putida KT2440
gucgaugaucgccgc

SEQ ID NO: 3584523 - RNA, 17 nt, Pseudomonas putida KT2440
gucgauguccagcgagg

SEQ ID NO: 3584524 - RNA, 17 nt, Pseudomonas putida KT2440
gucgauguccaggccga

SEQ ID NO: 3584525 - RNA, 16 nt, Pseudomonas putida KT2440
gucgaugucgauccac

SEQ ID NO: 3584526 - RNA, 20 nt, Pseudomonas putida KT2440
gucgaugucguggucgccgu

SEQ ID NO: 3584527 - RNA, 14 nt, Pseudomonas putida KT2440
gucgcacaggucca

SEQ ID NO: 3584528 - RNA, 23 nt, Pseudomonas putida KT2440
gucgcacagguccagccgccauu

SEQ ID NO: 3584529 - RNA, 15 nt, Pseudomonas putida KT2440
gucgcacaugaagcc

SEQ ID NO: 3584530 - RNA, 16 nt, Pseudomonas putida KT2440
gucgcacaugaagccg

SEQ ID NO: 3584531 - RNA, 14 nt, Pseudomonas putida KT2440
gucguucuccugcg

SEQ ID NO: 3584532 - RNA, 17 nt, Pseudomonas putida KT2440
gucguuguccagguggu

SEQ ID NO: 3584533 - RNA, 16 nt, Pseudomonas putida KT2440
gucuaaaagcuggcgc

SEQ ID NO: 3584534 - RNA, 17 nt, Pseudomonas putida KT2440
gucuacaaaacuuccag

SEQ ID NO: 3584535 - RNA, 18 nt, Pseudomonas putida KT2440
gucuagagaucugcaggg

SEQ ID NO: 3584536 - RNA, 20 nt, Pseudomonas putida KT2440
gucuccaacgucaaccgugc

SEQ ID NO: 3584537 - RNA, 16 nt, Pseudomonas putida KT2440
gucuccagcagugccg

SEQ ID NO: 3584538 - RNA, 18 nt, Pseudomonas putida KT2440
gucucccagcgcuguccc

SEQ ID NO: 3584539 - RNA, 23 nt, Pseudomonas putida KT2440
gucucccagcgcugucccccagc

SEQ ID NO: 3584540 - RNA, 13 nt, Pseudomonas putida KT2440
gucuccgcgcuug

SEQ ID NO: 3584541 - RNA, 14 nt, Pseudomonas putida KT2440
gucuccgcgcuugc

SEQ ID NO: 3584542 - RNA, 17 nt, Pseudomonas putida KT2440
gucuccgugcucaggcg

SEQ ID NO: 3584543 - RNA, 19 nt, Pseudomonas putida KT2440
gucuccgugcucaggcggc

SEQ ID NO: 3584544 - RNA, 18 nt, Pseudomonas putida KT2440
gucucgaacgcugugccg

SEQ ID NO: 3584545 - RNA, 15 nt, Pseudomonas putida KT2440
gucucgaacggcgcc

SEQ ID NO: 3584546 - RNA, 17 nt, Pseudomonas putida KT2440
gucucgccaaacugcug

SEQ ID NO: 3584547 - RNA, 12 nt, Pseudomonas putida KT2440
gucucgcgccuu

SEQ ID NO: 3584548 - RNA, 18 nt, Pseudomonas putida KT2440
gucucugaacacaugcca

SEQ ID NO: 3584549 - RNA, 18 nt, Pseudomonas putida KT2440
gucucugaccggcacugc

SEQ ID NO: 3584550 - RNA, 22 nt, Pseudomonas putida KT2440
gucucugaccggcacugcacag

SEQ ID NO: 3584551 - RNA, 23 nt, Pseudomonas putida KT2440
gucucugaccggcacugcacagc

SEQ ID NO: 3584552 - RNA, 20 nt, Pseudomonas putida KT2440
gucucuuccugcaccugguu

SEQ ID NO: 3584553 - RNA, 21 nt, Pseudomonas putida KT2440
gucucuuccugcaccugguug

SEQ ID NO: 3584554 - RNA, 13 nt, Pseudomonas putida KT2440
gucugacagcagg

SEQ ID NO: 3584555 - RNA, 16 nt, Pseudomonas putida KT2440
gucugacagcaggaac

SEQ ID NO: 3584556 - RNA, 17 nt, Pseudomonas putida KT2440
gucugacagcaggaaca

SEQ ID NO: 3584557 - RNA, 15 nt, Pseudomonas putida KT2440
gucugcaacugccca

SEQ ID NO: 3584558 - RNA, 19 nt, Pseudomonas putida KT2440
gucugccaguucaugcagc

SEQ ID NO: 3584559 - RNA, 16 nt, Pseudomonas putida KT2440
gucugccgcagccccg

SEQ ID NO: 3584560 - RNA, 19 nt, Pseudomonas putida KT2440
gucugccgguaccacugcu

SEQ ID NO: 3584561 - RNA, 21 nt, Pseudomonas putida KT2440
gucugcgcgguaaugaccugg

SEQ ID NO: 3584562 - RNA, 14 nt, Pseudomonas putida KT2440
gucugcguaaggua

SEQ ID NO: 3584563 - RNA, 18 nt, Pseudomonas putida KT2440
gucugcugcgucagcauc

SEQ ID NO: 3584564 - RNA, 19 nt, Pseudomonas putida KT2440
gucugcuuugcagcccuuc

SEQ ID NO: 3584565 - RNA, 17 nt, Pseudomonas putida KT2440
gucuggaucugaggcga

SEQ ID NO: 3584566 - RNA, 14 nt, Pseudomonas putida KT2440
gucuggcaucaaug

SEQ ID NO: 3584567 - RNA, 22 nt, Pseudomonas putida KT2440
gucuggcgcaggaagucuuccu

SEQ ID NO: 3584568 - RNA, 21 nt, Pseudomonas putida KT2440
gucuggugccugucgucagcu

SEQ ID NO: 3584569 - RNA, 16 nt, Pseudomonas putida KT2440
gucugguguugaccuc

SEQ ID NO: 3584570 - RNA, 14 nt, Pseudomonas putida KT2440
gucuguacaaaaga

SEQ ID NO: 3584571 - RNA, 12 nt, Pseudomonas putida KT2440
gucuucaaggcc

SEQ ID NO: 3584572 - RNA, 20 nt, Pseudomonas putida KT2440
gucuucaaucgucaugaucg

SEQ ID NO: 3584573 - RNA, 19 nt, Pseudomonas putida KT2440
gucuuccaccaccuccauc

SEQ ID NO: 3584574 - RNA, 17 nt, Pseudomonas putida KT2440
gucuuccagaccagaca

SEQ ID NO: 3584575 - RNA, 14 nt, Pseudomonas putida KT2440
gucuuccagggcaa

SEQ ID NO: 3584576 - RNA, 16 nt, Pseudomonas putida KT2440
gucuuccccuuggcga

SEQ ID NO: 3584577 - RNA, 18 nt, Pseudomonas putida KT2440
gucuuccggcagggugaa

SEQ ID NO: 3584578 - RNA, 14 nt, Pseudomonas putida KT2440
gucuuccggcaggu

SEQ ID NO: 3584579 - RNA, 14 nt, Pseudomonas putida KT2440
gucuuccggcauga

SEQ ID NO: 3584580 - RNA, 17 nt, Pseudomonas putida KT2440
gucuuccucgacccagc

SEQ ID NO: 3584581 - RNA, 19 nt, Pseudomonas putida KT2440
gucuuccugguuuucgcgg

SEQ ID NO: 3584582 - RNA, 15 nt, Pseudomonas putida KT2440
gucuucgaucucggc

SEQ ID NO: 3584583 - RNA, 19 nt, Pseudomonas putida KT2440
gucuucgaucucggccagc

SEQ ID NO: 3584584 - RNA, 22 nt, Pseudomonas putida KT2440
gucuucgcucacaaagcccuug

SEQ ID NO: 3584585 - RNA, 16 nt, Pseudomonas putida KT2440
gucuucguacaugcgc

SEQ ID NO: 3584586 - RNA, 17 nt, Pseudomonas putida KT2440
gucuucguacaugcgcg

SEQ ID NO: 3584587 - RNA, 15 nt, Pseudomonas putida KT2440
gucuucuuucgacau

SEQ ID NO: 3584588 - RNA, 15 nt, Pseudomonas putida KT2440
gucuuggccgcaaug

SEQ ID NO: 3584589 - RNA, 20 nt, Pseudomonas putida KT2440
gucuugucugacagcaggaa

SEQ ID NO: 3584590 - RNA, 16 nt, Pseudomonas putida KT2440
gucuuuuccccuuaua

SEQ ID NO: 3584591 - RNA, 14 nt, Pseudomonas putida KT2440
gucuuuucuucgcc

SEQ ID NO: 3584592 - RNA, 22 nt, Pseudomonas putida KT2440
gucuuuuuucauucaggccauc

SEQ ID NO: 3584593 - RNA, 22 nt, Pseudomonas putida KT2440
gugaaacgcagcuuugguucaa

SEQ ID NO: 3584594 - RNA, 17 nt, Pseudomonas putida KT2440
gugaaagucgaccagca

SEQ ID NO: 3584595 - RNA, 20 nt, Pseudomonas putida KT2440
gugaaaugcaaccgaugccc

SEQ ID NO: 3584596 - RNA, 22 nt, Pseudomonas putida KT2440
gugaacccgauuacaagggccu

SEQ ID NO: 3584597 - RNA, 17 nt, Pseudomonas putida KT2440
gugaacccgcuccuaca

SEQ ID NO: 3584598 - RNA, 12 nt, Pseudomonas putida KT2440
gugaaccgcgcc

SEQ ID NO: 3584599 - RNA, 22 nt, Pseudomonas putida KT2440
gugaacuuaugguugucgaaca

SEQ ID NO: 3584600 - RNA, 22 nt, Pseudomonas putida KT2440
gugaagaagaacuccuccagcu

SEQ ID NO: 3584601 - RNA, 19 nt, Pseudomonas putida KT2440
gugaagaucgccgcgcuga

SEQ ID NO: 3584602 - RNA, 12 nt, Pseudomonas putida KT2440
gugaagccaggg

SEQ ID NO: 3584603 - RNA, 19 nt, Pseudomonas putida KT2440
gugaagcccuucgaugcuc

SEQ ID NO: 3584604 - RNA, 15 nt, Pseudomonas putida KT2440
gugaagccgaccacu

SEQ ID NO: 3584605 - RNA, 19 nt, Pseudomonas putida KT2440
gugaagccgaccacuucga

SEQ ID NO: 3584606 - RNA, 22 nt, Pseudomonas putida KT2440
gugaagcgcacuuggccugcug

SEQ ID NO: 3584607 - RNA, 18 nt, Pseudomonas putida KT2440
gugaagcggccaccugcc

SEQ ID NO: 3584608 - RNA, 12 nt, Pseudomonas putida KT2440
gugaaggccagg

SEQ ID NO: 3584609 - RNA, 22 nt, Pseudomonas putida KT2440
gugaaggccaggaacagcgcag

SEQ ID NO: 3584610 - RNA, 19 nt, Pseudomonas putida KT2440
gugaagucaaccaacuccu

SEQ ID NO: 3584611 - RNA, 19 nt, Pseudomonas putida KT2440
gugaagucauucgccggca

SEQ ID NO: 3584612 - RNA, 20 nt, Pseudomonas putida KT2440
gugaagucgguggucaccag

SEQ ID NO: 3584613 - RNA, 18 nt, Pseudomonas putida KT2440
gugaaguugcggcauagc

SEQ ID NO: 3584614 - RNA, 21 nt, Pseudomonas putida KT2440
gugaauagcaggccgcauuuc

SEQ ID NO: 3584615 - RNA, 12 nt, Pseudomonas putida KT2440
gugaaucagccc

SEQ ID NO: 3584616 - RNA, 18 nt, Pseudomonas putida KT2440
gugaaucagcggcaggcu

SEQ ID NO: 3584617 - RNA, 17 nt, Pseudomonas putida KT2440
gugaauuccuugcuggu

SEQ ID NO: 3584618 - RNA, 15 nt, Pseudomonas putida KT2440
gugaccagcggcagc

SEQ ID NO: 3584619 - RNA, 21 nt, Pseudomonas putida KT2440
gugacccguguaggagcgggu

SEQ ID NO: 3584620 - RNA, 20 nt, Pseudomonas putida KT2440
gugacgaccucggccagguc

SEQ ID NO: 3584621 - RNA, 19 nt, Pseudomonas putida KT2440
gugacgaucaccagggcau

SEQ ID NO: 3584622 - RNA, 16 nt, Pseudomonas putida KT2440
gugacgcggagccggc

SEQ ID NO: 3584623 - RNA, 21 nt, Pseudomonas putida KT2440
gugacgugcgcuccuggucau

SEQ ID NO: 3584624 - RNA, 12 nt, Pseudomonas putida KT2440
gugagaccugca

SEQ ID NO: 3584625 - RNA, 16 nt, Pseudomonas putida KT2440
gugagaucgagcgccg

SEQ ID NO: 3584626 - RNA, 11 nt, Pseudomonas putida KT2440
gugagcacggc

SEQ ID NO: 3584627 - RNA, 12 nt, Pseudomonas putida KT2440
gugagcauggca

SEQ ID NO: 3584628 - RNA, 15 nt, Pseudomonas putida KT2440
gugagcgaaucccgc

SEQ ID NO: 3584629 - RNA, 14 nt, Pseudomonas putida KT2440
gugagcugcgcgcg

SEQ ID NO: 3584630 - RNA, 22 nt, Pseudomonas putida KT2440
gugagggcguuccagccaggcg

SEQ ID NO: 3584631 - RNA, 19 nt, Pseudomonas putida KT2440
gugagggggcacgcggcgc

SEQ ID NO: 3584632 - RNA, 21 nt, Pseudomonas putida KT2440
gugaggucgggaauugcagcc

SEQ ID NO: 3584633 - RNA, 18 nt, Pseudomonas putida KT2440
gugaguggcccuggagcg

SEQ ID NO: 3584634 - RNA, 17 nt, Pseudomonas putida KT2440
gugauacagcacgcgca

SEQ ID NO: 3584635 - RNA, 22 nt, Pseudomonas putida KT2440
gugauaccugugggagcgggcg

SEQ ID NO: 3584636 - RNA, 22 nt, Pseudomonas putida KT2440
guggaaauuggccagcaggccc

SEQ ID NO: 3584637 - RNA, 15 nt, Pseudomonas putida KT2440
guggaagcgcgcauc

SEQ ID NO: 3584638 - RNA, 18 nt, Pseudomonas putida KT2440
guggaagugcuucaccuu

SEQ ID NO: 3584639 - RNA, 20 nt, Pseudomonas putida KT2440
guggaagugggcuugcccgc

SEQ ID NO: 3584640 - RNA, 15 nt, Pseudomonas putida KT2440
guggaaguuccugcu

SEQ ID NO: 3584641 - RNA, 15 nt, Pseudomonas putida KT2440
guggacaccauggcc

SEQ ID NO: 3584642 - RNA, 16 nt, Pseudomonas putida KT2440
guggagauuggccagc

SEQ ID NO: 3584643 - RNA, 11 nt, Pseudomonas putida KT2440
guggagcgcga

SEQ ID NO: 3584644 - RNA, 15 nt, Pseudomonas putida KT2440
guggauauccagcga

SEQ ID NO: 3584645 - RNA, 17 nt, Pseudomonas putida KT2440
guggauauccagcgagg

SEQ ID NO: 3584646 - RNA, 14 nt, Pseudomonas putida KT2440
guggaugaucggcu

SEQ ID NO: 3584647 - RNA, 15 nt, Pseudomonas putida KT2440
guggauggucagcgc

SEQ ID NO: 3584648 - RNA, 16 nt, Pseudomonas putida KT2440
guggauggucagcgcu

SEQ ID NO: 3584649 - RNA, 18 nt, Pseudomonas putida KT2440
guggcaagggcggaggcu

SEQ ID NO: 3584650 - RNA, 19 nt, Pseudomonas putida KT2440
guggcaauggccugcaugu

SEQ ID NO: 3584651 - RNA, 13 nt, Pseudomonas putida KT2440
guggcaauuggcg

SEQ ID NO: 3584652 - RNA, 13 nt, Pseudomonas putida KT2440
guggcacaccaug

SEQ ID NO: 3584653 - RNA, 18 nt, Pseudomonas putida KT2440
guggcacaccaugggcaa

SEQ ID NO: 3584654 - RNA, 19 nt, Pseudomonas putida KT2440
guggcacaccaugggcaau

SEQ ID NO: 3584655 - RNA, 17 nt, Pseudomonas putida KT2440
guggcacccacagcgcc

SEQ ID NO: 3584656 - RNA, 20 nt, Pseudomonas putida KT2440
guggcaccgccgcccacgcc

SEQ ID NO: 3584657 - RNA, 22 nt, Pseudomonas putida KT2440
guggcaccgccgcccacgccgg

SEQ ID NO: 3584658 - RNA, 13 nt, Pseudomonas putida KT2440
guggcaccggcga

SEQ ID NO: 3584659 - RNA, 21 nt, Pseudomonas putida KT2440
guggcaccggcgaagacggca

SEQ ID NO: 3584660 - RNA, 12 nt, Pseudomonas putida KT2440
guggcagaacau

SEQ ID NO: 3584661 - RNA, 14 nt, Pseudomonas putida KT2440
guggcagaacaucg

SEQ ID NO: 3584662 - RNA, 23 nt, Pseudomonas putida KT2440
guggcaggcaguucgagcgccug

SEQ ID NO: 3584663 - RNA, 15 nt, Pseudomonas putida KT2440
guggcagguucgacc

SEQ ID NO: 3584664 - RNA, 12 nt, Pseudomonas putida KT2440
guggcauccuuu

SEQ ID NO: 3584665 - RNA, 18 nt, Pseudomonas putida KT2440
guggccacacugcucagu

SEQ ID NO: 3584666 - RNA, 13 nt, Pseudomonas putida KT2440
guggcccaugacg

SEQ ID NO: 3584667 - RNA, 13 nt, Pseudomonas putida KT2440
guggcccucagcc

SEQ ID NO: 3584668 - RNA, 18 nt, Pseudomonas putida KT2440
guggcccugaccgcggug

SEQ ID NO: 3584669 - RNA, 21 nt, Pseudomonas putida KT2440
guggcccugaccgcggugcug

SEQ ID NO: 3584670 - RNA, 13 nt, Pseudomonas putida KT2440
guggcccuggagc

SEQ ID NO: 3584671 - RNA, 15 nt, Pseudomonas putida KT2440
guggccucgaacaug

SEQ ID NO: 3584672 - RNA, 14 nt, Pseudomonas putida KT2440
guggccugagccgg

SEQ ID NO: 3584673 - RNA, 24 nt, Pseudomonas putida KT2440
guggcgaccaacacggugaugcgc

SEQ ID NO: 3584674 - RNA, 17 nt, Pseudomonas putida KT2440
guggcgauccacagcgg

SEQ ID NO: 3584675 - RNA, 14 nt, Pseudomonas putida KT2440
guggcgaucucugc

SEQ ID NO: 3584676 - RNA, 21 nt, Pseudomonas putida KT2440
guggcgcagcaccgugggcgc

SEQ ID NO: 3584677 - RNA, 21 nt, Pseudomonas putida KT2440
guggcgcagcaucaucucugc

SEQ ID NO: 3584678 - RNA, 14 nt, Pseudomonas putida KT2440
guggcgcccggcgc

SEQ ID NO: 3584679 - RNA, 18 nt, Pseudomonas putida KT2440
guggcgcccggcgcuggu

SEQ ID NO: 3584680 - RNA, 22 nt, Pseudomonas putida KT2440
guggcgccggauuucuuccaug

SEQ ID NO: 3584681 - RNA, 21 nt, Pseudomonas putida KT2440
guggcgccuugauuaccagcg

SEQ ID NO: 3584682 - RNA, 12 nt, Pseudomonas putida KT2440
guggcgcuggcg

SEQ ID NO: 3584683 - RNA, 13 nt, Pseudomonas putida KT2440
guggcguccacga

SEQ ID NO: 3584684 - RNA, 14 nt, Pseudomonas putida KT2440
guggcguggccacg

SEQ ID NO: 3584685 - RNA, 14 nt, Pseudomonas putida KT2440
guggcguggcugcg

SEQ ID NO: 3584686 - RNA, 20 nt, Pseudomonas putida KT2440
guggcguugucagcaaccgg

SEQ ID NO: 3584687 - RNA, 13 nt, Pseudomonas putida KT2440
guggcucaucagc

SEQ ID NO: 3584688 - RNA, 22 nt, Pseudomonas putida KT2440
guggcucuccucucccaccagc

SEQ ID NO: 3584689 - RNA, 19 nt, Pseudomonas putida KT2440
guggcugaugccaucgaua

SEQ ID NO: 3584690 - RNA, 19 nt, Pseudomonas putida KT2440
guggcugccagcgcgcugc

SEQ ID NO: 3584691 - RNA, 16 nt, Pseudomonas putida KT2440
guggcuguucgucggc

SEQ ID NO: 3584692 - RNA, 14 nt, Pseudomonas putida KT2440
guggcuuacagcgu

SEQ ID NO: 3584693 - RNA, 17 nt, Pseudomonas putida KT2440
guggcuucguggugcug

SEQ ID NO: 3584694 - RNA, 20 nt, Pseudomonas putida KT2440
gugggagcaggcaugcccgc

SEQ ID NO: 3584695 - RNA, 16 nt, Pseudomonas putida KT2440
gugggagcggccuugc

SEQ ID NO: 3584696 - RNA, 20 nt, Pseudomonas putida KT2440
gugggagcggccuugcgucg

SEQ ID NO: 3584697 - RNA, 20 nt, Pseudomonas putida KT2440
gugggagcggccuugugucg

SEQ ID NO: 3584698 - RNA, 21 nt, Pseudomonas putida KT2440
gugggagcgggacugcccgcc

SEQ ID NO: 3584699 - RNA, 20 nt, Pseudomonas putida KT2440
gugggagcgggcgugcccgc

SEQ ID NO: 3584700 - RNA, 16 nt, Pseudomonas putida KT2440
gugggagcgggcuugc

SEQ ID NO: 3584701 - RNA, 20 nt, Pseudomonas putida KT2440
gugggagcgggcuugcccgc

SEQ ID NO: 3584702 - RNA, 13 nt, Pseudomonas putida KT2440
gugggagcggggg

SEQ ID NO: 3584703 - RNA, 20 nt, Pseudomonas putida KT2440
gugggaguaacggcccuugc

SEQ ID NO: 3584704 - RNA, 15 nt, Pseudomonas putida KT2440
gugggcacacaccgg

SEQ ID NO: 3584705 - RNA, 18 nt, Pseudomonas putida KT2440
gugggcgaugaucgcggc

SEQ ID NO: 3584706 - RNA, 19 nt, Pseudomonas putida KT2440
gugggcgucaaacagccgc

SEQ ID NO: 3584707 - RNA, 17 nt, Pseudomonas putida KT2440
gugggcuugcccgcgaa

SEQ ID NO: 3584708 - RNA, 16 nt, Pseudomonas putida KT2440
guggggcaacugcgcg

SEQ ID NO: 3584709 - RNA, 19 nt, Pseudomonas putida KT2440
guggggcaacugcgcgauc

SEQ ID NO: 3584710 - RNA, 23 nt, Pseudomonas putida KT2440
guggggcuauagcucagcuggga

SEQ ID NO: 3584711 - RNA, 12 nt, Pseudomonas putida KT2440
guggggcugacu

SEQ ID NO: 3584712 - RNA, 15 nt, Pseudomonas putida KT2440
guggggucugcccgg

SEQ ID NO: 3584713 - RNA, 23 nt, Pseudomonas putida KT2440
gugggucaugucggcagccaggg

SEQ ID NO: 3584714 - RNA, 14 nt, Pseudomonas putida KT2440
guggguccugcgcc

SEQ ID NO: 3584715 - RNA, 16 nt, Pseudomonas putida KT2440
gugggucguuccagug

SEQ ID NO: 3584716 - RNA, 23 nt, Pseudomonas putida KT2440
gugggugccguacauagcaggau

SEQ ID NO: 3584717 - RNA, 13 nt, Pseudomonas putida KT2440
guggguguccugc

SEQ ID NO: 3584718 - RNA, 16 nt, Pseudomonas putida KT2440
gugguaaugcgcugau

SEQ ID NO: 3584719 - RNA, 18 nt, Pseudomonas putida KT2440
gugguaucgcuuacagau

SEQ ID NO: 3584720 - RNA, 14 nt, Pseudomonas putida KT2440
guggucagccaggc

SEQ ID NO: 3584721 - RNA, 15 nt, Pseudomonas putida KT2440
guggucagccaggcg

SEQ ID NO: 3584722 - RNA, 17 nt, Pseudomonas putida KT2440
guggucauccaggcugg

SEQ ID NO: 3584723 - RNA, 22 nt, Pseudomonas putida KT2440
gugguccagcguucggccagca

SEQ ID NO: 3584724 - RNA, 22 nt, Pseudomonas putida KT2440
guggucgaggcaaagaacagcg

SEQ ID NO: 3584725 - RNA, 12 nt, Pseudomonas putida KT2440
guggucgccguc

SEQ ID NO: 3584726 - RNA, 20 nt, Pseudomonas putida KT2440
guggucuucaaggccaccac

SEQ ID NO: 3584727 - RNA, 21 nt, Pseudomonas putida KT2440
guggucuucaaggccaccacg

SEQ ID NO: 3584728 - RNA, 16 nt, Pseudomonas putida KT2440
guggugaaacgggucu

SEQ ID NO: 3584729 - RNA, 13 nt, Pseudomonas putida KT2440
guggugaauggcg

SEQ ID NO: 3584730 - RNA, 21 nt, Pseudomonas putida KT2440
guggugagcccugugggagcg

SEQ ID NO: 3584731 - RNA, 23 nt, Pseudomonas putida KT2440
guggugaucacggguaagccggc

SEQ ID NO: 3584732 - RNA, 13 nt, Pseudomonas putida KT2440
guggugcugcaua

SEQ ID NO: 3584733 - RNA, 12 nt, Pseudomonas putida KT2440
guggugcuggcg

SEQ ID NO: 3584734 - RNA, 17 nt, Pseudomonas putida KT2440
guggugcugguggccac

SEQ ID NO: 3584735 - RNA, 13 nt, Pseudomonas putida KT2440
gugguggcugcuu

SEQ ID NO: 3584736 - RNA, 16 nt, Pseudomonas putida KT2440
gugguguacagcaaca

SEQ ID NO: 3584737 - RNA, 15 nt, Pseudomonas putida KT2440
gugguucaucaccag

SEQ ID NO: 3584738 - RNA, 19 nt, Pseudomonas putida KT2440
guguaccccaucugcucgg

SEQ ID NO: 3584739 - RNA, 16 nt, Pseudomonas putida KT2440
guguacgggacaaggc

SEQ ID NO: 3584740 - RNA, 19 nt, Pseudomonas putida KT2440
guguagaacggcagcaggc

SEQ ID NO: 3584741 - RNA, 22 nt, Pseudomonas putida KT2440
guguagccgcuuucggucaggg

SEQ ID NO: 3584742 - RNA, 12 nt, Pseudomonas putida KT2440
guuccaggccac

SEQ ID NO: 3584743 - RNA, 13 nt, Pseudomonas putida KT2440
guuccaucaccgg

SEQ ID NO: 3584744 - RNA, 17 nt, Pseudomonas putida KT2440
guuccaugucgugcugc

SEQ ID NO: 3584745 - RNA, 17 nt, Pseudomonas putida KT2440
guuccauuucacuggcu

SEQ ID NO: 3584746 - RNA, 18 nt, Pseudomonas putida KT2440
guuccauuucccuacagc

SEQ ID NO: 3584747 - RNA, 23 nt, Pseudomonas putida KT2440
guucccaaugucacuucuuucag

SEQ ID NO: 3584748 - RNA, 14 nt, Pseudomonas putida KT2440
guucccaggcagcc

SEQ ID NO: 3584749 - RNA, 21 nt, Pseudomonas putida KT2440
guucccccaccggccgccgcc

SEQ ID NO: 3584750 - RNA, 21 nt, Pseudomonas putida KT2440
guuccccgaccaaaugaguga

SEQ ID NO: 3584751 - RNA, 14 nt, Pseudomonas putida KT2440
guucccgauccuca

SEQ ID NO: 3584752 - RNA, 13 nt, Pseudomonas putida KT2440
guucccgccaugu

SEQ ID NO: 3584753 - RNA, 22 nt, Pseudomonas putida KT2440
guucccgccauguugcgcagca

SEQ ID NO: 3584754 - RNA, 18 nt, Pseudomonas putida KT2440
guucccucaacaagcuga

SEQ ID NO: 3584755 - RNA, 22 nt, Pseudomonas putida KT2440
guuccgaacugccccggcggcg

SEQ ID NO: 3584756 - RNA, 23 nt, Pseudomonas putida KT2440
guuccgcaaauucucgagcugau

SEQ ID NO: 3584757 - RNA, 13 nt, Pseudomonas putida KT2440
guuccgcccagcu

SEQ ID NO: 3584758 - RNA, 16 nt, Pseudomonas putida KT2440
guuccgcccagcucug

SEQ ID NO: 3584759 - RNA, 23 nt, Pseudomonas putida KT2440
guuccgccgcuuuguuugcuggc

SEQ ID NO: 3584760 - RNA, 19 nt, Pseudomonas putida KT2440
guuccggcccuuucgcggg

SEQ ID NO: 3584761 - RNA, 20 nt, Pseudomonas putida KT2440
guuccggccucuucgcgggc

SEQ ID NO: 3584762 - RNA, 14 nt, Pseudomonas putida KT2440
guuccucggccuga

SEQ ID NO: 3584763 - RNA, 11 nt, Pseudomonas putida KT2440
guuccugcagg

SEQ ID NO: 3584764 - RNA, 18 nt, Pseudomonas putida KT2440
guuccuggcgcuccucca

SEQ ID NO: 3584765 - RNA, 13 nt, Pseudomonas putida KT2440
guuccuucagcag

SEQ ID NO: 3584766 - RNA, 18 nt, Pseudomonas putida KT2440
guucgaaucgcucaugcc

SEQ ID NO: 3584767 - RNA, 17 nt, Pseudomonas putida KT2440
guucgaccaccgcaggu

SEQ ID NO: 3584768 - RNA, 13 nt, Pseudomonas putida KT2440
guucgaccacugc

SEQ ID NO: 3584769 - RNA, 17 nt, Pseudomonas putida KT2440
guucgaccacugcaggu

SEQ ID NO: 3584770 - RNA, 16 nt, Pseudomonas putida KT2440
guucgacgaucgacuu

SEQ ID NO: 3584771 - RNA, 14 nt, Pseudomonas putida KT2440
guucgacgcugcug

SEQ ID NO: 3584772 - RNA, 21 nt, Pseudomonas putida KT2440
guucgacgcugcuguccagac

SEQ ID NO: 3584773 - RNA, 17 nt, Pseudomonas putida KT2440
guucgacugccgcucau

SEQ ID NO: 3584774 - RNA, 18 nt, Pseudomonas putida KT2440
guucgagcaucggcucgc

SEQ ID NO: 3584775 - RNA, 12 nt, Pseudomonas putida KT2440
guucgaguccag

SEQ ID NO: 3584776 - RNA, 15 nt, Pseudomonas putida KT2440
guucgaguccagguc

SEQ ID NO: 3584777 - RNA, 16 nt, Pseudomonas putida KT2440
guucgcagccauaguu

SEQ ID NO: 3584778 - RNA, 12 nt, Pseudomonas putida KT2440
guucgcccugcg

SEQ ID NO: 3584779 - RNA, 16 nt, Pseudomonas putida KT2440
guucgcccugcgccug

SEQ ID NO: 3584780 - RNA, 18 nt, Pseudomonas putida KT2440
guucgcccugcgccugca

SEQ ID NO: 3584781 - RNA, 19 nt, Pseudomonas putida KT2440
guucgccgcuuacgaacgg

SEQ ID NO: 3584782 - RNA, 15 nt, Pseudomonas putida KT2440
guucgccucgucggc

SEQ ID NO: 3584783 - RNA, 18 nt, Pseudomonas putida KT2440
guucgcgagaaccggggc

SEQ ID NO: 3584784 - RNA, 20 nt, Pseudomonas putida KT2440
guucgcgaggaaacccgcgc

SEQ ID NO: 3584785 - RNA, 22 nt, Pseudomonas putida KT2440
guucgcgcaagcaggugcgcag

SEQ ID NO: 3584786 - RNA, 21 nt, Pseudomonas putida KT2440
guucgcgcaggauccacgccu

SEQ ID NO: 3584787 - RNA, 19 nt, Pseudomonas putida KT2440
guucgcgggugaaccgcgc

SEQ ID NO: 3584788 - RNA, 23 nt, Pseudomonas putida KT2440
guucgcggucgccgugcaacgcc

SEQ ID NO: 3584789 - RNA, 15 nt, Pseudomonas putida KT2440
guucgcgugccaccu

SEQ ID NO: 3584790 - RNA, 16 nt, Pseudomonas putida KT2440
guucgcugaugcgccg

SEQ ID NO: 3584791 - RNA, 14 nt, Pseudomonas putida KT2440
guucgcugcgcaag

SEQ ID NO: 3584792 - RNA, 14 nt, Pseudomonas putida KT2440
guucggacaggcgc

SEQ ID NO: 3584793 - RNA, 15 nt, Pseudomonas putida KT2440
guucggacaggcgcu

SEQ ID NO: 3584794 - RNA, 15 nt, Pseudomonas putida KT2440
guucggcaucgacga

SEQ ID NO: 3584795 - RNA, 16 nt, Pseudomonas putida KT2440
guucggcaucggugcu

SEQ ID NO: 3584796 - RNA, 17 nt, Pseudomonas putida KT2440
guucggcaucugccggg

SEQ ID NO: 3584797 - RNA, 13 nt, Pseudomonas putida KT2440
guucggcggaacc

SEQ ID NO: 3584798 - RNA, 18 nt, Pseudomonas putida KT2440
guucggcguaacgguccu

SEQ ID NO: 3584799 - RNA, 17 nt, Pseudomonas putida KT2440
guucggcguacugcacg

SEQ ID NO: 3584800 - RNA, 13 nt, Pseudomonas putida KT2440
guucgggucaacu

SEQ ID NO: 3584801 - RNA, 16 nt, Pseudomonas putida KT2440
guucgguaaugcccgc

SEQ ID NO: 3584802 - RNA, 17 nt, Pseudomonas putida KT2440
guucggugcucaggcuc

SEQ ID NO: 3584803 - RNA, 12 nt, Pseudomonas putida KT2440
guucguccaggc

SEQ ID NO: 3584804 - RNA, 21 nt, Pseudomonas putida KT2440
guucguccucgacccacggcu

SEQ ID NO: 3584805 - RNA, 16 nt, Pseudomonas putida KT2440
guucgucgagcaucug

SEQ ID NO: 3584806 - RNA, 12 nt, Pseudomonas putida KT2440
guucgugcaccc

SEQ ID NO: 3584807 - RNA, 22 nt, Pseudomonas putida KT2440
guucuaccguuggcaucugcug

SEQ ID NO: 3584808 - RNA, 18 nt, Pseudomonas putida KT2440
guucuccagcuccuggcc

SEQ ID NO: 3584809 - RNA, 14 nt, Pseudomonas putida KT2440
guucucgccgccgc

SEQ ID NO: 3584810 - RNA, 13 nt, Pseudomonas putida KT2440
guucucuucacuc

SEQ ID NO: 3584811 - RNA, 16 nt, Pseudomonas putida KT2440
guucugaaucuggcuc

SEQ ID NO: 3584812 - RNA, 12 nt, Pseudomonas putida KT2440
guucugcccggc

SEQ ID NO: 3584813 - RNA, 15 nt, Pseudomonas putida KT2440
guucugccggggcau

SEQ ID NO: 3584814 - RNA, 16 nt, Pseudomonas putida KT2440
guucugcuugaggccc

SEQ ID NO: 3584815 - RNA, 23 nt, Pseudomonas putida KT2440
guucuggccuuggcgugcacgcu

SEQ ID NO: 3584816 - RNA, 22 nt, Pseudomonas putida KT2440
guucuggcugccuucgcucagg

SEQ ID NO: 3584817 - RNA, 22 nt, Pseudomonas putida KT2440
guucuggucacccagcgcuuga

SEQ ID NO: 3584818 - RNA, 16 nt, Pseudomonas putida KT2440
guucuguuucaccagc

SEQ ID NO: 3584819 - RNA, 17 nt, Pseudomonas putida KT2440
guucuuaucuggggugg

SEQ ID NO: 3584820 - RNA, 21 nt, Pseudomonas putida KT2440
guucuuccaaguuggcucugu

SEQ ID NO: 3584821 - RNA, 23 nt, Pseudomonas putida KT2440
guucuuccauuugcgcuggcugc

SEQ ID NO: 3584822 - RNA, 19 nt, Pseudomonas putida KT2440
guucuucuuuaagccccug

SEQ ID NO: 3584823 - RNA, 15 nt, Pseudomonas putida KT2440
guucuugccuguccc

SEQ ID NO: 3584824 - RNA, 18 nt, Pseudomonas putida KT2440
guucuugccuguccccuu

SEQ ID NO: 3584825 - RNA, 19 nt, Pseudomonas putida KT2440
guucuuucucccaggccga

SEQ ID NO: 3584826 - RNA, 16 nt, Pseudomonas putida KT2440
guugaaaaccucccag

SEQ ID NO: 3584827 - RNA, 12 nt, Pseudomonas putida KT2440
guugaagaacag

SEQ ID NO: 3584828 - RNA, 22 nt, Pseudomonas putida KT2440
guugaagcgccgguauucgcga

SEQ ID NO: 3584829 - RNA, 12 nt, Pseudomonas putida KT2440
guugaaugccgc

SEQ ID NO: 3584830 - RNA, 13 nt, Pseudomonas putida KT2440
guugaaugccgcc

SEQ ID NO: 3584831 - RNA, 20 nt, Pseudomonas putida KT2440
guugaauguugacgaacagc

SEQ ID NO: 3584832 - RNA, 22 nt, Pseudomonas putida KT2440
guugaccacgaugcccauggcg

SEQ ID NO: 3584833 - RNA, 15 nt, Pseudomonas putida KT2440
guugaccagcaccag

SEQ ID NO: 3584834 - RNA, 20 nt, Pseudomonas putida KT2440
guugaccagggcgucgaaca

SEQ ID NO: 3584835 - RNA, 17 nt, Pseudomonas putida KT2440
guugaccgccgccacca

SEQ ID NO: 3584836 - RNA, 23 nt, Pseudomonas putida KT2440
guugaccgugaucaucagcgccg

SEQ ID NO: 3584837 - RNA, 15 nt, Pseudomonas putida KT2440
guugaccugcugggu

SEQ ID NO: 3584838 - RNA, 23 nt, Pseudomonas putida KT2440
guugacggugugcggaucgccgc

SEQ ID NO: 3584839 - RNA, 15 nt, Pseudomonas putida KT2440
guugagcaccggcag

SEQ ID NO: 3584840 - RNA, 14 nt, Pseudomonas putida KT2440
guugagcagcagcc

SEQ ID NO: 3584841 - RNA, 21 nt, Pseudomonas putida KT2440
guugagccagggcgcugucgg

SEQ ID NO: 3584842 - RNA, 12 nt, Pseudomonas putida KT2440
guugagcgccgc

SEQ ID NO: 3584843 - RNA, 15 nt, Pseudomonas putida KT2440
guugaggccgaacac

SEQ ID NO: 3584844 - RNA, 23 nt, Pseudomonas putida KT2440
guugagggugacccagcgcuggu

SEQ ID NO: 3584845 - RNA, 15 nt, Pseudomonas putida KT2440
guugaggguggcaau

SEQ ID NO: 3584846 - RNA, 18 nt, Pseudomonas putida KT2440
guugagugucagaaaaaa

SEQ ID NO: 3584847 - RNA, 14 nt, Pseudomonas putida KT2440
guugaucagcgaca

SEQ ID NO: 3584848 - RNA, 20 nt, Pseudomonas putida KT2440
guuuacccgcgaagaggccc

SEQ ID NO: 3584849 - RNA, 22 nt, Pseudomonas putida KT2440
guuuacccgcgaagaggccggc

SEQ ID NO: 3584850 - RNA, 22 nt, Pseudomonas putida KT2440
guuuacccgcgaagaggccggu

SEQ ID NO: 3584851 - RNA, 20 nt, Pseudomonas putida KT2440
guuuacccgcgaaggggccg

SEQ ID NO: 3584852 - RNA, 14 nt, Pseudomonas putida KT2440
guuuacccucggga

SEQ ID NO: 3584853 - RNA, 15 nt, Pseudomonas putida KT2440
guuuaccugcagcuc

SEQ ID NO: 3584854 - RNA, 18 nt, Pseudomonas putida KT2440
guuucacagcacaaggcu

SEQ ID NO: 3584855 - RNA, 20 nt, Pseudomonas putida KT2440
guuucacccuugggcucagc

SEQ ID NO: 3584856 - RNA, 21 nt, Pseudomonas putida KT2440
guuucaccugaccaucagccu

SEQ ID NO: 3584857 - RNA, 18 nt, Pseudomonas putida KT2440
guuucagauacugcaccc

SEQ ID NO: 3584858 - RNA, 21 nt, Pseudomonas putida KT2440
guuuccagcaaccgccccugc

SEQ ID NO: 3584859 - RNA, 17 nt, Pseudomonas putida KT2440
guuuccagcccuuccac

SEQ ID NO: 3584860 - RNA, 12 nt, Pseudomonas putida KT2440
guuuccagguuc

SEQ ID NO: 3584861 - RNA, 19 nt, Pseudomonas putida KT2440
guuuccccuguucccucaa

SEQ ID NO: 3584862 - RNA, 22 nt, Pseudomonas putida KT2440
guuuccuguguaggagcggguu

SEQ ID NO: 3584863 - RNA, 19 nt, Pseudomonas putida KT2440
guuucgaugauauccaugu

SEQ ID NO: 3584864 - RNA, 18 nt, Pseudomonas putida KT2440
guuucgcccccggcggcg

SEQ ID NO: 3584865 - RNA, 19 nt, Pseudomonas putida KT2440
guuucggguaggucaccau

SEQ ID NO: 3584866 - RNA, 13 nt, Pseudomonas putida KT2440
guuucucgcagca

SEQ ID NO: 3584867 - RNA, 16 nt, Pseudomonas putida KT2440
guuucucgcagcagca

SEQ ID NO: 3584868 - RNA, 14 nt, Pseudomonas putida KT2440
guuucuuaguauuu

SEQ ID NO: 3584869 - RNA, 15 nt, Pseudomonas putida KT2440
guuucuugccuucca

SEQ ID NO: 3584870 - RNA, 19 nt, Pseudomonas putida KT2440
guuugaagccauaucccgc

SEQ ID NO: 3584871 - RNA, 14 nt, Pseudomonas putida KT2440
guuugaagcuaaac

SEQ ID NO: 3584872 - RNA, 14 nt, Pseudomonas putida KT2440
guuugacgcugcuc

SEQ ID NO: 3584873 - RNA, 20 nt, Pseudomonas putida KT2440
guuugagccggcgcugggcu

SEQ ID NO: 3584874 - RNA, 14 nt, Pseudomonas putida KT2440
guuugcaagcggcg

SEQ ID NO: 3584875 - RNA, 20 nt, Pseudomonas putida KT2440
guuugcaaggcugcuucaau

SEQ ID NO: 3584876 - RNA, 14 nt, Pseudomonas putida KT2440
guuugcagcucacc

SEQ ID NO: 3584877 - RNA, 18 nt, Pseudomonas putida KT2440
guuugcgagcgcgggcag

SEQ ID NO: 3584878 - RNA, 14 nt, Pseudomonas putida KT2440
guuuggcagugcca

SEQ ID NO: 3584879 - RNA, 15 nt, Pseudomonas putida KT2440
guuuggcagugccau

SEQ ID NO: 3584880 - RNA, 16 nt, Pseudomonas putida KT2440
guuuggccugacgcuu

SEQ ID NO: 3584881 - RNA, 17 nt, Pseudomonas putida KT2440
guuuggccuguccaggc

SEQ ID NO: 3584882 - RNA, 16 nt, Pseudomonas putida KT2440
guuuggcuuugccggc

SEQ ID NO: 3584883 - RNA, 15 nt, Pseudomonas putida KT2440
guuugguuuuuucac

SEQ ID NO: 3584884 - RNA, 15 nt, Pseudomonas putida KT2440
guuugucgcccgccu

SEQ ID NO: 3584885 - RNA, 12 nt, Pseudomonas putida KT2440
guuuucaaggcg

SEQ ID NO: 3584886 - RNA, 21 nt, Pseudomonas putida KT2440
guuuucaaugcugcucgcccg

SEQ ID NO: 3584887 - RNA, 20 nt, Pseudomonas putida KT2440
guuuucauaccgagaaugaa

SEQ ID NO: 3584888 - RNA, 22 nt, Pseudomonas putida KT2440
guuuucauaccgagaaugaaac

SEQ ID NO: 3584889 - RNA, 16 nt, Pseudomonas putida KT2440
guuuucaucugcccgc

SEQ ID NO: 3584890 - RNA, 15 nt, Pseudomonas putida KT2440
guuuuccaccggcac

SEQ ID NO: 3584891 - RNA, 18 nt, Pseudomonas putida KT2440
guuuuccuaaagcauuuc

SEQ ID NO: 3584892 - RNA, 12 nt, Pseudomonas putida KT2440
guuuucgcugau

SEQ ID NO: 3584893 - RNA, 19 nt, Pseudomonas putida KT2440
guuuucuguugccuuacau

SEQ ID NO: 3584894 - RNA, 13 nt, Pseudomonas putida KT2440
guuuugagagggu

SEQ ID NO: 3584895 - RNA, 11 nt, Pseudomonas putida KT2440
guuuugcagcg

SEQ ID NO: 3584896 - RNA, 15 nt, Pseudomonas putida KT2440
guuuuucacacgcca

SEQ ID NO: 3584897 - RNA, 14 nt, Pseudomonas putida KT2440
guuuuuugggagcg

SEQ ID NO: 3584898 - RNA, 22 nt, Pseudomonas putida KT2440
uaaaaacgccaucggccucucu

SEQ ID NO: 3584899 - RNA, 19 nt, Pseudomonas putida KT2440
uaaaaacuggccagcagcc

SEQ ID NO: 3584900 - RNA, 22 nt, Pseudomonas putida KT2440
uaaaaauauugcgaaaaucgua

SEQ ID NO: 3584901 - RNA, 13 nt, Pseudomonas putida KT2440
uaaaacagccuug

SEQ ID NO: 3584902 - RNA, 23 nt, Pseudomonas putida KT2440
uaaaagauguguugucugugccc

SEQ ID NO: 3584903 - RNA, 15 nt, Pseudomonas putida KT2440
uaaaagccaacugcu

SEQ ID NO: 3584904 - RNA, 13 nt, Pseudomonas putida KT2440
uaaaccagcagcg

SEQ ID NO: 3584905 - RNA, 16 nt, Pseudomonas putida KT2440
uaaacccauuccuaca

SEQ ID NO: 3584906 - RNA, 22 nt, Pseudomonas putida KT2440
uaaacccgcuccuacaagguac

SEQ ID NO: 3584907 - RNA, 19 nt, Pseudomonas putida KT2440
uaaacccgcuccuacaugg

SEQ ID NO: 3584908 - RNA, 14 nt, Pseudomonas putida KT2440
uaaaccugccaccc

SEQ ID NO: 3584909 - RNA, 18 nt, Pseudomonas putida KT2440
uaaaccugccugauugcc

SEQ ID NO: 3584910 - RNA, 11 nt, Pseudomonas putida KT2440
uaaaccuucaa

SEQ ID NO: 3584911 - RNA, 13 nt, Pseudomonas putida KT2440
uaaaccuucaaca

SEQ ID NO: 3584912 - RNA, 22 nt, Pseudomonas putida KT2440
uaaacugugggagcaggcaugc

SEQ ID NO: 3584913 - RNA, 19 nt, Pseudomonas putida KT2440
uaaagaaaagccgcuggcc

SEQ ID NO: 3584914 - RNA, 22 nt, Pseudomonas putida KT2440
uaaagaaaagccgcuggcccua

SEQ ID NO: 3584915 - RNA, 16 nt, Pseudomonas putida KT2440
uaaagauuaggcucca

SEQ ID NO: 3584916 - RNA, 19 nt, Pseudomonas putida KT2440
uaaagccagcagccugugc

SEQ ID NO: 3584917 - RNA, 20 nt, Pseudomonas putida KT2440
uaaagccgcaccuacaggga

SEQ ID NO: 3584918 - RNA, 18 nt, Pseudomonas putida KT2440
uaaagcgucgcccgcgaa

SEQ ID NO: 3584919 - RNA, 16 nt, Pseudomonas putida KT2440
uaaauccaaucuccaa

SEQ ID NO: 3584920 - RNA, 13 nt, Pseudomonas putida KT2440
uaacaagaacaac

SEQ ID NO: 3584921 - RNA, 22 nt, Pseudomonas putida KT2440
uaacacagguaguucacuggcc

SEQ ID NO: 3584922 - RNA, 18 nt, Pseudomonas putida KT2440
uaacaccccccagcagcg

SEQ ID NO: 3584923 - RNA, 17 nt, Pseudomonas putida KT2440
uaacacuugccgcccuc

SEQ ID NO: 3584924 - RNA, 12 nt, Pseudomonas putida KT2440
uaacaugcuggc

SEQ ID NO: 3584925 - RNA, 13 nt, Pseudomonas putida KT2440
uaacaugcuggcc

SEQ ID NO: 3584926 - RNA, 19 nt, Pseudomonas putida KT2440
uaaccagucgauaaaccgu

SEQ ID NO: 3584927 - RNA, 12 nt, Pseudomonas putida KT2440
uaaccauguuga

SEQ ID NO: 3584928 - RNA, 19 nt, Pseudomonas putida KT2440
uaaccccccacccagcuca

SEQ ID NO: 3584929 - RNA, 15 nt, Pseudomonas putida KT2440
uaaccgcccgccaua

SEQ ID NO: 3584930 - RNA, 17 nt, Pseudomonas putida KT2440
uaaccggcccugaaggc

SEQ ID NO: 3584931 - RNA, 20 nt, Pseudomonas putida KT2440
uaaccggcccugaaggccgc

SEQ ID NO: 3584932 - RNA, 13 nt, Pseudomonas putida KT2440
uaaccucugcaug

SEQ ID NO: 3584933 - RNA, 14 nt, Pseudomonas putida KT2440
uaaccucugcaugc

SEQ ID NO: 3584934 - RNA, 21 nt, Pseudomonas putida KT2440
uaacgacccaaaaauggucgg

SEQ ID NO: 3584935 - RNA, 18 nt, Pseudomonas putida KT2440
uaacgagccuuggccagc

SEQ ID NO: 3584936 - RNA, 20 nt, Pseudomonas putida KT2440
uaacgagccuuggccagcgu

SEQ ID NO: 3584937 - RNA, 22 nt, Pseudomonas putida KT2440
uaacgcccuucauacagcgccu

SEQ ID NO: 3584938 - RNA, 15 nt, Pseudomonas putida KT2440
uaacgcgggcaaugu

SEQ ID NO: 3584939 - RNA, 18 nt, Pseudomonas putida KT2440
uaacggcuggcgcaugca

SEQ ID NO: 3584940 - RNA, 15 nt, Pseudomonas putida KT2440
uaacguuggccgggg

SEQ ID NO: 3584941 - RNA, 15 nt, Pseudomonas putida KT2440
uaagaagcaaccgcu

SEQ ID NO: 3584942 - RNA, 18 nt, Pseudomonas putida KT2440
uaagaagccgacccacuu

SEQ ID NO: 3584943 - RNA, 15 nt, Pseudomonas putida KT2440
uaagauacgcgcaga

SEQ ID NO: 3584944 - RNA, 14 nt, Pseudomonas putida KT2440
uaagccagcccugc

SEQ ID NO: 3584945 - RNA, 22 nt, Pseudomonas putida KT2440
uaagccgcaggccaaugcagcu

SEQ ID NO: 3584946 - RNA, 22 nt, Pseudomonas putida KT2440
uaagccgccguggcacgcucgc

SEQ ID NO: 3584947 - RNA, 21 nt, Pseudomonas putida KT2440
uaagccucgagcgcuuucagc

SEQ ID NO: 3584948 - RNA, 20 nt, Pseudomonas putida KT2440
uaagcgacacccuggucaug

SEQ ID NO: 3584949 - RNA, 23 nt, Pseudomonas putida KT2440
uaagcgccagcaacgcagccagg

SEQ ID NO: 3584950 - RNA, 15 nt, Pseudomonas putida KT2440
uaagcggucucggug

SEQ ID NO: 3584951 - RNA, 16 nt, Pseudomonas putida KT2440
uaagcugucagcaccu

SEQ ID NO: 3584952 - RNA, 21 nt, Pseudomonas putida KT2440
uaagcuucagcgaccgacacg

SEQ ID NO: 3584953 - RNA, 24 nt, Pseudomonas putida KT2440
uaaggaucaugaacgaggacugca

SEQ ID NO: 3584954 - RNA, 20 nt, Pseudomonas putida KT2440
uacccgguaaaaccgcucga

SEQ ID NO: 3584955 - RNA, 13 nt, Pseudomonas putida KT2440
uacccggucaggg

SEQ ID NO: 3584956 - RNA, 20 nt, Pseudomonas putida KT2440
uacccggucagggugaaguc

SEQ ID NO: 3584957 - RNA, 19 nt, Pseudomonas putida KT2440
uacccugcgggagcgggcg

SEQ ID NO: 3584958 - RNA, 12 nt, Pseudomonas putida KT2440
uacccuuccugg

SEQ ID NO: 3584959 - RNA, 18 nt, Pseudomonas putida KT2440
uacccuuugccauccacc

SEQ ID NO: 3584960 - RNA, 21 nt, Pseudomonas putida KT2440
uaccgauugccucaggcccca

SEQ ID NO: 3584961 - RNA, 20 nt, Pseudomonas putida KT2440
uaccgcaacaccugccgcag

SEQ ID NO: 3584962 - RNA, 14 nt, Pseudomonas putida KT2440
uaccgcaucccaau

SEQ ID NO: 3584963 - RNA, 17 nt, Pseudomonas putida KT2440
uaccgcaucccaaugug

SEQ ID NO: 3584964 - RNA, 23 nt, Pseudomonas putida KT2440
uaccgcaucccaauguggauagu

SEQ ID NO: 3584965 - RNA, 20 nt, Pseudomonas putida KT2440
uaccgcauucuuggccagga

SEQ ID NO: 3584966 - RNA, 21 nt, Pseudomonas putida KT2440
uaccgcauucuuggccaggau

SEQ ID NO: 3584967 - RNA, 15 nt, Pseudomonas putida KT2440
uaccgccguccacca

SEQ ID NO: 3584968 - RNA, 17 nt, Pseudomonas putida KT2440
uaccgccguccaccauc

SEQ ID NO: 3584969 - RNA, 21 nt, Pseudomonas putida KT2440
uaccgcgccuccagcuggcca

SEQ ID NO: 3584970 - RNA, 15 nt, Pseudomonas putida KT2440
uaccggacugcgcua

SEQ ID NO: 3584971 - RNA, 22 nt, Pseudomonas putida KT2440
uaccggauagcgccgaucagcu

SEQ ID NO: 3584972 - RNA, 18 nt, Pseudomonas putida KT2440
uaccggauugggaaaccg

SEQ ID NO: 3584973 - RNA, 18 nt, Pseudomonas putida KT2440
uaccggcauaccaucuuc

SEQ ID NO: 3584974 - RNA, 15 nt, Pseudomonas putida KT2440
uaccggccgcucacc

SEQ ID NO: 3584975 - RNA, 20 nt, Pseudomonas putida KT2440
uaccggccucuucgcgggca

SEQ ID NO: 3584976 - RNA, 22 nt, Pseudomonas putida KT2440
uaccggcucccccuccacccgg

SEQ ID NO: 3584977 - RNA, 16 nt, Pseudomonas putida KT2440
uaccgggcggccaccg

SEQ ID NO: 3584978 - RNA, 17 nt, Pseudomonas putida KT2440
uaccgggcggccaccgg

SEQ ID NO: 3584979 - RNA, 20 nt, Pseudomonas putida KT2440
uaccggugccccgguccagc

SEQ ID NO: 3584980 - RNA, 15 nt, Pseudomonas putida KT2440
uaccguauucgcggg

SEQ ID NO: 3584981 - RNA, 14 nt, Pseudomonas putida KT2440
uaccgugcugcagg

SEQ ID NO: 3584982 - RNA, 19 nt, Pseudomonas putida KT2440
uaccuccagcccggcuuca

SEQ ID NO: 3584983 - RNA, 16 nt, Pseudomonas putida KT2440
uaccucccgcacauuu

SEQ ID NO: 3584984 - RNA, 11 nt, Pseudomonas putida KT2440
uaccugagcuu

SEQ ID NO: 3584985 - RNA, 16 nt, Pseudomonas putida KT2440
uaccugcacacugccc

SEQ ID NO: 3584986 - RNA, 18 nt, Pseudomonas putida KT2440
uaccuggaauaccaccuc

SEQ ID NO: 3584987 - RNA, 19 nt, Pseudomonas putida KT2440
uaccuggccgcguucgccc

SEQ ID NO: 3584988 - RNA, 18 nt, Pseudomonas putida KT2440
uaccugugggagcgggcg

SEQ ID NO: 3584989 - RNA, 19 nt, Pseudomonas putida KT2440
uaccugugggagcgggcgu

SEQ ID NO: 3584990 - RNA, 23 nt, Pseudomonas putida KT2440
uaccugugggagcgggcgugccu

SEQ ID NO: 3584991 - RNA, 19 nt, Pseudomonas putida KT2440
uaccuguggggcaacugcg

SEQ ID NO: 3584992 - RNA, 21 nt, Pseudomonas putida KT2440
uaccuucuggcuggagccguc

SEQ ID NO: 3584993 - RNA, 19 nt, Pseudomonas putida KT2440
uaccuuggcguaggccugc

SEQ ID NO: 3584994 - RNA, 18 nt, Pseudomonas putida KT2440
uacgaaaaggccugcacu

SEQ ID NO: 3584995 - RNA, 22 nt, Pseudomonas putida KT2440
uacgaacaaauccgcgccgauc

SEQ ID NO: 3584996 - RNA, 12 nt, Pseudomonas putida KT2440
uacgaagccaug

SEQ ID NO: 3584997 - RNA, 21 nt, Pseudomonas putida KT2440
uacgaagcucuggucgaucuu

SEQ ID NO: 3584998 - RNA, 19 nt, Pseudomonas putida KT2440
uacgacccugaagcccugg

SEQ ID NO: 3584999 - RNA, 18 nt, Pseudomonas putida KT2440
uacgacgggcugagccca

SEQ ID NO: 3585000 - RNA, 21 nt, Pseudomonas putida KT2440
uacgagucauccucaccggca

SEQ ID NO: 3585001 - RNA, 12 nt, Pseudomonas putida KT2440
uacgcaaaccaa

SEQ ID NO: 3585002 - RNA, 17 nt, Pseudomonas putida KT2440
uacgcaaucgcucaggg

SEQ ID NO: 3585003 - RNA, 23 nt, Pseudomonas putida KT2440
uacgcaaucucgacaagcgcauu

SEQ ID NO: 3585004 - RNA, 20 nt, Pseudomonas putida KT2440
uacgcacaggcgcagcagcu

SEQ ID NO: 3585005 - RNA, 14 nt, Pseudomonas putida KT2440
uacgcacauagccc

SEQ ID NO: 3585006 - RNA, 18 nt, Pseudomonas putida KT2440
uacgcacauagcccugcu

SEQ ID NO: 3585007 - RNA, 16 nt, Pseudomonas putida KT2440
uacgcaccaacugguc

SEQ ID NO: 3585008 - RNA, 17 nt, Pseudomonas putida KT2440
uacgcaccaacuggucg

SEQ ID NO: 3585009 - RNA, 16 nt, Pseudomonas putida KT2440
uacgcaccgcuaccau

SEQ ID NO: 3585010 - RNA, 19 nt, Pseudomonas putida KT2440
uacgcaccgcuaccauggc

SEQ ID NO: 3585011 - RNA, 14 nt, Pseudomonas putida KT2440
uacgcagcacccgg

SEQ ID NO: 3585012 - RNA, 11 nt, Pseudomonas putida KT2440
uacgccaggcg

SEQ ID NO: 3585013 - RNA, 22 nt, Pseudomonas putida KT2440
uacgccaugugcgcccgaacaa

SEQ ID NO: 3585014 - RNA, 14 nt, Pseudomonas putida KT2440
uacgcccauccaac

SEQ ID NO: 3585015 - RNA, 22 nt, Pseudomonas putida KT2440
uacgcccauccaacgcauccag

SEQ ID NO: 3585016 - RNA, 23 nt, Pseudomonas putida KT2440
uacgcccauggcccugaucugcc

SEQ ID NO: 3585017 - RNA, 14 nt, Pseudomonas putida KT2440
uacgcccccagccu

SEQ ID NO: 3585018 - RNA, 14 nt, Pseudomonas putida KT2440
uacgccgccgaggc

SEQ ID NO: 3585019 - RNA, 20 nt, Pseudomonas putida KT2440
uacgccggcgcacgcaugcg

SEQ ID NO: 3585020 - RNA, 15 nt, Pseudomonas putida KT2440
uacgccgucuuccca

SEQ ID NO: 3585021 - RNA, 19 nt, Pseudomonas putida KT2440
uacgccgucuucccaucca

SEQ ID NO: 3585022 - RNA, 22 nt, Pseudomonas putida KT2440
uacgccguugucacgcgccagg

SEQ ID NO: 3585023 - RNA, 22 nt, Pseudomonas putida KT2440
uacgccugaaccaccgggaucu

SEQ ID NO: 3585024 - RNA, 21 nt, Pseudomonas putida KT2440
uacgcgcaggcagcucgaugu

SEQ ID NO: 3585025 - RNA, 20 nt, Pseudomonas putida KT2440
uacgcggcagcagcagcccc

SEQ ID NO: 3585026 - RNA, 14 nt, Pseudomonas putida KT2440
uacgcguggucgcc

SEQ ID NO: 3585027 - RNA, 21 nt, Pseudomonas putida KT2440
uacgcucgaccagaucagccg

SEQ ID NO: 3585028 - RNA, 16 nt, Pseudomonas putida KT2440
uacgcuggaucaccac

SEQ ID NO: 3585029 - RNA, 12 nt, Pseudomonas putida KT2440
uacgcuggccaa

SEQ ID NO: 3585030 - RNA, 16 nt, Pseudomonas putida KT2440
uacgcuggccaaggcc

SEQ ID NO: 3585031 - RNA, 16 nt, Pseudomonas putida KT2440
uacgcugggcgugcca

SEQ ID NO: 3585032 - RNA, 21 nt, Pseudomonas putida KT2440
uacgcugggcgugccaggcuu

SEQ ID NO: 3585033 - RNA, 17 nt, Pseudomonas putida KT2440
uacggaacugcucuucg

SEQ ID NO: 3585034 - RNA, 18 nt, Pseudomonas putida KT2440
uacggaaucugcaccgcc

SEQ ID NO: 3585035 - RNA, 18 nt, Pseudomonas putida KT2440
uacggacgggcguugauc

SEQ ID NO: 3585036 - RNA, 11 nt, Pseudomonas putida KT2440
uacggccaaug

SEQ ID NO: 3585037 - RNA, 17 nt, Pseudomonas putida KT2440
uacggccaguuguccgg

SEQ ID NO: 3585038 - RNA, 14 nt, Pseudomonas putida KT2440
uacggccaucagca

SEQ ID NO: 3585039 - RNA, 16 nt, Pseudomonas putida KT2440
uacggcccaugucgau

SEQ ID NO: 3585040 - RNA, 14 nt, Pseudomonas putida KT2440
uacggccgugcagg

SEQ ID NO: 3585041 - RNA, 14 nt, Pseudomonas putida KT2440
uacggcugauggug

SEQ ID NO: 3585042 - RNA, 12 nt, Pseudomonas putida KT2440
uacggcuugccg

SEQ ID NO: 3585043 - RNA, 16 nt, Pseudomonas putida KT2440
uacgggcaaccgcauc

SEQ ID NO: 3585044 - RNA, 18 nt, Pseudomonas putida KT2440
uacgggcgagcgcgcagg

SEQ ID NO: 3585045 - RNA, 21 nt, Pseudomonas putida KT2440
uacggggguucacagccggca

SEQ ID NO: 3585046 - RNA, 23 nt, Pseudomonas putida KT2440
uacggguguuuccaccccggcag

SEQ ID NO: 3585047 - RNA, 16 nt, Pseudomonas putida KT2440
uacgguugcagcacac

SEQ ID NO: 3585048 - RNA, 17 nt, Pseudomonas putida KT2440
uacguaagucaggccga

SEQ ID NO: 3585049 - RNA, 17 nt, Pseudomonas putida KT2440
uacuagauggcugaaau

SEQ ID NO: 3585050 - RNA, 15 nt, Pseudomonas putida KT2440
uacuagcggugcaga

SEQ ID NO: 3585051 - RNA, 15 nt, Pseudomonas putida KT2440
uacucacccgcuugc

SEQ ID NO: 3585052 - RNA, 17 nt, Pseudomonas putida KT2440
uacucacccgcuugcca

SEQ ID NO: 3585053 - RNA, 24 nt, Pseudomonas putida KT2440
uacucagcggcuggcccuguacau

SEQ ID NO: 3585054 - RNA, 13 nt, Pseudomonas putida KT2440
uacuccagcagcg

SEQ ID NO: 3585055 - RNA, 13 nt, Pseudomonas putida KT2440
uacucccacagcg

SEQ ID NO: 3585056 - RNA, 21 nt, Pseudomonas putida KT2440
uacucccacagcggccccauc

SEQ ID NO: 3585057 - RNA, 22 nt, Pseudomonas putida KT2440
uacucgcgacugaagcgcgggu

SEQ ID NO: 3585058 - RNA, 13 nt, Pseudomonas putida KT2440
uacucggccaggu

SEQ ID NO: 3585059 - RNA, 16 nt, Pseudomonas putida KT2440
aaacucccccccaauc

SEQ ID NO: 3585060 - RNA, 14 nt, Pseudomonas putida KT2440
aaacuccuugaaau

SEQ ID NO: 3585061 - RNA, 14 nt, Pseudomonas putida KT2440
aaacuccuugagau

SEQ ID NO: 3585062 - RNA, 16 nt, Pseudomonas putida KT2440
aaacucggucaggcag

SEQ ID NO: 3585063 - RNA, 13 nt, Pseudomonas putida KT2440
aaacucugcaggu

SEQ ID NO: 3585064 - RNA, 12 nt, Pseudomonas putida KT2440
aaacugcgggcu

SEQ ID NO: 3585065 - RNA, 19 nt, Pseudomonas putida KT2440
aaacuggccagcagccccc

SEQ ID NO: 3585066 - RNA, 18 nt, Pseudomonas putida KT2440
aaacugggcagcccucag

SEQ ID NO: 3585067 - RNA, 21 nt, Pseudomonas putida KT2440
aaacuguguaggaucugcgac

SEQ ID NO: 3585068 - RNA, 18 nt, Pseudomonas putida KT2440
aaagaacccaaucauaua

SEQ ID NO: 3585069 - RNA, 14 nt, Pseudomonas putida KT2440
aaagaaccugggac

SEQ ID NO: 3585070 - RNA, 22 nt, Pseudomonas putida KT2440
aaagaacggugcugccgaggcg

SEQ ID NO: 3585071 - RNA, 16 nt, Pseudomonas putida KT2440
aaagaagcgaccgguu

SEQ ID NO: 3585072 - RNA, 13 nt, Pseudomonas putida KT2440
aaagacugcuccg

SEQ ID NO: 3585073 - RNA, 17 nt, Pseudomonas putida KT2440
aaagauaccccugcgcc

SEQ ID NO: 3585074 - RNA, 15 nt, Pseudomonas putida KT2440
aaagaucgcccagcu

SEQ ID NO: 3585075 - RNA, 12 nt, Pseudomonas putida KT2440
aaagcacacaac

SEQ ID NO: 3585076 - RNA, 15 nt, Pseudomonas putida KT2440
aaagcagcccccaac

SEQ ID NO: 3585077 - RNA, 24 nt, Pseudomonas putida KT2440
aaagcaggauggugacugccagca

SEQ ID NO: 3585078 - RNA, 23 nt, Pseudomonas putida KT2440
aaagcaggucagcgcucaaaaaa

SEQ ID NO: 3585079 - RNA, 15 nt, Pseudomonas putida KT2440
aaagcaucaacucac

SEQ ID NO: 3585080 - RNA, 11 nt, Pseudomonas putida KT2440
aaagcauuucg

SEQ ID NO: 3585081 - RNA, 15 nt, Pseudomonas putida KT2440
aaagccaacugcucu

SEQ ID NO: 3585082 - RNA, 18 nt, Pseudomonas putida KT2440
aaagccaccggacagaau

SEQ ID NO: 3585083 - RNA, 16 nt, Pseudomonas putida KT2440
aaagccacugcaccaa

SEQ ID NO: 3585084 - RNA, 16 nt, Pseudomonas putida KT2440
aaagccagcagccugu

SEQ ID NO: 3585085 - RNA, 12 nt, Pseudomonas putida KT2440
aaagccagcagu

SEQ ID NO: 3585086 - RNA, 23 nt, Pseudomonas putida KT2440
aaagccagcagugcggcaaccac

SEQ ID NO: 3585087 - RNA, 22 nt, Pseudomonas putida KT2440
aaagccauaccgcaucccaaug

SEQ ID NO: 3585088 - RNA, 14 nt, Pseudomonas putida KT2440
aaagccccggcagc

SEQ ID NO: 3585089 - RNA, 16 nt, Pseudomonas putida KT2440
aaagccccggcucgca

SEQ ID NO: 3585090 - RNA, 22 nt, Pseudomonas putida KT2440
aaagcccgugccgcaucagccg

SEQ ID NO: 3585091 - RNA, 23 nt, Pseudomonas putida KT2440
aaagcccuugucgaacagcugau

SEQ ID NO: 3585092 - RNA, 20 nt, Pseudomonas putida KT2440
aaagccgcuucuggacaaga

SEQ ID NO: 3585093 - RNA, 13 nt, Pseudomonas putida KT2440
aaagccugcacca

SEQ ID NO: 3585094 - RNA, 17 nt, Pseudomonas putida KT2440
aaagccugcuccagcac

SEQ ID NO: 3585095 - RNA, 16 nt, Pseudomonas putida KT2440
aaagcgauaauugugc

SEQ ID NO: 3585096 - RNA, 24 nt, Pseudomonas putida KT2440
aaagcgcaaucaaagcagacagcu

SEQ ID NO: 3585097 - RNA, 21 nt, Pseudomonas putida KT2440
aaagcgccagacgcgcgcugg

SEQ ID NO: 3585098 - RNA, 17 nt, Pseudomonas putida KT2440
aaagcgcgccuccagcu

SEQ ID NO: 3585099 - RNA, 11 nt, Pseudomonas putida KT2440
aaagcgcucga

SEQ ID NO: 3585100 - RNA, 14 nt, Pseudomonas putida KT2440
aaagcgcucgaagu

SEQ ID NO: 3585101 - RNA, 13 nt, Pseudomonas putida KT2440
aaagcggccccca

SEQ ID NO: 3585102 - RNA, 21 nt, Pseudomonas putida KT2440
aaagcggccccuucgauucag

SEQ ID NO: 3585103 - RNA, 18 nt, Pseudomonas putida KT2440
aaagcgugaaugcauggu

SEQ ID NO: 3585104 - RNA, 23 nt, Pseudomonas putida KT2440
aaagcguucgcccuccugcagca

SEQ ID NO: 3585105 - RNA, 19 nt, Pseudomonas putida KT2440
aaagcugaaugaaaaagcc

SEQ ID NO: 3585106 - RNA, 19 nt, Pseudomonas putida KT2440
aaagcugucgcagucgaag

SEQ ID NO: 3585107 - RNA, 13 nt, Pseudomonas putida KT2440
aaaggcaugggcc

SEQ ID NO: 3585108 - RNA, 23 nt, Pseudomonas putida KT2440
aaaggccggcaccgacagcaacg

SEQ ID NO: 3585109 - RNA, 23 nt, Pseudomonas putida KT2440
aaaggcgacuccugaacggugaa

SEQ ID NO: 3585110 - RNA, 21 nt, Pseudomonas putida KT2440
aaaggcuugucaugccuuggc

SEQ ID NO: 3585111 - RNA, 18 nt, Pseudomonas putida KT2440
aaaggcuuucgauaucgg

SEQ ID NO: 3585112 - RNA, 14 nt, Pseudomonas putida KT2440
aaaggcuuuggccg

SEQ ID NO: 3585113 - RNA, 19 nt, Pseudomonas putida KT2440
aaagggcaucucuuugaga

SEQ ID NO: 3585114 - RNA, 18 nt, Pseudomonas putida KT2440
aaaggucugcugcggccg

SEQ ID NO: 3585115 - RNA, 21 nt, Pseudomonas putida KT2440
aaaggugcgaguauccuccag

SEQ ID NO: 3585116 - RNA, 14 nt, Pseudomonas putida KT2440
aaaguccggcgaag

SEQ ID NO: 3585117 - RNA, 15 nt, Pseudomonas putida KT2440
aaaguccugcaaagg

SEQ ID NO: 3585118 - RNA, 16 nt, Pseudomonas putida KT2440
aaagucgaccagcagc

SEQ ID NO: 3585119 - RNA, 13 nt, Pseudomonas putida KT2440
aaauaaagaucua

SEQ ID NO: 3585120 - RNA, 15 nt, Pseudomonas putida KT2440
aaauaccccaggcaa

SEQ ID NO: 3585121 - RNA, 19 nt, Pseudomonas putida KT2440
aaauaccccaggcaaaaaa

SEQ ID NO: 3585122 - RNA, 17 nt, Pseudomonas putida KT2440
aaauaggccuuggcuuc

SEQ ID NO: 3585123 - RNA, 18 nt, Pseudomonas putida KT2440
aaauccaggacaaaccag

SEQ ID NO: 3585124 - RNA, 22 nt, Pseudomonas putida KT2440
aaauccccauguaggagauucu

SEQ ID NO: 3585125 - RNA, 16 nt, Pseudomonas putida KT2440
aaauccgcgccgauca

SEQ ID NO: 3585126 - RNA, 15 nt, Pseudomonas putida KT2440
aaauccgcuugaugg

SEQ ID NO: 3585127 - RNA, 13 nt, Pseudomonas putida KT2440
aaaucgcugcggc

SEQ ID NO: 3585128 - RNA, 17 nt, Pseudomonas putida KT2440
aaaucggguaacaggga

SEQ ID NO: 3585129 - RNA, 17 nt, Pseudomonas putida KT2440
aaaugacuguuaaucau

SEQ ID NO: 3585130 - RNA, 22 nt, Pseudomonas putida KT2440
aaaugagggaugagaaagcccg

SEQ ID NO: 3585131 - RNA, 14 nt, Pseudomonas putida KT2440
aaaugcaccacgcg

SEQ ID NO: 3585132 - RNA, 17 nt, Pseudomonas putida KT2440
aaaugcagaugcgcgau

SEQ ID NO: 3585133 - RNA, 18 nt, Pseudomonas putida KT2440
aaaugccccgggcaggcc

SEQ ID NO: 3585134 - RNA, 17 nt, Pseudomonas putida KT2440
aaaugccucggcaaagc

SEQ ID NO: 3585135 - RNA, 20 nt, Pseudomonas putida KT2440
aaaugcgcccugcugccgca

SEQ ID NO: 3585136 - RNA, 15 nt, Pseudomonas putida KT2440
aaaugguugaagauc

SEQ ID NO: 3585137 - RNA, 17 nt, Pseudomonas putida KT2440
aaauguaggaucaagua

SEQ ID NO: 3585138 - RNA, 22 nt, Pseudomonas putida KT2440
aaauguccauugagcacucaac

SEQ ID NO: 3585139 - RNA, 19 nt, Pseudomonas putida KT2440
aaaugugcgcaucaacgaa

SEQ ID NO: 3585140 - RNA, 14 nt, Pseudomonas putida KT2440
aaauucaaugaguu

SEQ ID NO: 3585141 - RNA, 18 nt, Pseudomonas putida KT2440
aaauucaccugccgggca

SEQ ID NO: 3585142 - RNA, 16 nt, Pseudomonas putida KT2440
aaauucucgagcugau

SEQ ID NO: 3585143 - RNA, 14 nt, Pseudomonas putida KT2440
aacaacaaaaaaaa

SEQ ID NO: 3585144 - RNA, 18 nt, Pseudomonas putida KT2440
aacaacuccgggugcucc

SEQ ID NO: 3585145 - RNA, 21 nt, Pseudomonas putida KT2440
aacaagccccuccuaagggcu

SEQ ID NO: 3585146 - RNA, 16 nt, Pseudomonas putida KT2440
aacaagcgcgacuggu

SEQ ID NO: 3585147 - RNA, 14 nt, Pseudomonas putida KT2440
aacaagcuggacau

SEQ ID NO: 3585148 - RNA, 11 nt, Pseudomonas putida KT2440
aacaaggcacg

SEQ ID NO: 3585149 - RNA, 12 nt, Pseudomonas putida KT2440
aacaaggcacga

SEQ ID NO: 3585150 - RNA, 14 nt, Pseudomonas putida KT2440
aacaaggcucagcu

SEQ ID NO: 3585151 - RNA, 19 nt, Pseudomonas putida KT2440
aacaaguccacgaaccugu

SEQ ID NO: 3585152 - RNA, 21 nt, Pseudomonas putida KT2440
aacaauaggccggucccaaua

SEQ ID NO: 3585153 - RNA, 19 nt, Pseudomonas putida KT2440
aacaaucgcgucagcaccg

SEQ ID NO: 3585154 - RNA, 18 nt, Pseudomonas putida KT2440
aacaauuuucgaccaagg

SEQ ID NO: 3585155 - RNA, 12 nt, Pseudomonas putida KT2440
aacacacgcucc

SEQ ID NO: 3585156 - RNA, 17 nt, Pseudomonas putida KT2440
aacacaggcacaaaaaa

SEQ ID NO: 3585157 - RNA, 14 nt, Pseudomonas putida KT2440
aacacauccacauc

SEQ ID NO: 3585158 - RNA, 23 nt, Pseudomonas putida KT2440
aacaccaccgcgaaacacagcag

SEQ ID NO: 3585159 - RNA, 13 nt, Pseudomonas putida KT2440
aacaccagacuca

SEQ ID NO: 3585160 - RNA, 12 nt, Pseudomonas putida KT2440
aacaccagcagc

SEQ ID NO: 3585161 - RNA, 13 nt, Pseudomonas putida KT2440
aacaccaucuuca

SEQ ID NO: 3585162 - RNA, 16 nt, Pseudomonas putida KT2440
aacacccagucgccuu

SEQ ID NO: 3585163 - RNA, 14 nt, Pseudomonas putida KT2440
aacacccugcacca

SEQ ID NO: 3585164 - RNA, 20 nt, Pseudomonas putida KT2440
aacacccugcaccacggcag

SEQ ID NO: 3585165 - RNA, 21 nt, Pseudomonas putida KT2440
aacccgcuccuacauaggggc

SEQ ID NO: 3585166 - RNA, 19 nt, Pseudomonas putida KT2440
aacccgcugccacccacag

SEQ ID NO: 3585167 - RNA, 23 nt, Pseudomonas putida KT2440
aacccgcugccacccacaggcac

SEQ ID NO: 3585168 - RNA, 15 nt, Pseudomonas putida KT2440
aacccggcaaugguc

SEQ ID NO: 3585169 - RNA, 14 nt, Pseudomonas putida KT2440
aacccggccagcag

SEQ ID NO: 3585170 - RNA, 18 nt, Pseudomonas putida KT2440
aacccggccagcagguca

SEQ ID NO: 3585171 - RNA, 19 nt, Pseudomonas putida KT2440
aacccggccagcaggucag

SEQ ID NO: 3585172 - RNA, 13 nt, Pseudomonas putida KT2440
aacccggccaggc

SEQ ID NO: 3585173 - RNA, 13 nt, Pseudomonas putida KT2440
aacccggccgagg

SEQ ID NO: 3585174 - RNA, 12 nt, Pseudomonas putida KT2440
aacccggguugc

SEQ ID NO: 3585175 - RNA, 18 nt, Pseudomonas putida KT2440
aacccucacgcgccaggu

SEQ ID NO: 3585176 - RNA, 23 nt, Pseudomonas putida KT2440
aacccuucgcggguaaacccgcu

SEQ ID NO: 3585177 - RNA, 17 nt, Pseudomonas putida KT2440
aacccuucggccagcag

SEQ ID NO: 3585178 - RNA, 18 nt, Pseudomonas putida KT2440
aacccuucggccagcagu

SEQ ID NO: 3585179 - RNA, 14 nt, Pseudomonas putida KT2440
aacccuucucuucc

SEQ ID NO: 3585180 - RNA, 19 nt, Pseudomonas putida KT2440
aacccuucucuuccggcag

SEQ ID NO: 3585181 - RNA, 21 nt, Pseudomonas putida KT2440
aacccuucucuuccggcaggu

SEQ ID NO: 3585182 - RNA, 23 nt, Pseudomonas putida KT2440
aacccuugcagcgccugugagau

SEQ ID NO: 3585183 - RNA, 23 nt, Pseudomonas putida KT2440
aacccuuuuaucugguugccgcc

SEQ ID NO: 3585184 - RNA, 20 nt, Pseudomonas putida KT2440
aaccgaaaaggccaaccacc

SEQ ID NO: 3585185 - RNA, 15 nt, Pseudomonas putida KT2440
aaccgaacccgcugc

SEQ ID NO: 3585186 - RNA, 16 nt, Pseudomonas putida KT2440
aaccgaauccagguug

SEQ ID NO: 3585187 - RNA, 19 nt, Pseudomonas putida KT2440
aaccgcacccggcuaccaa

SEQ ID NO: 3585188 - RNA, 13 nt, Pseudomonas putida KT2440
aaccgccagcagu

SEQ ID NO: 3585189 - RNA, 23 nt, Pseudomonas putida KT2440
aaccgccagccaaccgcgugcuu

SEQ ID NO: 3585190 - RNA, 22 nt, Pseudomonas putida KT2440
aaccgccccaccacauccgacc

SEQ ID NO: 3585191 - RNA, 23 nt, Pseudomonas putida KT2440
aaccgccgcgccucgcggugcaa

SEQ ID NO: 3585192 - RNA, 12 nt, Pseudomonas putida KT2440
aaccgccuccac

SEQ ID NO: 3585193 - RNA, 17 nt, Pseudomonas putida KT2440
aaccgccuccacgguca

SEQ ID NO: 3585194 - RNA, 19 nt, Pseudomonas putida KT2440
aaccgcgauaucagcgcca

SEQ ID NO: 3585195 - RNA, 18 nt, Pseudomonas putida KT2440
aaccgcggcugacgaagc

SEQ ID NO: 3585196 - RNA, 11 nt, Pseudomonas putida KT2440
aaccgcucucg

SEQ ID NO: 3585197 - RNA, 20 nt, Pseudomonas putida KT2440
aaccgcuucaccgcgcaccu

SEQ ID NO: 3585198 - RNA, 19 nt, Pseudomonas putida KT2440
aaccggcaaacgcggucag

SEQ ID NO: 3585199 - RNA, 14 nt, Pseudomonas putida KT2440
aaccggccaccgac

SEQ ID NO: 3585200 - RNA, 18 nt, Pseudomonas putida KT2440
aaccggcgaucagggugu

SEQ ID NO: 3585201 - RNA, 14 nt, Pseudomonas putida KT2440
aaccggcgcuggcc

SEQ ID NO: 3585202 - RNA, 20 nt, Pseudomonas putida KT2440
aaccggcuuguagccggcag

SEQ ID NO: 3585203 - RNA, 15 nt, Pseudomonas putida KT2440
aaccgggucuugaag

SEQ ID NO: 3585204 - RNA, 16 nt, Pseudomonas putida KT2440
aaccggugcaacugcc

SEQ ID NO: 3585205 - RNA, 12 nt, Pseudomonas putida KT2440
aaccguacccuu

SEQ ID NO: 3585206 - RNA, 19 nt, Pseudomonas putida KT2440
aaccguucacguucaacgc

SEQ ID NO: 3585207 - RNA, 17 nt, Pseudomonas putida KT2440
aaccguuggucagcgac

SEQ ID NO: 3585208 - RNA, 12 nt, Pseudomonas putida KT2440
aaccucaccgcc

SEQ ID NO: 3585209 - RNA, 13 nt, Pseudomonas putida KT2440
aaccucacuggca

SEQ ID NO: 3585210 - RNA, 20 nt, Pseudomonas putida KT2440
aaccucaguuuuucuccgcc

SEQ ID NO: 3585211 - RNA, 20 nt, Pseudomonas putida KT2440
aaccucggccgcauccugcg

SEQ ID NO: 3585212 - RNA, 18 nt, Pseudomonas putida KT2440
aaccugcucgcucaggcu

SEQ ID NO: 3585213 - RNA, 17 nt, Pseudomonas putida KT2440
aaccuguaacucagcuu

SEQ ID NO: 3585214 - RNA, 20 nt, Pseudomonas putida KT2440
aaccugugggagcgggcgug

SEQ ID NO: 3585215 - RNA, 16 nt, Pseudomonas putida KT2440
aaccuucaacaccaac

SEQ ID NO: 3585216 - RNA, 19 nt, Pseudomonas putida KT2440
aacgaaaaaaagggcaccu

SEQ ID NO: 3585217 - RNA, 17 nt, Pseudomonas putida KT2440
aacgaaggccugaaacc

SEQ ID NO: 3585218 - RNA, 13 nt, Pseudomonas putida KT2440
aacgaaucagcca

SEQ ID NO: 3585219 - RNA, 13 nt, Pseudomonas putida KT2440
aacgacaagguac

SEQ ID NO: 3585220 - RNA, 14 nt, Pseudomonas putida KT2440
aacgacacggcagg

SEQ ID NO: 3585221 - RNA, 20 nt, Pseudomonas putida KT2440
aacgaccggcuugucuucca

SEQ ID NO: 3585222 - RNA, 22 nt, Pseudomonas putida KT2440
aacgacuucggcaacagccggg

SEQ ID NO: 3585223 - RNA, 13 nt, Pseudomonas putida KT2440
aacgaggacugca

SEQ ID NO: 3585224 - RNA, 15 nt, Pseudomonas putida KT2440
aacgaggacugcacc

SEQ ID NO: 3585225 - RNA, 20 nt, Pseudomonas putida KT2440
aacgaggccgccauuaccgg

SEQ ID NO: 3585226 - RNA, 14 nt, Pseudomonas putida KT2440
aacgaucagcgccg

SEQ ID NO: 3585227 - RNA, 21 nt, Pseudomonas putida KT2440
aacgcaaauccuccugcgcau

SEQ ID NO: 3585228 - RNA, 16 nt, Pseudomonas putida KT2440
aacgcaagaaggcugc

SEQ ID NO: 3585229 - RNA, 12 nt, Pseudomonas putida KT2440
aacgcaccgacc

SEQ ID NO: 3585230 - RNA, 21 nt, Pseudomonas putida KT2440
aacgcacgugggucgggaaca

SEQ ID NO: 3585231 - RNA, 14 nt, Pseudomonas putida KT2440
aacgcagccaggau

SEQ ID NO: 3585232 - RNA, 16 nt, Pseudomonas putida KT2440
aacgcagccggcaccg

SEQ ID NO: 3585233 - RNA, 12 nt, Pseudomonas putida KT2440
aacgcagcgccg

SEQ ID NO: 3585234 - RNA, 13 nt, Pseudomonas putida KT2440
aacgcaggcucug

SEQ ID NO: 3585235 - RNA, 14 nt, Pseudomonas putida KT2440
aacgcaggcucugc

SEQ ID NO: 3585236 - RNA, 14 nt, Pseudomonas putida KT2440
aacgcauccaggcg

SEQ ID NO: 3585237 - RNA, 23 nt, Pseudomonas putida KT2440
aacgccacgcccaacccagccag

SEQ ID NO: 3585238 - RNA, 24 nt, Pseudomonas putida KT2440
aacgccacgcccaacccagccagc

SEQ ID NO: 3585239 - RNA, 23 nt, Pseudomonas putida KT2440
aacgccacggcggcauccaggcg

SEQ ID NO: 3585240 - RNA, 23 nt, Pseudomonas putida KT2440
aacgccagggcaaucgccaaggu

SEQ ID NO: 3585241 - RNA, 17 nt, Pseudomonas putida KT2440
aacgccccccggcucca

SEQ ID NO: 3585242 - RNA, 19 nt, Pseudomonas putida KT2440
aacgccccccggcuccaca

SEQ ID NO: 3585243 - RNA, 18 nt, Pseudomonas putida KT2440
aacgcccccgccaccccc

SEQ ID NO: 3585244 - RNA, 22 nt, Pseudomonas putida KT2440
aacgcccgcgcagcuuccacca

SEQ ID NO: 3585245 - RNA, 20 nt, Pseudomonas putida KT2440
aacgcccgcgcauagcagaa

SEQ ID NO: 3585246 - RNA, 20 nt, Pseudomonas putida KT2440
aacgccgagcauuacaggca

SEQ ID NO: 3585247 - RNA, 15 nt, Pseudomonas putida KT2440
aacgccgauagccag

SEQ ID NO: 3585248 - RNA, 20 nt, Pseudomonas putida KT2440
aacgccgauagccagcuggc

SEQ ID NO: 3585249 - RNA, 13 nt, Pseudomonas putida KT2440
aacgccgccugcc

SEQ ID NO: 3585250 - RNA, 17 nt, Pseudomonas putida KT2440
aacgccgggcacaucac

SEQ ID NO: 3585251 - RNA, 22 nt, Pseudomonas putida KT2440
aacgccgggcacaucaccagca

SEQ ID NO: 3585252 - RNA, 16 nt, Pseudomonas putida KT2440
aacgccgggucagcuc

SEQ ID NO: 3585253 - RNA, 12 nt, Pseudomonas putida KT2440
aacgccuuggcc

SEQ ID NO: 3585254 - RNA, 18 nt, Pseudomonas putida KT2440
aacgccuuggccuggcga

SEQ ID NO: 3585255 - RNA, 19 nt, Pseudomonas putida KT2440
aacgccuuguuccgcccag

SEQ ID NO: 3585256 - RNA, 15 nt, Pseudomonas putida KT2440
aacgcgaaagcgaag

SEQ ID NO: 3585257 - RNA, 24 nt, Pseudomonas putida KT2440
aacgcgauauucagugcgcaggua

SEQ ID NO: 3585258 - RNA, 19 nt, Pseudomonas putida KT2440
aacgcgccauggccuggcg

SEQ ID NO: 3585259 - RNA, 15 nt, Pseudomonas putida KT2440
aacgcgccgcugccu

SEQ ID NO: 3585260 - RNA, 15 nt, Pseudomonas putida KT2440
aacgcggaucgugac

SEQ ID NO: 3585261 - RNA, 13 nt, Pseudomonas putida KT2440
aacgcggcaaccu

SEQ ID NO: 3585262 - RNA, 23 nt, Pseudomonas putida KT2440
aacgcggcuucgaugcccggcag

SEQ ID NO: 3585263 - RNA, 17 nt, Pseudomonas putida KT2440
aacgcgguaagcaccac

SEQ ID NO: 3585264 - RNA, 13 nt, Pseudomonas putida KT2440
aacgcggucagca

SEQ ID NO: 3585265 - RNA, 23 nt, Pseudomonas putida KT2440
aacgcguuucggcggccugcagc

SEQ ID NO: 3585266 - RNA, 17 nt, Pseudomonas putida KT2440
aacgcucgcgcaugaaa

SEQ ID NO: 3585267 - RNA, 14 nt, Pseudomonas putida KT2440
aacgcugcucggcc

SEQ ID NO: 3585268 - RNA, 18 nt, Pseudomonas putida KT2440
aacgcuugcccggcucca

SEQ ID NO: 3585269 - RNA, 22 nt, Pseudomonas putida KT2440
aacggaacgacaaacuccuuga

SEQ ID NO: 3585270 - RNA, 17 nt, Pseudomonas putida KT2440
aagagaagcugcagcuu

SEQ ID NO: 3585271 - RNA, 20 nt, Pseudomonas putida KT2440
aagagaagcugcagcuucag

SEQ ID NO: 3585272 - RNA, 12 nt, Pseudomonas putida KT2440
aagagcaggaag

SEQ ID NO: 3585273 - RNA, 13 nt, Pseudomonas putida KT2440
aagagcaggaaga

SEQ ID NO: 3585274 - RNA, 14 nt, Pseudomonas putida KT2440
aagaggcagcgaaa

SEQ ID NO: 3585275 - RNA, 17 nt, Pseudomonas putida KT2440
aagaggccccgacagca

SEQ ID NO: 3585276 - RNA, 18 nt, Pseudomonas putida KT2440
aagaggcccgaacagaca

SEQ ID NO: 3585277 - RNA, 14 nt, Pseudomonas putida KT2440
aagaggccggcaca

SEQ ID NO: 3585278 - RNA, 22 nt, Pseudomonas putida KT2440
aagaggccggcacaggaaggca

SEQ ID NO: 3585279 - RNA, 23 nt, Pseudomonas putida KT2440
aagaggccggcacaggaaggcau

SEQ ID NO: 3585280 - RNA, 14 nt, Pseudomonas putida KT2440
aagaggccggcccc

SEQ ID NO: 3585281 - RNA, 20 nt, Pseudomonas putida KT2440
aagaggccgguacugcccau

SEQ ID NO: 3585282 - RNA, 16 nt, Pseudomonas putida KT2440
aagaucaagccccugg

SEQ ID NO: 3585283 - RNA, 14 nt, Pseudomonas putida KT2440
aagaucgcccagcu

SEQ ID NO: 3585284 - RNA, 14 nt, Pseudomonas putida KT2440
aagaucuaugacca

SEQ ID NO: 3585285 - RNA, 17 nt, Pseudomonas putida KT2440
aagauguguuggccgga

SEQ ID NO: 3585286 - RNA, 16 nt, Pseudomonas putida KT2440
aagauguguugucugu

SEQ ID NO: 3585287 - RNA, 19 nt, Pseudomonas putida KT2440
aagauguguugucugugcc

SEQ ID NO: 3585288 - RNA, 13 nt, Pseudomonas putida KT2440
aagcaaacgccag

SEQ ID NO: 3585289 - RNA, 22 nt, Pseudomonas putida KT2440
aagcaacuguuggaauggcgca

SEQ ID NO: 3585290 - RNA, 21 nt, Pseudomonas putida KT2440
aagcaauccacgguauagugg

SEQ ID NO: 3585291 - RNA, 19 nt, Pseudomonas putida KT2440
aagcaccagguuugcugcc

SEQ ID NO: 3585292 - RNA, 14 nt, Pseudomonas putida KT2440
aagcagaacaucag

SEQ ID NO: 3585293 - RNA, 20 nt, Pseudomonas putida KT2440
aagcagacagcugugcugcc

SEQ ID NO: 3585294 - RNA, 17 nt, Pseudomonas putida KT2440
aagcagccccaaaagcc

SEQ ID NO: 3585295 - RNA, 11 nt, Pseudomonas putida KT2440
aagcaggaugg

SEQ ID NO: 3585296 - RNA, 22 nt, Pseudomonas putida KT2440
aagcaggauggugacugccagc

SEQ ID NO: 3585297 - RNA, 13 nt, Pseudomonas putida KT2440
aagcagugcugcc

SEQ ID NO: 3585298 - RNA, 14 nt, Pseudomonas putida KT2440
aagccaacugcucu

SEQ ID NO: 3585299 - RNA, 15 nt, Pseudomonas putida KT2440
aagccaacugcucua

SEQ ID NO: 3585300 - RNA, 20 nt, Pseudomonas putida KT2440
aagccaagcgccgucgaacg

SEQ ID NO: 3585301 - RNA, 17 nt, Pseudomonas putida KT2440
aagccaaugguauugcc

SEQ ID NO: 3585302 - RNA, 18 nt, Pseudomonas putida KT2440
aagccaccggacagaauc

SEQ ID NO: 3585303 - RNA, 16 nt, Pseudomonas putida KT2440
aagccacuggccagca

SEQ ID NO: 3585304 - RNA, 14 nt, Pseudomonas putida KT2440
aagccagcccugcc

SEQ ID NO: 3585305 - RNA, 12 nt, Pseudomonas putida KT2440
aagccagccucc

SEQ ID NO: 3585306 - RNA, 18 nt, Pseudomonas putida KT2440
aagccagcguaagcuggc

SEQ ID NO: 3585307 - RNA, 15 nt, Pseudomonas putida KT2440
aagccauaucccgcc

SEQ ID NO: 3585308 - RNA, 19 nt, Pseudomonas putida KT2440
aagccaugaucagcgccug

SEQ ID NO: 3585309 - RNA, 14 nt, Pseudomonas putida KT2440
aagccaugggcaga

SEQ ID NO: 3585310 - RNA, 19 nt, Pseudomonas putida KT2440
aagcccaguugcuggcugg

SEQ ID NO: 3585311 - RNA, 10 nt, Pseudomonas putida KT2440
aagcccaugg

SEQ ID NO: 3585312 - RNA, 16 nt, Pseudomonas putida KT2440
aagcccauggcuggca

SEQ ID NO: 3585313 - RNA, 20 nt, Pseudomonas putida KT2440
aagcccauggcuggcagcac

SEQ ID NO: 3585314 - RNA, 18 nt, Pseudomonas putida KT2440
aagcccccggaugcgcaa

SEQ ID NO: 3585315 - RNA, 16 nt, Pseudomonas putida KT2440
aagccccgccagugca

SEQ ID NO: 3585316 - RNA, 22 nt, Pseudomonas putida KT2440
aagccccgguucgcgagaaccg

SEQ ID NO: 3585317 - RNA, 24 nt, Pseudomonas putida KT2440
aagcccgaagcuaucgccagcagg

SEQ ID NO: 3585318 - RNA, 21 nt, Pseudomonas putida KT2440
aagcccgccccaauggcgaac

SEQ ID NO: 3585319 - RNA, 12 nt, Pseudomonas putida KT2440
aagcccgcgaag

SEQ ID NO: 3585320 - RNA, 12 nt, Pseudomonas putida KT2440
aagcccgcuccc

SEQ ID NO: 3585321 - RNA, 17 nt, Pseudomonas putida KT2440
aagcccgcuugcugugu

SEQ ID NO: 3585322 - RNA, 15 nt, Pseudomonas putida KT2440
aagcccgugccgcau

SEQ ID NO: 3585323 - RNA, 10 nt, Pseudomonas putida KT2440
aagcccugcc

SEQ ID NO: 3585324 - RNA, 13 nt, Pseudomonas putida KT2440
aagcccugcugcu

SEQ ID NO: 3585325 - RNA, 22 nt, Pseudomonas putida KT2440
aagcccugcugcuggcacgccu

SEQ ID NO: 3585326 - RNA, 14 nt, Pseudomonas putida KT2440
aagccgacaaaaac

SEQ ID NO: 3585327 - RNA, 13 nt, Pseudomonas putida KT2440
aagccgccacaug

SEQ ID NO: 3585328 - RNA, 12 nt, Pseudomonas putida KT2440
aagccgccagcg

SEQ ID NO: 3585329 - RNA, 14 nt, Pseudomonas putida KT2440
aagccgcucacccc

SEQ ID NO: 3585330 - RNA, 12 nt, Pseudomonas putida KT2440
aagccgcugcca

SEQ ID NO: 3585331 - RNA, 17 nt, Pseudomonas putida KT2440
aagccgcugccacaggu

SEQ ID NO: 3585332 - RNA, 12 nt, Pseudomonas putida KT2440
aagccgcuggcc

SEQ ID NO: 3585333 - RNA, 15 nt, Pseudomonas putida KT2440
aagccgcuggcccua

SEQ ID NO: 3585334 - RNA, 17 nt, Pseudomonas putida KT2440
aagccggcgaacagcac

SEQ ID NO: 3585335 - RNA, 17 nt, Pseudomonas putida KT2440
aagccgugccugggugg

SEQ ID NO: 3585336 - RNA, 14 nt, Pseudomonas putida KT2440
aagccuaaaggcau

SEQ ID NO: 3585337 - RNA, 19 nt, Pseudomonas putida KT2440
aagccugaggcugcgccga

SEQ ID NO: 3585338 - RNA, 12 nt, Pseudomonas putida KT2440
aagccugcacca

SEQ ID NO: 3585339 - RNA, 15 nt, Pseudomonas putida KT2440
aagccuucggccaug

SEQ ID NO: 3585340 - RNA, 13 nt, Pseudomonas putida KT2440
aagccuuuggccg

SEQ ID NO: 3585341 - RNA, 14 nt, Pseudomonas putida KT2440
aagcgaaacaccag

SEQ ID NO: 3585342 - RNA, 13 nt, Pseudomonas putida KT2440
aagcgcagcgcag

SEQ ID NO: 3585343 - RNA, 17 nt, Pseudomonas putida KT2440
aagcgcagguccaggcg

SEQ ID NO: 3585344 - RNA, 16 nt, Pseudomonas putida KT2440
aagcgccaauuggcgg

SEQ ID NO: 3585345 - RNA, 21 nt, Pseudomonas putida KT2440
aagcgccagcaacgcagccag

SEQ ID NO: 3585346 - RNA, 14 nt, Pseudomonas putida KT2440
aagcgccccaggau

SEQ ID NO: 3585347 - RNA, 19 nt, Pseudomonas putida KT2440
aagcgccugacgcagugca

SEQ ID NO: 3585348 - RNA, 22 nt, Pseudomonas putida KT2440
aagcgcgacuggugcucugcag

SEQ ID NO: 3585349 - RNA, 15 nt, Pseudomonas putida KT2440
aagcgcugguaaagu

SEQ ID NO: 3585350 - RNA, 15 nt, Pseudomonas putida KT2440
aagcggaucggccgg

SEQ ID NO: 3585351 - RNA, 19 nt, Pseudomonas putida KT2440
aagcggcacuaccaggccc

SEQ ID NO: 3585352 - RNA, 14 nt, Pseudomonas putida KT2440
aagcggccggcccc

SEQ ID NO: 3585353 - RNA, 19 nt, Pseudomonas putida KT2440
aagcggccuuuucgcgcua

SEQ ID NO: 3585354 - RNA, 23 nt, Pseudomonas putida KT2440
aagcgggcagugcaauaccagcc

SEQ ID NO: 3585355 - RNA, 13 nt, Pseudomonas putida KT2440
aagcgguacaccu

SEQ ID NO: 3585356 - RNA, 18 nt, Pseudomonas putida KT2440
aagcggucguuacccagg

SEQ ID NO: 3585357 - RNA, 16 nt, Pseudomonas putida KT2440
aagcgguugcccgcug

SEQ ID NO: 3585358 - RNA, 14 nt, Pseudomonas putida KT2440
aagcguaccgccag

SEQ ID NO: 3585359 - RNA, 13 nt, Pseudomonas putida KT2440
aagcguucaugcc

SEQ ID NO: 3585360 - RNA, 15 nt, Pseudomonas putida KT2440
aagcuaaacgaguuu

SEQ ID NO: 3585361 - RNA, 22 nt, Pseudomonas putida KT2440
aagcuaaacgaguuucucgcaa

SEQ ID NO: 3585362 - RNA, 13 nt, Pseudomonas putida KT2440
aagcucaaaugcu

SEQ ID NO: 3585363 - RNA, 14 nt, Pseudomonas putida KT2440
aagcucaaaugcug

SEQ ID NO: 3585364 - RNA, 19 nt, Pseudomonas putida KT2440
aagcucaaaugcuggcaau

SEQ ID NO: 3585365 - RNA, 14 nt, Pseudomonas putida KT2440
aagcuccagggugc

SEQ ID NO: 3585366 - RNA, 14 nt, Pseudomonas putida KT2440
aagcucuccagcag

SEQ ID NO: 3585367 - RNA, 15 nt, Pseudomonas putida KT2440
aagcucuccagcagg

SEQ ID NO: 3585368 - RNA, 13 nt, Pseudomonas putida KT2440
aagcugcaccgcc

SEQ ID NO: 3585369 - RNA, 14 nt, Pseudomonas putida KT2440
aagcugcagcagcu

SEQ ID NO: 3585370 - RNA, 22 nt, Pseudomonas putida KT2440
aagcugcgccgcaaaccccuuc

SEQ ID NO: 3585371 - RNA, 13 nt, Pseudomonas putida KT2440
aagcugcgcucga

SEQ ID NO: 3585372 - RNA, 19 nt, Pseudomonas putida KT2440
aagcugcgcucgauccugu

SEQ ID NO: 3585373 - RNA, 19 nt, Pseudomonas putida KT2440
aagcuggagucguugcgcu

SEQ ID NO: 3585374 - RNA, 15 nt, Pseudomonas putida KT2440
aagcuggcacgugca

SEQ ID NO: 3585375 - RNA, 19 nt, Pseudomonas putida KT2440
aagcuggcacgugcaggag

SEQ ID NO: 3585376 - RNA, 15 nt, Pseudomonas putida KT2440
aagcugucagcaccu

SEQ ID NO: 3585377 - RNA, 13 nt, Pseudomonas putida KT2440
aauaauaaaaaaa

SEQ ID NO: 3585378 - RNA, 15 nt, Pseudomonas putida KT2440
aauaauaaaaaaaga

SEQ ID NO: 3585379 - RNA, 20 nt, Pseudomonas putida KT2440
aauaauucuuauuaccagaa

SEQ ID NO: 3585380 - RNA, 20 nt, Pseudomonas putida KT2440
aauaauuguucguaggucag

SEQ ID NO: 3585381 - RNA, 14 nt, Pseudomonas putida KT2440
aauacauacaccaa

SEQ ID NO: 3585382 - RNA, 16 nt, Pseudomonas putida KT2440
aauacauacaccaacg

SEQ ID NO: 3585383 - RNA, 12 nt, Pseudomonas putida KT2440
aauacauccagg

SEQ ID NO: 3585384 - RNA, 23 nt, Pseudomonas putida KT2440
aauacauccgcguccccuucacg

SEQ ID NO: 3585385 - RNA, 16 nt, Pseudomonas putida KT2440
aauaccagacgcaggc

SEQ ID NO: 3585386 - RNA, 14 nt, Pseudomonas putida KT2440
aauacccaacagca

SEQ ID NO: 3585387 - RNA, 22 nt, Pseudomonas putida KT2440
aauaccgauggccccgcccagg

SEQ ID NO: 3585388 - RNA, 18 nt, Pseudomonas putida KT2440
aauaccgauugccucagg

SEQ ID NO: 3585389 - RNA, 15 nt, Pseudomonas putida KT2440
aauaccgcugcaaca

SEQ ID NO: 3585390 - RNA, 15 nt, Pseudomonas putida KT2440
aauaccgugcuugcg

SEQ ID NO: 3585391 - RNA, 18 nt, Pseudomonas putida KT2440
aauacgagggugaaccca

SEQ ID NO: 3585392 - RNA, 18 nt, Pseudomonas putida KT2440
aauacgauauccgcagcc

SEQ ID NO: 3585393 - RNA, 16 nt, Pseudomonas putida KT2440
aauacgccgccaccgg

SEQ ID NO: 3585394 - RNA, 16 nt, Pseudomonas putida KT2440
aauacgcucgaccaga

SEQ ID NO: 3585395 - RNA, 16 nt, Pseudomonas putida KT2440
aauagcccaccuucac

SEQ ID NO: 3585396 - RNA, 19 nt, Pseudomonas putida KT2440
aauagccggccucagcagc

SEQ ID NO: 3585397 - RNA, 16 nt, Pseudomonas putida KT2440
aauagcggcgguucuu

SEQ ID NO: 3585398 - RNA, 14 nt, Pseudomonas putida KT2440
aauagguaaagcca

SEQ ID NO: 3585399 - RNA, 18 nt, Pseudomonas putida KT2440
aauaucaucacugccacc

SEQ ID NO: 3585400 - RNA, 13 nt, Pseudomonas putida KT2440
aaucaaagcagac

SEQ ID NO: 3585401 - RNA, 14 nt, Pseudomonas putida KT2440
aaucaaccagcccg

SEQ ID NO: 3585402 - RNA, 19 nt, Pseudomonas putida KT2440
aaucaagagcccggaagcu

SEQ ID NO: 3585403 - RNA, 17 nt, Pseudomonas putida KT2440
aaucacgaacaccagcc

SEQ ID NO: 3585404 - RNA, 20 nt, Pseudomonas putida KT2440
aaucacgaacaccagcccca

SEQ ID NO: 3585405 - RNA, 14 nt, Pseudomonas putida KT2440
aaucagcacugugc

SEQ ID NO: 3585406 - RNA, 21 nt, Pseudomonas putida KT2440
aaucagcaucagugcaggugc

SEQ ID NO: 3585407 - RNA, 15 nt, Pseudomonas putida KT2440
aaucagcaugcccag

SEQ ID NO: 3585408 - RNA, 20 nt, Pseudomonas putida KT2440
aaucagcaugcccagcgcca

SEQ ID NO: 3585409 - RNA, 21 nt, Pseudomonas putida KT2440
aaucagcaugcccagcgccac

SEQ ID NO: 3585410 - RNA, 24 nt, Pseudomonas putida KT2440
aaucagccuuugcccuugguccgg

SEQ ID NO: 3585411 - RNA, 17 nt, Pseudomonas putida KT2440
aaucagcggcaggcugg

SEQ ID NO: 3585412 - RNA, 15 nt, Pseudomonas putida KT2440
aaucagcuauugaga

SEQ ID NO: 3585413 - RNA, 16 nt, Pseudomonas putida KT2440
aaucagcucacaggcu

SEQ ID NO: 3585414 - RNA, 19 nt, Pseudomonas putida KT2440
aaucagcucacaggcucag

SEQ ID NO: 3585415 - RNA, 20 nt, Pseudomonas putida KT2440
aaucagcucacaggcucagu

SEQ ID NO: 3585416 - RNA, 18 nt, Pseudomonas putida KT2440
aaucagcucgucagccac

SEQ ID NO: 3585417 - RNA, 20 nt, Pseudomonas putida KT2440
aaucagcuugaacacgaaca

SEQ ID NO: 3585418 - RNA, 16 nt, Pseudomonas putida KT2440
aaucaggcagcgauca

SEQ ID NO: 3585419 - RNA, 14 nt, Pseudomonas putida KT2440
aaucaggcugucca

SEQ ID NO: 3585420 - RNA, 18 nt, Pseudomonas putida KT2440
aaucaggcuguccacacc

SEQ ID NO: 3585421 - RNA, 22 nt, Pseudomonas putida KT2440
aaucaggucaucgaagaucagc

SEQ ID NO: 3585422 - RNA, 17 nt, Pseudomonas putida KT2440
aaucagguuguucaccu

SEQ ID NO: 3585423 - RNA, 21 nt, Pseudomonas putida KT2440
aaucaucguauuacccuucau

SEQ ID NO: 3585424 - RNA, 22 nt, Pseudomonas putida KT2440
aaucaucguauuacccuucauc

SEQ ID NO: 3585425 - RNA, 17 nt, Pseudomonas putida KT2440
aauccagugcaggucua

SEQ ID NO: 3585426 - RNA, 13 nt, Pseudomonas putida KT2440
aauccaucaccac

SEQ ID NO: 3585427 - RNA, 14 nt, Pseudomonas putida KT2440
aaucccggucaccu

SEQ ID NO: 3585428 - RNA, 15 nt, Pseudomonas putida KT2440
aauccggcaacuggc

SEQ ID NO: 3585429 - RNA, 17 nt, Pseudomonas putida KT2440
aauccgugagccaggag

SEQ ID NO: 3585430 - RNA, 23 nt, Pseudomonas putida KT2440
aauccuugcccucgcccacucac

SEQ ID NO: 3585431 - RNA, 17 nt, Pseudomonas putida KT2440
aaucgaccagggccuug

SEQ ID NO: 3585432 - RNA, 23 nt, Pseudomonas putida KT2440
aaucgccgcaucguuauccagca

SEQ ID NO: 3585433 - RNA, 15 nt, Pseudomonas putida KT2440
aaucgccgggcgcac

SEQ ID NO: 3585434 - RNA, 16 nt, Pseudomonas putida KT2440
aaucgcgcuugcgguc

SEQ ID NO: 3585435 - RNA, 20 nt, Pseudomonas putida KT2440
aaucgcgucagcaccggcag

SEQ ID NO: 3585436 - RNA, 16 nt, Pseudomonas putida KT2440
aaucgcucugccgcac

SEQ ID NO: 3585437 - RNA, 16 nt, Pseudomonas putida KT2440
aaucgcugcgcaugaa

SEQ ID NO: 3585438 - RNA, 19 nt, Pseudomonas putida KT2440
aaucgcugcgcaugaaacu

SEQ ID NO: 3585439 - RNA, 16 nt, Pseudomonas putida KT2440
aaucgcugugcaacag

SEQ ID NO: 3585440 - RNA, 21 nt, Pseudomonas putida KT2440
aaucggcaggccggccaccag

SEQ ID NO: 3585441 - RNA, 18 nt, Pseudomonas putida KT2440
aaucggcgccaggaucga

SEQ ID NO: 3585442 - RNA, 20 nt, Pseudomonas putida KT2440
aaucgggauggcaccggcag

SEQ ID NO: 3585443 - RNA, 20 nt, Pseudomonas putida KT2440
aaucgucggugaugaucagg

SEQ ID NO: 3585444 - RNA, 22 nt, Pseudomonas putida KT2440
aaucgucguaggcgcggguuua

SEQ ID NO: 3585445 - RNA, 11 nt, Pseudomonas putida KT2440
aaucuccagcc

SEQ ID NO: 3585446 - RNA, 13 nt, Pseudomonas putida KT2440
aaucuccagcccg

SEQ ID NO: 3585447 - RNA, 14 nt, Pseudomonas putida KT2440
aaucucgcccuugu

SEQ ID NO: 3585448 - RNA, 20 nt, Pseudomonas putida KT2440
aaucucggucugucaaccca

SEQ ID NO: 3585449 - RNA, 22 nt, Pseudomonas putida KT2440
aaucugauuugcgcuacagcuu

SEQ ID NO: 3585450 - RNA, 14 nt, Pseudomonas putida KT2440
aaucugcagcagca

SEQ ID NO: 3585451 - RNA, 15 nt, Pseudomonas putida KT2440
aaucugcagcagcau

SEQ ID NO: 3585452 - RNA, 18 nt, Pseudomonas putida KT2440
aaucugccugcugcaaca

SEQ ID NO: 3585453 - RNA, 14 nt, Pseudomonas putida KT2440
aaucugcucuuuga

SEQ ID NO: 3585454 - RNA, 16 nt, Pseudomonas putida KT2440
aaucuuccgcaugcuu

SEQ ID NO: 3585455 - RNA, 21 nt, Pseudomonas putida KT2440
aaucuucggcuuugaacagcu

SEQ ID NO: 3585456 - RNA, 16 nt, Pseudomonas putida KT2440
aaugaaaguccaucac

SEQ ID NO: 3585457 - RNA, 17 nt, Pseudomonas putida KT2440
aaugacuccgccccaaa

SEQ ID NO: 3585458 - RNA, 16 nt, Pseudomonas putida KT2440
aaugacuucgcugccc

SEQ ID NO: 3585459 - RNA, 21 nt, Pseudomonas putida KT2440
aaugaguccgguaacgaaggc

SEQ ID NO: 3585460 - RNA, 15 nt, Pseudomonas putida KT2440
aaugaucaagaaguc

SEQ ID NO: 3585461 - RNA, 22 nt, Pseudomonas putida KT2440
aaugaucgccagcgguugagau

SEQ ID NO: 3585462 - RNA, 18 nt, Pseudomonas putida KT2440
aaugaucgggcagacgac

SEQ ID NO: 3585463 - RNA, 16 nt, Pseudomonas putida KT2440
aaugaugaaagcaggu

SEQ ID NO: 3585464 - RNA, 21 nt, Pseudomonas putida KT2440
aaugaugcguacggccuuggc

SEQ ID NO: 3585465 - RNA, 14 nt, Pseudomonas putida KT2440
aaugauggcaauca

SEQ ID NO: 3585466 - RNA, 18 nt, Pseudomonas putida KT2440
aaugauggcaaucacgaa

SEQ ID NO: 3585467 - RNA, 12 nt, Pseudomonas putida KT2440
aaugcacagcgc

SEQ ID NO: 3585468 - RNA, 13 nt, Pseudomonas putida KT2440
aaugcacgccugg

SEQ ID NO: 3585469 - RNA, 22 nt, Pseudomonas putida KT2440
aaugcacgccugucuagccgcc

SEQ ID NO: 3585470 - RNA, 12 nt, Pseudomonas putida KT2440
aaugcagaugcg

SEQ ID NO: 3585471 - RNA, 23 nt, Pseudomonas putida KT2440
aaugcagaugguccggcaucacu

SEQ ID NO: 3585472 - RNA, 13 nt, Pseudomonas putida KT2440
aaugcagcaagcu

SEQ ID NO: 3585473 - RNA, 18 nt, Pseudomonas putida KT2440
aaugcagcaagcuggcac

SEQ ID NO: 3585474 - RNA, 17 nt, Pseudomonas putida KT2440
aaugcaggcaguaggcc

SEQ ID NO: 3585475 - RNA, 12 nt, Pseudomonas putida KT2440
aaugccagcagu

SEQ ID NO: 3585476 - RNA, 15 nt, Pseudomonas putida KT2440
aaugccaguugauca

SEQ ID NO: 3585477 - RNA, 16 nt, Pseudomonas putida KT2440
aaugcccauggccagg

SEQ ID NO: 3585478 - RNA, 19 nt, Pseudomonas putida KT2440
aaugccgccuugcagaaag

SEQ ID NO: 3585479 - RNA, 15 nt, Pseudomonas putida KT2440
aaugcgacugaggca

SEQ ID NO: 3585480 - RNA, 15 nt, Pseudomonas putida KT2440
aaugcgccccggcga

SEQ ID NO: 3585481 - RNA, 17 nt, Pseudomonas putida KT2440
aaugcgccccggcgauc

SEQ ID NO: 3585482 - RNA, 13 nt, Pseudomonas putida KT2440
aaugcgcccugcu

SEQ ID NO: 3585483 - RNA, 22 nt, Pseudomonas putida KT2440
acaacuccgggugcuccuuauc

SEQ ID NO: 3585484 - RNA, 13 nt, Pseudomonas putida KT2440
acaacugcuccag

SEQ ID NO: 3585485 - RNA, 17 nt, Pseudomonas putida KT2440
acaacugcuccaggcag

SEQ ID NO: 3585486 - RNA, 20 nt, Pseudomonas putida KT2440
acaacuuacaaaucaguaag

SEQ ID NO: 3585487 - RNA, 17 nt, Pseudomonas putida KT2440
acaagaacaacacggca

SEQ ID NO: 3585488 - RNA, 13 nt, Pseudomonas putida KT2440
acaagaacugcga

SEQ ID NO: 3585489 - RNA, 16 nt, Pseudomonas putida KT2440
acaagaucaagccccu

SEQ ID NO: 3585490 - RNA, 21 nt, Pseudomonas putida KT2440
acaagccaugugccuggcccg

SEQ ID NO: 3585491 - RNA, 16 nt, Pseudomonas putida KT2440
acaagccgacaaaaac

SEQ ID NO: 3585492 - RNA, 20 nt, Pseudomonas putida KT2440
acaagccgacaaaaacaaca

SEQ ID NO: 3585493 - RNA, 21 nt, Pseudomonas putida KT2440
acaagccgacaaaaacaacaa

SEQ ID NO: 3585494 - RNA, 15 nt, Pseudomonas putida KT2440
acaagccgcugggcu

SEQ ID NO: 3585495 - RNA, 18 nt, Pseudomonas putida KT2440
acaagcgcauugaucgcc

SEQ ID NO: 3585496 - RNA, 20 nt, Pseudomonas putida KT2440
acaagcgucccugcccgauc

SEQ ID NO: 3585497 - RNA, 23 nt, Pseudomonas putida KT2440
acaagcuggcacgugcaggagag

SEQ ID NO: 3585498 - RNA, 18 nt, Pseudomonas putida KT2440
acaaggccacuggcgucg

SEQ ID NO: 3585499 - RNA, 18 nt, Pseudomonas putida KT2440
acaaggccgcucccacag

SEQ ID NO: 3585500 - RNA, 23 nt, Pseudomonas putida KT2440
acaaggccgcucccacagguaau

SEQ ID NO: 3585501 - RNA, 23 nt, Pseudomonas putida KT2440
acaaggccuggcccaguacgcca

SEQ ID NO: 3585502 - RNA, 20 nt, Pseudomonas putida KT2440
acaaggcucaacuacccuga

SEQ ID NO: 3585503 - RNA, 16 nt, Pseudomonas putida KT2440
acaaggcucagcugau

SEQ ID NO: 3585504 - RNA, 13 nt, Pseudomonas putida KT2440
acaaggcugcgcc

SEQ ID NO: 3585505 - RNA, 22 nt, Pseudomonas putida KT2440
acaaggcuguuccacagcaguc

SEQ ID NO: 3585506 - RNA, 11 nt, Pseudomonas putida KT2440
acaagggccug

SEQ ID NO: 3585507 - RNA, 18 nt, Pseudomonas putida KT2440
acaagguaccccaccggc

SEQ ID NO: 3585508 - RNA, 15 nt, Pseudomonas putida KT2440
acaagguugcgcaag

SEQ ID NO: 3585509 - RNA, 15 nt, Pseudomonas putida KT2440
acaaguucauuacca

SEQ ID NO: 3585510 - RNA, 23 nt, Pseudomonas putida KT2440
acaaguuucaaaaacggugcaga

SEQ ID NO: 3585511 - RNA, 14 nt, Pseudomonas putida KT2440
acaaucgccaggua

SEQ ID NO: 3585512 - RNA, 18 nt, Pseudomonas putida KT2440
acaaugcacagcgcucga

SEQ ID NO: 3585513 - RNA, 15 nt, Pseudomonas putida KT2440
acacaaggccgcucc

SEQ ID NO: 3585514 - RNA, 22 nt, Pseudomonas putida KT2440
acacaccaugcccacaggggcu

SEQ ID NO: 3585515 - RNA, 17 nt, Pseudomonas putida KT2440
acacaccggguguugga

SEQ ID NO: 3585516 - RNA, 15 nt, Pseudomonas putida KT2440
acacagaugccgccg

SEQ ID NO: 3585517 - RNA, 22 nt, Pseudomonas putida KT2440
acacagaugccgccgcugccag

SEQ ID NO: 3585518 - RNA, 24 nt, Pseudomonas putida KT2440
acacagaugccgccgcugccagca

SEQ ID NO: 3585519 - RNA, 13 nt, Pseudomonas putida KT2440
acacagcaggcca

SEQ ID NO: 3585520 - RNA, 22 nt, Pseudomonas putida KT2440
acacagcauuacgcggcagcag

SEQ ID NO: 3585521 - RNA, 20 nt, Pseudomonas putida KT2440
acacagcccaaggcuggcca

SEQ ID NO: 3585522 - RNA, 21 nt, Pseudomonas putida KT2440
acacagguaguucacuggcca

SEQ ID NO: 3585523 - RNA, 13 nt, Pseudomonas putida KT2440
acacauaggcagc

SEQ ID NO: 3585524 - RNA, 19 nt, Pseudomonas putida KT2440
acacauagucgauacccag

SEQ ID NO: 3585525 - RNA, 14 nt, Pseudomonas putida KT2440
acacauaucagcca

SEQ ID NO: 3585526 - RNA, 14 nt, Pseudomonas putida KT2440
acacaucacgcaca

SEQ ID NO: 3585527 - RNA, 15 nt, Pseudomonas putida KT2440
acacauccagcgccg

SEQ ID NO: 3585528 - RNA, 16 nt, Pseudomonas putida KT2440
acacaucggucggccc

SEQ ID NO: 3585529 - RNA, 16 nt, Pseudomonas putida KT2440
acacauuauccaccag

SEQ ID NO: 3585530 - RNA, 17 nt, Pseudomonas putida KT2440
acacauuauccaccagg

SEQ ID NO: 3585531 - RNA, 15 nt, Pseudomonas putida KT2440
acaccacagcugcac

SEQ ID NO: 3585532 - RNA, 13 nt, Pseudomonas putida KT2440
acaccaccaguuc

SEQ ID NO: 3585533 - RNA, 23 nt, Pseudomonas putida KT2440
acaccacccggucggccagcugc

SEQ ID NO: 3585534 - RNA, 12 nt, Pseudomonas putida KT2440
acaccacgccaa

SEQ ID NO: 3585535 - RNA, 17 nt, Pseudomonas putida KT2440
acaccacugucagccag

SEQ ID NO: 3585536 - RNA, 20 nt, Pseudomonas putida KT2440
acaccagaaagcccgcauga

SEQ ID NO: 3585537 - RNA, 15 nt, Pseudomonas putida KT2440
acaccagacggccuu

SEQ ID NO: 3585538 - RNA, 21 nt, Pseudomonas putida KT2440
acaccagacucagcgcuugcc

SEQ ID NO: 3585539 - RNA, 12 nt, Pseudomonas putida KT2440
acaccagcagcc

SEQ ID NO: 3585540 - RNA, 19 nt, Pseudomonas putida KT2440
acaccagcauguccugcug

SEQ ID NO: 3585541 - RNA, 22 nt, Pseudomonas putida KT2440
acaccagcauguccugcugcag

SEQ ID NO: 3585542 - RNA, 17 nt, Pseudomonas putida KT2440
acaccagcgcaccacug

SEQ ID NO: 3585543 - RNA, 23 nt, Pseudomonas putida KT2440
acaccaggacaagccgacaaaaa

SEQ ID NO: 3585544 - RNA, 15 nt, Pseudomonas putida KT2440
acaccaguucaccau

SEQ ID NO: 3585545 - RNA, 17 nt, Pseudomonas putida KT2440
acaccaguucaccaucc

SEQ ID NO: 3585546 - RNA, 16 nt, Pseudomonas putida KT2440
acaccaucggccggcu

SEQ ID NO: 3585547 - RNA, 17 nt, Pseudomonas putida KT2440
acaccaucggccggcuc

SEQ ID NO: 3585548 - RNA, 18 nt, Pseudomonas putida KT2440
acaccaucuucaugcaau

SEQ ID NO: 3585549 - RNA, 19 nt, Pseudomonas putida KT2440
acaccaucuucaugcaaua

SEQ ID NO: 3585550 - RNA, 13 nt, Pseudomonas putida KT2440
acacccagcaccc

SEQ ID NO: 3585551 - RNA, 14 nt, Pseudomonas putida KT2440
acacccgccacgcu

SEQ ID NO: 3585552 - RNA, 15 nt, Pseudomonas putida KT2440
acacccgcuccaaca

SEQ ID NO: 3585553 - RNA, 21 nt, Pseudomonas putida KT2440
acacccggucgcucaacucca

SEQ ID NO: 3585554 - RNA, 15 nt, Pseudomonas putida KT2440
acacccucgacguug

SEQ ID NO: 3585555 - RNA, 20 nt, Pseudomonas putida KT2440
acacccucgccccgcgcaag

SEQ ID NO: 3585556 - RNA, 18 nt, Pseudomonas putida KT2440
acaccgacauccacgucc

SEQ ID NO: 3585557 - RNA, 14 nt, Pseudomonas putida KT2440
acaccgacgccgau

SEQ ID NO: 3585558 - RNA, 21 nt, Pseudomonas putida KT2440
acaccgacgccgaucaauguc

SEQ ID NO: 3585559 - RNA, 12 nt, Pseudomonas putida KT2440
acaccgccagcg

SEQ ID NO: 3585560 - RNA, 17 nt, Pseudomonas putida KT2440
acaccgccagcgggcug

SEQ ID NO: 3585561 - RNA, 22 nt, Pseudomonas putida KT2440
acaccgcccccaaaccgcugcc

SEQ ID NO: 3585562 - RNA, 17 nt, Pseudomonas putida KT2440
acaccgcgcaccucgac

SEQ ID NO: 3585563 - RNA, 21 nt, Pseudomonas putida KT2440
acaccgcguuaugacuggccu

SEQ ID NO: 3585564 - RNA, 23 nt, Pseudomonas putida KT2440
acaccggccccccagccagcaga

SEQ ID NO: 3585565 - RNA, 14 nt, Pseudomonas putida KT2440
acaccggccgccag

SEQ ID NO: 3585566 - RNA, 14 nt, Pseudomonas putida KT2440
acaccggccuugcg

SEQ ID NO: 3585567 - RNA, 21 nt, Pseudomonas putida KT2440
acaccggccuuggccagcuca

SEQ ID NO: 3585568 - RNA, 22 nt, Pseudomonas putida KT2440
acaccgggaacaggugcgcgcg

SEQ ID NO: 3585569 - RNA, 20 nt, Pseudomonas putida KT2440
acaccggguguuggacacag

SEQ ID NO: 3585570 - RNA, 21 nt, Pseudomonas putida KT2440
acaccggguguuggacacagg

SEQ ID NO: 3585571 - RNA, 21 nt, Pseudomonas putida KT2440
acaccguagcgagcaccggca

SEQ ID NO: 3585572 - RNA, 15 nt, Pseudomonas putida KT2440
acaccucccgcgcau

SEQ ID NO: 3585573 - RNA, 17 nt, Pseudomonas putida KT2440
acaccucccgcgcaucc

SEQ ID NO: 3585574 - RNA, 16 nt, Pseudomonas putida KT2440
acaccucgacccgccg

SEQ ID NO: 3585575 - RNA, 12 nt, Pseudomonas putida KT2440
acaccugcagcg

SEQ ID NO: 3585576 - RNA, 16 nt, Pseudomonas putida KT2440
acaccugccagccccg

SEQ ID NO: 3585577 - RNA, 13 nt, Pseudomonas putida KT2440
acaccugccgcga

SEQ ID NO: 3585578 - RNA, 14 nt, Pseudomonas putida KT2440
acacgaaaaagcca

SEQ ID NO: 3585579 - RNA, 16 nt, Pseudomonas putida KT2440
acacgaaaaagccagc

SEQ ID NO: 3585580 - RNA, 13 nt, Pseudomonas putida KT2440
acacgaacaccgg

SEQ ID NO: 3585581 - RNA, 19 nt, Pseudomonas putida KT2440
acacgaacaucagcaggaa

SEQ ID NO: 3585582 - RNA, 18 nt, Pseudomonas putida KT2440
acacgacgauggccacca

SEQ ID NO: 3585583 - RNA, 23 nt, Pseudomonas putida KT2440
acacgacgauggccaccagcacc

SEQ ID NO: 3585584 - RNA, 20 nt, Pseudomonas putida KT2440
acacgcccgugcucacgcac

SEQ ID NO: 3585585 - RNA, 17 nt, Pseudomonas putida KT2440
acacgcgcccuguggga

SEQ ID NO: 3585586 - RNA, 21 nt, Pseudomonas putida KT2440
acacgcucaugaacagcgccc

SEQ ID NO: 3585587 - RNA, 13 nt, Pseudomonas putida KT2440
acacgcuugcgaa

SEQ ID NO: 3585588 - RNA, 16 nt, Pseudomonas putida KT2440
acagcucacuggcauc

SEQ ID NO: 3585589 - RNA, 16 nt, Pseudomonas putida KT2440
acagcucacuggccaa

SEQ ID NO: 3585590 - RNA, 13 nt, Pseudomonas putida KT2440
acagcucauccag

SEQ ID NO: 3585591 - RNA, 20 nt, Pseudomonas putida KT2440
acagcucauccaggcugcac

SEQ ID NO: 3585592 - RNA, 21 nt, Pseudomonas putida KT2440
acagcuccagcaacugcgccg

SEQ ID NO: 3585593 - RNA, 18 nt, Pseudomonas putida KT2440
acagcucgaaaccggccu

SEQ ID NO: 3585594 - RNA, 19 nt, Pseudomonas putida KT2440
acagcucgacaacccgcgc

SEQ ID NO: 3585595 - RNA, 12 nt, Pseudomonas putida KT2440
acagcucgauca

SEQ ID NO: 3585596 - RNA, 13 nt, Pseudomonas putida KT2440
acagcucgaucag

SEQ ID NO: 3585597 - RNA, 16 nt, Pseudomonas putida KT2440
acagcucgauggccag

SEQ ID NO: 3585598 - RNA, 17 nt, Pseudomonas putida KT2440
acagcucgauggccagg

SEQ ID NO: 3585599 - RNA, 18 nt, Pseudomonas putida KT2440
acagcucgauggccagga

SEQ ID NO: 3585600 - RNA, 19 nt, Pseudomonas putida KT2440
acagcucgcgcugccaggc

SEQ ID NO: 3585601 - RNA, 19 nt, Pseudomonas putida KT2440
acagcucuggcagcagugc

SEQ ID NO: 3585602 - RNA, 20 nt, Pseudomonas putida KT2440
acagcugaucgccgucgacc

SEQ ID NO: 3585603 - RNA, 15 nt, Pseudomonas putida KT2440
acagcugcacaucuc

SEQ ID NO: 3585604 - RNA, 18 nt, Pseudomonas putida KT2440
acagcugccggccagcgc

SEQ ID NO: 3585605 - RNA, 14 nt, Pseudomonas putida KT2440
acagcugcggcaug

SEQ ID NO: 3585606 - RNA, 19 nt, Pseudomonas putida KT2440
acagcuggauggucacgcc

SEQ ID NO: 3585607 - RNA, 16 nt, Pseudomonas putida KT2440
acagcuggccuugcgg

SEQ ID NO: 3585608 - RNA, 21 nt, Pseudomonas putida KT2440
acagcugugugucgucacggc

SEQ ID NO: 3585609 - RNA, 15 nt, Pseudomonas putida KT2440
acagcuucugguugu

SEQ ID NO: 3585610 - RNA, 18 nt, Pseudomonas putida KT2440
acagcuucuugcaccgcu

SEQ ID NO: 3585611 - RNA, 19 nt, Pseudomonas putida KT2440
acagcuucuugcaccgcuc

SEQ ID NO: 3585612 - RNA, 15 nt, Pseudomonas putida KT2440
acagcuugcccagcu

SEQ ID NO: 3585613 - RNA, 17 nt, Pseudomonas putida KT2440
acagcuugcccagcugc

SEQ ID NO: 3585614 - RNA, 23 nt, Pseudomonas putida KT2440
acagcuugcccaucaccucgucg

SEQ ID NO: 3585615 - RNA, 21 nt, Pseudomonas putida KT2440
acagcuuguugccagcggcga

SEQ ID NO: 3585616 - RNA, 17 nt, Pseudomonas putida KT2440
acagcuuuuggagagcg

SEQ ID NO: 3585617 - RNA, 12 nt, Pseudomonas putida KT2440
acaggaccaggc

SEQ ID NO: 3585618 - RNA, 15 nt, Pseudomonas putida KT2440
acaggaccaggccga

SEQ ID NO: 3585619 - RNA, 19 nt, Pseudomonas putida KT2440
acaggaucuccucggccag

SEQ ID NO: 3585620 - RNA, 23 nt, Pseudomonas putida KT2440
acaggaucuccucggccagcggc

SEQ ID NO: 3585621 - RNA, 22 nt, Pseudomonas putida KT2440
acaggauggcaaagcgcagcaa

SEQ ID NO: 3585622 - RNA, 14 nt, Pseudomonas putida KT2440
acaggcaaagaaac

SEQ ID NO: 3585623 - RNA, 18 nt, Pseudomonas putida KT2440
acaggcaaccgcaucccc

SEQ ID NO: 3585624 - RNA, 18 nt, Pseudomonas putida KT2440
acaggcaauacaaggcuc

SEQ ID NO: 3585625 - RNA, 18 nt, Pseudomonas putida KT2440
acaggcacaggcccagca

SEQ ID NO: 3585626 - RNA, 17 nt, Pseudomonas putida KT2440
acaggcacgacugaaca

SEQ ID NO: 3585627 - RNA, 15 nt, Pseudomonas putida KT2440
acaggcagcaugacc

SEQ ID NO: 3585628 - RNA, 14 nt, Pseudomonas putida KT2440
acaggcccagcaug

SEQ ID NO: 3585629 - RNA, 18 nt, Pseudomonas putida KT2440
acaggcccugacaggcga

SEQ ID NO: 3585630 - RNA, 13 nt, Pseudomonas putida KT2440
acaggccggcugc

SEQ ID NO: 3585631 - RNA, 15 nt, Pseudomonas putida KT2440
acaggcgaugaaagc

SEQ ID NO: 3585632 - RNA, 12 nt, Pseudomonas putida KT2440
acaggcgcagca

SEQ ID NO: 3585633 - RNA, 22 nt, Pseudomonas putida KT2440
acaggcgcgugugcagguggau

SEQ ID NO: 3585634 - RNA, 16 nt, Pseudomonas putida KT2440
acaggcgcuugaagaa

SEQ ID NO: 3585635 - RNA, 17 nt, Pseudomonas putida KT2440
acaggcgcuugaagaag

SEQ ID NO: 3585636 - RNA, 18 nt, Pseudomonas putida KT2440
acaggcgcuugaagaagc

SEQ ID NO: 3585637 - RNA, 23 nt, Pseudomonas putida KT2440
acaggcggccgaucacucggcag

SEQ ID NO: 3585638 - RNA, 18 nt, Pseudomonas putida KT2440
acaggcguacaucagccu

SEQ ID NO: 3585639 - RNA, 21 nt, Pseudomonas putida KT2440
acaggcugucggcaugcacuu

SEQ ID NO: 3585640 - RNA, 17 nt, Pseudomonas putida KT2440
acaggcuucagccuucg

SEQ ID NO: 3585641 - RNA, 12 nt, Pseudomonas putida KT2440
acagggccuuga

SEQ ID NO: 3585642 - RNA, 20 nt, Pseudomonas putida KT2440
acagggccuugaucugcugc

SEQ ID NO: 3585643 - RNA, 21 nt, Pseudomonas putida KT2440
acagggcgcguguagcccgcu

SEQ ID NO: 3585644 - RNA, 11 nt, Pseudomonas putida KT2440
acaggggaugc

SEQ ID NO: 3585645 - RNA, 15 nt, Pseudomonas putida KT2440
acaggggccgcgcag

SEQ ID NO: 3585646 - RNA, 20 nt, Pseudomonas putida KT2440
acagguaagucacaggcuuc

SEQ ID NO: 3585647 - RNA, 22 nt, Pseudomonas putida KT2440
acagguaauacgcugugcucug

SEQ ID NO: 3585648 - RNA, 16 nt, Pseudomonas putida KT2440
acagguaauugguggu

SEQ ID NO: 3585649 - RNA, 19 nt, Pseudomonas putida KT2440
acagguaauugguggugcu

SEQ ID NO: 3585650 - RNA, 14 nt, Pseudomonas putida KT2440
acagguaccaggcu

SEQ ID NO: 3585651 - RNA, 20 nt, Pseudomonas putida KT2440
acagguacugagucggccuc

SEQ ID NO: 3585652 - RNA, 19 nt, Pseudomonas putida KT2440
acagguaggcgccacgccg

SEQ ID NO: 3585653 - RNA, 17 nt, Pseudomonas putida KT2440
acagguaguuggccggg

SEQ ID NO: 3585654 - RNA, 19 nt, Pseudomonas putida KT2440
acagguaucgccgcccuug

SEQ ID NO: 3585655 - RNA, 15 nt, Pseudomonas putida KT2440
acagguccagccgcc

SEQ ID NO: 3585656 - RNA, 20 nt, Pseudomonas putida KT2440
acagguccagcgcaggcuuc

SEQ ID NO: 3585657 - RNA, 19 nt, Pseudomonas putida KT2440
acaggugauagacguggcu

SEQ ID NO: 3585658 - RNA, 22 nt, Pseudomonas putida KT2440
acaggugcgcgcgcgacagcac

SEQ ID NO: 3585659 - RNA, 22 nt, Pseudomonas putida KT2440
acaggugcggcagcucgccgug

SEQ ID NO: 3585660 - RNA, 13 nt, Pseudomonas putida KT2440
acagguuaggguc

SEQ ID NO: 3585661 - RNA, 15 nt, Pseudomonas putida KT2440
acagguucggcucac

SEQ ID NO: 3585662 - RNA, 15 nt, Pseudomonas putida KT2440
acagguucucggcac

SEQ ID NO: 3585663 - RNA, 23 nt, Pseudomonas putida KT2440
acagguucuugcggugcaugcgc

SEQ ID NO: 3585664 - RNA, 15 nt, Pseudomonas putida KT2440
acagguugcgcgccg

SEQ ID NO: 3585665 - RNA, 15 nt, Pseudomonas putida KT2440
acagguugcggccau

SEQ ID NO: 3585666 - RNA, 22 nt, Pseudomonas putida KT2440
acagugcggcggcacugaugcc

SEQ ID NO: 3585667 - RNA, 17 nt, Pseudomonas putida KT2440
acagugcuuccagcagg

SEQ ID NO: 3585668 - RNA, 16 nt, Pseudomonas putida KT2440
acagugguguacagca

SEQ ID NO: 3585669 - RNA, 19 nt, Pseudomonas putida KT2440
acagugguguacagcaaca

SEQ ID NO: 3585670 - RNA, 17 nt, Pseudomonas putida KT2440
acaguucgaaaaccugc

SEQ ID NO: 3585671 - RNA, 18 nt, Pseudomonas putida KT2440
acaguucgaaaaccugcu

SEQ ID NO: 3585672 - RNA, 21 nt, Pseudomonas putida KT2440
acaguucgaaaaccugcugac

SEQ ID NO: 3585673 - RNA, 18 nt, Pseudomonas putida KT2440
acaguucgaaaccacccu

SEQ ID NO: 3585674 - RNA, 15 nt, Pseudomonas putida KT2440
acaguuggugggcaa

SEQ ID NO: 3585675 - RNA, 14 nt, Pseudomonas putida KT2440
acaguuucuugccu

SEQ ID NO: 3585676 - RNA, 23 nt, Pseudomonas putida KT2440
acaguuugcuuuuucgagcagcg

SEQ ID NO: 3585677 - RNA, 23 nt, Pseudomonas putida KT2440
acauaaaaaagccccggcucgca

SEQ ID NO: 3585678 - RNA, 19 nt, Pseudomonas putida KT2440
acauaaccccccacccagc

SEQ ID NO: 3585679 - RNA, 17 nt, Pseudomonas putida KT2440
acauaacugccggcaua

SEQ ID NO: 3585680 - RNA, 13 nt, Pseudomonas putida KT2440
acauacaccaacg

SEQ ID NO: 3585681 - RNA, 14 nt, Pseudomonas putida KT2440
acauaccacacacc

SEQ ID NO: 3585682 - RNA, 21 nt, Pseudomonas putida KT2440
acauaccacacaccccagaac

SEQ ID NO: 3585683 - RNA, 19 nt, Pseudomonas putida KT2440
acauaccgcugggcacccu

SEQ ID NO: 3585684 - RNA, 23 nt, Pseudomonas putida KT2440
acauacggcuugauauccagcac

SEQ ID NO: 3585685 - RNA, 16 nt, Pseudomonas putida KT2440
acauacugcuucugcc

SEQ ID NO: 3585686 - RNA, 18 nt, Pseudomonas putida KT2440
acauagcaggaucuagcc

SEQ ID NO: 3585687 - RNA, 13 nt, Pseudomonas putida KT2440
acaucaccagcag

SEQ ID NO: 3585688 - RNA, 14 nt, Pseudomonas putida KT2440
acaucaccagcagc

SEQ ID NO: 3585689 - RNA, 14 nt, Pseudomonas putida KT2440
acaucacggcgcag

SEQ ID NO: 3585690 - RNA, 19 nt, Pseudomonas putida KT2440
acaucacggcgcaggccga

SEQ ID NO: 3585691 - RNA, 22 nt, Pseudomonas putida KT2440
acaucacggcgcaggccgacaa

SEQ ID NO: 3585692 - RNA, 22 nt, Pseudomonas putida KT2440
acaucagccucggucagguacu

SEQ ID NO: 3585693 - RNA, 13 nt, Pseudomonas putida KT2440
accaccugggcca

SEQ ID NO: 3585694 - RNA, 23 nt, Pseudomonas putida KT2440
accaccuucucacugaugucguu

SEQ ID NO: 3585695 - RNA, 15 nt, Pseudomonas putida KT2440
accacgaccggcuca

SEQ ID NO: 3585696 - RNA, 21 nt, Pseudomonas putida KT2440
accacgaucuuggccagggcc

SEQ ID NO: 3585697 - RNA, 16 nt, Pseudomonas putida KT2440
accacgaugcccaugg

SEQ ID NO: 3585698 - RNA, 17 nt, Pseudomonas putida KT2440
accacgcccgccggcac

SEQ ID NO: 3585699 - RNA, 23 nt, Pseudomonas putida KT2440
accacgcccgccggcacuuccuc

SEQ ID NO: 3585700 - RNA, 13 nt, Pseudomonas putida KT2440
accacgccgaagc

SEQ ID NO: 3585701 - RNA, 13 nt, Pseudomonas putida KT2440
accacgccugcgc

SEQ ID NO: 3585702 - RNA, 14 nt, Pseudomonas putida KT2440
accacgccugcgcc

SEQ ID NO: 3585703 - RNA, 17 nt, Pseudomonas putida KT2440
accacgcgauuuuuuug

SEQ ID NO: 3585704 - RNA, 20 nt, Pseudomonas putida KT2440
accacgcgcaaaugcuugcc

SEQ ID NO: 3585705 - RNA, 15 nt, Pseudomonas putida KT2440
accacggccggggcc

SEQ ID NO: 3585706 - RNA, 17 nt, Pseudomonas putida KT2440
accacggccggggccug

SEQ ID NO: 3585707 - RNA, 14 nt, Pseudomonas putida KT2440
accacggccuggcc

SEQ ID NO: 3585708 - RNA, 13 nt, Pseudomonas putida KT2440
accacgguaccgg

SEQ ID NO: 3585709 - RNA, 21 nt, Pseudomonas putida KT2440
accacggucgaaccggucugc

SEQ ID NO: 3585710 - RNA, 18 nt, Pseudomonas putida KT2440
accacggucggccugcgc

SEQ ID NO: 3585711 - RNA, 18 nt, Pseudomonas putida KT2440
accacgguggugguuugu

SEQ ID NO: 3585712 - RNA, 15 nt, Pseudomonas putida KT2440
accacguacacacau

SEQ ID NO: 3585713 - RNA, 16 nt, Pseudomonas putida KT2440
accacguacacacauc

SEQ ID NO: 3585714 - RNA, 16 nt, Pseudomonas putida KT2440
accacguagugcuucu

SEQ ID NO: 3585715 - RNA, 18 nt, Pseudomonas putida KT2440
accacguagugcuucugc

SEQ ID NO: 3585716 - RNA, 19 nt, Pseudomonas putida KT2440
accacguccggccagcaac

SEQ ID NO: 3585717 - RNA, 21 nt, Pseudomonas putida KT2440
accacguccggccagcaacag

SEQ ID NO: 3585718 - RNA, 22 nt, Pseudomonas putida KT2440
accacguuauccagcugcaaca

SEQ ID NO: 3585719 - RNA, 12 nt, Pseudomonas putida KT2440
accacguugcgc

SEQ ID NO: 3585720 - RNA, 18 nt, Pseudomonas putida KT2440
accacguugcgcuugagc

SEQ ID NO: 3585721 - RNA, 12 nt, Pseudomonas putida KT2440
accacuccaggg

SEQ ID NO: 3585722 - RNA, 23 nt, Pseudomonas putida KT2440
accacuccagggucugcgcuuca

SEQ ID NO: 3585723 - RNA, 18 nt, Pseudomonas putida KT2440
accacugaugcgcgucca

SEQ ID NO: 3585724 - RNA, 22 nt, Pseudomonas putida KT2440
accacugaugcgcguccagccc

SEQ ID NO: 3585725 - RNA, 19 nt, Pseudomonas putida KT2440
accacugcaaauaccccag

SEQ ID NO: 3585726 - RNA, 23 nt, Pseudomonas putida KT2440
accacugcuucugagccagccgc

SEQ ID NO: 3585727 - RNA, 21 nt, Pseudomonas putida KT2440
accacuggaugacgccgcagc

SEQ ID NO: 3585728 - RNA, 16 nt, Pseudomonas putida KT2440
accacuggugccggca

SEQ ID NO: 3585729 - RNA, 19 nt, Pseudomonas putida KT2440
accacuucaagcacgccga

SEQ ID NO: 3585730 - RNA, 17 nt, Pseudomonas putida KT2440
accacuuccaacacccg

SEQ ID NO: 3585731 - RNA, 21 nt, Pseudomonas putida KT2440
accacuucuggcugggcuucg

SEQ ID NO: 3585732 - RNA, 22 nt, Pseudomonas putida KT2440
accacuugcucggugcugcugc

SEQ ID NO: 3585733 - RNA, 18 nt, Pseudomonas putida KT2440
accagaaacccagggcag

SEQ ID NO: 3585734 - RNA, 17 nt, Pseudomonas putida KT2440
accagaaccccggcccu

SEQ ID NO: 3585735 - RNA, 13 nt, Pseudomonas putida KT2440
accagaccagcag

SEQ ID NO: 3585736 - RNA, 14 nt, Pseudomonas putida KT2440
accagaccagcagc

SEQ ID NO: 3585737 - RNA, 21 nt, Pseudomonas putida KT2440
accagaccagcagcaguggca

SEQ ID NO: 3585738 - RNA, 22 nt, Pseudomonas putida KT2440
accagacccgcuucgccgcgcu

SEQ ID NO: 3585739 - RNA, 22 nt, Pseudomonas putida KT2440
accagaccuggaggucauguga

SEQ ID NO: 3585740 - RNA, 12 nt, Pseudomonas putida KT2440
accagagagcug

SEQ ID NO: 3585741 - RNA, 19 nt, Pseudomonas putida KT2440
accagauaacguccagagg

SEQ ID NO: 3585742 - RNA, 13 nt, Pseudomonas putida KT2440
accagcaacggcc

SEQ ID NO: 3585743 - RNA, 14 nt, Pseudomonas putida KT2440
accagcaacggccg

SEQ ID NO: 3585744 - RNA, 14 nt, Pseudomonas putida KT2440
accagcaccaccug

SEQ ID NO: 3585745 - RNA, 14 nt, Pseudomonas putida KT2440
accagcaccugcag

SEQ ID NO: 3585746 - RNA, 16 nt, Pseudomonas putida KT2440
accagcaccugcaggu

SEQ ID NO: 3585747 - RNA, 18 nt, Pseudomonas putida KT2440
accagcacugccuugccc

SEQ ID NO: 3585748 - RNA, 12 nt, Pseudomonas putida KT2440
accagcacugcu

SEQ ID NO: 3585749 - RNA, 15 nt, Pseudomonas putida KT2440
accagcacugcugcg

SEQ ID NO: 3585750 - RNA, 23 nt, Pseudomonas putida KT2440
accagcagaucaucgacuucaug

SEQ ID NO: 3585751 - RNA, 19 nt, Pseudomonas putida KT2440
accagcagcaccugccgcu

SEQ ID NO: 3585752 - RNA, 17 nt, Pseudomonas putida KT2440
accagcagcaguggcaa

SEQ ID NO: 3585753 - RNA, 19 nt, Pseudomonas putida KT2440
accagcagcaguggcaagc

SEQ ID NO: 3585754 - RNA, 18 nt, Pseudomonas putida KT2440
accagcagcgccugcagc

SEQ ID NO: 3585755 - RNA, 17 nt, Pseudomonas putida KT2440
accagcaggcugcgugc

SEQ ID NO: 3585756 - RNA, 21 nt, Pseudomonas putida KT2440
accagcaggcugcgugccugc

SEQ ID NO: 3585757 - RNA, 21 nt, Pseudomonas putida KT2440
accagcaggucggcacgcacc

SEQ ID NO: 3585758 - RNA, 22 nt, Pseudomonas putida KT2440
accagcaggucggcacgcaccu

SEQ ID NO: 3585759 - RNA, 13 nt, Pseudomonas putida KT2440
accagcagugccc

SEQ ID NO: 3585760 - RNA, 23 nt, Pseudomonas putida KT2440
accagcagugucagcccauccag

SEQ ID NO: 3585761 - RNA, 14 nt, Pseudomonas putida KT2440
accagcaucaacag

SEQ ID NO: 3585762 - RNA, 16 nt, Pseudomonas putida KT2440
accagccaaacccggc

SEQ ID NO: 3585763 - RNA, 17 nt, Pseudomonas putida KT2440
accagccaaacccggcc

SEQ ID NO: 3585764 - RNA, 13 nt, Pseudomonas putida KT2440
accagccccagcc

SEQ ID NO: 3585765 - RNA, 14 nt, Pseudomonas putida KT2440
accagccccagcgc

SEQ ID NO: 3585766 - RNA, 16 nt, Pseudomonas putida KT2440
accagccccagcgccu

SEQ ID NO: 3585767 - RNA, 21 nt, Pseudomonas putida KT2440
accagcccgaacgacacggca

SEQ ID NO: 3585768 - RNA, 15 nt, Pseudomonas putida KT2440
accagcccgccgcca

SEQ ID NO: 3585769 - RNA, 16 nt, Pseudomonas putida KT2440
accagcccggcccaua

SEQ ID NO: 3585770 - RNA, 23 nt, Pseudomonas putida KT2440
accagcccggcuccgcgcaagcg

SEQ ID NO: 3585771 - RNA, 18 nt, Pseudomonas putida KT2440
accagccggcaauuuccu

SEQ ID NO: 3585772 - RNA, 17 nt, Pseudomonas putida KT2440
accagcgacugcaagcg

SEQ ID NO: 3585773 - RNA, 13 nt, Pseudomonas putida KT2440
accagcgccccgc

SEQ ID NO: 3585774 - RNA, 14 nt, Pseudomonas putida KT2440
accagcgccccgcc

SEQ ID NO: 3585775 - RNA, 13 nt, Pseudomonas putida KT2440
accagcgccgcau

SEQ ID NO: 3585776 - RNA, 17 nt, Pseudomonas putida KT2440
accagcgccgcaucgcc

SEQ ID NO: 3585777 - RNA, 17 nt, Pseudomonas putida KT2440
accagcgcgaucaccag

SEQ ID NO: 3585778 - RNA, 11 nt, Pseudomonas putida KT2440
accagcgcugc

SEQ ID NO: 3585779 - RNA, 18 nt, Pseudomonas putida KT2440
accagcgcugccgccuug

SEQ ID NO: 3585780 - RNA, 14 nt, Pseudomonas putida KT2440
accagcggaucacc

SEQ ID NO: 3585781 - RNA, 20 nt, Pseudomonas putida KT2440
accagcggcucgcucaggcg

SEQ ID NO: 3585782 - RNA, 17 nt, Pseudomonas putida KT2440
accagcgggcccagcag

SEQ ID NO: 3585783 - RNA, 17 nt, Pseudomonas putida KT2440
accagcguugucccgcc

SEQ ID NO: 3585784 - RNA, 21 nt, Pseudomonas putida KT2440
accagcucacgcaagcggccc

SEQ ID NO: 3585785 - RNA, 19 nt, Pseudomonas putida KT2440
accagcucauccaucaccu

SEQ ID NO: 3585786 - RNA, 23 nt, Pseudomonas putida KT2440
accagcucauccaucaccugccc

SEQ ID NO: 3585787 - RNA, 22 nt, Pseudomonas putida KT2440
accagcuccaacaagucuuccc

SEQ ID NO: 3585788 - RNA, 19 nt, Pseudomonas putida KT2440
accagcucguucaacaccu

SEQ ID NO: 3585789 - RNA, 13 nt, Pseudomonas putida KT2440
accagcugcacca

SEQ ID NO: 3585790 - RNA, 16 nt, Pseudomonas putida KT2440
accagcugcaccaccu

SEQ ID NO: 3585791 - RNA, 12 nt, Pseudomonas putida KT2440
accagcugccau

SEQ ID NO: 3585792 - RNA, 20 nt, Pseudomonas putida KT2440
accagcuugugaucccgcga

SEQ ID NO: 3585793 - RNA, 14 nt, Pseudomonas putida KT2440
accaggaagcuggg

SEQ ID NO: 3585794 - RNA, 23 nt, Pseudomonas putida KT2440
accaggacuucccggcaccgcuu

SEQ ID NO: 3585795 - RNA, 17 nt, Pseudomonas putida KT2440
accaggauuggccgcaa

SEQ ID NO: 3585796 - RNA, 21 nt, Pseudomonas putida KT2440
accaggcaauugugccgcgcc

SEQ ID NO: 3585797 - RNA, 12 nt, Pseudomonas putida KT2440
accaggcaccga

SEQ ID NO: 3585798 - RNA, 19 nt, Pseudomonas putida KT2440
acccagcguauagccaccg

SEQ ID NO: 3585799 - RNA, 16 nt, Pseudomonas putida KT2440
acccagcucgccaaca

SEQ ID NO: 3585800 - RNA, 21 nt, Pseudomonas putida KT2440
acccaggcccugacgccagcg

SEQ ID NO: 3585801 - RNA, 22 nt, Pseudomonas putida KT2440
acccaggcccugacgccagcgc

SEQ ID NO: 3585802 - RNA, 17 nt, Pseudomonas putida KT2440
acccaggcgcgccugca

SEQ ID NO: 3585803 - RNA, 18 nt, Pseudomonas putida KT2440
acccagguacgaagccau

SEQ ID NO: 3585804 - RNA, 20 nt, Pseudomonas putida KT2440
acccagguacgaagccaugu

SEQ ID NO: 3585805 - RNA, 17 nt, Pseudomonas putida KT2440
acccaggugaucgccac

SEQ ID NO: 3585806 - RNA, 17 nt, Pseudomonas putida KT2440
acccaggugaugcaggc

SEQ ID NO: 3585807 - RNA, 15 nt, Pseudomonas putida KT2440
acccaguacggcgcc

SEQ ID NO: 3585808 - RNA, 16 nt, Pseudomonas putida KT2440
acccagucaccuugcu

SEQ ID NO: 3585809 - RNA, 22 nt, Pseudomonas putida KT2440
acccagucgccccgccagcgcc

SEQ ID NO: 3585810 - RNA, 14 nt, Pseudomonas putida KT2440
acccaguucgcgga

SEQ ID NO: 3585811 - RNA, 18 nt, Pseudomonas putida KT2440
acccaucucgaucauguc

SEQ ID NO: 3585812 - RNA, 13 nt, Pseudomonas putida KT2440
acccaucugcucg

SEQ ID NO: 3585813 - RNA, 14 nt, Pseudomonas putida KT2440
acccaucugcucgc

SEQ ID NO: 3585814 - RNA, 20 nt, Pseudomonas putida KT2440
acccaucugcucgccaucug

SEQ ID NO: 3585815 - RNA, 17 nt, Pseudomonas putida KT2440
acccaugccacccauau

SEQ ID NO: 3585816 - RNA, 18 nt, Pseudomonas putida KT2440
accccaaaccgcucgaag

SEQ ID NO: 3585817 - RNA, 20 nt, Pseudomonas putida KT2440
accccaacccggucccgccc

SEQ ID NO: 3585818 - RNA, 22 nt, Pseudomonas putida KT2440
accccaaggcugccaaucaacc

SEQ ID NO: 3585819 - RNA, 15 nt, Pseudomonas putida KT2440
accccaccagcacug

SEQ ID NO: 3585820 - RNA, 16 nt, Pseudomonas putida KT2440
accccaccagcacugc

SEQ ID NO: 3585821 - RNA, 16 nt, Pseudomonas putida KT2440
accccaccccagcguu

SEQ ID NO: 3585822 - RNA, 17 nt, Pseudomonas putida KT2440
accccacccuugaagac

SEQ ID NO: 3585823 - RNA, 12 nt, Pseudomonas putida KT2440
accccaccgcgg

SEQ ID NO: 3585824 - RNA, 17 nt, Pseudomonas putida KT2440
accccagaacggcacgc

SEQ ID NO: 3585825 - RNA, 12 nt, Pseudomonas putida KT2440
accccagcaagg

SEQ ID NO: 3585826 - RNA, 21 nt, Pseudomonas putida KT2440
accccagcaugaaccgcuccg

SEQ ID NO: 3585827 - RNA, 15 nt, Pseudomonas putida KT2440
accccagcccgaagc

SEQ ID NO: 3585828 - RNA, 15 nt, Pseudomonas putida KT2440
accccagcguuccug

SEQ ID NO: 3585829 - RNA, 22 nt, Pseudomonas putida KT2440
accccagggcaucgaucccugg

SEQ ID NO: 3585830 - RNA, 23 nt, Pseudomonas putida KT2440
accccaguugaucaacccgugcc

SEQ ID NO: 3585831 - RNA, 21 nt, Pseudomonas putida KT2440
accccauaacgcccacguuca

SEQ ID NO: 3585832 - RNA, 20 nt, Pseudomonas putida KT2440
accccauaccucuucacugc

SEQ ID NO: 3585833 - RNA, 21 nt, Pseudomonas putida KT2440
accccauagggccagcggcuu

SEQ ID NO: 3585834 - RNA, 18 nt, Pseudomonas putida KT2440
accccaucaccuuggccg

SEQ ID NO: 3585835 - RNA, 22 nt, Pseudomonas putida KT2440
accccauccacaucgccaggug

SEQ ID NO: 3585836 - RNA, 16 nt, Pseudomonas putida KT2440
accccauguggcgcag

SEQ ID NO: 3585837 - RNA, 14 nt, Pseudomonas putida KT2440
acccccacgaacac

SEQ ID NO: 3585838 - RNA, 14 nt, Pseudomonas putida KT2440
acccccagcgacca

SEQ ID NO: 3585839 - RNA, 12 nt, Pseudomonas putida KT2440
acccccagcgcc

SEQ ID NO: 3585840 - RNA, 18 nt, Pseudomonas putida KT2440
accccccagcagcgggca

SEQ ID NO: 3585841 - RNA, 12 nt, Pseudomonas putida KT2440
accccccugcac

SEQ ID NO: 3585842 - RNA, 14 nt, Pseudomonas putida KT2440
accccccugcacca

SEQ ID NO: 3585843 - RNA, 19 nt, Pseudomonas putida KT2440
acccccgccgccagggcaa

SEQ ID NO: 3585844 - RNA, 11 nt, Pseudomonas putida KT2440
acccccgcucc

SEQ ID NO: 3585845 - RNA, 15 nt, Pseudomonas putida KT2440
acccccgcuccuacg

SEQ ID NO: 3585846 - RNA, 19 nt, Pseudomonas putida KT2440
acccccguaggagcggguu

SEQ ID NO: 3585847 - RNA, 16 nt, Pseudomonas putida KT2440
acccccuucaaugccg

SEQ ID NO: 3585848 - RNA, 20 nt, Pseudomonas putida KT2440
acccccuucaaugccgggaa

SEQ ID NO: 3585849 - RNA, 16 nt, Pseudomonas putida KT2440
accccgaguguuucaa

SEQ ID NO: 3585850 - RNA, 16 nt, Pseudomonas putida KT2440
accccgaugcgcugau

SEQ ID NO: 3585851 - RNA, 17 nt, Pseudomonas putida KT2440
accccgcaaagcccugc

SEQ ID NO: 3585852 - RNA, 11 nt, Pseudomonas putida KT2440
accccgcagac

SEQ ID NO: 3585853 - RNA, 17 nt, Pseudomonas putida KT2440
accccgcaggccgcagc

SEQ ID NO: 3585854 - RNA, 18 nt, Pseudomonas putida KT2440
accccgcaggccgcagcc

SEQ ID NO: 3585855 - RNA, 14 nt, Pseudomonas putida KT2440
accccgccccugcu

SEQ ID NO: 3585856 - RNA, 15 nt, Pseudomonas putida KT2440
accccgccgcuggcu

SEQ ID NO: 3585857 - RNA, 17 nt, Pseudomonas putida KT2440
accccgccuguuggcac

SEQ ID NO: 3585858 - RNA, 16 nt, Pseudomonas putida KT2440
accccgcugccugcgc

SEQ ID NO: 3585859 - RNA, 23 nt, Pseudomonas putida KT2440
accccgcuucggcgggguuuuuu

SEQ ID NO: 3585860 - RNA, 14 nt, Pseudomonas putida KT2440
accccggcacaggg

SEQ ID NO: 3585861 - RNA, 11 nt, Pseudomonas putida KT2440
accccgggcac

SEQ ID NO: 3585862 - RNA, 22 nt, Pseudomonas putida KT2440
accccgggcacaugcagguugc

SEQ ID NO: 3585863 - RNA, 14 nt, Pseudomonas putida KT2440
accccguacacccg

SEQ ID NO: 3585864 - RNA, 22 nt, Pseudomonas putida KT2440
accccguguacgacugccgccc

SEQ ID NO: 3585865 - RNA, 14 nt, Pseudomonas putida KT2440
accccuccagcaca

SEQ ID NO: 3585866 - RNA, 20 nt, Pseudomonas putida KT2440
accccuccuucagguaaucc

SEQ ID NO: 3585867 - RNA, 18 nt, Pseudomonas putida KT2440
accccucgacgccuuggc

SEQ ID NO: 3585868 - RNA, 18 nt, Pseudomonas putida KT2440
accccucggcucacgccc

SEQ ID NO: 3585869 - RNA, 14 nt, Pseudomonas putida KT2440
accccugccaccag

SEQ ID NO: 3585870 - RNA, 20 nt, Pseudomonas putida KT2440
accccuggaaacccuugcgc

SEQ ID NO: 3585871 - RNA, 16 nt, Pseudomonas putida KT2440
accccuucaucaccca

SEQ ID NO: 3585872 - RNA, 15 nt, Pseudomonas putida KT2440
accccuucauccgcg

SEQ ID NO: 3585873 - RNA, 15 nt, Pseudomonas putida KT2440
accccuuccagcuuc

SEQ ID NO: 3585874 - RNA, 18 nt, Pseudomonas putida KT2440
accccuuccagcuucugc

SEQ ID NO: 3585875 - RNA, 20 nt, Pseudomonas putida KT2440
accccuucggcaaucaccgc

SEQ ID NO: 3585876 - RNA, 19 nt, Pseudomonas putida KT2440
accccuucguagacgaagc

SEQ ID NO: 3585877 - RNA, 18 nt, Pseudomonas putida KT2440
accccuugcucaaccggu

SEQ ID NO: 3585878 - RNA, 17 nt, Pseudomonas putida KT2440
accccuuuacuggccau

SEQ ID NO: 3585879 - RNA, 14 nt, Pseudomonas putida KT2440
acccgaacaaaacc

SEQ ID NO: 3585880 - RNA, 17 nt, Pseudomonas putida KT2440
acccgacaacagcugca

SEQ ID NO: 3585881 - RNA, 15 nt, Pseudomonas putida KT2440
acccgaccagaucag

SEQ ID NO: 3585882 - RNA, 16 nt, Pseudomonas putida KT2440
acccgaccagaucagg

SEQ ID NO: 3585883 - RNA, 15 nt, Pseudomonas putida KT2440
acccgacgccaccuu

SEQ ID NO: 3585884 - RNA, 16 nt, Pseudomonas putida KT2440
acccgauuacaagggc

SEQ ID NO: 3585885 - RNA, 18 nt, Pseudomonas putida KT2440
acccgcacaugccugcac

SEQ ID NO: 3585886 - RNA, 20 nt, Pseudomonas putida KT2440
acccgcaggcgacgagccag

SEQ ID NO: 3585887 - RNA, 22 nt, Pseudomonas putida KT2440
acccgcaggcgacgagccaguu

SEQ ID NO: 3585888 - RNA, 19 nt, Pseudomonas putida KT2440
acccgcauaaccaccaccg

SEQ ID NO: 3585889 - RNA, 20 nt, Pseudomonas putida KT2440
acccgcaucaucacgcgcaa

SEQ ID NO: 3585890 - RNA, 13 nt, Pseudomonas putida KT2440
acccgccacccca

SEQ ID NO: 3585891 - RNA, 20 nt, Pseudomonas putida KT2440
acccgcccaucgcacacccu

SEQ ID NO: 3585892 - RNA, 22 nt, Pseudomonas putida KT2440
acccgcccaucgcacacccugu

SEQ ID NO: 3585893 - RNA, 14 nt, Pseudomonas putida KT2440
acccgccgcuucgc

SEQ ID NO: 3585894 - RNA, 13 nt, Pseudomonas putida KT2440
acccgccgguugc

SEQ ID NO: 3585895 - RNA, 21 nt, Pseudomonas putida KT2440
acccgccguucacuguugccg

SEQ ID NO: 3585896 - RNA, 14 nt, Pseudomonas putida KT2440
acccgccugacgcc

SEQ ID NO: 3585897 - RNA, 20 nt, Pseudomonas putida KT2440
acccgccuggugccagcggc

SEQ ID NO: 3585898 - RNA, 22 nt, Pseudomonas putida KT2440
acccgccuggugccagcggcca

SEQ ID NO: 3585899 - RNA, 15 nt, Pseudomonas putida KT2440
acccgcgaaagggcc

SEQ ID NO: 3585900 - RNA, 19 nt, Pseudomonas putida KT2440
acccgcgaaagggccagca

SEQ ID NO: 3585901 - RNA, 22 nt, Pseudomonas putida KT2440
acccgcgaaagggccgcaacgc

SEQ ID NO: 3585902 - RNA, 21 nt, Pseudomonas putida KT2440
acccgcgaaagggccggcccu

SEQ ID NO: 3585903 - RNA, 21 nt, Pseudomonas putida KT2440
acccgcgaaagggccgggccu

SEQ ID NO: 3585904 - RNA, 13 nt, Pseudomonas putida KT2440
acccuugggcuca

SEQ ID NO: 3585905 - RNA, 16 nt, Pseudomonas putida KT2440
acccuugggcucagcc

SEQ ID NO: 3585906 - RNA, 23 nt, Pseudomonas putida KT2440
acccuuuaggggcucuucgcggg

SEQ ID NO: 3585907 - RNA, 23 nt, Pseudomonas putida KT2440
acccuuuuaucugguugccgcca

SEQ ID NO: 3585908 - RNA, 16 nt, Pseudomonas putida KT2440
accgaacagcaccgcc

SEQ ID NO: 3585909 - RNA, 19 nt, Pseudomonas putida KT2440
accgaacagcaccgccaug

SEQ ID NO: 3585910 - RNA, 21 nt, Pseudomonas putida KT2440
accgaacagcaccgccauggc

SEQ ID NO: 3585911 - RNA, 13 nt, Pseudomonas putida KT2440
accgaacccgcug

SEQ ID NO: 3585912 - RNA, 17 nt, Pseudomonas putida KT2440
accgaacccgcugccac

SEQ ID NO: 3585913 - RNA, 12 nt, Pseudomonas putida KT2440
accgaaccggcg

SEQ ID NO: 3585914 - RNA, 19 nt, Pseudomonas putida KT2440
accgaacuuguaaggcucg

SEQ ID NO: 3585915 - RNA, 20 nt, Pseudomonas putida KT2440
accgaaggccgccggcaacu

SEQ ID NO: 3585916 - RNA, 24 nt, Pseudomonas putida KT2440
accgacacauaaccccccacccag

SEQ ID NO: 3585917 - RNA, 13 nt, Pseudomonas putida KT2440
accgacagcaacg

SEQ ID NO: 3585918 - RNA, 15 nt, Pseudomonas putida KT2440
accgacauccacguc

SEQ ID NO: 3585919 - RNA, 13 nt, Pseudomonas putida KT2440
accgaccaaacca

SEQ ID NO: 3585920 - RNA, 14 nt, Pseudomonas putida KT2440
accgaccaaaccac

SEQ ID NO: 3585921 - RNA, 16 nt, Pseudomonas putida KT2440
accgaccaccugcucg

SEQ ID NO: 3585922 - RNA, 15 nt, Pseudomonas putida KT2440
accgacccacaggca

SEQ ID NO: 3585923 - RNA, 19 nt, Pseudomonas putida KT2440
accgacccacaggcacagg

SEQ ID NO: 3585924 - RNA, 11 nt, Pseudomonas putida KT2440
accgacccugc

SEQ ID NO: 3585925 - RNA, 15 nt, Pseudomonas putida KT2440
accgaccugugucca

SEQ ID NO: 3585926 - RNA, 18 nt, Pseudomonas putida KT2440
accgacgcauucgcgggu

SEQ ID NO: 3585927 - RNA, 14 nt, Pseudomonas putida KT2440
accgacgccaggaa

SEQ ID NO: 3585928 - RNA, 16 nt, Pseudomonas putida KT2440
accgagaacaggcggc

SEQ ID NO: 3585929 - RNA, 23 nt, Pseudomonas putida KT2440
accgagaacaggcggcccggcac

SEQ ID NO: 3585930 - RNA, 16 nt, Pseudomonas putida KT2440
accgagacgaucacca

SEQ ID NO: 3585931 - RNA, 22 nt, Pseudomonas putida KT2440
accgagacgaucaccagguugc

SEQ ID NO: 3585932 - RNA, 15 nt, Pseudomonas putida KT2440
accgagaucucggua

SEQ ID NO: 3585933 - RNA, 13 nt, Pseudomonas putida KT2440
accgagaugaucg

SEQ ID NO: 3585934 - RNA, 19 nt, Pseudomonas putida KT2440
accgagcccggguugaccu

SEQ ID NO: 3585935 - RNA, 12 nt, Pseudomonas putida KT2440
accgagcgccgc

SEQ ID NO: 3585936 - RNA, 13 nt, Pseudomonas putida KT2440
accgagcgccgcg

SEQ ID NO: 3585937 - RNA, 16 nt, Pseudomonas putida KT2440
accgaggaggaggcug

SEQ ID NO: 3585938 - RNA, 18 nt, Pseudomonas putida KT2440
accgaggaggaggcuggg

SEQ ID NO: 3585939 - RNA, 14 nt, Pseudomonas putida KT2440
accgaggggccgcu

SEQ ID NO: 3585940 - RNA, 18 nt, Pseudomonas putida KT2440
accgagguaccaccggag

SEQ ID NO: 3585941 - RNA, 19 nt, Pseudomonas putida KT2440
accgagguaccaccggagg

SEQ ID NO: 3585942 - RNA, 17 nt, Pseudomonas putida KT2440
accgagugcccgcgcag

SEQ ID NO: 3585943 - RNA, 18 nt, Pseudomonas putida KT2440
accgauaaagagaagcug

SEQ ID NO: 3585944 - RNA, 20 nt, Pseudomonas putida KT2440
accgaucacggggcgacgca

SEQ ID NO: 3585945 - RNA, 19 nt, Pseudomonas putida KT2440
accgaucaugaacaugccc

SEQ ID NO: 3585946 - RNA, 23 nt, Pseudomonas putida KT2440
accgaucucgccagccugcagcg

SEQ ID NO: 3585947 - RNA, 16 nt, Pseudomonas putida KT2440
accgaugcggugcagc

SEQ ID NO: 3585948 - RNA, 20 nt, Pseudomonas putida KT2440
accgaugcggugcagcaccu

SEQ ID NO: 3585949 - RNA, 20 nt, Pseudomonas putida KT2440
accgauggugugguagcugu

SEQ ID NO: 3585950 - RNA, 19 nt, Pseudomonas putida KT2440
accgauuaccuguuucuug

SEQ ID NO: 3585951 - RNA, 15 nt, Pseudomonas putida KT2440
accgcaaaucacuga

SEQ ID NO: 3585952 - RNA, 19 nt, Pseudomonas putida KT2440
accgcaaaucacugacccg

SEQ ID NO: 3585953 - RNA, 16 nt, Pseudomonas putida KT2440
accgcaaaugcugcca

SEQ ID NO: 3585954 - RNA, 17 nt, Pseudomonas putida KT2440
accgcaacaccugccgc

SEQ ID NO: 3585955 - RNA, 18 nt, Pseudomonas putida KT2440
accgcaacaccugccgca

SEQ ID NO: 3585956 - RNA, 23 nt, Pseudomonas putida KT2440
accgcaacaccugccgcagcugg

SEQ ID NO: 3585957 - RNA, 16 nt, Pseudomonas putida KT2440
accgcaacccagcccc

SEQ ID NO: 3585958 - RNA, 20 nt, Pseudomonas putida KT2440
accgcaacuggcccgcgcca

SEQ ID NO: 3585959 - RNA, 21 nt, Pseudomonas putida KT2440
accgcaacuggcccgcgccag

SEQ ID NO: 3585960 - RNA, 14 nt, Pseudomonas putida KT2440
accgcaagcugcac

SEQ ID NO: 3585961 - RNA, 16 nt, Pseudomonas putida KT2440
accgcaagcugcaccg

SEQ ID NO: 3585962 - RNA, 16 nt, Pseudomonas putida KT2440
accgcacccgcaagcg

SEQ ID NO: 3585963 - RNA, 20 nt, Pseudomonas putida KT2440
accgcacccgcaagcgccga

SEQ ID NO: 3585964 - RNA, 13 nt, Pseudomonas putida KT2440
accgcacccggcu

SEQ ID NO: 3585965 - RNA, 14 nt, Pseudomonas putida KT2440
accgcacccggcua

SEQ ID NO: 3585966 - RNA, 15 nt, Pseudomonas putida KT2440
accgcacccggcuac

SEQ ID NO: 3585967 - RNA, 16 nt, Pseudomonas putida KT2440
accgcaccggccaccg

SEQ ID NO: 3585968 - RNA, 17 nt, Pseudomonas putida KT2440
accgcacuccccaucag

SEQ ID NO: 3585969 - RNA, 18 nt, Pseudomonas putida KT2440
accgcacuccccaucagc

SEQ ID NO: 3585970 - RNA, 23 nt, Pseudomonas putida KT2440
accgcacuccccaucagcagcug

SEQ ID NO: 3585971 - RNA, 16 nt, Pseudomonas putida KT2440
accgcacucugcugcu

SEQ ID NO: 3585972 - RNA, 21 nt, Pseudomonas putida KT2440
accgcacucugcugcucugcc

SEQ ID NO: 3585973 - RNA, 20 nt, Pseudomonas putida KT2440
accgcacugugcuggggcca

SEQ ID NO: 3585974 - RNA, 23 nt, Pseudomonas putida KT2440
accgcagaucggugcguaggagc

SEQ ID NO: 3585975 - RNA, 15 nt, Pseudomonas putida KT2440
accgcagccccagcu

SEQ ID NO: 3585976 - RNA, 15 nt, Pseudomonas putida KT2440
accgcaggucacugc

SEQ ID NO: 3585977 - RNA, 23 nt, Pseudomonas putida KT2440
accgcaggugcaggcucggccac

SEQ ID NO: 3585978 - RNA, 17 nt, Pseudomonas putida KT2440
accgcaucccaaugugg

SEQ ID NO: 3585979 - RNA, 17 nt, Pseudomonas putida KT2440
accgcauccgcacccca

SEQ ID NO: 3585980 - RNA, 22 nt, Pseudomonas putida KT2440
accgcauccgcaccccaaggcu

SEQ ID NO: 3585981 - RNA, 12 nt, Pseudomonas putida KT2440
accgcaucucca

SEQ ID NO: 3585982 - RNA, 23 nt, Pseudomonas putida KT2440
accgcauucuuggccaggauggc

SEQ ID NO: 3585983 - RNA, 16 nt, Pseudomonas putida KT2440
accgcauugcaggcca

SEQ ID NO: 3585984 - RNA, 17 nt, Pseudomonas putida KT2440
accgcauugcaggccag

SEQ ID NO: 3585985 - RNA, 21 nt, Pseudomonas putida KT2440
accgcauugcaggccagcguc

SEQ ID NO: 3585986 - RNA, 17 nt, Pseudomonas putida KT2440
accgccaacgaaucagc

SEQ ID NO: 3585987 - RNA, 14 nt, Pseudomonas putida KT2440
accgccaaggcacg

SEQ ID NO: 3585988 - RNA, 21 nt, Pseudomonas putida KT2440
accgccaccaucggccaggaa

SEQ ID NO: 3585989 - RNA, 20 nt, Pseudomonas putida KT2440
accgccaccaugcucaccgc

SEQ ID NO: 3585990 - RNA, 19 nt, Pseudomonas putida KT2440
accgccacugaccagcccg

SEQ ID NO: 3585991 - RNA, 20 nt, Pseudomonas putida KT2440
accgccacugaccagcccgg

SEQ ID NO: 3585992 - RNA, 12 nt, Pseudomonas putida KT2440
accgccagcacc

SEQ ID NO: 3585993 - RNA, 15 nt, Pseudomonas putida KT2440
accgccagcccgcca

SEQ ID NO: 3585994 - RNA, 15 nt, Pseudomonas putida KT2440
accgccagcgggcug

SEQ ID NO: 3585995 - RNA, 16 nt, Pseudomonas putida KT2440
accgccagcuccacca

SEQ ID NO: 3585996 - RNA, 13 nt, Pseudomonas putida KT2440
accgccaggucca

SEQ ID NO: 3585997 - RNA, 20 nt, Pseudomonas putida KT2440
accgccagguccaggcugcg

SEQ ID NO: 3585998 - RNA, 21 nt, Pseudomonas putida KT2440
accgccagguccaggcugcgc

SEQ ID NO: 3585999 - RNA, 14 nt, Pseudomonas putida KT2440
accgccauggccag

SEQ ID NO: 3586000 - RNA, 17 nt, Pseudomonas putida KT2440
accgccauggccagguc

SEQ ID NO: 3586001 - RNA, 21 nt, Pseudomonas putida KT2440
accgccauugacuaccaggua

SEQ ID NO: 3586002 - RNA, 21 nt, Pseudomonas putida KT2440
accgcccagguuauacgccgc

SEQ ID NO: 3586003 - RNA, 13 nt, Pseudomonas putida KT2440
accgccccagcgc

SEQ ID NO: 3586004 - RNA, 15 nt, Pseudomonas putida KT2440
accgccccagcgcgc

SEQ ID NO: 3586005 - RNA, 20 nt, Pseudomonas putida KT2440
accgccccagcgcgccagca

SEQ ID NO: 3586006 - RNA, 15 nt, Pseudomonas putida KT2440
accgccccggccagu

SEQ ID NO: 3586007 - RNA, 21 nt, Pseudomonas putida KT2440
accgccgaucgaagcagcagc

SEQ ID NO: 3586008 - RNA, 22 nt, Pseudomonas putida KT2440
accgccgaucgaagcagcagcu

SEQ ID NO: 3586009 - RNA, 19 nt, Pseudomonas putida KT2440
accugcacacugcccagca

SEQ ID NO: 3586010 - RNA, 20 nt, Pseudomonas putida KT2440
accugcacacugcccagcag

SEQ ID NO: 3586011 - RNA, 15 nt, Pseudomonas putida KT2440
accugcacaucggcc

SEQ ID NO: 3586012 - RNA, 19 nt, Pseudomonas putida KT2440
accugcacuaucugcguuu

SEQ ID NO: 3586013 - RNA, 19 nt, Pseudomonas putida KT2440
accugcagcucagccagca

SEQ ID NO: 3586014 - RNA, 14 nt, Pseudomonas putida KT2440
accugcaggcgcgg

SEQ ID NO: 3586015 - RNA, 22 nt, Pseudomonas putida KT2440
accugcaggcgcggugccggca

SEQ ID NO: 3586016 - RNA, 19 nt, Pseudomonas putida KT2440
accugcagguaaugcgccg

SEQ ID NO: 3586017 - RNA, 18 nt, Pseudomonas putida KT2440
accugcagguacagcagc

SEQ ID NO: 3586018 - RNA, 20 nt, Pseudomonas putida KT2440
accugcagguacagcagcug

SEQ ID NO: 3586019 - RNA, 22 nt, Pseudomonas putida KT2440
accugcagguacagcagcugca

SEQ ID NO: 3586020 - RNA, 22 nt, Pseudomonas putida KT2440
accugccaacgcaccgaccacg

SEQ ID NO: 3586021 - RNA, 15 nt, Pseudomonas putida KT2440
accugccacugcgcu

SEQ ID NO: 3586022 - RNA, 17 nt, Pseudomonas putida KT2440
accugccagccccgcac

SEQ ID NO: 3586023 - RNA, 18 nt, Pseudomonas putida KT2440
accugccagccccgcaca

SEQ ID NO: 3586024 - RNA, 21 nt, Pseudomonas putida KT2440
accugccaugcaggucgacga

SEQ ID NO: 3586025 - RNA, 15 nt, Pseudomonas putida KT2440
accugccccagcguc

SEQ ID NO: 3586026 - RNA, 17 nt, Pseudomonas putida KT2440
accugccccagcgucac

SEQ ID NO: 3586027 - RNA, 21 nt, Pseudomonas putida KT2440
accugccccagcgucacccgu

SEQ ID NO: 3586028 - RNA, 22 nt, Pseudomonas putida KT2440
accugcccgggccgcuugcuca

SEQ ID NO: 3586029 - RNA, 13 nt, Pseudomonas putida KT2440
accugccgcagcu

SEQ ID NO: 3586030 - RNA, 22 nt, Pseudomonas putida KT2440
accugcgccuugcuuggcagcg

SEQ ID NO: 3586031 - RNA, 14 nt, Pseudomonas putida KT2440
accugcgcuugcac

SEQ ID NO: 3586032 - RNA, 21 nt, Pseudomonas putida KT2440
accugcgcuugcaccagguca

SEQ ID NO: 3586033 - RNA, 15 nt, Pseudomonas putida KT2440
accugcggccuggcc

SEQ ID NO: 3586034 - RNA, 23 nt, Pseudomonas putida KT2440
accugcggccuggcccggugcaa

SEQ ID NO: 3586035 - RNA, 24 nt, Pseudomonas putida KT2440
accugcggcuguccagcaagggcc

SEQ ID NO: 3586036 - RNA, 13 nt, Pseudomonas putida KT2440
accugcguggugc

SEQ ID NO: 3586037 - RNA, 19 nt, Pseudomonas putida KT2440
accugcguugcccccagcc

SEQ ID NO: 3586038 - RNA, 15 nt, Pseudomonas putida KT2440
accugcuccagcacc

SEQ ID NO: 3586039 - RNA, 16 nt, Pseudomonas putida KT2440
accugcuccagcaccu

SEQ ID NO: 3586040 - RNA, 18 nt, Pseudomonas putida KT2440
accugcuccugauaguug

SEQ ID NO: 3586041 - RNA, 21 nt, Pseudomonas putida KT2440
accugcucgcucaggcucuug

SEQ ID NO: 3586042 - RNA, 14 nt, Pseudomonas putida KT2440
accugcucggcgcg

SEQ ID NO: 3586043 - RNA, 15 nt, Pseudomonas putida KT2440
accugcucuggcccg

SEQ ID NO: 3586044 - RNA, 20 nt, Pseudomonas putida KT2440
accugcucuggcccgaacag

SEQ ID NO: 3586045 - RNA, 23 nt, Pseudomonas putida KT2440
accugcugacaccgcugccgggc

SEQ ID NO: 3586046 - RNA, 16 nt, Pseudomonas putida KT2440
accugcuucgcgggca

SEQ ID NO: 3586047 - RNA, 12 nt, Pseudomonas putida KT2440
accugcuugcug

SEQ ID NO: 3586048 - RNA, 14 nt, Pseudomonas putida KT2440
accuggaauaccac

SEQ ID NO: 3586049 - RNA, 19 nt, Pseudomonas putida KT2440
accuggaucgcgccuucau

SEQ ID NO: 3586050 - RNA, 22 nt, Pseudomonas putida KT2440
accuggcagccgaagcugucga

SEQ ID NO: 3586051 - RNA, 15 nt, Pseudomonas putida KT2440
accuggcccacgccu

SEQ ID NO: 3586052 - RNA, 16 nt, Pseudomonas putida KT2440
accuggcccacgccuu

SEQ ID NO: 3586053 - RNA, 14 nt, Pseudomonas putida KT2440
accuggcccugcuc

SEQ ID NO: 3586054 - RNA, 16 nt, Pseudomonas putida KT2440
accuggccuuccagcu

SEQ ID NO: 3586055 - RNA, 17 nt, Pseudomonas putida KT2440
accuggccuuccagcug

SEQ ID NO: 3586056 - RNA, 11 nt, Pseudomonas putida KT2440
accuggcucuu

SEQ ID NO: 3586057 - RNA, 16 nt, Pseudomonas putida KT2440
accuggcugcgggugc

SEQ ID NO: 3586058 - RNA, 12 nt, Pseudomonas putida KT2440
accuggcugcug

SEQ ID NO: 3586059 - RNA, 21 nt, Pseudomonas putida KT2440
accugggccggguccccggcc

SEQ ID NO: 3586060 - RNA, 22 nt, Pseudomonas putida KT2440
accugggcgaucacauaaggca

SEQ ID NO: 3586061 - RNA, 20 nt, Pseudomonas putida KT2440
accugggcgucaucacccgg

SEQ ID NO: 3586062 - RNA, 15 nt, Pseudomonas putida KT2440
accugguccagcuuc

SEQ ID NO: 3586063 - RNA, 17 nt, Pseudomonas putida KT2440
accugguccagcuucac

SEQ ID NO: 3586064 - RNA, 18 nt, Pseudomonas putida KT2440
accugguccagcuucacc

SEQ ID NO: 3586065 - RNA, 18 nt, Pseudomonas putida KT2440
accugguuugaggaaugu

SEQ ID NO: 3586066 - RNA, 13 nt, Pseudomonas putida KT2440
accugucgcucuu

SEQ ID NO: 3586067 - RNA, 20 nt, Pseudomonas putida KT2440
accugugaagccagggcaag

SEQ ID NO: 3586068 - RNA, 24 nt, Pseudomonas putida KT2440
accugugaggccuucagcgcggca

SEQ ID NO: 3586069 - RNA, 18 nt, Pseudomonas putida KT2440
accugugggagcgggcgu

SEQ ID NO: 3586070 - RNA, 19 nt, Pseudomonas putida KT2440
accugugggagcgggcgug

SEQ ID NO: 3586071 - RNA, 18 nt, Pseudomonas putida KT2440
accugugggagcgggcuu

SEQ ID NO: 3586072 - RNA, 19 nt, Pseudomonas putida KT2440
accuguggggcaacugcgc

SEQ ID NO: 3586073 - RNA, 22 nt, Pseudomonas putida KT2440
accuguggggcaacugcgcgau

SEQ ID NO: 3586074 - RNA, 20 nt, Pseudomonas putida KT2440
accuguggguugcucggcac

SEQ ID NO: 3586075 - RNA, 20 nt, Pseudomonas putida KT2440
accugugguggcugcuucuc

SEQ ID NO: 3586076 - RNA, 16 nt, Pseudomonas putida KT2440
accuguuucaacgggu

SEQ ID NO: 3586077 - RNA, 18 nt, Pseudomonas putida KT2440
accuuaucggccggcagc

SEQ ID NO: 3586078 - RNA, 21 nt, Pseudomonas putida KT2440
accuucaacaccaacuugcca

SEQ ID NO: 3586079 - RNA, 22 nt, Pseudomonas putida KT2440
accuucaacaccaacuugccaa

SEQ ID NO: 3586080 - RNA, 15 nt, Pseudomonas putida KT2440
accuucaaccacggu

SEQ ID NO: 3586081 - RNA, 17 nt, Pseudomonas putida KT2440
accuucaauagcggcca

SEQ ID NO: 3586082 - RNA, 16 nt, Pseudomonas putida KT2440
accuucacgccagccg

SEQ ID NO: 3586083 - RNA, 16 nt, Pseudomonas putida KT2440
accuucggcgacaggu

SEQ ID NO: 3586084 - RNA, 19 nt, Pseudomonas putida KT2440
accuucucggccucagccg

SEQ ID NO: 3586085 - RNA, 15 nt, Pseudomonas putida KT2440
accuucuggcagccg

SEQ ID NO: 3586086 - RNA, 19 nt, Pseudomonas putida KT2440
accuugaucuguccuccug

SEQ ID NO: 3586087 - RNA, 18 nt, Pseudomonas putida KT2440
accuugaugcgcgagcug

SEQ ID NO: 3586088 - RNA, 21 nt, Pseudomonas putida KT2440
accuugaugcgcgagcugggc

SEQ ID NO: 3586089 - RNA, 18 nt, Pseudomonas putida KT2440
accuugauuucgucgcua

SEQ ID NO: 3586090 - RNA, 15 nt, Pseudomonas putida KT2440
accuugccaucgacc

SEQ ID NO: 3586091 - RNA, 22 nt, Pseudomonas putida KT2440
accuugccuuccggcccggcau

SEQ ID NO: 3586092 - RNA, 19 nt, Pseudomonas putida KT2440
accuugcgcacggccucca

SEQ ID NO: 3586093 - RNA, 22 nt, Pseudomonas putida KT2440
accuugcggguuucgucgauca

SEQ ID NO: 3586094 - RNA, 17 nt, Pseudomonas putida KT2440
accuugcuccaccaggc

SEQ ID NO: 3586095 - RNA, 20 nt, Pseudomonas putida KT2440
accuugcuggaacugcugca

SEQ ID NO: 3586096 - RNA, 18 nt, Pseudomonas putida KT2440
accuugcuugaccuuguc

SEQ ID NO: 3586097 - RNA, 16 nt, Pseudomonas putida KT2440
accuuggacgcuggca

SEQ ID NO: 3586098 - RNA, 17 nt, Pseudomonas putida KT2440
accuuggacgcuggcag

SEQ ID NO: 3586099 - RNA, 21 nt, Pseudomonas putida KT2440
accuuggacgcuggcagcuug

SEQ ID NO: 3586100 - RNA, 21 nt, Pseudomonas putida KT2440
accuuggcgacauaggcgcgg

SEQ ID NO: 3586101 - RNA, 17 nt, Pseudomonas putida KT2440
accuuggcguccaggua

SEQ ID NO: 3586102 - RNA, 14 nt, Pseudomonas putida KT2440
accuugggcgagga

SEQ ID NO: 3586103 - RNA, 19 nt, Pseudomonas putida KT2440
accuuggugccaaccuuga

SEQ ID NO: 3586104 - RNA, 20 nt, Pseudomonas putida KT2440
accuuggugccaaccuugac

SEQ ID NO: 3586105 - RNA, 19 nt, Pseudomonas putida KT2440
accuugucagcaaccacgc

SEQ ID NO: 3586106 - RNA, 15 nt, Pseudomonas putida KT2440
accuuguccagcagg

SEQ ID NO: 3586107 - RNA, 22 nt, Pseudomonas putida KT2440
accuugucgccagugagaaugc

SEQ ID NO: 3586108 - RNA, 18 nt, Pseudomonas putida KT2440
accuuguucgagcgccau

SEQ ID NO: 3586109 - RNA, 19 nt, Pseudomonas putida KT2440
accuuugagugcuucgccc

SEQ ID NO: 3586110 - RNA, 15 nt, Pseudomonas putida KT2440
acgaaaccgacuuga

SEQ ID NO: 3586111 - RNA, 15 nt, Pseudomonas putida KT2440
acgaaacgccaggca

SEQ ID NO: 3586112 - RNA, 17 nt, Pseudomonas putida KT2440
acgaacaccagccccag

SEQ ID NO: 3586113 - RNA, 21 nt, Pseudomonas putida KT2440
acgcauggcguuguccagcag

SEQ ID NO: 3586114 - RNA, 22 nt, Pseudomonas putida KT2440
acgcauggcguuguccagcagg

SEQ ID NO: 3586115 - RNA, 17 nt, Pseudomonas putida KT2440
acgcauguccuuggccc

SEQ ID NO: 3586116 - RNA, 15 nt, Pseudomonas putida KT2440
acgcauucgcgggug

SEQ ID NO: 3586117 - RNA, 22 nt, Pseudomonas putida KT2440
acgcauugccgacuccaacugg

SEQ ID NO: 3586118 - RNA, 15 nt, Pseudomonas putida KT2440
acgcauuuucaucaa

SEQ ID NO: 3586119 - RNA, 17 nt, Pseudomonas putida KT2440
acgcauuuucaucaaaa

SEQ ID NO: 3586120 - RNA, 20 nt, Pseudomonas putida KT2440
acgccaaagugauaacgcgc

SEQ ID NO: 3586121 - RNA, 23 nt, Pseudomonas putida KT2440
acgccaaucaccugcacaucggc

SEQ ID NO: 3586122 - RNA, 19 nt, Pseudomonas putida KT2440
acgccaccaguuccaccgg

SEQ ID NO: 3586123 - RNA, 16 nt, Pseudomonas putida KT2440
acgccaccgaaggcgu

SEQ ID NO: 3586124 - RNA, 16 nt, Pseudomonas putida KT2440
acgccaccuucgccag

SEQ ID NO: 3586125 - RNA, 18 nt, Pseudomonas putida KT2440
acgccacgcccaacccag

SEQ ID NO: 3586126 - RNA, 19 nt, Pseudomonas putida KT2440
acgccagaagguaucggcc

SEQ ID NO: 3586127 - RNA, 20 nt, Pseudomonas putida KT2440
acgccaggcguuguggguga

SEQ ID NO: 3586128 - RNA, 17 nt, Pseudomonas putida KT2440
acgccagggcaaucgcc

SEQ ID NO: 3586129 - RNA, 22 nt, Pseudomonas putida KT2440
acgccagggcaaucgccaaggu

SEQ ID NO: 3586130 - RNA, 23 nt, Pseudomonas putida KT2440
acgccagggcaaucgccaagguc

SEQ ID NO: 3586131 - RNA, 18 nt, Pseudomonas putida KT2440
acgccaucaggcagcuca

SEQ ID NO: 3586132 - RNA, 19 nt, Pseudomonas putida KT2440
acgccauuguucgccucgu

SEQ ID NO: 3586133 - RNA, 13 nt, Pseudomonas putida KT2440
acgcccaacccca

SEQ ID NO: 3586134 - RNA, 14 nt, Pseudomonas putida KT2440
acgcccaaccccag

SEQ ID NO: 3586135 - RNA, 23 nt, Pseudomonas putida KT2440
acgcccagcaacugcgcccaaug

SEQ ID NO: 3586136 - RNA, 14 nt, Pseudomonas putida KT2440
acgcccauccaacg

SEQ ID NO: 3586137 - RNA, 20 nt, Pseudomonas putida KT2440
acgccccccggcuccacacc

SEQ ID NO: 3586138 - RNA, 15 nt, Pseudomonas putida KT2440
acgccccgugaaguc

SEQ ID NO: 3586139 - RNA, 18 nt, Pseudomonas putida KT2440
acgcccgacuggcuggcc

SEQ ID NO: 3586140 - RNA, 21 nt, Pseudomonas putida KT2440
acgcccgcaacaaccuggccg

SEQ ID NO: 3586141 - RNA, 11 nt, Pseudomonas putida KT2440
acgcccgcgug

SEQ ID NO: 3586142 - RNA, 17 nt, Pseudomonas putida KT2440
acgcccgcucccacagg

SEQ ID NO: 3586143 - RNA, 19 nt, Pseudomonas putida KT2440
acgcccgcucccacaggga

SEQ ID NO: 3586144 - RNA, 19 nt, Pseudomonas putida KT2440
acgcccgcucccacaggua

SEQ ID NO: 3586145 - RNA, 20 nt, Pseudomonas putida KT2440
acgcccgcucccacagguac

SEQ ID NO: 3586146 - RNA, 14 nt, Pseudomonas putida KT2440
acgcccgggccagg

SEQ ID NO: 3586147 - RNA, 19 nt, Pseudomonas putida KT2440
acgcccgggccaggccccu

SEQ ID NO: 3586148 - RNA, 23 nt, Pseudomonas putida KT2440
acgcccgucaccuugccaucgac

SEQ ID NO: 3586149 - RNA, 19 nt, Pseudomonas putida KT2440
acgcccuucauacagcgcc

SEQ ID NO: 3586150 - RNA, 22 nt, Pseudomonas putida KT2440
acgcccuucauacagcgccucc

SEQ ID NO: 3586151 - RNA, 23 nt, Pseudomonas putida KT2440
acgcccuucauacagcgccucca

SEQ ID NO: 3586152 - RNA, 19 nt, Pseudomonas putida KT2440
acgcccuuuuucaccaggc

SEQ ID NO: 3586153 - RNA, 20 nt, Pseudomonas putida KT2440
acgcccuuuuucaccaggcg

SEQ ID NO: 3586154 - RNA, 19 nt, Pseudomonas putida KT2440
acgccgagcauuacaggca

SEQ ID NO: 3586155 - RNA, 21 nt, Pseudomonas putida KT2440
acgccgagcauuacaggcaga

SEQ ID NO: 3586156 - RNA, 22 nt, Pseudomonas putida KT2440
acgccgauccucugugggagcg

SEQ ID NO: 3586157 - RNA, 12 nt, Pseudomonas putida KT2440
acgccgccagcg

SEQ ID NO: 3586158 - RNA, 14 nt, Pseudomonas putida KT2440
acgccgccagcgcu

SEQ ID NO: 3586159 - RNA, 16 nt, Pseudomonas putida KT2440
acgccgccauccuggu

SEQ ID NO: 3586160 - RNA, 13 nt, Pseudomonas putida KT2440
acgccgccgaggc

SEQ ID NO: 3586161 - RNA, 18 nt, Pseudomonas putida KT2440
acgccgcguugucaggca

SEQ ID NO: 3586162 - RNA, 14 nt, Pseudomonas putida KT2440
acgccgcugguaca

SEQ ID NO: 3586163 - RNA, 19 nt, Pseudomonas putida KT2440
acgccgcuucucaagaaac

SEQ ID NO: 3586164 - RNA, 14 nt, Pseudomonas putida KT2440
acgccggcgcacgc

SEQ ID NO: 3586165 - RNA, 18 nt, Pseudomonas putida KT2440
acgccggcgcacgcaugc

SEQ ID NO: 3586166 - RNA, 15 nt, Pseudomonas putida KT2440
acgccggcgccgugc

SEQ ID NO: 3586167 - RNA, 14 nt, Pseudomonas putida KT2440
acgccgggcacugc

SEQ ID NO: 3586168 - RNA, 15 nt, Pseudomonas putida KT2440
acgccgggucagcuc

SEQ ID NO: 3586169 - RNA, 17 nt, Pseudomonas putida KT2440
acgccguacggcccaug

SEQ ID NO: 3586170 - RNA, 16 nt, Pseudomonas putida KT2440
acgccguacugcuggg

SEQ ID NO: 3586171 - RNA, 22 nt, Pseudomonas putida KT2440
acgccguugucacgcgccaggu

SEQ ID NO: 3586172 - RNA, 23 nt, Pseudomonas putida KT2440
acgccucgaaguaggcaaacggc

SEQ ID NO: 3586173 - RNA, 15 nt, Pseudomonas putida KT2440
acgccucuugcgaaa

SEQ ID NO: 3586174 - RNA, 14 nt, Pseudomonas putida KT2440
acgccugaaccacc

SEQ ID NO: 3586175 - RNA, 20 nt, Pseudomonas putida KT2440
acgccugaaccaccgggauc

SEQ ID NO: 3586176 - RNA, 16 nt, Pseudomonas putida KT2440
acgccugcagggccug

SEQ ID NO: 3586177 - RNA, 14 nt, Pseudomonas putida KT2440
acgccuuggccucg

SEQ ID NO: 3586178 - RNA, 15 nt, Pseudomonas putida KT2440
acgccuuggccugcg

SEQ ID NO: 3586179 - RNA, 15 nt, Pseudomonas putida KT2440
acgccuuggccuggc

SEQ ID NO: 3586180 - RNA, 17 nt, Pseudomonas putida KT2440
acgccuuggucgaaccg

SEQ ID NO: 3586181 - RNA, 18 nt, Pseudomonas putida KT2440
acgcgaacgacuucggca

SEQ ID NO: 3586182 - RNA, 16 nt, Pseudomonas putida KT2440
acgcgacgaagauguc

SEQ ID NO: 3586183 - RNA, 22 nt, Pseudomonas putida KT2440
acgcgauacccaauaaaaacaa

SEQ ID NO: 3586184 - RNA, 19 nt, Pseudomonas putida KT2440
acgcgauauucagugcgca

SEQ ID NO: 3586185 - RNA, 20 nt, Pseudomonas putida KT2440
acgcgauauucagugcgcag

SEQ ID NO: 3586186 - RNA, 22 nt, Pseudomonas putida KT2440
acgcgcagcacuuccucggcac

SEQ ID NO: 3586187 - RNA, 16 nt, Pseudomonas putida KT2440
acgcgcaggcgcugca

SEQ ID NO: 3586188 - RNA, 21 nt, Pseudomonas putida KT2440
acgcgcaggcgcugcagggcg

SEQ ID NO: 3586189 - RNA, 14 nt, Pseudomonas putida KT2440
acgcgccaaccgcg

SEQ ID NO: 3586190 - RNA, 20 nt, Pseudomonas putida KT2440
acgcgccaaccgcgccagca

SEQ ID NO: 3586191 - RNA, 21 nt, Pseudomonas putida KT2440
acgcgccacauagcuggcacu

SEQ ID NO: 3586192 - RNA, 16 nt, Pseudomonas putida KT2440
acgcgccaccgccgug

SEQ ID NO: 3586193 - RNA, 18 nt, Pseudomonas putida KT2440
acgcgccaccgccgugcc

SEQ ID NO: 3586194 - RNA, 23 nt, Pseudomonas putida KT2440
acgcgccagcauggaccaucagg

SEQ ID NO: 3586195 - RNA, 12 nt, Pseudomonas putida KT2440
acgcgccagguc

SEQ ID NO: 3586196 - RNA, 21 nt, Pseudomonas putida KT2440
acgcgccauggccuggcgggu

SEQ ID NO: 3586197 - RNA, 19 nt, Pseudomonas putida KT2440
acgcgccgauugcugccga

SEQ ID NO: 3586198 - RNA, 18 nt, Pseudomonas putida KT2440
acgcgccucuugcaccug

SEQ ID NO: 3586199 - RNA, 13 nt, Pseudomonas putida KT2440
acgcgcgcagccu

SEQ ID NO: 3586200 - RNA, 13 nt, Pseudomonas putida KT2440
acgcgcgcuggcu

SEQ ID NO: 3586201 - RNA, 22 nt, Pseudomonas putida KT2440
acgcgcucacgcuugccaaggc

SEQ ID NO: 3586202 - RNA, 16 nt, Pseudomonas putida KT2440
acgcgcuuuuccagca

SEQ ID NO: 3586203 - RNA, 15 nt, Pseudomonas putida KT2440
acgcggacccggcau

SEQ ID NO: 3586204 - RNA, 18 nt, Pseudomonas putida KT2440
acgcggauccgugcaccg

SEQ ID NO: 3586205 - RNA, 15 nt, Pseudomonas putida KT2440
acgcggcaaccugca

SEQ ID NO: 3586206 - RNA, 19 nt, Pseudomonas putida KT2440
acgcggcagcagcagcccc

SEQ ID NO: 3586207 - RNA, 20 nt, Pseudomonas putida KT2440
acgcggcagcagcagcccca

SEQ ID NO: 3586208 - RNA, 15 nt, Pseudomonas putida KT2440
acgcgggcagacuuc

SEQ ID NO: 3586209 - RNA, 14 nt, Pseudomonas putida KT2440
acgcgggccaaggu

SEQ ID NO: 3586210 - RNA, 21 nt, Pseudomonas putida KT2440
acgcgggcgcgacaaucaggc

SEQ ID NO: 3586211 - RNA, 18 nt, Pseudomonas putida KT2440
acgcggggcagcgcacgu

SEQ ID NO: 3586212 - RNA, 22 nt, Pseudomonas putida KT2440
acgcggucaauuggagcggccu

SEQ ID NO: 3586213 - RNA, 15 nt, Pseudomonas putida KT2440
acgcggucagcgaau

SEQ ID NO: 3586214 - RNA, 15 nt, Pseudomonas putida KT2440
acgcgguggagggca

SEQ ID NO: 3586215 - RNA, 19 nt, Pseudomonas putida KT2440
acgcgguggagggcaccgg

SEQ ID NO: 3586216 - RNA, 15 nt, Pseudomonas putida KT2440
acgcguaccccuggc

SEQ ID NO: 3586217 - RNA, 21 nt, Pseudomonas putida KT2440
acgcguacgccguugccgccc

SEQ ID NO: 3586218 - RNA, 17 nt, Pseudomonas putida KT2440
acggcgcugcuggccuu

SEQ ID NO: 3586219 - RNA, 18 nt, Pseudomonas putida KT2440
acggcgcugucggucagc

SEQ ID NO: 3586220 - RNA, 23 nt, Pseudomonas putida KT2440
acggcgcugucggucagcaucug

SEQ ID NO: 3586221 - RNA, 13 nt, Pseudomonas putida KT2440
acggcggccugcu

SEQ ID NO: 3586222 - RNA, 13 nt, Pseudomonas putida KT2440
acggcggcgauca

SEQ ID NO: 3586223 - RNA, 15 nt, Pseudomonas putida KT2440
acggcggcgaucagc

SEQ ID NO: 3586224 - RNA, 16 nt, Pseudomonas putida KT2440
acggcggcgaucagcg

SEQ ID NO: 3586225 - RNA, 17 nt, Pseudomonas putida KT2440
acggcggcgaucagcgc

SEQ ID NO: 3586226 - RNA, 17 nt, Pseudomonas putida KT2440
acggcgggccaucugcu

SEQ ID NO: 3586227 - RNA, 21 nt, Pseudomonas putida KT2440
acggcggugauaugcguaccc

SEQ ID NO: 3586228 - RNA, 17 nt, Pseudomonas putida KT2440
acggcgguucugcgcac

SEQ ID NO: 3586229 - RNA, 13 nt, Pseudomonas putida KT2440
acggcgucgacac

SEQ ID NO: 3586230 - RNA, 13 nt, Pseudomonas putida KT2440
acggcgucgagca

SEQ ID NO: 3586231 - RNA, 13 nt, Pseudomonas putida KT2440
acggcguggagcg

SEQ ID NO: 3586232 - RNA, 15 nt, Pseudomonas putida KT2440
acggcuaaagccgca

SEQ ID NO: 3586233 - RNA, 22 nt, Pseudomonas putida KT2440
acggcuaaagccgcaccuacag

SEQ ID NO: 3586234 - RNA, 18 nt, Pseudomonas putida KT2440
acggcuaccccgaugcgc

SEQ ID NO: 3586235 - RNA, 16 nt, Pseudomonas putida KT2440
acggcugaacuuccag

SEQ ID NO: 3586236 - RNA, 20 nt, Pseudomonas putida KT2440
acggcugaacuuccaggucg

SEQ ID NO: 3586237 - RNA, 13 nt, Pseudomonas putida KT2440
acggcugaagaag

SEQ ID NO: 3586238 - RNA, 16 nt, Pseudomonas putida KT2440
acggcugcccugcaug

SEQ ID NO: 3586239 - RNA, 20 nt, Pseudomonas putida KT2440
acggcugccgacaggccgug

SEQ ID NO: 3586240 - RNA, 14 nt, Pseudomonas putida KT2440
acggcuggcugccg

SEQ ID NO: 3586241 - RNA, 16 nt, Pseudomonas putida KT2440
acggcuguuccucgcc

SEQ ID NO: 3586242 - RNA, 16 nt, Pseudomonas putida KT2440
acggcuugauauccag

SEQ ID NO: 3586243 - RNA, 17 nt, Pseudomonas putida KT2440
acgggcaaacaggcuga

SEQ ID NO: 3586244 - RNA, 16 nt, Pseudomonas putida KT2440
acgggcaaccgcaucc

SEQ ID NO: 3586245 - RNA, 18 nt, Pseudomonas putida KT2440
acgggcaaccgcaucccc

SEQ ID NO: 3586246 - RNA, 17 nt, Pseudomonas putida KT2440
acgggcaaggcuggcaa

SEQ ID NO: 3586247 - RNA, 17 nt, Pseudomonas putida KT2440
acgggcacaccuggugc

SEQ ID NO: 3586248 - RNA, 22 nt, Pseudomonas putida KT2440
acgggcauggcaaccaugucga

SEQ ID NO: 3586249 - RNA, 15 nt, Pseudomonas putida KT2440
acgggcaugguggaa

SEQ ID NO: 3586250 - RNA, 23 nt, Pseudomonas putida KT2440
acgggccaccaaaggccuugauc

SEQ ID NO: 3586251 - RNA, 18 nt, Pseudomonas putida KT2440
acgggcgacggaucggca

SEQ ID NO: 3586252 - RNA, 19 nt, Pseudomonas putida KT2440
acgggcgacggaucggcac

SEQ ID NO: 3586253 - RNA, 23 nt, Pseudomonas putida KT2440
acgggcgagcgcgcaggcgguuc

SEQ ID NO: 3586254 - RNA, 16 nt, Pseudomonas putida KT2440
acgggcugucgagcag

SEQ ID NO: 3586255 - RNA, 20 nt, Pseudomonas putida KT2440
acgggcugucgagcagguuc

SEQ ID NO: 3586256 - RNA, 22 nt, Pseudomonas putida KT2440
acgggcuugugcaucagcgugu

SEQ ID NO: 3586257 - RNA, 13 nt, Pseudomonas putida KT2440
acggggcgacgca

SEQ ID NO: 3586258 - RNA, 12 nt, Pseudomonas putida KT2440
acgggggggcgc

SEQ ID NO: 3586259 - RNA, 19 nt, Pseudomonas putida KT2440
acgggucaccacgggaaug

SEQ ID NO: 3586260 - RNA, 16 nt, Pseudomonas putida KT2440
acgggucaccucaucg

SEQ ID NO: 3586261 - RNA, 18 nt, Pseudomonas putida KT2440
acgggucaugccaccgcc

SEQ ID NO: 3586262 - RNA, 19 nt, Pseudomonas putida KT2440
acggguuuacccucgggac

SEQ ID NO: 3586263 - RNA, 21 nt, Pseudomonas putida KT2440
acggguuucggaaaaagggcg

SEQ ID NO: 3586264 - RNA, 22 nt, Pseudomonas putida KT2440
acggguuucggaaaaagggcgc

SEQ ID NO: 3586265 - RNA, 17 nt, Pseudomonas putida KT2440
acgguaacguuggccgg

SEQ ID NO: 3586266 - RNA, 15 nt, Pseudomonas putida KT2440
acgguagcggcagca

SEQ ID NO: 3586267 - RNA, 15 nt, Pseudomonas putida KT2440
acgguauaggccccg

SEQ ID NO: 3586268 - RNA, 11 nt, Pseudomonas putida KT2440
acggucagcgg

SEQ ID NO: 3586269 - RNA, 17 nt, Pseudomonas putida KT2440
acggucaguaccuggcc

SEQ ID NO: 3586270 - RNA, 17 nt, Pseudomonas putida KT2440
acggucgaucuucgccg

SEQ ID NO: 3586271 - RNA, 23 nt, Pseudomonas putida KT2440
acggucuccggcgaaauacccaa

SEQ ID NO: 3586272 - RNA, 15 nt, Pseudomonas putida KT2440
acggucuggcgcagg

SEQ ID NO: 3586273 - RNA, 16 nt, Pseudomonas putida KT2440
acggugaagaguggau

SEQ ID NO: 3586274 - RNA, 22 nt, Pseudomonas putida KT2440
acggugacaaaggccggcaccg

SEQ ID NO: 3586275 - RNA, 17 nt, Pseudomonas putida KT2440
acggugccgaacagcac

SEQ ID NO: 3586276 - RNA, 20 nt, Pseudomonas putida KT2440
acggugccgaacagcacgau

SEQ ID NO: 3586277 - RNA, 16 nt, Pseudomonas putida KT2440
acggugcgccugaaca

SEQ ID NO: 3586278 - RNA, 14 nt, Pseudomonas putida KT2440
acggugcgcgccag

SEQ ID NO: 3586279 - RNA, 15 nt, Pseudomonas putida KT2440
acggugcgcgccagc

SEQ ID NO: 3586280 - RNA, 16 nt, Pseudomonas putida KT2440
acggugcgcgccagcg

SEQ ID NO: 3586281 - RNA, 16 nt, Pseudomonas putida KT2440
acggugcugccgaggc

SEQ ID NO: 3586282 - RNA, 20 nt, Pseudomonas putida KT2440
acggugcugccgaggcgccg

SEQ ID NO: 3586283 - RNA, 15 nt, Pseudomonas putida KT2440
acgguggcggcagca

SEQ ID NO: 3586284 - RNA, 18 nt, Pseudomonas putida KT2440
acgguggcguggccacgc

SEQ ID NO: 3586285 - RNA, 22 nt, Pseudomonas putida KT2440
acgguggcguggccacgcccgg

SEQ ID NO: 3586286 - RNA, 11 nt, Pseudomonas putida KT2440
acgguggcugc

SEQ ID NO: 3586287 - RNA, 18 nt, Pseudomonas putida KT2440
acgguggucuuccaggua

SEQ ID NO: 3586288 - RNA, 13 nt, Pseudomonas putida KT2440
acgguguggccag

SEQ ID NO: 3586289 - RNA, 14 nt, Pseudomonas putida KT2440
acgguguggccagu

SEQ ID NO: 3586290 - RNA, 18 nt, Pseudomonas putida KT2440
acgguguggccagugcca

SEQ ID NO: 3586291 - RNA, 14 nt, Pseudomonas putida KT2440
acgguuuccaggcg

SEQ ID NO: 3586292 - RNA, 14 nt, Pseudomonas putida KT2440
acguacacacaucu

SEQ ID NO: 3586293 - RNA, 16 nt, Pseudomonas putida KT2440
acguacagcagcucac

SEQ ID NO: 3586294 - RNA, 20 nt, Pseudomonas putida KT2440
acguagaaaggagacaacca

SEQ ID NO: 3586295 - RNA, 18 nt, Pseudomonas putida KT2440
acguagaacaggccugcg

SEQ ID NO: 3586296 - RNA, 21 nt, Pseudomonas putida KT2440
acguagcuguugcgcugggcg

SEQ ID NO: 3586297 - RNA, 22 nt, Pseudomonas putida KT2440
acguaggcgggagagcagggcu

SEQ ID NO: 3586298 - RNA, 15 nt, Pseudomonas putida KT2440
acguauccgccgcaa

SEQ ID NO: 3586299 - RNA, 16 nt, Pseudomonas putida KT2440
acgucacaugcgccac

SEQ ID NO: 3586300 - RNA, 15 nt, Pseudomonas putida KT2440
acgucacccacuuca

SEQ ID NO: 3586301 - RNA, 16 nt, Pseudomonas putida KT2440
acguccagagggccug

SEQ ID NO: 3586302 - RNA, 19 nt, Pseudomonas putida KT2440
acguccagagggccugcau

SEQ ID NO: 3586303 - RNA, 22 nt, Pseudomonas putida KT2440
acguccagcucaacgcgaacga

SEQ ID NO: 3586304 - RNA, 17 nt, Pseudomonas putida KT2440
acgucgcgauugaucag

SEQ ID NO: 3586305 - RNA, 22 nt, Pseudomonas putida KT2440
acgucgcgauugaucagcgccu

SEQ ID NO: 3586306 - RNA, 16 nt, Pseudomonas putida KT2440
acgucgcgcuggccgc

SEQ ID NO: 3586307 - RNA, 14 nt, Pseudomonas putida KT2440
acgucggccugccc

SEQ ID NO: 3586308 - RNA, 16 nt, Pseudomonas putida KT2440
acgucggcuggcagcu

SEQ ID NO: 3586309 - RNA, 16 nt, Pseudomonas putida KT2440
acgucguacucggccg

SEQ ID NO: 3586310 - RNA, 16 nt, Pseudomonas putida KT2440
acgucguugaaggcgu

SEQ ID NO: 3586311 - RNA, 16 nt, Pseudomonas putida KT2440
acgucucgaacggcgc

SEQ ID NO: 3586312 - RNA, 20 nt, Pseudomonas putida KT2440
acgucucgaacggcgccagc

SEQ ID NO: 3586313 - RNA, 18 nt, Pseudomonas putida KT2440
acgucuggcaccaguucc

SEQ ID NO: 3586314 - RNA, 22 nt, Pseudomonas putida KT2440
acgugaauaugcucuuuccaac

SEQ ID NO: 3586315 - RNA, 14 nt, Pseudomonas putida KT2440
acgugacuggaacu

SEQ ID NO: 3586316 - RNA, 16 nt, Pseudomonas putida KT2440
acgugauaccugggcu

SEQ ID NO: 3586317 - RNA, 16 nt, Pseudomonas putida KT2440
acgugcaacgucgcgu

SEQ ID NO: 3586318 - RNA, 18 nt, Pseudomonas putida KT2440
acgugcaaggaucaccaa

SEQ ID NO: 3586319 - RNA, 21 nt, Pseudomonas putida KT2440
acgugcaaggaucaccaaggc

SEQ ID NO: 3586320 - RNA, 14 nt, Pseudomonas putida KT2440
acgugcaccggccu

SEQ ID NO: 3586321 - RNA, 22 nt, Pseudomonas putida KT2440
acgugcagcuugaggucgccag

SEQ ID NO: 3586322 - RNA, 15 nt, Pseudomonas putida KT2440
acgugcccagaucac

SEQ ID NO: 3586323 - RNA, 21 nt, Pseudomonas putida KT2440
acgugcccugaacagggccag

SEQ ID NO: 3586324 - RNA, 15 nt, Pseudomonas putida KT2440
acucugcugcucugc

SEQ ID NO: 3586325 - RNA, 20 nt, Pseudomonas putida KT2440
acucugucacccgcugcacg

SEQ ID NO: 3586326 - RNA, 14 nt, Pseudomonas putida KT2440
acucuucaccagcu

SEQ ID NO: 3586327 - RNA, 12 nt, Pseudomonas putida KT2440
acucuuccagcu

SEQ ID NO: 3586328 - RNA, 18 nt, Pseudomonas putida KT2440
acucuucccaccaccagc

SEQ ID NO: 3586329 - RNA, 15 nt, Pseudomonas putida KT2440
acucuuccugccgca

SEQ ID NO: 3586330 - RNA, 21 nt, Pseudomonas putida KT2440
acucuuguguugccacccggc

SEQ ID NO: 3586331 - RNA, 21 nt, Pseudomonas putida KT2440
acugaacaccugccagccccg

SEQ ID NO: 3586332 - RNA, 15 nt, Pseudomonas putida KT2440
acugaacagcgccuu

SEQ ID NO: 3586333 - RNA, 18 nt, Pseudomonas putida KT2440
acugaagauuuucagcca

SEQ ID NO: 3586334 - RNA, 18 nt, Pseudomonas putida KT2440
acugaauacagccaaugg

SEQ ID NO: 3586335 - RNA, 23 nt, Pseudomonas putida KT2440
acugaauggccuuggccaucacu

SEQ ID NO: 3586336 - RNA, 21 nt, Pseudomonas putida KT2440
acugaauucguauauguauuu

SEQ ID NO: 3586337 - RNA, 20 nt, Pseudomonas putida KT2440
acugacaagauaguaggcac

SEQ ID NO: 3586338 - RNA, 18 nt, Pseudomonas putida KT2440
acugacgcuacgccgccc

SEQ ID NO: 3586339 - RNA, 13 nt, Pseudomonas putida KT2440
acugagccaggcc

SEQ ID NO: 3586340 - RNA, 16 nt, Pseudomonas putida KT2440
acugagccaggccgac

SEQ ID NO: 3586341 - RNA, 16 nt, Pseudomonas putida KT2440
acugagcuaacgaccc

SEQ ID NO: 3586342 - RNA, 18 nt, Pseudomonas putida KT2440
acugagucggccucgaua

SEQ ID NO: 3586343 - RNA, 22 nt, Pseudomonas putida KT2440
acugaucccuacccccuccucc

SEQ ID NO: 3586344 - RNA, 17 nt, Pseudomonas putida KT2440
acugaucgggauuacau

SEQ ID NO: 3586345 - RNA, 19 nt, Pseudomonas putida KT2440
acugcaaaucgaaggcaua

SEQ ID NO: 3586346 - RNA, 15 nt, Pseudomonas putida KT2440
acugcaagcaaacgc

SEQ ID NO: 3586347 - RNA, 17 nt, Pseudomonas putida KT2440
acugcaagcaaacgcca

SEQ ID NO: 3586348 - RNA, 19 nt, Pseudomonas putida KT2440
acugcaagcaaacgccaga

SEQ ID NO: 3586349 - RNA, 15 nt, Pseudomonas putida KT2440
acugcaagcgaugca

SEQ ID NO: 3586350 - RNA, 17 nt, Pseudomonas putida KT2440
acugcaagcgaugcacg

SEQ ID NO: 3586351 - RNA, 23 nt, Pseudomonas putida KT2440
acugcaagcgaugcacgccagca

SEQ ID NO: 3586352 - RNA, 14 nt, Pseudomonas putida KT2440
acugcaauucguga

SEQ ID NO: 3586353 - RNA, 16 nt, Pseudomonas putida KT2440
acugcacccgccagcc

SEQ ID NO: 3586354 - RNA, 18 nt, Pseudomonas putida KT2440
acugcacccgccagccgu

SEQ ID NO: 3586355 - RNA, 13 nt, Pseudomonas putida KT2440
acugcaccucccg

SEQ ID NO: 3586356 - RNA, 15 nt, Pseudomonas putida KT2440
acugcaccucccgcc

SEQ ID NO: 3586357 - RNA, 16 nt, Pseudomonas putida KT2440
acugcacgcuucgauc

SEQ ID NO: 3586358 - RNA, 14 nt, Pseudomonas putida KT2440
acugcagaucacca

SEQ ID NO: 3586359 - RNA, 19 nt, Pseudomonas putida KT2440
acugcagaucaccagcucg

SEQ ID NO: 3586360 - RNA, 15 nt, Pseudomonas putida KT2440
acugcaggagcgggc

SEQ ID NO: 3586361 - RNA, 16 nt, Pseudomonas putida KT2440
acugcaggagcgggca

SEQ ID NO: 3586362 - RNA, 22 nt, Pseudomonas putida KT2440
acugcagggacugucggcucaa

SEQ ID NO: 3586363 - RNA, 14 nt, Pseudomonas putida KT2440
acugcaggugcagg

SEQ ID NO: 3586364 - RNA, 16 nt, Pseudomonas putida KT2440
acugcauccgccccag

SEQ ID NO: 3586365 - RNA, 16 nt, Pseudomonas putida KT2440
acugcaugugccgcuc

SEQ ID NO: 3586366 - RNA, 14 nt, Pseudomonas putida KT2440
acugcauuggccac

SEQ ID NO: 3586367 - RNA, 16 nt, Pseudomonas putida KT2440
acugccaacgggauac

SEQ ID NO: 3586368 - RNA, 21 nt, Pseudomonas putida KT2440
acugccaaugcucaguggacc

SEQ ID NO: 3586369 - RNA, 19 nt, Pseudomonas putida KT2440
acugccaccgugagcaugg

SEQ ID NO: 3586370 - RNA, 12 nt, Pseudomonas putida KT2440
acugccagcacg

SEQ ID NO: 3586371 - RNA, 20 nt, Pseudomonas putida KT2440
acugccagcacgaucauggg

SEQ ID NO: 3586372 - RNA, 22 nt, Pseudomonas putida KT2440
acugccagcccggcggccagca

SEQ ID NO: 3586373 - RNA, 17 nt, Pseudomonas putida KT2440
acugccagcgccucacc

SEQ ID NO: 3586374 - RNA, 16 nt, Pseudomonas putida KT2440
acugccaggcuggcgc

SEQ ID NO: 3586375 - RNA, 18 nt, Pseudomonas putida KT2440
acugccaucucgccaagc

SEQ ID NO: 3586376 - RNA, 22 nt, Pseudomonas putida KT2440
acugcccaagccauccaccagc

SEQ ID NO: 3586377 - RNA, 22 nt, Pseudomonas putida KT2440
acugcccaggaucacuggccug

SEQ ID NO: 3586378 - RNA, 20 nt, Pseudomonas putida KT2440
acugccccuguuccauugaa

SEQ ID NO: 3586379 - RNA, 14 nt, Pseudomonas putida KT2440
acugccgcgccgcc

SEQ ID NO: 3586380 - RNA, 15 nt, Pseudomonas putida KT2440
acugccugcacggca

SEQ ID NO: 3586381 - RNA, 17 nt, Pseudomonas putida KT2440
acugccugcaugcgugc

SEQ ID NO: 3586382 - RNA, 20 nt, Pseudomonas putida KT2440
acugccugcaugcgugccuu

SEQ ID NO: 3586383 - RNA, 12 nt, Pseudomonas putida KT2440
acugccuggcca

SEQ ID NO: 3586384 - RNA, 14 nt, Pseudomonas putida KT2440
acugccuugcccug

SEQ ID NO: 3586385 - RNA, 18 nt, Pseudomonas putida KT2440
acugcgacgaacucaacg

SEQ ID NO: 3586386 - RNA, 15 nt, Pseudomonas putida KT2440
acugcgcaaucccug

SEQ ID NO: 3586387 - RNA, 22 nt, Pseudomonas putida KT2440
acugcgcccaaucggguaaaac

SEQ ID NO: 3586388 - RNA, 15 nt, Pseudomonas putida KT2440
acugcgccugggaaa

SEQ ID NO: 3586389 - RNA, 15 nt, Pseudomonas putida KT2440
acugcgcgcaaaggc

SEQ ID NO: 3586390 - RNA, 21 nt, Pseudomonas putida KT2440
acugcgcuacgacccaccgac

SEQ ID NO: 3586391 - RNA, 20 nt, Pseudomonas putida KT2440
acugcgcucaaccagccgcc

SEQ ID NO: 3586392 - RNA, 21 nt, Pseudomonas putida KT2440
acugcgcucaaccagccgccu

SEQ ID NO: 3586393 - RNA, 15 nt, Pseudomonas putida KT2440
acugcggccccugga

SEQ ID NO: 3586394 - RNA, 20 nt, Pseudomonas putida KT2440
acugcuauuuucgugagacc

SEQ ID NO: 3586395 - RNA, 15 nt, Pseudomonas putida KT2440
acugcuccaggcagc

SEQ ID NO: 3586396 - RNA, 18 nt, Pseudomonas putida KT2440
acugcuccaggcagccug

SEQ ID NO: 3586397 - RNA, 23 nt, Pseudomonas putida KT2440
acugcucgcugccacgcaugccu

SEQ ID NO: 3586398 - RNA, 13 nt, Pseudomonas putida KT2440
acugcucgcuggc

SEQ ID NO: 3586399 - RNA, 22 nt, Pseudomonas putida KT2440
acugcucuucgaguuuggccag

SEQ ID NO: 3586400 - RNA, 17 nt, Pseudomonas putida KT2440
acugcugacccggaauc

SEQ ID NO: 3586401 - RNA, 17 nt, Pseudomonas putida KT2440
acugcugagucagcuug

SEQ ID NO: 3586402 - RNA, 18 nt, Pseudomonas putida KT2440
acugcugagucagcuugu

SEQ ID NO: 3586403 - RNA, 15 nt, Pseudomonas putida KT2440
acugcuguggaacag

SEQ ID NO: 3586404 - RNA, 21 nt, Pseudomonas putida KT2440
acugcuucaucugcgccugug

SEQ ID NO: 3586405 - RNA, 16 nt, Pseudomonas putida KT2440
acugcuucugagccag

SEQ ID NO: 3586406 - RNA, 17 nt, Pseudomonas putida KT2440
acugcuucugccguuca

SEQ ID NO: 3586407 - RNA, 21 nt, Pseudomonas putida KT2440
acugcuuuaucuccaagccgc

SEQ ID NO: 3586408 - RNA, 22 nt, Pseudomonas putida KT2440
acuggaacucgaucggcacccc

SEQ ID NO: 3586409 - RNA, 20 nt, Pseudomonas putida KT2440
acuggaggugauggucaccu

SEQ ID NO: 3586410 - RNA, 23 nt, Pseudomonas putida KT2440
acuggaugacgccgcagccgggc

SEQ ID NO: 3586411 - RNA, 18 nt, Pseudomonas putida KT2440
acuggaugauccagccca

SEQ ID NO: 3586412 - RNA, 22 nt, Pseudomonas putida KT2440
acuggaugauccagcccaccac

SEQ ID NO: 3586413 - RNA, 16 nt, Pseudomonas putida KT2440
acuggaugaugguauc

SEQ ID NO: 3586414 - RNA, 15 nt, Pseudomonas putida KT2440
acuggcacaacccga

SEQ ID NO: 3586415 - RNA, 17 nt, Pseudomonas putida KT2440
acuggcagcaaggccau

SEQ ID NO: 3586416 - RNA, 20 nt, Pseudomonas putida KT2440
acuggcauccagcgccacca

SEQ ID NO: 3586417 - RNA, 19 nt, Pseudomonas putida KT2440
acuggcauccggcagcuca

SEQ ID NO: 3586418 - RNA, 18 nt, Pseudomonas putida KT2440
acuggccaauugcgccau

SEQ ID NO: 3586419 - RNA, 15 nt, Pseudomonas putida KT2440
acuggccagcagccc

SEQ ID NO: 3586420 - RNA, 17 nt, Pseudomonas putida KT2440
acuggccagcagccccc

SEQ ID NO: 3586421 - RNA, 18 nt, Pseudomonas putida KT2440
acuggcccggcgggagga

SEQ ID NO: 3586422 - RNA, 14 nt, Pseudomonas putida KT2440
acuggcccuggcca

SEQ ID NO: 3586423 - RNA, 21 nt, Pseudomonas putida KT2440
acuggccggucuguucggcaa

SEQ ID NO: 3586424 - RNA, 13 nt, Pseudomonas putida KT2440
acuggcgacagcc

SEQ ID NO: 3586425 - RNA, 20 nt, Pseudomonas putida KT2440
acuggcgcaggccgcuggcc

SEQ ID NO: 3586426 - RNA, 16 nt, Pseudomonas putida KT2440
acuggcgcccggcauc

SEQ ID NO: 3586427 - RNA, 20 nt, Pseudomonas putida KT2440
acuggcgcgaugcgguugca

SEQ ID NO: 3586428 - RNA, 18 nt, Pseudomonas putida KT2440
acuggcgcugaucaucga

SEQ ID NO: 3586429 - RNA, 13 nt, Pseudomonas putida KT2440
agaagcaaccgcu

SEQ ID NO: 3586430 - RNA, 19 nt, Pseudomonas putida KT2440
agaagcagaucaucaugcc

SEQ ID NO: 3586431 - RNA, 22 nt, Pseudomonas putida KT2440
agaagccaccgcgauggauggc

SEQ ID NO: 3586432 - RNA, 22 nt, Pseudomonas putida KT2440
agaagcgaccgguuuucuguug

SEQ ID NO: 3586433 - RNA, 14 nt, Pseudomonas putida KT2440
agaagcgccgcagg

SEQ ID NO: 3586434 - RNA, 15 nt, Pseudomonas putida KT2440
agaagcggcuaccgc

SEQ ID NO: 3586435 - RNA, 22 nt, Pseudomonas putida KT2440
agaagcggcugccuacccaggc

SEQ ID NO: 3586436 - RNA, 14 nt, Pseudomonas putida KT2440
agaagcuaccccac

SEQ ID NO: 3586437 - RNA, 19 nt, Pseudomonas putida KT2440
agaagcuaccccacaaccc

SEQ ID NO: 3586438 - RNA, 18 nt, Pseudomonas putida KT2440
agaagcugcagcuucagg

SEQ ID NO: 3586439 - RNA, 18 nt, Pseudomonas putida KT2440
agaagcuguagucaccac

SEQ ID NO: 3586440 - RNA, 14 nt, Pseudomonas putida KT2440
agaaggacucggcg

SEQ ID NO: 3586441 - RNA, 13 nt, Pseudomonas putida KT2440
agaaggcauccag

SEQ ID NO: 3586442 - RNA, 19 nt, Pseudomonas putida KT2440
agaaggcugcguaaggccg

SEQ ID NO: 3586443 - RNA, 19 nt, Pseudomonas putida KT2440
agaagguaucggccauggc

SEQ ID NO: 3586444 - RNA, 21 nt, Pseudomonas putida KT2440
agaagguaucggccauggccg

SEQ ID NO: 3586445 - RNA, 23 nt, Pseudomonas putida KT2440
agaauaauucuuauuaccagaau

SEQ ID NO: 3586446 - RNA, 19 nt, Pseudomonas putida KT2440
agaauagccggccucagca

SEQ ID NO: 3586447 - RNA, 15 nt, Pseudomonas putida KT2440
agaauccucuaugcc

SEQ ID NO: 3586448 - RNA, 14 nt, Pseudomonas putida KT2440
agaaucucccgggc

SEQ ID NO: 3586449 - RNA, 18 nt, Pseudomonas putida KT2440
agaaucucccgggccaug

SEQ ID NO: 3586450 - RNA, 24 nt, Pseudomonas putida KT2440
agaaugacuucgcugcccgagcgu

SEQ ID NO: 3586451 - RNA, 19 nt, Pseudomonas putida KT2440
agaaugccgcccaucaccg

SEQ ID NO: 3586452 - RNA, 19 nt, Pseudomonas putida KT2440
agaaugcggauguaguucu

SEQ ID NO: 3586453 - RNA, 14 nt, Pseudomonas putida KT2440
agaaugcugcgcag

SEQ ID NO: 3586454 - RNA, 18 nt, Pseudomonas putida KT2440
agaauggaggagggcugc

SEQ ID NO: 3586455 - RNA, 16 nt, Pseudomonas putida KT2440
agaaugugcucggccu

SEQ ID NO: 3586456 - RNA, 22 nt, Pseudomonas putida KT2440
agaaugugcucggccugggcag

SEQ ID NO: 3586457 - RNA, 18 nt, Pseudomonas putida KT2440
agacaaaaaaaucggccg

SEQ ID NO: 3586458 - RNA, 11 nt, Pseudomonas putida KT2440
agacaacuggc

SEQ ID NO: 3586459 - RNA, 15 nt, Pseudomonas putida KT2440
agacaacuggccagg

SEQ ID NO: 3586460 - RNA, 20 nt, Pseudomonas putida KT2440
agacaaguccuucaucuguc

SEQ ID NO: 3586461 - RNA, 16 nt, Pseudomonas putida KT2440
agacacaggcgcucgu

SEQ ID NO: 3586462 - RNA, 17 nt, Pseudomonas putida KT2440
agacaccgcaaaucacu

SEQ ID NO: 3586463 - RNA, 14 nt, Pseudomonas putida KT2440
agacacgagcggcc

SEQ ID NO: 3586464 - RNA, 21 nt, Pseudomonas putida KT2440
agacacggacucauagcucag

SEQ ID NO: 3586465 - RNA, 22 nt, Pseudomonas putida KT2440
agacagaagccuguacacagcc

SEQ ID NO: 3586466 - RNA, 23 nt, Pseudomonas putida KT2440
agacauccgcaacaugaagccau

SEQ ID NO: 3586467 - RNA, 22 nt, Pseudomonas putida KT2440
agacaucgauuucgccaucgcc

SEQ ID NO: 3586468 - RNA, 22 nt, Pseudomonas putida KT2440
agacaucuccauagguuaucca

SEQ ID NO: 3586469 - RNA, 18 nt, Pseudomonas putida KT2440
agacauugagcaagggcc

SEQ ID NO: 3586470 - RNA, 13 nt, Pseudomonas putida KT2440
agaccaccucauc

SEQ ID NO: 3586471 - RNA, 14 nt, Pseudomonas putida KT2440
agaccaccucaucc

SEQ ID NO: 3586472 - RNA, 12 nt, Pseudomonas putida KT2440
agaccacggucg

SEQ ID NO: 3586473 - RNA, 15 nt, Pseudomonas putida KT2440
agaccaucagguauu

SEQ ID NO: 3586474 - RNA, 16 nt, Pseudomonas putida KT2440
agaccauuucgcgcag

SEQ ID NO: 3586475 - RNA, 18 nt, Pseudomonas putida KT2440
agaccauuucgcgcaggg

SEQ ID NO: 3586476 - RNA, 15 nt, Pseudomonas putida KT2440
agacccgcuucgccg

SEQ ID NO: 3586477 - RNA, 16 nt, Pseudomonas putida KT2440
agacccgcuucgccgc

SEQ ID NO: 3586478 - RNA, 17 nt, Pseudomonas putida KT2440
agaccgauuucaacccu

SEQ ID NO: 3586479 - RNA, 18 nt, Pseudomonas putida KT2440
agaccgauuucaacccua

SEQ ID NO: 3586480 - RNA, 19 nt, Pseudomonas putida KT2440
agaccguuccgcaaauucu

SEQ ID NO: 3586481 - RNA, 19 nt, Pseudomonas putida KT2440
agaccugugggagcgggca

SEQ ID NO: 3586482 - RNA, 18 nt, Pseudomonas putida KT2440
agaccugugguuucacac

SEQ ID NO: 3586483 - RNA, 19 nt, Pseudomonas putida KT2440
agaccuucuggcagccgcc

SEQ ID NO: 3586484 - RNA, 20 nt, Pseudomonas putida KT2440
agaccuucuggcagccgccc

SEQ ID NO: 3586485 - RNA, 14 nt, Pseudomonas putida KT2440
agaccuugcgcacg

SEQ ID NO: 3586486 - RNA, 17 nt, Pseudomonas putida KT2440
agaccuuucccaugacg

SEQ ID NO: 3586487 - RNA, 15 nt, Pseudomonas putida KT2440
agacgaacagcgccg

SEQ ID NO: 3586488 - RNA, 13 nt, Pseudomonas putida KT2440
agacgaagccgaa

SEQ ID NO: 3586489 - RNA, 18 nt, Pseudomonas putida KT2440
agacgcaggcaaacgcgg

SEQ ID NO: 3586490 - RNA, 18 nt, Pseudomonas putida KT2440
agacgcggaacuggcuga

SEQ ID NO: 3586491 - RNA, 19 nt, Pseudomonas putida KT2440
agacgcucgacagcaacuu

SEQ ID NO: 3586492 - RNA, 20 nt, Pseudomonas putida KT2440
agacggucuccccuuccccc

SEQ ID NO: 3586493 - RNA, 15 nt, Pseudomonas putida KT2440
agacggugagaggua

SEQ ID NO: 3586494 - RNA, 13 nt, Pseudomonas putida KT2440
agacgguggcugc

SEQ ID NO: 3586495 - RNA, 18 nt, Pseudomonas putida KT2440
agacgguuacgugcaggc

SEQ ID NO: 3586496 - RNA, 16 nt, Pseudomonas putida KT2440
agacgucgcaauugau

SEQ ID NO: 3586497 - RNA, 21 nt, Pseudomonas putida KT2440
agacgucuuccaugccuucuu

SEQ ID NO: 3586498 - RNA, 20 nt, Pseudomonas putida KT2440
agacucgaaaccaucaauca

SEQ ID NO: 3586499 - RNA, 20 nt, Pseudomonas putida KT2440
agacucucgauugaccccug

SEQ ID NO: 3586500 - RNA, 22 nt, Pseudomonas putida KT2440
agacugccaaguaccaauacca

SEQ ID NO: 3586501 - RNA, 22 nt, Pseudomonas putida KT2440
agacuucauaggcuggcgucuc

SEQ ID NO: 3586502 - RNA, 19 nt, Pseudomonas putida KT2440
agacuucgcugucuuccag

SEQ ID NO: 3586503 - RNA, 14 nt, Pseudomonas putida KT2440
agagaagcugcagc

SEQ ID NO: 3586504 - RNA, 16 nt, Pseudomonas putida KT2440
agagaucugcaggggu

SEQ ID NO: 3586505 - RNA, 23 nt, Pseudomonas putida KT2440
agagauuugccuuggaaugcaca

SEQ ID NO: 3586506 - RNA, 14 nt, Pseudomonas putida KT2440
agagcaucccccuc

SEQ ID NO: 3586507 - RNA, 20 nt, Pseudomonas putida KT2440
agagcaucccccuccuaagg

SEQ ID NO: 3586508 - RNA, 19 nt, Pseudomonas putida KT2440
agagcccgcucggucaggg

SEQ ID NO: 3586509 - RNA, 19 nt, Pseudomonas putida KT2440
agagcccggcgcagccguu

SEQ ID NO: 3586510 - RNA, 20 nt, Pseudomonas putida KT2440
agagccggugccauccaccg

SEQ ID NO: 3586511 - RNA, 13 nt, Pseudomonas putida KT2440
agagccugcaccc

SEQ ID NO: 3586512 - RNA, 16 nt, Pseudomonas putida KT2440
agagccuuuggcugga

SEQ ID NO: 3586513 - RNA, 16 nt, Pseudomonas putida KT2440
agagcgaaaugggccg

SEQ ID NO: 3586514 - RNA, 12 nt, Pseudomonas putida KT2440
agagcgccagca

SEQ ID NO: 3586515 - RNA, 13 nt, Pseudomonas putida KT2440
agagcgcccacca

SEQ ID NO: 3586516 - RNA, 15 nt, Pseudomonas putida KT2440
agagcgugaagcgga

SEQ ID NO: 3586517 - RNA, 23 nt, Pseudomonas putida KT2440
agaggaucugaauguacaaugca

SEQ ID NO: 3586518 - RNA, 22 nt, Pseudomonas putida KT2440
agaggccagcacaggcggccga

SEQ ID NO: 3586519 - RNA, 22 nt, Pseudomonas putida KT2440
agaggccagugagccucacaca

SEQ ID NO: 3586520 - RNA, 15 nt, Pseudomonas putida KT2440
agaggcccgucaggc

SEQ ID NO: 3586521 - RNA, 21 nt, Pseudomonas putida KT2440
agaggcccgucaggcaaacca

SEQ ID NO: 3586522 - RNA, 21 nt, Pseudomonas putida KT2440
agaggcccucaagggcgcuga

SEQ ID NO: 3586523 - RNA, 19 nt, Pseudomonas putida KT2440
agaggccggaccugcuggc

SEQ ID NO: 3586524 - RNA, 17 nt, Pseudomonas putida KT2440
agaggccggcacaggaa

SEQ ID NO: 3586525 - RNA, 17 nt, Pseudomonas putida KT2440
agaggcguagcaagcag

SEQ ID NO: 3586526 - RNA, 19 nt, Pseudomonas putida KT2440
agagggccugcaucgcuga

SEQ ID NO: 3586527 - RNA, 22 nt, Pseudomonas putida KT2440
agaggugccuaucgcucuggca

SEQ ID NO: 3586528 - RNA, 15 nt, Pseudomonas putida KT2440
agaguccgaagcgaa

SEQ ID NO: 3586529 - RNA, 16 nt, Pseudomonas putida KT2440
agauaaccaaccccug

SEQ ID NO: 3586530 - RNA, 23 nt, Pseudomonas putida KT2440
agauaaccuggcucggcugggcu

SEQ ID NO: 3586531 - RNA, 23 nt, Pseudomonas putida KT2440
agauacaggcuguuccauuuccc

SEQ ID NO: 3586532 - RNA, 11 nt, Pseudomonas putida KT2440
agauacccgcc

SEQ ID NO: 3586533 - RNA, 21 nt, Pseudomonas putida KT2440
agauacgcuucgaacacccgc

SEQ ID NO: 3586534 - RNA, 19 nt, Pseudomonas putida KT2440
agauagaccuugccagcgc

SEQ ID NO: 3586535 - RNA, 20 nt, Pseudomonas putida KT2440
agauaggcauugagguugac

SEQ ID NO: 3586536 - RNA, 15 nt, Pseudomonas putida KT2440
agauaucgcauuucu

SEQ ID NO: 3586537 - RNA, 15 nt, Pseudomonas putida KT2440
agauaucuggacccc

SEQ ID NO: 3586538 - RNA, 17 nt, Pseudomonas putida KT2440
agauauguccauccaug

SEQ ID NO: 3586539 - RNA, 22 nt, Pseudomonas putida KT2440
agauauugguccagccacaauu

SEQ ID NO: 3586540 - RNA, 24 nt, Pseudomonas putida KT2440
agaucaacgccgccagcggcucga

SEQ ID NO: 3586541 - RNA, 16 nt, Pseudomonas putida KT2440
agaucacccuuggcca

SEQ ID NO: 3586542 - RNA, 22 nt, Pseudomonas putida KT2440
agaucacuguugucggccagau

SEQ ID NO: 3586543 - RNA, 21 nt, Pseudomonas putida KT2440
agaucacuuccaccugcgccu

SEQ ID NO: 3586544 - RNA, 17 nt, Pseudomonas putida KT2440
agaucagcaaccugcug

SEQ ID NO: 3586545 - RNA, 12 nt, Pseudomonas putida KT2440
agaucagcagca

SEQ ID NO: 3586546 - RNA, 15 nt, Pseudomonas putida KT2440
agaucagccacgggc

SEQ ID NO: 3586547 - RNA, 18 nt, Pseudomonas putida KT2440
agaucaggucgccaggcu

SEQ ID NO: 3586548 - RNA, 15 nt, Pseudomonas putida KT2440
agaucaucagcgcca

SEQ ID NO: 3586549 - RNA, 12 nt, Pseudomonas putida KT2440
agaucaucaucg

SEQ ID NO: 3586550 - RNA, 19 nt, Pseudomonas putida KT2440
agaucaucaucggcaugca

SEQ ID NO: 3586551 - RNA, 13 nt, Pseudomonas putida KT2440
agaucauggcggu

SEQ ID NO: 3586552 - RNA, 21 nt, Pseudomonas putida KT2440
agauccgcagggucuucucag

SEQ ID NO: 3586553 - RNA, 22 nt, Pseudomonas putida KT2440
agauccgcggcaugugcggguu

SEQ ID NO: 3586554 - RNA, 12 nt, Pseudomonas putida KT2440
agauccugcagc

SEQ ID NO: 3586555 - RNA, 21 nt, Pseudomonas putida KT2440
agaucgagcgccgcccgcgcg

SEQ ID NO: 3586556 - RNA, 20 nt, Pseudomonas putida KT2440
agaucgagcgccgcccgcgu

SEQ ID NO: 3586557 - RNA, 16 nt, Pseudomonas putida KT2440
agaucgcccagcugga

SEQ ID NO: 3586558 - RNA, 23 nt, Pseudomonas putida KT2440
agaucggugcguaggagcggguc

SEQ ID NO: 3586559 - RNA, 16 nt, Pseudomonas putida KT2440
agaugaaguagaacug

SEQ ID NO: 3586560 - RNA, 22 nt, Pseudomonas putida KT2440
agaugcacaccaguucaccauc

SEQ ID NO: 3586561 - RNA, 23 nt, Pseudomonas putida KT2440
agaugcacaccaguucaccaucc

SEQ ID NO: 3586562 - RNA, 20 nt, Pseudomonas putida KT2440
agaugccgccgcugccagca

SEQ ID NO: 3586563 - RNA, 19 nt, Pseudomonas putida KT2440
agaugcgccgggacagcac

SEQ ID NO: 3586564 - RNA, 21 nt, Pseudomonas putida KT2440
agaugcuccaaccccagcgca

SEQ ID NO: 3586565 - RNA, 16 nt, Pseudomonas putida KT2440
agaugcugcugcagug

SEQ ID NO: 3586566 - RNA, 13 nt, Pseudomonas putida KT2440
agaugcugguucg

SEQ ID NO: 3586567 - RNA, 23 nt, Pseudomonas putida KT2440
agauggcagacaaguccuucauc

SEQ ID NO: 3586568 - RNA, 22 nt, Pseudomonas putida KT2440
agauggcccggucccgcugccg

SEQ ID NO: 3586569 - RNA, 20 nt, Pseudomonas putida KT2440
agauggcuacgugauugacc

SEQ ID NO: 3586570 - RNA, 17 nt, Pseudomonas putida KT2440
agauggcucaucgccgu

SEQ ID NO: 3586571 - RNA, 21 nt, Pseudomonas putida KT2440
agauguacagaaugcgcucga

SEQ ID NO: 3586572 - RNA, 18 nt, Pseudomonas putida KT2440
agauuacgcgucaucugc

SEQ ID NO: 3586573 - RNA, 17 nt, Pseudomonas putida KT2440
agauuccguaccaguuc

SEQ ID NO: 3586574 - RNA, 19 nt, Pseudomonas putida KT2440
agauugaaggggcaaaguu

SEQ ID NO: 3586575 - RNA, 12 nt, Pseudomonas putida KT2440
agauugagagga

SEQ ID NO: 3586576 - RNA, 13 nt, Pseudomonas putida KT2440
agauugcaucacu

SEQ ID NO: 3586577 - RNA, 18 nt, Pseudomonas putida KT2440
agauugcccuguggcugu

SEQ ID NO: 3586578 - RNA, 21 nt, Pseudomonas putida KT2440
agauugcuuauucuucuggcu

SEQ ID NO: 3586579 - RNA, 11 nt, Pseudomonas putida KT2440
agauuggccag

SEQ ID NO: 3586580 - RNA, 12 nt, Pseudomonas putida KT2440
agauuggccagc

SEQ ID NO: 3586581 - RNA, 13 nt, Pseudomonas putida KT2440
agauuggccagca

SEQ ID NO: 3586582 - RNA, 14 nt, Pseudomonas putida KT2440
agauuggccagcag

SEQ ID NO: 3586583 - RNA, 21 nt, Pseudomonas putida KT2440
agauuggccagcagggccggc

SEQ ID NO: 3586584 - RNA, 16 nt, Pseudomonas putida KT2440
agauuggucggcaggg

SEQ ID NO: 3586585 - RNA, 18 nt, Pseudomonas putida KT2440
agauuugccuuggaaugc

SEQ ID NO: 3586586 - RNA, 21 nt, Pseudomonas putida KT2440
agcaaacccgacaacagcugc

SEQ ID NO: 3586587 - RNA, 23 nt, Pseudomonas putida KT2440
agcaaacccgacaacagcugcau

SEQ ID NO: 3586588 - RNA, 18 nt, Pseudomonas putida KT2440
agcaaaccgaccaggcag

SEQ ID NO: 3586589 - RNA, 14 nt, Pseudomonas putida KT2440
agcaaagcccgccc

SEQ ID NO: 3586590 - RNA, 15 nt, Pseudomonas putida KT2440
agcaaaggcgaccuu

SEQ ID NO: 3586591 - RNA, 20 nt, Pseudomonas putida KT2440
agcaaagguuugucgcccgc

SEQ ID NO: 3586592 - RNA, 23 nt, Pseudomonas putida KT2440
agcaaagguuugucgcccgccuc

SEQ ID NO: 3586593 - RNA, 16 nt, Pseudomonas putida KT2440
agcaaaugcccacugc

SEQ ID NO: 3586594 - RNA, 21 nt, Pseudomonas putida KT2440
agcaacacgacgauggccacc

SEQ ID NO: 3586595 - RNA, 22 nt, Pseudomonas putida KT2440
agcaaccacgcuuggcucauca

SEQ ID NO: 3586596 - RNA, 18 nt, Pseudomonas putida KT2440
agcaaccggacggguuuc

SEQ ID NO: 3586597 - RNA, 16 nt, Pseudomonas putida KT2440
agcaaccgugacuggu

SEQ ID NO: 3586598 - RNA, 23 nt, Pseudomonas putida KT2440
agcaaccucgagguacgagucag

SEQ ID NO: 3586599 - RNA, 18 nt, Pseudomonas putida KT2440
agcaacgcaucgacgaac

SEQ ID NO: 3586600 - RNA, 13 nt, Pseudomonas putida KT2440
agcaacgccgagc

SEQ ID NO: 3586601 - RNA, 14 nt, Pseudomonas putida KT2440
agcaacgccgagca

SEQ ID NO: 3586602 - RNA, 15 nt, Pseudomonas putida KT2440
agcaacgccuucagg

SEQ ID NO: 3586603 - RNA, 16 nt, Pseudomonas putida KT2440
agcaacgccuuggccu

SEQ ID NO: 3586604 - RNA, 18 nt, Pseudomonas putida KT2440
agcaacggugaacggcgg

SEQ ID NO: 3586605 - RNA, 15 nt, Pseudomonas putida KT2440
agcaacuccccccgc

SEQ ID NO: 3586606 - RNA, 17 nt, Pseudomonas putida KT2440
agcaacugcgcccaaug

SEQ ID NO: 3586607 - RNA, 21 nt, Pseudomonas putida KT2440
agcaacugcgccguggccgcc

SEQ ID NO: 3586608 - RNA, 21 nt, Pseudomonas putida KT2440
agcaacuguuggaauggcgca

SEQ ID NO: 3586609 - RNA, 14 nt, Pseudomonas putida KT2440
agcaagcagauuuu

SEQ ID NO: 3586610 - RNA, 14 nt, Pseudomonas putida KT2440
agcaagcuggcacc

SEQ ID NO: 3586611 - RNA, 15 nt, Pseudomonas putida KT2440
agcaagcuggcaccg

SEQ ID NO: 3586612 - RNA, 18 nt, Pseudomonas putida KT2440
agcaagcuggcaccggcg

SEQ ID NO: 3586613 - RNA, 15 nt, Pseudomonas putida KT2440
agcaaggccuccagg

SEQ ID NO: 3586614 - RNA, 23 nt, Pseudomonas putida KT2440
agcaagggccguuacucccacag

SEQ ID NO: 3586615 - RNA, 17 nt, Pseudomonas putida KT2440
agcaagucaugcucgcc

SEQ ID NO: 3586616 - RNA, 20 nt, Pseudomonas putida KT2440
agcaagucccccaucggcac

SEQ ID NO: 3586617 - RNA, 22 nt, Pseudomonas putida KT2440
agcaagucccccaucggcaccc

SEQ ID NO: 3586618 - RNA, 20 nt, Pseudomonas putida KT2440
agcaauacauccaggcccgu

SEQ ID NO: 3586619 - RNA, 20 nt, Pseudomonas putida KT2440
agcaaucaggucaucgaaga

SEQ ID NO: 3586620 - RNA, 12 nt, Pseudomonas putida KT2440
agcaaucugcug

SEQ ID NO: 3586621 - RNA, 22 nt, Pseudomonas putida KT2440
agcaaugcccgcucgcugcgau

SEQ ID NO: 3586622 - RNA, 22 nt, Pseudomonas putida KT2440
agcaaugccgaacagucaucca

SEQ ID NO: 3586623 - RNA, 15 nt, Pseudomonas putida KT2440
agcacaaccacugca

SEQ ID NO: 3586624 - RNA, 22 nt, Pseudomonas putida KT2440
agcacaaggcucaagcgcagcc

SEQ ID NO: 3586625 - RNA, 13 nt, Pseudomonas putida KT2440
agcacaaggcugu

SEQ ID NO: 3586626 - RNA, 21 nt, Pseudomonas putida KT2440
agcacaaggcuguuccacagc

SEQ ID NO: 3586627 - RNA, 15 nt, Pseudomonas putida KT2440
agcacaagggccagg

SEQ ID NO: 3586628 - RNA, 16 nt, Pseudomonas putida KT2440
agcacaagggccaggu

SEQ ID NO: 3586629 - RNA, 16 nt, Pseudomonas putida KT2440
agcacacgcuugucuu

SEQ ID NO: 3586630 - RNA, 19 nt, Pseudomonas putida KT2440
agcacacgcuugucuucca

SEQ ID NO: 3586631 - RNA, 15 nt, Pseudomonas putida KT2440
agcacacugagcacc

SEQ ID NO: 3586632 - RNA, 14 nt, Pseudomonas putida KT2440
agcacagauaaacc

SEQ ID NO: 3586633 - RNA, 23 nt, Pseudomonas putida KT2440
agcacagauaaaccugccaccca

SEQ ID NO: 3586634 - RNA, 20 nt, Pseudomonas putida KT2440
agcacaggccgccugaccug

SEQ ID NO: 3586635 - RNA, 21 nt, Pseudomonas putida KT2440
agcacaggucucgaacgcugu

SEQ ID NO: 3586636 - RNA, 20 nt, Pseudomonas putida KT2440
agcacagugcggcggcacug

SEQ ID NO: 3586637 - RNA, 19 nt, Pseudomonas putida KT2440
agcacaucacacagcggca

SEQ ID NO: 3586638 - RNA, 17 nt, Pseudomonas putida KT2440
agcacauucagcagcgc

SEQ ID NO: 3586639 - RNA, 13 nt, Pseudomonas putida KT2440
agcagcugccgga

SEQ ID NO: 3586640 - RNA, 12 nt, Pseudomonas putida KT2440
agcagcuucagc

SEQ ID NO: 3586641 - RNA, 16 nt, Pseudomonas putida KT2440
agcagcuucagccagg

SEQ ID NO: 3586642 - RNA, 17 nt, Pseudomonas putida KT2440
agcagcuucagccaggg

SEQ ID NO: 3586643 - RNA, 20 nt, Pseudomonas putida KT2440
agcagcuuccugugccgcuu

SEQ ID NO: 3586644 - RNA, 20 nt, Pseudomonas putida KT2440
agcagcuugcagcgccgagc

SEQ ID NO: 3586645 - RNA, 19 nt, Pseudomonas putida KT2440
agcaggaagaucaucaucu

SEQ ID NO: 3586646 - RNA, 16 nt, Pseudomonas putida KT2440
agcaggagcugaacug

SEQ ID NO: 3586647 - RNA, 14 nt, Pseudomonas putida KT2440
agcaggaucugcug

SEQ ID NO: 3586648 - RNA, 23 nt, Pseudomonas putida KT2440
agcaggauggugacugccagcac

SEQ ID NO: 3586649 - RNA, 16 nt, Pseudomonas putida KT2440
agcaggaugucaggag

SEQ ID NO: 3586650 - RNA, 20 nt, Pseudomonas putida KT2440
agcaggcaagcccgcuugcu

SEQ ID NO: 3586651 - RNA, 14 nt, Pseudomonas putida KT2440
agcaggccaccggc

SEQ ID NO: 3586652 - RNA, 19 nt, Pseudomonas putida KT2440
agcaggcccgccaccgccu

SEQ ID NO: 3586653 - RNA, 19 nt, Pseudomonas putida KT2440
agcaggcgcgagccuugcc

SEQ ID NO: 3586654 - RNA, 14 nt, Pseudomonas putida KT2440
agcaggcgcucggg

SEQ ID NO: 3586655 - RNA, 17 nt, Pseudomonas putida KT2440
agcagggaaaugaccug

SEQ ID NO: 3586656 - RNA, 16 nt, Pseudomonas putida KT2440
agcaggggacgcauuc

SEQ ID NO: 3586657 - RNA, 13 nt, Pseudomonas putida KT2440
agcagggugccuu

SEQ ID NO: 3586658 - RNA, 16 nt, Pseudomonas putida KT2440
agcaggguggccagca

SEQ ID NO: 3586659 - RNA, 17 nt, Pseudomonas putida KT2440
agcagguaaacccgcgc

SEQ ID NO: 3586660 - RNA, 14 nt, Pseudomonas putida KT2440
agcagguacagcac

SEQ ID NO: 3586661 - RNA, 22 nt, Pseudomonas putida KT2440
agcaggucagcgcucaaaaaaa

SEQ ID NO: 3586662 - RNA, 23 nt, Pseudomonas putida KT2440
agcaggucagcgcucaaaaaaau

SEQ ID NO: 3586663 - RNA, 22 nt, Pseudomonas putida KT2440
agcaggucaugcaggucaucga

SEQ ID NO: 3586664 - RNA, 12 nt, Pseudomonas putida KT2440
agcagguccagc

SEQ ID NO: 3586665 - RNA, 17 nt, Pseudomonas putida KT2440
agcaggucucgacacgc

SEQ ID NO: 3586666 - RNA, 19 nt, Pseudomonas putida KT2440
agcaggugcccaagcggca

SEQ ID NO: 3586667 - RNA, 18 nt, Pseudomonas putida KT2440
agcaggugcucaagccgg

SEQ ID NO: 3586668 - RNA, 15 nt, Pseudomonas putida KT2440
agcagguucaggcgc

SEQ ID NO: 3586669 - RNA, 17 nt, Pseudomonas putida KT2440
agcagguugaacagcag

SEQ ID NO: 3586670 - RNA, 17 nt, Pseudomonas putida KT2440
agcagguuguccaccgc

SEQ ID NO: 3586671 - RNA, 19 nt, Pseudomonas putida KT2440
agcagguuguccaccgcgc

SEQ ID NO: 3586672 - RNA, 18 nt, Pseudomonas putida KT2440
agcagguuuuccagcccg

SEQ ID NO: 3586673 - RNA, 13 nt, Pseudomonas putida KT2440
agcagucccagca

SEQ ID NO: 3586674 - RNA, 14 nt, Pseudomonas putida KT2440
agcagucccagcac

SEQ ID NO: 3586675 - RNA, 16 nt, Pseudomonas putida KT2440
agcagucccaucuggu

SEQ ID NO: 3586676 - RNA, 19 nt, Pseudomonas putida KT2440
agcagucccaucugguugg

SEQ ID NO: 3586677 - RNA, 19 nt, Pseudomonas putida KT2440
agcagucuugugcugcgag

SEQ ID NO: 3586678 - RNA, 13 nt, Pseudomonas putida KT2440
agcagugcaucga

SEQ ID NO: 3586679 - RNA, 14 nt, Pseudomonas putida KT2440
agcagugccagcaa

SEQ ID NO: 3586680 - RNA, 12 nt, Pseudomonas putida KT2440
agcagugccauc

SEQ ID NO: 3586681 - RNA, 10 nt, Pseudomonas putida KT2440
agcaguggug

SEQ ID NO: 3586682 - RNA, 16 nt, Pseudomonas putida KT2440
agcaguuccuucagca

SEQ ID NO: 3586683 - RNA, 23 nt, Pseudomonas putida KT2440
agcaguucgcgcaccaucggcuc

SEQ ID NO: 3586684 - RNA, 16 nt, Pseudomonas putida KT2440
agcaguucgucgagca

SEQ ID NO: 3586685 - RNA, 14 nt, Pseudomonas putida KT2440
agcaguugcugcug

SEQ ID NO: 3586686 - RNA, 19 nt, Pseudomonas putida KT2440
agcaguuucagcggccgcu

SEQ ID NO: 3586687 - RNA, 18 nt, Pseudomonas putida KT2440
agcauagccaaacuugug

SEQ ID NO: 3586688 - RNA, 22 nt, Pseudomonas putida KT2440
agcaucaaucgcuccaggcggc

SEQ ID NO: 3586689 - RNA, 15 nt, Pseudomonas putida KT2440
agcaucaccacgccc

SEQ ID NO: 3586690 - RNA, 16 nt, Pseudomonas putida KT2440
agcaucaccacgcccu

SEQ ID NO: 3586691 - RNA, 17 nt, Pseudomonas putida KT2440
agcaucaccacgcccug

SEQ ID NO: 3586692 - RNA, 18 nt, Pseudomonas putida KT2440
agcaucaccacgcccugg

SEQ ID NO: 3586693 - RNA, 17 nt, Pseudomonas putida KT2440
agcaucaccgcgccggu

SEQ ID NO: 3586694 - RNA, 18 nt, Pseudomonas putida KT2440
agcaucaccgcgccgguc

SEQ ID NO: 3586695 - RNA, 16 nt, Pseudomonas putida KT2440
agcaucaccgcgucga

SEQ ID NO: 3586696 - RNA, 13 nt, Pseudomonas putida KT2440
agcaucacgccgc

SEQ ID NO: 3586697 - RNA, 21 nt, Pseudomonas putida KT2440
agcaucagcacacccagcacg

SEQ ID NO: 3586698 - RNA, 16 nt, Pseudomonas putida KT2440
agcaucagccaugggc

SEQ ID NO: 3586699 - RNA, 13 nt, Pseudomonas putida KT2440
agcaucagugcag

SEQ ID NO: 3586700 - RNA, 19 nt, Pseudomonas putida KT2440
agcauccagccauuccagg

SEQ ID NO: 3586701 - RNA, 17 nt, Pseudomonas putida KT2440
agcaucccccuccuaag

SEQ ID NO: 3586702 - RNA, 19 nt, Pseudomonas putida KT2440
agcaucccccuccuaaggg

SEQ ID NO: 3586703 - RNA, 21 nt, Pseudomonas putida KT2440
agcaucccccuccuaagggga

SEQ ID NO: 3586704 - RNA, 21 nt, Pseudomonas putida KT2440
agcaucgaccugccacugcgc

SEQ ID NO: 3586705 - RNA, 22 nt, Pseudomonas putida KT2440
agcaucgaccugccacugcgcu

SEQ ID NO: 3586706 - RNA, 20 nt, Pseudomonas putida KT2440
agcaucggauaucugcgcca

SEQ ID NO: 3586707 - RNA, 15 nt, Pseudomonas putida KT2440
agcaucugcaccagg

SEQ ID NO: 3586708 - RNA, 22 nt, Pseudomonas putida KT2440
agcaucugcugcggcaggcugg

SEQ ID NO: 3586709 - RNA, 15 nt, Pseudomonas putida KT2440
agcaucuucuucacg

SEQ ID NO: 3586710 - RNA, 15 nt, Pseudomonas putida KT2440
agcaucuucuucccc

SEQ ID NO: 3586711 - RNA, 10 nt, Pseudomonas putida KT2440
agcaugaaca

SEQ ID NO: 3586712 - RNA, 16 nt, Pseudomonas putida KT2440
agcaugaacagcgcug

SEQ ID NO: 3586713 - RNA, 22 nt, Pseudomonas putida KT2440
agcaugaauagcgcacugagca

SEQ ID NO: 3586714 - RNA, 17 nt, Pseudomonas putida KT2440
agcaugaucaccgccag

SEQ ID NO: 3586715 - RNA, 22 nt, Pseudomonas putida KT2440
agcaugaucaccgccagcggca

SEQ ID NO: 3586716 - RNA, 14 nt, Pseudomonas putida KT2440
agcaugcccagcgc

SEQ ID NO: 3586717 - RNA, 18 nt, Pseudomonas putida KT2440
agcaugcccagcgccacc

SEQ ID NO: 3586718 - RNA, 16 nt, Pseudomonas putida KT2440
agcaugccccgggugc

SEQ ID NO: 3586719 - RNA, 21 nt, Pseudomonas putida KT2440
agcaugcgaagccgccagcgu

SEQ ID NO: 3586720 - RNA, 17 nt, Pseudomonas putida KT2440
agcaugcgcuugagcga

SEQ ID NO: 3586721 - RNA, 16 nt, Pseudomonas putida KT2440
agcaugcgggggcccc

SEQ ID NO: 3586722 - RNA, 16 nt, Pseudomonas putida KT2440
agcauggcaaacagca

SEQ ID NO: 3586723 - RNA, 19 nt, Pseudomonas putida KT2440
agcauggccgaaaccagcc

SEQ ID NO: 3586724 - RNA, 23 nt, Pseudomonas putida KT2440
agcauggccgaaaccagccccuu

SEQ ID NO: 3586725 - RNA, 11 nt, Pseudomonas putida KT2440
agcauggcgau

SEQ ID NO: 3586726 - RNA, 17 nt, Pseudomonas putida KT2440
agcauguaagcuucagc

SEQ ID NO: 3586727 - RNA, 21 nt, Pseudomonas putida KT2440
agcauguaagcuucagcgacc

SEQ ID NO: 3586728 - RNA, 16 nt, Pseudomonas putida KT2440
agcauguccugcugca

SEQ ID NO: 3586729 - RNA, 18 nt, Pseudomonas putida KT2440
agcauguccugcugcagg

SEQ ID NO: 3586730 - RNA, 17 nt, Pseudomonas putida KT2440
agcauguucaccagguu

SEQ ID NO: 3586731 - RNA, 14 nt, Pseudomonas putida KT2440
agcauuacuucuug

SEQ ID NO: 3586732 - RNA, 21 nt, Pseudomonas putida KT2440
agcauucagcucauaucgcuc

SEQ ID NO: 3586733 - RNA, 19 nt, Pseudomonas putida KT2440
agcauuggauacugcccgu

SEQ ID NO: 3586734 - RNA, 20 nt, Pseudomonas putida KT2440
agccaaaucagcuguuugaa

SEQ ID NO: 3586735 - RNA, 16 nt, Pseudomonas putida KT2440
agccaaccgagucaac

SEQ ID NO: 3586736 - RNA, 15 nt, Pseudomonas putida KT2440
agccaaccgccccac

SEQ ID NO: 3586737 - RNA, 16 nt, Pseudomonas putida KT2440
agccaaccgccccacc

SEQ ID NO: 3586738 - RNA, 20 nt, Pseudomonas putida KT2440
agccaaccgccccacccauu

SEQ ID NO: 3586739 - RNA, 17 nt, Pseudomonas putida KT2440
agccaacgccccacccg

SEQ ID NO: 3586740 - RNA, 17 nt, Pseudomonas putida KT2440
agccaaggccgcccagu

SEQ ID NO: 3586741 - RNA, 22 nt, Pseudomonas putida KT2440
agccaaucugauuugcgcuaca

SEQ ID NO: 3586742 - RNA, 16 nt, Pseudomonas putida KT2440
agccaaugcagauggu

SEQ ID NO: 3586743 - RNA, 18 nt, Pseudomonas putida KT2440
agccaaugcugaugaagc

SEQ ID NO: 3586744 - RNA, 22 nt, Pseudomonas putida KT2440
agccaauuucaacgcucgcgca

SEQ ID NO: 3586745 - RNA, 13 nt, Pseudomonas putida KT2440
agcccccagaaug

SEQ ID NO: 3586746 - RNA, 22 nt, Pseudomonas putida KT2440
agcccccagaauguugcaagga

SEQ ID NO: 3586747 - RNA, 15 nt, Pseudomonas putida KT2440
agccccccuguagga

SEQ ID NO: 3586748 - RNA, 18 nt, Pseudomonas putida KT2440
agcccccgcugcucgagg

SEQ ID NO: 3586749 - RNA, 22 nt, Pseudomonas putida KT2440
agcccccgcugcucgaggaagc

SEQ ID NO: 3586750 - RNA, 16 nt, Pseudomonas putida KT2440
agccccgagcaaagcc

SEQ ID NO: 3586751 - RNA, 15 nt, Pseudomonas putida KT2440
agccccgcacaucac

SEQ ID NO: 3586752 - RNA, 12 nt, Pseudomonas putida KT2440
agccccgccagu

SEQ ID NO: 3586753 - RNA, 15 nt, Pseudomonas putida KT2440
agccccgccgccccc

SEQ ID NO: 3586754 - RNA, 22 nt, Pseudomonas putida KT2440
agccccgcgcguccauggcgcc

SEQ ID NO: 3586755 - RNA, 22 nt, Pseudomonas putida KT2440
agccccggcuuucucaagccug

SEQ ID NO: 3586756 - RNA, 15 nt, Pseudomonas putida KT2440
agccccucaggcaca

SEQ ID NO: 3586757 - RNA, 15 nt, Pseudomonas putida KT2440
agccccuccuaaggg

SEQ ID NO: 3586758 - RNA, 19 nt, Pseudomonas putida KT2440
agccccugcggcugcccca

SEQ ID NO: 3586759 - RNA, 17 nt, Pseudomonas putida KT2440
agccccuuccccaggcc

SEQ ID NO: 3586760 - RNA, 19 nt, Pseudomonas putida KT2440
agcccgaaaccgccagcca

SEQ ID NO: 3586761 - RNA, 13 nt, Pseudomonas putida KT2440
agcccgaagccgg

SEQ ID NO: 3586762 - RNA, 17 nt, Pseudomonas putida KT2440
agcccgaagcuaucgcc

SEQ ID NO: 3586763 - RNA, 20 nt, Pseudomonas putida KT2440
agcccgagcaaggcgcagcc

SEQ ID NO: 3586764 - RNA, 14 nt, Pseudomonas putida KT2440
agcccgauggccuu

SEQ ID NO: 3586765 - RNA, 18 nt, Pseudomonas putida KT2440
agcccgauggccuugauc

SEQ ID NO: 3586766 - RNA, 20 nt, Pseudomonas putida KT2440
agcccgauggccuugaucag

SEQ ID NO: 3586767 - RNA, 15 nt, Pseudomonas putida KT2440
agcccgcacccacag

SEQ ID NO: 3586768 - RNA, 23 nt, Pseudomonas putida KT2440
agcccgcacccacagagacaccg

SEQ ID NO: 3586769 - RNA, 16 nt, Pseudomonas putida KT2440
agcccgcaccggccga

SEQ ID NO: 3586770 - RNA, 12 nt, Pseudomonas putida KT2440
agcccgccagca

SEQ ID NO: 3586771 - RNA, 14 nt, Pseudomonas putida KT2440
agcccgccagcagg

SEQ ID NO: 3586772 - RNA, 15 nt, Pseudomonas putida KT2440
agcccgccagcaggc

SEQ ID NO: 3586773 - RNA, 21 nt, Pseudomonas putida KT2440
agcccgcccacaugcgagccg

SEQ ID NO: 3586774 - RNA, 14 nt, Pseudomonas putida KT2440
agcccgccgccagu

SEQ ID NO: 3586775 - RNA, 19 nt, Pseudomonas putida KT2440
agcccgcgaagaggccagg

SEQ ID NO: 3586776 - RNA, 20 nt, Pseudomonas putida KT2440
agcccgcgaagaggccagga

SEQ ID NO: 3586777 - RNA, 19 nt, Pseudomonas putida KT2440
agcccgcgcuucacgucug

SEQ ID NO: 3586778 - RNA, 19 nt, Pseudomonas putida KT2440
agcccgcguucaugccggc

SEQ ID NO: 3586779 - RNA, 17 nt, Pseudomonas putida KT2440
agcccgcucauguccag

SEQ ID NO: 3586780 - RNA, 21 nt, Pseudomonas putida KT2440
agcccgcucauguccagguca

SEQ ID NO: 3586781 - RNA, 21 nt, Pseudomonas putida KT2440
agcccgcucgccacacaaauc

SEQ ID NO: 3586782 - RNA, 15 nt, Pseudomonas putida KT2440
agcccggacugcacc

SEQ ID NO: 3586783 - RNA, 19 nt, Pseudomonas putida KT2440
agcccggacugcaccaggu

SEQ ID NO: 3586784 - RNA, 21 nt, Pseudomonas putida KT2440
agcccggcacgguugcgcccg

SEQ ID NO: 3586785 - RNA, 20 nt, Pseudomonas putida KT2440
agcccggccgcgccaccggg

SEQ ID NO: 3586786 - RNA, 16 nt, Pseudomonas putida KT2440
agcccggcggccagca

SEQ ID NO: 3586787 - RNA, 18 nt, Pseudomonas putida KT2440
agcccggcggccagcacg

SEQ ID NO: 3586788 - RNA, 21 nt, Pseudomonas putida KT2440
agcccggcuugcaccaacggc

SEQ ID NO: 3586789 - RNA, 14 nt, Pseudomonas putida KT2440
agcccgggcagccg

SEQ ID NO: 3586790 - RNA, 13 nt, Pseudomonas putida KT2440
agcccgguccaug

SEQ ID NO: 3586791 - RNA, 17 nt, Pseudomonas putida KT2440
agcccggugcccuugcc

SEQ ID NO: 3586792 - RNA, 22 nt, Pseudomonas putida KT2440
agcccguauucgcggguaaacc

SEQ ID NO: 3586793 - RNA, 21 nt, Pseudomonas putida KT2440
agcccguccgccuugagguug

SEQ ID NO: 3586794 - RNA, 13 nt, Pseudomonas putida KT2440
agcccgugccgca

SEQ ID NO: 3586795 - RNA, 19 nt, Pseudomonas putida KT2440
agcccgugccgcaucagcc

SEQ ID NO: 3586796 - RNA, 13 nt, Pseudomonas putida KT2440
agcccguggcccu

SEQ ID NO: 3586797 - RNA, 22 nt, Pseudomonas putida KT2440
agcccguggcccucagcccagu

SEQ ID NO: 3586798 - RNA, 20 nt, Pseudomonas putida KT2440
agcccuacgcagucagccac

SEQ ID NO: 3586799 - RNA, 23 nt, Pseudomonas putida KT2440
agcccucggcaaucugcagcagc

SEQ ID NO: 3586800 - RNA, 22 nt, Pseudomonas putida KT2440
agcccugcucguccaucaccgc

SEQ ID NO: 3586801 - RNA, 13 nt, Pseudomonas putida KT2440
agcccugcugcug

SEQ ID NO: 3586802 - RNA, 17 nt, Pseudomonas putida KT2440
agcccuucgcggcaagc

SEQ ID NO: 3586803 - RNA, 21 nt, Pseudomonas putida KT2440
agcccuucucgcucagcaacu

SEQ ID NO: 3586804 - RNA, 18 nt, Pseudomonas putida KT2440
agcccuugcucggccagc

SEQ ID NO: 3586805 - RNA, 20 nt, Pseudomonas putida KT2440
agcccuugcucggccagccg

SEQ ID NO: 3586806 - RNA, 14 nt, Pseudomonas putida KT2440
agcccuugcugcag

SEQ ID NO: 3586807 - RNA, 20 nt, Pseudomonas putida KT2440
agccgaaccauucaaugcgu

SEQ ID NO: 3586808 - RNA, 18 nt, Pseudomonas putida KT2440
agccgaaguugcccgaac

SEQ ID NO: 3586809 - RNA, 18 nt, Pseudomonas putida KT2440
agccgacaaaaacaacaa

SEQ ID NO: 3586810 - RNA, 13 nt, Pseudomonas putida KT2440
agccgacggccaa

SEQ ID NO: 3586811 - RNA, 19 nt, Pseudomonas putida KT2440
agccgagcaucuuccagcc

SEQ ID NO: 3586812 - RNA, 16 nt, Pseudomonas putida KT2440
agccgcaggcgccccc

SEQ ID NO: 3586813 - RNA, 15 nt, Pseudomonas putida KT2440
agccgccaacccgug

SEQ ID NO: 3586814 - RNA, 13 nt, Pseudomonas putida KT2440
agccgccacauga

SEQ ID NO: 3586815 - RNA, 21 nt, Pseudomonas putida KT2440
agccgccagcaucacgccgcg

SEQ ID NO: 3586816 - RNA, 18 nt, Pseudomonas putida KT2440
agccgcccgcccgccugc

SEQ ID NO: 3586817 - RNA, 20 nt, Pseudomonas putida KT2440
agccgcccgcccgccugcgc

SEQ ID NO: 3586818 - RNA, 16 nt, Pseudomonas putida KT2440
agccgccgaccaggug

SEQ ID NO: 3586819 - RNA, 23 nt, Pseudomonas putida KT2440
agccgccgccgagugcgcggaac

SEQ ID NO: 3586820 - RNA, 18 nt, Pseudomonas putida KT2440
agccgccgccugucgcga

SEQ ID NO: 3586821 - RNA, 21 nt, Pseudomonas putida KT2440
agccgccgcugcgaggaucag

SEQ ID NO: 3586822 - RNA, 12 nt, Pseudomonas putida KT2440
agccgccguacc

SEQ ID NO: 3586823 - RNA, 16 nt, Pseudomonas putida KT2440
agccgccguaccuucg

SEQ ID NO: 3586824 - RNA, 15 nt, Pseudomonas putida KT2440
agccgcgccacuccc

SEQ ID NO: 3586825 - RNA, 14 nt, Pseudomonas putida KT2440
agccgcgccagguc

SEQ ID NO: 3586826 - RNA, 14 nt, Pseudomonas putida KT2440
agccgcgcccucuu

SEQ ID NO: 3586827 - RNA, 15 nt, Pseudomonas putida KT2440
agccgcgggcgucgc

SEQ ID NO: 3586828 - RNA, 19 nt, Pseudomonas putida KT2440
agccgcgggcgucgcgauc

SEQ ID NO: 3586829 - RNA, 20 nt, Pseudomonas putida KT2440
agccgcguccacaaaccccg

SEQ ID NO: 3586830 - RNA, 16 nt, Pseudomonas putida KT2440
agccgcucagccaccu

SEQ ID NO: 3586831 - RNA, 18 nt, Pseudomonas putida KT2440
agccgcucagccaccugu

SEQ ID NO: 3586832 - RNA, 20 nt, Pseudomonas putida KT2440
agccgcucgagaaacgccag

SEQ ID NO: 3586833 - RNA, 17 nt, Pseudomonas putida KT2440
agccgcugccacaggua

SEQ ID NO: 3586834 - RNA, 16 nt, Pseudomonas putida KT2440
agccgcugcgccugcc

SEQ ID NO: 3586835 - RNA, 20 nt, Pseudomonas putida KT2440
agccgcugucgguaaaacag

SEQ ID NO: 3586836 - RNA, 22 nt, Pseudomonas putida KT2440
agccgcuguucugcagucaggu

SEQ ID NO: 3586837 - RNA, 19 nt, Pseudomonas putida KT2440
agccgcuuucggucagggc

SEQ ID NO: 3586838 - RNA, 22 nt, Pseudomonas putida KT2440
agccgcuuucggucagggcgau

SEQ ID NO: 3586839 - RNA, 18 nt, Pseudomonas putida KT2440
agccggcaauuuccugcg

SEQ ID NO: 3586840 - RNA, 21 nt, Pseudomonas putida KT2440
agccggcacagugccaaggac

SEQ ID NO: 3586841 - RNA, 18 nt, Pseudomonas putida KT2440
agccggcaccgccauggu

SEQ ID NO: 3586842 - RNA, 17 nt, Pseudomonas putida KT2440
agccggcagucacccac

SEQ ID NO: 3586843 - RNA, 15 nt, Pseudomonas putida KT2440
agccggcccuucugc

SEQ ID NO: 3586844 - RNA, 14 nt, Pseudomonas putida KT2440
agccggcgaacagc

SEQ ID NO: 3586845 - RNA, 19 nt, Pseudomonas putida KT2440
agccggcgaacagcacugc

SEQ ID NO: 3586846 - RNA, 18 nt, Pseudomonas putida KT2440
agccggcgccgguggcgg

SEQ ID NO: 3586847 - RNA, 12 nt, Pseudomonas putida KT2440
agccggcggcca

SEQ ID NO: 3586848 - RNA, 15 nt, Pseudomonas putida KT2440
agccggcuaucggac

SEQ ID NO: 3586849 - RNA, 15 nt, Pseudomonas putida KT2440
agccggcuaucggcc

SEQ ID NO: 3586850 - RNA, 11 nt, Pseudomonas putida KT2440
agcgagguacg

SEQ ID NO: 3586851 - RNA, 21 nt, Pseudomonas putida KT2440
agcgagguacggcaagguacu

SEQ ID NO: 3586852 - RNA, 23 nt, Pseudomonas putida KT2440
agcgagguaggccgucagcagca

SEQ ID NO: 3586853 - RNA, 14 nt, Pseudomonas putida KT2440
agcgagugaccuug

SEQ ID NO: 3586854 - RNA, 23 nt, Pseudomonas putida KT2440
agcgaguggccacggaucaccac

SEQ ID NO: 3586855 - RNA, 16 nt, Pseudomonas putida KT2440
agcgauaaaccagcag

SEQ ID NO: 3586856 - RNA, 21 nt, Pseudomonas putida KT2440
agcgauaauugugcccuugaa

SEQ ID NO: 3586857 - RNA, 22 nt, Pseudomonas putida KT2440
agcgaucgaaaggcgacuccug

SEQ ID NO: 3586858 - RNA, 14 nt, Pseudomonas putida KT2440
agcgaugcacgcca

SEQ ID NO: 3586859 - RNA, 17 nt, Pseudomonas putida KT2440
agcgaugcacgccagca

SEQ ID NO: 3586860 - RNA, 12 nt, Pseudomonas putida KT2440
agcgaugccggg

SEQ ID NO: 3586861 - RNA, 13 nt, Pseudomonas putida KT2440
agcgaugccgggg

SEQ ID NO: 3586862 - RNA, 15 nt, Pseudomonas putida KT2440
agcgaugccggggcu

SEQ ID NO: 3586863 - RNA, 18 nt, Pseudomonas putida KT2440
agcgcaaaaaacgccgca

SEQ ID NO: 3586864 - RNA, 17 nt, Pseudomonas putida KT2440
agcgcaaaaccaccagc

SEQ ID NO: 3586865 - RNA, 23 nt, Pseudomonas putida KT2440
agcgcaaauccccaaccaugcug

SEQ ID NO: 3586866 - RNA, 14 nt, Pseudomonas putida KT2440
agcgcaacaccgcc

SEQ ID NO: 3586867 - RNA, 19 nt, Pseudomonas putida KT2440
agcgcaagggggcaaagaa

SEQ ID NO: 3586868 - RNA, 16 nt, Pseudomonas putida KT2440
agcgcaaucaaagcag

SEQ ID NO: 3586869 - RNA, 17 nt, Pseudomonas putida KT2440
agcgcaaucaaagcaga

SEQ ID NO: 3586870 - RNA, 17 nt, Pseudomonas putida KT2440
agcgcaaugcccagcgc

SEQ ID NO: 3586871 - RNA, 14 nt, Pseudomonas putida KT2440
agcgcacagcugcc

SEQ ID NO: 3586872 - RNA, 23 nt, Pseudomonas putida KT2440
agcgcaccaguguagugaacagg

SEQ ID NO: 3586873 - RNA, 11 nt, Pseudomonas putida KT2440
agcgcaccgcg

SEQ ID NO: 3586874 - RNA, 11 nt, Pseudomonas putida KT2440
agcgcaccgcu

SEQ ID NO: 3586875 - RNA, 16 nt, Pseudomonas putida KT2440
agcgcaccgcugacca

SEQ ID NO: 3586876 - RNA, 18 nt, Pseudomonas putida KT2440
agcgcaccgcugaccaca

SEQ ID NO: 3586877 - RNA, 23 nt, Pseudomonas putida KT2440
agcgcaccgcugaccacaaagcc

SEQ ID NO: 3586878 - RNA, 21 nt, Pseudomonas putida KT2440
agcgcaccgugcaccagcacc

SEQ ID NO: 3586879 - RNA, 15 nt, Pseudomonas putida KT2440
agcgcaccugcaggu

SEQ ID NO: 3586880 - RNA, 21 nt, Pseudomonas putida KT2440
agcgcacuuccacacccagcg

SEQ ID NO: 3586881 - RNA, 13 nt, Pseudomonas putida KT2440
agcgcagacuggg

SEQ ID NO: 3586882 - RNA, 21 nt, Pseudomonas putida KT2440
agcgcagcaucuuccugccac

SEQ ID NO: 3586883 - RNA, 14 nt, Pseudomonas putida KT2440
agcgcagccaccag

SEQ ID NO: 3586884 - RNA, 18 nt, Pseudomonas putida KT2440
agcgcagcgacgaccugc

SEQ ID NO: 3586885 - RNA, 23 nt, Pseudomonas putida KT2440
agcgcagcuucucaagcaucugg

SEQ ID NO: 3586886 - RNA, 23 nt, Pseudomonas putida KT2440
agcgcaggcgguuggccauguug

SEQ ID NO: 3586887 - RNA, 16 nt, Pseudomonas putida KT2440
agcgcauaggcaauga

SEQ ID NO: 3586888 - RNA, 21 nt, Pseudomonas putida KT2440
agcgcaucaacgccucgcugc

SEQ ID NO: 3586889 - RNA, 20 nt, Pseudomonas putida KT2440
agcgcaucgaccggcaggcg

SEQ ID NO: 3586890 - RNA, 15 nt, Pseudomonas putida KT2440
agcgcaucggccacu

SEQ ID NO: 3586891 - RNA, 17 nt, Pseudomonas putida KT2440
agcgcaucuuccggcac

SEQ ID NO: 3586892 - RNA, 19 nt, Pseudomonas putida KT2440
agcgcaugcucgcgggccu

SEQ ID NO: 3586893 - RNA, 21 nt, Pseudomonas putida KT2440
agcgcauggcucaacuggcag

SEQ ID NO: 3586894 - RNA, 22 nt, Pseudomonas putida KT2440
agcgcauuggcguugagccgcc

SEQ ID NO: 3586895 - RNA, 16 nt, Pseudomonas putida KT2440
agcgccaaaggcgcgu

SEQ ID NO: 3586896 - RNA, 20 nt, Pseudomonas putida KT2440
agcgccagaucucgcgcuuu

SEQ ID NO: 3586897 - RNA, 15 nt, Pseudomonas putida KT2440
agcgccagcaacgca

SEQ ID NO: 3586898 - RNA, 19 nt, Pseudomonas putida KT2440
agcgccagcaacgcagcca

SEQ ID NO: 3586899 - RNA, 18 nt, Pseudomonas putida KT2440
agcgccagcaagcgcaua

SEQ ID NO: 3586900 - RNA, 16 nt, Pseudomonas putida KT2440
agcgccagcacgcagg

SEQ ID NO: 3586901 - RNA, 17 nt, Pseudomonas putida KT2440
agcgccagcacgcaggc

SEQ ID NO: 3586902 - RNA, 17 nt, Pseudomonas putida KT2440
agcgccagcaucgagga

SEQ ID NO: 3586903 - RNA, 21 nt, Pseudomonas putida KT2440
agcgccagcaucgaggaaggc

SEQ ID NO: 3586904 - RNA, 19 nt, Pseudomonas putida KT2440
agcgccaguacggccauca

SEQ ID NO: 3586905 - RNA, 16 nt, Pseudomonas putida KT2440
agcgccaguuacccug

SEQ ID NO: 3586906 - RNA, 16 nt, Pseudomonas putida KT2440
agcgccauccaccugu

SEQ ID NO: 3586907 - RNA, 19 nt, Pseudomonas putida KT2440
agcgccaugagugcaggca

SEQ ID NO: 3586908 - RNA, 12 nt, Pseudomonas putida KT2440
agcgcccaccaa

SEQ ID NO: 3586909 - RNA, 16 nt, Pseudomonas putida KT2440
agcgcccagaucagca

SEQ ID NO: 3586910 - RNA, 18 nt, Pseudomonas putida KT2440
agcgcccagaucagcagc

SEQ ID NO: 3586911 - RNA, 22 nt, Pseudomonas putida KT2440
agcgcccagaucagcagcaccg

SEQ ID NO: 3586912 - RNA, 12 nt, Pseudomonas putida KT2440
agcgccccagga

SEQ ID NO: 3586913 - RNA, 13 nt, Pseudomonas putida KT2440
agcgccccggcaa

SEQ ID NO: 3586914 - RNA, 22 nt, Pseudomonas putida KT2440
agcgcccgcccaccaccagccc

SEQ ID NO: 3586915 - RNA, 21 nt, Pseudomonas putida KT2440
agcgcccgggcaucaucaaag

SEQ ID NO: 3586916 - RNA, 16 nt, Pseudomonas putida KT2440
agcgcccgguuccagg

SEQ ID NO: 3586917 - RNA, 18 nt, Pseudomonas putida KT2440
agcgcccgguuccagguu

SEQ ID NO: 3586918 - RNA, 16 nt, Pseudomonas putida KT2440
agcgcccgucuggcug

SEQ ID NO: 3586919 - RNA, 18 nt, Pseudomonas putida KT2440
agcgcccguugcgcuuga

SEQ ID NO: 3586920 - RNA, 15 nt, Pseudomonas putida KT2440
agcgcccuugaacag

SEQ ID NO: 3586921 - RNA, 20 nt, Pseudomonas putida KT2440
agcgccgaugcucgucagcc

SEQ ID NO: 3586922 - RNA, 14 nt, Pseudomonas putida KT2440
agcgccgcaacggc

SEQ ID NO: 3586923 - RNA, 13 nt, Pseudomonas putida KT2440
agcgccgcagguc

SEQ ID NO: 3586924 - RNA, 15 nt, Pseudomonas putida KT2440
agcgccgcaggucca

SEQ ID NO: 3586925 - RNA, 16 nt, Pseudomonas putida KT2440
agcgccgcauccagca

SEQ ID NO: 3586926 - RNA, 18 nt, Pseudomonas putida KT2440
agcgccgcauccagcacu

SEQ ID NO: 3586927 - RNA, 20 nt, Pseudomonas putida KT2440
agcgccgcauccagcacugc

SEQ ID NO: 3586928 - RNA, 12 nt, Pseudomonas putida KT2440
agcgccgccaug

SEQ ID NO: 3586929 - RNA, 13 nt, Pseudomonas putida KT2440
agcgccgccggcu

SEQ ID NO: 3586930 - RNA, 16 nt, Pseudomonas putida KT2440
agcgccgcgccaccga

SEQ ID NO: 3586931 - RNA, 18 nt, Pseudomonas putida KT2440
agcgccgcuucagccuuu

SEQ ID NO: 3586932 - RNA, 20 nt, Pseudomonas putida KT2440
agcgccggcgggguaucgau

SEQ ID NO: 3586933 - RNA, 20 nt, Pseudomonas putida KT2440
agcgccgucgaacguccgcu

SEQ ID NO: 3586934 - RNA, 19 nt, Pseudomonas putida KT2440
agcgccuccagcaggggca

SEQ ID NO: 3586935 - RNA, 20 nt, Pseudomonas putida KT2440
agcgccuccagcaggggcag

SEQ ID NO: 3586936 - RNA, 16 nt, Pseudomonas putida KT2440
agcgccucuuugcccu

SEQ ID NO: 3586937 - RNA, 17 nt, Pseudomonas putida KT2440
agcgccugacgcagugc

SEQ ID NO: 3586938 - RNA, 13 nt, Pseudomonas putida KT2440
agcgccugcagcg

SEQ ID NO: 3586939 - RNA, 22 nt, Pseudomonas putida KT2440
agcgccugcauggcaugcagga

SEQ ID NO: 3586940 - RNA, 17 nt, Pseudomonas putida KT2440
agcgccugccuggcccu

SEQ ID NO: 3586941 - RNA, 14 nt, Pseudomonas putida KT2440
agcgccugcugcca

SEQ ID NO: 3586942 - RNA, 22 nt, Pseudomonas putida KT2440
agcgccugcugccaggccgcac

SEQ ID NO: 3586943 - RNA, 15 nt, Pseudomonas putida KT2440
agcgccuggccugca

SEQ ID NO: 3586944 - RNA, 17 nt, Pseudomonas putida KT2440
agcgccuggccugcaga

SEQ ID NO: 3586945 - RNA, 20 nt, Pseudomonas putida KT2440
agcgccuggcgagaaggcgu

SEQ ID NO: 3586946 - RNA, 21 nt, Pseudomonas putida KT2440
agcgccuggcgagaaggcgug

SEQ ID NO: 3586947 - RNA, 14 nt, Pseudomonas putida KT2440
agcgccuggcgcag

SEQ ID NO: 3586948 - RNA, 12 nt, Pseudomonas putida KT2440
agcgccuucuug

SEQ ID NO: 3586949 - RNA, 16 nt, Pseudomonas putida KT2440
agcgcgacgcagcagc

SEQ ID NO: 3586950 - RNA, 17 nt, Pseudomonas putida KT2440
agcgcgacgcagcagcg

SEQ ID NO: 3586951 - RNA, 16 nt, Pseudomonas putida KT2440
agcgcgagcguuacca

SEQ ID NO: 3586952 - RNA, 15 nt, Pseudomonas putida KT2440
agcgcgagcuggaga

SEQ ID NO: 3586953 - RNA, 13 nt, Pseudomonas putida KT2440
agcgcgaggcgcg

SEQ ID NO: 3586954 - RNA, 18 nt, Pseudomonas putida KT2440
agcgcgaucaccagcccc

SEQ ID NO: 3586955 - RNA, 19 nt, Pseudomonas putida KT2440
agcgggcgauugccagggu

SEQ ID NO: 3586956 - RNA, 19 nt, Pseudomonas putida KT2440
agcgggcgugcccgcgaac

SEQ ID NO: 3586957 - RNA, 20 nt, Pseudomonas putida KT2440
agcgggcgugcccgcgaaga

SEQ ID NO: 3586958 - RNA, 20 nt, Pseudomonas putida KT2440
agcgggcgugcccgcgaagg

SEQ ID NO: 3586959 - RNA, 16 nt, Pseudomonas putida KT2440
agcgggcuacacgcgc

SEQ ID NO: 3586960 - RNA, 12 nt, Pseudomonas putida KT2440
agcgggcucgcc

SEQ ID NO: 3586961 - RNA, 18 nt, Pseudomonas putida KT2440
agcgggcucgcccacacg

SEQ ID NO: 3586962 - RNA, 21 nt, Pseudomonas putida KT2440
agcgggcucgcccacacggca

SEQ ID NO: 3586963 - RNA, 20 nt, Pseudomonas putida KT2440
agcgggcuuacccgcgaaga

SEQ ID NO: 3586964 - RNA, 15 nt, Pseudomonas putida KT2440
agcgggcuugcccau

SEQ ID NO: 3586965 - RNA, 20 nt, Pseudomonas putida KT2440
agcgggcuugcccgcgaaca

SEQ ID NO: 3586966 - RNA, 20 nt, Pseudomonas putida KT2440
agcgggcuugcccgcgaagc

SEQ ID NO: 3586967 - RNA, 19 nt, Pseudomonas putida KT2440
agcggggauucaacagcgc

SEQ ID NO: 3586968 - RNA, 15 nt, Pseudomonas putida KT2440
agcgggggcgcguca

SEQ ID NO: 3586969 - RNA, 17 nt, Pseudomonas putida KT2440
agcgggggcgcgucagc

SEQ ID NO: 3586970 - RNA, 15 nt, Pseudomonas putida KT2440
agcgggucgagccag

SEQ ID NO: 3586971 - RNA, 16 nt, Pseudomonas putida KT2440
agcgggucgagccagg

SEQ ID NO: 3586972 - RNA, 20 nt, Pseudomonas putida KT2440
agcgggucuacccgcgaaag

SEQ ID NO: 3586973 - RNA, 13 nt, Pseudomonas putida KT2440
agcggguucaccc

SEQ ID NO: 3586974 - RNA, 15 nt, Pseudomonas putida KT2440
agcggguucacccgc

SEQ ID NO: 3586975 - RNA, 16 nt, Pseudomonas putida KT2440
agcggguucacccgcg

SEQ ID NO: 3586976 - RNA, 20 nt, Pseudomonas putida KT2440
agcggguucacccgcgaaag

SEQ ID NO: 3586977 - RNA, 19 nt, Pseudomonas putida KT2440
agcggguucacccgcgaag

SEQ ID NO: 3586978 - RNA, 20 nt, Pseudomonas putida KT2440
agcggguucacccgcgaagc

SEQ ID NO: 3586979 - RNA, 20 nt, Pseudomonas putida KT2440
agcggguucacccgcgaaug

SEQ ID NO: 3586980 - RNA, 18 nt, Pseudomonas putida KT2440
agcggguuccccagcaag

SEQ ID NO: 3586981 - RNA, 15 nt, Pseudomonas putida KT2440
agcggguuuacccgc

SEQ ID NO: 3586982 - RNA, 21 nt, Pseudomonas putida KT2440
agcggguuuacccgcgaacag

SEQ ID NO: 3586983 - RNA, 19 nt, Pseudomonas putida KT2440
agcggguuuacccgcgaag

SEQ ID NO: 3586984 - RNA, 20 nt, Pseudomonas putida KT2440
agcggguuuacccgcgaaga

SEQ ID NO: 3586985 - RNA, 20 nt, Pseudomonas putida KT2440
agcggguuuacccgcgaagg

SEQ ID NO: 3586986 - RNA, 20 nt, Pseudomonas putida KT2440
agcggguuuacccgcgaaua

SEQ ID NO: 3586987 - RNA, 14 nt, Pseudomonas putida KT2440
agcggguuugcgug

SEQ ID NO: 3586988 - RNA, 11 nt, Pseudomonas putida KT2440
agcggguuuuc

SEQ ID NO: 3586989 - RNA, 19 nt, Pseudomonas putida KT2440
agcggguuuucucgcgaau

SEQ ID NO: 3586990 - RNA, 18 nt, Pseudomonas putida KT2440
agcgguaaacgucggcag

SEQ ID NO: 3586991 - RNA, 16 nt, Pseudomonas putida KT2440
agcgguacagcaccca

SEQ ID NO: 3586992 - RNA, 15 nt, Pseudomonas putida KT2440
agcggucaugcagcg

SEQ ID NO: 3586993 - RNA, 16 nt, Pseudomonas putida KT2440
agcggucaugcagcgu

SEQ ID NO: 3586994 - RNA, 18 nt, Pseudomonas putida KT2440
agcgguccggacuuggac

SEQ ID NO: 3586995 - RNA, 14 nt, Pseudomonas putida KT2440
agcggucguuaccc

SEQ ID NO: 3586996 - RNA, 16 nt, Pseudomonas putida KT2440
agcgguggguggcuca

SEQ ID NO: 3586997 - RNA, 19 nt, Pseudomonas putida KT2440
agcgguucgaccaauggcu

SEQ ID NO: 3586998 - RNA, 19 nt, Pseudomonas putida KT2440
agcgguugaccgccgccac

SEQ ID NO: 3586999 - RNA, 20 nt, Pseudomonas putida KT2440
agcgguugaccgccgccacc

SEQ ID NO: 3587000 - RNA, 15 nt, Pseudomonas putida KT2440
agcgguugagaugau

SEQ ID NO: 3587001 - RNA, 17 nt, Pseudomonas putida KT2440
agcgguugcacggcccc

SEQ ID NO: 3587002 - RNA, 14 nt, Pseudomonas putida KT2440
agcguaagcuggcu

SEQ ID NO: 3587003 - RNA, 15 nt, Pseudomonas putida KT2440
agcguaagcuggcuu

SEQ ID NO: 3587004 - RNA, 16 nt, Pseudomonas putida KT2440
agcguacacugcagga

SEQ ID NO: 3587005 - RNA, 21 nt, Pseudomonas putida KT2440
agcguacacugcaggagcggg

SEQ ID NO: 3587006 - RNA, 13 nt, Pseudomonas putida KT2440
agcguacgcaugg

SEQ ID NO: 3587007 - RNA, 19 nt, Pseudomonas putida KT2440
agcguacgcauggucacgu

SEQ ID NO: 3587008 - RNA, 13 nt, Pseudomonas putida KT2440
agcguagugcagg

SEQ ID NO: 3587009 - RNA, 14 nt, Pseudomonas putida KT2440
agcguagugcaggc

SEQ ID NO: 3587010 - RNA, 15 nt, Pseudomonas putida KT2440
agcguauugccagaa

SEQ ID NO: 3587011 - RNA, 13 nt, Pseudomonas putida KT2440
agcgucaacugcc

SEQ ID NO: 3587012 - RNA, 19 nt, Pseudomonas putida KT2440
agcgucaacugccaggcug

SEQ ID NO: 3587013 - RNA, 12 nt, Pseudomonas putida KT2440
agcgucacccgu

SEQ ID NO: 3587014 - RNA, 15 nt, Pseudomonas putida KT2440
agcgucagcagggcc

SEQ ID NO: 3587015 - RNA, 21 nt, Pseudomonas putida KT2440
agcgucaugaacucaguuaca

SEQ ID NO: 3587016 - RNA, 14 nt, Pseudomonas putida KT2440
agcguccaguucaa

SEQ ID NO: 3587017 - RNA, 19 nt, Pseudomonas putida KT2440
agcguccaucuugguuggc

SEQ ID NO: 3587018 - RNA, 16 nt, Pseudomonas putida KT2440
agcgucccugcccgau

SEQ ID NO: 3587019 - RNA, 13 nt, Pseudomonas putida KT2440
agcgucgaugcgg

SEQ ID NO: 3587020 - RNA, 15 nt, Pseudomonas putida KT2440
agcgucgcgcgccca

SEQ ID NO: 3587021 - RNA, 18 nt, Pseudomonas putida KT2440
agcgucgcgcgcccaggc

SEQ ID NO: 3587022 - RNA, 22 nt, Pseudomonas putida KT2440
agcgucggcagagcgccagcau

SEQ ID NO: 3587023 - RNA, 16 nt, Pseudomonas putida KT2440
agcgucguguucgccu

SEQ ID NO: 3587024 - RNA, 22 nt, Pseudomonas putida KT2440
agcgucguguucgccuguccgg

SEQ ID NO: 3587025 - RNA, 16 nt, Pseudomonas putida KT2440
agcgucuggacccacg

SEQ ID NO: 3587026 - RNA, 15 nt, Pseudomonas putida KT2440
agcgugaagcggcca

SEQ ID NO: 3587027 - RNA, 16 nt, Pseudomonas putida KT2440
agcgugaaugcauggu

SEQ ID NO: 3587028 - RNA, 14 nt, Pseudomonas putida KT2440
agcgugaccugggc

SEQ ID NO: 3587029 - RNA, 20 nt, Pseudomonas putida KT2440
agcgugaccugggccggguc

SEQ ID NO: 3587030 - RNA, 22 nt, Pseudomonas putida KT2440
agcguggccgccaacagcgcag

SEQ ID NO: 3587031 - RNA, 16 nt, Pseudomonas putida KT2440
agcgugggccgugcag

SEQ ID NO: 3587032 - RNA, 18 nt, Pseudomonas putida KT2440
agcguuauaccggcccug

SEQ ID NO: 3587033 - RNA, 12 nt, Pseudomonas putida KT2440
agcguucgagca

SEQ ID NO: 3587034 - RNA, 18 nt, Pseudomonas putida KT2440
agcguucggccagcacua

SEQ ID NO: 3587035 - RNA, 19 nt, Pseudomonas putida KT2440
agcguucucgcucagguag

SEQ ID NO: 3587036 - RNA, 13 nt, Pseudomonas putida KT2440
agcguucucggug

SEQ ID NO: 3587037 - RNA, 15 nt, Pseudomonas putida KT2440
agcguugcuccagcu

SEQ ID NO: 3587038 - RNA, 18 nt, Pseudomonas putida KT2440
agcguugcuccagcucac

SEQ ID NO: 3587039 - RNA, 15 nt, Pseudomonas putida KT2440
agcguugcuggcgau

SEQ ID NO: 3587040 - RNA, 21 nt, Pseudomonas putida KT2440
agcuaaaccgcgaugcugcaa

SEQ ID NO: 3587041 - RNA, 13 nt, Pseudomonas putida KT2440
agcuacagccccu

SEQ ID NO: 3587042 - RNA, 18 nt, Pseudomonas putida KT2440
agcuacgagacgguggcu

SEQ ID NO: 3587043 - RNA, 14 nt, Pseudomonas putida KT2440
agcuaucgccagca

SEQ ID NO: 3587044 - RNA, 16 nt, Pseudomonas putida KT2440
agcuaucgccagcagg

SEQ ID NO: 3587045 - RNA, 19 nt, Pseudomonas putida KT2440
agcuaucucaagccuugcu

SEQ ID NO: 3587046 - RNA, 13 nt, Pseudomonas putida KT2440
agcucaaaugcug

SEQ ID NO: 3587047 - RNA, 17 nt, Pseudomonas putida KT2440
agcucaaaugcuggcaa

SEQ ID NO: 3587048 - RNA, 22 nt, Pseudomonas putida KT2440
agcucaaaugcuggcaauccag

SEQ ID NO: 3587049 - RNA, 23 nt, Pseudomonas putida KT2440
agcucaaaugcuggcaauccagc

SEQ ID NO: 3587050 - RNA, 15 nt, Pseudomonas putida KT2440
agcucaaccauugcu

SEQ ID NO: 3587051 - RNA, 12 nt, Pseudomonas putida KT2440
agcucaacccca

SEQ ID NO: 3587052 - RNA, 23 nt, Pseudomonas putida KT2440
agcucaaccgacaccagacggcc

SEQ ID NO: 3587053 - RNA, 21 nt, Pseudomonas putida KT2440
agcucaauuucuuucagcucg

SEQ ID NO: 3587054 - RNA, 13 nt, Pseudomonas putida KT2440
agcucacuggcca

SEQ ID NO: 3587055 - RNA, 14 nt, Pseudomonas putida KT2440
agcucagccagcaa

SEQ ID NO: 3587056 - RNA, 15 nt, Pseudomonas putida KT2440
agcucagccagcaag

SEQ ID NO: 3587057 - RNA, 19 nt, Pseudomonas putida KT2440
agcucagcgugacgauggc

SEQ ID NO: 3587058 - RNA, 23 nt, Pseudomonas putida KT2440
agcucagcuggauagaguacucg

SEQ ID NO: 3587059 - RNA, 20 nt, Pseudomonas putida KT2440
agcucagcugggagagcgcc

SEQ ID NO: 3587060 - RNA, 12 nt, Pseudomonas putida KT2440
agcucaggccuu

SEQ ID NO: 3587061 - RNA, 19 nt, Pseudomonas putida KT2440
agcuggaacgcuuggccag

SEQ ID NO: 3587062 - RNA, 20 nt, Pseudomonas putida KT2440
agcuggaacgcuuggccaga

SEQ ID NO: 3587063 - RNA, 19 nt, Pseudomonas putida KT2440
agcuggagacgaacagcgc

SEQ ID NO: 3587064 - RNA, 21 nt, Pseudomonas putida KT2440
agcuggagucguugcgcuggu

SEQ ID NO: 3587065 - RNA, 16 nt, Pseudomonas putida KT2440
agcuggcaaugcaacu

SEQ ID NO: 3587066 - RNA, 15 nt, Pseudomonas putida KT2440
agcuggcaccggcgc

SEQ ID NO: 3587067 - RNA, 16 nt, Pseudomonas putida KT2440
agcuggcaccggcgcc

SEQ ID NO: 3587068 - RNA, 16 nt, Pseudomonas putida KT2440
agcuggccaucgaccc

SEQ ID NO: 3587069 - RNA, 16 nt, Pseudomonas putida KT2440
agcuggccguccagcu

SEQ ID NO: 3587070 - RNA, 19 nt, Pseudomonas putida KT2440
agcuggccguccagcugag

SEQ ID NO: 3587071 - RNA, 19 nt, Pseudomonas putida KT2440
agcuggcgcaagccgugcc

SEQ ID NO: 3587072 - RNA, 22 nt, Pseudomonas putida KT2440
agcuggcgcaagccgugccugg

SEQ ID NO: 3587073 - RNA, 23 nt, Pseudomonas putida KT2440
agcuggcgcgaucccugugggag

SEQ ID NO: 3587074 - RNA, 22 nt, Pseudomonas putida KT2440
agcuggcuacccgcucggccuu

SEQ ID NO: 3587075 - RNA, 13 nt, Pseudomonas putida KT2440
agcuggcucaucu

SEQ ID NO: 3587076 - RNA, 19 nt, Pseudomonas putida KT2440
agcuggcucaucugccggc

SEQ ID NO: 3587077 - RNA, 11 nt, Pseudomonas putida KT2440
agcuggcuggu

SEQ ID NO: 3587078 - RNA, 19 nt, Pseudomonas putida KT2440
agcuggcuggugacaacgc

SEQ ID NO: 3587079 - RNA, 21 nt, Pseudomonas putida KT2440
agcugggcccgcccagcuggc

SEQ ID NO: 3587080 - RNA, 18 nt, Pseudomonas putida KT2440
agcuggucaucguccacc

SEQ ID NO: 3587081 - RNA, 18 nt, Pseudomonas putida KT2440
agcuggucgagcaaggca

SEQ ID NO: 3587082 - RNA, 24 nt, Pseudomonas putida KT2440
agcuggucguugguguagucgguc

SEQ ID NO: 3587083 - RNA, 16 nt, Pseudomonas putida KT2440
agcuggugggcgauga

SEQ ID NO: 3587084 - RNA, 13 nt, Pseudomonas putida KT2440
agcuguacaacgc

SEQ ID NO: 3587085 - RNA, 21 nt, Pseudomonas putida KT2440
agcuguacaacgcagccggca

SEQ ID NO: 3587086 - RNA, 14 nt, Pseudomonas putida KT2440
agcuguacagcgca

SEQ ID NO: 3587087 - RNA, 15 nt, Pseudomonas putida KT2440
agcuguacgcuggcc

SEQ ID NO: 3587088 - RNA, 16 nt, Pseudomonas putida KT2440
agcuguacgcuggcca

SEQ ID NO: 3587089 - RNA, 23 nt, Pseudomonas putida KT2440
agcuguacgcuggccaaggccuc

SEQ ID NO: 3587090 - RNA, 15 nt, Pseudomonas putida KT2440
agcuguagucaccac

SEQ ID NO: 3587091 - RNA, 16 nt, Pseudomonas putida KT2440
agcugucacccuuggu

SEQ ID NO: 3587092 - RNA, 12 nt, Pseudomonas putida KT2440
agcugucagcac

SEQ ID NO: 3587093 - RNA, 19 nt, Pseudomonas putida KT2440
agcugucgaacgcugccug

SEQ ID NO: 3587094 - RNA, 14 nt, Pseudomonas putida KT2440
agcugucggucagc

SEQ ID NO: 3587095 - RNA, 18 nt, Pseudomonas putida KT2440
agcuguggggcugacugc

SEQ ID NO: 3587096 - RNA, 17 nt, Pseudomonas putida KT2440
agcuguugcgcugggcg

SEQ ID NO: 3587097 - RNA, 15 nt, Pseudomonas putida KT2440
agcuuaacgcuuggc

SEQ ID NO: 3587098 - RNA, 17 nt, Pseudomonas putida KT2440
agcuuaacgcuuggcca

SEQ ID NO: 3587099 - RNA, 20 nt, Pseudomonas putida KT2440
agcuucagaccugauccaaa

SEQ ID NO: 3587100 - RNA, 19 nt, Pseudomonas putida KT2440
agcuucagcgaccgacacg

SEQ ID NO: 3587101 - RNA, 17 nt, Pseudomonas putida KT2440
agcuucauguacagguu

SEQ ID NO: 3587102 - RNA, 15 nt, Pseudomonas putida KT2440
agcuuccaccauucc

SEQ ID NO: 3587103 - RNA, 16 nt, Pseudomonas putida KT2440
agcuuccaccauuccc

SEQ ID NO: 3587104 - RNA, 20 nt, Pseudomonas putida KT2440
agcuuccaccauucccugca

SEQ ID NO: 3587105 - RNA, 21 nt, Pseudomonas putida KT2440
agcuuccaccauucccugcac

SEQ ID NO: 3587106 - RNA, 21 nt, Pseudomonas putida KT2440
agcuuccaguuggccggcaug

SEQ ID NO: 3587107 - RNA, 14 nt, Pseudomonas putida KT2440
agcuucccggccug

SEQ ID NO: 3587108 - RNA, 17 nt, Pseudomonas putida KT2440
agcuucccggccuggcg

SEQ ID NO: 3587109 - RNA, 20 nt, Pseudomonas putida KT2440
agcuucccggccuggcgcag

SEQ ID NO: 3587110 - RNA, 19 nt, Pseudomonas putida KT2440
agcuucucgcgcuuggcca

SEQ ID NO: 3587111 - RNA, 16 nt, Pseudomonas putida KT2440
agcuucugcaacuccu

SEQ ID NO: 3587112 - RNA, 20 nt, Pseudomonas putida KT2440
agcuucugcugguccuugca

SEQ ID NO: 3587113 - RNA, 17 nt, Pseudomonas putida KT2440
agcuucugcuugcucug

SEQ ID NO: 3587114 - RNA, 18 nt, Pseudomonas putida KT2440
agcuucugcuugcucugu

SEQ ID NO: 3587115 - RNA, 12 nt, Pseudomonas putida KT2440
agcuucugggca

SEQ ID NO: 3587116 - RNA, 18 nt, Pseudomonas putida KT2440
agcuucugguuguaagcg

SEQ ID NO: 3587117 - RNA, 15 nt, Pseudomonas putida KT2440
agcuucuucacaccg

SEQ ID NO: 3587118 - RNA, 19 nt, Pseudomonas putida KT2440
agcuucuucacaccggccu

SEQ ID NO: 3587119 - RNA, 12 nt, Pseudomonas putida KT2440
agcuucuugugc

SEQ ID NO: 3587120 - RNA, 20 nt, Pseudomonas putida KT2440
agcuucuugugcuuccagcu

SEQ ID NO: 3587121 - RNA, 20 nt, Pseudomonas putida KT2440
agcuugaggcaugugcuguc

SEQ ID NO: 3587122 - RNA, 21 nt, Pseudomonas putida KT2440
agcuugagggucuugcccccc

SEQ ID NO: 3587123 - RNA, 17 nt, Pseudomonas putida KT2440
agcuugaggucgccagg

SEQ ID NO: 3587124 - RNA, 22 nt, Pseudomonas putida KT2440
agcuugaugcugucgaagcgcu

SEQ ID NO: 3587125 - RNA, 22 nt, Pseudomonas putida KT2440
agcuugccaccaucgaccuggc

SEQ ID NO: 3587126 - RNA, 14 nt, Pseudomonas putida KT2440
agcuugccagcguc

SEQ ID NO: 3587127 - RNA, 16 nt, Pseudomonas putida KT2440
agcuugccauccuuga

SEQ ID NO: 3587128 - RNA, 20 nt, Pseudomonas putida KT2440
agcuugccauccuugaagua

SEQ ID NO: 3587129 - RNA, 12 nt, Pseudomonas putida KT2440
agcuugccauuc

SEQ ID NO: 3587130 - RNA, 16 nt, Pseudomonas putida KT2440
agcuugcccagcaggu

SEQ ID NO: 3587131 - RNA, 17 nt, Pseudomonas putida KT2440
agcuugcccaucaccuc

SEQ ID NO: 3587132 - RNA, 23 nt, Pseudomonas putida KT2440
agcuugcccaucaccucgucgcu

SEQ ID NO: 3587133 - RNA, 21 nt, Pseudomonas putida KT2440
agcuugccgucgcuggagcgg

SEQ ID NO: 3587134 - RNA, 23 nt, Pseudomonas putida KT2440
agcuugcguuugggguccuguuu

SEQ ID NO: 3587135 - RNA, 19 nt, Pseudomonas putida KT2440
agcuuggccauuuccggcc

SEQ ID NO: 3587136 - RNA, 13 nt, Pseudomonas putida KT2440
agcuuggcgucca

SEQ ID NO: 3587137 - RNA, 20 nt, Pseudomonas putida KT2440
agcuuggcuuucggcgcacc

SEQ ID NO: 3587138 - RNA, 23 nt, Pseudomonas putida KT2440
agcuuggcuuucggcgcacccgg

SEQ ID NO: 3587139 - RNA, 23 nt, Pseudomonas putida KT2440
agcuuggggcgauguuggccgag

SEQ ID NO: 3587140 - RNA, 14 nt, Pseudomonas putida KT2440
agcuuggucagggc

SEQ ID NO: 3587141 - RNA, 14 nt, Pseudomonas putida KT2440
agcuuucaggcgca

SEQ ID NO: 3587142 - RNA, 15 nt, Pseudomonas putida KT2440
agcuuucaggcgcag

SEQ ID NO: 3587143 - RNA, 21 nt, Pseudomonas putida KT2440
aggaaaagcagcuccagcguu

SEQ ID NO: 3587144 - RNA, 23 nt, Pseudomonas putida KT2440
aggaacaaccugaacaaggccug

SEQ ID NO: 3587145 - RNA, 14 nt, Pseudomonas putida KT2440
aggaacaacuuggu

SEQ ID NO: 3587146 - RNA, 22 nt, Pseudomonas putida KT2440
aggaacacuucgcuuucaccuu

SEQ ID NO: 3587147 - RNA, 19 nt, Pseudomonas putida KT2440
aggaacagcggcagcaaca

SEQ ID NO: 3587148 - RNA, 19 nt, Pseudomonas putida KT2440
aggaacagcucgauggcca

SEQ ID NO: 3587149 - RNA, 21 nt, Pseudomonas putida KT2440
aggaacagcucgauggccagg

SEQ ID NO: 3587150 - RNA, 18 nt, Pseudomonas putida KT2440
aggaacuggcugccgcug

SEQ ID NO: 3587151 - RNA, 19 nt, Pseudomonas putida KT2440
aggaacuggcugccgcuga

SEQ ID NO: 3587152 - RNA, 22 nt, Pseudomonas putida KT2440
aggaagaugaagaaaccaccgc

SEQ ID NO: 3587153 - RNA, 14 nt, Pseudomonas putida KT2440
aggaagcagaugaa

SEQ ID NO: 3587154 - RNA, 20 nt, Pseudomonas putida KT2440
aggaagcuggccagccgcug

SEQ ID NO: 3587155 - RNA, 15 nt, Pseudomonas putida KT2440
aggaagcuguacagc

SEQ ID NO: 3587156 - RNA, 15 nt, Pseudomonas putida KT2440
aggaagucaaccuca

SEQ ID NO: 3587157 - RNA, 20 nt, Pseudomonas putida KT2440
aggaagucgauguucagcac

SEQ ID NO: 3587158 - RNA, 13 nt, Pseudomonas putida KT2440
aggaaguggcaga

SEQ ID NO: 3587159 - RNA, 14 nt, Pseudomonas putida KT2440
aggaauagccggug

SEQ ID NO: 3587160 - RNA, 14 nt, Pseudomonas putida KT2440
aggaaugucaccgc

SEQ ID NO: 3587161 - RNA, 14 nt, Pseudomonas putida KT2440
aggaauuacgcagg

SEQ ID NO: 3587162 - RNA, 16 nt, Pseudomonas putida KT2440
aggaauuacgcaggcu

SEQ ID NO: 3587163 - RNA, 19 nt, Pseudomonas putida KT2440
aggaauuacgcaggcucca

SEQ ID NO: 3587164 - RNA, 18 nt, Pseudomonas putida KT2440
aggacaacaaggacugcc

SEQ ID NO: 3587165 - RNA, 23 nt, Pseudomonas putida KT2440
aggacauaccacacaccccagaa

SEQ ID NO: 3587166 - RNA, 23 nt, Pseudomonas putida KT2440
aggccaagguugccaccagcauc

SEQ ID NO: 3587167 - RNA, 19 nt, Pseudomonas putida KT2440
aggccaaguacggccagca

SEQ ID NO: 3587168 - RNA, 19 nt, Pseudomonas putida KT2440
aggccaaugcagcuuugag

SEQ ID NO: 3587169 - RNA, 19 nt, Pseudomonas putida KT2440
aggccaaugcccaugccca

SEQ ID NO: 3587170 - RNA, 17 nt, Pseudomonas putida KT2440
aggccaccggcagcacc

SEQ ID NO: 3587171 - RNA, 19 nt, Pseudomonas putida KT2440
aggccaccguugcgcucga

SEQ ID NO: 3587172 - RNA, 22 nt, Pseudomonas putida KT2440
aggccaccguugcgcucgagcc

SEQ ID NO: 3587173 - RNA, 20 nt, Pseudomonas putida KT2440
aggccacgccgccuucggac

SEQ ID NO: 3587174 - RNA, 14 nt, Pseudomonas putida KT2440
aggccacguuugag

SEQ ID NO: 3587175 - RNA, 16 nt, Pseudomonas putida KT2440
aggccagcacggccag

SEQ ID NO: 3587176 - RNA, 20 nt, Pseudomonas putida KT2440
aggccagccagguauggcca

SEQ ID NO: 3587177 - RNA, 19 nt, Pseudomonas putida KT2440
aggccagcccauggcgcug

SEQ ID NO: 3587178 - RNA, 11 nt, Pseudomonas putida KT2440
aggccagcccc

SEQ ID NO: 3587179 - RNA, 15 nt, Pseudomonas putida KT2440
aggccagccgagcca

SEQ ID NO: 3587180 - RNA, 14 nt, Pseudomonas putida KT2440
aggccaggaacagc

SEQ ID NO: 3587181 - RNA, 15 nt, Pseudomonas putida KT2440
aggccaggaacagcg

SEQ ID NO: 3587182 - RNA, 18 nt, Pseudomonas putida KT2440
aggccaggaacagcgcag

SEQ ID NO: 3587183 - RNA, 16 nt, Pseudomonas putida KT2440
aggccagguacaggca

SEQ ID NO: 3587184 - RNA, 22 nt, Pseudomonas putida KT2440
aggccagguacaggcaaagaaa

SEQ ID NO: 3587185 - RNA, 15 nt, Pseudomonas putida KT2440
aggccaguaccagca

SEQ ID NO: 3587186 - RNA, 19 nt, Pseudomonas putida KT2440
aggccaguaccagcagcac

SEQ ID NO: 3587187 - RNA, 21 nt, Pseudomonas putida KT2440
aggccaguaccagcagcacau

SEQ ID NO: 3587188 - RNA, 14 nt, Pseudomonas putida KT2440
aggccagugagccu

SEQ ID NO: 3587189 - RNA, 20 nt, Pseudomonas putida KT2440
aggccaucuaagccuccaga

SEQ ID NO: 3587190 - RNA, 12 nt, Pseudomonas putida KT2440
aggccaugcugc

SEQ ID NO: 3587191 - RNA, 23 nt, Pseudomonas putida KT2440
aggcccaaacauugugcgccccc

SEQ ID NO: 3587192 - RNA, 13 nt, Pseudomonas putida KT2440
aggcccaacagcg

SEQ ID NO: 3587193 - RNA, 23 nt, Pseudomonas putida KT2440
aggcccaacagcgcggagaggug

SEQ ID NO: 3587194 - RNA, 13 nt, Pseudomonas putida KT2440
aggcccaccaccg

SEQ ID NO: 3587195 - RNA, 23 nt, Pseudomonas putida KT2440
aggcccacggcguccaggcccgc

SEQ ID NO: 3587196 - RNA, 20 nt, Pseudomonas putida KT2440
aggcccagcagguacagcac

SEQ ID NO: 3587197 - RNA, 22 nt, Pseudomonas putida KT2440
aggcccaguucggacaggcgcu

SEQ ID NO: 3587198 - RNA, 23 nt, Pseudomonas putida KT2440
aggcccaguucggacaggcgcuu

SEQ ID NO: 3587199 - RNA, 22 nt, Pseudomonas putida KT2440
aggcccauguggcgcagcaccg

SEQ ID NO: 3587200 - RNA, 20 nt, Pseudomonas putida KT2440
aggccccagggggcagcugc

SEQ ID NO: 3587201 - RNA, 21 nt, Pseudomonas putida KT2440
aggccccagggggcagcugcu

SEQ ID NO: 3587202 - RNA, 16 nt, Pseudomonas putida KT2440
aggccccgauacagcg

SEQ ID NO: 3587203 - RNA, 16 nt, Pseudomonas putida KT2440
aggccccugcaacagg

SEQ ID NO: 3587204 - RNA, 14 nt, Pseudomonas putida KT2440
aggccccuuggcca

SEQ ID NO: 3587205 - RNA, 20 nt, Pseudomonas putida KT2440
aggcccgaacagacaacauc

SEQ ID NO: 3587206 - RNA, 18 nt, Pseudomonas putida KT2440
aggcccgaacuggccggu

SEQ ID NO: 3587207 - RNA, 17 nt, Pseudomonas putida KT2440
aggcccgccagagcaug

SEQ ID NO: 3587208 - RNA, 21 nt, Pseudomonas putida KT2440
aggcccgccagagcauggcca

SEQ ID NO: 3587209 - RNA, 14 nt, Pseudomonas putida KT2440
aggcccggcagguu

SEQ ID NO: 3587210 - RNA, 16 nt, Pseudomonas putida KT2440
aggcccgugguuggag

SEQ ID NO: 3587211 - RNA, 20 nt, Pseudomonas putida KT2440
aggcccucaagggcgcugau

SEQ ID NO: 3587212 - RNA, 20 nt, Pseudomonas putida KT2440
aggcccugacgccagcgcug

SEQ ID NO: 3587213 - RNA, 12 nt, Pseudomonas putida KT2440
aggcccugcagc

SEQ ID NO: 3587214 - RNA, 20 nt, Pseudomonas putida KT2440
aggcccugcagcgcuucgug

SEQ ID NO: 3587215 - RNA, 19 nt, Pseudomonas putida KT2440
aggcccugcauaugcaggg

SEQ ID NO: 3587216 - RNA, 13 nt, Pseudomonas putida KT2440
aggcccugcugcu

SEQ ID NO: 3587217 - RNA, 16 nt, Pseudomonas putida KT2440
aggccgaaaccgcccg

SEQ ID NO: 3587218 - RNA, 17 nt, Pseudomonas putida KT2440
aggccgaaaccgcccgg

SEQ ID NO: 3587219 - RNA, 15 nt, Pseudomonas putida KT2440
aggccgagcgcgagc

SEQ ID NO: 3587220 - RNA, 17 nt, Pseudomonas putida KT2440
aggccgaguaaccggcg

SEQ ID NO: 3587221 - RNA, 16 nt, Pseudomonas putida KT2440
aggccgaugccaagca

SEQ ID NO: 3587222 - RNA, 16 nt, Pseudomonas putida KT2440
aggccgauggcgaugg

SEQ ID NO: 3587223 - RNA, 10 nt, Pseudomonas putida KT2440
aggccgcagc

SEQ ID NO: 3587224 - RNA, 13 nt, Pseudomonas putida KT2440
aggccgccaccuc

SEQ ID NO: 3587225 - RNA, 18 nt, Pseudomonas putida KT2440
aggccgccauugaugccg

SEQ ID NO: 3587226 - RNA, 20 nt, Pseudomonas putida KT2440
aggccgcccacccaccacaa

SEQ ID NO: 3587227 - RNA, 17 nt, Pseudomonas putida KT2440
aggccgccggcaacugg

SEQ ID NO: 3587228 - RNA, 13 nt, Pseudomonas putida KT2440
aggccgccugccc

SEQ ID NO: 3587229 - RNA, 16 nt, Pseudomonas putida KT2440
aggccgccugcccgcc

SEQ ID NO: 3587230 - RNA, 19 nt, Pseudomonas putida KT2440
aggccgccugcccgccccc

SEQ ID NO: 3587231 - RNA, 14 nt, Pseudomonas putida KT2440
aggccgcuccugcg

SEQ ID NO: 3587232 - RNA, 19 nt, Pseudomonas putida KT2440
aggccgcugaacaacuccg

SEQ ID NO: 3587233 - RNA, 13 nt, Pseudomonas putida KT2440
aggccgcugagga

SEQ ID NO: 3587234 - RNA, 22 nt, Pseudomonas putida KT2440
aggccggaacaggcuaaagugc

SEQ ID NO: 3587235 - RNA, 18 nt, Pseudomonas putida KT2440
aggccggaccugcuggcc

SEQ ID NO: 3587236 - RNA, 23 nt, Pseudomonas putida KT2440
aggccggcacagaccgcaacagu

SEQ ID NO: 3587237 - RNA, 14 nt, Pseudomonas putida KT2440
aggccggcacagga

SEQ ID NO: 3587238 - RNA, 13 nt, Pseudomonas putida KT2440
aggccggcaccga

SEQ ID NO: 3587239 - RNA, 22 nt, Pseudomonas putida KT2440
aggccggcacuggcuacagauc

SEQ ID NO: 3587240 - RNA, 15 nt, Pseudomonas putida KT2440
aggccggcaucgacg

SEQ ID NO: 3587241 - RNA, 12 nt, Pseudomonas putida KT2440
aggccggccacc

SEQ ID NO: 3587242 - RNA, 13 nt, Pseudomonas putida KT2440
aggccggccacca

SEQ ID NO: 3587243 - RNA, 18 nt, Pseudomonas putida KT2440
aggccggcgcagauggug

SEQ ID NO: 3587244 - RNA, 13 nt, Pseudomonas putida KT2440
aggccggguuuuu

SEQ ID NO: 3587245 - RNA, 14 nt, Pseudomonas putida KT2440
aggccggguuuuuc

SEQ ID NO: 3587246 - RNA, 16 nt, Pseudomonas putida KT2440
aggccgguacugccca

SEQ ID NO: 3587247 - RNA, 19 nt, Pseudomonas putida KT2440
aggccgguacugcccauaa

SEQ ID NO: 3587248 - RNA, 15 nt, Pseudomonas putida KT2440
aggccgguaggccuc

SEQ ID NO: 3587249 - RNA, 21 nt, Pseudomonas putida KT2440
aggccgguaggucuaaccgcg

SEQ ID NO: 3587250 - RNA, 22 nt, Pseudomonas putida KT2440
aggccgguaggugcucaaggca

SEQ ID NO: 3587251 - RNA, 22 nt, Pseudomonas putida KT2440
aggccggucuugucugacagca

SEQ ID NO: 3587252 - RNA, 23 nt, Pseudomonas putida KT2440
aggccggucuugucugacagcag

SEQ ID NO: 3587253 - RNA, 24 nt, Pseudomonas putida KT2440
aggccgguugcuccagcguguuca

SEQ ID NO: 3587254 - RNA, 14 nt, Pseudomonas putida KT2440
aggccgucagcagc

SEQ ID NO: 3587255 - RNA, 18 nt, Pseudomonas putida KT2440
aggccgucagcagcaggc

SEQ ID NO: 3587256 - RNA, 19 nt, Pseudomonas putida KT2440
aggccgucagcagcaggcg

SEQ ID NO: 3587257 - RNA, 18 nt, Pseudomonas putida KT2440
aggccgucaggccucccc

SEQ ID NO: 3587258 - RNA, 20 nt, Pseudomonas putida KT2440
aggccgucguguaggagcgg

SEQ ID NO: 3587259 - RNA, 15 nt, Pseudomonas putida KT2440
aggccguggcaaggc

SEQ ID NO: 3587260 - RNA, 19 nt, Pseudomonas putida KT2440
aggccguggcaaggcccgc

SEQ ID NO: 3587261 - RNA, 17 nt, Pseudomonas putida KT2440
aggccuaucuucgucau

SEQ ID NO: 3587262 - RNA, 21 nt, Pseudomonas putida KT2440
aggccucaagccucgcgcaac

SEQ ID NO: 3587263 - RNA, 15 nt, Pseudomonas putida KT2440
aggccucaaucacug

SEQ ID NO: 3587264 - RNA, 17 nt, Pseudomonas putida KT2440
aggccucuaccgcugcu

SEQ ID NO: 3587265 - RNA, 14 nt, Pseudomonas putida KT2440
aggccucuucaggc

SEQ ID NO: 3587266 - RNA, 20 nt, Pseudomonas putida KT2440
aggccucuucaggcaauggc

SEQ ID NO: 3587267 - RNA, 21 nt, Pseudomonas putida KT2440
aggccugaaacccauccacgg

SEQ ID NO: 3587268 - RNA, 14 nt, Pseudomonas putida KT2440
aggccugaggcccu

SEQ ID NO: 3587269 - RNA, 15 nt, Pseudomonas putida KT2440
aggccugcacugcac

SEQ ID NO: 3587270 - RNA, 22 nt, Pseudomonas putida KT2440
aggccugcacugcacccucuuc

SEQ ID NO: 3587271 - RNA, 17 nt, Pseudomonas putida KT2440
aggcugcgugccugcug

SEQ ID NO: 3587272 - RNA, 13 nt, Pseudomonas putida KT2440
aggcuggcaauca

SEQ ID NO: 3587273 - RNA, 12 nt, Pseudomonas putida KT2440
aggcuggccuca

SEQ ID NO: 3587274 - RNA, 21 nt, Pseudomonas putida KT2440
aggcuggccucacaucgcgca

SEQ ID NO: 3587275 - RNA, 23 nt, Pseudomonas putida KT2440
aggcuggcgcuaccccuguagga

SEQ ID NO: 3587276 - RNA, 20 nt, Pseudomonas putida KT2440
aggcuggcgggguggccggc

SEQ ID NO: 3587277 - RNA, 22 nt, Pseudomonas putida KT2440
aggcuggcgggguggccggcac

SEQ ID NO: 3587278 - RNA, 18 nt, Pseudomonas putida KT2440
aggcuggucgcugcccuc

SEQ ID NO: 3587279 - RNA, 14 nt, Pseudomonas putida KT2440
aggcugucgaucag

SEQ ID NO: 3587280 - RNA, 17 nt, Pseudomonas putida KT2440
aggcugucgaucagacg

SEQ ID NO: 3587281 - RNA, 18 nt, Pseudomonas putida KT2440
aggcuguuccauuucccu

SEQ ID NO: 3587282 - RNA, 15 nt, Pseudomonas putida KT2440
aggcuguuggcgguc

SEQ ID NO: 3587283 - RNA, 19 nt, Pseudomonas putida KT2440
aggcuuacaucggcgacga

SEQ ID NO: 3587284 - RNA, 17 nt, Pseudomonas putida KT2440
aggcuuacuuggucacc

SEQ ID NO: 3587285 - RNA, 13 nt, Pseudomonas putida KT2440
aggcuucacgcgc

SEQ ID NO: 3587286 - RNA, 21 nt, Pseudomonas putida KT2440
aggcuucaggccgccuuggcu

SEQ ID NO: 3587287 - RNA, 22 nt, Pseudomonas putida KT2440
aggcuuuggccguagccaggca

SEQ ID NO: 3587288 - RNA, 14 nt, Pseudomonas putida KT2440
agggaaauuggcca

SEQ ID NO: 3587289 - RNA, 16 nt, Pseudomonas putida KT2440
agggaagaauugcugg

SEQ ID NO: 3587290 - RNA, 19 nt, Pseudomonas putida KT2440
agggaagcggaugagccuu

SEQ ID NO: 3587291 - RNA, 19 nt, Pseudomonas putida KT2440
agggaaggcuacauccagg

SEQ ID NO: 3587292 - RNA, 13 nt, Pseudomonas putida KT2440
agggaccgcaucu

SEQ ID NO: 3587293 - RNA, 20 nt, Pseudomonas putida KT2440
agggaccgugcagggaaggg

SEQ ID NO: 3587294 - RNA, 14 nt, Pseudomonas putida KT2440
agggaucgaugccc

SEQ ID NO: 3587295 - RNA, 18 nt, Pseudomonas putida KT2440
agggcaaaaugcagcaag

SEQ ID NO: 3587296 - RNA, 22 nt, Pseudomonas putida KT2440
agggcaauggcgucacagacau

SEQ ID NO: 3587297 - RNA, 16 nt, Pseudomonas putida KT2440
agggcacauacggcuu

SEQ ID NO: 3587298 - RNA, 14 nt, Pseudomonas putida KT2440
agggcaccuccaga

SEQ ID NO: 3587299 - RNA, 20 nt, Pseudomonas putida KT2440
agggcagacuucgcugucuu

SEQ ID NO: 3587300 - RNA, 12 nt, Pseudomonas putida KT2440
agggcaggcuga

SEQ ID NO: 3587301 - RNA, 20 nt, Pseudomonas putida KT2440
agggcagggugaucgcgcug

SEQ ID NO: 3587302 - RNA, 14 nt, Pseudomonas putida KT2440
agggcaucgaccag

SEQ ID NO: 3587303 - RNA, 14 nt, Pseudomonas putida KT2440
agggcaucggacag

SEQ ID NO: 3587304 - RNA, 17 nt, Pseudomonas putida KT2440
agggcaucggacaggua

SEQ ID NO: 3587305 - RNA, 20 nt, Pseudomonas putida KT2440
agggcaucggcgugcugcgu

SEQ ID NO: 3587306 - RNA, 11 nt, Pseudomonas putida KT2440
agggcauggcc

SEQ ID NO: 3587307 - RNA, 21 nt, Pseudomonas putida KT2440
agggcauugaggaugcugaag

SEQ ID NO: 3587308 - RNA, 21 nt, Pseudomonas putida KT2440
agggccagcacaaccacugca

SEQ ID NO: 3587309 - RNA, 21 nt, Pseudomonas putida KT2440
agggccaggccgauggcgaug

SEQ ID NO: 3587310 - RNA, 21 nt, Pseudomonas putida KT2440
agggccaucaucugcugaucu

SEQ ID NO: 3587311 - RNA, 16 nt, Pseudomonas putida KT2440
agggccauggcgcgga

SEQ ID NO: 3587312 - RNA, 14 nt, Pseudomonas putida KT2440
agggcccagccacc

SEQ ID NO: 3587313 - RNA, 19 nt, Pseudomonas putida KT2440
agggcccagccaccgacga

SEQ ID NO: 3587314 - RNA, 19 nt, Pseudomonas putida KT2440
agggccccuucaaggggcc

SEQ ID NO: 3587315 - RNA, 14 nt, Pseudomonas putida KT2440
agggcccucaaccc

SEQ ID NO: 3587316 - RNA, 17 nt, Pseudomonas putida KT2440
agggcccucaacccucg

SEQ ID NO: 3587317 - RNA, 19 nt, Pseudomonas putida KT2440
agggcccucaacccucgcc

SEQ ID NO: 3587318 - RNA, 13 nt, Pseudomonas putida KT2440
agggccgcaaagc

SEQ ID NO: 3587319 - RNA, 17 nt, Pseudomonas putida KT2440
agggccgcaaagcggcc

SEQ ID NO: 3587320 - RNA, 13 nt, Pseudomonas putida KT2440
agggccgcaacgc

SEQ ID NO: 3587321 - RNA, 20 nt, Pseudomonas putida KT2440
agggccgcgcaggcggcuga

SEQ ID NO: 3587322 - RNA, 20 nt, Pseudomonas putida KT2440
agggccgcgcuuggcggccc

SEQ ID NO: 3587323 - RNA, 16 nt, Pseudomonas putida KT2440
agggccgggccugcau

SEQ ID NO: 3587324 - RNA, 19 nt, Pseudomonas putida KT2440
agggccguaggacagugcg

SEQ ID NO: 3587325 - RNA, 18 nt, Pseudomonas putida KT2440
agggccguuacucccaca

SEQ ID NO: 3587326 - RNA, 22 nt, Pseudomonas putida KT2440
agggccuccauacgcuggugca

SEQ ID NO: 3587327 - RNA, 14 nt, Pseudomonas putida KT2440
agggccugaccgcc

SEQ ID NO: 3587328 - RNA, 12 nt, Pseudomonas putida KT2440
agggccuggcgc

SEQ ID NO: 3587329 - RNA, 14 nt, Pseudomonas putida KT2440
agggccuggcgcga

SEQ ID NO: 3587330 - RNA, 16 nt, Pseudomonas putida KT2440
agggccuuggccuggg

SEQ ID NO: 3587331 - RNA, 20 nt, Pseudomonas putida KT2440
agggccuuuccgcacucagg

SEQ ID NO: 3587332 - RNA, 22 nt, Pseudomonas putida KT2440
agggccuuuucauauggcucga

SEQ ID NO: 3587333 - RNA, 21 nt, Pseudomonas putida KT2440
agggcgaugcccuucaggccc

SEQ ID NO: 3587334 - RNA, 16 nt, Pseudomonas putida KT2440
agggcgcgaaaagccu

SEQ ID NO: 3587335 - RNA, 20 nt, Pseudomonas putida KT2440
agggcgcgaaaagccugcac

SEQ ID NO: 3587336 - RNA, 15 nt, Pseudomonas putida KT2440
agggcgcgcuggcgc

SEQ ID NO: 3587337 - RNA, 22 nt, Pseudomonas putida KT2440
agggcgcguguagcccgcugaa

SEQ ID NO: 3587338 - RNA, 18 nt, Pseudomonas putida KT2440
agggcgcuugcccgcgaa

SEQ ID NO: 3587339 - RNA, 14 nt, Pseudomonas putida KT2440
agggcggccaaggc

SEQ ID NO: 3587340 - RNA, 16 nt, Pseudomonas putida KT2440
agggcggccaaggcgu

SEQ ID NO: 3587341 - RNA, 14 nt, Pseudomonas putida KT2440
agggcgucaugcuc

SEQ ID NO: 3587342 - RNA, 19 nt, Pseudomonas putida KT2440
agggcgucugcuccgcgau

SEQ ID NO: 3587343 - RNA, 12 nt, Pseudomonas putida KT2440
agggcguucagc

SEQ ID NO: 3587344 - RNA, 13 nt, Pseudomonas putida KT2440
agggcguugccga

SEQ ID NO: 3587345 - RNA, 15 nt, Pseudomonas putida KT2440
agggcguugggcacg

SEQ ID NO: 3587346 - RNA, 18 nt, Pseudomonas putida KT2440
agggcuacgaaaccguca

SEQ ID NO: 3587347 - RNA, 21 nt, Pseudomonas putida KT2440
agggcucaacgccagggcaau

SEQ ID NO: 3587348 - RNA, 15 nt, Pseudomonas putida KT2440
agggcugcaucacuu

SEQ ID NO: 3587349 - RNA, 13 nt, Pseudomonas putida KT2440
agggcugccgcgc

SEQ ID NO: 3587350 - RNA, 14 nt, Pseudomonas putida KT2440
agggcugcggggca

SEQ ID NO: 3587351 - RNA, 19 nt, Pseudomonas putida KT2440
agggcugguggcggcauac

SEQ ID NO: 3587352 - RNA, 18 nt, Pseudomonas putida KT2440
agggcugguuaugagccu

SEQ ID NO: 3587353 - RNA, 20 nt, Pseudomonas putida KT2440
aggggacagccacaugccag

SEQ ID NO: 3587354 - RNA, 18 nt, Pseudomonas putida KT2440
aggggacgaucugcagca

SEQ ID NO: 3587355 - RNA, 16 nt, Pseudomonas putida KT2440
aggggaugcgcgagag

SEQ ID NO: 3587356 - RNA, 19 nt, Pseudomonas putida KT2440
aggggcacggguacccgcg

SEQ ID NO: 3587357 - RNA, 20 nt, Pseudomonas putida KT2440
aggggcagaugcuccaaccc

SEQ ID NO: 3587358 - RNA, 14 nt, Pseudomonas putida KT2440
aggggcagccaggu

SEQ ID NO: 3587359 - RNA, 14 nt, Pseudomonas putida KT2440
aggggccgcaaagc

SEQ ID NO: 3587360 - RNA, 14 nt, Pseudomonas putida KT2440
aggggcggguggag

SEQ ID NO: 3587361 - RNA, 18 nt, Pseudomonas putida KT2440
aggggcugccuugcagcc

SEQ ID NO: 3587362 - RNA, 22 nt, Pseudomonas putida KT2440
aggggcuguauagcccugcccu

SEQ ID NO: 3587363 - RNA, 16 nt, Pseudomonas putida KT2440
agggggguaaggcugg

SEQ ID NO: 3587364 - RNA, 18 nt, Pseudomonas putida KT2440
agggguggaucaggaaca

SEQ ID NO: 3587365 - RNA, 17 nt, Pseudomonas putida KT2440
agggguguucagugauu

SEQ ID NO: 3587366 - RNA, 17 nt, Pseudomonas putida KT2440
agggguuuccuuugggu

SEQ ID NO: 3587367 - RNA, 18 nt, Pseudomonas putida KT2440
aggguaccgccguccacc

SEQ ID NO: 3587368 - RNA, 23 nt, Pseudomonas putida KT2440
aggguagggguggaucaggaaca

SEQ ID NO: 3587369 - RNA, 18 nt, Pseudomonas putida KT2440
aggguauugaacggcgca

SEQ ID NO: 3587370 - RNA, 15 nt, Pseudomonas putida KT2440
agggucagggccagg

SEQ ID NO: 3587371 - RNA, 16 nt, Pseudomonas putida KT2440
agggucgcgccccaag

SEQ ID NO: 3587372 - RNA, 14 nt, Pseudomonas putida KT2440
agggucgcuucuuu

SEQ ID NO: 3587373 - RNA, 14 nt, Pseudomonas putida KT2440
agggucggcgggcg

SEQ ID NO: 3587374 - RNA, 15 nt, Pseudomonas putida KT2440
agggucgggcacagg

SEQ ID NO: 3587375 - RNA, 19 nt, Pseudomonas putida KT2440
agggucgggcacaggccca

SEQ ID NO: 3587376 - RNA, 22 nt, Pseudomonas putida KT2440
agggucgggcacaggcccagca

SEQ ID NO: 3587377 - RNA, 15 nt, Pseudomonas putida KT2440
aggugcagcaacagg

SEQ ID NO: 3587378 - RNA, 19 nt, Pseudomonas putida KT2440
aggugcagcaacagguaca

SEQ ID NO: 3587379 - RNA, 18 nt, Pseudomonas putida KT2440
aggugcaggcucggccac

SEQ ID NO: 3587380 - RNA, 13 nt, Pseudomonas putida KT2440
aggugcaggguag

SEQ ID NO: 3587381 - RNA, 15 nt, Pseudomonas putida KT2440
aggugcaggguaggg

SEQ ID NO: 3587382 - RNA, 18 nt, Pseudomonas putida KT2440
aggugcagguucgaccac

SEQ ID NO: 3587383 - RNA, 19 nt, Pseudomonas putida KT2440
aggugcagguucgaccacc

SEQ ID NO: 3587384 - RNA, 21 nt, Pseudomonas putida KT2440
aggugcagguucgaccaccgc

SEQ ID NO: 3587385 - RNA, 22 nt, Pseudomonas putida KT2440
aggugcaucgucacauccugcu

SEQ ID NO: 3587386 - RNA, 16 nt, Pseudomonas putida KT2440
aggugccaacaggcag

SEQ ID NO: 3587387 - RNA, 18 nt, Pseudomonas putida KT2440
aggugccaacaggcagca

SEQ ID NO: 3587388 - RNA, 19 nt, Pseudomonas putida KT2440
aggugccaacaggcagcau

SEQ ID NO: 3587389 - RNA, 12 nt, Pseudomonas putida KT2440
aggugccaggcu

SEQ ID NO: 3587390 - RNA, 15 nt, Pseudomonas putida KT2440
aggugccaggcucag

SEQ ID NO: 3587391 - RNA, 23 nt, Pseudomonas putida KT2440
aggugcccaagcggcacuaccag

SEQ ID NO: 3587392 - RNA, 21 nt, Pseudomonas putida KT2440
aggugccgucgggcacgauca

SEQ ID NO: 3587393 - RNA, 20 nt, Pseudomonas putida KT2440
aggugcgcaggcuuucggcc

SEQ ID NO: 3587394 - RNA, 18 nt, Pseudomonas putida KT2440
aggugcgcggcaggucga

SEQ ID NO: 3587395 - RNA, 19 nt, Pseudomonas putida KT2440
aggugcgcggcaggucgac

SEQ ID NO: 3587396 - RNA, 21 nt, Pseudomonas putida KT2440
aggugcgcuucaaauagaaga

SEQ ID NO: 3587397 - RNA, 21 nt, Pseudomonas putida KT2440
aggugcgguccggcuccuuga

SEQ ID NO: 3587398 - RNA, 15 nt, Pseudomonas putida KT2440
aggugcuaccggcgc

SEQ ID NO: 3587399 - RNA, 16 nt, Pseudomonas putida KT2440
aggugcuacggaacug

SEQ ID NO: 3587400 - RNA, 15 nt, Pseudomonas putida KT2440
aggugcucaaggcac

SEQ ID NO: 3587401 - RNA, 14 nt, Pseudomonas putida KT2440
aggugcucagccac

SEQ ID NO: 3587402 - RNA, 21 nt, Pseudomonas putida KT2440
aggugcucagccacgcuggca

SEQ ID NO: 3587403 - RNA, 23 nt, Pseudomonas putida KT2440
aggugcucagccacgcuggcacc

SEQ ID NO: 3587404 - RNA, 15 nt, Pseudomonas putida KT2440
aggugcuugcggaac

SEQ ID NO: 3587405 - RNA, 14 nt, Pseudomonas putida KT2440
aggugcuuggggcu

SEQ ID NO: 3587406 - RNA, 21 nt, Pseudomonas putida KT2440
aggugcuuuuuugugccuggu

SEQ ID NO: 3587407 - RNA, 12 nt, Pseudomonas putida KT2440
agguggccggca

SEQ ID NO: 3587408 - RNA, 19 nt, Pseudomonas putida KT2440
aggugggguugaccaggca

SEQ ID NO: 3587409 - RNA, 17 nt, Pseudomonas putida KT2440
aggugguaacuggccag

SEQ ID NO: 3587410 - RNA, 18 nt, Pseudomonas putida KT2440
aggugguagccgugcggc

SEQ ID NO: 3587411 - RNA, 16 nt, Pseudomonas putida KT2440
aggugguagucggcaa

SEQ ID NO: 3587412 - RNA, 15 nt, Pseudomonas putida KT2440
agguggucgaggcaa

SEQ ID NO: 3587413 - RNA, 17 nt, Pseudomonas putida KT2440
aggugucaccgcgagca

SEQ ID NO: 3587414 - RNA, 21 nt, Pseudomonas putida KT2440
aggugucgaacuucuccagcg

SEQ ID NO: 3587415 - RNA, 22 nt, Pseudomonas putida KT2440
aggugugccacuucaugggcca

SEQ ID NO: 3587416 - RNA, 14 nt, Pseudomonas putida KT2440
agguguuccagcac

SEQ ID NO: 3587417 - RNA, 15 nt, Pseudomonas putida KT2440
agguguuccagcacg

SEQ ID NO: 3587418 - RNA, 14 nt, Pseudomonas putida KT2440
agguguugaaaugg

SEQ ID NO: 3587419 - RNA, 22 nt, Pseudomonas putida KT2440
agguuacgcaccagcuccaaca

SEQ ID NO: 3587420 - RNA, 22 nt, Pseudomonas putida KT2440
agguuacuggccaauugcgcca

SEQ ID NO: 3587421 - RNA, 16 nt, Pseudomonas putida KT2440
agguuauccacacccu

SEQ ID NO: 3587422 - RNA, 13 nt, Pseudomonas putida KT2440
agguucacuucca

SEQ ID NO: 3587423 - RNA, 16 nt, Pseudomonas putida KT2440
agguucacuuccacac

SEQ ID NO: 3587424 - RNA, 13 nt, Pseudomonas putida KT2440
agguucaggcgca

SEQ ID NO: 3587425 - RNA, 20 nt, Pseudomonas putida KT2440
agguuccauagugugcucac

SEQ ID NO: 3587426 - RNA, 15 nt, Pseudomonas putida KT2440
agguucgaauccugc

SEQ ID NO: 3587427 - RNA, 17 nt, Pseudomonas putida KT2440
agguucgaauccugcug

SEQ ID NO: 3587428 - RNA, 21 nt, Pseudomonas putida KT2440
agguucgaaucgcucaugccc

SEQ ID NO: 3587429 - RNA, 22 nt, Pseudomonas putida KT2440
agguucgaaucgcucaugcccc

SEQ ID NO: 3587430 - RNA, 17 nt, Pseudomonas putida KT2440
agguucgaccaccgcag

SEQ ID NO: 3587431 - RNA, 17 nt, Pseudomonas putida KT2440
agguucgaccacugcag

SEQ ID NO: 3587432 - RNA, 14 nt, Pseudomonas putida KT2440
agguucguccccuu

SEQ ID NO: 3587433 - RNA, 13 nt, Pseudomonas putida KT2440
agguucucggcac

SEQ ID NO: 3587434 - RNA, 22 nt, Pseudomonas putida KT2440
agguucugaaucuggcucugca

SEQ ID NO: 3587435 - RNA, 20 nt, Pseudomonas putida KT2440
agguucuguagcgcaaugcc

SEQ ID NO: 3587436 - RNA, 21 nt, Pseudomonas putida KT2440
agguucuguagcgcaaugccc

SEQ ID NO: 3587437 - RNA, 16 nt, Pseudomonas putida KT2440
agguucuuaucugggg

SEQ ID NO: 3587438 - RNA, 15 nt, Pseudomonas putida KT2440
agguugaacagcagc

SEQ ID NO: 3587439 - RNA, 14 nt, Pseudomonas putida KT2440
agguugacggugug

SEQ ID NO: 3587440 - RNA, 23 nt, Pseudomonas putida KT2440
agguugacguuguagcggccauc

SEQ ID NO: 3587441 - RNA, 16 nt, Pseudomonas putida KT2440
agguugauccagcccu

SEQ ID NO: 3587442 - RNA, 14 nt, Pseudomonas putida KT2440
agguugcacagcau

SEQ ID NO: 3587443 - RNA, 15 nt, Pseudomonas putida KT2440
agguugccaccagca

SEQ ID NO: 3587444 - RNA, 12 nt, Pseudomonas putida KT2440
agguugcccggc

SEQ ID NO: 3587445 - RNA, 24 nt, Pseudomonas putida KT2440
agguugcccggcgagcgcaggaac

SEQ ID NO: 3587446 - RNA, 16 nt, Pseudomonas putida KT2440
agguugcgcgccgcca

SEQ ID NO: 3587447 - RNA, 20 nt, Pseudomonas putida KT2440
agguugcgcgccgccaggcg

SEQ ID NO: 3587448 - RNA, 17 nt, Pseudomonas putida KT2440
agguugcgcuccaucca

SEQ ID NO: 3587449 - RNA, 17 nt, Pseudomonas putida KT2440
agguugcuggccuugga

SEQ ID NO: 3587450 - RNA, 16 nt, Pseudomonas putida KT2440
agguuggacagcgccc

SEQ ID NO: 3587451 - RNA, 14 nt, Pseudomonas putida KT2440
agguuggccgccgc

SEQ ID NO: 3587452 - RNA, 14 nt, Pseudomonas putida KT2440
agguuuccagcccu

SEQ ID NO: 3587453 - RNA, 14 nt, Pseudomonas putida KT2440
agguuuggguuggc

SEQ ID NO: 3587454 - RNA, 15 nt, Pseudomonas putida KT2440
agguuuuccagcccg

SEQ ID NO: 3587455 - RNA, 13 nt, Pseudomonas putida KT2440
agguuuugcagcg

SEQ ID NO: 3587456 - RNA, 16 nt, Pseudomonas putida KT2440
aguaacggcccuugcu

SEQ ID NO: 3587457 - RNA, 19 nt, Pseudomonas putida KT2440
aguaacggcccuugcucaa

SEQ ID NO: 3587458 - RNA, 15 nt, Pseudomonas putida KT2440
aguaaugcagccggc

SEQ ID NO: 3587459 - RNA, 19 nt, Pseudomonas putida KT2440
aguaaugcagccggccccu

SEQ ID NO: 3587460 - RNA, 14 nt, Pseudomonas putida KT2440
aguacaaacaccac

SEQ ID NO: 3587461 - RNA, 12 nt, Pseudomonas putida KT2440
aguacaacugcc

SEQ ID NO: 3587462 - RNA, 18 nt, Pseudomonas putida KT2440
aguacaacugccacccuc

SEQ ID NO: 3587463 - RNA, 12 nt, Pseudomonas putida KT2440
aguacaccggca

SEQ ID NO: 3587464 - RNA, 13 nt, Pseudomonas putida KT2440
aguacacgaggau

SEQ ID NO: 3587465 - RNA, 20 nt, Pseudomonas putida KT2440
aguacaugaucggguucuuc

SEQ ID NO: 3587466 - RNA, 13 nt, Pseudomonas putida KT2440
aguaccagcagca

SEQ ID NO: 3587467 - RNA, 20 nt, Pseudomonas putida KT2440
aguaccaggucgccagcacc

SEQ ID NO: 3587468 - RNA, 21 nt, Pseudomonas putida KT2440
aguaccaggucgccagcacca

SEQ ID NO: 3587469 - RNA, 19 nt, Pseudomonas putida KT2440
aguaccuguggcagcggcu

SEQ ID NO: 3587470 - RNA, 20 nt, Pseudomonas putida KT2440
aguaccugugggagcgggcu

SEQ ID NO: 3587471 - RNA, 19 nt, Pseudomonas putida KT2440
aguaccuucuggcuggagc

SEQ ID NO: 3587472 - RNA, 18 nt, Pseudomonas putida KT2440
aguacggccaucagcaag

SEQ ID NO: 3587473 - RNA, 17 nt, Pseudomonas putida KT2440
aguacggcuugccggca

SEQ ID NO: 3587474 - RNA, 15 nt, Pseudomonas putida KT2440
aguacuccagcagcg

SEQ ID NO: 3587475 - RNA, 16 nt, Pseudomonas putida KT2440
aguacuuauaagcagc

SEQ ID NO: 3587476 - RNA, 19 nt, Pseudomonas putida KT2440
aguacuugcaggugcaggg

SEQ ID NO: 3587477 - RNA, 21 nt, Pseudomonas putida KT2440
aguacuuggcgccgcccugga

SEQ ID NO: 3587478 - RNA, 14 nt, Pseudomonas putida KT2440
aguacuuuuucagg

SEQ ID NO: 3587479 - RNA, 18 nt, Pseudomonas putida KT2440
aguagagcccccagcaca

SEQ ID NO: 3587480 - RNA, 16 nt, Pseudomonas putida KT2440
aguagauaucggccgu

SEQ ID NO: 3587481 - RNA, 19 nt, Pseudomonas putida KT2440
aguagccuucuucggucag

SEQ ID NO: 3587482 - RNA, 16 nt, Pseudomonas putida KT2440
aguagcgccaccaucu

SEQ ID NO: 3587483 - RNA, 17 nt, Pseudomonas putida KT2440
agugccguccgcugccu

SEQ ID NO: 3587484 - RNA, 17 nt, Pseudomonas putida KT2440
agugccguggcaggcag

SEQ ID NO: 3587485 - RNA, 23 nt, Pseudomonas putida KT2440
agugccucacgcaugccgauguc

SEQ ID NO: 3587486 - RNA, 15 nt, Pseudomonas putida KT2440
agugccucgaccacc

SEQ ID NO: 3587487 - RNA, 19 nt, Pseudomonas putida KT2440
agugcgcaugcccgcgcaa

SEQ ID NO: 3587488 - RNA, 23 nt, Pseudomonas putida KT2440
agugcggcaaccaccaacagcac

SEQ ID NO: 3587489 - RNA, 14 nt, Pseudomonas putida KT2440
agugcggcaggccg

SEQ ID NO: 3587490 - RNA, 16 nt, Pseudomonas putida KT2440
agugcguagccuucag

SEQ ID NO: 3587491 - RNA, 16 nt, Pseudomonas putida KT2440
agugcgucggccacca

SEQ ID NO: 3587492 - RNA, 23 nt, Pseudomonas putida KT2440
agugcgucggccaccaccgggug

SEQ ID NO: 3587493 - RNA, 17 nt, Pseudomonas putida KT2440
agugcguuggcugcuga

SEQ ID NO: 3587494 - RNA, 18 nt, Pseudomonas putida KT2440
agugcucgccucacagcg

SEQ ID NO: 3587495 - RNA, 17 nt, Pseudomonas putida KT2440
agugcucggcaacggcc

SEQ ID NO: 3587496 - RNA, 14 nt, Pseudomonas putida KT2440
agugcugagagggu

SEQ ID NO: 3587497 - RNA, 23 nt, Pseudomonas putida KT2440
agugcugccacguuuucgcggcc

SEQ ID NO: 3587498 - RNA, 13 nt, Pseudomonas putida KT2440
agugcuggcgugu

SEQ ID NO: 3587499 - RNA, 23 nt, Pseudomonas putida KT2440
agugcugucacccuugggcacca

SEQ ID NO: 3587500 - RNA, 15 nt, Pseudomonas putida KT2440
agugcuucacugccg

SEQ ID NO: 3587501 - RNA, 19 nt, Pseudomonas putida KT2440
agugcuucgcccagugccu

SEQ ID NO: 3587502 - RNA, 14 nt, Pseudomonas putida KT2440
agugcuucuggaua

SEQ ID NO: 3587503 - RNA, 19 nt, Pseudomonas putida KT2440
agugcuuguggccauugca

SEQ ID NO: 3587504 - RNA, 15 nt, Pseudomonas putida KT2440
aguggcacaccaugg

SEQ ID NO: 3587505 - RNA, 22 nt, Pseudomonas putida KT2440
aguggcacccacagcgccugcu

SEQ ID NO: 3587506 - RNA, 17 nt, Pseudomonas putida KT2440
aguggcagaacucccau

SEQ ID NO: 3587507 - RNA, 18 nt, Pseudomonas putida KT2440
aguggcagguucgaccac

SEQ ID NO: 3587508 - RNA, 21 nt, Pseudomonas putida KT2440
aguggcagguucgaccacugc

SEQ ID NO: 3587509 - RNA, 18 nt, Pseudomonas putida KT2440
aguggccgaguuggcuuc

SEQ ID NO: 3587510 - RNA, 17 nt, Pseudomonas putida KT2440
aguggccucgaacaugg

SEQ ID NO: 3587511 - RNA, 18 nt, Pseudomonas putida KT2440
aguggccucgaacauggc

SEQ ID NO: 3587512 - RNA, 12 nt, Pseudomonas putida KT2440
aguggccuuggu

SEQ ID NO: 3587513 - RNA, 14 nt, Pseudomonas putida KT2440
aguggcgcaggcug

SEQ ID NO: 3587514 - RNA, 14 nt, Pseudomonas putida KT2440
aguggcgccggauu

SEQ ID NO: 3587515 - RNA, 21 nt, Pseudomonas putida KT2440
aguggcggcucgcugaacacg

SEQ ID NO: 3587516 - RNA, 22 nt, Pseudomonas putida KT2440
aguggcggcucgcugaacacgc

SEQ ID NO: 3587517 - RNA, 17 nt, Pseudomonas putida KT2440
agugguaaugaaagucc

SEQ ID NO: 3587518 - RNA, 22 nt, Pseudomonas putida KT2440
aguggucgugccauucaucgua

SEQ ID NO: 3587519 - RNA, 22 nt, Pseudomonas putida KT2440
aguggugguagaaggucggugc

SEQ ID NO: 3587520 - RNA, 13 nt, Pseudomonas putida KT2440
aguguaaccaugu

SEQ ID NO: 3587521 - RNA, 19 nt, Pseudomonas putida KT2440
agugucccggccagggcug

SEQ ID NO: 3587522 - RNA, 19 nt, Pseudomonas putida KT2440
agugucgaacuucacuucg

SEQ ID NO: 3587523 - RNA, 16 nt, Pseudomonas putida KT2440
agugucugcgccugcu

SEQ ID NO: 3587524 - RNA, 17 nt, Pseudomonas putida KT2440
agugugcaaacacccag

SEQ ID NO: 3587525 - RNA, 13 nt, Pseudomonas putida KT2440
agugugggggcgg

SEQ ID NO: 3587526 - RNA, 16 nt, Pseudomonas putida KT2440
aguguucgaggaacau

SEQ ID NO: 3587527 - RNA, 14 nt, Pseudomonas putida KT2440
aguucaaugccagc

SEQ ID NO: 3587528 - RNA, 16 nt, Pseudomonas putida KT2440
aguucaaugccagcag

SEQ ID NO: 3587529 - RNA, 20 nt, Pseudomonas putida KT2440
aguucacacucagccgcugc

SEQ ID NO: 3587530 - RNA, 16 nt, Pseudomonas putida KT2440
aguucacgcaggucgg

SEQ ID NO: 3587531 - RNA, 20 nt, Pseudomonas putida KT2440
aguucacggaucgccaggac

SEQ ID NO: 3587532 - RNA, 20 nt, Pseudomonas putida KT2440
aguucagcgccucuuugccc

SEQ ID NO: 3587533 - RNA, 20 nt, Pseudomonas putida KT2440
aguucaggcgcccugcgcca

SEQ ID NO: 3587534 - RNA, 21 nt, Pseudomonas putida KT2440
aguucauuaccauccaucacc

SEQ ID NO: 3587535 - RNA, 21 nt, Pseudomonas putida KT2440
aguucauuguucuggccaccg

SEQ ID NO: 3587536 - RNA, 19 nt, Pseudomonas putida KT2440
aguucccaggcagccucca

SEQ ID NO: 3587537 - RNA, 18 nt, Pseudomonas putida KT2440
aguuccugcuugccgggu

SEQ ID NO: 3587538 - RNA, 23 nt, Pseudomonas putida KT2440
aguuccuucuugugcacaaagcc

SEQ ID NO: 3587539 - RNA, 23 nt, Pseudomonas putida KT2440
aguucgaaaccacccugaugcag

SEQ ID NO: 3587540 - RNA, 17 nt, Pseudomonas putida KT2440
aguucgacgcugcuguc

SEQ ID NO: 3587541 - RNA, 13 nt, Pseudomonas putida KT2440
aguucgccacccg

SEQ ID NO: 3587542 - RNA, 20 nt, Pseudomonas putida KT2440
aguucgcgcaccaucggcuc

SEQ ID NO: 3587543 - RNA, 20 nt, Pseudomonas putida KT2440
aguucgcugcgcaaggcauu

SEQ ID NO: 3587544 - RNA, 15 nt, Pseudomonas putida KT2440
aguucggcaccuuuc

SEQ ID NO: 3587545 - RNA, 19 nt, Pseudomonas putida KT2440
aguucggcggccccggcgc

SEQ ID NO: 3587546 - RNA, 23 nt, Pseudomonas putida KT2440
aguucggcggccccggcgccgcc

SEQ ID NO: 3587547 - RNA, 13 nt, Pseudomonas putida KT2440
aguucguccaggc

SEQ ID NO: 3587548 - RNA, 15 nt, Pseudomonas putida KT2440
aguucguccaggcuu

SEQ ID NO: 3587549 - RNA, 22 nt, Pseudomonas putida KT2440
aguucguccucgacccacggcu

SEQ ID NO: 3587550 - RNA, 23 nt, Pseudomonas putida KT2440
aguucguccucgacccacggcug

SEQ ID NO: 3587551 - RNA, 13 nt, Pseudomonas putida KT2440
aguucgugcaccc

SEQ ID NO: 3587552 - RNA, 13 nt, Pseudomonas putida KT2440
aguucugcucagc

SEQ ID NO: 3587553 - RNA, 21 nt, Pseudomonas putida KT2440
aguucuucuuuaagccccugc

SEQ ID NO: 3587554 - RNA, 19 nt, Pseudomonas putida KT2440
aguucuugauccaguagcc

SEQ ID NO: 3587555 - RNA, 14 nt, Pseudomonas putida KT2440
aguucuuggcggcu

SEQ ID NO: 3587556 - RNA, 16 nt, Pseudomonas putida KT2440
aguucuuggcggcugg

SEQ ID NO: 3587557 - RNA, 17 nt, Pseudomonas putida KT2440
aguucuuggucagcauc

SEQ ID NO: 3587558 - RNA, 16 nt, Pseudomonas putida KT2440
aguucuuuguccugcg

SEQ ID NO: 3587559 - RNA, 20 nt, Pseudomonas putida KT2440
aguugaaugccgccauccuc

SEQ ID NO: 3587560 - RNA, 14 nt, Pseudomonas putida KT2440
aguugaccagcacc

SEQ ID NO: 3587561 - RNA, 22 nt, Pseudomonas putida KT2440
aguugacccugaaucagcaaac

SEQ ID NO: 3587562 - RNA, 15 nt, Pseudomonas putida KT2440
aguugagcaccggca

SEQ ID NO: 3587563 - RNA, 14 nt, Pseudomonas putida KT2440
aguugaucaccguc

SEQ ID NO: 3587564 - RNA, 15 nt, Pseudomonas putida KT2440
aguugaucucaagcu

SEQ ID NO: 3587565 - RNA, 17 nt, Pseudomonas putida KT2440
aguugcaggcgcagggu

SEQ ID NO: 3587566 - RNA, 19 nt, Pseudomonas putida KT2440
aguugcccggguacagccc

SEQ ID NO: 3587567 - RNA, 15 nt, Pseudomonas putida KT2440
aguugccggugguga

SEQ ID NO: 3587568 - RNA, 19 nt, Pseudomonas putida KT2440
aguugcguggggccugccg

SEQ ID NO: 3587569 - RNA, 16 nt, Pseudomonas putida KT2440
aguugcuccaccugcc

SEQ ID NO: 3587570 - RNA, 21 nt, Pseudomonas putida KT2440
aguuggccgacgauuucugcc

SEQ ID NO: 3587571 - RNA, 20 nt, Pseudomonas putida KT2440
aguuggugagguguugaaau

SEQ ID NO: 3587572 - RNA, 13 nt, Pseudomonas putida KT2440
aguuguccggguc

SEQ ID NO: 3587573 - RNA, 15 nt, Pseudomonas putida KT2440
aguuguuuuauaacg

SEQ ID NO: 3587574 - RNA, 20 nt, Pseudomonas putida KT2440
aguuuauauccuagguagua

SEQ ID NO: 3587575 - RNA, 20 nt, Pseudomonas putida KT2440
aguuucaccugaccaucagc

SEQ ID NO: 3587576 - RNA, 21 nt, Pseudomonas putida KT2440
aguuuccggcaaagagugccc

SEQ ID NO: 3587577 - RNA, 17 nt, Pseudomonas putida KT2440
aguuucuugccuuccac

SEQ ID NO: 3587578 - RNA, 22 nt, Pseudomonas putida KT2440
aguuucuugccuuccaccggga

SEQ ID NO: 3587579 - RNA, 22 nt, Pseudomonas putida KT2440
aguuugacggugaauuccuugc

SEQ ID NO: 3587580 - RNA, 14 nt, Pseudomonas putida KT2440
aguuugcccagcgc

SEQ ID NO: 3587581 - RNA, 12 nt, Pseudomonas putida KT2440
aguuuggccagc

SEQ ID NO: 3587582 - RNA, 17 nt, Pseudomonas putida KT2440
aguuuuccuaaagcauu

SEQ ID NO: 3587583 - RNA, 16 nt, Pseudomonas putida KT2440
auaaaaaaaccggcca

SEQ ID NO: 3587584 - RNA, 18 nt, Pseudomonas putida KT2440
auaaaaaaccccggcaca

SEQ ID NO: 3587585 - RNA, 20 nt, Pseudomonas putida KT2440
auaaaaaagggccccuucaa

SEQ ID NO: 3587586 - RNA, 12 nt, Pseudomonas putida KT2440
auaaaaacaaca

SEQ ID NO: 3587587 - RNA, 14 nt, Pseudomonas putida KT2440
auaaaccagcagcg

SEQ ID NO: 3587588 - RNA, 20 nt, Pseudomonas putida KT2440
auauagcaccgguaccgcuc

SEQ ID NO: 3587589 - RNA, 14 nt, Pseudomonas putida KT2440
auauauuuuccuga

SEQ ID NO: 3587590 - RNA, 21 nt, Pseudomonas putida KT2440
auauccacacccgccacgcuc

SEQ ID NO: 3587591 - RNA, 12 nt, Pseudomonas putida KT2440
auauccagcacc

SEQ ID NO: 3587592 - RNA, 21 nt, Pseudomonas putida KT2440
auauccagugcuucacugccg

SEQ ID NO: 3587593 - RNA, 14 nt, Pseudomonas putida KT2440
auaucccgccaggu

SEQ ID NO: 3587594 - RNA, 15 nt, Pseudomonas putida KT2440
auauccgcagccccg

SEQ ID NO: 3587595 - RNA, 22 nt, Pseudomonas putida KT2440
auaucgaaccagcagcaccugc

SEQ ID NO: 3587596 - RNA, 20 nt, Pseudomonas putida KT2440
auaucgacuucggccauuug

SEQ ID NO: 3587597 - RNA, 23 nt, Pseudomonas putida KT2440
auaucgcgaaacgcggcaaccug

SEQ ID NO: 3587598 - RNA, 21 nt, Pseudomonas putida KT2440
auaucggccguggguaccuuc

SEQ ID NO: 3587599 - RNA, 20 nt, Pseudomonas putida KT2440
auaucggcgcggcccaguuu

SEQ ID NO: 3587600 - RNA, 18 nt, Pseudomonas putida KT2440
auaucucugguacaacaa

SEQ ID NO: 3587601 - RNA, 19 nt, Pseudomonas putida KT2440
auaucucugguacaacaac

SEQ ID NO: 3587602 - RNA, 22 nt, Pseudomonas putida KT2440
auaucucugguacaacaacaaa

SEQ ID NO: 3587603 - RNA, 13 nt, Pseudomonas putida KT2440
auaugcuccaugu

SEQ ID NO: 3587604 - RNA, 18 nt, Pseudomonas putida KT2440
auauggcgcuuucacugg

SEQ ID NO: 3587605 - RNA, 14 nt, Pseudomonas putida KT2440
auauggcuccacca

SEQ ID NO: 3587606 - RNA, 13 nt, Pseudomonas putida KT2440
auaugguggguau

SEQ ID NO: 3587607 - RNA, 14 nt, Pseudomonas putida KT2440
auaugugaccgcau

SEQ ID NO: 3587608 - RNA, 14 nt, Pseudomonas putida KT2440
auauugcugagcca

SEQ ID NO: 3587609 - RNA, 16 nt, Pseudomonas putida KT2440
auauugcugagccagu

SEQ ID NO: 3587610 - RNA, 18 nt, Pseudomonas putida KT2440
auauugcugagccaguuc

SEQ ID NO: 3587611 - RNA, 20 nt, Pseudomonas putida KT2440
auauugcugagccaguucac

SEQ ID NO: 3587612 - RNA, 21 nt, Pseudomonas putida KT2440
auauugguccagccacaauuu

SEQ ID NO: 3587613 - RNA, 19 nt, Pseudomonas putida KT2440
auauuucacuuucuugaaa

SEQ ID NO: 3587614 - RNA, 22 nt, Pseudomonas putida KT2440
auauuucacuuucuugaaauua

SEQ ID NO: 3587615 - RNA, 22 nt, Pseudomonas putida KT2440
aucaaacggucccgaucucccc

SEQ ID NO: 3587616 - RNA, 23 nt, Pseudomonas putida KT2440
aucaacaaaccgacccugcugcu

SEQ ID NO: 3587617 - RNA, 20 nt, Pseudomonas putida KT2440
aucaacccgcgaagcggcca

SEQ ID NO: 3587618 - RNA, 14 nt, Pseudomonas putida KT2440
aucaacgcugccau

SEQ ID NO: 3587619 - RNA, 13 nt, Pseudomonas putida KT2440
aucaacgguggcc

SEQ ID NO: 3587620 - RNA, 23 nt, Pseudomonas putida KT2440
aucaacgguggccagcagcucca

SEQ ID NO: 3587621 - RNA, 20 nt, Pseudomonas putida KT2440
aucaacgugguaaugcgcug

SEQ ID NO: 3587622 - RNA, 21 nt, Pseudomonas putida KT2440
aucaacucacuuucagcgccu

SEQ ID NO: 3587623 - RNA, 14 nt, Pseudomonas putida KT2440
aucaagcccgcucg

SEQ ID NO: 3587624 - RNA, 15 nt, Pseudomonas putida KT2440
aucaagccugcgcag

SEQ ID NO: 3587625 - RNA, 20 nt, Pseudomonas putida KT2440
aucaagccugcgcaggcgcc

SEQ ID NO: 3587626 - RNA, 15 nt, Pseudomonas putida KT2440
aucaagcggcuggua

SEQ ID NO: 3587627 - RNA, 18 nt, Pseudomonas putida KT2440
aucaagguuucagcagcg

SEQ ID NO: 3587628 - RNA, 20 nt, Pseudomonas putida KT2440
aucaaugggccgaucacgaa

SEQ ID NO: 3587629 - RNA, 12 nt, Pseudomonas putida KT2440
aucacaccggca

SEQ ID NO: 3587630 - RNA, 13 nt, Pseudomonas putida KT2440
aucacaccggccg

SEQ ID NO: 3587631 - RNA, 15 nt, Pseudomonas putida KT2440
aucacauaaggcagc

SEQ ID NO: 3587632 - RNA, 18 nt, Pseudomonas putida KT2440
aucacauaaggcagcagc

SEQ ID NO: 3587633 - RNA, 14 nt, Pseudomonas putida KT2440
aucacauccacagc

SEQ ID NO: 3587634 - RNA, 15 nt, Pseudomonas putida KT2440
aucacauccacagcc

SEQ ID NO: 3587635 - RNA, 16 nt, Pseudomonas putida KT2440
aucacauccacagccu

SEQ ID NO: 3587636 - RNA, 22 nt, Pseudomonas putida KT2440
aucacaugcggcaccgccagcu

SEQ ID NO: 3587637 - RNA, 20 nt, Pseudomonas putida KT2440
aucaccaaggcuugaguggu

SEQ ID NO: 3587638 - RNA, 17 nt, Pseudomonas putida KT2440
aucaccacaaaaccuuc

SEQ ID NO: 3587639 - RNA, 20 nt, Pseudomonas putida KT2440
aucaccacaaaaccuuccau

SEQ ID NO: 3587640 - RNA, 15 nt, Pseudomonas putida KT2440
aucaccacgcccugg

SEQ ID NO: 3587641 - RNA, 18 nt, Pseudomonas putida KT2440
aucaccacgcccuggccc

SEQ ID NO: 3587642 - RNA, 21 nt, Pseudomonas putida KT2440
aucaccagcagcuucuucaca

SEQ ID NO: 3587643 - RNA, 13 nt, Pseudomonas putida KT2440
aucaccagccccc

SEQ ID NO: 3587644 - RNA, 13 nt, Pseudomonas putida KT2440
aucaccagccccu

SEQ ID NO: 3587645 - RNA, 20 nt, Pseudomonas putida KT2440
aucaccaggauugccgggcu

SEQ ID NO: 3587646 - RNA, 21 nt, Pseudomonas putida KT2440
aucaccaggcccgcaaggguc

SEQ ID NO: 3587647 - RNA, 18 nt, Pseudomonas putida KT2440
aucaccagguuguggccc

SEQ ID NO: 3587648 - RNA, 14 nt, Pseudomonas putida KT2440
aucacccgcgaaug

SEQ ID NO: 3587649 - RNA, 20 nt, Pseudomonas putida KT2440
aucacccgggaacagcagca

SEQ ID NO: 3587650 - RNA, 17 nt, Pseudomonas putida KT2440
aucacccgucugcagga

SEQ ID NO: 3587651 - RNA, 17 nt, Pseudomonas putida KT2440
aucacccuuggccaccu

SEQ ID NO: 3587652 - RNA, 17 nt, Pseudomonas putida KT2440
aucaccgcaagcugcac

SEQ ID NO: 3587653 - RNA, 19 nt, Pseudomonas putida KT2440
aucaccgcaagcugcaccg

SEQ ID NO: 3587654 - RNA, 15 nt, Pseudomonas putida KT2440
aucaccgccagcaug

SEQ ID NO: 3587655 - RNA, 13 nt, Pseudomonas putida KT2440
aucaccgccagcg

SEQ ID NO: 3587656 - RNA, 17 nt, Pseudomonas putida KT2440
aucaccgccgccaccga

SEQ ID NO: 3587657 - RNA, 13 nt, Pseudomonas putida KT2440
aucaccgccgccc

SEQ ID NO: 3587658 - RNA, 17 nt, Pseudomonas putida KT2440
aucaccgcgaccuucac

SEQ ID NO: 3587659 - RNA, 16 nt, Pseudomonas putida KT2440
aucaccggcaccggga

SEQ ID NO: 3587660 - RNA, 17 nt, Pseudomonas putida KT2440
aucaccggcaggugaaa

SEQ ID NO: 3587661 - RNA, 13 nt, Pseudomonas putida KT2440
aucaccgguaccg

SEQ ID NO: 3587662 - RNA, 20 nt, Pseudomonas putida KT2440
aucaccucgguaaaggugcc

SEQ ID NO: 3587663 - RNA, 19 nt, Pseudomonas putida KT2440
aucaccucguaaggccuga

SEQ ID NO: 3587664 - RNA, 23 nt, Pseudomonas putida KT2440
aucaccucguaaggccugaggcc

SEQ ID NO: 3587665 - RNA, 14 nt, Pseudomonas putida KT2440
aucaccucgucgcu

SEQ ID NO: 3587666 - RNA, 22 nt, Pseudomonas putida KT2440
aucaccugcacaucggccaccg

SEQ ID NO: 3587667 - RNA, 14 nt, Pseudomonas putida KT2440
aucaccugcggccu

SEQ ID NO: 3587668 - RNA, 16 nt, Pseudomonas putida KT2440
aucaccuguuccccca

SEQ ID NO: 3587669 - RNA, 17 nt, Pseudomonas putida KT2440
aucacgaacacaucacc

SEQ ID NO: 3587670 - RNA, 19 nt, Pseudomonas putida KT2440
aucacgaacaccagcccca

SEQ ID NO: 3587671 - RNA, 13 nt, Pseudomonas putida KT2440
aucacgaucacuc

SEQ ID NO: 3587672 - RNA, 21 nt, Pseudomonas putida KT2440
aucacgaucaugcuggccagg

SEQ ID NO: 3587673 - RNA, 15 nt, Pseudomonas putida KT2440
aucacgcaaccucgu

SEQ ID NO: 3587674 - RNA, 12 nt, Pseudomonas putida KT2440
aucacgcacugg

SEQ ID NO: 3587675 - RNA, 17 nt, Pseudomonas putida KT2440
aucacgcgaccucagcc

SEQ ID NO: 3587676 - RNA, 17 nt, Pseudomonas putida KT2440
aucacgcggcgucaccg

SEQ ID NO: 3587677 - RNA, 21 nt, Pseudomonas putida KT2440
aucacgguguccgccgccguc

SEQ ID NO: 3587678 - RNA, 16 nt, Pseudomonas putida KT2440
aucacgucggccugcc

SEQ ID NO: 3587679 - RNA, 15 nt, Pseudomonas putida KT2440
aucacgucggcguca

SEQ ID NO: 3587680 - RNA, 18 nt, Pseudomonas putida KT2440
aucacguuuggcagugcc

SEQ ID NO: 3587681 - RNA, 16 nt, Pseudomonas putida KT2440
aucacuacaugcggcc

SEQ ID NO: 3587682 - RNA, 14 nt, Pseudomonas putida KT2440
aucacugccagcac

SEQ ID NO: 3587683 - RNA, 23 nt, Pseudomonas putida KT2440
aucacugccagcaccuggcggcc

SEQ ID NO: 3587684 - RNA, 12 nt, Pseudomonas putida KT2440
aucacugcgcag

SEQ ID NO: 3587685 - RNA, 16 nt, Pseudomonas putida KT2440
aucacuguugucggcc

SEQ ID NO: 3587686 - RNA, 18 nt, Pseudomonas putida KT2440
aucacuguugucggccag

SEQ ID NO: 3587687 - RNA, 15 nt, Pseudomonas putida KT2440
aucacuuccaggccc

SEQ ID NO: 3587688 - RNA, 13 nt, Pseudomonas putida KT2440
aucacuuccaugg

SEQ ID NO: 3587689 - RNA, 14 nt, Pseudomonas putida KT2440
aucacuuccuggcc

SEQ ID NO: 3587690 - RNA, 15 nt, Pseudomonas putida KT2440
aucacuugcucaucu

SEQ ID NO: 3587691 - RNA, 22 nt, Pseudomonas putida KT2440
aucagagcgccagcaagcgcau

SEQ ID NO: 3587692 - RNA, 20 nt, Pseudomonas putida KT2440
aucagagcgugaagcggaca

SEQ ID NO: 3587693 - RNA, 13 nt, Pseudomonas putida KT2440
auccacacgcugc

SEQ ID NO: 3587694 - RNA, 19 nt, Pseudomonas putida KT2440
auccacauccgguggcauc

SEQ ID NO: 3587695 - RNA, 19 nt, Pseudomonas putida KT2440
auccaccagccccagcgcc

SEQ ID NO: 3587696 - RNA, 12 nt, Pseudomonas putida KT2440
auccaccaggcu

SEQ ID NO: 3587697 - RNA, 19 nt, Pseudomonas putida KT2440
auccaccaggcuggccacc

SEQ ID NO: 3587698 - RNA, 18 nt, Pseudomonas putida KT2440
auccaccgcgccagccug

SEQ ID NO: 3587699 - RNA, 21 nt, Pseudomonas putida KT2440
auccaccucgucaugcagcgc

SEQ ID NO: 3587700 - RNA, 22 nt, Pseudomonas putida KT2440
auccaccugugaggccuucagc

SEQ ID NO: 3587701 - RNA, 23 nt, Pseudomonas putida KT2440
auccacucgucgaucuggaugaa

SEQ ID NO: 3587702 - RNA, 14 nt, Pseudomonas putida KT2440
auccacuugaagac

SEQ ID NO: 3587703 - RNA, 22 nt, Pseudomonas putida KT2440
auccacuugucccggcccagcc

SEQ ID NO: 3587704 - RNA, 19 nt, Pseudomonas putida KT2440
auccagaucggcagugccg

SEQ ID NO: 3587705 - RNA, 17 nt, Pseudomonas putida KT2440
auccagaugaugucuac

SEQ ID NO: 3587706 - RNA, 22 nt, Pseudomonas putida KT2440
auccagcacugccuggccacug

SEQ ID NO: 3587707 - RNA, 20 nt, Pseudomonas putida KT2440
auccagcaggguggccagca

SEQ ID NO: 3587708 - RNA, 14 nt, Pseudomonas putida KT2440
auccagcccaccac

SEQ ID NO: 3587709 - RNA, 13 nt, Pseudomonas putida KT2440
auccagcccggcg

SEQ ID NO: 3587710 - RNA, 13 nt, Pseudomonas putida KT2440
auccagccuuccg

SEQ ID NO: 3587711 - RNA, 14 nt, Pseudomonas putida KT2440
auccagcgccuccc

SEQ ID NO: 3587712 - RNA, 20 nt, Pseudomonas putida KT2440
auccagcgccucccccagcg

SEQ ID NO: 3587713 - RNA, 20 nt, Pseudomonas putida KT2440
auccagcggcgacaggugcc

SEQ ID NO: 3587714 - RNA, 15 nt, Pseudomonas putida KT2440
auccagcgggaugca

SEQ ID NO: 3587715 - RNA, 15 nt, Pseudomonas putida KT2440
auccagcugcaacag

SEQ ID NO: 3587716 - RNA, 16 nt, Pseudomonas putida KT2440
auccagcugcaacagc

SEQ ID NO: 3587717 - RNA, 20 nt, Pseudomonas putida KT2440
auccaggaaaagguagugca

SEQ ID NO: 3587718 - RNA, 17 nt, Pseudomonas putida KT2440
auccaggacaaaccagc

SEQ ID NO: 3587719 - RNA, 17 nt, Pseudomonas putida KT2440
auccaggcgggcgaaga

SEQ ID NO: 3587720 - RNA, 19 nt, Pseudomonas putida KT2440
auccaggcugcacuggcau

SEQ ID NO: 3587721 - RNA, 12 nt, Pseudomonas putida KT2440
auccagggcuuc

SEQ ID NO: 3587722 - RNA, 16 nt, Pseudomonas putida KT2440
auccagggcuuccugc

SEQ ID NO: 3587723 - RNA, 17 nt, Pseudomonas putida KT2440
auccaggucggugauau

SEQ ID NO: 3587724 - RNA, 21 nt, Pseudomonas putida KT2440
auccagguuaucuagcaggug

SEQ ID NO: 3587725 - RNA, 16 nt, Pseudomonas putida KT2440
auccagguucccccca

SEQ ID NO: 3587726 - RNA, 23 nt, Pseudomonas putida KT2440
auccaguaccagugcauaaucgu

SEQ ID NO: 3587727 - RNA, 16 nt, Pseudomonas putida KT2440
auccagucggcgcugg

SEQ ID NO: 3587728 - RNA, 12 nt, Pseudomonas putida KT2440
auccagugcagg

SEQ ID NO: 3587729 - RNA, 21 nt, Pseudomonas putida KT2440
auccaguucauugcgaaucug

SEQ ID NO: 3587730 - RNA, 23 nt, Pseudomonas putida KT2440
auccaucaccacaaaaccuucca

SEQ ID NO: 3587731 - RNA, 17 nt, Pseudomonas putida KT2440
auccaucuucaccuugc

SEQ ID NO: 3587732 - RNA, 20 nt, Pseudomonas putida KT2440
auccauuuguaggagcgggu

SEQ ID NO: 3587733 - RNA, 18 nt, Pseudomonas putida KT2440
aucccacgcccggccacg

SEQ ID NO: 3587734 - RNA, 21 nt, Pseudomonas putida KT2440
auccccaaccaugcuggccaa

SEQ ID NO: 3587735 - RNA, 18 nt, Pseudomonas putida KT2440
auccccccuccucaccgc

SEQ ID NO: 3587736 - RNA, 19 nt, Pseudomonas putida KT2440
aucccccgcucaugguucu

SEQ ID NO: 3587737 - RNA, 16 nt, Pseudomonas putida KT2440
aucccccggcccagcc

SEQ ID NO: 3587738 - RNA, 19 nt, Pseudomonas putida KT2440
auccccgccgccagcagcg

SEQ ID NO: 3587739 - RNA, 22 nt, Pseudomonas putida KT2440
auccccggccuccucgcgggca

SEQ ID NO: 3587740 - RNA, 20 nt, Pseudomonas putida KT2440
auccccuguaggagcgggcu

SEQ ID NO: 3587741 - RNA, 17 nt, Pseudomonas putida KT2440
aucccgaggucagcagu

SEQ ID NO: 3587742 - RNA, 19 nt, Pseudomonas putida KT2440
aucccgaggucagcagugg

SEQ ID NO: 3587743 - RNA, 13 nt, Pseudomonas putida KT2440
aucccgccagguc

SEQ ID NO: 3587744 - RNA, 20 nt, Pseudomonas putida KT2440
aucccgcucccauagccaau

SEQ ID NO: 3587745 - RNA, 18 nt, Pseudomonas putida KT2440
aucccgcugugcagcgcu

SEQ ID NO: 3587746 - RNA, 20 nt, Pseudomonas putida KT2440
aucccgcuucgccagcgcca

SEQ ID NO: 3587747 - RNA, 16 nt, Pseudomonas putida KT2440
aucccggacagcagca

SEQ ID NO: 3587748 - RNA, 17 nt, Pseudomonas putida KT2440
aucccggcgacguucuu

SEQ ID NO: 3587749 - RNA, 21 nt, Pseudomonas putida KT2440
aucccggcgacguucuugccg

SEQ ID NO: 3587750 - RNA, 15 nt, Pseudomonas putida KT2440
aucccggucaccugc

SEQ ID NO: 3587751 - RNA, 21 nt, Pseudomonas putida KT2440
aucccuggcacgcccggcacc

SEQ ID NO: 3587752 - RNA, 17 nt, Pseudomonas putida KT2440
aucccuguaggugcggc

SEQ ID NO: 3587753 - RNA, 18 nt, Pseudomonas putida KT2440
aucccugugggagcgggc

SEQ ID NO: 3587754 - RNA, 14 nt, Pseudomonas putida KT2440
auccgaccccagca

SEQ ID NO: 3587755 - RNA, 16 nt, Pseudomonas putida KT2440
auccgcaacaugaagc

SEQ ID NO: 3587756 - RNA, 19 nt, Pseudomonas putida KT2440
auccgcaacaugaagccau

SEQ ID NO: 3587757 - RNA, 17 nt, Pseudomonas putida KT2440
auccgcacgcaugucag

SEQ ID NO: 3587758 - RNA, 19 nt, Pseudomonas putida KT2440
auccgccccuacgcugguu

SEQ ID NO: 3587759 - RNA, 18 nt, Pseudomonas putida KT2440
auccgccucauccucgcc

SEQ ID NO: 3587760 - RNA, 23 nt, Pseudomonas putida KT2440
auccgccucauccucgcccacca

SEQ ID NO: 3587761 - RNA, 20 nt, Pseudomonas putida KT2440
auccgcgaguaaagccagca

SEQ ID NO: 3587762 - RNA, 19 nt, Pseudomonas putida KT2440
auccgcgccaucagcugcg

SEQ ID NO: 3587763 - RNA, 16 nt, Pseudomonas putida KT2440
auccgcgcccagucac

SEQ ID NO: 3587764 - RNA, 15 nt, Pseudomonas putida KT2440
auccgcgcuacggcg

SEQ ID NO: 3587765 - RNA, 17 nt, Pseudomonas putida KT2440
auccggcaacuggcaca

SEQ ID NO: 3587766 - RNA, 16 nt, Pseudomonas putida KT2440
auccggcgcaucgacg

SEQ ID NO: 3587767 - RNA, 22 nt, Pseudomonas putida KT2440
auccggcgcaucgacgggcaug

SEQ ID NO: 3587768 - RNA, 19 nt, Pseudomonas putida KT2440
auccggcgcggccugcucc

SEQ ID NO: 3587769 - RNA, 13 nt, Pseudomonas putida KT2440
auccggggccgca

SEQ ID NO: 3587770 - RNA, 13 nt, Pseudomonas putida KT2440
auccgguggccuu

SEQ ID NO: 3587771 - RNA, 16 nt, Pseudomonas putida KT2440
auccgucgacucauuu

SEQ ID NO: 3587772 - RNA, 14 nt, Pseudomonas putida KT2440
auccgugagccagg

SEQ ID NO: 3587773 - RNA, 15 nt, Pseudomonas putida KT2440
auccgugcaccgcuc

SEQ ID NO: 3587774 - RNA, 18 nt, Pseudomonas putida KT2440
auccguucggcgcgcugc

SEQ ID NO: 3587775 - RNA, 21 nt, Pseudomonas putida KT2440
auccguucggcgcgcugcugg

SEQ ID NO: 3587776 - RNA, 21 nt, Pseudomonas putida KT2440
auccuagguaguaaagccccc

SEQ ID NO: 3587777 - RNA, 21 nt, Pseudomonas putida KT2440
auccucaaaucgcugcggccg

SEQ ID NO: 3587778 - RNA, 17 nt, Pseudomonas putida KT2440
auccucaagcugcaccg

SEQ ID NO: 3587779 - RNA, 19 nt, Pseudomonas putida KT2440
auccucaagcugcaccgcc

SEQ ID NO: 3587780 - RNA, 14 nt, Pseudomonas putida KT2440
auccucggccaggc

SEQ ID NO: 3587781 - RNA, 22 nt, Pseudomonas putida KT2440
auccucggugcgcgguaccugg

SEQ ID NO: 3587782 - RNA, 15 nt, Pseudomonas putida KT2440
auccucguccagcuc

SEQ ID NO: 3587783 - RNA, 16 nt, Pseudomonas putida KT2440
auccucugcccgcagc

SEQ ID NO: 3587784 - RNA, 20 nt, Pseudomonas putida KT2440
auccucugugggagcggccu

SEQ ID NO: 3587785 - RNA, 11 nt, Pseudomonas putida KT2440
auccugcagca

SEQ ID NO: 3587786 - RNA, 14 nt, Pseudomonas putida KT2440
auccugcagcacca

SEQ ID NO: 3587787 - RNA, 21 nt, Pseudomonas putida KT2440
auccugccggcuucacuagcc

SEQ ID NO: 3587788 - RNA, 16 nt, Pseudomonas putida KT2440
auccugcgcggccacu

SEQ ID NO: 3587789 - RNA, 21 nt, Pseudomonas putida KT2440
auccugcgugcugugcacugc

SEQ ID NO: 3587790 - RNA, 15 nt, Pseudomonas putida KT2440
auccugcuggcccgc

SEQ ID NO: 3587791 - RNA, 23 nt, Pseudomonas putida KT2440
auccugguaaggcucgcccucgc

SEQ ID NO: 3587792 - RNA, 18 nt, Pseudomonas putida KT2440
auccuggugaucaacaaa

SEQ ID NO: 3587793 - RNA, 20 nt, Pseudomonas putida KT2440
auccuguggaagcgggcgug

SEQ ID NO: 3587794 - RNA, 15 nt, Pseudomonas putida KT2440
auccuguuguuggau

SEQ ID NO: 3587795 - RNA, 20 nt, Pseudomonas putida KT2440
auccuucaggcgcucacccc

SEQ ID NO: 3587796 - RNA, 22 nt, Pseudomonas putida KT2440
auccuugaagaacaccugcagc

SEQ ID NO: 3587797 - RNA, 20 nt, Pseudomonas putida KT2440
auccuugaucaacugacgca

SEQ ID NO: 3587798 - RNA, 21 nt, Pseudomonas putida KT2440
aucgggcagacgacccggaua

SEQ ID NO: 3587799 - RNA, 19 nt, Pseudomonas putida KT2440
aucggguccacccacccuc

SEQ ID NO: 3587800 - RNA, 19 nt, Pseudomonas putida KT2440
aucgggugaaaucaguuca

SEQ ID NO: 3587801 - RNA, 16 nt, Pseudomonas putida KT2440
aucggugaucgcaaaa

SEQ ID NO: 3587802 - RNA, 15 nt, Pseudomonas putida KT2440
aucgguuuuuccaug

SEQ ID NO: 3587803 - RNA, 18 nt, Pseudomonas putida KT2440
aucgguuuuuccaugcgc

SEQ ID NO: 3587804 - RNA, 21 nt, Pseudomonas putida KT2440
aucgucacauccugcucgucg

SEQ ID NO: 3587805 - RNA, 12 nt, Pseudomonas putida KT2440
aucguccaccca

SEQ ID NO: 3587806 - RNA, 13 nt, Pseudomonas putida KT2440
aucguccacccac

SEQ ID NO: 3587807 - RNA, 20 nt, Pseudomonas putida KT2440
aucguccgccgcgcugacca

SEQ ID NO: 3587808 - RNA, 19 nt, Pseudomonas putida KT2440
aucguccuugcagggcacc

SEQ ID NO: 3587809 - RNA, 20 nt, Pseudomonas putida KT2440
aucgucgacaacgcacccgc

SEQ ID NO: 3587810 - RNA, 18 nt, Pseudomonas putida KT2440
aucgucggugaugaucag

SEQ ID NO: 3587811 - RNA, 16 nt, Pseudomonas putida KT2440
aucgucguaggcgcgg

SEQ ID NO: 3587812 - RNA, 20 nt, Pseudomonas putida KT2440
aucgugacggucugccggca

SEQ ID NO: 3587813 - RNA, 19 nt, Pseudomonas putida KT2440
aucguuguaggagcgggcu

SEQ ID NO: 3587814 - RNA, 17 nt, Pseudomonas putida KT2440
aucguuugaugcgggcu

SEQ ID NO: 3587815 - RNA, 18 nt, Pseudomonas putida KT2440
aucuaaaaucaucggcaa

SEQ ID NO: 3587816 - RNA, 12 nt, Pseudomonas putida KT2440
aucuaccagcuu

SEQ ID NO: 3587817 - RNA, 15 nt, Pseudomonas putida KT2440
aucuaccugagccug

SEQ ID NO: 3587818 - RNA, 14 nt, Pseudomonas putida KT2440
aucuagcaggugcu

SEQ ID NO: 3587819 - RNA, 16 nt, Pseudomonas putida KT2440
aucuaugcccggcuca

SEQ ID NO: 3587820 - RNA, 20 nt, Pseudomonas putida KT2440
aucuaugcccggcucaccgc

SEQ ID NO: 3587821 - RNA, 14 nt, Pseudomonas putida KT2440
aucucaaccaccuc

SEQ ID NO: 3587822 - RNA, 13 nt, Pseudomonas putida KT2440
aucucaagcuuca

SEQ ID NO: 3587823 - RNA, 20 nt, Pseudomonas putida KT2440
aucucaaggcuuuccaccug

SEQ ID NO: 3587824 - RNA, 18 nt, Pseudomonas putida KT2440
aucucacgcgccacauag

SEQ ID NO: 3587825 - RNA, 13 nt, Pseudomonas putida KT2440
aucucacggccau

SEQ ID NO: 3587826 - RNA, 14 nt, Pseudomonas putida KT2440
aucucacggccauc

SEQ ID NO: 3587827 - RNA, 17 nt, Pseudomonas putida KT2440
aucucacggccauccug

SEQ ID NO: 3587828 - RNA, 18 nt, Pseudomonas putida KT2440
aucucacuuucugcgcug

SEQ ID NO: 3587829 - RNA, 18 nt, Pseudomonas putida KT2440
aucucaggcccaccaguc

SEQ ID NO: 3587830 - RNA, 15 nt, Pseudomonas putida KT2440
aucuccaaaaggugc

SEQ ID NO: 3587831 - RNA, 13 nt, Pseudomonas putida KT2440
aucuccagcccga

SEQ ID NO: 3587832 - RNA, 19 nt, Pseudomonas putida KT2440
aucuccauagguuauccac

SEQ ID NO: 3587833 - RNA, 19 nt, Pseudomonas putida KT2440
aucuccaugaaggccggca

SEQ ID NO: 3587834 - RNA, 15 nt, Pseudomonas putida KT2440
aucuccaugcugcug

SEQ ID NO: 3587835 - RNA, 13 nt, Pseudomonas putida KT2440
aucuccucggcca

SEQ ID NO: 3587836 - RNA, 21 nt, Pseudomonas putida KT2440
aucucgaucaugucgccguau

SEQ ID NO: 3587837 - RNA, 21 nt, Pseudomonas putida KT2440
aucucgauguacucaggggca

SEQ ID NO: 3587838 - RNA, 14 nt, Pseudomonas putida KT2440
aucucgccagccug

SEQ ID NO: 3587839 - RNA, 15 nt, Pseudomonas putida KT2440
aucucgccagccugc

SEQ ID NO: 3587840 - RNA, 13 nt, Pseudomonas putida KT2440
aucucgcccauga

SEQ ID NO: 3587841 - RNA, 22 nt, Pseudomonas putida KT2440
aucucgcccaugauguggcugg

SEQ ID NO: 3587842 - RNA, 18 nt, Pseudomonas putida KT2440
aucucgcgcuggcgcugg

SEQ ID NO: 3587843 - RNA, 17 nt, Pseudomonas putida KT2440
aucucgcuucauggccc

SEQ ID NO: 3587844 - RNA, 20 nt, Pseudomonas putida KT2440
aucucgguauggcucagugu

SEQ ID NO: 3587845 - RNA, 20 nt, Pseudomonas putida KT2440
aucucggucgacaggggcac

SEQ ID NO: 3587846 - RNA, 15 nt, Pseudomonas putida KT2440
aucucguucaugccc

SEQ ID NO: 3587847 - RNA, 17 nt, Pseudomonas putida KT2440
aucucugccgagaggau

SEQ ID NO: 3587848 - RNA, 17 nt, Pseudomonas putida KT2440
aucucugguacaacaac

SEQ ID NO: 3587849 - RNA, 20 nt, Pseudomonas putida KT2440
aucucugguacaacaacaaa

SEQ ID NO: 3587850 - RNA, 15 nt, Pseudomonas putida KT2440
aucucuucagccacc

SEQ ID NO: 3587851 - RNA, 15 nt, Pseudomonas putida KT2440
aucucuuccagcguc

SEQ ID NO: 3587852 - RNA, 20 nt, Pseudomonas putida KT2440
aucugaaaccguuggucagc

SEQ ID NO: 3587853 - RNA, 19 nt, Pseudomonas putida KT2440
aucugaaaguucagcgccu

SEQ ID NO: 3587854 - RNA, 22 nt, Pseudomonas putida KT2440
aucugaucuguaauagccucaa

SEQ ID NO: 3587855 - RNA, 18 nt, Pseudomonas putida KT2440
aucugcacacugcgcuug

SEQ ID NO: 3587856 - RNA, 14 nt, Pseudomonas putida KT2440
aucugcaccgccuu

SEQ ID NO: 3587857 - RNA, 16 nt, Pseudomonas putida KT2440
aucugcagggguggga

SEQ ID NO: 3587858 - RNA, 13 nt, Pseudomonas putida KT2440
aucugcauggcau

SEQ ID NO: 3587859 - RNA, 13 nt, Pseudomonas putida KT2440
aucugccgaugcg

SEQ ID NO: 3587860 - RNA, 15 nt, Pseudomonas putida KT2440
aucugccggcagggc

SEQ ID NO: 3587861 - RNA, 17 nt, Pseudomonas putida KT2440
aucugccggcgccucca

SEQ ID NO: 3587862 - RNA, 20 nt, Pseudomonas putida KT2440
aucugccgggucggccugcu

SEQ ID NO: 3587863 - RNA, 22 nt, Pseudomonas putida KT2440
aucugccgggucggccugcucg

SEQ ID NO: 3587864 - RNA, 13 nt, Pseudomonas putida KT2440
aucugccugccuc

SEQ ID NO: 3587865 - RNA, 16 nt, Pseudomonas putida KT2440
aucugcgacugcaggu

SEQ ID NO: 3587866 - RNA, 22 nt, Pseudomonas putida KT2440
aucugcgcacggaaggcaucga

SEQ ID NO: 3587867 - RNA, 20 nt, Pseudomonas putida KT2440
aucugcgccccgcucgccug

SEQ ID NO: 3587868 - RNA, 15 nt, Pseudomonas putida KT2440
aucugcgcgcucacu

SEQ ID NO: 3587869 - RNA, 13 nt, Pseudomonas putida KT2440
aucugcuccccca

SEQ ID NO: 3587870 - RNA, 16 nt, Pseudomonas putida KT2440
aucugcucccccaggc

SEQ ID NO: 3587871 - RNA, 21 nt, Pseudomonas putida KT2440
aucugcucgacgaaggucuug

SEQ ID NO: 3587872 - RNA, 16 nt, Pseudomonas putida KT2440
aucugcugcagcaugg

SEQ ID NO: 3587873 - RNA, 16 nt, Pseudomonas putida KT2440
aucugcugcggcaggc

SEQ ID NO: 3587874 - RNA, 17 nt, Pseudomonas putida KT2440
aucugcugcggcaggcu

SEQ ID NO: 3587875 - RNA, 19 nt, Pseudomonas putida KT2440
aucugcuggauacccagcg

SEQ ID NO: 3587876 - RNA, 12 nt, Pseudomonas putida KT2440
aucugcuugccu

SEQ ID NO: 3587877 - RNA, 13 nt, Pseudomonas putida KT2440
aucuggaucacug

SEQ ID NO: 3587878 - RNA, 19 nt, Pseudomonas putida KT2440
aucuggaugaagucggcaa

SEQ ID NO: 3587879 - RNA, 16 nt, Pseudomonas putida KT2440
aucuggcucugcagcg

SEQ ID NO: 3587880 - RNA, 17 nt, Pseudomonas putida KT2440
aucuggcucugcagcgu

SEQ ID NO: 3587881 - RNA, 23 nt, Pseudomonas putida KT2440
aucuggggccgcgucgcggcccc

SEQ ID NO: 3587882 - RNA, 21 nt, Pseudomonas putida KT2440
aucuggggcgcuuugcuuuug

SEQ ID NO: 3587883 - RNA, 14 nt, Pseudomonas putida KT2440
aucugggguggggu

SEQ ID NO: 3587884 - RNA, 23 nt, Pseudomonas putida KT2440
aucuggggugggguacagucucc

SEQ ID NO: 3587885 - RNA, 20 nt, Pseudomonas putida KT2440
aucuggucacccugacgcug

SEQ ID NO: 3587886 - RNA, 23 nt, Pseudomonas putida KT2440
aucuggucagucgagucgacagu

SEQ ID NO: 3587887 - RNA, 20 nt, Pseudomonas putida KT2440
aucuggucgaagcucaggua

SEQ ID NO: 3587888 - RNA, 21 nt, Pseudomonas putida KT2440
aucuggucgaagcucagguag

SEQ ID NO: 3587889 - RNA, 13 nt, Pseudomonas putida KT2440
aucuggugcaggu

SEQ ID NO: 3587890 - RNA, 18 nt, Pseudomonas putida KT2440
aucuguaccuugcuaugg

SEQ ID NO: 3587891 - RNA, 21 nt, Pseudomonas putida KT2440
aucugucagguguggcucagc

SEQ ID NO: 3587892 - RNA, 16 nt, Pseudomonas putida KT2440
aucuguccuccugccg

SEQ ID NO: 3587893 - RNA, 16 nt, Pseudomonas putida KT2440
aucuguugcugcaggu

SEQ ID NO: 3587894 - RNA, 17 nt, Pseudomonas putida KT2440
aucuguugcugcagguu

SEQ ID NO: 3587895 - RNA, 16 nt, Pseudomonas putida KT2440
aucuucaccuugccua

SEQ ID NO: 3587896 - RNA, 16 nt, Pseudomonas putida KT2440
aucuucaggcaucacg

SEQ ID NO: 3587897 - RNA, 19 nt, Pseudomonas putida KT2440
aucuucaugccauuggugc

SEQ ID NO: 3587898 - RNA, 13 nt, Pseudomonas putida KT2440
aucuuccagccug

SEQ ID NO: 3587899 - RNA, 19 nt, Pseudomonas putida KT2440
aucuuccagccugcagcac

SEQ ID NO: 3587900 - RNA, 19 nt, Pseudomonas putida KT2440
aucuuccugccacucgucc

SEQ ID NO: 3587901 - RNA, 16 nt, Pseudomonas putida KT2440
aucuucggugcccacu

SEQ ID NO: 3587902 - RNA, 18 nt, Pseudomonas putida KT2440
aucuucggugcccacugc

SEQ ID NO: 3587903 - RNA, 19 nt, Pseudomonas putida KT2440
aucuucggugcccacugca

SEQ ID NO: 3587904 - RNA, 16 nt, Pseudomonas putida KT2440
augccaacuuccaucg

SEQ ID NO: 3587905 - RNA, 18 nt, Pseudomonas putida KT2440
augccaacuuccaucgaa

SEQ ID NO: 3587906 - RNA, 14 nt, Pseudomonas putida KT2440
augccaagcaccga

SEQ ID NO: 3587907 - RNA, 14 nt, Pseudomonas putida KT2440
augccaagcccaca

SEQ ID NO: 3587908 - RNA, 16 nt, Pseudomonas putida KT2440
augccaccgccacuga

SEQ ID NO: 3587909 - RNA, 17 nt, Pseudomonas putida KT2440
augccacgcugaacacg

SEQ ID NO: 3587910 - RNA, 15 nt, Pseudomonas putida KT2440
augccacgggcaaac

SEQ ID NO: 3587911 - RNA, 17 nt, Pseudomonas putida KT2440
augccagcagcuggcuu

SEQ ID NO: 3587912 - RNA, 19 nt, Pseudomonas putida KT2440
augccauccucggccaggc

SEQ ID NO: 3587913 - RNA, 22 nt, Pseudomonas putida KT2440
augccauccucggccaggccca

SEQ ID NO: 3587914 - RNA, 20 nt, Pseudomonas putida KT2440
augccaucgaguaucgccuc

SEQ ID NO: 3587915 - RNA, 19 nt, Pseudomonas putida KT2440
augccauugaucaccucca

SEQ ID NO: 3587916 - RNA, 12 nt, Pseudomonas putida KT2440
augcccaaacgc

SEQ ID NO: 3587917 - RNA, 19 nt, Pseudomonas putida KT2440
augcccaguucgcgugcca

SEQ ID NO: 3587918 - RNA, 21 nt, Pseudomonas putida KT2440
augcccauggccagcguggcc

SEQ ID NO: 3587919 - RNA, 16 nt, Pseudomonas putida KT2440
augcccauggccaggc

SEQ ID NO: 3587920 - RNA, 20 nt, Pseudomonas putida KT2440
augccccgaccaccgccucg

SEQ ID NO: 3587921 - RNA, 15 nt, Pseudomonas putida KT2440
augccccgggugcag

SEQ ID NO: 3587922 - RNA, 16 nt, Pseudomonas putida KT2440
augccccgggugcagc

SEQ ID NO: 3587923 - RNA, 14 nt, Pseudomonas putida KT2440
augccccuaccgcc

SEQ ID NO: 3587924 - RNA, 15 nt, Pseudomonas putida KT2440
augccccuaccgcca

SEQ ID NO: 3587925 - RNA, 23 nt, Pseudomonas putida KT2440
augcccgaucggguacuccacca

SEQ ID NO: 3587926 - RNA, 20 nt, Pseudomonas putida KT2440
augcccgccaaaaggcccga

SEQ ID NO: 3587927 - RNA, 17 nt, Pseudomonas putida KT2440
augcccgccccugccag

SEQ ID NO: 3587928 - RNA, 20 nt, Pseudomonas putida KT2440
augcccgcgcaaaucgccgc

SEQ ID NO: 3587929 - RNA, 20 nt, Pseudomonas putida KT2440
augcccgcucccacagggac

SEQ ID NO: 3587930 - RNA, 12 nt, Pseudomonas putida KT2440
augcccgcucgc

SEQ ID NO: 3587931 - RNA, 23 nt, Pseudomonas putida KT2440
augcccgcuguugagcagcagcc

SEQ ID NO: 3587932 - RNA, 17 nt, Pseudomonas putida KT2440
augcccggcucaccgca

SEQ ID NO: 3587933 - RNA, 16 nt, Pseudomonas putida KT2440
augcccgggcgcaggc

SEQ ID NO: 3587934 - RNA, 14 nt, Pseudomonas putida KT2440
augcccgucggcgu

SEQ ID NO: 3587935 - RNA, 12 nt, Pseudomonas putida KT2440
augccgaaggcc

SEQ ID NO: 3587936 - RNA, 17 nt, Pseudomonas putida KT2440
augccgacggugccggu

SEQ ID NO: 3587937 - RNA, 17 nt, Pseudomonas putida KT2440
augccgaggacauacca

SEQ ID NO: 3587938 - RNA, 19 nt, Pseudomonas putida KT2440
augccgagggugaggugcu

SEQ ID NO: 3587939 - RNA, 23 nt, Pseudomonas putida KT2440
augccgagggugaggugcugcag

SEQ ID NO: 3587940 - RNA, 16 nt, Pseudomonas putida KT2440
augccgccauccucgg

SEQ ID NO: 3587941 - RNA, 18 nt, Pseudomonas putida KT2440
augccgccauccucggcc

SEQ ID NO: 3587942 - RNA, 19 nt, Pseudomonas putida KT2440
augccgcccaucaccggca

SEQ ID NO: 3587943 - RNA, 23 nt, Pseudomonas putida KT2440
augccgcccaucaccggcaccgg

SEQ ID NO: 3587944 - RNA, 16 nt, Pseudomonas putida KT2440
augccgccgcugccag

SEQ ID NO: 3587945 - RNA, 17 nt, Pseudomonas putida KT2440
augccgccgcugccagc

SEQ ID NO: 3587946 - RNA, 18 nt, Pseudomonas putida KT2440
augccgccgcugccagca

SEQ ID NO: 3587947 - RNA, 16 nt, Pseudomonas putida KT2440
augccgcguuccuuuc

SEQ ID NO: 3587948 - RNA, 17 nt, Pseudomonas putida KT2440
augccggcacagcccag

SEQ ID NO: 3587949 - RNA, 17 nt, Pseudomonas putida KT2440
augccggucagcagcau

SEQ ID NO: 3587950 - RNA, 18 nt, Pseudomonas putida KT2440
augccgguuugcggccuu

SEQ ID NO: 3587951 - RNA, 20 nt, Pseudomonas putida KT2440
augccguaagccgcaggcca

SEQ ID NO: 3587952 - RNA, 23 nt, Pseudomonas putida KT2440
augccguacaccaugcucaggaa

SEQ ID NO: 3587953 - RNA, 15 nt, Pseudomonas putida KT2440
augccgugaugguau

SEQ ID NO: 3587954 - RNA, 20 nt, Pseudomonas putida KT2440
augccgugcgcggcaucagc

SEQ ID NO: 3587955 - RNA, 15 nt, Pseudomonas putida KT2440
augccguucuacccu

SEQ ID NO: 3587956 - RNA, 15 nt, Pseudomonas putida KT2440
augccuacugcuggc

SEQ ID NO: 3587957 - RNA, 17 nt, Pseudomonas putida KT2440
augccuagauaagcgac

SEQ ID NO: 3587958 - RNA, 19 nt, Pseudomonas putida KT2440
augccuaucucuuccagcg

SEQ ID NO: 3587959 - RNA, 14 nt, Pseudomonas putida KT2440
augccucaucaggc

SEQ ID NO: 3587960 - RNA, 22 nt, Pseudomonas putida KT2440
augccugcacugggcgaaggug

SEQ ID NO: 3587961 - RNA, 16 nt, Pseudomonas putida KT2440
augccuucgguggcaa

SEQ ID NO: 3587962 - RNA, 22 nt, Pseudomonas putida KT2440
augccuucugugauuuccagcg

SEQ ID NO: 3587963 - RNA, 23 nt, Pseudomonas putida KT2440
augccuuugcaaagcgcaccgcg

SEQ ID NO: 3587964 - RNA, 16 nt, Pseudomonas putida KT2440
augcgacugagcaacg

SEQ ID NO: 3587965 - RNA, 14 nt, Pseudomonas putida KT2440
augcgacugaggca

SEQ ID NO: 3587966 - RNA, 16 nt, Pseudomonas putida KT2440
augcgagcuaccugac

SEQ ID NO: 3587967 - RNA, 17 nt, Pseudomonas putida KT2440
augcgauugaucugcug

SEQ ID NO: 3587968 - RNA, 13 nt, Pseudomonas putida KT2440
augcgcacaccgc

SEQ ID NO: 3587969 - RNA, 22 nt, Pseudomonas putida KT2440
augcgcaccggaguccccaccg

SEQ ID NO: 3587970 - RNA, 14 nt, Pseudomonas putida KT2440
augcgcaggcagcg

SEQ ID NO: 3587971 - RNA, 19 nt, Pseudomonas putida KT2440
augcgccaguacgccagca

SEQ ID NO: 3587972 - RNA, 23 nt, Pseudomonas putida KT2440
augcgccaguacgccagcagcgc

SEQ ID NO: 3587973 - RNA, 16 nt, Pseudomonas putida KT2440
augcgccccccaggcg

SEQ ID NO: 3587974 - RNA, 16 nt, Pseudomonas putida KT2440
augcgccccggcgauc

SEQ ID NO: 3587975 - RNA, 19 nt, Pseudomonas putida KT2440
augcgcccgccgcccgcgg

SEQ ID NO: 3587976 - RNA, 18 nt, Pseudomonas putida KT2440
augcgcccugcugccgca

SEQ ID NO: 3587977 - RNA, 16 nt, Pseudomonas putida KT2440
augcgcccuggcggcc

SEQ ID NO: 3587978 - RNA, 22 nt, Pseudomonas putida KT2440
augcgcccuggcggccacggca

SEQ ID NO: 3587979 - RNA, 22 nt, Pseudomonas putida KT2440
augcgccgggacagcaccaugc

SEQ ID NO: 3587980 - RNA, 20 nt, Pseudomonas putida KT2440
augcgcgacagcaucaucag

SEQ ID NO: 3587981 - RNA, 21 nt, Pseudomonas putida KT2440
augcgcgauucguagcgguug

SEQ ID NO: 3587982 - RNA, 18 nt, Pseudomonas putida KT2440
augcgcgcugcaaucacc

SEQ ID NO: 3587983 - RNA, 22 nt, Pseudomonas putida KT2440
augcgcguauccuugcccacca

SEQ ID NO: 3587984 - RNA, 23 nt, Pseudomonas putida KT2440
augcgcguauccuugcccaccag

SEQ ID NO: 3587985 - RNA, 14 nt, Pseudomonas putida KT2440
augcgcgugcauuu

SEQ ID NO: 3587986 - RNA, 16 nt, Pseudomonas putida KT2440
augcgcuucauccagc

SEQ ID NO: 3587987 - RNA, 15 nt, Pseudomonas putida KT2440
augcgcuugaggcuu

SEQ ID NO: 3587988 - RNA, 17 nt, Pseudomonas putida KT2440
augcggauguaguucuu

SEQ ID NO: 3587989 - RNA, 20 nt, Pseudomonas putida KT2440
augcggcucuguuucugccc

SEQ ID NO: 3587990 - RNA, 16 nt, Pseudomonas putida KT2440
augcggcugaccccac

SEQ ID NO: 3587991 - RNA, 15 nt, Pseudomonas putida KT2440
augcgggacucgauc

SEQ ID NO: 3587992 - RNA, 14 nt, Pseudomonas putida KT2440
augcgggcccuggu

SEQ ID NO: 3587993 - RNA, 16 nt, Pseudomonas putida KT2440
augcgggcuuuccacg

SEQ ID NO: 3587994 - RNA, 22 nt, Pseudomonas putida KT2440
augcgggcuuuuuuuguuggcc

SEQ ID NO: 3587995 - RNA, 20 nt, Pseudomonas putida KT2440
augcgggggccccaccaggc

SEQ ID NO: 3587996 - RNA, 15 nt, Pseudomonas putida KT2440
augcgguagcggcug

SEQ ID NO: 3587997 - RNA, 22 nt, Pseudomonas putida KT2440
augcggugguugucgcacccac

SEQ ID NO: 3587998 - RNA, 20 nt, Pseudomonas putida KT2440
augcguagguuauuggccag

SEQ ID NO: 3587999 - RNA, 23 nt, Pseudomonas putida KT2440
augcguagguuauuggccagguc

SEQ ID NO: 3588000 - RNA, 15 nt, Pseudomonas putida KT2440
augcgucggcgugga

SEQ ID NO: 3588001 - RNA, 15 nt, Pseudomonas putida KT2440
augcgugaugguggu

SEQ ID NO: 3588002 - RNA, 12 nt, Pseudomonas putida KT2440
augcguucggca

SEQ ID NO: 3588003 - RNA, 15 nt, Pseudomonas putida KT2440
augcguucggcaucu

SEQ ID NO: 3588004 - RNA, 21 nt, Pseudomonas putida KT2440
augcguuguucgaucagccgu

SEQ ID NO: 3588005 - RNA, 22 nt, Pseudomonas putida KT2440
augcuacagaagccucaccgcc

SEQ ID NO: 3588006 - RNA, 20 nt, Pseudomonas putida KT2440
augcucaccagcuucugggc

SEQ ID NO: 3588007 - RNA, 21 nt, Pseudomonas putida KT2440
augcucaccagcuucugggca

SEQ ID NO: 3588008 - RNA, 17 nt, Pseudomonas putida KT2440
augcuccaaccccagcg

SEQ ID NO: 3588009 - RNA, 16 nt, Pseudomonas putida KT2440
auggugucuuccaggu

SEQ ID NO: 3588010 - RNA, 13 nt, Pseudomonas putida KT2440
augguugaagauc

SEQ ID NO: 3588011 - RNA, 19 nt, Pseudomonas putida KT2440
auguacgucaaguaggcac

SEQ ID NO: 3588012 - RNA, 15 nt, Pseudomonas putida KT2440
auguacucaggggca

SEQ ID NO: 3588013 - RNA, 19 nt, Pseudomonas putida KT2440
auguacucaggggcauugc

SEQ ID NO: 3588014 - RNA, 13 nt, Pseudomonas putida KT2440
auguacuucggau

SEQ ID NO: 3588015 - RNA, 23 nt, Pseudomonas putida KT2440
auguagaauagccggccucagca

SEQ ID NO: 3588016 - RNA, 15 nt, Pseudomonas putida KT2440
auguagccacgcugc

SEQ ID NO: 3588017 - RNA, 19 nt, Pseudomonas putida KT2440
auguagcgggucacugcgc

SEQ ID NO: 3588018 - RNA, 15 nt, Pseudomonas putida KT2440
auguaggcagcugcc

SEQ ID NO: 3588019 - RNA, 16 nt, Pseudomonas putida KT2440
auguaguucuugcgca

SEQ ID NO: 3588020 - RNA, 18 nt, Pseudomonas putida KT2440
augucaggggugccuucg

SEQ ID NO: 3588021 - RNA, 21 nt, Pseudomonas putida KT2440
augucaucaauauccagccuu

SEQ ID NO: 3588022 - RNA, 14 nt, Pseudomonas putida KT2440
auguccauccaugc

SEQ ID NO: 3588023 - RNA, 14 nt, Pseudomonas putida KT2440
augucccaguucau

SEQ ID NO: 3588024 - RNA, 14 nt, Pseudomonas putida KT2440
auguccugcugcag

SEQ ID NO: 3588025 - RNA, 23 nt, Pseudomonas putida KT2440
augucgacguacagcagcucacu

SEQ ID NO: 3588026 - RNA, 21 nt, Pseudomonas putida KT2440
augucgagcaugaucaccgcc

SEQ ID NO: 3588027 - RNA, 13 nt, Pseudomonas putida KT2440
augucgaucagcg

SEQ ID NO: 3588028 - RNA, 18 nt, Pseudomonas putida KT2440
augucgauccacucgucg

SEQ ID NO: 3588029 - RNA, 20 nt, Pseudomonas putida KT2440
augucgcggcuacgcucguc

SEQ ID NO: 3588030 - RNA, 23 nt, Pseudomonas putida KT2440
augucgcugccgccaaccagcuc

SEQ ID NO: 3588031 - RNA, 18 nt, Pseudomonas putida KT2440
augucggagcgggcuugc

SEQ ID NO: 3588032 - RNA, 17 nt, Pseudomonas putida KT2440
augucggcagucuugcu

SEQ ID NO: 3588033 - RNA, 20 nt, Pseudomonas putida KT2440
augucguccaguuggcggcg

SEQ ID NO: 3588034 - RNA, 21 nt, Pseudomonas putida KT2440
augucguugaugaucugcucc

SEQ ID NO: 3588035 - RNA, 15 nt, Pseudomonas putida KT2440
augucuggcaucaau

SEQ ID NO: 3588036 - RNA, 19 nt, Pseudomonas putida KT2440
augucuggcaucaaugcaa

SEQ ID NO: 3588037 - RNA, 15 nt, Pseudomonas putida KT2440
augucuuccagacca

SEQ ID NO: 3588038 - RNA, 20 nt, Pseudomonas putida KT2440
augucuuucgcguacugcau

SEQ ID NO: 3588039 - RNA, 24 nt, Pseudomonas putida KT2440
augugccgcucguacuggucgagg

SEQ ID NO: 3588040 - RNA, 16 nt, Pseudomonas putida KT2440
augugccuggcccggc

SEQ ID NO: 3588041 - RNA, 22 nt, Pseudomonas putida KT2440
augugcgcccgaacaacagguc

SEQ ID NO: 3588042 - RNA, 19 nt, Pseudomonas putida KT2440
augugcgccggcuugccuu

SEQ ID NO: 3588043 - RNA, 13 nt, Pseudomonas putida KT2440
augugcucggccu

SEQ ID NO: 3588044 - RNA, 14 nt, Pseudomonas putida KT2440
augugcucggccug

SEQ ID NO: 3588045 - RNA, 16 nt, Pseudomonas putida KT2440
augugcucggccuggg

SEQ ID NO: 3588046 - RNA, 19 nt, Pseudomonas putida KT2440
auguggcgcagcaccgugg

SEQ ID NO: 3588047 - RNA, 21 nt, Pseudomonas putida KT2440
auguggcugguggcaaugcca

SEQ ID NO: 3588048 - RNA, 21 nt, Pseudomonas putida KT2440
auguucagcaccuucuugccc

SEQ ID NO: 3588049 - RNA, 15 nt, Pseudomonas putida KT2440
auguucgcugccagc

SEQ ID NO: 3588050 - RNA, 16 nt, Pseudomonas putida KT2440
auguucggugcucagg

SEQ ID NO: 3588051 - RNA, 22 nt, Pseudomonas putida KT2440
auguugaagaagaucaggucgc

SEQ ID NO: 3588052 - RNA, 13 nt, Pseudomonas putida KT2440
auguugcaaggau

SEQ ID NO: 3588053 - RNA, 13 nt, Pseudomonas putida KT2440
auguugcgcagca

SEQ ID NO: 3588054 - RNA, 14 nt, Pseudomonas putida KT2440
auguugucacccag

SEQ ID NO: 3588055 - RNA, 20 nt, Pseudomonas putida KT2440
auguugugggcaaugauggc

SEQ ID NO: 3588056 - RNA, 22 nt, Pseudomonas putida KT2440
auuaaagguugacacccucuug

SEQ ID NO: 3588057 - RNA, 17 nt, Pseudomonas putida KT2440
auuaaugcacgccugga

SEQ ID NO: 3588058 - RNA, 15 nt, Pseudomonas putida KT2440
auuaauuugaacaau

SEQ ID NO: 3588059 - RNA, 13 nt, Pseudomonas putida KT2440
auuacaaaagcgc

SEQ ID NO: 3588060 - RNA, 13 nt, Pseudomonas putida KT2440
auuacaagggccu

SEQ ID NO: 3588061 - RNA, 14 nt, Pseudomonas putida KT2440
auuacaagggccug

SEQ ID NO: 3588062 - RNA, 16 nt, Pseudomonas putida KT2440
auuacaugaugaagua

SEQ ID NO: 3588063 - RNA, 15 nt, Pseudomonas putida KT2440
auuaccagaauagca

SEQ ID NO: 3588064 - RNA, 12 nt, Pseudomonas putida KT2440
auuaccugcagg

SEQ ID NO: 3588065 - RNA, 17 nt, Pseudomonas putida KT2440
auuacgcgaaaaagccc

SEQ ID NO: 3588066 - RNA, 20 nt, Pseudomonas putida KT2440
auuacgcgucaucugcgcac

SEQ ID NO: 3588067 - RNA, 19 nt, Pseudomonas putida KT2440
auuacuccgauuguggccg

SEQ ID NO: 3588068 - RNA, 20 nt, Pseudomonas putida KT2440
auuacuucuuggagcggccu

SEQ ID NO: 3588069 - RNA, 15 nt, Pseudomonas putida KT2440
auuagaaaauggcuu

SEQ ID NO: 3588070 - RNA, 18 nt, Pseudomonas putida KT2440
auuaucgagcuacagccc

SEQ ID NO: 3588071 - RNA, 13 nt, Pseudomonas putida KT2440
auuauuggccagc

SEQ ID NO: 3588072 - RNA, 14 nt, Pseudomonas putida KT2440
auucaaagccugcu

SEQ ID NO: 3588073 - RNA, 16 nt, Pseudomonas putida KT2440
auucaccagccaggca

SEQ ID NO: 3588074 - RNA, 18 nt, Pseudomonas putida KT2440
auucaccagccaggcaca

SEQ ID NO: 3588075 - RNA, 14 nt, Pseudomonas putida KT2440
auucaccagcuuca

SEQ ID NO: 3588076 - RNA, 15 nt, Pseudomonas putida KT2440
auucagcucggccac

SEQ ID NO: 3588077 - RNA, 17 nt, Pseudomonas putida KT2440
auucagcucggccaccc

SEQ ID NO: 3588078 - RNA, 21 nt, Pseudomonas putida KT2440
auucagcucggccacccgcgu

SEQ ID NO: 3588079 - RNA, 23 nt, Pseudomonas putida KT2440
auucaggaugcuucggcugaucu

SEQ ID NO: 3588080 - RNA, 20 nt, Pseudomonas putida KT2440
auucaggcacggcaccagca

SEQ ID NO: 3588081 - RNA, 21 nt, Pseudomonas putida KT2440
auucaggcacggcaccagcac

SEQ ID NO: 3588082 - RNA, 17 nt, Pseudomonas putida KT2440
auucaggccuuuucaca

SEQ ID NO: 3588083 - RNA, 13 nt, Pseudomonas putida KT2440
auuccaagugccu

SEQ ID NO: 3588084 - RNA, 21 nt, Pseudomonas putida KT2440
auuccaaugagaauaauucuu

SEQ ID NO: 3588085 - RNA, 16 nt, Pseudomonas putida KT2440
auuccagcaggggacg

SEQ ID NO: 3588086 - RNA, 22 nt, Pseudomonas putida KT2440
auucccggccacugguaguuca

SEQ ID NO: 3588087 - RNA, 19 nt, Pseudomonas putida KT2440
auuccgccgucaccgccgc

SEQ ID NO: 3588088 - RNA, 18 nt, Pseudomonas putida KT2440
auuccgggcugcugcgca

SEQ ID NO: 3588089 - RNA, 15 nt, Pseudomonas putida KT2440
auuccgucccaguua

SEQ ID NO: 3588090 - RNA, 19 nt, Pseudomonas putida KT2440
auuccugugggagcgggcg

SEQ ID NO: 3588091 - RNA, 17 nt, Pseudomonas putida KT2440
auuccuugcagcgccgc

SEQ ID NO: 3588092 - RNA, 20 nt, Pseudomonas putida KT2440
auuccuugcagcucuugucg

SEQ ID NO: 3588093 - RNA, 21 nt, Pseudomonas putida KT2440
auucgacccgcgucucgccgc

SEQ ID NO: 3588094 - RNA, 12 nt, Pseudomonas putida KT2440
auucgagcuuga

SEQ ID NO: 3588095 - RNA, 12 nt, Pseudomonas putida KT2440
auucgccucccg

SEQ ID NO: 3588096 - RNA, 20 nt, Pseudomonas putida KT2440
auucgcgggcaagcccgcuc

SEQ ID NO: 3588097 - RNA, 13 nt, Pseudomonas putida KT2440
auucgcgggcaug

SEQ ID NO: 3588098 - RNA, 20 nt, Pseudomonas putida KT2440
auucgcgggcaugcccgcuc

SEQ ID NO: 3588099 - RNA, 19 nt, Pseudomonas putida KT2440
auucgcggguaaacccgcg

SEQ ID NO: 3588100 - RNA, 19 nt, Pseudomonas putida KT2440
auucgcggguaaacccgcu

SEQ ID NO: 3588101 - RNA, 20 nt, Pseudomonas putida KT2440
auucgcggguaaacccgcuc

SEQ ID NO: 3588102 - RNA, 19 nt, Pseudomonas putida KT2440
auucgcgggugaacccgcu

SEQ ID NO: 3588103 - RNA, 22 nt, Pseudomonas putida KT2440
auucgcuguacagcacaccuuc

SEQ ID NO: 3588104 - RNA, 14 nt, Pseudomonas putida KT2440
auucguuuucggua

SEQ ID NO: 3588105 - RNA, 23 nt, Pseudomonas putida KT2440
auucugccaugauccgcauauca

SEQ ID NO: 3588106 - RNA, 16 nt, Pseudomonas putida KT2440
auucuuauuaccagaa

SEQ ID NO: 3588107 - RNA, 22 nt, Pseudomonas putida KT2440
auucuucgucaguccaucacca

SEQ ID NO: 3588108 - RNA, 19 nt, Pseudomonas putida KT2440
auucuucuggcuuucuggc

SEQ ID NO: 3588109 - RNA, 13 nt, Pseudomonas putida KT2440
auugaauguugau

SEQ ID NO: 3588110 - RNA, 14 nt, Pseudomonas putida KT2440
auugaauucuggcu

SEQ ID NO: 3588111 - RNA, 12 nt, Pseudomonas putida KT2440
auugacccgcuu

SEQ ID NO: 3588112 - RNA, 21 nt, Pseudomonas putida KT2440
auugacuaccagguagccguc

SEQ ID NO: 3588113 - RNA, 10 nt, Pseudomonas putida KT2440
auugagagga

SEQ ID NO: 3588114 - RNA, 14 nt, Pseudomonas putida KT2440
caaaccgccccacc

SEQ ID NO: 3588115 - RNA, 14 nt, Pseudomonas putida KT2440
caaaccguccaggu

SEQ ID NO: 3588116 - RNA, 21 nt, Pseudomonas putida KT2440
caaaccguccagguagcgcuc

SEQ ID NO: 3588117 - RNA, 21 nt, Pseudomonas putida KT2440
caaacgaugcgggcuuucuca

SEQ ID NO: 3588118 - RNA, 12 nt, Pseudomonas putida KT2440
caaacgccgcuc

SEQ ID NO: 3588119 - RNA, 22 nt, Pseudomonas putida KT2440
caaacgccgggcacaucaccag

SEQ ID NO: 3588120 - RNA, 18 nt, Pseudomonas putida KT2440
caaacguaccagccgcac

SEQ ID NO: 3588121 - RNA, 20 nt, Pseudomonas putida KT2440
caaacuccacugugcccgcc

SEQ ID NO: 3588122 - RNA, 21 nt, Pseudomonas putida KT2440
caaacucuugagcuggccguc

SEQ ID NO: 3588123 - RNA, 17 nt, Pseudomonas putida KT2440
caaacugauucacgccc

SEQ ID NO: 3588124 - RNA, 19 nt, Pseudomonas putida KT2440
caaacugauucacgcccuu

SEQ ID NO: 3588125 - RNA, 19 nt, Pseudomonas putida KT2440
caaacugcugagucagcuu

SEQ ID NO: 3588126 - RNA, 20 nt, Pseudomonas putida KT2440
caaacugcuggaaaaagaac

SEQ ID NO: 3588127 - RNA, 21 nt, Pseudomonas putida KT2440
caaacugcuggaaaaagaaca

SEQ ID NO: 3588128 - RNA, 22 nt, Pseudomonas putida KT2440
caaacugcuggaaaaagaacag

SEQ ID NO: 3588129 - RNA, 12 nt, Pseudomonas putida KT2440
caaacuggcgcc

SEQ ID NO: 3588130 - RNA, 20 nt, Pseudomonas putida KT2440
caaacuucgggcuguccuca

SEQ ID NO: 3588131 - RNA, 16 nt, Pseudomonas putida KT2440
caaagaaaagcccgca

SEQ ID NO: 3588132 - RNA, 20 nt, Pseudomonas putida KT2440
caaagaaacaccaggccuuc

SEQ ID NO: 3588133 - RNA, 21 nt, Pseudomonas putida KT2440
caaagaacacuuccgggcuga

SEQ ID NO: 3588134 - RNA, 14 nt, Pseudomonas putida KT2440
caaagaacagcgug

SEQ ID NO: 3588135 - RNA, 21 nt, Pseudomonas putida KT2440
caaagaacagcgugccaugca

SEQ ID NO: 3588136 - RNA, 11 nt, Pseudomonas putida KT2440
caaagcaccau

SEQ ID NO: 3588137 - RNA, 13 nt, Pseudomonas putida KT2440
caaagcaccauga

SEQ ID NO: 3588138 - RNA, 23 nt, Pseudomonas putida KT2440
caaagcagacagcugugcugcca

SEQ ID NO: 3588139 - RNA, 13 nt, Pseudomonas putida KT2440
caaagcagcccca

SEQ ID NO: 3588140 - RNA, 16 nt, Pseudomonas putida KT2440
caaagcagccccaggg

SEQ ID NO: 3588141 - RNA, 13 nt, Pseudomonas putida KT2440
caaagcagccccc

SEQ ID NO: 3588142 - RNA, 22 nt, Pseudomonas putida KT2440
caaagccccggcagcgaugccg

SEQ ID NO: 3588143 - RNA, 16 nt, Pseudomonas putida KT2440
caaagccccggcaucg

SEQ ID NO: 3588144 - RNA, 16 nt, Pseudomonas putida KT2440
caaagcccgccccaau

SEQ ID NO: 3588145 - RNA, 14 nt, Pseudomonas putida KT2440
caaagccgccaugu

SEQ ID NO: 3588146 - RNA, 14 nt, Pseudomonas putida KT2440
caaagccugcucca

SEQ ID NO: 3588147 - RNA, 17 nt, Pseudomonas putida KT2440
caaagccugcuccagca

SEQ ID NO: 3588148 - RNA, 20 nt, Pseudomonas putida KT2440
caaagccugcuccagcaccc

SEQ ID NO: 3588149 - RNA, 17 nt, Pseudomonas putida KT2440
caaagcgcaccgcgcac

SEQ ID NO: 3588150 - RNA, 22 nt, Pseudomonas putida KT2440
caaagcgcgucugauagccagg

SEQ ID NO: 3588151 - RNA, 23 nt, Pseudomonas putida KT2440
caaagcgcgucugauagccaggg

SEQ ID NO: 3588152 - RNA, 22 nt, Pseudomonas putida KT2440
caaagcggcccccacgccgacc

SEQ ID NO: 3588153 - RNA, 15 nt, Pseudomonas putida KT2440
caaagcggccccuuc

SEQ ID NO: 3588154 - RNA, 19 nt, Pseudomonas putida KT2440
caaagcguucgguguccuu

SEQ ID NO: 3588155 - RNA, 23 nt, Pseudomonas putida KT2440
caaagcugaaugaaaaagccccg

SEQ ID NO: 3588156 - RNA, 22 nt, Pseudomonas putida KT2440
caaagcugucgcuacgcgccau

SEQ ID NO: 3588157 - RNA, 14 nt, Pseudomonas putida KT2440
caaaggcagccucg

SEQ ID NO: 3588158 - RNA, 15 nt, Pseudomonas putida KT2440
caaaggcaugggcca

SEQ ID NO: 3588159 - RNA, 18 nt, Pseudomonas putida KT2440
caaaggcccuuuaggcac

SEQ ID NO: 3588160 - RNA, 15 nt, Pseudomonas putida KT2440
caaaggccggcaccg

SEQ ID NO: 3588161 - RNA, 18 nt, Pseudomonas putida KT2440
caaaggccggcaccgaca

SEQ ID NO: 3588162 - RNA, 17 nt, Pseudomonas putida KT2440
caaaggcuugcgcgauc

SEQ ID NO: 3588163 - RNA, 14 nt, Pseudomonas putida KT2440
caaaggucugcugc

SEQ ID NO: 3588164 - RNA, 15 nt, Pseudomonas putida KT2440
caaaggucugcugcg

SEQ ID NO: 3588165 - RNA, 19 nt, Pseudomonas putida KT2440
caaaggugaaagagguucu

SEQ ID NO: 3588166 - RNA, 13 nt, Pseudomonas putida KT2440
caaaguccaaggc

SEQ ID NO: 3588167 - RNA, 18 nt, Pseudomonas putida KT2440
caaaguccagcaucagca

SEQ ID NO: 3588168 - RNA, 22 nt, Pseudomonas putida KT2440
caaaguccagcaucagcacacc

SEQ ID NO: 3588169 - RNA, 14 nt, Pseudomonas putida KT2440
caaagucuucagcc

SEQ ID NO: 3588170 - RNA, 17 nt, Pseudomonas putida KT2440
caaaguggaaggcaucg

SEQ ID NO: 3588171 - RNA, 20 nt, Pseudomonas putida KT2440
caaauacggccaauaacucg

SEQ ID NO: 3588172 - RNA, 15 nt, Pseudomonas putida KT2440
caaauagaagaacag

SEQ ID NO: 3588173 - RNA, 21 nt, Pseudomonas putida KT2440
caaauagaugcaggugggauu

SEQ ID NO: 3588174 - RNA, 16 nt, Pseudomonas putida KT2440
caaauccuccugcgca

SEQ ID NO: 3588175 - RNA, 17 nt, Pseudomonas putida KT2440
caaaucgccaaucaggu

SEQ ID NO: 3588176 - RNA, 12 nt, Pseudomonas putida KT2440
caaaucggcaga

SEQ ID NO: 3588177 - RNA, 15 nt, Pseudomonas putida KT2440
caaaucggcagaauu

SEQ ID NO: 3588178 - RNA, 12 nt, Pseudomonas putida KT2440
caaaucuucccg

SEQ ID NO: 3588179 - RNA, 21 nt, Pseudomonas putida KT2440
caaaucuucccgcguccaggg

SEQ ID NO: 3588180 - RNA, 18 nt, Pseudomonas putida KT2440
caaaugcccacugcguuc

SEQ ID NO: 3588181 - RNA, 15 nt, Pseudomonas putida KT2440
caaaugcgcccugcu

SEQ ID NO: 3588182 - RNA, 17 nt, Pseudomonas putida KT2440
caaaugcgcccugcugc

SEQ ID NO: 3588183 - RNA, 18 nt, Pseudomonas putida KT2440
caaaugcgcccugcugcc

SEQ ID NO: 3588184 - RNA, 13 nt, Pseudomonas putida KT2440
caaaugcggcgcg

SEQ ID NO: 3588185 - RNA, 19 nt, Pseudomonas putida KT2440
caaaugcgguauaggccgc

SEQ ID NO: 3588186 - RNA, 14 nt, Pseudomonas putida KT2440
caaaugcugccaug

SEQ ID NO: 3588187 - RNA, 12 nt, Pseudomonas putida KT2440
caaaugcuggca

SEQ ID NO: 3588188 - RNA, 22 nt, Pseudomonas putida KT2440
caaaugcuggcaauccagcgug

SEQ ID NO: 3588189 - RNA, 18 nt, Pseudomonas putida KT2440
caaauucgaccagcagug

SEQ ID NO: 3588190 - RNA, 21 nt, Pseudomonas putida KT2440
caaauucgaccagcaguguca

SEQ ID NO: 3588191 - RNA, 21 nt, Pseudomonas putida KT2440
caacaaagccccggcaucgcu

SEQ ID NO: 3588192 - RNA, 14 nt, Pseudomonas putida KT2440
caacaacaaaaaaa

SEQ ID NO: 3588193 - RNA, 16 nt, Pseudomonas putida KT2440
caacaacagucaacaa

SEQ ID NO: 3588194 - RNA, 19 nt, Pseudomonas putida KT2440
caacaaccaauccccccuc

SEQ ID NO: 3588195 - RNA, 11 nt, Pseudomonas putida KT2440
caacaaccugg

SEQ ID NO: 3588196 - RNA, 18 nt, Pseudomonas putida KT2440
caacaaccuggccgggcu

SEQ ID NO: 3588197 - RNA, 22 nt, Pseudomonas putida KT2440
caacaacgacuggucauacucc

SEQ ID NO: 3588198 - RNA, 22 nt, Pseudomonas putida KT2440
caacaacgccuuggccuggcga

SEQ ID NO: 3588199 - RNA, 22 nt, Pseudomonas putida KT2440
caacaacguggcgcggcccccu

SEQ ID NO: 3588200 - RNA, 23 nt, Pseudomonas putida KT2440
caacacauacuccaccgccaggg

SEQ ID NO: 3588201 - RNA, 13 nt, Pseudomonas putida KT2440
caacaccaccucc

SEQ ID NO: 3588202 - RNA, 18 nt, Pseudomonas putida KT2440
caacaccagacucagcgc

SEQ ID NO: 3588203 - RNA, 13 nt, Pseudomonas putida KT2440
caacaccagcagc

SEQ ID NO: 3588204 - RNA, 14 nt, Pseudomonas putida KT2440
caacaccagcagcc

SEQ ID NO: 3588205 - RNA, 11 nt, Pseudomonas putida KT2440
caacaccaucu

SEQ ID NO: 3588206 - RNA, 21 nt, Pseudomonas putida KT2440
caacacccucacccacuccgg

SEQ ID NO: 3588207 - RNA, 15 nt, Pseudomonas putida KT2440
caacaccgccagaaa

SEQ ID NO: 3588208 - RNA, 17 nt, Pseudomonas putida KT2440
caacaccggucaggucc

SEQ ID NO: 3588209 - RNA, 20 nt, Pseudomonas putida KT2440
caacaccguagcgagcaccg

SEQ ID NO: 3588210 - RNA, 23 nt, Pseudomonas putida KT2440
caacaccguagcgagcaccggca

SEQ ID NO: 3588211 - RNA, 21 nt, Pseudomonas putida KT2440
caacaccuccacgccaccgcg

SEQ ID NO: 3588212 - RNA, 15 nt, Pseudomonas putida KT2440
caacaccugccgcag

SEQ ID NO: 3588213 - RNA, 17 nt, Pseudomonas putida KT2440
caacaccugccgcagcu

SEQ ID NO: 3588214 - RNA, 16 nt, Pseudomonas putida KT2440
caacacggcagaggcg

SEQ ID NO: 3588215 - RNA, 19 nt, Pseudomonas putida KT2440
caacacggugaugcgcccu

SEQ ID NO: 3588216 - RNA, 19 nt, Pseudomonas putida KT2440
caacacugucccgaucagg

SEQ ID NO: 3588217 - RNA, 16 nt, Pseudomonas putida KT2440
caacacuuccagcauc

SEQ ID NO: 3588218 - RNA, 16 nt, Pseudomonas putida KT2440
caacagaccaccugcc

SEQ ID NO: 3588219 - RNA, 20 nt, Pseudomonas putida KT2440
caaccuguuccggccucuuc

SEQ ID NO: 3588220 - RNA, 16 nt, Pseudomonas putida KT2440
caaccuuugcggcaca

SEQ ID NO: 3588221 - RNA, 19 nt, Pseudomonas putida KT2440
caacgaaaaaggcccugca

SEQ ID NO: 3588222 - RNA, 14 nt, Pseudomonas putida KT2440
caacgaacggaaca

SEQ ID NO: 3588223 - RNA, 18 nt, Pseudomonas putida KT2440
caacgacuggucauacuc

SEQ ID NO: 3588224 - RNA, 14 nt, Pseudomonas putida KT2440
caacgaggccgcca

SEQ ID NO: 3588225 - RNA, 14 nt, Pseudomonas putida KT2440
caacgauaauuacc

SEQ ID NO: 3588226 - RNA, 18 nt, Pseudomonas putida KT2440
caacgauacccacgccca

SEQ ID NO: 3588227 - RNA, 15 nt, Pseudomonas putida KT2440
caacgaucagcgccg

SEQ ID NO: 3588228 - RNA, 18 nt, Pseudomonas putida KT2440
caacgaucagcgccgaac

SEQ ID NO: 3588229 - RNA, 18 nt, Pseudomonas putida KT2440
caacgauugggcggcagu

SEQ ID NO: 3588230 - RNA, 15 nt, Pseudomonas putida KT2440
caacgcaaauccucc

SEQ ID NO: 3588231 - RNA, 22 nt, Pseudomonas putida KT2440
caacgcaaauccuccugcgcau

SEQ ID NO: 3588232 - RNA, 18 nt, Pseudomonas putida KT2440
caacgcaacaaccccguc

SEQ ID NO: 3588233 - RNA, 18 nt, Pseudomonas putida KT2440
caacgcaacugcggcccc

SEQ ID NO: 3588234 - RNA, 12 nt, Pseudomonas putida KT2440
caacgcacccgc

SEQ ID NO: 3588235 - RNA, 14 nt, Pseudomonas putida KT2440
caacgcagccggca

SEQ ID NO: 3588236 - RNA, 15 nt, Pseudomonas putida KT2440
caacgcagccggcac

SEQ ID NO: 3588237 - RNA, 21 nt, Pseudomonas putida KT2440
caacgccaguugucgcugggu

SEQ ID NO: 3588238 - RNA, 16 nt, Pseudomonas putida KT2440
caacgccccacccgcu

SEQ ID NO: 3588239 - RNA, 17 nt, Pseudomonas putida KT2440
caacgcccccgccaccc

SEQ ID NO: 3588240 - RNA, 21 nt, Pseudomonas putida KT2440
caacgcccgcaacaaccuggc

SEQ ID NO: 3588241 - RNA, 23 nt, Pseudomonas putida KT2440
caacgcccgccguguucccagca

SEQ ID NO: 3588242 - RNA, 14 nt, Pseudomonas putida KT2440
caacgcccgcgcau

SEQ ID NO: 3588243 - RNA, 16 nt, Pseudomonas putida KT2440
caacgccgccagcggc

SEQ ID NO: 3588244 - RNA, 16 nt, Pseudomonas putida KT2440
caacgccucgcugccu

SEQ ID NO: 3588245 - RNA, 17 nt, Pseudomonas putida KT2440
caacgccuuggccuggc

SEQ ID NO: 3588246 - RNA, 15 nt, Pseudomonas putida KT2440
caacgcgaacgacuu

SEQ ID NO: 3588247 - RNA, 14 nt, Pseudomonas putida KT2440
caacgcgccaccgc

SEQ ID NO: 3588248 - RNA, 15 nt, Pseudomonas putida KT2440
caacgcgccauggcc

SEQ ID NO: 3588249 - RNA, 21 nt, Pseudomonas putida KT2440
caacgcgccgauugcugccga

SEQ ID NO: 3588250 - RNA, 14 nt, Pseudomonas putida KT2440
caacgcgcgggcaa

SEQ ID NO: 3588251 - RNA, 15 nt, Pseudomonas putida KT2440
caacgcgcgggcaau

SEQ ID NO: 3588252 - RNA, 18 nt, Pseudomonas putida KT2440
caacgcgguggcuggcac

SEQ ID NO: 3588253 - RNA, 14 nt, Pseudomonas putida KT2440
caacgcuucggcca

SEQ ID NO: 3588254 - RNA, 17 nt, Pseudomonas putida KT2440
caacgcuucggccauga

SEQ ID NO: 3588255 - RNA, 17 nt, Pseudomonas putida KT2440
caacggcaacgccagca

SEQ ID NO: 3588256 - RNA, 16 nt, Pseudomonas putida KT2440
caacggcacucgaagc

SEQ ID NO: 3588257 - RNA, 19 nt, Pseudomonas putida KT2440
caacggcacucgaagcacu

SEQ ID NO: 3588258 - RNA, 13 nt, Pseudomonas putida KT2440
caacggcagcgac

SEQ ID NO: 3588259 - RNA, 18 nt, Pseudomonas putida KT2440
caacggcagcgacagcug

SEQ ID NO: 3588260 - RNA, 13 nt, Pseudomonas putida KT2440
caacggcaucacg

SEQ ID NO: 3588261 - RNA, 18 nt, Pseudomonas putida KT2440
caacggcaucacgcuggc

SEQ ID NO: 3588262 - RNA, 22 nt, Pseudomonas putida KT2440
caacggcaucacgcuggccauu

SEQ ID NO: 3588263 - RNA, 16 nt, Pseudomonas putida KT2440
caacggccacgcugcg

SEQ ID NO: 3588264 - RNA, 20 nt, Pseudomonas putida KT2440
caacggcgcccgggccaugc

SEQ ID NO: 3588265 - RNA, 19 nt, Pseudomonas putida KT2440
caacggcgcgcccggcgca

SEQ ID NO: 3588266 - RNA, 13 nt, Pseudomonas putida KT2440
caacggcucacug

SEQ ID NO: 3588267 - RNA, 17 nt, Pseudomonas putida KT2440
caacggguucagguaca

SEQ ID NO: 3588268 - RNA, 21 nt, Pseudomonas putida KT2440
caacggguucagguacagcag

SEQ ID NO: 3588269 - RNA, 22 nt, Pseudomonas putida KT2440
caacggguucagguacagcagc

SEQ ID NO: 3588270 - RNA, 20 nt, Pseudomonas putida KT2440
caacgguaacguggacagca

SEQ ID NO: 3588271 - RNA, 22 nt, Pseudomonas putida KT2440
caacgguaacguggacagcagc

SEQ ID NO: 3588272 - RNA, 14 nt, Pseudomonas putida KT2440
caacggucgaucag

SEQ ID NO: 3588273 - RNA, 15 nt, Pseudomonas putida KT2440
caacggucgaucagc

SEQ ID NO: 3588274 - RNA, 21 nt, Pseudomonas putida KT2440
caacggugaacggcgggcgga

SEQ ID NO: 3588275 - RNA, 22 nt, Pseudomonas putida KT2440
caacgucacaugcgccacaccc

SEQ ID NO: 3588276 - RNA, 16 nt, Pseudomonas putida KT2440
caacgucaucggccca

SEQ ID NO: 3588277 - RNA, 12 nt, Pseudomonas putida KT2440
caacgucucgaa

SEQ ID NO: 3588278 - RNA, 14 nt, Pseudomonas putida KT2440
caacguucaucccc

SEQ ID NO: 3588279 - RNA, 14 nt, Pseudomonas putida KT2440
caacguucccaaug

SEQ ID NO: 3588280 - RNA, 16 nt, Pseudomonas putida KT2440
caacuaccaugaaaaa

SEQ ID NO: 3588281 - RNA, 21 nt, Pseudomonas putida KT2440
caacuaccaugaaaaacaaca

SEQ ID NO: 3588282 - RNA, 22 nt, Pseudomonas putida KT2440
caacuaccaugaaaaacaacaa

SEQ ID NO: 3588283 - RNA, 13 nt, Pseudomonas putida KT2440
caacuacccugaa

SEQ ID NO: 3588284 - RNA, 15 nt, Pseudomonas putida KT2440
caacuacccugaaau

SEQ ID NO: 3588285 - RNA, 13 nt, Pseudomonas putida KT2440
caacucacuuuca

SEQ ID NO: 3588286 - RNA, 21 nt, Pseudomonas putida KT2440
caacucacuuucagcgccugc

SEQ ID NO: 3588287 - RNA, 23 nt, Pseudomonas putida KT2440
caacucacuuucagcgccugccu

SEQ ID NO: 3588288 - RNA, 22 nt, Pseudomonas putida KT2440
caacucagcgcagcuucucaag

SEQ ID NO: 3588289 - RNA, 21 nt, Pseudomonas putida KT2440
caacucaggcugagcagacca

SEQ ID NO: 3588290 - RNA, 16 nt, Pseudomonas putida KT2440
caacuccacgcggaac

SEQ ID NO: 3588291 - RNA, 19 nt, Pseudomonas putida KT2440
caacuccacguucccgcca

SEQ ID NO: 3588292 - RNA, 16 nt, Pseudomonas putida KT2440
caacuccccacccagg

SEQ ID NO: 3588293 - RNA, 14 nt, Pseudomonas putida KT2440
caacuccuccagcc

SEQ ID NO: 3588294 - RNA, 16 nt, Pseudomonas putida KT2440
caacuccugcguaccc

SEQ ID NO: 3588295 - RNA, 21 nt, Pseudomonas putida KT2440
caacuccugcguacccagccc

SEQ ID NO: 3588296 - RNA, 16 nt, Pseudomonas putida KT2440
caacuccuucucgccc

SEQ ID NO: 3588297 - RNA, 19 nt, Pseudomonas putida KT2440
caacucgcgcauccagcca

SEQ ID NO: 3588298 - RNA, 16 nt, Pseudomonas putida KT2440
caacucgcuuccccca

SEQ ID NO: 3588299 - RNA, 19 nt, Pseudomonas putida KT2440
caacucuaccucacugaca

SEQ ID NO: 3588300 - RNA, 23 nt, Pseudomonas putida KT2440
caacugagcuaacgacccaaaaa

SEQ ID NO: 3588301 - RNA, 19 nt, Pseudomonas putida KT2440
caacugagcuaacgacccg

SEQ ID NO: 3588302 - RNA, 20 nt, Pseudomonas putida KT2440
caacugcacccgccagccgu

SEQ ID NO: 3588303 - RNA, 17 nt, Pseudomonas putida KT2440
caacugcauccgcccca

SEQ ID NO: 3588304 - RNA, 18 nt, Pseudomonas putida KT2440
caacugcauccgccccag

SEQ ID NO: 3588305 - RNA, 21 nt, Pseudomonas putida KT2440
caacugcccacccaaccgcgc

SEQ ID NO: 3588306 - RNA, 21 nt, Pseudomonas putida KT2440
caacugcccaggaucacuggc

SEQ ID NO: 3588307 - RNA, 16 nt, Pseudomonas putida KT2440
caacugccgcgccgcc

SEQ ID NO: 3588308 - RNA, 16 nt, Pseudomonas putida KT2440
caacugcgccguggcc

SEQ ID NO: 3588309 - RNA, 21 nt, Pseudomonas putida KT2440
caacugcgccguggccgccau

SEQ ID NO: 3588310 - RNA, 13 nt, Pseudomonas putida KT2440
caacugcgccugg

SEQ ID NO: 3588311 - RNA, 14 nt, Pseudomonas putida KT2440
caacugcgccuggg

SEQ ID NO: 3588312 - RNA, 12 nt, Pseudomonas putida KT2440
caacugcgcgau

SEQ ID NO: 3588313 - RNA, 19 nt, Pseudomonas putida KT2440
caacugcgcgauagccugu

SEQ ID NO: 3588314 - RNA, 22 nt, Pseudomonas putida KT2440
caacugcggccccuggaacccc

SEQ ID NO: 3588315 - RNA, 15 nt, Pseudomonas putida KT2440
caacugcuccaggca

SEQ ID NO: 3588316 - RNA, 17 nt, Pseudomonas putida KT2440
caacugcucuaccaacu

SEQ ID NO: 3588317 - RNA, 19 nt, Pseudomonas putida KT2440
caacuggaccaucacggaa

SEQ ID NO: 3588318 - RNA, 13 nt, Pseudomonas putida KT2440
caacuggccaggg

SEQ ID NO: 3588319 - RNA, 18 nt, Pseudomonas putida KT2440
caacuggcucaugcgcca

SEQ ID NO: 3588320 - RNA, 16 nt, Pseudomonas putida KT2440
caacugggcaauguaa

SEQ ID NO: 3588321 - RNA, 23 nt, Pseudomonas putida KT2440
caacugggcaauguaaugcgccg

SEQ ID NO: 3588322 - RNA, 20 nt, Pseudomonas putida KT2440
caacuggugaaucagcccca

SEQ ID NO: 3588323 - RNA, 21 nt, Pseudomonas putida KT2440
caacuggugaaucagccccag

SEQ ID NO: 3588324 - RNA, 15 nt, Pseudomonas putida KT2440
caaggccaaccacgc

SEQ ID NO: 3588325 - RNA, 14 nt, Pseudomonas putida KT2440
caaggccagcgccu

SEQ ID NO: 3588326 - RNA, 14 nt, Pseudomonas putida KT2440
caaggccagcggaa

SEQ ID NO: 3588327 - RNA, 22 nt, Pseudomonas putida KT2440
caaggcccaguucggacaggcg

SEQ ID NO: 3588328 - RNA, 16 nt, Pseudomonas putida KT2440
caaggcccgcgccgac

SEQ ID NO: 3588329 - RNA, 22 nt, Pseudomonas putida KT2440
caaggcccgcgccgacagccuc

SEQ ID NO: 3588330 - RNA, 14 nt, Pseudomonas putida KT2440
caaggccgccaccu

SEQ ID NO: 3588331 - RNA, 15 nt, Pseudomonas putida KT2440
caaggccgccaccuc

SEQ ID NO: 3588332 - RNA, 17 nt, Pseudomonas putida KT2440
caaggccgccaccucgc

SEQ ID NO: 3588333 - RNA, 17 nt, Pseudomonas putida KT2440
caaggccuccagguaau

SEQ ID NO: 3588334 - RNA, 14 nt, Pseudomonas putida KT2440
caaggccuggccca

SEQ ID NO: 3588335 - RNA, 21 nt, Pseudomonas putida KT2440
caaggcgaccugccagccuuc

SEQ ID NO: 3588336 - RNA, 18 nt, Pseudomonas putida KT2440
caaggcgagggcuucgcc

SEQ ID NO: 3588337 - RNA, 19 nt, Pseudomonas putida KT2440
caaggcgagguucagcgca

SEQ ID NO: 3588338 - RNA, 23 nt, Pseudomonas putida KT2440
caaggcgccgaugaagcaggccg

SEQ ID NO: 3588339 - RNA, 16 nt, Pseudomonas putida KT2440
caaggcggcgaucgac

SEQ ID NO: 3588340 - RNA, 15 nt, Pseudomonas putida KT2440
caaggcgguggagua

SEQ ID NO: 3588341 - RNA, 14 nt, Pseudomonas putida KT2440
caaggcguggcuug

SEQ ID NO: 3588342 - RNA, 15 nt, Pseudomonas putida KT2440
caaggcucaagcgca

SEQ ID NO: 3588343 - RNA, 22 nt, Pseudomonas putida KT2440
caaggcugcgcuugagccuugu

SEQ ID NO: 3588344 - RNA, 17 nt, Pseudomonas putida KT2440
caaggcugcuucaauca

SEQ ID NO: 3588345 - RNA, 20 nt, Pseudomonas putida KT2440
caaggcuggcaacccgccuc

SEQ ID NO: 3588346 - RNA, 13 nt, Pseudomonas putida KT2440
caaggcuguucca

SEQ ID NO: 3588347 - RNA, 11 nt, Pseudomonas putida KT2440
caaggcuuccg

SEQ ID NO: 3588348 - RNA, 16 nt, Pseudomonas putida KT2440
caaggcuuuccaccug

SEQ ID NO: 3588349 - RNA, 12 nt, Pseudomonas putida KT2440
caagggccaggu

SEQ ID NO: 3588350 - RNA, 17 nt, Pseudomonas putida KT2440
caagggccugcaggcag

SEQ ID NO: 3588351 - RNA, 20 nt, Pseudomonas putida KT2440
caagggccugcaggcagcau

SEQ ID NO: 3588352 - RNA, 14 nt, Pseudomonas putida KT2440
caagggccugugcc

SEQ ID NO: 3588353 - RNA, 16 nt, Pseudomonas putida KT2440
caagggcgaaccaggu

SEQ ID NO: 3588354 - RNA, 13 nt, Pseudomonas putida KT2440
caagggugaagua

SEQ ID NO: 3588355 - RNA, 19 nt, Pseudomonas putida KT2440
caagguaaucuggcugucg

SEQ ID NO: 3588356 - RNA, 14 nt, Pseudomonas putida KT2440
caagguagccugcu

SEQ ID NO: 3588357 - RNA, 14 nt, Pseudomonas putida KT2440
caagguagcggcca

SEQ ID NO: 3588358 - RNA, 16 nt, Pseudomonas putida KT2440
caagguagcggccagc

SEQ ID NO: 3588359 - RNA, 16 nt, Pseudomonas putida KT2440
caagguagcggcggca

SEQ ID NO: 3588360 - RNA, 14 nt, Pseudomonas putida KT2440
caagguaggggcag

SEQ ID NO: 3588361 - RNA, 15 nt, Pseudomonas putida KT2440
caaggucagcaagcc

SEQ ID NO: 3588362 - RNA, 17 nt, Pseudomonas putida KT2440
caaggucagccagacga

SEQ ID NO: 3588363 - RNA, 17 nt, Pseudomonas putida KT2440
caaggucagcuucuggg

SEQ ID NO: 3588364 - RNA, 18 nt, Pseudomonas putida KT2440
caaggucaucgcugcggu

SEQ ID NO: 3588365 - RNA, 16 nt, Pseudomonas putida KT2440
caaggucgaugcugcu

SEQ ID NO: 3588366 - RNA, 14 nt, Pseudomonas putida KT2440
caaggucgccgccg

SEQ ID NO: 3588367 - RNA, 17 nt, Pseudomonas putida KT2440
caaggucuccagcaccg

SEQ ID NO: 3588368 - RNA, 22 nt, Pseudomonas putida KT2440
caaggucuccagcaccgccccg

SEQ ID NO: 3588369 - RNA, 13 nt, Pseudomonas putida KT2440
caaggugcacacc

SEQ ID NO: 3588370 - RNA, 19 nt, Pseudomonas putida KT2440
caaggugcuaccggcgcca

SEQ ID NO: 3588371 - RNA, 17 nt, Pseudomonas putida KT2440
caaggugggguugacca

SEQ ID NO: 3588372 - RNA, 14 nt, Pseudomonas putida KT2440
caagguuggggcca

SEQ ID NO: 3588373 - RNA, 23 nt, Pseudomonas putida KT2440
caagguuguauuuagucagggug

SEQ ID NO: 3588374 - RNA, 18 nt, Pseudomonas putida KT2440
caagguuucacgccgcug

SEQ ID NO: 3588375 - RNA, 15 nt, Pseudomonas putida KT2440
caagguuucagcagc

SEQ ID NO: 3588376 - RNA, 16 nt, Pseudomonas putida KT2440
caagguuucagcagcg

SEQ ID NO: 3588377 - RNA, 16 nt, Pseudomonas putida KT2440
caaguacaacugccac

SEQ ID NO: 3588378 - RNA, 13 nt, Pseudomonas putida KT2440
caaguacggccag

SEQ ID NO: 3588379 - RNA, 18 nt, Pseudomonas putida KT2440
caaguacggccagcaggu

SEQ ID NO: 3588380 - RNA, 18 nt, Pseudomonas putida KT2440
caaguacuugcaggugca

SEQ ID NO: 3588381 - RNA, 16 nt, Pseudomonas putida KT2440
caaguaggcacgauga

SEQ ID NO: 3588382 - RNA, 20 nt, Pseudomonas putida KT2440
caaguaggcacgaugaccgu

SEQ ID NO: 3588383 - RNA, 17 nt, Pseudomonas putida KT2440
caagucauccgccaggc

SEQ ID NO: 3588384 - RNA, 18 nt, Pseudomonas putida KT2440
caagucauccgccaggcu

SEQ ID NO: 3588385 - RNA, 16 nt, Pseudomonas putida KT2440
caagucaugcucgccg

SEQ ID NO: 3588386 - RNA, 21 nt, Pseudomonas putida KT2440
caagucccccaucggcacccg

SEQ ID NO: 3588387 - RNA, 19 nt, Pseudomonas putida KT2440
caaguccgaacuccccacc

SEQ ID NO: 3588388 - RNA, 23 nt, Pseudomonas putida KT2440
caaguccgaacuccccaccaggc

SEQ ID NO: 3588389 - RNA, 19 nt, Pseudomonas putida KT2440
caagucgcccaguuccaug

SEQ ID NO: 3588390 - RNA, 21 nt, Pseudomonas putida KT2440
caagucgcccaguuccauguc

SEQ ID NO: 3588391 - RNA, 16 nt, Pseudomonas putida KT2440
caagugccagaaccag

SEQ ID NO: 3588392 - RNA, 18 nt, Pseudomonas putida KT2440
caagugccguccgcugcc

SEQ ID NO: 3588393 - RNA, 19 nt, Pseudomonas putida KT2440
caagugccuuggcggcgga

SEQ ID NO: 3588394 - RNA, 14 nt, Pseudomonas putida KT2440
caagugcuguauga

SEQ ID NO: 3588395 - RNA, 22 nt, Pseudomonas putida KT2440
caaguggccuuguugccaccca

SEQ ID NO: 3588396 - RNA, 23 nt, Pseudomonas putida KT2440
caaguggccuuguugccacccag

SEQ ID NO: 3588397 - RNA, 15 nt, Pseudomonas putida KT2440
caaguucccgauccu

SEQ ID NO: 3588398 - RNA, 14 nt, Pseudomonas putida KT2440
caaguucccgugcg

SEQ ID NO: 3588399 - RNA, 13 nt, Pseudomonas putida KT2440
caaguucguuggc

SEQ ID NO: 3588400 - RNA, 13 nt, Pseudomonas putida KT2440
caauaaaaacaac

SEQ ID NO: 3588401 - RNA, 14 nt, Pseudomonas putida KT2440
caauaaaaacaaca

SEQ ID NO: 3588402 - RNA, 15 nt, Pseudomonas putida KT2440
caauaaaaacaacag

SEQ ID NO: 3588403 - RNA, 19 nt, Pseudomonas putida KT2440
caauaaaaacaacagguaa

SEQ ID NO: 3588404 - RNA, 23 nt, Pseudomonas putida KT2440
caauaacaaguucaaggucaucg

SEQ ID NO: 3588405 - RNA, 14 nt, Pseudomonas putida KT2440
caauaauaaaaaaa

SEQ ID NO: 3588406 - RNA, 18 nt, Pseudomonas putida KT2440
caauacaacgaucagcgc

SEQ ID NO: 3588407 - RNA, 15 nt, Pseudomonas putida KT2440
caauacauccaggcc

SEQ ID NO: 3588408 - RNA, 22 nt, Pseudomonas putida KT2440
caauacauccgcguccccuuca

SEQ ID NO: 3588409 - RNA, 16 nt, Pseudomonas putida KT2440
caauacccaacagcau

SEQ ID NO: 3588410 - RNA, 18 nt, Pseudomonas putida KT2440
caauacccgcaacgaucg

SEQ ID NO: 3588411 - RNA, 14 nt, Pseudomonas putida KT2440
caauaccgacaagu

SEQ ID NO: 3588412 - RNA, 21 nt, Pseudomonas putida KT2440
caauacgaauguuauccaugu

SEQ ID NO: 3588413 - RNA, 23 nt, Pseudomonas putida KT2440
caauacgguaagccgccguggca

SEQ ID NO: 3588414 - RNA, 14 nt, Pseudomonas putida KT2440
caauagccauuccg

SEQ ID NO: 3588415 - RNA, 20 nt, Pseudomonas putida KT2440
caauagccauuccggcugca

SEQ ID NO: 3588416 - RNA, 18 nt, Pseudomonas putida KT2440
caauaugcaccuugagau

SEQ ID NO: 3588417 - RNA, 19 nt, Pseudomonas putida KT2440
caaucaaagcagacagcug

SEQ ID NO: 3588418 - RNA, 21 nt, Pseudomonas putida KT2440
caaucaacgguggccagcagc

SEQ ID NO: 3588419 - RNA, 16 nt, Pseudomonas putida KT2440
caaucaccgccagguc

SEQ ID NO: 3588420 - RNA, 16 nt, Pseudomonas putida KT2440
caaucacgaacaccag

SEQ ID NO: 3588421 - RNA, 19 nt, Pseudomonas putida KT2440
caaucagcaucagugcagg

SEQ ID NO: 3588422 - RNA, 15 nt, Pseudomonas putida KT2440
caaucagcgacaacg

SEQ ID NO: 3588423 - RNA, 15 nt, Pseudomonas putida KT2440
caaucagcucacagg

SEQ ID NO: 3588424 - RNA, 18 nt, Pseudomonas putida KT2440
caaucagcucacaggcuc

SEQ ID NO: 3588425 - RNA, 20 nt, Pseudomonas putida KT2440
caaucagcucacaggcucag

SEQ ID NO: 3588426 - RNA, 15 nt, Pseudomonas putida KT2440
caaucaggcagcgau

SEQ ID NO: 3588427 - RNA, 18 nt, Pseudomonas putida KT2440
caaucagggauacugcug

SEQ ID NO: 3588428 - RNA, 14 nt, Pseudomonas putida KT2440
caaucaggucaucg

SEQ ID NO: 3588429 - RNA, 14 nt, Pseudomonas putida KT2440
caaucauauacauc

SEQ ID NO: 3588430 - RNA, 20 nt, Pseudomonas putida KT2440
cacacauaucagccaacacc

SEQ ID NO: 3588431 - RNA, 21 nt, Pseudomonas putida KT2440
cacacauucccuguaggagcg

SEQ ID NO: 3588432 - RNA, 12 nt, Pseudomonas putida KT2440
cacaccacagcu

SEQ ID NO: 3588433 - RNA, 16 nt, Pseudomonas putida KT2440
cacaccacagcugcac

SEQ ID NO: 3588434 - RNA, 20 nt, Pseudomonas putida KT2440
cacaccacagcugcacaucu

SEQ ID NO: 3588435 - RNA, 16 nt, Pseudomonas putida KT2440
cacacccagcgcggca

SEQ ID NO: 3588436 - RNA, 11 nt, Pseudomonas putida KT2440
cacacccaggc

SEQ ID NO: 3588437 - RNA, 20 nt, Pseudomonas putida KT2440
cacaccccagaacggcacgc

SEQ ID NO: 3588438 - RNA, 22 nt, Pseudomonas putida KT2440
cacaccccagaacggcacgccc

SEQ ID NO: 3588439 - RNA, 15 nt, Pseudomonas putida KT2440
cacacccgccacgcu

SEQ ID NO: 3588440 - RNA, 14 nt, Pseudomonas putida KT2440
cacacccggacccu

SEQ ID NO: 3588441 - RNA, 13 nt, Pseudomonas putida KT2440
cacacccgggccc

SEQ ID NO: 3588442 - RNA, 22 nt, Pseudomonas putida KT2440
cacacccugucgaucacgggca

SEQ ID NO: 3588443 - RNA, 18 nt, Pseudomonas putida KT2440
cacaccgcaacccagccc

SEQ ID NO: 3588444 - RNA, 19 nt, Pseudomonas putida KT2440
cacaccgcaacccagcccc

SEQ ID NO: 3588445 - RNA, 19 nt, Pseudomonas putida KT2440
cacaccgcgcaccucgacc

SEQ ID NO: 3588446 - RNA, 14 nt, Pseudomonas putida KT2440
cacaccggcaaucg

SEQ ID NO: 3588447 - RNA, 16 nt, Pseudomonas putida KT2440
cacaccugccaggcca

SEQ ID NO: 3588448 - RNA, 13 nt, Pseudomonas putida KT2440
cacaccuugggcc

SEQ ID NO: 3588449 - RNA, 13 nt, Pseudomonas putida KT2440
cacacgaccuugg

SEQ ID NO: 3588450 - RNA, 22 nt, Pseudomonas putida KT2440
cacacgaccuuggacgcuggca

SEQ ID NO: 3588451 - RNA, 15 nt, Pseudomonas putida KT2440
cacacgcaccacccc

SEQ ID NO: 3588452 - RNA, 21 nt, Pseudomonas putida KT2440
cacacgcuccgggugcggcau

SEQ ID NO: 3588453 - RNA, 14 nt, Pseudomonas putida KT2440
cacacggcaagcca

SEQ ID NO: 3588454 - RNA, 11 nt, Pseudomonas putida KT2440
cacacggcggu

SEQ ID NO: 3588455 - RNA, 21 nt, Pseudomonas putida KT2440
cacacgguaggcgucuuccac

SEQ ID NO: 3588456 - RNA, 16 nt, Pseudomonas putida KT2440
cacacgguuuccaggc

SEQ ID NO: 3588457 - RNA, 18 nt, Pseudomonas putida KT2440
cacacgguuuccaggcgu

SEQ ID NO: 3588458 - RNA, 19 nt, Pseudomonas putida KT2440
cacacguuguccgacagcu

SEQ ID NO: 3588459 - RNA, 20 nt, Pseudomonas putida KT2440
cacacucuuccugccgcagc

SEQ ID NO: 3588460 - RNA, 19 nt, Pseudomonas putida KT2440
cacacucuuugaggggcua

SEQ ID NO: 3588461 - RNA, 13 nt, Pseudomonas putida KT2440
cacacugcccagc

SEQ ID NO: 3588462 - RNA, 12 nt, Pseudomonas putida KT2440
cacacugcgcuu

SEQ ID NO: 3588463 - RNA, 16 nt, Pseudomonas putida KT2440
cacacugcucgucaaa

SEQ ID NO: 3588464 - RNA, 20 nt, Pseudomonas putida KT2440
cacacuggucacgcucggcc

SEQ ID NO: 3588465 - RNA, 22 nt, Pseudomonas putida KT2440
cacacugucccggcacaaccga

SEQ ID NO: 3588466 - RNA, 16 nt, Pseudomonas putida KT2440
cacacuucgccgugcu

SEQ ID NO: 3588467 - RNA, 18 nt, Pseudomonas putida KT2440
cacagaacaccaccaguu

SEQ ID NO: 3588468 - RNA, 16 nt, Pseudomonas putida KT2440
cacagaaggcugcgua

SEQ ID NO: 3588469 - RNA, 13 nt, Pseudomonas putida KT2440
cacagacaccaca

SEQ ID NO: 3588470 - RNA, 21 nt, Pseudomonas putida KT2440
cacagacaccacaaaaccuca

SEQ ID NO: 3588471 - RNA, 13 nt, Pseudomonas putida KT2440
cacagagacaccg

SEQ ID NO: 3588472 - RNA, 16 nt, Pseudomonas putida KT2440
cacagauaaaccugcc

SEQ ID NO: 3588473 - RNA, 20 nt, Pseudomonas putida KT2440
cacagauaaaccugccaccc

SEQ ID NO: 3588474 - RNA, 15 nt, Pseudomonas putida KT2440
cacagaucaacgccg

SEQ ID NO: 3588475 - RNA, 22 nt, Pseudomonas putida KT2440
cacagaucaacgccgccagcgg

SEQ ID NO: 3588476 - RNA, 12 nt, Pseudomonas putida KT2440
cacagaugccgc

SEQ ID NO: 3588477 - RNA, 17 nt, Pseudomonas putida KT2440
cacagaugccgccgcug

SEQ ID NO: 3588478 - RNA, 23 nt, Pseudomonas putida KT2440
cacagaugccgccgcugccagca

SEQ ID NO: 3588479 - RNA, 22 nt, Pseudomonas putida KT2440
cacagcaucacccgcgaaugcu

SEQ ID NO: 3588480 - RNA, 16 nt, Pseudomonas putida KT2440
cacagccaugccggca

SEQ ID NO: 3588481 - RNA, 12 nt, Pseudomonas putida KT2440
cacagcccaagg

SEQ ID NO: 3588482 - RNA, 19 nt, Pseudomonas putida KT2440
cacagcccaaggcuggcca

SEQ ID NO: 3588483 - RNA, 12 nt, Pseudomonas putida KT2440
cacagccgugcc

SEQ ID NO: 3588484 - RNA, 19 nt, Pseudomonas putida KT2440
cacagccgugccuuccagc

SEQ ID NO: 3588485 - RNA, 19 nt, Pseudomonas putida KT2440
cacagccuucaggguugug

SEQ ID NO: 3588486 - RNA, 17 nt, Pseudomonas putida KT2440
cacagcgagcagccugg

SEQ ID NO: 3588487 - RNA, 14 nt, Pseudomonas putida KT2440
cacagcgccgcggc

SEQ ID NO: 3588488 - RNA, 15 nt, Pseudomonas putida KT2440
cacagcgccugcugc

SEQ ID NO: 3588489 - RNA, 19 nt, Pseudomonas putida KT2440
cacagcgccugcugcugga

SEQ ID NO: 3588490 - RNA, 15 nt, Pseudomonas putida KT2440
cacagcgcggaacac

SEQ ID NO: 3588491 - RNA, 21 nt, Pseudomonas putida KT2440
cacagcgcggaacacacgcuc

SEQ ID NO: 3588492 - RNA, 20 nt, Pseudomonas putida KT2440
cacagcgcucgaugcggugg

SEQ ID NO: 3588493 - RNA, 20 nt, Pseudomonas putida KT2440
cacagcggcagacacaggcg

SEQ ID NO: 3588494 - RNA, 13 nt, Pseudomonas putida KT2440
cacagcggccaca

SEQ ID NO: 3588495 - RNA, 18 nt, Pseudomonas putida KT2440
cacagcggccacagcgcc

SEQ ID NO: 3588496 - RNA, 18 nt, Pseudomonas putida KT2440
cacagcggccccaucacc

SEQ ID NO: 3588497 - RNA, 22 nt, Pseudomonas putida KT2440
cacagcggccuugaccacuucg

SEQ ID NO: 3588498 - RNA, 17 nt, Pseudomonas putida KT2440
cacagcguccaguucaa

SEQ ID NO: 3588499 - RNA, 19 nt, Pseudomonas putida KT2440
cacagcucgaugccuuugc

SEQ ID NO: 3588500 - RNA, 14 nt, Pseudomonas putida KT2440
cacagcugccggcc

SEQ ID NO: 3588501 - RNA, 20 nt, Pseudomonas putida KT2440
cacagcugccggccagcgcc

SEQ ID NO: 3588502 - RNA, 16 nt, Pseudomonas putida KT2440
cacagcugcgccagcc

SEQ ID NO: 3588503 - RNA, 17 nt, Pseudomonas putida KT2440
cacaggaaucaccagac

SEQ ID NO: 3588504 - RNA, 19 nt, Pseudomonas putida KT2440
cacaggaaucaccagaccu

SEQ ID NO: 3588505 - RNA, 22 nt, Pseudomonas putida KT2440
cacaggaauuacgcaggcucca

SEQ ID NO: 3588506 - RNA, 14 nt, Pseudomonas putida KT2440
cacaggcacaggcc

SEQ ID NO: 3588507 - RNA, 18 nt, Pseudomonas putida KT2440
cacaggcacaggcccagc

SEQ ID NO: 3588508 - RNA, 15 nt, Pseudomonas putida KT2440
cacaggccagcccca

SEQ ID NO: 3588509 - RNA, 20 nt, Pseudomonas putida KT2440
cacaggccagccccagcggc

SEQ ID NO: 3588510 - RNA, 13 nt, Pseudomonas putida KT2440
cacaggcccagca

SEQ ID NO: 3588511 - RNA, 14 nt, Pseudomonas putida KT2440
cacaggcccagcaa

SEQ ID NO: 3588512 - RNA, 19 nt, Pseudomonas putida KT2440
cacaggcccagcaacagcc

SEQ ID NO: 3588513 - RNA, 14 nt, Pseudomonas putida KT2440
cacaggcccagcau

SEQ ID NO: 3588514 - RNA, 22 nt, Pseudomonas putida KT2440
cacaggcccagcaugaacgcag

SEQ ID NO: 3588515 - RNA, 16 nt, Pseudomonas putida KT2440
cacaggccgcgcauga

SEQ ID NO: 3588516 - RNA, 19 nt, Pseudomonas putida KT2440
cacaggccguaguaggagc

SEQ ID NO: 3588517 - RNA, 13 nt, Pseudomonas putida KT2440
cacaggccgucgu

SEQ ID NO: 3588518 - RNA, 15 nt, Pseudomonas putida KT2440
cacaggcgcacacgc

SEQ ID NO: 3588519 - RNA, 14 nt, Pseudomonas putida KT2440
cacaggcgcagcag

SEQ ID NO: 3588520 - RNA, 11 nt, Pseudomonas putida KT2440
cacaggcgcuc

SEQ ID NO: 3588521 - RNA, 18 nt, Pseudomonas putida KT2440
cacaggcgcuugaagaag

SEQ ID NO: 3588522 - RNA, 19 nt, Pseudomonas putida KT2440
cacaggcggauguucuuga

SEQ ID NO: 3588523 - RNA, 18 nt, Pseudomonas putida KT2440
cacaggcuacgcagcacc

SEQ ID NO: 3588524 - RNA, 20 nt, Pseudomonas putida KT2440
cacaggcuacgcagcacccg

SEQ ID NO: 3588525 - RNA, 21 nt, Pseudomonas putida KT2440
cacaggcuacgcagcacccgg

SEQ ID NO: 3588526 - RNA, 22 nt, Pseudomonas putida KT2440
cacaggcuacgcagcacccggu

SEQ ID NO: 3588527 - RNA, 17 nt, Pseudomonas putida KT2440
cacaggcuggccaccau

SEQ ID NO: 3588528 - RNA, 18 nt, Pseudomonas putida KT2440
cacaggcuggccaccaug

SEQ ID NO: 3588529 - RNA, 15 nt, Pseudomonas putida KT2440
cacagggaccgugca

SEQ ID NO: 3588530 - RNA, 16 nt, Pseudomonas putida KT2440
cacagggcggccaagg

SEQ ID NO: 3588531 - RNA, 21 nt, Pseudomonas putida KT2440
cacaggggaucgcgcaagccu

SEQ ID NO: 3588532 - RNA, 22 nt, Pseudomonas putida KT2440
cacaggggaucgcgcaagccuu

SEQ ID NO: 3588533 - RNA, 18 nt, Pseudomonas putida KT2440
cacaggggccgcgcagcc

SEQ ID NO: 3588534 - RNA, 20 nt, Pseudomonas putida KT2440
cacagguaagucacaggcuu

SEQ ID NO: 3588535 - RNA, 22 nt, Pseudomonas putida KT2440
cacagguaauacgcugugcucu

SEQ ID NO: 3588536 - RNA, 22 nt, Pseudomonas putida KT2440
caccacgaacgcccccagcccg

SEQ ID NO: 3588537 - RNA, 23 nt, Pseudomonas putida KT2440
caccacgaacuuguuggccacca

SEQ ID NO: 3588538 - RNA, 22 nt, Pseudomonas putida KT2440
caccacgccaccaugcucggcc

SEQ ID NO: 3588539 - RNA, 14 nt, Pseudomonas putida KT2440
caccacgccauagc

SEQ ID NO: 3588540 - RNA, 15 nt, Pseudomonas putida KT2440
caccacgccauagcu

SEQ ID NO: 3588541 - RNA, 14 nt, Pseudomonas putida KT2440
caccacggaaggcc

SEQ ID NO: 3588542 - RNA, 15 nt, Pseudomonas putida KT2440
caccacggcggcgau

SEQ ID NO: 3588543 - RNA, 23 nt, Pseudomonas putida KT2440
caccacggucggccugcgcucca

SEQ ID NO: 3588544 - RNA, 18 nt, Pseudomonas putida KT2440
caccacguagugcuucug

SEQ ID NO: 3588545 - RNA, 13 nt, Pseudomonas putida KT2440
caccacguccggc

SEQ ID NO: 3588546 - RNA, 22 nt, Pseudomonas putida KT2440
caccacguccggccagcaacag

SEQ ID NO: 3588547 - RNA, 16 nt, Pseudomonas putida KT2440
caccacguucgggcau

SEQ ID NO: 3588548 - RNA, 19 nt, Pseudomonas putida KT2440
caccacguucgggcauugc

SEQ ID NO: 3588549 - RNA, 17 nt, Pseudomonas putida KT2440
caccacguugcgcuuga

SEQ ID NO: 3588550 - RNA, 17 nt, Pseudomonas putida KT2440
caccacuggugccggca

SEQ ID NO: 3588551 - RNA, 14 nt, Pseudomonas putida KT2440
caccacugucagcc

SEQ ID NO: 3588552 - RNA, 17 nt, Pseudomonas putida KT2440
caccacuucuggcuggg

SEQ ID NO: 3588553 - RNA, 15 nt, Pseudomonas putida KT2440
caccacuugcucggu

SEQ ID NO: 3588554 - RNA, 14 nt, Pseudomonas putida KT2440
caccagaccagcag

SEQ ID NO: 3588555 - RNA, 19 nt, Pseudomonas putida KT2440
caccagauucaagcccggc

SEQ ID NO: 3588556 - RNA, 15 nt, Pseudomonas putida KT2440
caccagcaccagcuc

SEQ ID NO: 3588557 - RNA, 15 nt, Pseudomonas putida KT2440
caccagcacgucacc

SEQ ID NO: 3588558 - RNA, 16 nt, Pseudomonas putida KT2440
caccagcacugccuug

SEQ ID NO: 3588559 - RNA, 17 nt, Pseudomonas putida KT2440
caccagcacugccuugc

SEQ ID NO: 3588560 - RNA, 13 nt, Pseudomonas putida KT2440
caccagcacugcu

SEQ ID NO: 3588561 - RNA, 16 nt, Pseudomonas putida KT2440
caccagcacugcugcg

SEQ ID NO: 3588562 - RNA, 10 nt, Pseudomonas putida KT2440
caccagcagc

SEQ ID NO: 3588563 - RNA, 11 nt, Pseudomonas putida KT2440
caccagcagcc

SEQ ID NO: 3588564 - RNA, 21 nt, Pseudomonas putida KT2440
caccagcagcuucuucacacc

SEQ ID NO: 3588565 - RNA, 22 nt, Pseudomonas putida KT2440
caccagcagcuucuucacaccg

SEQ ID NO: 3588566 - RNA, 14 nt, Pseudomonas putida KT2440
caccagcaggcugc

SEQ ID NO: 3588567 - RNA, 21 nt, Pseudomonas putida KT2440
caccagcaggucggcacgcac

SEQ ID NO: 3588568 - RNA, 19 nt, Pseudomonas putida KT2440
caccagcagugcccccguc

SEQ ID NO: 3588569 - RNA, 17 nt, Pseudomonas putida KT2440
caccagcauguccugcu

SEQ ID NO: 3588570 - RNA, 20 nt, Pseudomonas putida KT2440
caccagcauguccugcugca

SEQ ID NO: 3588571 - RNA, 23 nt, Pseudomonas putida KT2440
caccagcauguccugcugcaggc

SEQ ID NO: 3588572 - RNA, 16 nt, Pseudomonas putida KT2440
caccagccaggcacag

SEQ ID NO: 3588573 - RNA, 14 nt, Pseudomonas putida KT2440
caccagccccagcc

SEQ ID NO: 3588574 - RNA, 18 nt, Pseudomonas putida KT2440
caccagcccgaagcgcag

SEQ ID NO: 3588575 - RNA, 19 nt, Pseudomonas putida KT2440
caccagcccgaagcgcagg

SEQ ID NO: 3588576 - RNA, 13 nt, Pseudomonas putida KT2440
caccagcccgucc

SEQ ID NO: 3588577 - RNA, 14 nt, Pseudomonas putida KT2440
caccagccguggca

SEQ ID NO: 3588578 - RNA, 15 nt, Pseudomonas putida KT2440
caccagccguggcaa

SEQ ID NO: 3588579 - RNA, 13 nt, Pseudomonas putida KT2440
caccagcgacugc

SEQ ID NO: 3588580 - RNA, 17 nt, Pseudomonas putida KT2440
caccagcgcaccacugu

SEQ ID NO: 3588581 - RNA, 18 nt, Pseudomonas putida KT2440
caccagcgcaccacuguu

SEQ ID NO: 3588582 - RNA, 13 nt, Pseudomonas putida KT2440
caccagcggcgcg

SEQ ID NO: 3588583 - RNA, 23 nt, Pseudomonas putida KT2440
caccagcggcucgcucaggcgca

SEQ ID NO: 3588584 - RNA, 17 nt, Pseudomonas putida KT2440
caccagcggcuuggcac

SEQ ID NO: 3588585 - RNA, 22 nt, Pseudomonas putida KT2440
caccagcgggcccagcaggugc

SEQ ID NO: 3588586 - RNA, 21 nt, Pseudomonas putida KT2440
caccagcgucaccccucggcu

SEQ ID NO: 3588587 - RNA, 17 nt, Pseudomonas putida KT2440
caccagcguugucccgc

SEQ ID NO: 3588588 - RNA, 22 nt, Pseudomonas putida KT2440
caccagcguugucccgcccuga

SEQ ID NO: 3588589 - RNA, 15 nt, Pseudomonas putida KT2440
caccagcucauccau

SEQ ID NO: 3588590 - RNA, 13 nt, Pseudomonas putida KT2440
caccagcuccaac

SEQ ID NO: 3588591 - RNA, 16 nt, Pseudomonas putida KT2440
caccagcuccaccuuc

SEQ ID NO: 3588592 - RNA, 17 nt, Pseudomonas putida KT2440
caccagcuccaccuucc

SEQ ID NO: 3588593 - RNA, 13 nt, Pseudomonas putida KT2440
caccagcuccaug

SEQ ID NO: 3588594 - RNA, 19 nt, Pseudomonas putida KT2440
caccagcucguucaacacc

SEQ ID NO: 3588595 - RNA, 20 nt, Pseudomonas putida KT2440
caccagcucguucaacaccu

SEQ ID NO: 3588596 - RNA, 17 nt, Pseudomonas putida KT2440
caccagcuucugggcaa

SEQ ID NO: 3588597 - RNA, 15 nt, Pseudomonas putida KT2440
caccagcuugaugcu

SEQ ID NO: 3588598 - RNA, 16 nt, Pseudomonas putida KT2440
caccaggaacaucgcc

SEQ ID NO: 3588599 - RNA, 20 nt, Pseudomonas putida KT2440
caccaggaacaucgccguca

SEQ ID NO: 3588600 - RNA, 22 nt, Pseudomonas putida KT2440
caccaggacaagccgacaaaaa

SEQ ID NO: 3588601 - RNA, 23 nt, Pseudomonas putida KT2440
caccaggacaagccgacaaaaac

SEQ ID NO: 3588602 - RNA, 18 nt, Pseudomonas putida KT2440
caccaggauugccgggcu

SEQ ID NO: 3588603 - RNA, 21 nt, Pseudomonas putida KT2440
caccaggauuggccgcaacac

SEQ ID NO: 3588604 - RNA, 18 nt, Pseudomonas putida KT2440
caccaggcaauugugccg

SEQ ID NO: 3588605 - RNA, 13 nt, Pseudomonas putida KT2440
caccaggccacgu

SEQ ID NO: 3588606 - RNA, 17 nt, Pseudomonas putida KT2440
caccaggcccagccggg

SEQ ID NO: 3588607 - RNA, 20 nt, Pseudomonas putida KT2440
caccaggcccgcaagggucu

SEQ ID NO: 3588608 - RNA, 15 nt, Pseudomonas putida KT2440
caccaggccgaucac

SEQ ID NO: 3588609 - RNA, 17 nt, Pseudomonas putida KT2440
caccaggccgaucacca

SEQ ID NO: 3588610 - RNA, 21 nt, Pseudomonas putida KT2440
caccaggccgaucaccagcac

SEQ ID NO: 3588611 - RNA, 15 nt, Pseudomonas putida KT2440
caccaggcggucggc

SEQ ID NO: 3588612 - RNA, 14 nt, Pseudomonas putida KT2440
caccaggcuggcca

SEQ ID NO: 3588613 - RNA, 15 nt, Pseudomonas putida KT2440
caccagggacgaacc

SEQ ID NO: 3588614 - RNA, 11 nt, Pseudomonas putida KT2440
caccagggcau

SEQ ID NO: 3588615 - RNA, 14 nt, Pseudomonas putida KT2440
caccaggguaaacc

SEQ ID NO: 3588616 - RNA, 22 nt, Pseudomonas putida KT2440
caccaggguggcgauccacagc

SEQ ID NO: 3588617 - RNA, 15 nt, Pseudomonas putida KT2440
caccaggucaggaca

SEQ ID NO: 3588618 - RNA, 21 nt, Pseudomonas putida KT2440
caccaggucgcggugcagcgg

SEQ ID NO: 3588619 - RNA, 20 nt, Pseudomonas putida KT2440
caccagguugcgugccucgc

SEQ ID NO: 3588620 - RNA, 22 nt, Pseudomonas putida KT2440
caccaguauugcgucaggcuuc

SEQ ID NO: 3588621 - RNA, 22 nt, Pseudomonas putida KT2440
caccagucugcucagccaaccg

SEQ ID NO: 3588622 - RNA, 21 nt, Pseudomonas putida KT2440
caccagugcuuccagggcgcc

SEQ ID NO: 3588623 - RNA, 23 nt, Pseudomonas putida KT2440
caccaguucauggcucacaccca

SEQ ID NO: 3588624 - RNA, 13 nt, Pseudomonas putida KT2440
caccaguuccacc

SEQ ID NO: 3588625 - RNA, 16 nt, Pseudomonas putida KT2440
caccaguuccaccggc

SEQ ID NO: 3588626 - RNA, 14 nt, Pseudomonas putida KT2440
caccaguuccaggg

SEQ ID NO: 3588627 - RNA, 15 nt, Pseudomonas putida KT2440
caccaguuccuggcg

SEQ ID NO: 3588628 - RNA, 17 nt, Pseudomonas putida KT2440
caccaguuccuggcgcu

SEQ ID NO: 3588629 - RNA, 15 nt, Pseudomonas putida KT2440
caccaguucgccauc

SEQ ID NO: 3588630 - RNA, 15 nt, Pseudomonas putida KT2440
caccaguugcagguc

SEQ ID NO: 3588631 - RNA, 12 nt, Pseudomonas putida KT2440
caccaucaagcc

SEQ ID NO: 3588632 - RNA, 15 nt, Pseudomonas putida KT2440
caccaucagagcgcc

SEQ ID NO: 3588633 - RNA, 16 nt, Pseudomonas putida KT2440
caccaucagagcgcca

SEQ ID NO: 3588634 - RNA, 18 nt, Pseudomonas putida KT2440
caccaucagccgcgggcu

SEQ ID NO: 3588635 - RNA, 21 nt, Pseudomonas putida KT2440
caccaucaggcacaggccagc

SEQ ID NO: 3588636 - RNA, 21 nt, Pseudomonas putida KT2440
caccaucaucagacagaagcc

SEQ ID NO: 3588637 - RNA, 14 nt, Pseudomonas putida KT2440
caccaucggcucca

SEQ ID NO: 3588638 - RNA, 18 nt, Pseudomonas putida KT2440
caccaucggcuccagcgc

SEQ ID NO: 3588639 - RNA, 22 nt, Pseudomonas putida KT2440
caccaucggugcggcccccugg

SEQ ID NO: 3588640 - RNA, 21 nt, Pseudomonas putida KT2440
caccaucuccagcucgccgcc

SEQ ID NO: 3588641 - RNA, 19 nt, Pseudomonas putida KT2440
cacccuggcgguugaccag

SEQ ID NO: 3588642 - RNA, 17 nt, Pseudomonas putida KT2440
cacccuggucacgcagu

SEQ ID NO: 3588643 - RNA, 16 nt, Pseudomonas putida KT2440
cacccuggucaugcag

SEQ ID NO: 3588644 - RNA, 17 nt, Pseudomonas putida KT2440
cacccuggucaugcagc

SEQ ID NO: 3588645 - RNA, 19 nt, Pseudomonas putida KT2440
cacccuggucaugcagcgg

SEQ ID NO: 3588646 - RNA, 23 nt, Pseudomonas putida KT2440
cacccugucguuauccugcagca

SEQ ID NO: 3588647 - RNA, 24 nt, Pseudomonas putida KT2440
cacccugucguuauccugcagcac

SEQ ID NO: 3588648 - RNA, 22 nt, Pseudomonas putida KT2440
cacccuuaucguauugcccuuc

SEQ ID NO: 3588649 - RNA, 16 nt, Pseudomonas putida KT2440
cacccuuccccccugg

SEQ ID NO: 3588650 - RNA, 15 nt, Pseudomonas putida KT2440
cacccuuggccaccu

SEQ ID NO: 3588651 - RNA, 21 nt, Pseudomonas putida KT2440
cacccuugggcaccagcuucc

SEQ ID NO: 3588652 - RNA, 22 nt, Pseudomonas putida KT2440
cacccuugggcaccagcuucca

SEQ ID NO: 3588653 - RNA, 18 nt, Pseudomonas putida KT2440
cacccuugggcucagccg

SEQ ID NO: 3588654 - RNA, 20 nt, Pseudomonas putida KT2440
cacccuugggcucagccgcc

SEQ ID NO: 3588655 - RNA, 18 nt, Pseudomonas putida KT2440
cacccuuggucaggauca

SEQ ID NO: 3588656 - RNA, 17 nt, Pseudomonas putida KT2440
cacccuuuaggggcucu

SEQ ID NO: 3588657 - RNA, 18 nt, Pseudomonas putida KT2440
caccgaaaucagcaacgc

SEQ ID NO: 3588658 - RNA, 16 nt, Pseudomonas putida KT2440
caccgaacucguugac

SEQ ID NO: 3588659 - RNA, 14 nt, Pseudomonas putida KT2440
caccgaagcaccac

SEQ ID NO: 3588660 - RNA, 20 nt, Pseudomonas putida KT2440
caccgaaguucagcacgggc

SEQ ID NO: 3588661 - RNA, 15 nt, Pseudomonas putida KT2440
caccgacagcaacgc

SEQ ID NO: 3588662 - RNA, 21 nt, Pseudomonas putida KT2440
caccgaccacgguaccggcaa

SEQ ID NO: 3588663 - RNA, 19 nt, Pseudomonas putida KT2440
caccgacccacaggcacag

SEQ ID NO: 3588664 - RNA, 13 nt, Pseudomonas putida KT2440
caccgacccggcc

SEQ ID NO: 3588665 - RNA, 17 nt, Pseudomonas putida KT2440
caccgaccgcaccggcc

SEQ ID NO: 3588666 - RNA, 15 nt, Pseudomonas putida KT2440
caccgaccugugucc

SEQ ID NO: 3588667 - RNA, 23 nt, Pseudomonas putida KT2440
caccgacgcauucgcgggugaac

SEQ ID NO: 3588668 - RNA, 14 nt, Pseudomonas putida KT2440
caccgacgccgauc

SEQ ID NO: 3588669 - RNA, 17 nt, Pseudomonas putida KT2440
caccgacgugcaggauc

SEQ ID NO: 3588670 - RNA, 18 nt, Pseudomonas putida KT2440
caccgacgugugcccacu

SEQ ID NO: 3588671 - RNA, 14 nt, Pseudomonas putida KT2440
caccgacuccggca

SEQ ID NO: 3588672 - RNA, 14 nt, Pseudomonas putida KT2440
caccgacuggcgua

SEQ ID NO: 3588673 - RNA, 22 nt, Pseudomonas putida KT2440
caccgacuuccccggcgccgcc

SEQ ID NO: 3588674 - RNA, 16 nt, Pseudomonas putida KT2440
caccgagacgaucacc

SEQ ID NO: 3588675 - RNA, 20 nt, Pseudomonas putida KT2440
caccgagacgaucaccaggu

SEQ ID NO: 3588676 - RNA, 18 nt, Pseudomonas putida KT2440
caccgagaugaucgcggc

SEQ ID NO: 3588677 - RNA, 18 nt, Pseudomonas putida KT2440
caccgagccuuccgggca

SEQ ID NO: 3588678 - RNA, 20 nt, Pseudomonas putida KT2440
caccgaguaccgucggcacg

SEQ ID NO: 3588679 - RNA, 14 nt, Pseudomonas putida KT2440
caccgaucaccugg

SEQ ID NO: 3588680 - RNA, 23 nt, Pseudomonas putida KT2440
caccgaucaccugggcgaucaca

SEQ ID NO: 3588681 - RNA, 14 nt, Pseudomonas putida KT2440
caccgauccggugu

SEQ ID NO: 3588682 - RNA, 20 nt, Pseudomonas putida KT2440
caccgauccgguguaggagc

SEQ ID NO: 3588683 - RNA, 23 nt, Pseudomonas putida KT2440
caccgaugccuuuuuuugccgca

SEQ ID NO: 3588684 - RNA, 16 nt, Pseudomonas putida KT2440
caccgaugcugugccg

SEQ ID NO: 3588685 - RNA, 15 nt, Pseudomonas putida KT2440
caccgauggaauagg

SEQ ID NO: 3588686 - RNA, 19 nt, Pseudomonas putida KT2440
caccgauguguguccacca

SEQ ID NO: 3588687 - RNA, 15 nt, Pseudomonas putida KT2440
caccgauuaccuguu

SEQ ID NO: 3588688 - RNA, 17 nt, Pseudomonas putida KT2440
caccgauuaccuguuuc

SEQ ID NO: 3588689 - RNA, 16 nt, Pseudomonas putida KT2440
caccgcaaaucacuga

SEQ ID NO: 3588690 - RNA, 15 nt, Pseudomonas putida KT2440
caccgcaacccagcc

SEQ ID NO: 3588691 - RNA, 17 nt, Pseudomonas putida KT2440
caccgcaacccagcccc

SEQ ID NO: 3588692 - RNA, 17 nt, Pseudomonas putida KT2440
caccgcaagcugcaccg

SEQ ID NO: 3588693 - RNA, 18 nt, Pseudomonas putida KT2440
caccgcacucugcugcuc

SEQ ID NO: 3588694 - RNA, 16 nt, Pseudomonas putida KT2440
caccgcaggugcaggc

SEQ ID NO: 3588695 - RNA, 13 nt, Pseudomonas putida KT2440
caccgcauccgca

SEQ ID NO: 3588696 - RNA, 15 nt, Pseudomonas putida KT2440
caccgcauccgcacc

SEQ ID NO: 3588697 - RNA, 16 nt, Pseudomonas putida KT2440
caccgccaccaucggc

SEQ ID NO: 3588698 - RNA, 14 nt, Pseudomonas putida KT2440
caccgccagcagcu

SEQ ID NO: 3588699 - RNA, 19 nt, Pseudomonas putida KT2440
caccgccagcagcuggucg

SEQ ID NO: 3588700 - RNA, 16 nt, Pseudomonas putida KT2440
caccgccagcccgcca

SEQ ID NO: 3588701 - RNA, 13 nt, Pseudomonas putida KT2440
caccgccagcggc

SEQ ID NO: 3588702 - RNA, 14 nt, Pseudomonas putida KT2440
caccgccagcgggc

SEQ ID NO: 3588703 - RNA, 12 nt, Pseudomonas putida KT2440
caccgccagggu

SEQ ID NO: 3588704 - RNA, 17 nt, Pseudomonas putida KT2440
caccgccaggucgccgg

SEQ ID NO: 3588705 - RNA, 17 nt, Pseudomonas putida KT2440
caccgccauggccaggu

SEQ ID NO: 3588706 - RNA, 18 nt, Pseudomonas putida KT2440
caccgccccaagcgccug

SEQ ID NO: 3588707 - RNA, 14 nt, Pseudomonas putida KT2440
caccgccccagcgc

SEQ ID NO: 3588708 - RNA, 16 nt, Pseudomonas putida KT2440
caccgccccagcgcgc

SEQ ID NO: 3588709 - RNA, 21 nt, Pseudomonas putida KT2440
caccgcccccaaaccgcugcc

SEQ ID NO: 3588710 - RNA, 13 nt, Pseudomonas putida KT2440
caccgccccggcc

SEQ ID NO: 3588711 - RNA, 21 nt, Pseudomonas putida KT2440
caccgccgcauuagcagguaa

SEQ ID NO: 3588712 - RNA, 16 nt, Pseudomonas putida KT2440
caccgccgcccacgcc

SEQ ID NO: 3588713 - RNA, 13 nt, Pseudomonas putida KT2440
caccgccgccccg

SEQ ID NO: 3588714 - RNA, 18 nt, Pseudomonas putida KT2440
caccgccgccccgcacca

SEQ ID NO: 3588715 - RNA, 20 nt, Pseudomonas putida KT2440
caccgccggcucgucacugc

SEQ ID NO: 3588716 - RNA, 22 nt, Pseudomonas putida KT2440
caccgccggcucgucacugccg

SEQ ID NO: 3588717 - RNA, 20 nt, Pseudomonas putida KT2440
caccgccuaugaaaccgagc

SEQ ID NO: 3588718 - RNA, 15 nt, Pseudomonas putida KT2440
caccgccucgaccug

SEQ ID NO: 3588719 - RNA, 17 nt, Pseudomonas putida KT2440
caccgccucgaccuggc

SEQ ID NO: 3588720 - RNA, 15 nt, Pseudomonas putida KT2440
caccgccucgguacc

SEQ ID NO: 3588721 - RNA, 17 nt, Pseudomonas putida KT2440
caccgcgaaacacagca

SEQ ID NO: 3588722 - RNA, 23 nt, Pseudomonas putida KT2440
caccgcgaaacacagcaggccaa

SEQ ID NO: 3588723 - RNA, 17 nt, Pseudomonas putida KT2440
caccgcgacgaccgcac

SEQ ID NO: 3588724 - RNA, 17 nt, Pseudomonas putida KT2440
caccgcgcaacgcgcca

SEQ ID NO: 3588725 - RNA, 21 nt, Pseudomonas putida KT2440
caccgcgcacacuucgccggu

SEQ ID NO: 3588726 - RNA, 14 nt, Pseudomonas putida KT2440
caccgcgcgccagu

SEQ ID NO: 3588727 - RNA, 23 nt, Pseudomonas putida KT2440
caccgcgcgguuaagcgccacca

SEQ ID NO: 3588728 - RNA, 19 nt, Pseudomonas putida KT2440
caccgcggaugcgccuggc

SEQ ID NO: 3588729 - RNA, 19 nt, Pseudomonas putida KT2440
caccgcgguggauggcacg

SEQ ID NO: 3588730 - RNA, 23 nt, Pseudomonas putida KT2440
caccgcggugucuucuucgcggg

SEQ ID NO: 3588731 - RNA, 13 nt, Pseudomonas putida KT2440
caccgcguaacca

SEQ ID NO: 3588732 - RNA, 15 nt, Pseudomonas putida KT2440
caccgcgucgauacg

SEQ ID NO: 3588733 - RNA, 20 nt, Pseudomonas putida KT2440
caccgcguuaugacuggccu

SEQ ID NO: 3588734 - RNA, 17 nt, Pseudomonas putida KT2440
caccgcguuggccaggu

SEQ ID NO: 3588735 - RNA, 18 nt, Pseudomonas putida KT2440
caccgcucaaacccggca

SEQ ID NO: 3588736 - RNA, 22 nt, Pseudomonas putida KT2440
caccgcugcaaucgagccgaac

SEQ ID NO: 3588737 - RNA, 12 nt, Pseudomonas putida KT2440
caccgcugccga

SEQ ID NO: 3588738 - RNA, 16 nt, Pseudomonas putida KT2440
caccgcugccgaucag

SEQ ID NO: 3588739 - RNA, 21 nt, Pseudomonas putida KT2440
caccgcugucggucacagcag

SEQ ID NO: 3588740 - RNA, 13 nt, Pseudomonas putida KT2440
caccgcuugcaca

SEQ ID NO: 3588741 - RNA, 20 nt, Pseudomonas putida KT2440
caccggacgcuugccaccca

SEQ ID NO: 3588742 - RNA, 15 nt, Pseudomonas putida KT2440
caccggaguccccac

SEQ ID NO: 3588743 - RNA, 18 nt, Pseudomonas putida KT2440
caccggaguccccaccgg

SEQ ID NO: 3588744 - RNA, 23 nt, Pseudomonas putida KT2440
caccggaguccccaccggcacca

SEQ ID NO: 3588745 - RNA, 15 nt, Pseudomonas putida KT2440
caccggaucggugcc

SEQ ID NO: 3588746 - RNA, 17 nt, Pseudomonas putida KT2440
caccugcccgggccgcu

SEQ ID NO: 3588747 - RNA, 14 nt, Pseudomonas putida KT2440
caccugccgcagcu

SEQ ID NO: 3588748 - RNA, 20 nt, Pseudomonas putida KT2440
caccugccgcgauaagcgcg

SEQ ID NO: 3588749 - RNA, 13 nt, Pseudomonas putida KT2440
caccugccgggca

SEQ ID NO: 3588750 - RNA, 13 nt, Pseudomonas putida KT2440
caccugcgccccg

SEQ ID NO: 3588751 - RNA, 12 nt, Pseudomonas putida KT2440
caccugcgccuu

SEQ ID NO: 3588752 - RNA, 16 nt, Pseudomonas putida KT2440
caccugcuccagcacc

SEQ ID NO: 3588753 - RNA, 19 nt, Pseudomonas putida KT2440
caccugcucggcgcgguca

SEQ ID NO: 3588754 - RNA, 20 nt, Pseudomonas putida KT2440
caccugcuugccgcuggcau

SEQ ID NO: 3588755 - RNA, 19 nt, Pseudomonas putida KT2440
caccuggaauucgcugcgc

SEQ ID NO: 3588756 - RNA, 22 nt, Pseudomonas putida KT2440
caccuggaauucgcugcgcauc

SEQ ID NO: 3588757 - RNA, 17 nt, Pseudomonas putida KT2440
caccuggcagccgaagc

SEQ ID NO: 3588758 - RNA, 20 nt, Pseudomonas putida KT2440
caccuggcagccgaagcugu

SEQ ID NO: 3588759 - RNA, 17 nt, Pseudomonas putida KT2440
caccuggccacccggcu

SEQ ID NO: 3588760 - RNA, 14 nt, Pseudomonas putida KT2440
caccuggcccugcu

SEQ ID NO: 3588761 - RNA, 15 nt, Pseudomonas putida KT2440
caccuggcccugcuc

SEQ ID NO: 3588762 - RNA, 23 nt, Pseudomonas putida KT2440
caccuggcccugcucacgcagcu

SEQ ID NO: 3588763 - RNA, 21 nt, Pseudomonas putida KT2440
caccuggccguguucgacgau

SEQ ID NO: 3588764 - RNA, 22 nt, Pseudomonas putida KT2440
caccuggccuuccagcugcggc

SEQ ID NO: 3588765 - RNA, 16 nt, Pseudomonas putida KT2440
caccuggcugcgggug

SEQ ID NO: 3588766 - RNA, 14 nt, Pseudomonas putida KT2440
caccugggccagua

SEQ ID NO: 3588767 - RNA, 22 nt, Pseudomonas putida KT2440
caccugggcgaucacauaaggc

SEQ ID NO: 3588768 - RNA, 16 nt, Pseudomonas putida KT2440
caccugucccagcugg

SEQ ID NO: 3588769 - RNA, 15 nt, Pseudomonas putida KT2440
caccugugcaggcgu

SEQ ID NO: 3588770 - RNA, 16 nt, Pseudomonas putida KT2440
caccuguuccacgacc

SEQ ID NO: 3588771 - RNA, 15 nt, Pseudomonas putida KT2440
caccuguucccccac

SEQ ID NO: 3588772 - RNA, 16 nt, Pseudomonas putida KT2440
caccuguucccccacc

SEQ ID NO: 3588773 - RNA, 19 nt, Pseudomonas putida KT2440
caccuguucccccaccggc

SEQ ID NO: 3588774 - RNA, 18 nt, Pseudomonas putida KT2440
caccuguuucaacgggua

SEQ ID NO: 3588775 - RNA, 21 nt, Pseudomonas putida KT2440
caccuuacuugcacaucccag

SEQ ID NO: 3588776 - RNA, 13 nt, Pseudomonas putida KT2440
caccuucacgcca

SEQ ID NO: 3588777 - RNA, 13 nt, Pseudomonas putida KT2440
caccuuccacucu

SEQ ID NO: 3588778 - RNA, 13 nt, Pseudomonas putida KT2440
caccuucgccagg

SEQ ID NO: 3588779 - RNA, 16 nt, Pseudomonas putida KT2440
caccuucguccuugag

SEQ ID NO: 3588780 - RNA, 14 nt, Pseudomonas putida KT2440
caccuucucggccu

SEQ ID NO: 3588781 - RNA, 19 nt, Pseudomonas putida KT2440
caccuucucggccucagcc

SEQ ID NO: 3588782 - RNA, 20 nt, Pseudomonas putida KT2440
caccuugaugcgcgagcugg

SEQ ID NO: 3588783 - RNA, 21 nt, Pseudomonas putida KT2440
caccuugccccgcaggccgcc

SEQ ID NO: 3588784 - RNA, 15 nt, Pseudomonas putida KT2440
caccuugccuaccug

SEQ ID NO: 3588785 - RNA, 16 nt, Pseudomonas putida KT2440
caccuugcuccaccag

SEQ ID NO: 3588786 - RNA, 12 nt, Pseudomonas putida KT2440
caccuugcugaa

SEQ ID NO: 3588787 - RNA, 21 nt, Pseudomonas putida KT2440
caccuugcuggaacugcugca

SEQ ID NO: 3588788 - RNA, 14 nt, Pseudomonas putida KT2440
caccuuggcccuuc

SEQ ID NO: 3588789 - RNA, 13 nt, Pseudomonas putida KT2440
caccuuggccgcc

SEQ ID NO: 3588790 - RNA, 14 nt, Pseudomonas putida KT2440
caccuuggccgccc

SEQ ID NO: 3588791 - RNA, 19 nt, Pseudomonas putida KT2440
caccuuggccgcccggaug

SEQ ID NO: 3588792 - RNA, 17 nt, Pseudomonas putida KT2440
caccuuggugcgcgcau

SEQ ID NO: 3588793 - RNA, 18 nt, Pseudomonas putida KT2440
caccuuggugcgcgcauc

SEQ ID NO: 3588794 - RNA, 17 nt, Pseudomonas putida KT2440
caccuuguauucgagcu

SEQ ID NO: 3588795 - RNA, 13 nt, Pseudomonas putida KT2440
cacgaaaaagcca

SEQ ID NO: 3588796 - RNA, 14 nt, Pseudomonas putida KT2440
cacgaaaaagccag

SEQ ID NO: 3588797 - RNA, 16 nt, Pseudomonas putida KT2440
cacgaaacgccacgcc

SEQ ID NO: 3588798 - RNA, 18 nt, Pseudomonas putida KT2440
cacgaaacgccacgccca

SEQ ID NO: 3588799 - RNA, 14 nt, Pseudomonas putida KT2440
cacgaaacugcgcu

SEQ ID NO: 3588800 - RNA, 19 nt, Pseudomonas putida KT2440
cacgaacacaucaccugcu

SEQ ID NO: 3588801 - RNA, 17 nt, Pseudomonas putida KT2440
cacgaacaccagcccca

SEQ ID NO: 3588802 - RNA, 19 nt, Pseudomonas putida KT2440
cacgaacaccagccccagc

SEQ ID NO: 3588803 - RNA, 15 nt, Pseudomonas putida KT2440
cacgaacagcggcaa

SEQ ID NO: 3588804 - RNA, 14 nt, Pseudomonas putida KT2440
cacgaacaggcgcu

SEQ ID NO: 3588805 - RNA, 17 nt, Pseudomonas putida KT2440
cacgaacaguggcccga

SEQ ID NO: 3588806 - RNA, 14 nt, Pseudomonas putida KT2440
cacgaacaucagca

SEQ ID NO: 3588807 - RNA, 20 nt, Pseudomonas putida KT2440
cacgaacaucagcaggaagc

SEQ ID NO: 3588808 - RNA, 23 nt, Pseudomonas putida KT2440
cacgaacaucagcaggaagcaga

SEQ ID NO: 3588809 - RNA, 15 nt, Pseudomonas putida KT2440
cacgaaccugugcac

SEQ ID NO: 3588810 - RNA, 15 nt, Pseudomonas putida KT2440
cacgaacgcccccag

SEQ ID NO: 3588811 - RNA, 23 nt, Pseudomonas putida KT2440
cacgaacuuguuggccaccaucg

SEQ ID NO: 3588812 - RNA, 21 nt, Pseudomonas putida KT2440
cacgaagccguugaggccgaa

SEQ ID NO: 3588813 - RNA, 14 nt, Pseudomonas putida KT2440
cacgaaggccagca

SEQ ID NO: 3588814 - RNA, 14 nt, Pseudomonas putida KT2440
cacgaaguaacggc

SEQ ID NO: 3588815 - RNA, 19 nt, Pseudomonas putida KT2440
cacgaaguugagcaccggc

SEQ ID NO: 3588816 - RNA, 15 nt, Pseudomonas putida KT2440
cacgaaucgggucca

SEQ ID NO: 3588817 - RNA, 23 nt, Pseudomonas putida KT2440
cacgaaucggguccacccacccu

SEQ ID NO: 3588818 - RNA, 23 nt, Pseudomonas putida KT2440
cacgacaccgggauacugcgcac

SEQ ID NO: 3588819 - RNA, 14 nt, Pseudomonas putida KT2440
cacgacacuccgcu

SEQ ID NO: 3588820 - RNA, 17 nt, Pseudomonas putida KT2440
cacgacaggggcgcaga

SEQ ID NO: 3588821 - RNA, 19 nt, Pseudomonas putida KT2440
cacgacaggggcgcagagc

SEQ ID NO: 3588822 - RNA, 13 nt, Pseudomonas putida KT2440
cacgacgauggcc

SEQ ID NO: 3588823 - RNA, 14 nt, Pseudomonas putida KT2440
cacgacgauggcca

SEQ ID NO: 3588824 - RNA, 20 nt, Pseudomonas putida KT2440
cacgacgauggccaccagca

SEQ ID NO: 3588825 - RNA, 22 nt, Pseudomonas putida KT2440
cacgacgauggccaccagcacc

SEQ ID NO: 3588826 - RNA, 17 nt, Pseudomonas putida KT2440
cacgacgcaggucgcca

SEQ ID NO: 3588827 - RNA, 20 nt, Pseudomonas putida KT2440
cacgacugaacaccugccag

SEQ ID NO: 3588828 - RNA, 13 nt, Pseudomonas putida KT2440
cacgagcaugccg

SEQ ID NO: 3588829 - RNA, 19 nt, Pseudomonas putida KT2440
cacgauaccggcgccgccc

SEQ ID NO: 3588830 - RNA, 22 nt, Pseudomonas putida KT2440
cacgauagcgucagcagggcca

SEQ ID NO: 3588831 - RNA, 13 nt, Pseudomonas putida KT2440
cacgaucacucgu

SEQ ID NO: 3588832 - RNA, 15 nt, Pseudomonas putida KT2440
cacgaucagcagcaa

SEQ ID NO: 3588833 - RNA, 14 nt, Pseudomonas putida KT2440
cacgauccccacca

SEQ ID NO: 3588834 - RNA, 14 nt, Pseudomonas putida KT2440
cacgaucgccaacc

SEQ ID NO: 3588835 - RNA, 20 nt, Pseudomonas putida KT2440
cacgaucgccaaccccaacc

SEQ ID NO: 3588836 - RNA, 16 nt, Pseudomonas putida KT2440
cacgaucucacgcgcc

SEQ ID NO: 3588837 - RNA, 17 nt, Pseudomonas putida KT2440
cacgaucucacgcgcca

SEQ ID NO: 3588838 - RNA, 15 nt, Pseudomonas putida KT2440
cacgaucuuggccag

SEQ ID NO: 3588839 - RNA, 21 nt, Pseudomonas putida KT2440
cacgaugaaauacagcucgau

SEQ ID NO: 3588840 - RNA, 15 nt, Pseudomonas putida KT2440
cacgaugaucugccg

SEQ ID NO: 3588841 - RNA, 21 nt, Pseudomonas putida KT2440
cacgaugaucugccguuguuc

SEQ ID NO: 3588842 - RNA, 18 nt, Pseudomonas putida KT2440
cacgaugcccauggcgca

SEQ ID NO: 3588843 - RNA, 19 nt, Pseudomonas putida KT2440
cacgaugccuucgaccacc

SEQ ID NO: 3588844 - RNA, 20 nt, Pseudomonas putida KT2440
cacgauggucacccgcgacc

SEQ ID NO: 3588845 - RNA, 15 nt, Pseudomonas putida KT2440
cacgcaacaggucga

SEQ ID NO: 3588846 - RNA, 13 nt, Pseudomonas putida KT2440
cacgcaagcgccu

SEQ ID NO: 3588847 - RNA, 17 nt, Pseudomonas putida KT2440
cacgcaagcggcccuga

SEQ ID NO: 3588848 - RNA, 15 nt, Pseudomonas putida KT2440
cacgcaccaccccgg

SEQ ID NO: 3588849 - RNA, 21 nt, Pseudomonas putida KT2440
cacgcaccaugucccaguuca

SEQ ID NO: 3588850 - RNA, 15 nt, Pseudomonas putida KT2440
cacgcacggccuucc

SEQ ID NO: 3588851 - RNA, 21 nt, Pseudomonas putida KT2440
cacgcagccaguucgacaggu

SEQ ID NO: 3588852 - RNA, 23 nt, Pseudomonas putida KT2440
cacggaucagccgcgggcgucgc

SEQ ID NO: 3588853 - RNA, 18 nt, Pseudomonas putida KT2440
cacggcaagccacgccag

SEQ ID NO: 3588854 - RNA, 13 nt, Pseudomonas putida KT2440
cacggcaagccug

SEQ ID NO: 3588855 - RNA, 15 nt, Pseudomonas putida KT2440
cacggcaaucggcag

SEQ ID NO: 3588856 - RNA, 19 nt, Pseudomonas putida KT2440
cacggcaaucggcaggccg

SEQ ID NO: 3588857 - RNA, 20 nt, Pseudomonas putida KT2440
cacggcaauugccaccggcg

SEQ ID NO: 3588858 - RNA, 22 nt, Pseudomonas putida KT2440
cacggcaauugccaccggcgcu

SEQ ID NO: 3588859 - RNA, 13 nt, Pseudomonas putida KT2440
cacggcaccagca

SEQ ID NO: 3588860 - RNA, 22 nt, Pseudomonas putida KT2440
cacggcagcaaucgccgccugg

SEQ ID NO: 3588861 - RNA, 19 nt, Pseudomonas putida KT2440
cacggcauccccgccagug

SEQ ID NO: 3588862 - RNA, 17 nt, Pseudomonas putida KT2440
cacggccgaguccuugc

SEQ ID NO: 3588863 - RNA, 14 nt, Pseudomonas putida KT2440
cacggccuggccug

SEQ ID NO: 3588864 - RNA, 17 nt, Pseudomonas putida KT2440
cacggcgaacaccccga

SEQ ID NO: 3588865 - RNA, 23 nt, Pseudomonas putida KT2440
cacggcgaugcgccccccaggcg

SEQ ID NO: 3588866 - RNA, 20 nt, Pseudomonas putida KT2440
cacggcgauggucugcucca

SEQ ID NO: 3588867 - RNA, 14 nt, Pseudomonas putida KT2440
cacggcgcaggccg

SEQ ID NO: 3588868 - RNA, 21 nt, Pseudomonas putida KT2440
cacggcgcgcuucagggucgg

SEQ ID NO: 3588869 - RNA, 13 nt, Pseudomonas putida KT2440
cacggcgcugacc

SEQ ID NO: 3588870 - RNA, 20 nt, Pseudomonas putida KT2440
cacggcggaaggcgucacgc

SEQ ID NO: 3588871 - RNA, 18 nt, Pseudomonas putida KT2440
cacggcggcauccaggcg

SEQ ID NO: 3588872 - RNA, 17 nt, Pseudomonas putida KT2440
cacggcgguucugcgca

SEQ ID NO: 3588873 - RNA, 23 nt, Pseudomonas putida KT2440
cacggcgguucugcgcacgacca

SEQ ID NO: 3588874 - RNA, 20 nt, Pseudomonas putida KT2440
cacggcguccaggcccgcca

SEQ ID NO: 3588875 - RNA, 15 nt, Pseudomonas putida KT2440
cacggcgucgagcag

SEQ ID NO: 3588876 - RNA, 17 nt, Pseudomonas putida KT2440
cacggcgugcuccacaa

SEQ ID NO: 3588877 - RNA, 14 nt, Pseudomonas putida KT2440
cacggcguggugcu

SEQ ID NO: 3588878 - RNA, 18 nt, Pseudomonas putida KT2440
cacggcuaaagccgcacc

SEQ ID NO: 3588879 - RNA, 12 nt, Pseudomonas putida KT2440
cacggcugucac

SEQ ID NO: 3588880 - RNA, 14 nt, Pseudomonas putida KT2440
cacggcugucacca

SEQ ID NO: 3588881 - RNA, 15 nt, Pseudomonas putida KT2440
cacggcuucgcgcau

SEQ ID NO: 3588882 - RNA, 12 nt, Pseudomonas putida KT2440
cacgggcacacu

SEQ ID NO: 3588883 - RNA, 13 nt, Pseudomonas putida KT2440
cacgggcaggccc

SEQ ID NO: 3588884 - RNA, 16 nt, Pseudomonas putida KT2440
cacgggcuucguccgu

SEQ ID NO: 3588885 - RNA, 23 nt, Pseudomonas putida KT2440
cacggguaagccggcggccaucg

SEQ ID NO: 3588886 - RNA, 18 nt, Pseudomonas putida KT2440
cacggguauagccaugca

SEQ ID NO: 3588887 - RNA, 13 nt, Pseudomonas putida KT2440
cacgggucaccac

SEQ ID NO: 3588888 - RNA, 14 nt, Pseudomonas putida KT2440
cacgggucaugcca

SEQ ID NO: 3588889 - RNA, 23 nt, Pseudomonas putida KT2440
cacgguagccagucugcuccacc

SEQ ID NO: 3588890 - RNA, 22 nt, Pseudomonas putida KT2440
cacgguaggccuugaccagcuu

SEQ ID NO: 3588891 - RNA, 17 nt, Pseudomonas putida KT2440
cacgguaggugaugcgg

SEQ ID NO: 3588892 - RNA, 15 nt, Pseudomonas putida KT2440
cacggucagcaucca

SEQ ID NO: 3588893 - RNA, 20 nt, Pseudomonas putida KT2440
cacgguccaucaggugcagc

SEQ ID NO: 3588894 - RNA, 18 nt, Pseudomonas putida KT2440
cacggucggccugcgcuc

SEQ ID NO: 3588895 - RNA, 20 nt, Pseudomonas putida KT2440
cacggucggccugcgcucca

SEQ ID NO: 3588896 - RNA, 23 nt, Pseudomonas putida KT2440
cacggucggccugcgcuccagca

SEQ ID NO: 3588897 - RNA, 20 nt, Pseudomonas putida KT2440
cacggugacaaaggccggca

SEQ ID NO: 3588898 - RNA, 14 nt, Pseudomonas putida KT2440
cacggugccgaaca

SEQ ID NO: 3588899 - RNA, 12 nt, Pseudomonas putida KT2440
cacggugguggu

SEQ ID NO: 3588900 - RNA, 17 nt, Pseudomonas putida KT2440
cacgguguccgccgccg

SEQ ID NO: 3588901 - RNA, 19 nt, Pseudomonas putida KT2440
cacgguguccgccgccguc

SEQ ID NO: 3588902 - RNA, 17 nt, Pseudomonas putida KT2440
cacggugucggacaggu

SEQ ID NO: 3588903 - RNA, 17 nt, Pseudomonas putida KT2440
cacgguugcgcccggcg

SEQ ID NO: 3588904 - RNA, 23 nt, Pseudomonas putida KT2440
cacguagcgcccgucuggcugca

SEQ ID NO: 3588905 - RNA, 17 nt, Pseudomonas putida KT2440
cacguagcucaauuucu

SEQ ID NO: 3588906 - RNA, 20 nt, Pseudomonas putida KT2440
cacguaguaauccggcaacu

SEQ ID NO: 3588907 - RNA, 12 nt, Pseudomonas putida KT2440
cacgucacccac

SEQ ID NO: 3588908 - RNA, 14 nt, Pseudomonas putida KT2440
cacgucacgcacca

SEQ ID NO: 3588909 - RNA, 22 nt, Pseudomonas putida KT2440
cacguccagccccgcaccgcgg

SEQ ID NO: 3588910 - RNA, 13 nt, Pseudomonas putida KT2440
cacguccgaugcc

SEQ ID NO: 3588911 - RNA, 18 nt, Pseudomonas putida KT2440
cacguccguuccugcagu

SEQ ID NO: 3588912 - RNA, 22 nt, Pseudomonas putida KT2440
cacguccuucggagguagccac

SEQ ID NO: 3588913 - RNA, 14 nt, Pseudomonas putida KT2440
cacgucuuccuggc

SEQ ID NO: 3588914 - RNA, 14 nt, Pseudomonas putida KT2440
cacgugcacggguu

SEQ ID NO: 3588915 - RNA, 15 nt, Pseudomonas putida KT2440
cacgugccuucacca

SEQ ID NO: 3588916 - RNA, 21 nt, Pseudomonas putida KT2440
cacgugggucgggaacagcuc

SEQ ID NO: 3588917 - RNA, 15 nt, Pseudomonas putida KT2440
cacguucaacgccgu

SEQ ID NO: 3588918 - RNA, 20 nt, Pseudomonas putida KT2440
cacguucacgcaagcgccug

SEQ ID NO: 3588919 - RNA, 21 nt, Pseudomonas putida KT2440
cacguucgggcauugcucacu

SEQ ID NO: 3588920 - RNA, 14 nt, Pseudomonas putida KT2440
cacguucugcagcc

SEQ ID NO: 3588921 - RNA, 18 nt, Pseudomonas putida KT2440
cacguugcugccugugcc

SEQ ID NO: 3588922 - RNA, 20 nt, Pseudomonas putida KT2440
cacguugcugccugugccgg

SEQ ID NO: 3588923 - RNA, 20 nt, Pseudomonas putida KT2440
cacguuguagcccaccaccu

SEQ ID NO: 3588924 - RNA, 22 nt, Pseudomonas putida KT2440
cacguuugcucaggcgggcagc

SEQ ID NO: 3588925 - RNA, 22 nt, Pseudomonas putida KT2440
cacuaagaagcaaccgcugcau

SEQ ID NO: 3588926 - RNA, 14 nt, Pseudomonas putida KT2440
cacuaagcgaaaca

SEQ ID NO: 3588927 - RNA, 18 nt, Pseudomonas putida KT2440
cacuaccguauucgcggg

SEQ ID NO: 3588928 - RNA, 15 nt, Pseudomonas putida KT2440
cacuaccuccagccc

SEQ ID NO: 3588929 - RNA, 20 nt, Pseudomonas putida KT2440
cacuacgccggccaagguca

SEQ ID NO: 3588930 - RNA, 16 nt, Pseudomonas putida KT2440
cacucaaccaccgcuc

SEQ ID NO: 3588931 - RNA, 11 nt, Pseudomonas putida KT2440
cacucaccgca

SEQ ID NO: 3588932 - RNA, 17 nt, Pseudomonas putida KT2440
cacucaccgcacaggca

SEQ ID NO: 3588933 - RNA, 24 nt, Pseudomonas putida KT2440
cacucaccgcacaggcauaccgca

SEQ ID NO: 3588934 - RNA, 15 nt, Pseudomonas putida KT2440
cacucaccgcgccca

SEQ ID NO: 3588935 - RNA, 16 nt, Pseudomonas putida KT2440
cacucagcggguccuc

SEQ ID NO: 3588936 - RNA, 22 nt, Pseudomonas putida KT2440
cacucaguuaaucagcaacgcc

SEQ ID NO: 3588937 - RNA, 16 nt, Pseudomonas putida KT2440
cacucauaaugaaaac

SEQ ID NO: 3588938 - RNA, 13 nt, Pseudomonas putida KT2440
cacuccagcgagu

SEQ ID NO: 3588939 - RNA, 19 nt, Pseudomonas putida KT2440
cacuccagucggcauccuc

SEQ ID NO: 3588940 - RNA, 22 nt, Pseudomonas putida KT2440
cacucccauguagaccaccagc

SEQ ID NO: 3588941 - RNA, 22 nt, Pseudomonas putida KT2440
cacucccgggaucaccgcaagc

SEQ ID NO: 3588942 - RNA, 23 nt, Pseudomonas putida KT2440
cacuccgcccguaugcauccgcc

SEQ ID NO: 3588943 - RNA, 13 nt, Pseudomonas putida KT2440
cacucgcgcagca

SEQ ID NO: 3588944 - RNA, 15 nt, Pseudomonas putida KT2440
cacucgcgcagcaca

SEQ ID NO: 3588945 - RNA, 16 nt, Pseudomonas putida KT2440
cacucgcgcagcacau

SEQ ID NO: 3588946 - RNA, 12 nt, Pseudomonas putida KT2440
cacucgcggcca

SEQ ID NO: 3588947 - RNA, 15 nt, Pseudomonas putida KT2440
cacucgcggccauga

SEQ ID NO: 3588948 - RNA, 17 nt, Pseudomonas putida KT2440
cacucguccgggcgcca

SEQ ID NO: 3588949 - RNA, 16 nt, Pseudomonas putida KT2440
cacucguuucacagca

SEQ ID NO: 3588950 - RNA, 20 nt, Pseudomonas putida KT2440
cacucguuucacagcacaag

SEQ ID NO: 3588951 - RNA, 20 nt, Pseudomonas putida KT2440
cacucugccgccccuccacc

SEQ ID NO: 3588952 - RNA, 12 nt, Pseudomonas putida KT2440
cacucugggcuu

SEQ ID NO: 3588953 - RNA, 14 nt, Pseudomonas putida KT2440
cacucugggcuuug

SEQ ID NO: 3588954 - RNA, 22 nt, Pseudomonas putida KT2440
cacucugggcuuugaaagguuu

SEQ ID NO: 3588955 - RNA, 14 nt, Pseudomonas putida KT2440
cacugaacagcgcc

SEQ ID NO: 3588956 - RNA, 15 nt, Pseudomonas putida KT2440
cacugaacgcaauau

SEQ ID NO: 3588957 - RNA, 19 nt, Pseudomonas putida KT2440
cacuugggaucgaugcacg

SEQ ID NO: 3588958 - RNA, 22 nt, Pseudomonas putida KT2440
cacuugguggcguccacgaccg

SEQ ID NO: 3588959 - RNA, 19 nt, Pseudomonas putida KT2440
cacuugucccggcccagcc

SEQ ID NO: 3588960 - RNA, 21 nt, Pseudomonas putida KT2440
cacuugucccggcccagccgc

SEQ ID NO: 3588961 - RNA, 15 nt, Pseudomonas putida KT2440
cacuuucagcgccug

SEQ ID NO: 3588962 - RNA, 13 nt, Pseudomonas putida KT2440
cacuuucuugaaa

SEQ ID NO: 3588963 - RNA, 14 nt, Pseudomonas putida KT2440
cacuuugucgaugc

SEQ ID NO: 3588964 - RNA, 20 nt, Pseudomonas putida KT2440
cacuuuugccaccacccggg

SEQ ID NO: 3588965 - RNA, 17 nt, Pseudomonas putida KT2440
cagaaaaaacagugccg

SEQ ID NO: 3588966 - RNA, 15 nt, Pseudomonas putida KT2440
cagaaaaucaggggu

SEQ ID NO: 3588967 - RNA, 23 nt, Pseudomonas putida KT2440
cagaaacgagcaagccugccguu

SEQ ID NO: 3588968 - RNA, 12 nt, Pseudomonas putida KT2440
cagaaacgccau

SEQ ID NO: 3588969 - RNA, 19 nt, Pseudomonas putida KT2440
cagaaacggcuugaacccg

SEQ ID NO: 3588970 - RNA, 11 nt, Pseudomonas putida KT2440
cagaaagccac

SEQ ID NO: 3588971 - RNA, 21 nt, Pseudomonas putida KT2440
cagaaaguuugguuuuuucac

SEQ ID NO: 3588972 - RNA, 21 nt, Pseudomonas putida KT2440
cagaacacaucgguacgccgc

SEQ ID NO: 3588973 - RNA, 15 nt, Pseudomonas putida KT2440
cagaacaccaccagu

SEQ ID NO: 3588974 - RNA, 16 nt, Pseudomonas putida KT2440
cagaacaucaggucug

SEQ ID NO: 3588975 - RNA, 16 nt, Pseudomonas putida KT2440
cagaacauggccgagc

SEQ ID NO: 3588976 - RNA, 15 nt, Pseudomonas putida KT2440
cagaaccccggcccu

SEQ ID NO: 3588977 - RNA, 14 nt, Pseudomonas putida KT2440
cagaaccgccagca

SEQ ID NO: 3588978 - RNA, 16 nt, Pseudomonas putida KT2440
cagaacgccuuguucc

SEQ ID NO: 3588979 - RNA, 21 nt, Pseudomonas putida KT2440
cagaacggcacgcccauuucc

SEQ ID NO: 3588980 - RNA, 19 nt, Pseudomonas putida KT2440
cagaacggcuucgaugucc

SEQ ID NO: 3588981 - RNA, 13 nt, Pseudomonas putida KT2440
cagaagcagcuga

SEQ ID NO: 3588982 - RNA, 14 nt, Pseudomonas putida KT2440
cagaagccgucgac

SEQ ID NO: 3588983 - RNA, 19 nt, Pseudomonas putida KT2440
cagaagcgcugacugccag

SEQ ID NO: 3588984 - RNA, 20 nt, Pseudomonas putida KT2440
cagaagcgcugacugccagg

SEQ ID NO: 3588985 - RNA, 22 nt, Pseudomonas putida KT2440
cagaaggaagauugaaggggca

SEQ ID NO: 3588986 - RNA, 13 nt, Pseudomonas putida KT2440
cagaaggcugcgu

SEQ ID NO: 3588987 - RNA, 22 nt, Pseudomonas putida KT2440
cagaauagcaagcgccaauugg

SEQ ID NO: 3588988 - RNA, 17 nt, Pseudomonas putida KT2440
cagaaucucaaccaccu

SEQ ID NO: 3588989 - RNA, 22 nt, Pseudomonas putida KT2440
cagaaugugcucggccugggca

SEQ ID NO: 3588990 - RNA, 16 nt, Pseudomonas putida KT2440
cagaauguugcaagga

SEQ ID NO: 3588991 - RNA, 14 nt, Pseudomonas putida KT2440
cagacaaaacgcug

SEQ ID NO: 3588992 - RNA, 15 nt, Pseudomonas putida KT2440
cagacaacgcggcgg

SEQ ID NO: 3588993 - RNA, 14 nt, Pseudomonas putida KT2440
cagacagaagccug

SEQ ID NO: 3588994 - RNA, 11 nt, Pseudomonas putida KT2440
cagaccaccuc

SEQ ID NO: 3588995 - RNA, 21 nt, Pseudomonas putida KT2440
cagaccaccucaucccccggc

SEQ ID NO: 3588996 - RNA, 15 nt, Pseudomonas putida KT2440
cagaccaccugccaa

SEQ ID NO: 3588997 - RNA, 13 nt, Pseudomonas putida KT2440
cagaccagcagca

SEQ ID NO: 3588998 - RNA, 16 nt, Pseudomonas putida KT2440
cagaccagcagcagug

SEQ ID NO: 3588999 - RNA, 18 nt, Pseudomonas putida KT2440
cagaccagcagcaguggc

SEQ ID NO: 3589000 - RNA, 19 nt, Pseudomonas putida KT2440
cagaccagcagcaguggca

SEQ ID NO: 3589001 - RNA, 20 nt, Pseudomonas putida KT2440
cagacccugacucaugccuu

SEQ ID NO: 3589002 - RNA, 21 nt, Pseudomonas putida KT2440
cagaccgccgaucgaagcagc

SEQ ID NO: 3589003 - RNA, 19 nt, Pseudomonas putida KT2440
cagaccgccgggcccaggc

SEQ ID NO: 3589004 - RNA, 17 nt, Pseudomonas putida KT2440
cagaccuccgucugcuc

SEQ ID NO: 3589005 - RNA, 19 nt, Pseudomonas putida KT2440
cagaccuccgucugcucug

SEQ ID NO: 3589006 - RNA, 15 nt, Pseudomonas putida KT2440
cagaccugcuggcac

SEQ ID NO: 3589007 - RNA, 13 nt, Pseudomonas putida KT2440
cagaccuugcgca

SEQ ID NO: 3589008 - RNA, 15 nt, Pseudomonas putida KT2440
cagacgaccagcaug

SEQ ID NO: 3589009 - RNA, 17 nt, Pseudomonas putida KT2440
cagacgaccagcaugcg

SEQ ID NO: 3589010 - RNA, 19 nt, Pseudomonas putida KT2440
cagacgcgcagcacuuccu

SEQ ID NO: 3589011 - RNA, 15 nt, Pseudomonas putida KT2440
cagacgcgcgcuggc

SEQ ID NO: 3589012 - RNA, 16 nt, Pseudomonas putida KT2440
cagacgcggaacuggc

SEQ ID NO: 3589013 - RNA, 22 nt, Pseudomonas putida KT2440
cagacgggcgacggaucggcac

SEQ ID NO: 3589014 - RNA, 16 nt, Pseudomonas putida KT2440
cagacggugcgccuga

SEQ ID NO: 3589015 - RNA, 14 nt, Pseudomonas putida KT2440
cagacgucuuccau

SEQ ID NO: 3589016 - RNA, 12 nt, Pseudomonas putida KT2440
cagacuaccaac

SEQ ID NO: 3589017 - RNA, 17 nt, Pseudomonas putida KT2440
cagacucaaucaggcag

SEQ ID NO: 3589018 - RNA, 18 nt, Pseudomonas putida KT2440
cagacucaaucaggcagc

SEQ ID NO: 3589019 - RNA, 17 nt, Pseudomonas putida KT2440
cagacucagcugcugcu

SEQ ID NO: 3589020 - RNA, 16 nt, Pseudomonas putida KT2440
cagacuucgaagugcc

SEQ ID NO: 3589021 - RNA, 17 nt, Pseudomonas putida KT2440
cagacuucgaagugcca

SEQ ID NO: 3589022 - RNA, 18 nt, Pseudomonas putida KT2440
cagacuucgcugucuucc

SEQ ID NO: 3589023 - RNA, 23 nt, Pseudomonas putida KT2440
cagacuuuccugaaaccccgccc

SEQ ID NO: 3589024 - RNA, 14 nt, Pseudomonas putida KT2440
cagagaagccgcac

SEQ ID NO: 3589025 - RNA, 21 nt, Pseudomonas putida KT2440
cagagaauuucuccccagcau

SEQ ID NO: 3589026 - RNA, 13 nt, Pseudomonas putida KT2440
cagagagauugag

SEQ ID NO: 3589027 - RNA, 20 nt, Pseudomonas putida KT2440
cagagcaaccagcagaucau

SEQ ID NO: 3589028 - RNA, 19 nt, Pseudomonas putida KT2440
cagagcauggccagccggc

SEQ ID NO: 3589029 - RNA, 11 nt, Pseudomonas putida KT2440
cagagccgcaa

SEQ ID NO: 3589030 - RNA, 19 nt, Pseudomonas putida KT2440
cagagccggugccauccac

SEQ ID NO: 3589031 - RNA, 15 nt, Pseudomonas putida KT2440
cagagccugcaccca

SEQ ID NO: 3589032 - RNA, 18 nt, Pseudomonas putida KT2440
cagagcgccagcaagcgc

SEQ ID NO: 3589033 - RNA, 19 nt, Pseudomonas putida KT2440
cagagcgccagcaagcgca

SEQ ID NO: 3589034 - RNA, 16 nt, Pseudomonas putida KT2440
cagagcgcccaccaau

SEQ ID NO: 3589035 - RNA, 17 nt, Pseudomonas putida KT2440
cagagcgcccaccaauu

SEQ ID NO: 3589036 - RNA, 12 nt, Pseudomonas putida KT2440
cagagcgcgcca

SEQ ID NO: 3589037 - RNA, 16 nt, Pseudomonas putida KT2440
cagagcgcgccacgca

SEQ ID NO: 3589038 - RNA, 23 nt, Pseudomonas putida KT2440
cagagcgcgccacgcaccagggc

SEQ ID NO: 3589039 - RNA, 21 nt, Pseudomonas putida KT2440
cagaggcccccuuauggacuu

SEQ ID NO: 3589040 - RNA, 12 nt, Pseudomonas putida KT2440
cagaggccucaa

SEQ ID NO: 3589041 - RNA, 20 nt, Pseudomonas putida KT2440
cagaggcguagcaagcagau

SEQ ID NO: 3589042 - RNA, 22 nt, Pseudomonas putida KT2440
cagagggaagggcgucugcucc

SEQ ID NO: 3589043 - RNA, 23 nt, Pseudomonas putida KT2440
cagagggucuugggucgccacgc

SEQ ID NO: 3589044 - RNA, 13 nt, Pseudomonas putida KT2440
cagaguaaccgcg

SEQ ID NO: 3589045 - RNA, 23 nt, Pseudomonas putida KT2440
cagaguauugaauguugaucgcu

SEQ ID NO: 3589046 - RNA, 15 nt, Pseudomonas putida KT2440
cagauaaaccugcca

SEQ ID NO: 3589047 - RNA, 16 nt, Pseudomonas putida KT2440
cagauaaaccugccac

SEQ ID NO: 3589048 - RNA, 19 nt, Pseudomonas putida KT2440
cagauaaaccugccaccca

SEQ ID NO: 3589049 - RNA, 23 nt, Pseudomonas putida KT2440
cagauaacccugguacagauggc

SEQ ID NO: 3589050 - RNA, 22 nt, Pseudomonas putida KT2440
cagauaaccuggcucggcuggg

SEQ ID NO: 3589051 - RNA, 13 nt, Pseudomonas putida KT2440
cagauacugcacc

SEQ ID NO: 3589052 - RNA, 15 nt, Pseudomonas putida KT2440
cagauacugcacccu

SEQ ID NO: 3589053 - RNA, 16 nt, Pseudomonas putida KT2440
cagauacugcacccuc

SEQ ID NO: 3589054 - RNA, 14 nt, Pseudomonas putida KT2440
cagauacuggcgcu

SEQ ID NO: 3589055 - RNA, 20 nt, Pseudomonas putida KT2440
cagauagaucaugcaaggua

SEQ ID NO: 3589056 - RNA, 19 nt, Pseudomonas putida KT2440
cagaucaacgccgccagcg

SEQ ID NO: 3589057 - RNA, 16 nt, Pseudomonas putida KT2440
cagaucaccagcucgc

SEQ ID NO: 3589058 - RNA, 17 nt, Pseudomonas putida KT2440
cagaucacccuuggcca

SEQ ID NO: 3589059 - RNA, 19 nt, Pseudomonas putida KT2440
cagaucacccuuggccacc

SEQ ID NO: 3589060 - RNA, 16 nt, Pseudomonas putida KT2440
cagaucacgcaaccuc

SEQ ID NO: 3589061 - RNA, 22 nt, Pseudomonas putida KT2440
cagaucacuuccaccugcgccu

SEQ ID NO: 3589062 - RNA, 23 nt, Pseudomonas putida KT2440
cagcaccaucaggcacaggccag

SEQ ID NO: 3589063 - RNA, 16 nt, Pseudomonas putida KT2440
cagcaccccagcacca

SEQ ID NO: 3589064 - RNA, 18 nt, Pseudomonas putida KT2440
cagcaccccagcaccacc

SEQ ID NO: 3589065 - RNA, 13 nt, Pseudomonas putida KT2440
cagcaccccgucc

SEQ ID NO: 3589066 - RNA, 21 nt, Pseudomonas putida KT2440
cagcacccgcaggcgacgagc

SEQ ID NO: 3589067 - RNA, 12 nt, Pseudomonas putida KT2440
cagcacccgcuu

SEQ ID NO: 3589068 - RNA, 18 nt, Pseudomonas putida KT2440
cagcacccgcuuggccac

SEQ ID NO: 3589069 - RNA, 23 nt, Pseudomonas putida KT2440
cagcacccgcuuggccaccacgu

SEQ ID NO: 3589070 - RNA, 20 nt, Pseudomonas putida KT2440
cagcacccuuccccccuggc

SEQ ID NO: 3589071 - RNA, 23 nt, Pseudomonas putida KT2440
cagcaccgaaccggcgaucaggg

SEQ ID NO: 3589072 - RNA, 14 nt, Pseudomonas putida KT2440
cagcaccgacuggc

SEQ ID NO: 3589073 - RNA, 17 nt, Pseudomonas putida KT2440
cagcaccgacuggcgua

SEQ ID NO: 3589074 - RNA, 21 nt, Pseudomonas putida KT2440
cagcaccgagucgccuucaca

SEQ ID NO: 3589075 - RNA, 13 nt, Pseudomonas putida KT2440
cagcaccgauuca

SEQ ID NO: 3589076 - RNA, 17 nt, Pseudomonas putida KT2440
cagcaccgccauggcca

SEQ ID NO: 3589077 - RNA, 18 nt, Pseudomonas putida KT2440
cagcaccgcugccagcug

SEQ ID NO: 3589078 - RNA, 15 nt, Pseudomonas putida KT2440
cagcaccggccaggc

SEQ ID NO: 3589079 - RNA, 16 nt, Pseudomonas putida KT2440
cagcaccggccaggcu

SEQ ID NO: 3589080 - RNA, 23 nt, Pseudomonas putida KT2440
cagcaccgggcgggugcauggcu

SEQ ID NO: 3589081 - RNA, 14 nt, Pseudomonas putida KT2440
cagcaccgugggcg

SEQ ID NO: 3589082 - RNA, 13 nt, Pseudomonas putida KT2440
cagcaccuccacc

SEQ ID NO: 3589083 - RNA, 14 nt, Pseudomonas putida KT2440
cagcaccuccugca

SEQ ID NO: 3589084 - RNA, 14 nt, Pseudomonas putida KT2440
cagcaccugacgca

SEQ ID NO: 3589085 - RNA, 17 nt, Pseudomonas putida KT2440
cagcaccugacgcaagc

SEQ ID NO: 3589086 - RNA, 23 nt, Pseudomonas putida KT2440
cagcaccugacgcaagcgcgccg

SEQ ID NO: 3589087 - RNA, 13 nt, Pseudomonas putida KT2440
cagcaccugcagg

SEQ ID NO: 3589088 - RNA, 17 nt, Pseudomonas putida KT2440
cagcaccugcagguaca

SEQ ID NO: 3589089 - RNA, 18 nt, Pseudomonas putida KT2440
cagcaccugcagguacag

SEQ ID NO: 3589090 - RNA, 14 nt, Pseudomonas putida KT2440
cagcaccugccagc

SEQ ID NO: 3589091 - RNA, 18 nt, Pseudomonas putida KT2440
cagcaccugccagccgca

SEQ ID NO: 3589092 - RNA, 14 nt, Pseudomonas putida KT2440
cagcaccugccgcu

SEQ ID NO: 3589093 - RNA, 14 nt, Pseudomonas putida KT2440
cagcacgaacagca

SEQ ID NO: 3589094 - RNA, 18 nt, Pseudomonas putida KT2440
cagcacgaucagcgcggc

SEQ ID NO: 3589095 - RNA, 16 nt, Pseudomonas putida KT2440
cagcacgaugacgaac

SEQ ID NO: 3589096 - RNA, 17 nt, Pseudomonas putida KT2440
cagcacgauggcggucg

SEQ ID NO: 3589097 - RNA, 14 nt, Pseudomonas putida KT2440
cagcacgcaggcca

SEQ ID NO: 3589098 - RNA, 15 nt, Pseudomonas putida KT2440
cagcacgcaggccag

SEQ ID NO: 3589099 - RNA, 16 nt, Pseudomonas putida KT2440
cagcacgcaggccagc

SEQ ID NO: 3589100 - RNA, 19 nt, Pseudomonas putida KT2440
cagcacgcccaucagcgcc

SEQ ID NO: 3589101 - RNA, 21 nt, Pseudomonas putida KT2440
cagcacgcccaucagcgccgc

SEQ ID NO: 3589102 - RNA, 23 nt, Pseudomonas putida KT2440
cagcacgcccaucagcgccgcca

SEQ ID NO: 3589103 - RNA, 22 nt, Pseudomonas putida KT2440
cagcacgccgccgauaccgaac

SEQ ID NO: 3589104 - RNA, 20 nt, Pseudomonas putida KT2440
cagcacgccguugcggucgg

SEQ ID NO: 3589105 - RNA, 20 nt, Pseudomonas putida KT2440
cagcacgcgaucggcagcga

SEQ ID NO: 3589106 - RNA, 18 nt, Pseudomonas putida KT2440
cagcacgggcacacuggc

SEQ ID NO: 3589107 - RNA, 20 nt, Pseudomonas putida KT2440
cagcacgggcacacuggcca

SEQ ID NO: 3589108 - RNA, 22 nt, Pseudomonas putida KT2440
cagcacgggcagcuugcguuug

SEQ ID NO: 3589109 - RNA, 17 nt, Pseudomonas putida KT2440
cagcacugcauuggcca

SEQ ID NO: 3589110 - RNA, 19 nt, Pseudomonas putida KT2440
cagcacugcauuggccacg

SEQ ID NO: 3589111 - RNA, 21 nt, Pseudomonas putida KT2440
cagcacugcauuggccacgcc

SEQ ID NO: 3589112 - RNA, 18 nt, Pseudomonas putida KT2440
cagcacugccagcccggc

SEQ ID NO: 3589113 - RNA, 19 nt, Pseudomonas putida KT2440
cagcacugccugcaugcgu

SEQ ID NO: 3589114 - RNA, 22 nt, Pseudomonas putida KT2440
cagcacugccugcaugcgugcc

SEQ ID NO: 3589115 - RNA, 20 nt, Pseudomonas putida KT2440
cagcacugccuugcccugca

SEQ ID NO: 3589116 - RNA, 12 nt, Pseudomonas putida KT2440
cagcacugcugc

SEQ ID NO: 3589117 - RNA, 13 nt, Pseudomonas putida KT2440
cagcacugcugcg

SEQ ID NO: 3589118 - RNA, 15 nt, Pseudomonas putida KT2440
cagcacugcugcgca

SEQ ID NO: 3589119 - RNA, 21 nt, Pseudomonas putida KT2440
cagcacugugcucgcccgggu

SEQ ID NO: 3589120 - RNA, 17 nt, Pseudomonas putida KT2440
cagcacuucgaucaggc

SEQ ID NO: 3589121 - RNA, 17 nt, Pseudomonas putida KT2440
cagcacuucguccaggg

SEQ ID NO: 3589122 - RNA, 16 nt, Pseudomonas putida KT2440
cagcacuugcuugaca

SEQ ID NO: 3589123 - RNA, 18 nt, Pseudomonas putida KT2440
cagcacuugcuugacagc

SEQ ID NO: 3589124 - RNA, 20 nt, Pseudomonas putida KT2440
cagcacuuuugccaccaccc

SEQ ID NO: 3589125 - RNA, 20 nt, Pseudomonas putida KT2440
cagcagacugaauuggccgg

SEQ ID NO: 3589126 - RNA, 14 nt, Pseudomonas putida KT2440
cagcagagagauug

SEQ ID NO: 3589127 - RNA, 18 nt, Pseudomonas putida KT2440
cagcagagagauugagag

SEQ ID NO: 3589128 - RNA, 22 nt, Pseudomonas putida KT2440
cagcagcaaugccgaacaguca

SEQ ID NO: 3589129 - RNA, 20 nt, Pseudomonas putida KT2440
cagcagcaccgaggcgugau

SEQ ID NO: 3589130 - RNA, 17 nt, Pseudomonas putida KT2440
cagcagcaccgccacca

SEQ ID NO: 3589131 - RNA, 20 nt, Pseudomonas putida KT2440
cagcagcaccgccaccaugc

SEQ ID NO: 3589132 - RNA, 14 nt, Pseudomonas putida KT2440
cagcagcagcccca

SEQ ID NO: 3589133 - RNA, 17 nt, Pseudomonas putida KT2440
cagcagcagccccagcg

SEQ ID NO: 3589134 - RNA, 14 nt, Pseudomonas putida KT2440
cagcagcagcgcac

SEQ ID NO: 3589135 - RNA, 16 nt, Pseudomonas putida KT2440
cagcagcagcgcaccg

SEQ ID NO: 3589136 - RNA, 15 nt, Pseudomonas putida KT2440
cagcagcaggcccgc

SEQ ID NO: 3589137 - RNA, 22 nt, Pseudomonas putida KT2440
cagcagcaggcccgccaccgcc

SEQ ID NO: 3589138 - RNA, 20 nt, Pseudomonas putida KT2440
cagcagcaugaauagcgcac

SEQ ID NO: 3589139 - RNA, 14 nt, Pseudomonas putida KT2440
cagcagccaacgcc

SEQ ID NO: 3589140 - RNA, 14 nt, Pseudomonas putida KT2440
cagcagccccagcg

SEQ ID NO: 3589141 - RNA, 21 nt, Pseudomonas putida KT2440
cagcagccccccuuccgcgug

SEQ ID NO: 3589142 - RNA, 17 nt, Pseudomonas putida KT2440
cagcagccugugcggcu

SEQ ID NO: 3589143 - RNA, 14 nt, Pseudomonas putida KT2440
cagcagcgaagggc

SEQ ID NO: 3589144 - RNA, 24 nt, Pseudomonas putida KT2440
cagcagcgaagggcucaacgccag

SEQ ID NO: 3589145 - RNA, 21 nt, Pseudomonas putida KT2440
cagcagcgacaacgcgaaagc

SEQ ID NO: 3589146 - RNA, 20 nt, Pseudomonas putida KT2440
cagcagcgacaccagcgcac

SEQ ID NO: 3589147 - RNA, 16 nt, Pseudomonas putida KT2440
cagcagcgcauccacc

SEQ ID NO: 3589148 - RNA, 14 nt, Pseudomonas putida KT2440
cagcagcgccgcca

SEQ ID NO: 3589149 - RNA, 15 nt, Pseudomonas putida KT2440
cagcagcgccgccag

SEQ ID NO: 3589150 - RNA, 12 nt, Pseudomonas putida KT2440
cagcagcgccug

SEQ ID NO: 3589151 - RNA, 19 nt, Pseudomonas putida KT2440
cagcagcgcgauaccgacg

SEQ ID NO: 3589152 - RNA, 14 nt, Pseudomonas putida KT2440
cagcagcgcgugcu

SEQ ID NO: 3589153 - RNA, 19 nt, Pseudomonas putida KT2440
cagcagcguuguucaccac

SEQ ID NO: 3589154 - RNA, 19 nt, Pseudomonas putida KT2440
cagcagcucaugcggguca

SEQ ID NO: 3589155 - RNA, 15 nt, Pseudomonas putida KT2440
cagcagcuccacauc

SEQ ID NO: 3589156 - RNA, 21 nt, Pseudomonas putida KT2440
cagcagcuccacaucuugccc

SEQ ID NO: 3589157 - RNA, 14 nt, Pseudomonas putida KT2440
cagcagcuccauac

SEQ ID NO: 3589158 - RNA, 17 nt, Pseudomonas putida KT2440
cagcagcucccgagcca

SEQ ID NO: 3589159 - RNA, 20 nt, Pseudomonas putida KT2440
cagcagcucccgagccagga

SEQ ID NO: 3589160 - RNA, 23 nt, Pseudomonas putida KT2440
cagcagcucccgagccaggaaga

SEQ ID NO: 3589161 - RNA, 21 nt, Pseudomonas putida KT2440
cagcagcuucagccagggcga

SEQ ID NO: 3589162 - RNA, 16 nt, Pseudomonas putida KT2440
cagcagcuucagcuug

SEQ ID NO: 3589163 - RNA, 18 nt, Pseudomonas putida KT2440
cagcagcuucagcuugag

SEQ ID NO: 3589164 - RNA, 14 nt, Pseudomonas putida KT2440
cagcagcuucuggc

SEQ ID NO: 3589165 - RNA, 17 nt, Pseudomonas putida KT2440
cagcagcuucuggcgcg

SEQ ID NO: 3589166 - RNA, 18 nt, Pseudomonas putida KT2440
cagcagcuugaacaacgg

SEQ ID NO: 3589167 - RNA, 13 nt, Pseudomonas putida KT2440
cagcauggccgaa

SEQ ID NO: 3589168 - RNA, 19 nt, Pseudomonas putida KT2440
cagcauggccgaaaccagc

SEQ ID NO: 3589169 - RNA, 22 nt, Pseudomonas putida KT2440
cagcauggccgaaaccagcccc

SEQ ID NO: 3589170 - RNA, 18 nt, Pseudomonas putida KT2440
cagcauggcgucggcgau

SEQ ID NO: 3589171 - RNA, 15 nt, Pseudomonas putida KT2440
cagcaugucccgggu

SEQ ID NO: 3589172 - RNA, 20 nt, Pseudomonas putida KT2440
cagcauguccugcugcaggc

SEQ ID NO: 3589173 - RNA, 21 nt, Pseudomonas putida KT2440
cagcauguccugcugcaggcu

SEQ ID NO: 3589174 - RNA, 15 nt, Pseudomonas putida KT2440
cagcauguucaccag

SEQ ID NO: 3589175 - RNA, 18 nt, Pseudomonas putida KT2440
cagcauuacgcggcagca

SEQ ID NO: 3589176 - RNA, 22 nt, Pseudomonas putida KT2440
cagccaaaaaaaccccagggca

SEQ ID NO: 3589177 - RNA, 14 nt, Pseudomonas putida KT2440
cagccaaaucagcu

SEQ ID NO: 3589178 - RNA, 23 nt, Pseudomonas putida KT2440
cagccaaaucagcuguuugaagc

SEQ ID NO: 3589179 - RNA, 22 nt, Pseudomonas putida KT2440
cagccaacacccucacccacuc

SEQ ID NO: 3589180 - RNA, 18 nt, Pseudomonas putida KT2440
cagccaaccgccccaccc

SEQ ID NO: 3589181 - RNA, 14 nt, Pseudomonas putida KT2440
cagccaacgcccca

SEQ ID NO: 3589182 - RNA, 13 nt, Pseudomonas putida KT2440
cagccaauggcaa

SEQ ID NO: 3589183 - RNA, 15 nt, Pseudomonas putida KT2440
cagccacagcugcug

SEQ ID NO: 3589184 - RNA, 23 nt, Pseudomonas putida KT2440
cagccacagcugcugcagggccc

SEQ ID NO: 3589185 - RNA, 16 nt, Pseudomonas putida KT2440
cagccacauccucugc

SEQ ID NO: 3589186 - RNA, 12 nt, Pseudomonas putida KT2440
cagccacaugcc

SEQ ID NO: 3589187 - RNA, 19 nt, Pseudomonas putida KT2440
cagccacaugccagcuauc

SEQ ID NO: 3589188 - RNA, 16 nt, Pseudomonas putida KT2440
cagccaccaccaugcg

SEQ ID NO: 3589189 - RNA, 15 nt, Pseudomonas putida KT2440
cagccaccacggugg

SEQ ID NO: 3589190 - RNA, 12 nt, Pseudomonas putida KT2440
cagccaccagcu

SEQ ID NO: 3589191 - RNA, 15 nt, Pseudomonas putida KT2440
cagccacccuccgca

SEQ ID NO: 3589192 - RNA, 18 nt, Pseudomonas putida KT2440
cagccacccuccgcacag

SEQ ID NO: 3589193 - RNA, 19 nt, Pseudomonas putida KT2440
cagccaccgacgaacaggg

SEQ ID NO: 3589194 - RNA, 17 nt, Pseudomonas putida KT2440
cagccaccgcacucugc

SEQ ID NO: 3589195 - RNA, 21 nt, Pseudomonas putida KT2440
cagccaccgcacucugcugcu

SEQ ID NO: 3589196 - RNA, 20 nt, Pseudomonas putida KT2440
cagccacgauagcgucagca

SEQ ID NO: 3589197 - RNA, 12 nt, Pseudomonas putida KT2440
cagccacgcccg

SEQ ID NO: 3589198 - RNA, 16 nt, Pseudomonas putida KT2440
cagccacgcccgucac

SEQ ID NO: 3589199 - RNA, 14 nt, Pseudomonas putida KT2440
cagccacgcuggca

SEQ ID NO: 3589200 - RNA, 15 nt, Pseudomonas putida KT2440
cagccacgcuggcac

SEQ ID NO: 3589201 - RNA, 19 nt, Pseudomonas putida KT2440
cagccacggaucaccuggc

SEQ ID NO: 3589202 - RNA, 22 nt, Pseudomonas putida KT2440
cagccacgggcuuuaucgauga

SEQ ID NO: 3589203 - RNA, 13 nt, Pseudomonas putida KT2440
cagccacgucgcc

SEQ ID NO: 3589204 - RNA, 19 nt, Pseudomonas putida KT2440
cagccacgucgccagcggc

SEQ ID NO: 3589205 - RNA, 20 nt, Pseudomonas putida KT2440
cagccacgucgccagcggca

SEQ ID NO: 3589206 - RNA, 20 nt, Pseudomonas putida KT2440
cagccacuuggccccaggga

SEQ ID NO: 3589207 - RNA, 19 nt, Pseudomonas putida KT2440
cagccagaaagccacugca

SEQ ID NO: 3589208 - RNA, 17 nt, Pseudomonas putida KT2440
cagccagacgaccagca

SEQ ID NO: 3589209 - RNA, 19 nt, Pseudomonas putida KT2440
cagccagaugcgcgcugca

SEQ ID NO: 3589210 - RNA, 11 nt, Pseudomonas putida KT2440
cagccagcaga

SEQ ID NO: 3589211 - RNA, 16 nt, Pseudomonas putida KT2440
cagccagcagcguacc

SEQ ID NO: 3589212 - RNA, 18 nt, Pseudomonas putida KT2440
cagccagcaucucggcca

SEQ ID NO: 3589213 - RNA, 16 nt, Pseudomonas putida KT2440
cagccagccaccacca

SEQ ID NO: 3589214 - RNA, 22 nt, Pseudomonas putida KT2440
cagccagccacggaucaccugg

SEQ ID NO: 3589215 - RNA, 23 nt, Pseudomonas putida KT2440
cagccagccccaacccaccagca

SEQ ID NO: 3589216 - RNA, 20 nt, Pseudomonas putida KT2440
cagccagccggcgcaucagu

SEQ ID NO: 3589217 - RNA, 14 nt, Pseudomonas putida KT2440
cagccagccucuuc

SEQ ID NO: 3589218 - RNA, 19 nt, Pseudomonas putida KT2440
cagccagccuucgccaacu

SEQ ID NO: 3589219 - RNA, 14 nt, Pseudomonas putida KT2440
cagccagcgacagc

SEQ ID NO: 3589220 - RNA, 15 nt, Pseudomonas putida KT2440
cagccagcgacagca

SEQ ID NO: 3589221 - RNA, 24 nt, Pseudomonas putida KT2440
cagccagcgacagcaucggcaggu

SEQ ID NO: 3589222 - RNA, 19 nt, Pseudomonas putida KT2440
cagccaggcacagaucaac

SEQ ID NO: 3589223 - RNA, 17 nt, Pseudomonas putida KT2440
cagccaggcacuggcca

SEQ ID NO: 3589224 - RNA, 12 nt, Pseudomonas putida KT2440
cagccaggcuga

SEQ ID NO: 3589225 - RNA, 15 nt, Pseudomonas putida KT2440
cagccagggccugac

SEQ ID NO: 3589226 - RNA, 21 nt, Pseudomonas putida KT2440
cagccaggguguacuucaccu

SEQ ID NO: 3589227 - RNA, 14 nt, Pseudomonas putida KT2440
cagccagguucgga

SEQ ID NO: 3589228 - RNA, 17 nt, Pseudomonas putida KT2440
cagccaguucgacaggu

SEQ ID NO: 3589229 - RNA, 21 nt, Pseudomonas putida KT2440
cagccauaguuuugugccacc

SEQ ID NO: 3589230 - RNA, 18 nt, Pseudomonas putida KT2440
cagccaucaucagguacg

SEQ ID NO: 3589231 - RNA, 19 nt, Pseudomonas putida KT2440
cagccaucgagcaccggcu

SEQ ID NO: 3589232 - RNA, 16 nt, Pseudomonas putida KT2440
cagccauuggcccacg

SEQ ID NO: 3589233 - RNA, 14 nt, Pseudomonas putida KT2440
cagcccaaacagca

SEQ ID NO: 3589234 - RNA, 12 nt, Pseudomonas putida KT2440
cagcccaaggcc

SEQ ID NO: 3589235 - RNA, 17 nt, Pseudomonas putida KT2440
cagcccaaggcuggcca

SEQ ID NO: 3589236 - RNA, 20 nt, Pseudomonas putida KT2440
cagcccaaggcuggccagac

SEQ ID NO: 3589237 - RNA, 12 nt, Pseudomonas putida KT2440
cagcccaccacg

SEQ ID NO: 3589238 - RNA, 15 nt, Pseudomonas putida KT2440
cagcccaccacgaac

SEQ ID NO: 3589239 - RNA, 17 nt, Pseudomonas putida KT2440
cagcccaccgagcuugg

SEQ ID NO: 3589240 - RNA, 15 nt, Pseudomonas putida KT2440
cagcccacggccgcc

SEQ ID NO: 3589241 - RNA, 23 nt, Pseudomonas putida KT2440
cagcccacggccgccaauagccc

SEQ ID NO: 3589242 - RNA, 12 nt, Pseudomonas putida KT2440
cagcccagcgcc

SEQ ID NO: 3589243 - RNA, 14 nt, Pseudomonas putida KT2440
cagcccagcgccag

SEQ ID NO: 3589244 - RNA, 15 nt, Pseudomonas putida KT2440
cagcccagcgccgcc

SEQ ID NO: 3589245 - RNA, 12 nt, Pseudomonas putida KT2440
cagcccauccag

SEQ ID NO: 3589246 - RNA, 12 nt, Pseudomonas putida KT2440
cagcccauuuca

SEQ ID NO: 3589247 - RNA, 17 nt, Pseudomonas putida KT2440
cagcccauuucaccugc

SEQ ID NO: 3589248 - RNA, 19 nt, Pseudomonas putida KT2440
cagcccauuucaccugcuc

SEQ ID NO: 3589249 - RNA, 18 nt, Pseudomonas putida KT2440
cagccccaaaagcccacu

SEQ ID NO: 3589250 - RNA, 23 nt, Pseudomonas putida KT2440
cagccccaacccaccagcacugc

SEQ ID NO: 3589251 - RNA, 22 nt, Pseudomonas putida KT2440
cagccccaaucccaacuccacu

SEQ ID NO: 3589252 - RNA, 18 nt, Pseudomonas putida KT2440
cagccccaccucggcgau

SEQ ID NO: 3589253 - RNA, 17 nt, Pseudomonas putida KT2440
cagccccacgcccaggc

SEQ ID NO: 3589254 - RNA, 14 nt, Pseudomonas putida KT2440
cagccccagcccgc

SEQ ID NO: 3589255 - RNA, 12 nt, Pseudomonas putida KT2440
cagccccagccg

SEQ ID NO: 3589256 - RNA, 12 nt, Pseudomonas putida KT2440
cagccccagccu

SEQ ID NO: 3589257 - RNA, 13 nt, Pseudomonas putida KT2440
cagccccagccuc

SEQ ID NO: 3589258 - RNA, 22 nt, Pseudomonas putida KT2440
cagccccagccucagcuggccg

SEQ ID NO: 3589259 - RNA, 21 nt, Pseudomonas putida KT2440
cagccccagcgccuuggccug

SEQ ID NO: 3589260 - RNA, 13 nt, Pseudomonas putida KT2440
cagccccagcggc

SEQ ID NO: 3589261 - RNA, 18 nt, Pseudomonas putida KT2440
cagccccagcggcaaccu

SEQ ID NO: 3589262 - RNA, 11 nt, Pseudomonas putida KT2440
cagccccaggg

SEQ ID NO: 3589263 - RNA, 14 nt, Pseudomonas putida KT2440
cagccccagggccc

SEQ ID NO: 3589264 - RNA, 15 nt, Pseudomonas putida KT2440
cagccccagggcccu

SEQ ID NO: 3589265 - RNA, 18 nt, Pseudomonas putida KT2440
cagccccaucaccagccc

SEQ ID NO: 3589266 - RNA, 20 nt, Pseudomonas putida KT2440
cagccccaucaccagcccga

SEQ ID NO: 3589267 - RNA, 22 nt, Pseudomonas putida KT2440
cagccccaucaccagcccgaag

SEQ ID NO: 3589268 - RNA, 20 nt, Pseudomonas putida KT2440
cagcccccaacccucacucg

SEQ ID NO: 3589269 - RNA, 18 nt, Pseudomonas putida KT2440
cagcccccaccgggcugg

SEQ ID NO: 3589270 - RNA, 15 nt, Pseudomonas putida KT2440
cagcccccccaaggc

SEQ ID NO: 3589271 - RNA, 13 nt, Pseudomonas putida KT2440
cagcccccccagc

SEQ ID NO: 3589272 - RNA, 16 nt, Pseudomonas putida KT2440
cagcccccccagcaac

SEQ ID NO: 3589273 - RNA, 16 nt, Pseudomonas putida KT2440
cagccguucccgggca

SEQ ID NO: 3589274 - RNA, 21 nt, Pseudomonas putida KT2440
cagccguugauccaggcuugg

SEQ ID NO: 3589275 - RNA, 16 nt, Pseudomonas putida KT2440
cagccguugcgccgcu

SEQ ID NO: 3589276 - RNA, 13 nt, Pseudomonas putida KT2440
cagccguugcugg

SEQ ID NO: 3589277 - RNA, 19 nt, Pseudomonas putida KT2440
cagccguuguacaagcugg

SEQ ID NO: 3589278 - RNA, 20 nt, Pseudomonas putida KT2440
cagccuaccaacgcagcaug

SEQ ID NO: 3589279 - RNA, 21 nt, Pseudomonas putida KT2440
cagccucaaggccggcagcca

SEQ ID NO: 3589280 - RNA, 15 nt, Pseudomonas putida KT2440
cagccucagcuggcc

SEQ ID NO: 3589281 - RNA, 18 nt, Pseudomonas putida KT2440
cagccuccaguugcucca

SEQ ID NO: 3589282 - RNA, 14 nt, Pseudomonas putida KT2440
cagccuccggccca

SEQ ID NO: 3589283 - RNA, 17 nt, Pseudomonas putida KT2440
cagccucuucggccagc

SEQ ID NO: 3589284 - RNA, 18 nt, Pseudomonas putida KT2440
cagccucuucggccagca

SEQ ID NO: 3589285 - RNA, 18 nt, Pseudomonas putida KT2440
cagccucuucuucaaggc

SEQ ID NO: 3589286 - RNA, 19 nt, Pseudomonas putida KT2440
cagccucuucuucaaggcu

SEQ ID NO: 3589287 - RNA, 23 nt, Pseudomonas putida KT2440
cagccucuucuucaaggcugcuc

SEQ ID NO: 3589288 - RNA, 16 nt, Pseudomonas putida KT2440
cagccugacgcgccgc

SEQ ID NO: 3589289 - RNA, 18 nt, Pseudomonas putida KT2440
cagccugacgcgccgcca

SEQ ID NO: 3589290 - RNA, 14 nt, Pseudomonas putida KT2440
cagccugcagcacc

SEQ ID NO: 3589291 - RNA, 15 nt, Pseudomonas putida KT2440
cagccugcagcaccc

SEQ ID NO: 3589292 - RNA, 16 nt, Pseudomonas putida KT2440
cagccugcagcacccu

SEQ ID NO: 3589293 - RNA, 15 nt, Pseudomonas putida KT2440
cagccugcagcgcgg

SEQ ID NO: 3589294 - RNA, 18 nt, Pseudomonas putida KT2440
cagccugcagcgcggcga

SEQ ID NO: 3589295 - RNA, 23 nt, Pseudomonas putida KT2440
cagccugccaggucaccgcccag

SEQ ID NO: 3589296 - RNA, 15 nt, Pseudomonas putida KT2440
cagccugcccgccgu

SEQ ID NO: 3589297 - RNA, 14 nt, Pseudomonas putida KT2440
cagccugugcggcu

SEQ ID NO: 3589298 - RNA, 13 nt, Pseudomonas putida KT2440
cagccuucagugc

SEQ ID NO: 3589299 - RNA, 14 nt, Pseudomonas putida KT2440
cagccuucagugcu

SEQ ID NO: 3589300 - RNA, 18 nt, Pseudomonas putida KT2440
cagccuucagugcuucac

SEQ ID NO: 3589301 - RNA, 19 nt, Pseudomonas putida KT2440
cagccuucagugcuucaca

SEQ ID NO: 3589302 - RNA, 14 nt, Pseudomonas putida KT2440
cagccuucgccaac

SEQ ID NO: 3589303 - RNA, 14 nt, Pseudomonas putida KT2440
cagccuuggguaac

SEQ ID NO: 3589304 - RNA, 16 nt, Pseudomonas putida KT2440
cagccuuuagcgcauc

SEQ ID NO: 3589305 - RNA, 20 nt, Pseudomonas putida KT2440
cagccuuuagcgcaucuucc

SEQ ID NO: 3589306 - RNA, 23 nt, Pseudomonas putida KT2440
cagccuuugaaacggucagcggc

SEQ ID NO: 3589307 - RNA, 19 nt, Pseudomonas putida KT2440
cagcgaaagcaagguagcg

SEQ ID NO: 3589308 - RNA, 23 nt, Pseudomonas putida KT2440
cagcgaacacgaaaaagccagcg

SEQ ID NO: 3589309 - RNA, 15 nt, Pseudomonas putida KT2440
cagcgaauagcaaca

SEQ ID NO: 3589310 - RNA, 17 nt, Pseudomonas putida KT2440
cagcgacaacggcuggc

SEQ ID NO: 3589311 - RNA, 14 nt, Pseudomonas putida KT2440
cagcgacaccagcg

SEQ ID NO: 3589312 - RNA, 17 nt, Pseudomonas putida KT2440
cagcgacagcaucggca

SEQ ID NO: 3589313 - RNA, 17 nt, Pseudomonas putida KT2440
cagcgacagcugcggca

SEQ ID NO: 3589314 - RNA, 13 nt, Pseudomonas putida KT2440
cagcgacaugccg

SEQ ID NO: 3589315 - RNA, 20 nt, Pseudomonas putida KT2440
cagcgacaugccggccacca

SEQ ID NO: 3589316 - RNA, 21 nt, Pseudomonas putida KT2440
cagcgacaugccggccaccac

SEQ ID NO: 3589317 - RNA, 22 nt, Pseudomonas putida KT2440
cagcgacaugccggccaccaca

SEQ ID NO: 3589318 - RNA, 14 nt, Pseudomonas putida KT2440
cagcgacccugagu

SEQ ID NO: 3589319 - RNA, 22 nt, Pseudomonas putida KT2440
cagcgacccugagucuggcgcc

SEQ ID NO: 3589320 - RNA, 15 nt, Pseudomonas putida KT2440
cagcgaccgacacgc

SEQ ID NO: 3589321 - RNA, 14 nt, Pseudomonas putida KT2440
cagcgacgaccugc

SEQ ID NO: 3589322 - RNA, 18 nt, Pseudomonas putida KT2440
cagcgacgguggcguggc

SEQ ID NO: 3589323 - RNA, 20 nt, Pseudomonas putida KT2440
cagcgacugccaaugcucag

SEQ ID NO: 3589324 - RNA, 15 nt, Pseudomonas putida KT2440
cagcgagcagccugg

SEQ ID NO: 3589325 - RNA, 16 nt, Pseudomonas putida KT2440
cagcgagcgggugccg

SEQ ID NO: 3589326 - RNA, 20 nt, Pseudomonas putida KT2440
cagcgagcgguucagcgcac

SEQ ID NO: 3589327 - RNA, 16 nt, Pseudomonas putida KT2440
cagcgaggggacgauc

SEQ ID NO: 3589328 - RNA, 18 nt, Pseudomonas putida KT2440
cagcgaggguuccaggcc

SEQ ID NO: 3589329 - RNA, 23 nt, Pseudomonas putida KT2440
cagcgaggguuccaggccacggu

SEQ ID NO: 3589330 - RNA, 22 nt, Pseudomonas putida KT2440
cagcgagucguaguucggcgga

SEQ ID NO: 3589331 - RNA, 23 nt, Pseudomonas putida KT2440
cagcgagucguaguucggcggaa

SEQ ID NO: 3589332 - RNA, 21 nt, Pseudomonas putida KT2440
cagcgagugcguagccuucag

SEQ ID NO: 3589333 - RNA, 18 nt, Pseudomonas putida KT2440
cagcgauaaaccagcagc

SEQ ID NO: 3589334 - RNA, 21 nt, Pseudomonas putida KT2440
cagcgauaaaccagcagcgcc

SEQ ID NO: 3589335 - RNA, 13 nt, Pseudomonas putida KT2440
cagcgaucagugc

SEQ ID NO: 3589336 - RNA, 15 nt, Pseudomonas putida KT2440
cagcgaucagugccu

SEQ ID NO: 3589337 - RNA, 15 nt, Pseudomonas putida KT2440
cagcgaucaguuccg

SEQ ID NO: 3589338 - RNA, 12 nt, Pseudomonas putida KT2440
cagcgaugaccc

SEQ ID NO: 3589339 - RNA, 15 nt, Pseudomonas putida KT2440
cagcgaugacccggc

SEQ ID NO: 3589340 - RNA, 21 nt, Pseudomonas putida KT2440
cagcgauucaguucaaagcga

SEQ ID NO: 3589341 - RNA, 18 nt, Pseudomonas putida KT2440
cagcgcaaauccccaacc

SEQ ID NO: 3589342 - RNA, 17 nt, Pseudomonas putida KT2440
cagcgcacagcugccgg

SEQ ID NO: 3589343 - RNA, 18 nt, Pseudomonas putida KT2440
cagcgcacagcugccggc

SEQ ID NO: 3589344 - RNA, 23 nt, Pseudomonas putida KT2440
cagcgcacagcugccggccagcg

SEQ ID NO: 3589345 - RNA, 22 nt, Pseudomonas putida KT2440
cagcgcaccacuguucaggugu

SEQ ID NO: 3589346 - RNA, 15 nt, Pseudomonas putida KT2440
cagcgcaccgugcac

SEQ ID NO: 3589347 - RNA, 23 nt, Pseudomonas putida KT2440
cagcgcaccgugcaccagcacca

SEQ ID NO: 3589348 - RNA, 17 nt, Pseudomonas putida KT2440
cagcgcacucucccgca

SEQ ID NO: 3589349 - RNA, 19 nt, Pseudomonas putida KT2440
cagcgcacucucccgcagc

SEQ ID NO: 3589350 - RNA, 18 nt, Pseudomonas putida KT2440
cagcgcacugaacagcgc

SEQ ID NO: 3589351 - RNA, 17 nt, Pseudomonas putida KT2440
cagcgcagaaaccgcau

SEQ ID NO: 3589352 - RNA, 12 nt, Pseudomonas putida KT2440
cagcgcagccac

SEQ ID NO: 3589353 - RNA, 13 nt, Pseudomonas putida KT2440
cagcgcagccacc

SEQ ID NO: 3589354 - RNA, 15 nt, Pseudomonas putida KT2440
cagcgcagccaccag

SEQ ID NO: 3589355 - RNA, 16 nt, Pseudomonas putida KT2440
cagcgcagccaccagc

SEQ ID NO: 3589356 - RNA, 13 nt, Pseudomonas putida KT2440
cagcgcagcuucu

SEQ ID NO: 3589357 - RNA, 19 nt, Pseudomonas putida KT2440
cagcgcagcuucucaagca

SEQ ID NO: 3589358 - RNA, 21 nt, Pseudomonas putida KT2440
cagcgcaggcuucaaggccac

SEQ ID NO: 3589359 - RNA, 17 nt, Pseudomonas putida KT2440
cagcgcagucaccacac

SEQ ID NO: 3589360 - RNA, 14 nt, Pseudomonas putida KT2440
cagcgcauaggcca

SEQ ID NO: 3589361 - RNA, 16 nt, Pseudomonas putida KT2440
cagcgcauaggccaag

SEQ ID NO: 3589362 - RNA, 15 nt, Pseudomonas putida KT2440
cagcgcauccaccuc

SEQ ID NO: 3589363 - RNA, 19 nt, Pseudomonas putida KT2440
cagcgcaucgaccggcagg

SEQ ID NO: 3589364 - RNA, 14 nt, Pseudomonas putida KT2440
cagcgcaucggcca

SEQ ID NO: 3589365 - RNA, 19 nt, Pseudomonas putida KT2440
cagcgcaugcaucugcgcc

SEQ ID NO: 3589366 - RNA, 16 nt, Pseudomonas putida KT2440
cagcgcauggcucaac

SEQ ID NO: 3589367 - RNA, 15 nt, Pseudomonas putida KT2440
cagcgcauugcccgc

SEQ ID NO: 3589368 - RNA, 19 nt, Pseudomonas putida KT2440
cagcgccaacgcccccgcc

SEQ ID NO: 3589369 - RNA, 19 nt, Pseudomonas putida KT2440
cagcgccaauaccgcgcau

SEQ ID NO: 3589370 - RNA, 20 nt, Pseudomonas putida KT2440
cagcgccaauaccgcgcauc

SEQ ID NO: 3589371 - RNA, 12 nt, Pseudomonas putida KT2440
cagcgccaccca

SEQ ID NO: 3589372 - RNA, 15 nt, Pseudomonas putida KT2440
cagcgccaccggcag

SEQ ID NO: 3589373 - RNA, 19 nt, Pseudomonas putida KT2440
cagcgccacgccugcaguc

SEQ ID NO: 3589374 - RNA, 13 nt, Pseudomonas putida KT2440
cagcgccagcagc

SEQ ID NO: 3589375 - RNA, 20 nt, Pseudomonas putida KT2440
cagcgccagcagccgggccu

SEQ ID NO: 3589376 - RNA, 21 nt, Pseudomonas putida KT2440
cagcgccagcagccgggccug

SEQ ID NO: 3589377 - RNA, 14 nt, Pseudomonas putida KT2440
cagcgccagccauu

SEQ ID NO: 3589378 - RNA, 22 nt, Pseudomonas putida KT2440
cagcggccgcgcaauugccggu

SEQ ID NO: 3589379 - RNA, 20 nt, Pseudomonas putida KT2440
cagcggccugugcaugucca

SEQ ID NO: 3589380 - RNA, 18 nt, Pseudomonas putida KT2440
cagcggcgaacggucggu

SEQ ID NO: 3589381 - RNA, 18 nt, Pseudomonas putida KT2440
cagcggcgagucgaucgg

SEQ ID NO: 3589382 - RNA, 14 nt, Pseudomonas putida KT2440
cagcggcgcagcgc

SEQ ID NO: 3589383 - RNA, 16 nt, Pseudomonas putida KT2440
cagcggcgcgaucauc

SEQ ID NO: 3589384 - RNA, 20 nt, Pseudomonas putida KT2440
cagcggcguguaguagcucc

SEQ ID NO: 3589385 - RNA, 14 nt, Pseudomonas putida KT2440
cagcggcuggcgcu

SEQ ID NO: 3589386 - RNA, 17 nt, Pseudomonas putida KT2440
cagcggcuggcgcucgu

SEQ ID NO: 3589387 - RNA, 17 nt, Pseudomonas putida KT2440
cagcggcuuggccgcga

SEQ ID NO: 3589388 - RNA, 20 nt, Pseudomonas putida KT2440
cagcggcuuggccgcgaagc

SEQ ID NO: 3589389 - RNA, 18 nt, Pseudomonas putida KT2440
cagcgggcccagcaggug

SEQ ID NO: 3589390 - RNA, 19 nt, Pseudomonas putida KT2440
cagcgggcgauugccaggg

SEQ ID NO: 3589391 - RNA, 22 nt, Pseudomonas putida KT2440
cagcgggcgauugccagggugc

SEQ ID NO: 3589392 - RNA, 21 nt, Pseudomonas putida KT2440
cagcgggcguaccuggcugcu

SEQ ID NO: 3589393 - RNA, 19 nt, Pseudomonas putida KT2440
cagcgggcuacacgcgccc

SEQ ID NO: 3589394 - RNA, 13 nt, Pseudomonas putida KT2440
cagcgggcucgcc

SEQ ID NO: 3589395 - RNA, 15 nt, Pseudomonas putida KT2440
cagcgggcucgccca

SEQ ID NO: 3589396 - RNA, 17 nt, Pseudomonas putida KT2440
cagcgggcucgcccaca

SEQ ID NO: 3589397 - RNA, 22 nt, Pseudomonas putida KT2440
cagcgggcucgcccacacggca

SEQ ID NO: 3589398 - RNA, 23 nt, Pseudomonas putida KT2440
cagcgggcucgcccacacggcaa

SEQ ID NO: 3589399 - RNA, 16 nt, Pseudomonas putida KT2440
cagcgggcugcccggu

SEQ ID NO: 3589400 - RNA, 20 nt, Pseudomonas putida KT2440
cagcggggauucaacagcgc

SEQ ID NO: 3589401 - RNA, 17 nt, Pseudomonas putida KT2440
cagcgggggcagugccc

SEQ ID NO: 3589402 - RNA, 15 nt, Pseudomonas putida KT2440
cagcggguggucgcu

SEQ ID NO: 3589403 - RNA, 17 nt, Pseudomonas putida KT2440
cagcggguuccccagca

SEQ ID NO: 3589404 - RNA, 22 nt, Pseudomonas putida KT2440
cagcgguagauguagcggguca

SEQ ID NO: 3589405 - RNA, 17 nt, Pseudomonas putida KT2440
cagcggucagcaucuuc

SEQ ID NO: 3589406 - RNA, 15 nt, Pseudomonas putida KT2440
cagcggucugcugcg

SEQ ID NO: 3589407 - RNA, 16 nt, Pseudomonas putida KT2440
cagcggucugcugcgu

SEQ ID NO: 3589408 - RNA, 15 nt, Pseudomonas putida KT2440
cagcgguugagauga

SEQ ID NO: 3589409 - RNA, 16 nt, Pseudomonas putida KT2440
cagcguacacugcagg

SEQ ID NO: 3589410 - RNA, 16 nt, Pseudomonas putida KT2440
cagcguacgcaugguc

SEQ ID NO: 3589411 - RNA, 16 nt, Pseudomonas putida KT2440
cagcguauagccaccg

SEQ ID NO: 3589412 - RNA, 20 nt, Pseudomonas putida KT2440
cagcgucaccccucggcuca

SEQ ID NO: 3589413 - RNA, 12 nt, Pseudomonas putida KT2440
cagcgucaugcg

SEQ ID NO: 3589414 - RNA, 22 nt, Pseudomonas putida KT2440
cagcguccacucaccggcaucg

SEQ ID NO: 3589415 - RNA, 23 nt, Pseudomonas putida KT2440
cagcguccaguucaaugccagca

SEQ ID NO: 3589416 - RNA, 13 nt, Pseudomonas putida KT2440
cagcgucggcaga

SEQ ID NO: 3589417 - RNA, 17 nt, Pseudomonas putida KT2440
cagcgucggcagagcgc

SEQ ID NO: 3589418 - RNA, 21 nt, Pseudomonas putida KT2440
cagcgucggcagagcgccagc

SEQ ID NO: 3589419 - RNA, 23 nt, Pseudomonas putida KT2440
cagcgucucgaugcaauccgcca

SEQ ID NO: 3589420 - RNA, 17 nt, Pseudomonas putida KT2440
cagcgucugcuugccca

SEQ ID NO: 3589421 - RNA, 17 nt, Pseudomonas putida KT2440
cagcgucuuguuguccg

SEQ ID NO: 3589422 - RNA, 18 nt, Pseudomonas putida KT2440
cagcgucuuguuguccgg

SEQ ID NO: 3589423 - RNA, 20 nt, Pseudomonas putida KT2440
cagcgugaccugggccgggu

SEQ ID NO: 3589424 - RNA, 17 nt, Pseudomonas putida KT2440
cagcgugacgauggcca

SEQ ID NO: 3589425 - RNA, 20 nt, Pseudomonas putida KT2440
cagcgugacgauggccacca

SEQ ID NO: 3589426 - RNA, 16 nt, Pseudomonas putida KT2440
cagcgugcccgccaca

SEQ ID NO: 3589427 - RNA, 19 nt, Pseudomonas putida KT2440
cagcgugcccgccacaccu

SEQ ID NO: 3589428 - RNA, 13 nt, Pseudomonas putida KT2440
cagcgugcgcuca

SEQ ID NO: 3589429 - RNA, 13 nt, Pseudomonas putida KT2440
cagcguggccagc

SEQ ID NO: 3589430 - RNA, 17 nt, Pseudomonas putida KT2440
cagcguggccgccaaca

SEQ ID NO: 3589431 - RNA, 14 nt, Pseudomonas putida KT2440
cagcguggccugca

SEQ ID NO: 3589432 - RNA, 15 nt, Pseudomonas putida KT2440
cagcguguuccauca

SEQ ID NO: 3589433 - RNA, 18 nt, Pseudomonas putida KT2440
cagcguguuccaucaccg

SEQ ID NO: 3589434 - RNA, 13 nt, Pseudomonas putida KT2440
cagcguuccuggg

SEQ ID NO: 3589435 - RNA, 23 nt, Pseudomonas putida KT2440
cagcguucgggucaacucaggcu

SEQ ID NO: 3589436 - RNA, 20 nt, Pseudomonas putida KT2440
cagcguugcauuccaucauc

SEQ ID NO: 3589437 - RNA, 14 nt, Pseudomonas putida KT2440
cagcguugcuggcg

SEQ ID NO: 3589438 - RNA, 24 nt, Pseudomonas putida KT2440
cagcguuguucaccacacccggcu

SEQ ID NO: 3589439 - RNA, 19 nt, Pseudomonas putida KT2440
cagcuacgcgagucaacaa

SEQ ID NO: 3589440 - RNA, 20 nt, Pseudomonas putida KT2440
cagcuacgcgagucaacaau

SEQ ID NO: 3589441 - RNA, 15 nt, Pseudomonas putida KT2440
cagcuaucucccagc

SEQ ID NO: 3589442 - RNA, 16 nt, Pseudomonas putida KT2440
cagcuaucucccagcc

SEQ ID NO: 3589443 - RNA, 20 nt, Pseudomonas putida KT2440
cagcuauugagagcagauga

SEQ ID NO: 3589444 - RNA, 14 nt, Pseudomonas putida KT2440
cagcucaacccgcc

SEQ ID NO: 3589445 - RNA, 15 nt, Pseudomonas putida KT2440
cagcucaacccgccu

SEQ ID NO: 3589446 - RNA, 13 nt, Pseudomonas putida KT2440
cagcucaacgcga

SEQ ID NO: 3589447 - RNA, 13 nt, Pseudomonas putida KT2440
cagcucaagcccu

SEQ ID NO: 3589448 - RNA, 14 nt, Pseudomonas putida KT2440
cagcucaagcccug

SEQ ID NO: 3589449 - RNA, 16 nt, Pseudomonas putida KT2440
cagcucaagcccugcc

SEQ ID NO: 3589450 - RNA, 21 nt, Pseudomonas putida KT2440
cagcucaagcccugccgccuu

SEQ ID NO: 3589451 - RNA, 12 nt, Pseudomonas putida KT2440
cagcucacagca

SEQ ID NO: 3589452 - RNA, 13 nt, Pseudomonas putida KT2440
cagcucacagcac

SEQ ID NO: 3589453 - RNA, 14 nt, Pseudomonas putida KT2440
cagcucacagcacu

SEQ ID NO: 3589454 - RNA, 19 nt, Pseudomonas putida KT2440
cagcucacagcacucguug

SEQ ID NO: 3589455 - RNA, 13 nt, Pseudomonas putida KT2440
cagcucaccggca

SEQ ID NO: 3589456 - RNA, 22 nt, Pseudomonas putida KT2440
cagcucacgcaagcggcccuga

SEQ ID NO: 3589457 - RNA, 17 nt, Pseudomonas putida KT2440
cagcucacuggcaucca

SEQ ID NO: 3589458 - RNA, 22 nt, Pseudomonas putida KT2440
cagcucacuggcauccagcgcc

SEQ ID NO: 3589459 - RNA, 15 nt, Pseudomonas putida KT2440
cagcucacuggccaa

SEQ ID NO: 3589460 - RNA, 16 nt, Pseudomonas putida KT2440
cagcucacuggccaac

SEQ ID NO: 3589461 - RNA, 17 nt, Pseudomonas putida KT2440
cagcucacuggccaacu

SEQ ID NO: 3589462 - RNA, 16 nt, Pseudomonas putida KT2440
cagcucagccagcaag

SEQ ID NO: 3589463 - RNA, 12 nt, Pseudomonas putida KT2440
cagcucauccag

SEQ ID NO: 3589464 - RNA, 20 nt, Pseudomonas putida KT2440
cagcucauccaucaccugcc

SEQ ID NO: 3589465 - RNA, 23 nt, Pseudomonas putida KT2440
cagcuccaacaagucuuccccuu

SEQ ID NO: 3589466 - RNA, 15 nt, Pseudomonas putida KT2440
cagcuccacacucga

SEQ ID NO: 3589467 - RNA, 18 nt, Pseudomonas putida KT2440
cagcuccacacucgacgc

SEQ ID NO: 3589468 - RNA, 12 nt, Pseudomonas putida KT2440
cagcuccacauc

SEQ ID NO: 3589469 - RNA, 18 nt, Pseudomonas putida KT2440
cagcuccacaucuugccc

SEQ ID NO: 3589470 - RNA, 18 nt, Pseudomonas putida KT2440
cagcuccagcagugccgu

SEQ ID NO: 3589471 - RNA, 14 nt, Pseudomonas putida KT2440
cagcucccgagcca

SEQ ID NO: 3589472 - RNA, 20 nt, Pseudomonas putida KT2440
cagcucccgagccaggaaga

SEQ ID NO: 3589473 - RNA, 22 nt, Pseudomonas putida KT2440
cagcucccgagccaggaagauc

SEQ ID NO: 3589474 - RNA, 22 nt, Pseudomonas putida KT2440
cagcucccgcgcaugcugccag

SEQ ID NO: 3589475 - RNA, 20 nt, Pseudomonas putida KT2440
cagcucccucguaggagcgg

SEQ ID NO: 3589476 - RNA, 19 nt, Pseudomonas putida KT2440
cagcuccgacaggcugugu

SEQ ID NO: 3589477 - RNA, 20 nt, Pseudomonas putida KT2440
cagcuccucugccgacaaac

SEQ ID NO: 3589478 - RNA, 12 nt, Pseudomonas putida KT2440
cagcuccuggcc

SEQ ID NO: 3589479 - RNA, 16 nt, Pseudomonas putida KT2440
cagcuccuggcucagu

SEQ ID NO: 3589480 - RNA, 17 nt, Pseudomonas putida KT2440
cagcucgaaaccggccu

SEQ ID NO: 3589481 - RNA, 21 nt, Pseudomonas putida KT2440
cagcucgaaaccggccuugcc

SEQ ID NO: 3589482 - RNA, 20 nt, Pseudomonas putida KT2440
cagcucgaaguaggcauucg

SEQ ID NO: 3589483 - RNA, 15 nt, Pseudomonas putida KT2440
cagcuucuggcgcgu

SEQ ID NO: 3589484 - RNA, 14 nt, Pseudomonas putida KT2440
cagcuucuucacac

SEQ ID NO: 3589485 - RNA, 16 nt, Pseudomonas putida KT2440
cagcuucuugcaccgc

SEQ ID NO: 3589486 - RNA, 13 nt, Pseudomonas putida KT2440
cagcuucuugugc

SEQ ID NO: 3589487 - RNA, 23 nt, Pseudomonas putida KT2440
cagcuugacgaucuucugcacgc

SEQ ID NO: 3589488 - RNA, 20 nt, Pseudomonas putida KT2440
cagcuugacggugcgcgcca

SEQ ID NO: 3589489 - RNA, 18 nt, Pseudomonas putida KT2440
cagcuugaggcccaugug

SEQ ID NO: 3589490 - RNA, 21 nt, Pseudomonas putida KT2440
cagcuugaggucgccaggggu

SEQ ID NO: 3589491 - RNA, 20 nt, Pseudomonas putida KT2440
cagcuugaugcugucgaagc

SEQ ID NO: 3589492 - RNA, 18 nt, Pseudomonas putida KT2440
cagcuugcagcgccgagc

SEQ ID NO: 3589493 - RNA, 19 nt, Pseudomonas putida KT2440
cagcuugcagcgccgagcg

SEQ ID NO: 3589494 - RNA, 21 nt, Pseudomonas putida KT2440
cagcuugccaccaucgaccug

SEQ ID NO: 3589495 - RNA, 23 nt, Pseudomonas putida KT2440
cagcuugccaccaucgaccuggc

SEQ ID NO: 3589496 - RNA, 21 nt, Pseudomonas putida KT2440
cagcuugccauccuugaagua

SEQ ID NO: 3589497 - RNA, 19 nt, Pseudomonas putida KT2440
cagcuugccauucuugucc

SEQ ID NO: 3589498 - RNA, 15 nt, Pseudomonas putida KT2440
cagcuugcccagcag

SEQ ID NO: 3589499 - RNA, 14 nt, Pseudomonas putida KT2440
cagcuugcccagcu

SEQ ID NO: 3589500 - RNA, 20 nt, Pseudomonas putida KT2440
cagcuuggccauuuccggcc

SEQ ID NO: 3589501 - RNA, 22 nt, Pseudomonas putida KT2440
cagcuuggccauuuccggcccg

SEQ ID NO: 3589502 - RNA, 17 nt, Pseudomonas putida KT2440
cagcuuggucagggcaa

SEQ ID NO: 3589503 - RNA, 20 nt, Pseudomonas putida KT2440
cagcuugugaaccccacccc

SEQ ID NO: 3589504 - RNA, 22 nt, Pseudomonas putida KT2440
cagcuugugccgcggcuccagg

SEQ ID NO: 3589505 - RNA, 14 nt, Pseudomonas putida KT2440
cagcuugugccgcu

SEQ ID NO: 3589506 - RNA, 18 nt, Pseudomonas putida KT2440
cagcuugugccgcugcgc

SEQ ID NO: 3589507 - RNA, 14 nt, Pseudomonas putida KT2440
cagcuuguugccgg

SEQ ID NO: 3589508 - RNA, 22 nt, Pseudomonas putida KT2440
cagcuuuggcugcaggucggcc

SEQ ID NO: 3589509 - RNA, 20 nt, Pseudomonas putida KT2440
cagcuuuuagacauugagca

SEQ ID NO: 3589510 - RNA, 20 nt, Pseudomonas putida KT2440
caggaaauacgccgccaccg

SEQ ID NO: 3589511 - RNA, 18 nt, Pseudomonas putida KT2440
caggaacaaucuucuuca

SEQ ID NO: 3589512 - RNA, 13 nt, Pseudomonas putida KT2440
caggaacagcgca

SEQ ID NO: 3589513 - RNA, 22 nt, Pseudomonas putida KT2440
caggaacagcgccacgccugca

SEQ ID NO: 3589514 - RNA, 16 nt, Pseudomonas putida KT2440
caggaacagcggcagc

SEQ ID NO: 3589515 - RNA, 17 nt, Pseudomonas putida KT2440
caggaacagcggcagca

SEQ ID NO: 3589516 - RNA, 19 nt, Pseudomonas putida KT2440
caggaacagcggcagcaac

SEQ ID NO: 3589517 - RNA, 14 nt, Pseudomonas putida KT2440
caggaacagcucga

SEQ ID NO: 3589518 - RNA, 17 nt, Pseudomonas putida KT2440
caggaaccgcucccagg

SEQ ID NO: 3589519 - RNA, 19 nt, Pseudomonas putida KT2440
caggaaccuccguugcugc

SEQ ID NO: 3589520 - RNA, 23 nt, Pseudomonas putida KT2440
caggaacgguguaucggccaguu

SEQ ID NO: 3589521 - RNA, 15 nt, Pseudomonas putida KT2440
caggaagaaggcauc

SEQ ID NO: 3589522 - RNA, 17 nt, Pseudomonas putida KT2440
caggaagaaggcaucca

SEQ ID NO: 3589523 - RNA, 22 nt, Pseudomonas putida KT2440
caggaagaaggcauccagggcg

SEQ ID NO: 3589524 - RNA, 22 nt, Pseudomonas putida KT2440
caggaagauguguuggccggac

SEQ ID NO: 3589525 - RNA, 14 nt, Pseudomonas putida KT2440
caggaagcaggcgu

SEQ ID NO: 3589526 - RNA, 16 nt, Pseudomonas putida KT2440
caggaagcuggccagc

SEQ ID NO: 3589527 - RNA, 17 nt, Pseudomonas putida KT2440
caggaagcugggaaucc

SEQ ID NO: 3589528 - RNA, 18 nt, Pseudomonas putida KT2440
caggaagcuguacagcgc

SEQ ID NO: 3589529 - RNA, 21 nt, Pseudomonas putida KT2440
caggaaggcaccacggaaggc

SEQ ID NO: 3589530 - RNA, 23 nt, Pseudomonas putida KT2440
caggaaggccuugaagcgcggca

SEQ ID NO: 3589531 - RNA, 23 nt, Pseudomonas putida KT2440
caggaaggcgucguacaggccua

SEQ ID NO: 3589532 - RNA, 20 nt, Pseudomonas putida KT2440
caggaaggucaccaguucac

SEQ ID NO: 3589533 - RNA, 23 nt, Pseudomonas putida KT2440
caggaagucgauguucagcaccu

SEQ ID NO: 3589534 - RNA, 17 nt, Pseudomonas putida KT2440
caggaauuacgcaggcu

SEQ ID NO: 3589535 - RNA, 20 nt, Pseudomonas putida KT2440
caggacaaaccagcggucug

SEQ ID NO: 3589536 - RNA, 21 nt, Pseudomonas putida KT2440
caggacaagccgacaaaaaca

SEQ ID NO: 3589537 - RNA, 23 nt, Pseudomonas putida KT2440
caggacaagccgacaaaaacaac

SEQ ID NO: 3589538 - RNA, 22 nt, Pseudomonas putida KT2440
caggacggauacaccagaaagc

SEQ ID NO: 3589539 - RNA, 18 nt, Pseudomonas putida KT2440
caggagagcuuggucagc

SEQ ID NO: 3589540 - RNA, 20 nt, Pseudomonas putida KT2440
caggagcgagcaagcucgcu

SEQ ID NO: 3589541 - RNA, 20 nt, Pseudomonas putida KT2440
caggagcggguucacccgcg

SEQ ID NO: 3589542 - RNA, 14 nt, Pseudomonas putida KT2440
caggagggcuggug

SEQ ID NO: 3589543 - RNA, 17 nt, Pseudomonas putida KT2440
caggagucuacggaccu

SEQ ID NO: 3589544 - RNA, 19 nt, Pseudomonas putida KT2440
caggagucuacggaccucc

SEQ ID NO: 3589545 - RNA, 15 nt, Pseudomonas putida KT2440
caggauauugccgac

SEQ ID NO: 3589546 - RNA, 22 nt, Pseudomonas putida KT2440
caggauauugccgacuccaacg

SEQ ID NO: 3589547 - RNA, 14 nt, Pseudomonas putida KT2440
caggaucacuggcc

SEQ ID NO: 3589548 - RNA, 18 nt, Pseudomonas putida KT2440
caggaucacuggccugga

SEQ ID NO: 3589549 - RNA, 19 nt, Pseudomonas putida KT2440
caggaucaugugcgccacu

SEQ ID NO: 3589550 - RNA, 20 nt, Pseudomonas putida KT2440
caggaucuccucggccagcg

SEQ ID NO: 3589551 - RNA, 18 nt, Pseudomonas putida KT2440
caggaucugcugcagcau

SEQ ID NO: 3589552 - RNA, 20 nt, Pseudomonas putida KT2440
caggaucuucucggcgcgga

SEQ ID NO: 3589553 - RNA, 20 nt, Pseudomonas putida KT2440
caggaugccaaggaucagcu

SEQ ID NO: 3589554 - RNA, 21 nt, Pseudomonas putida KT2440
caggaugccaaggaucagcuc

SEQ ID NO: 3589555 - RNA, 21 nt, Pseudomonas putida KT2440
caggauggcaaagcgcagcaa

SEQ ID NO: 3589556 - RNA, 17 nt, Pseudomonas putida KT2440
caggauggcaccgauca

SEQ ID NO: 3589557 - RNA, 21 nt, Pseudomonas putida KT2440
caggauggcauuggccaacuc

SEQ ID NO: 3589558 - RNA, 13 nt, Pseudomonas putida KT2440
caggauggccgca

SEQ ID NO: 3589559 - RNA, 17 nt, Pseudomonas putida KT2440
caggauggugacugcca

SEQ ID NO: 3589560 - RNA, 18 nt, Pseudomonas putida KT2440
caggauggugacugccag

SEQ ID NO: 3589561 - RNA, 20 nt, Pseudomonas putida KT2440
caggauggugacugccagca

SEQ ID NO: 3589562 - RNA, 18 nt, Pseudomonas putida KT2440
caggauuggccgcaacac

SEQ ID NO: 3589563 - RNA, 23 nt, Pseudomonas putida KT2440
caggauuuucagcgcgaaacccu

SEQ ID NO: 3589564 - RNA, 23 nt, Pseudomonas putida KT2440
caggcaaacgaaaucugccugcu

SEQ ID NO: 3589565 - RNA, 20 nt, Pseudomonas putida KT2440
caggcaaagaaacaccaggc

SEQ ID NO: 3589566 - RNA, 20 nt, Pseudomonas putida KT2440
caggcaaagaaugccgccca

SEQ ID NO: 3589567 - RNA, 20 nt, Pseudomonas putida KT2440
caggcaaaguugagcgccgc

SEQ ID NO: 3589568 - RNA, 21 nt, Pseudomonas putida KT2440
caggcaaaguugagcgccgcg

SEQ ID NO: 3589569 - RNA, 20 nt, Pseudomonas putida KT2440
caggcaauaaaaaaccggcg

SEQ ID NO: 3589570 - RNA, 22 nt, Pseudomonas putida KT2440
caggcacacaaacaccggcccc

SEQ ID NO: 3589571 - RNA, 13 nt, Pseudomonas putida KT2440
caggcacagcacg

SEQ ID NO: 3589572 - RNA, 14 nt, Pseudomonas putida KT2440
caggcacagcacgg

SEQ ID NO: 3589573 - RNA, 15 nt, Pseudomonas putida KT2440
caggcacagcacggc

SEQ ID NO: 3589574 - RNA, 18 nt, Pseudomonas putida KT2440
caggcacaggccagccag

SEQ ID NO: 3589575 - RNA, 13 nt, Pseudomonas putida KT2440
caggcacaggccc

SEQ ID NO: 3589576 - RNA, 14 nt, Pseudomonas putida KT2440
caggcacaggccca

SEQ ID NO: 3589577 - RNA, 16 nt, Pseudomonas putida KT2440
caggcacaggcccagc

SEQ ID NO: 3589578 - RNA, 12 nt, Pseudomonas putida KT2440
caggcaccgcac

SEQ ID NO: 3589579 - RNA, 16 nt, Pseudomonas putida KT2440
caggcaccgcacccgg

SEQ ID NO: 3589580 - RNA, 17 nt, Pseudomonas putida KT2440
caggcacggcaccagca

SEQ ID NO: 3589581 - RNA, 23 nt, Pseudomonas putida KT2440
caggcacuaagcgaaacaccagc

SEQ ID NO: 3589582 - RNA, 15 nt, Pseudomonas putida KT2440
caggcacuggccagc

SEQ ID NO: 3589583 - RNA, 17 nt, Pseudomonas putida KT2440
caggcagaagguaggca

SEQ ID NO: 3589584 - RNA, 16 nt, Pseudomonas putida KT2440
caggcagaccacgcgc

SEQ ID NO: 3589585 - RNA, 20 nt, Pseudomonas putida KT2440
caggcagaucgaaagacagc

SEQ ID NO: 3589586 - RNA, 14 nt, Pseudomonas putida KT2440
caggcagcacaugc

SEQ ID NO: 3589587 - RNA, 21 nt, Pseudomonas putida KT2440
caggccuucaucggccuccuc

SEQ ID NO: 3589588 - RNA, 20 nt, Pseudomonas putida KT2440
caggccuucgccacugccac

SEQ ID NO: 3589589 - RNA, 16 nt, Pseudomonas putida KT2440
caggccuucggugcug

SEQ ID NO: 3589590 - RNA, 21 nt, Pseudomonas putida KT2440
caggccuucggugcuggcgcu

SEQ ID NO: 3589591 - RNA, 17 nt, Pseudomonas putida KT2440
caggccuuucagcgccc

SEQ ID NO: 3589592 - RNA, 16 nt, Pseudomonas putida KT2440
caggccuuucugcucg

SEQ ID NO: 3589593 - RNA, 15 nt, Pseudomonas putida KT2440
caggccuuuucacac

SEQ ID NO: 3589594 - RNA, 19 nt, Pseudomonas putida KT2440
caggcgaagcguucaugcc

SEQ ID NO: 3589595 - RNA, 20 nt, Pseudomonas putida KT2440
caggcgaagcguucaugccc

SEQ ID NO: 3589596 - RNA, 23 nt, Pseudomonas putida KT2440
caggcgaaugcgcccggccaggu

SEQ ID NO: 3589597 - RNA, 20 nt, Pseudomonas putida KT2440
caggcgaccgguggcgccuu

SEQ ID NO: 3589598 - RNA, 20 nt, Pseudomonas putida KT2440
caggcgacgagccaguucga

SEQ ID NO: 3589599 - RNA, 13 nt, Pseudomonas putida KT2440
caggcgacgcagu

SEQ ID NO: 3589600 - RNA, 21 nt, Pseudomonas putida KT2440
caggcgacggaacggccgcac

SEQ ID NO: 3589601 - RNA, 15 nt, Pseudomonas putida KT2440
caggcgaucagucag

SEQ ID NO: 3589602 - RNA, 15 nt, Pseudomonas putida KT2440
caggcgauucaggcu

SEQ ID NO: 3589603 - RNA, 19 nt, Pseudomonas putida KT2440
caggcgcaacucgcgccca

SEQ ID NO: 3589604 - RNA, 17 nt, Pseudomonas putida KT2440
caggcgcagcacgccgu

SEQ ID NO: 3589605 - RNA, 18 nt, Pseudomonas putida KT2440
caggcgcagcacgccguu

SEQ ID NO: 3589606 - RNA, 12 nt, Pseudomonas putida KT2440
caggcgcagcag

SEQ ID NO: 3589607 - RNA, 15 nt, Pseudomonas putida KT2440
caggcgcagcgcaug

SEQ ID NO: 3589608 - RNA, 18 nt, Pseudomonas putida KT2440
caggcgcagcgcaugcuc

SEQ ID NO: 3589609 - RNA, 14 nt, Pseudomonas putida KT2440
caggcgcagcugcc

SEQ ID NO: 3589610 - RNA, 14 nt, Pseudomonas putida KT2440
caggcgcaggugca

SEQ ID NO: 3589611 - RNA, 22 nt, Pseudomonas putida KT2440
caggcgcaggugcagccagccc

SEQ ID NO: 3589612 - RNA, 11 nt, Pseudomonas putida KT2440
caggcgccauu

SEQ ID NO: 3589613 - RNA, 13 nt, Pseudomonas putida KT2440
caggcgccccggc

SEQ ID NO: 3589614 - RNA, 15 nt, Pseudomonas putida KT2440
caggcgcccugcgcc

SEQ ID NO: 3589615 - RNA, 21 nt, Pseudomonas putida KT2440
caggcgccgagcgcggcgccc

SEQ ID NO: 3589616 - RNA, 20 nt, Pseudomonas putida KT2440
caggcgccgcagcaguuggc

SEQ ID NO: 3589617 - RNA, 15 nt, Pseudomonas putida KT2440
caggcgccgccagcu

SEQ ID NO: 3589618 - RNA, 15 nt, Pseudomonas putida KT2440
caggcgcgccugcac

SEQ ID NO: 3589619 - RNA, 18 nt, Pseudomonas putida KT2440
caggcgcgcuaccggacu

SEQ ID NO: 3589620 - RNA, 23 nt, Pseudomonas putida KT2440
caggcgcgcuaccggacugcgcu

SEQ ID NO: 3589621 - RNA, 17 nt, Pseudomonas putida KT2440
caggcgcggcagcauga

SEQ ID NO: 3589622 - RNA, 14 nt, Pseudomonas putida KT2440
caggcgcggcucga

SEQ ID NO: 3589623 - RNA, 21 nt, Pseudomonas putida KT2440
caggcgcggugccggcagcuc

SEQ ID NO: 3589624 - RNA, 15 nt, Pseudomonas putida KT2440
caggcgcgugccuga

SEQ ID NO: 3589625 - RNA, 14 nt, Pseudomonas putida KT2440
caggcgcucacccc

SEQ ID NO: 3589626 - RNA, 21 nt, Pseudomonas putida KT2440
caggcgcucaccuacugccgu

SEQ ID NO: 3589627 - RNA, 17 nt, Pseudomonas putida KT2440
caggcgcuccagcaggg

SEQ ID NO: 3589628 - RNA, 18 nt, Pseudomonas putida KT2440
caggcgcuccaucaugcg

SEQ ID NO: 3589629 - RNA, 23 nt, Pseudomonas putida KT2440
caggcgcucgcuccagggcaggc

SEQ ID NO: 3589630 - RNA, 23 nt, Pseudomonas putida KT2440
caggcgcuggcgccagccgccac

SEQ ID NO: 3589631 - RNA, 15 nt, Pseudomonas putida KT2440
caggcgcuucaggua

SEQ ID NO: 3589632 - RNA, 13 nt, Pseudomonas putida KT2440
caggcgcuugccc

SEQ ID NO: 3589633 - RNA, 22 nt, Pseudomonas putida KT2440
caggcggauguucuugaccuug

SEQ ID NO: 3589634 - RNA, 12 nt, Pseudomonas putida KT2440
caggcggccagc

SEQ ID NO: 3589635 - RNA, 13 nt, Pseudomonas putida KT2440
caggcggccagcc

SEQ ID NO: 3589636 - RNA, 12 nt, Pseudomonas putida KT2440
caggcggcgaca

SEQ ID NO: 3589637 - RNA, 14 nt, Pseudomonas putida KT2440
caggcggcgacaac

SEQ ID NO: 3589638 - RNA, 14 nt, Pseudomonas putida KT2440
caggcggucgccca

SEQ ID NO: 3589639 - RNA, 17 nt, Pseudomonas putida KT2440
caggcggugcacggccu

SEQ ID NO: 3589640 - RNA, 20 nt, Pseudomonas putida KT2440
caggcggugcacggccugca

SEQ ID NO: 3589641 - RNA, 23 nt, Pseudomonas putida KT2440
caggcgguuguagaucgccggca

SEQ ID NO: 3589642 - RNA, 21 nt, Pseudomonas putida KT2440
caggcguaaacccagguacga

SEQ ID NO: 3589643 - RNA, 19 nt, Pseudomonas putida KT2440
caggcguaacucagcaacg

SEQ ID NO: 3589644 - RNA, 18 nt, Pseudomonas putida KT2440
caggcguacaucagccuc

SEQ ID NO: 3589645 - RNA, 16 nt, Pseudomonas putida KT2440
caggcguauucggcca

SEQ ID NO: 3589646 - RNA, 19 nt, Pseudomonas putida KT2440
caggcguauucggccacca

SEQ ID NO: 3589647 - RNA, 15 nt, Pseudomonas putida KT2440
caggcgucaggcuug

SEQ ID NO: 3589648 - RNA, 15 nt, Pseudomonas putida KT2440
caggcgucguuguug

SEQ ID NO: 3589649 - RNA, 21 nt, Pseudomonas putida KT2440
caggcguuuuuccaugcguuc

SEQ ID NO: 3589650 - RNA, 21 nt, Pseudomonas putida KT2440
caggcuaaagugccuugauca

SEQ ID NO: 3589651 - RNA, 17 nt, Pseudomonas putida KT2440
caggcuaauggcgcgcc

SEQ ID NO: 3589652 - RNA, 16 nt, Pseudomonas putida KT2440
caggcuaucggcuccc

SEQ ID NO: 3589653 - RNA, 14 nt, Pseudomonas putida KT2440
caggcuaugccggu

SEQ ID NO: 3589654 - RNA, 18 nt, Pseudomonas putida KT2440
caggcuaugccggucagc

SEQ ID NO: 3589655 - RNA, 19 nt, Pseudomonas putida KT2440
caggcuaugccggucagca

SEQ ID NO: 3589656 - RNA, 22 nt, Pseudomonas putida KT2440
caggcuaugccggucagcagca

SEQ ID NO: 3589657 - RNA, 14 nt, Pseudomonas putida KT2440
caggcucagcaggu

SEQ ID NO: 3589658 - RNA, 16 nt, Pseudomonas putida KT2440
caggcucagcuccaug

SEQ ID NO: 3589659 - RNA, 18 nt, Pseudomonas putida KT2440
caggcucagcuccaugcg

SEQ ID NO: 3589660 - RNA, 15 nt, Pseudomonas putida KT2440
caggcucagggcagc

SEQ ID NO: 3589661 - RNA, 12 nt, Pseudomonas putida KT2440
caggcucggcca

SEQ ID NO: 3589662 - RNA, 14 nt, Pseudomonas putida KT2440
caggcucggccacc

SEQ ID NO: 3589663 - RNA, 17 nt, Pseudomonas putida KT2440
caggcucucagcccauu

SEQ ID NO: 3589664 - RNA, 20 nt, Pseudomonas putida KT2440
caggcucuccucaucgaugc

SEQ ID NO: 3589665 - RNA, 21 nt, Pseudomonas putida KT2440
caggcucugaaugucagcgcu

SEQ ID NO: 3589666 - RNA, 17 nt, Pseudomonas putida KT2440
caggcucugcgccagca

SEQ ID NO: 3589667 - RNA, 21 nt, Pseudomonas putida KT2440
caggcucugcuccagcugcuc

SEQ ID NO: 3589668 - RNA, 18 nt, Pseudomonas putida KT2440
caggcucuugaacugggc

SEQ ID NO: 3589669 - RNA, 21 nt, Pseudomonas putida KT2440
caggcucuugaacugggcauc

SEQ ID NO: 3589670 - RNA, 22 nt, Pseudomonas putida KT2440
caggcugaugcgcuggcccuug

SEQ ID NO: 3589671 - RNA, 12 nt, Pseudomonas putida KT2440
caggcugaugga

SEQ ID NO: 3589672 - RNA, 18 nt, Pseudomonas putida KT2440
caggcugcacaaggugcu

SEQ ID NO: 3589673 - RNA, 20 nt, Pseudomonas putida KT2440
caggcugccaaaccgcccca

SEQ ID NO: 3589674 - RNA, 17 nt, Pseudomonas putida KT2440
caggcugcgugccugcu

SEQ ID NO: 3589675 - RNA, 19 nt, Pseudomonas putida KT2440
caggcugcgugccugcugc

SEQ ID NO: 3589676 - RNA, 20 nt, Pseudomonas putida KT2440
caggcugcgugccugcugcu

SEQ ID NO: 3589677 - RNA, 23 nt, Pseudomonas putida KT2440
caggcuggauaagaucacugcgc

SEQ ID NO: 3589678 - RNA, 19 nt, Pseudomonas putida KT2440
caggcuggcaaucagcucu

SEQ ID NO: 3589679 - RNA, 13 nt, Pseudomonas putida KT2440
caggcuggccagc

SEQ ID NO: 3589680 - RNA, 15 nt, Pseudomonas putida KT2440
caggcuggccagcaa

SEQ ID NO: 3589681 - RNA, 16 nt, Pseudomonas putida KT2440
caggcuggcgacgcca

SEQ ID NO: 3589682 - RNA, 19 nt, Pseudomonas putida KT2440
caggcuggcgacgccaccc

SEQ ID NO: 3589683 - RNA, 21 nt, Pseudomonas putida KT2440
caggcuggcgacgccaccccg

SEQ ID NO: 3589684 - RNA, 20 nt, Pseudomonas putida KT2440
caggcuggguggugucgacc

SEQ ID NO: 3589685 - RNA, 18 nt, Pseudomonas putida KT2440
caggcuguuccauuuccc

SEQ ID NO: 3589686 - RNA, 19 nt, Pseudomonas putida KT2440
caggcuguuccauuucccu

SEQ ID NO: 3589687 - RNA, 22 nt, Pseudomonas putida KT2440
caggcuuacaacugcuccaggc

SEQ ID NO: 3589688 - RNA, 17 nt, Pseudomonas putida KT2440
caggcuuacaucggcga

SEQ ID NO: 3589689 - RNA, 19 nt, Pseudomonas putida KT2440
caggcuucagaagccuugg

SEQ ID NO: 3589690 - RNA, 16 nt, Pseudomonas putida KT2440
caggcuucaggccgcc

SEQ ID NO: 3589691 - RNA, 14 nt, Pseudomonas putida KT2440
caggcuugaagcug

SEQ ID NO: 3589692 - RNA, 14 nt, Pseudomonas putida KT2440
caggugcgcacgcu

SEQ ID NO: 3589693 - RNA, 17 nt, Pseudomonas putida KT2440
caggugcgcacgcugcc

SEQ ID NO: 3589694 - RNA, 15 nt, Pseudomonas putida KT2440
caggugcgcgcgcga

SEQ ID NO: 3589695 - RNA, 20 nt, Pseudomonas putida KT2440
caggugcggcagcucgccgu

SEQ ID NO: 3589696 - RNA, 14 nt, Pseudomonas putida KT2440
caggugcggcgcga

SEQ ID NO: 3589697 - RNA, 21 nt, Pseudomonas putida KT2440
caggugcugaugcccaaacgc

SEQ ID NO: 3589698 - RNA, 17 nt, Pseudomonas putida KT2440
cagguggaagcgcgcau

SEQ ID NO: 3589699 - RNA, 13 nt, Pseudomonas putida KT2440
cagguggaucagc

SEQ ID NO: 3589700 - RNA, 16 nt, Pseudomonas putida KT2440
cagguggaucggcgug

SEQ ID NO: 3589701 - RNA, 16 nt, Pseudomonas putida KT2440
cagguggauguugaug

SEQ ID NO: 3589702 - RNA, 23 nt, Pseudomonas putida KT2440
cagguggccuucccucuguaacu

SEQ ID NO: 3589703 - RNA, 18 nt, Pseudomonas putida KT2440
cagguggcugucugggaa

SEQ ID NO: 3589704 - RNA, 16 nt, Pseudomonas putida KT2440
caggugguaacuggcc

SEQ ID NO: 3589705 - RNA, 19 nt, Pseudomonas putida KT2440
caggugguaacuggccagu

SEQ ID NO: 3589706 - RNA, 23 nt, Pseudomonas putida KT2440
cagguggugguccccuucgucga

SEQ ID NO: 3589707 - RNA, 18 nt, Pseudomonas putida KT2440
cagguguagagccuuugg

SEQ ID NO: 3589708 - RNA, 23 nt, Pseudomonas putida KT2440
caggugugccacuucaugggcca

SEQ ID NO: 3589709 - RNA, 18 nt, Pseudomonas putida KT2440
cagguguggaaacccgca

SEQ ID NO: 3589710 - RNA, 15 nt, Pseudomonas putida KT2440
cagguguggcucagc

SEQ ID NO: 3589711 - RNA, 16 nt, Pseudomonas putida KT2440
cagguguuccagcacg

SEQ ID NO: 3589712 - RNA, 19 nt, Pseudomonas putida KT2440
cagguguuguugcaaccag

SEQ ID NO: 3589713 - RNA, 13 nt, Pseudomonas putida KT2440
cagguuacuggcc

SEQ ID NO: 3589714 - RNA, 20 nt, Pseudomonas putida KT2440
cagguucaacggcgcccggg

SEQ ID NO: 3589715 - RNA, 15 nt, Pseudomonas putida KT2440
cagguucacuuccac

SEQ ID NO: 3589716 - RNA, 19 nt, Pseudomonas putida KT2440
cagguucagcaggauggcc

SEQ ID NO: 3589717 - RNA, 20 nt, Pseudomonas putida KT2440
cagguucaggcgcagcacgc

SEQ ID NO: 3589718 - RNA, 19 nt, Pseudomonas putida KT2440
cagguuccauagugugcuc

SEQ ID NO: 3589719 - RNA, 16 nt, Pseudomonas putida KT2440
cagguuccccccacgc

SEQ ID NO: 3589720 - RNA, 18 nt, Pseudomonas putida KT2440
cagguuccccccacgcac

SEQ ID NO: 3589721 - RNA, 16 nt, Pseudomonas putida KT2440
cagguucgaauccugc

SEQ ID NO: 3589722 - RNA, 21 nt, Pseudomonas putida KT2440
cagguucgaauccugcugagu

SEQ ID NO: 3589723 - RNA, 13 nt, Pseudomonas putida KT2440
cagguucgaccac

SEQ ID NO: 3589724 - RNA, 22 nt, Pseudomonas putida KT2440
cagguucgaccacugcaggugc

SEQ ID NO: 3589725 - RNA, 17 nt, Pseudomonas putida KT2440
cagguucgaccagaaca

SEQ ID NO: 3589726 - RNA, 21 nt, Pseudomonas putida KT2440
cagguucgacucccgcugccu

SEQ ID NO: 3589727 - RNA, 18 nt, Pseudomonas putida KT2440
cagguucgguaaugcccg

SEQ ID NO: 3589728 - RNA, 21 nt, Pseudomonas putida KT2440
cagguucucgcuccaguggug

SEQ ID NO: 3589729 - RNA, 15 nt, Pseudomonas putida KT2440
cagguucucggcacc

SEQ ID NO: 3589730 - RNA, 14 nt, Pseudomonas putida KT2440
cagguucugaaucu

SEQ ID NO: 3589731 - RNA, 20 nt, Pseudomonas putida KT2440
cagguucugccggacaagaa

SEQ ID NO: 3589732 - RNA, 16 nt, Pseudomonas putida KT2440
cagguugaacagcagc

SEQ ID NO: 3589733 - RNA, 21 nt, Pseudomonas putida KT2440
cagguugaacagcagcgccgc

SEQ ID NO: 3589734 - RNA, 13 nt, Pseudomonas putida KT2440
cagguugagcacc

SEQ ID NO: 3589735 - RNA, 19 nt, Pseudomonas putida KT2440
cagguugagcaccgggcac

SEQ ID NO: 3589736 - RNA, 13 nt, Pseudomonas putida KT2440
cagguugcccagc

SEQ ID NO: 3589737 - RNA, 13 nt, Pseudomonas putida KT2440
cagguugcccgca

SEQ ID NO: 3589738 - RNA, 14 nt, Pseudomonas putida KT2440
cagguugccucauc

SEQ ID NO: 3589739 - RNA, 13 nt, Pseudomonas putida KT2440
cagguugcgcgcc

SEQ ID NO: 3589740 - RNA, 14 nt, Pseudomonas putida KT2440
cagguugcgcgccg

SEQ ID NO: 3589741 - RNA, 23 nt, Pseudomonas putida KT2440
cagguugcgugccucgcccaggu

SEQ ID NO: 3589742 - RNA, 17 nt, Pseudomonas putida KT2440
cagguugcuggccuugg

SEQ ID NO: 3589743 - RNA, 13 nt, Pseudomonas putida KT2440
cagguuggacagc

SEQ ID NO: 3589744 - RNA, 16 nt, Pseudomonas putida KT2440
cagguuggacagcgcc

SEQ ID NO: 3589745 - RNA, 15 nt, Pseudomonas putida KT2440
cagguuggccgccgc

SEQ ID NO: 3589746 - RNA, 20 nt, Pseudomonas putida KT2440
cagguuggugcaauugcagu

SEQ ID NO: 3589747 - RNA, 14 nt, Pseudomonas putida KT2440
cagguuguccaccg

SEQ ID NO: 3589748 - RNA, 15 nt, Pseudomonas putida KT2440
cagguuguccaccgc

SEQ ID NO: 3589749 - RNA, 14 nt, Pseudomonas putida KT2440
cagguuguggccca

SEQ ID NO: 3589750 - RNA, 15 nt, Pseudomonas putida KT2440
cagguugugucgggc

SEQ ID NO: 3589751 - RNA, 21 nt, Pseudomonas putida KT2440
cagguuguucggcaggcucug

SEQ ID NO: 3589752 - RNA, 14 nt, Pseudomonas putida KT2440
cagguuucagucga

SEQ ID NO: 3589753 - RNA, 14 nt, Pseudomonas putida KT2440
cagguuuuccagcc

SEQ ID NO: 3589754 - RNA, 21 nt, Pseudomonas putida KT2440
cagguuuucucgucuggcgcg

SEQ ID NO: 3589755 - RNA, 16 nt, Pseudomonas putida KT2440
caguaacaggcgcaca

SEQ ID NO: 3589756 - RNA, 13 nt, Pseudomonas putida KT2440
caguaaggcuugc

SEQ ID NO: 3589757 - RNA, 16 nt, Pseudomonas putida KT2440
caguaaugcagccggc

SEQ ID NO: 3589758 - RNA, 23 nt, Pseudomonas putida KT2440
caguaaugcagccggccccugcu

SEQ ID NO: 3589759 - RNA, 16 nt, Pseudomonas putida KT2440
caguacauagaacagc

SEQ ID NO: 3589760 - RNA, 14 nt, Pseudomonas putida KT2440
caguaccacagcca

SEQ ID NO: 3589761 - RNA, 13 nt, Pseudomonas putida KT2440
caguaccagcagc

SEQ ID NO: 3589762 - RNA, 14 nt, Pseudomonas putida KT2440
caguaccagcagca

SEQ ID NO: 3589763 - RNA, 22 nt, Pseudomonas putida KT2440
caguaccgcgccuccagcuggc

SEQ ID NO: 3589764 - RNA, 14 nt, Pseudomonas putida KT2440
caguaccuaggguu

SEQ ID NO: 3589765 - RNA, 19 nt, Pseudomonas putida KT2440
caguaccuaggguucaaau

SEQ ID NO: 3589766 - RNA, 20 nt, Pseudomonas putida KT2440
caguaccuaggguucaaauc

SEQ ID NO: 3589767 - RNA, 14 nt, Pseudomonas putida KT2440
caguaccuucuggc

SEQ ID NO: 3589768 - RNA, 19 nt, Pseudomonas putida KT2440
caguaccuuggcguaggcc

SEQ ID NO: 3589769 - RNA, 14 nt, Pseudomonas putida KT2440
caguacgaugcugc

SEQ ID NO: 3589770 - RNA, 23 nt, Pseudomonas putida KT2440
caguacgaugcugcgggcguugu

SEQ ID NO: 3589771 - RNA, 15 nt, Pseudomonas putida KT2440
caguacgcaggcaua

SEQ ID NO: 3589772 - RNA, 23 nt, Pseudomonas putida KT2440
caguacgcaggcauacaggacca

SEQ ID NO: 3589773 - RNA, 13 nt, Pseudomonas putida KT2440
caguacgccaccc

SEQ ID NO: 3589774 - RNA, 15 nt, Pseudomonas putida KT2440
caguacgccacccag

SEQ ID NO: 3589775 - RNA, 20 nt, Pseudomonas putida KT2440
caguacgccacccagaugcg

SEQ ID NO: 3589776 - RNA, 15 nt, Pseudomonas putida KT2440
caguacgccagcagc

SEQ ID NO: 3589777 - RNA, 21 nt, Pseudomonas putida KT2440
caguacgcgccugcaccuggc

SEQ ID NO: 3589778 - RNA, 21 nt, Pseudomonas putida KT2440
caguacggccaucagcaagcc

SEQ ID NO: 3589779 - RNA, 23 nt, Pseudomonas putida KT2440
caguacggccaucagcaagccgc

SEQ ID NO: 3589780 - RNA, 14 nt, Pseudomonas putida KT2440
caguacuugcugga

SEQ ID NO: 3589781 - RNA, 16 nt, Pseudomonas putida KT2440
caguagaaaguccauc

SEQ ID NO: 3589782 - RNA, 15 nt, Pseudomonas putida KT2440
caguagaacaaccgg

SEQ ID NO: 3589783 - RNA, 14 nt, Pseudomonas putida KT2440
caguagaagcccag

SEQ ID NO: 3589784 - RNA, 20 nt, Pseudomonas putida KT2440
caguagagcccccagcacag

SEQ ID NO: 3589785 - RNA, 14 nt, Pseudomonas putida KT2440
caguagcacagugc

SEQ ID NO: 3589786 - RNA, 13 nt, Pseudomonas putida KT2440
caguaggccaccg

SEQ ID NO: 3589787 - RNA, 17 nt, Pseudomonas putida KT2440
caguaguucucgacagc

SEQ ID NO: 3589788 - RNA, 18 nt, Pseudomonas putida KT2440
caguaguucucgacagcc

SEQ ID NO: 3589789 - RNA, 19 nt, Pseudomonas putida KT2440
caguaucgccccggucagc

SEQ ID NO: 3589790 - RNA, 16 nt, Pseudomonas putida KT2440
cagucacccaccggcu

SEQ ID NO: 3589791 - RNA, 15 nt, Pseudomonas putida KT2440
cagucaccuggccca

SEQ ID NO: 3589792 - RNA, 21 nt, Pseudomonas putida KT2440
cagucaccuugcuccaccagg

SEQ ID NO: 3589793 - RNA, 13 nt, Pseudomonas putida KT2440
cagucagaagcag

SEQ ID NO: 3589794 - RNA, 13 nt, Pseudomonas putida KT2440
cagucagcgccga

SEQ ID NO: 3589795 - RNA, 14 nt, Pseudomonas putida KT2440
cagucagcgccgau

SEQ ID NO: 3589796 - RNA, 16 nt, Pseudomonas putida KT2440
cagucagggucucggc

SEQ ID NO: 3589797 - RNA, 18 nt, Pseudomonas putida KT2440
cagucagggucucggcca

SEQ ID NO: 3589798 - RNA, 17 nt, Pseudomonas putida KT2440
caguuccauccaguccg

SEQ ID NO: 3589799 - RNA, 18 nt, Pseudomonas putida KT2440
caguuccaugucgugcug

SEQ ID NO: 3589800 - RNA, 18 nt, Pseudomonas putida KT2440
caguucccggugcuggcu

SEQ ID NO: 3589801 - RNA, 18 nt, Pseudomonas putida KT2440
caguuccgcguccuugac

SEQ ID NO: 3589802 - RNA, 20 nt, Pseudomonas putida KT2440
caguuccuggcgcuccucca

SEQ ID NO: 3589803 - RNA, 23 nt, Pseudomonas putida KT2440
caguuccuggcggaucugacggc

SEQ ID NO: 3589804 - RNA, 15 nt, Pseudomonas putida KT2440
caguuccuugagcac

SEQ ID NO: 3589805 - RNA, 20 nt, Pseudomonas putida KT2440
caguucgacgccuucgaaca

SEQ ID NO: 3589806 - RNA, 17 nt, Pseudomonas putida KT2440
caguucgacgcugcugu

SEQ ID NO: 3589807 - RNA, 13 nt, Pseudomonas putida KT2440
caguucgcagcca

SEQ ID NO: 3589808 - RNA, 14 nt, Pseudomonas putida KT2440
caguucgcagccau

SEQ ID NO: 3589809 - RNA, 15 nt, Pseudomonas putida KT2440
caguucgcagcccac

SEQ ID NO: 3589810 - RNA, 19 nt, Pseudomonas putida KT2440
caguucgcagcccacggcc

SEQ ID NO: 3589811 - RNA, 15 nt, Pseudomonas putida KT2440
caguucgccacccga

SEQ ID NO: 3589812 - RNA, 20 nt, Pseudomonas putida KT2440
caguucgccacccgacgcca

SEQ ID NO: 3589813 - RNA, 17 nt, Pseudomonas putida KT2440
caguucgcccuucagca

SEQ ID NO: 3589814 - RNA, 14 nt, Pseudomonas putida KT2440
caguucgcgcacca

SEQ ID NO: 3589815 - RNA, 22 nt, Pseudomonas putida KT2440
caguucgcgcaccaucggcucc

SEQ ID NO: 3589816 - RNA, 21 nt, Pseudomonas putida KT2440
caguucgcggaucugcugcuu

SEQ ID NO: 3589817 - RNA, 17 nt, Pseudomonas putida KT2440
caguucgcggcgcaccg

SEQ ID NO: 3589818 - RNA, 20 nt, Pseudomonas putida KT2440
caguucgcggcgcaccgcuu

SEQ ID NO: 3589819 - RNA, 19 nt, Pseudomonas putida KT2440
caguucgcgggcaaaugcg

SEQ ID NO: 3589820 - RNA, 17 nt, Pseudomonas putida KT2440
caguucgcgugccaccu

SEQ ID NO: 3589821 - RNA, 20 nt, Pseudomonas putida KT2440
caguucgcgugccaccucug

SEQ ID NO: 3589822 - RNA, 23 nt, Pseudomonas putida KT2440
caguucgcugcgcaaggcauuca

SEQ ID NO: 3589823 - RNA, 18 nt, Pseudomonas putida KT2440
caguucggaaaacuccug

SEQ ID NO: 3589824 - RNA, 18 nt, Pseudomonas putida KT2440
caguucggcggccccggc

SEQ ID NO: 3589825 - RNA, 22 nt, Pseudomonas putida KT2440
caguucggcggccccggcgccg

SEQ ID NO: 3589826 - RNA, 17 nt, Pseudomonas putida KT2440
caguucguccucgaccc

SEQ ID NO: 3589827 - RNA, 16 nt, Pseudomonas putida KT2440
caguucgucgagcauc

SEQ ID NO: 3589828 - RNA, 22 nt, Pseudomonas putida KT2440
caguucgucgagcaucugcugc

SEQ ID NO: 3589829 - RNA, 22 nt, Pseudomonas putida KT2440
caguucuaccguuggcaucugc

SEQ ID NO: 3589830 - RNA, 17 nt, Pseudomonas putida KT2440
caguucugcucagcuac

SEQ ID NO: 3589831 - RNA, 16 nt, Pseudomonas putida KT2440
caguucuuccagcggc

SEQ ID NO: 3589832 - RNA, 23 nt, Pseudomonas putida KT2440
caguucuuccagcggcaagguca

SEQ ID NO: 3589833 - RNA, 15 nt, Pseudomonas putida KT2440
caguucuuggcggcu

SEQ ID NO: 3589834 - RNA, 18 nt, Pseudomonas putida KT2440
caguugcagacgcgcagc

SEQ ID NO: 3589835 - RNA, 19 nt, Pseudomonas putida KT2440
caguugcagacgcgcagca

SEQ ID NO: 3589836 - RNA, 22 nt, Pseudomonas putida KT2440
caguugcagacgcgcagcacuu

SEQ ID NO: 3589837 - RNA, 17 nt, Pseudomonas putida KT2440
caguugccccaggccca

SEQ ID NO: 3589838 - RNA, 15 nt, Pseudomonas putida KT2440
caguugccugccuug

SEQ ID NO: 3589839 - RNA, 22 nt, Pseudomonas putida KT2440
caguugcgggaaggucggccag

SEQ ID NO: 3589840 - RNA, 14 nt, Pseudomonas putida KT2440
caguugcuccuuga

SEQ ID NO: 3589841 - RNA, 14 nt, Pseudomonas putida KT2440
caguugcucgcccg

SEQ ID NO: 3589842 - RNA, 16 nt, Pseudomonas putida KT2440
caguugcucgcccgca

SEQ ID NO: 3589843 - RNA, 12 nt, Pseudomonas putida KT2440
caguugcugcug

SEQ ID NO: 3589844 - RNA, 21 nt, Pseudomonas putida KT2440
caguuggccggcauggcgugc

SEQ ID NO: 3589845 - RNA, 13 nt, Pseudomonas putida KT2440
caguuggcgucca

SEQ ID NO: 3589846 - RNA, 20 nt, Pseudomonas putida KT2440
caguuggcguccagcagugc

SEQ ID NO: 3589847 - RNA, 12 nt, Pseudomonas putida KT2440
caguuggcugcc

SEQ ID NO: 3589848 - RNA, 23 nt, Pseudomonas putida KT2440
caguugguagagcacgaccuugc

SEQ ID NO: 3589849 - RNA, 13 nt, Pseudomonas putida KT2440
caguuguccaggc

SEQ ID NO: 3589850 - RNA, 20 nt, Pseudomonas putida KT2440
caguuguccaggcugcgcau

SEQ ID NO: 3589851 - RNA, 17 nt, Pseudomonas putida KT2440
caguugugacuagagga

SEQ ID NO: 3589852 - RNA, 19 nt, Pseudomonas putida KT2440
caguuguucgucgagcacc

SEQ ID NO: 3589853 - RNA, 15 nt, Pseudomonas putida KT2440
caguuguugggcagc

SEQ ID NO: 3589854 - RNA, 18 nt, Pseudomonas putida KT2440
caguuucaccugaccauc

SEQ ID NO: 3589855 - RNA, 22 nt, Pseudomonas putida KT2440
caguuucaccugaccaucagcc

SEQ ID NO: 3589856 - RNA, 15 nt, Pseudomonas putida KT2440
caguuucgcgacgag

SEQ ID NO: 3589857 - RNA, 18 nt, Pseudomonas putida KT2440
caguuucgcgacgaggcc

SEQ ID NO: 3589858 - RNA, 12 nt, Pseudomonas putida KT2440
caguuucuucag

SEQ ID NO: 3589859 - RNA, 18 nt, Pseudomonas putida KT2440
caguuucuugccuuccac

SEQ ID NO: 3589860 - RNA, 19 nt, Pseudomonas putida KT2440
caguuugcuuuuucgagca

SEQ ID NO: 3589861 - RNA, 17 nt, Pseudomonas putida KT2440
caguuuucaaugcugcu

SEQ ID NO: 3589862 - RNA, 22 nt, Pseudomonas putida KT2440
caguuuucaaugcugcucgccc

SEQ ID NO: 3589863 - RNA, 17 nt, Pseudomonas putida KT2440
caguuuuuguaccugug

SEQ ID NO: 3589864 - RNA, 17 nt, Pseudomonas putida KT2440
cauaaaaaaacccgcug

SEQ ID NO: 3589865 - RNA, 21 nt, Pseudomonas putida KT2440
cauaaaaaagggccccuucaa

SEQ ID NO: 3589866 - RNA, 22 nt, Pseudomonas putida KT2440
cauaaaccccagccuucagcag

SEQ ID NO: 3589867 - RNA, 14 nt, Pseudomonas putida KT2440
cauaaccaccaccg

SEQ ID NO: 3589868 - RNA, 17 nt, Pseudomonas putida KT2440
cauaaccaccaccgacc

SEQ ID NO: 3589869 - RNA, 15 nt, Pseudomonas putida KT2440
cauaaccccccaccc

SEQ ID NO: 3589870 - RNA, 13 nt, Pseudomonas putida KT2440
cauaacggcuggc

SEQ ID NO: 3589871 - RNA, 17 nt, Pseudomonas putida KT2440
cauaagcgacacccugg

SEQ ID NO: 3589872 - RNA, 17 nt, Pseudomonas putida KT2440
cauaagcugucagcacc

SEQ ID NO: 3589873 - RNA, 19 nt, Pseudomonas putida KT2440
cauaagcugucagcaccug

SEQ ID NO: 3589874 - RNA, 13 nt, Pseudomonas putida KT2440
cauacaccccgcg

SEQ ID NO: 3589875 - RNA, 16 nt, Pseudomonas putida KT2440
cauacagccagaaagc

SEQ ID NO: 3589876 - RNA, 21 nt, Pseudomonas putida KT2440
cauacagcgcacucucccgca

SEQ ID NO: 3589877 - RNA, 15 nt, Pseudomonas putida KT2440
cauacagcgccucca

SEQ ID NO: 3589878 - RNA, 18 nt, Pseudomonas putida KT2440
cauacagcucccgcgcau

SEQ ID NO: 3589879 - RNA, 16 nt, Pseudomonas putida KT2440
cauacaggaccaggcc

SEQ ID NO: 3589880 - RNA, 18 nt, Pseudomonas putida KT2440
cauacaggaccaggccga

SEQ ID NO: 3589881 - RNA, 18 nt, Pseudomonas putida KT2440
cauacagggccuggcgcg

SEQ ID NO: 3589882 - RNA, 15 nt, Pseudomonas putida KT2440
cauaccaauggcaau

SEQ ID NO: 3589883 - RNA, 19 nt, Pseudomonas putida KT2440
cauaccaauggcaaucgcc

SEQ ID NO: 3589884 - RNA, 16 nt, Pseudomonas putida KT2440
cauaccacacacccca

SEQ ID NO: 3589885 - RNA, 18 nt, Pseudomonas putida KT2440
cauacccuuugccaucca

SEQ ID NO: 3589886 - RNA, 16 nt, Pseudomonas putida KT2440
cauaccgagaaugaaa

SEQ ID NO: 3589887 - RNA, 17 nt, Pseudomonas putida KT2440
cauaccgcaacaccugc

SEQ ID NO: 3589888 - RNA, 19 nt, Pseudomonas putida KT2440
cauaccgcaacaccugccg

SEQ ID NO: 3589889 - RNA, 13 nt, Pseudomonas putida KT2440
cauaccucccgca

SEQ ID NO: 3589890 - RNA, 18 nt, Pseudomonas putida KT2440
cauaccucccgcacugcu

SEQ ID NO: 3589891 - RNA, 23 nt, Pseudomonas putida KT2440
cauaccucgaccgucgcuggacg

SEQ ID NO: 3589892 - RNA, 15 nt, Pseudomonas putida KT2440
cauaccuucggggau

SEQ ID NO: 3589893 - RNA, 23 nt, Pseudomonas putida KT2440
cauacgcaaucucgacaagcgca

SEQ ID NO: 3589894 - RNA, 16 nt, Pseudomonas putida KT2440
cauacgcaucagcgca

SEQ ID NO: 3589895 - RNA, 22 nt, Pseudomonas putida KT2440
cauacggcgcacucucgucacc

SEQ ID NO: 3589896 - RNA, 18 nt, Pseudomonas putida KT2440
cauacuccagcgucacca

SEQ ID NO: 3589897 - RNA, 16 nt, Pseudomonas putida KT2440
cauacugcuucugccg

SEQ ID NO: 3589898 - RNA, 13 nt, Pseudomonas putida KT2440
cauacuuggccga

SEQ ID NO: 3589899 - RNA, 20 nt, Pseudomonas putida KT2440
cauagaacagguucggcuca

SEQ ID NO: 3589900 - RNA, 13 nt, Pseudomonas putida KT2440
cauagaucagcau

SEQ ID NO: 3589901 - RNA, 16 nt, Pseudomonas putida KT2440
cauagaucagcaucgg

SEQ ID NO: 3589902 - RNA, 11 nt, Pseudomonas putida KT2440
cauagcaccag

SEQ ID NO: 3589903 - RNA, 15 nt, Pseudomonas putida KT2440
caucauggcggugaa

SEQ ID NO: 3589904 - RNA, 17 nt, Pseudomonas putida KT2440
cauccaacgcauccagg

SEQ ID NO: 3589905 - RNA, 18 nt, Pseudomonas putida KT2440
cauccaacgcauccaggc

SEQ ID NO: 3589906 - RNA, 21 nt, Pseudomonas putida KT2440
cauccaacgcugccuugccca

SEQ ID NO: 3589907 - RNA, 18 nt, Pseudomonas putida KT2440
cauccacaaucagcacug

SEQ ID NO: 3589908 - RNA, 19 nt, Pseudomonas putida KT2440
cauccacaaucagcacugu

SEQ ID NO: 3589909 - RNA, 16 nt, Pseudomonas putida KT2440
cauccacaccagcggc

SEQ ID NO: 3589910 - RNA, 12 nt, Pseudomonas putida KT2440
cauccacacccu

SEQ ID NO: 3589911 - RNA, 13 nt, Pseudomonas putida KT2440
cauccacacccug

SEQ ID NO: 3589912 - RNA, 18 nt, Pseudomonas putida KT2440
cauccacacgcugcugcg

SEQ ID NO: 3589913 - RNA, 14 nt, Pseudomonas putida KT2440
cauccacaggcgcc

SEQ ID NO: 3589914 - RNA, 15 nt, Pseudomonas putida KT2440
cauccacaggcgccc

SEQ ID NO: 3589915 - RNA, 16 nt, Pseudomonas putida KT2440
cauccacaggcgcccc

SEQ ID NO: 3589916 - RNA, 18 nt, Pseudomonas putida KT2440
cauccacauaggccagcu

SEQ ID NO: 3589917 - RNA, 17 nt, Pseudomonas putida KT2440
cauccacauccgguggc

SEQ ID NO: 3589918 - RNA, 16 nt, Pseudomonas putida KT2440
cauccaccacccuggc

SEQ ID NO: 3589919 - RNA, 16 nt, Pseudomonas putida KT2440
cauccaccagccccag

SEQ ID NO: 3589920 - RNA, 19 nt, Pseudomonas putida KT2440
cauccaccaggcuggccac

SEQ ID NO: 3589921 - RNA, 15 nt, Pseudomonas putida KT2440
cauccacccacuugg

SEQ ID NO: 3589922 - RNA, 23 nt, Pseudomonas putida KT2440
cauccaccgccccaagcgccuga

SEQ ID NO: 3589923 - RNA, 15 nt, Pseudomonas putida KT2440
cauccaccgcggugu

SEQ ID NO: 3589924 - RNA, 21 nt, Pseudomonas putida KT2440
cauccaccgcggugucuucuu

SEQ ID NO: 3589925 - RNA, 22 nt, Pseudomonas putida KT2440
cauccaccgcggugucuucuuc

SEQ ID NO: 3589926 - RNA, 15 nt, Pseudomonas putida KT2440
cauccagaucggcag

SEQ ID NO: 3589927 - RNA, 12 nt, Pseudomonas putida KT2440
cauccagcagcu

SEQ ID NO: 3589928 - RNA, 16 nt, Pseudomonas putida KT2440
cauccagcaggguggc

SEQ ID NO: 3589929 - RNA, 13 nt, Pseudomonas putida KT2440
cauccagccgcgu

SEQ ID NO: 3589930 - RNA, 14 nt, Pseudomonas putida KT2440
cauccagcgccacc

SEQ ID NO: 3589931 - RNA, 12 nt, Pseudomonas putida KT2440
cauccagcgccg

SEQ ID NO: 3589932 - RNA, 22 nt, Pseudomonas putida KT2440
cauccagcgccucccccagcgc

SEQ ID NO: 3589933 - RNA, 18 nt, Pseudomonas putida KT2440
cauccagcuccagcacca

SEQ ID NO: 3589934 - RNA, 14 nt, Pseudomonas putida KT2440
cauccagcuugcca

SEQ ID NO: 3589935 - RNA, 19 nt, Pseudomonas putida KT2440
cauccaggcccgugacgaa

SEQ ID NO: 3589936 - RNA, 13 nt, Pseudomonas putida KT2440
cauccaggcugca

SEQ ID NO: 3589937 - RNA, 18 nt, Pseudomonas putida KT2440
cauccaggcugcacuggc

SEQ ID NO: 3589938 - RNA, 19 nt, Pseudomonas putida KT2440
cauccaggcugcacuggca

SEQ ID NO: 3589939 - RNA, 15 nt, Pseudomonas putida KT2440
cauccaggcuggcca

SEQ ID NO: 3589940 - RNA, 17 nt, Pseudomonas putida KT2440
cauccaggcuggccagc

SEQ ID NO: 3589941 - RNA, 12 nt, Pseudomonas putida KT2440
cauccagggcuu

SEQ ID NO: 3589942 - RNA, 17 nt, Pseudomonas putida KT2440
cauccagggcuuccugc

SEQ ID NO: 3589943 - RNA, 18 nt, Pseudomonas putida KT2440
cauccaguccgccagcac

SEQ ID NO: 3589944 - RNA, 17 nt, Pseudomonas putida KT2440
cauccagucgaucagcg

SEQ ID NO: 3589945 - RNA, 23 nt, Pseudomonas putida KT2440
cauccagucgaucagcgacacca

SEQ ID NO: 3589946 - RNA, 20 nt, Pseudomonas putida KT2440
cauccagucggcgcuggaca

SEQ ID NO: 3589947 - RNA, 17 nt, Pseudomonas putida KT2440
cauccaucaccauggcu

SEQ ID NO: 3589948 - RNA, 15 nt, Pseudomonas putida KT2440
cauccaucaccugcc

SEQ ID NO: 3589949 - RNA, 15 nt, Pseudomonas putida KT2440
cauccaucgcaaucc

SEQ ID NO: 3589950 - RNA, 16 nt, Pseudomonas putida KT2440
cauccaucgcaauccc

SEQ ID NO: 3589951 - RNA, 17 nt, Pseudomonas putida KT2440
cauccaucgcaaucccc

SEQ ID NO: 3589952 - RNA, 14 nt, Pseudomonas putida KT2440
cauccccccagccc

SEQ ID NO: 3589953 - RNA, 14 nt, Pseudomonas putida KT2440
caucccccggccca

SEQ ID NO: 3589954 - RNA, 19 nt, Pseudomonas putida KT2440
caucccccggcccagcccc

SEQ ID NO: 3589955 - RNA, 20 nt, Pseudomonas putida KT2440
caucccccuccuaaggggaa

SEQ ID NO: 3589956 - RNA, 17 nt, Pseudomonas putida KT2440
cauccccgccgccagca

SEQ ID NO: 3589957 - RNA, 18 nt, Pseudomonas putida KT2440
cauccccuccggaucggu

SEQ ID NO: 3589958 - RNA, 21 nt, Pseudomonas putida KT2440
cauccccuguaggagcgggcu

SEQ ID NO: 3589959 - RNA, 21 nt, Pseudomonas putida KT2440
caucccgcuucgccagcgcca

SEQ ID NO: 3589960 - RNA, 15 nt, Pseudomonas putida KT2440
caucccgucagccga

SEQ ID NO: 3589961 - RNA, 21 nt, Pseudomonas putida KT2440
caucccuggcacgcccggcac

SEQ ID NO: 3589962 - RNA, 19 nt, Pseudomonas putida KT2440
cauccgagcugagcagcgg

SEQ ID NO: 3589963 - RNA, 18 nt, Pseudomonas putida KT2440
cauccgccaggcucucca

SEQ ID NO: 3589964 - RNA, 17 nt, Pseudomonas putida KT2440
cauccgccucauccucg

SEQ ID NO: 3589965 - RNA, 20 nt, Pseudomonas putida KT2440
cauccgccucauccucgccc

SEQ ID NO: 3589966 - RNA, 23 nt, Pseudomonas putida KT2440
cauccggaauuucugcaccuugc

SEQ ID NO: 3589967 - RNA, 17 nt, Pseudomonas putida KT2440
cauccggcagcucaccg

SEQ ID NO: 3589968 - RNA, 17 nt, Pseudomonas putida KT2440
cauccgggccgucaccg

SEQ ID NO: 3589969 - RNA, 20 nt, Pseudomonas putida KT2440
cauccguucggcgcgcugcu

SEQ ID NO: 3589970 - RNA, 20 nt, Pseudomonas putida KT2440
cauccucaaaggcagccucg

SEQ ID NO: 3589971 - RNA, 21 nt, Pseudomonas putida KT2440
cauccucaaaggcagccucgu

SEQ ID NO: 3589972 - RNA, 18 nt, Pseudomonas putida KT2440
cauccuccgcccugcccu

SEQ ID NO: 3589973 - RNA, 16 nt, Pseudomonas putida KT2440
cauccucgacacccag

SEQ ID NO: 3589974 - RNA, 18 nt, Pseudomonas putida KT2440
cauccucgcccaccagcu

SEQ ID NO: 3589975 - RNA, 22 nt, Pseudomonas putida KT2440
cauccucgugauagauaucaag

SEQ ID NO: 3589976 - RNA, 16 nt, Pseudomonas putida KT2440
cauccugcaaggcaau

SEQ ID NO: 3589977 - RNA, 15 nt, Pseudomonas putida KT2440
cauccugcgcggcca

SEQ ID NO: 3589978 - RNA, 19 nt, Pseudomonas putida KT2440
cauccugcgugcugugcac

SEQ ID NO: 3589979 - RNA, 21 nt, Pseudomonas putida KT2440
cauccugcuguagcgcccaca

SEQ ID NO: 3589980 - RNA, 19 nt, Pseudomonas putida KT2440
cauccuggucacucugccg

SEQ ID NO: 3589981 - RNA, 23 nt, Pseudomonas putida KT2440
cauccuggucacucugccgcccc

SEQ ID NO: 3589982 - RNA, 16 nt, Pseudomonas putida KT2440
cauccuuggugcaugc

SEQ ID NO: 3589983 - RNA, 17 nt, Pseudomonas putida KT2440
caucgaacagcuugcca

SEQ ID NO: 3589984 - RNA, 17 nt, Pseudomonas putida KT2440
caucgaagaucagcacc

SEQ ID NO: 3589985 - RNA, 15 nt, Pseudomonas putida KT2440
caucgaagcaggccg

SEQ ID NO: 3589986 - RNA, 18 nt, Pseudomonas putida KT2440
caucgaagcagugcugcc

SEQ ID NO: 3589987 - RNA, 16 nt, Pseudomonas putida KT2440
caucgaaguguugccg

SEQ ID NO: 3589988 - RNA, 21 nt, Pseudomonas putida KT2440
caucgaauuucugcaacagcu

SEQ ID NO: 3589989 - RNA, 13 nt, Pseudomonas putida KT2440
caucgacaggucc

SEQ ID NO: 3589990 - RNA, 19 nt, Pseudomonas putida KT2440
caucgacagguccaccgcu

SEQ ID NO: 3589991 - RNA, 18 nt, Pseudomonas putida KT2440
caucgacaggugcggcag

SEQ ID NO: 3589992 - RNA, 22 nt, Pseudomonas putida KT2440
caucgacaggugcggcagcucg

SEQ ID NO: 3589993 - RNA, 12 nt, Pseudomonas putida KT2440
caucgaccagua

SEQ ID NO: 3589994 - RNA, 15 nt, Pseudomonas putida KT2440
caucgacccgcugcc

SEQ ID NO: 3589995 - RNA, 13 nt, Pseudomonas putida KT2440
caucgacccuggc

SEQ ID NO: 3589996 - RNA, 15 nt, Pseudomonas putida KT2440
caucgaccugccacu

SEQ ID NO: 3589997 - RNA, 20 nt, Pseudomonas putida KT2440
caucgaccugccacugcgcu

SEQ ID NO: 3589998 - RNA, 21 nt, Pseudomonas putida KT2440
caucgaccuggcccgaacgca

SEQ ID NO: 3589999 - RNA, 21 nt, Pseudomonas putida KT2440
caucgacucacgcucguuguc

SEQ ID NO: 3590000 - RNA, 15 nt, Pseudomonas putida KT2440
caucgacuggaugcu

SEQ ID NO: 3590001 - RNA, 16 nt, Pseudomonas putida KT2440
caucgaggaaagggca

SEQ ID NO: 3590002 - RNA, 17 nt, Pseudomonas putida KT2440
caucgaggcgcgcgccu

SEQ ID NO: 3590003 - RNA, 20 nt, Pseudomonas putida KT2440
caucgaggcgcgcgccuggg

SEQ ID NO: 3590004 - RNA, 19 nt, Pseudomonas putida KT2440
caucgaguaucgccucgau

SEQ ID NO: 3590005 - RNA, 18 nt, Pseudomonas putida KT2440
caucgaucccuggggcca

SEQ ID NO: 3590006 - RNA, 23 nt, Pseudomonas putida KT2440
caucgaucccuggggccaagugg

SEQ ID NO: 3590007 - RNA, 19 nt, Pseudomonas putida KT2440
caucgaugcccgucccuuc

SEQ ID NO: 3590008 - RNA, 12 nt, Pseudomonas putida KT2440
caugaaggugua

SEQ ID NO: 3590009 - RNA, 15 nt, Pseudomonas putida KT2440
caugacaaagcggau

SEQ ID NO: 3590010 - RNA, 16 nt, Pseudomonas putida KT2440
caugacaaagcggauc

SEQ ID NO: 3590011 - RNA, 15 nt, Pseudomonas putida KT2440
caugagccuggccgg

SEQ ID NO: 3590012 - RNA, 23 nt, Pseudomonas putida KT2440
caugagccuggccgguguggcca

SEQ ID NO: 3590013 - RNA, 18 nt, Pseudomonas putida KT2440
caugagcgagcucaacca

SEQ ID NO: 3590014 - RNA, 16 nt, Pseudomonas putida KT2440
caugagugcaggcaua

SEQ ID NO: 3590015 - RNA, 23 nt, Pseudomonas putida KT2440
caugaucaccgccagcggcaagc

SEQ ID NO: 3590016 - RNA, 18 nt, Pseudomonas putida KT2440
caugaucagcugccacuc

SEQ ID NO: 3590017 - RNA, 14 nt, Pseudomonas putida KT2440
caugaucgccgccg

SEQ ID NO: 3590018 - RNA, 23 nt, Pseudomonas putida KT2440
caugaucgcggcaaugcgccggu

SEQ ID NO: 3590019 - RNA, 19 nt, Pseudomonas putida KT2440
caugaucucgcccaugaug

SEQ ID NO: 3590020 - RNA, 15 nt, Pseudomonas putida KT2440
caugaugaccaccag

SEQ ID NO: 3590021 - RNA, 17 nt, Pseudomonas putida KT2440
caugaugaccaccagga

SEQ ID NO: 3590022 - RNA, 15 nt, Pseudomonas putida KT2440
caugauguucugcuu

SEQ ID NO: 3590023 - RNA, 18 nt, Pseudomonas putida KT2440
caugauugcgggcuuucu

SEQ ID NO: 3590024 - RNA, 16 nt, Pseudomonas putida KT2440
caugcaauaaccaauc

SEQ ID NO: 3590025 - RNA, 20 nt, Pseudomonas putida KT2440
caugcacaacgcgcgggcaa

SEQ ID NO: 3590026 - RNA, 14 nt, Pseudomonas putida KT2440
caugcacagcgagc

SEQ ID NO: 3590027 - RNA, 17 nt, Pseudomonas putida KT2440
caugcaccacgccacca

SEQ ID NO: 3590028 - RNA, 14 nt, Pseudomonas putida KT2440
caugcacuuccagg

SEQ ID NO: 3590029 - RNA, 17 nt, Pseudomonas putida KT2440
caugcagcaccuccugc

SEQ ID NO: 3590030 - RNA, 14 nt, Pseudomonas putida KT2440
caugcagcccgcac

SEQ ID NO: 3590031 - RNA, 20 nt, Pseudomonas putida KT2440
caugcagcgucggcagagcg

SEQ ID NO: 3590032 - RNA, 22 nt, Pseudomonas putida KT2440
caugcagcgucggcagagcgcc

SEQ ID NO: 3590033 - RNA, 12 nt, Pseudomonas putida KT2440
caugcaggucga

SEQ ID NO: 3590034 - RNA, 17 nt, Pseudomonas putida KT2440
caugcaggucgaccugc

SEQ ID NO: 3590035 - RNA, 19 nt, Pseudomonas putida KT2440
caugcaggucgaccugcca

SEQ ID NO: 3590036 - RNA, 15 nt, Pseudomonas putida KT2440
caugcaggucgacga

SEQ ID NO: 3590037 - RNA, 20 nt, Pseudomonas putida KT2440
caugcagguucgaccagaac

SEQ ID NO: 3590038 - RNA, 21 nt, Pseudomonas putida KT2440
caugcagguugcccucggcca

SEQ ID NO: 3590039 - RNA, 18 nt, Pseudomonas putida KT2440
caugcaguucuaccagca

SEQ ID NO: 3590040 - RNA, 19 nt, Pseudomonas putida KT2440
caugcaguucuaccagcag

SEQ ID NO: 3590041 - RNA, 22 nt, Pseudomonas putida KT2440
caugcaguucuaccagcagcuc

SEQ ID NO: 3590042 - RNA, 17 nt, Pseudomonas putida KT2440
caugcaguugagcccuc

SEQ ID NO: 3590043 - RNA, 18 nt, Pseudomonas putida KT2440
caugcaucugcgccccgc

SEQ ID NO: 3590044 - RNA, 17 nt, Pseudomonas putida KT2440
caugccacccaugccac

SEQ ID NO: 3590045 - RNA, 18 nt, Pseudomonas putida KT2440
caugccacccccggccga

SEQ ID NO: 3590046 - RNA, 19 nt, Pseudomonas putida KT2440
caugccacccccggccgac

SEQ ID NO: 3590047 - RNA, 22 nt, Pseudomonas putida KT2440
caugccaccgccacugaccagc

SEQ ID NO: 3590048 - RNA, 14 nt, Pseudomonas putida KT2440
caugccacggccuu

SEQ ID NO: 3590049 - RNA, 19 nt, Pseudomonas putida KT2440
caugccacggccuucuuca

SEQ ID NO: 3590050 - RNA, 13 nt, Pseudomonas putida KT2440
caugccagcagcu

SEQ ID NO: 3590051 - RNA, 21 nt, Pseudomonas putida KT2440
caugccagcuaucucccagcc

SEQ ID NO: 3590052 - RNA, 22 nt, Pseudomonas putida KT2440
caugccagcuaucucccagccu

SEQ ID NO: 3590053 - RNA, 17 nt, Pseudomonas putida KT2440
caugccauccucggcca

SEQ ID NO: 3590054 - RNA, 20 nt, Pseudomonas putida KT2440
caugccauccucggccaggc

SEQ ID NO: 3590055 - RNA, 16 nt, Pseudomonas putida KT2440
caugcccacaggggcu

SEQ ID NO: 3590056 - RNA, 23 nt, Pseudomonas putida KT2440
caugcccaccgcauugcaggcca

SEQ ID NO: 3590057 - RNA, 17 nt, Pseudomonas putida KT2440
caugcccaccgcugcaa

SEQ ID NO: 3590058 - RNA, 14 nt, Pseudomonas putida KT2440
caugcccagcgcca

SEQ ID NO: 3590059 - RNA, 17 nt, Pseudomonas putida KT2440
caugcccagcgccaccg

SEQ ID NO: 3590060 - RNA, 19 nt, Pseudomonas putida KT2440
caugcccagcgccaccggc

SEQ ID NO: 3590061 - RNA, 23 nt, Pseudomonas putida KT2440
caugcccagcgccaccggcagca

SEQ ID NO: 3590062 - RNA, 18 nt, Pseudomonas putida KT2440
caugcccagcucgcuggc

SEQ ID NO: 3590063 - RNA, 16 nt, Pseudomonas putida KT2440
caugcccauggccagc

SEQ ID NO: 3590064 - RNA, 14 nt, Pseudomonas putida KT2440
caugccccgcaccu

SEQ ID NO: 3590065 - RNA, 18 nt, Pseudomonas putida KT2440
caugccccgggugcagcc

SEQ ID NO: 3590066 - RNA, 13 nt, Pseudomonas putida KT2440
caugccccuaccg

SEQ ID NO: 3590067 - RNA, 23 nt, Pseudomonas putida KT2440
caugcccgccccugccagcacca

SEQ ID NO: 3590068 - RNA, 17 nt, Pseudomonas putida KT2440
caugcccgcgaagggcu

SEQ ID NO: 3590069 - RNA, 23 nt, Pseudomonas putida KT2440
caugcccgcgaagggcucaacac

SEQ ID NO: 3590070 - RNA, 22 nt, Pseudomonas putida KT2440
caugcccgcggcucacccacca

SEQ ID NO: 3590071 - RNA, 17 nt, Pseudomonas putida KT2440
caugcccgcgucugccg

SEQ ID NO: 3590072 - RNA, 22 nt, Pseudomonas putida KT2440
caugcccgcucccacaggucca

SEQ ID NO: 3590073 - RNA, 13 nt, Pseudomonas putida KT2440
caugccgauaugc

SEQ ID NO: 3590074 - RNA, 15 nt, Pseudomonas putida KT2440
caugccgauaugccg

SEQ ID NO: 3590075 - RNA, 23 nt, Pseudomonas putida KT2440
caugccgaugucggcgugcacca

SEQ ID NO: 3590076 - RNA, 14 nt, Pseudomonas putida KT2440
caugccgccgaugu

SEQ ID NO: 3590077 - RNA, 22 nt, Pseudomonas putida KT2440
caugccggcaacgauacccacg

SEQ ID NO: 3590078 - RNA, 19 nt, Pseudomonas putida KT2440
caugccggccaccacacug

SEQ ID NO: 3590079 - RNA, 15 nt, Pseudomonas putida KT2440
caugccggccccaga

SEQ ID NO: 3590080 - RNA, 16 nt, Pseudomonas putida KT2440
caugccguaagccgca

SEQ ID NO: 3590081 - RNA, 21 nt, Pseudomonas putida KT2440
caugccguaagccgcaggcca

SEQ ID NO: 3590082 - RNA, 17 nt, Pseudomonas putida KT2440
caugccuaucucuucca

SEQ ID NO: 3590083 - RNA, 18 nt, Pseudomonas putida KT2440
caugccugugauuuacgc

SEQ ID NO: 3590084 - RNA, 20 nt, Pseudomonas putida KT2440
caugccuuggcuacgcaagg

SEQ ID NO: 3590085 - RNA, 18 nt, Pseudomonas putida KT2440
caugcgaacgcaggcgcg

SEQ ID NO: 3590086 - RNA, 14 nt, Pseudomonas putida KT2440
caugcgaccaguac

SEQ ID NO: 3590087 - RNA, 23 nt, Pseudomonas putida KT2440
caugcgcaggcuuguccuugagc

SEQ ID NO: 3590088 - RNA, 18 nt, Pseudomonas putida KT2440
caugcgccacacccgcua

SEQ ID NO: 3590089 - RNA, 17 nt, Pseudomonas putida KT2440
caugcgcccuggcggcc

SEQ ID NO: 3590090 - RNA, 14 nt, Pseudomonas putida KT2440
caugcgccgcugcu

SEQ ID NO: 3590091 - RNA, 16 nt, Pseudomonas putida KT2440
caugcgcgaaugaaug

SEQ ID NO: 3590092 - RNA, 14 nt, Pseudomonas putida KT2440
caugcgcgacagca

SEQ ID NO: 3590093 - RNA, 15 nt, Pseudomonas putida KT2440
caugcgcgacagcau

SEQ ID NO: 3590094 - RNA, 17 nt, Pseudomonas putida KT2440
caugcgcgacagcauca

SEQ ID NO: 3590095 - RNA, 15 nt, Pseudomonas putida KT2440
caugcgcgcagcgaa

SEQ ID NO: 3590096 - RNA, 16 nt, Pseudomonas putida KT2440
caugcgcgcagcgaac

SEQ ID NO: 3590097 - RNA, 21 nt, Pseudomonas putida KT2440
caugcgcgcgcgguucaccag

SEQ ID NO: 3590098 - RNA, 14 nt, Pseudomonas putida KT2440
caugcgcggguccg

SEQ ID NO: 3590099 - RNA, 13 nt, Pseudomonas putida KT2440
caugcgcuggcca

SEQ ID NO: 3590100 - RNA, 22 nt, Pseudomonas putida KT2440
caugcgcuggccacgacguguc

SEQ ID NO: 3590101 - RNA, 13 nt, Pseudomonas putida KT2440
caugcggcccuug

SEQ ID NO: 3590102 - RNA, 19 nt, Pseudomonas putida KT2440
caugcggcuacccagccgg

SEQ ID NO: 3590103 - RNA, 14 nt, Pseudomonas putida KT2440
caugcgggccggca

SEQ ID NO: 3590104 - RNA, 24 nt, Pseudomonas putida KT2440
caugcgggccggcacgacuucgca

SEQ ID NO: 3590105 - RNA, 18 nt, Pseudomonas putida KT2440
caugcucaccagcuucug

SEQ ID NO: 3590106 - RNA, 14 nt, Pseudomonas putida KT2440
caugcucagcuggg

SEQ ID NO: 3590107 - RNA, 15 nt, Pseudomonas putida KT2440
caugcucaucgcggc

SEQ ID NO: 3590108 - RNA, 13 nt, Pseudomonas putida KT2440
caugcucaugcgc

SEQ ID NO: 3590109 - RNA, 22 nt, Pseudomonas putida KT2440
caugcucggccagcucgccaaa

SEQ ID NO: 3590110 - RNA, 22 nt, Pseudomonas putida KT2440
caugcucggcggugccugcagc

SEQ ID NO: 3590111 - RNA, 14 nt, Pseudomonas putida KT2440
caugcucugcgcaa

SEQ ID NO: 3590112 - RNA, 14 nt, Pseudomonas putida KT2440
caugcugaugcggu

SEQ ID NO: 3590113 - RNA, 16 nt, Pseudomonas putida KT2440
cauucaggaugcuucg

SEQ ID NO: 3590114 - RNA, 19 nt, Pseudomonas putida KT2440
cauucaggcacggcaccag

SEQ ID NO: 3590115 - RNA, 22 nt, Pseudomonas putida KT2440
cauucaggcacggcaccagcac

SEQ ID NO: 3590116 - RNA, 13 nt, Pseudomonas putida KT2440
cauucaggccauc

SEQ ID NO: 3590117 - RNA, 14 nt, Pseudomonas putida KT2440
cauucaggccaucu

SEQ ID NO: 3590118 - RNA, 23 nt, Pseudomonas putida KT2440
cauucaucguauugccccggcca

SEQ ID NO: 3590119 - RNA, 16 nt, Pseudomonas putida KT2440
cauucgauagccugca

SEQ ID NO: 3590120 - RNA, 17 nt, Pseudomonas putida KT2440
cauucgcauuaccagca

SEQ ID NO: 3590121 - RNA, 18 nt, Pseudomonas putida KT2440
cauucgcauuaccagcac

SEQ ID NO: 3590122 - RNA, 20 nt, Pseudomonas putida KT2440
cauucgcauuaccagcacca

SEQ ID NO: 3590123 - RNA, 13 nt, Pseudomonas putida KT2440
cauucgcccgcac

SEQ ID NO: 3590124 - RNA, 23 nt, Pseudomonas putida KT2440
cauucgcgccauggcuugcguuu

SEQ ID NO: 3590125 - RNA, 18 nt, Pseudomonas putida KT2440
cauucgcgcccgcagugc

SEQ ID NO: 3590126 - RNA, 19 nt, Pseudomonas putida KT2440
cauucgcgcccgcagugca

SEQ ID NO: 3590127 - RNA, 20 nt, Pseudomonas putida KT2440
cauucgcgggcaagcccgcu

SEQ ID NO: 3590128 - RNA, 13 nt, Pseudomonas putida KT2440
cauucgcgggcau

SEQ ID NO: 3590129 - RNA, 20 nt, Pseudomonas putida KT2440
cauucgcgggcaugcccgcu

SEQ ID NO: 3590130 - RNA, 20 nt, Pseudomonas putida KT2440
cauucgcggguaaacccgcg

SEQ ID NO: 3590131 - RNA, 21 nt, Pseudomonas putida KT2440
cauucgcggguaaacccgcgc

SEQ ID NO: 3590132 - RNA, 20 nt, Pseudomonas putida KT2440
cauucgcggguaaacccgcu

SEQ ID NO: 3590133 - RNA, 19 nt, Pseudomonas putida KT2440
cauucgcgggugaacccgc

SEQ ID NO: 3590134 - RNA, 19 nt, Pseudomonas putida KT2440
cauucgcugcgucaggcca

SEQ ID NO: 3590135 - RNA, 20 nt, Pseudomonas putida KT2440
cauucggugacgaucaccag

SEQ ID NO: 3590136 - RNA, 18 nt, Pseudomonas putida KT2440
cauucggugcagcggcag

SEQ ID NO: 3590137 - RNA, 12 nt, Pseudomonas putida KT2440
cauugaagaagc

SEQ ID NO: 3590138 - RNA, 15 nt, Pseudomonas putida KT2440
cauugacagcuuuug

SEQ ID NO: 3590139 - RNA, 18 nt, Pseudomonas putida KT2440
cauugacccgcuugcagu

SEQ ID NO: 3590140 - RNA, 22 nt, Pseudomonas putida KT2440
cauugacccgcuugcaguuguc

SEQ ID NO: 3590141 - RNA, 17 nt, Pseudomonas putida KT2440
cauugaggaugcugaag

SEQ ID NO: 3590142 - RNA, 18 nt, Pseudomonas putida KT2440
cauugaggaugcugaagc

SEQ ID NO: 3590143 - RNA, 16 nt, Pseudomonas putida KT2440
cauugauagcggcagc

SEQ ID NO: 3590144 - RNA, 14 nt, Pseudomonas putida KT2440
cauugaugaacgac

SEQ ID NO: 3590145 - RNA, 19 nt, Pseudomonas putida KT2440
cauugaugccgaaggccuu

SEQ ID NO: 3590146 - RNA, 16 nt, Pseudomonas putida KT2440
cauugcaagguccuug

SEQ ID NO: 3590147 - RNA, 17 nt, Pseudomonas putida KT2440
cauugcaagguccuugu

SEQ ID NO: 3590148 - RNA, 20 nt, Pseudomonas putida KT2440
cauugcaccacccccagcgc

SEQ ID NO: 3590149 - RNA, 21 nt, Pseudomonas putida KT2440
cauugcaccacccccagcgcc

SEQ ID NO: 3590150 - RNA, 13 nt, Pseudomonas putida KT2440
cauugcagcccca

SEQ ID NO: 3590151 - RNA, 15 nt, Pseudomonas putida KT2440
cauugcaggccagcg

SEQ ID NO: 3590152 - RNA, 21 nt, Pseudomonas putida KT2440
cauugcagggcggccucggcc

SEQ ID NO: 3590153 - RNA, 23 nt, Pseudomonas putida KT2440
cauugccaacagcaguugcugcu

SEQ ID NO: 3590154 - RNA, 16 nt, Pseudomonas putida KT2440
cauugcccaagcgcuc

SEQ ID NO: 3590155 - RNA, 21 nt, Pseudomonas putida KT2440
cauugcccaagcgcuccgcca

SEQ ID NO: 3590156 - RNA, 15 nt, Pseudomonas putida KT2440
cauugcccagccugc

SEQ ID NO: 3590157 - RNA, 21 nt, Pseudomonas putida KT2440
cauugccgucaagcuggcgca

SEQ ID NO: 3590158 - RNA, 19 nt, Pseudomonas putida KT2440
cauugccuguuccggcccu

SEQ ID NO: 3590159 - RNA, 14 nt, Pseudomonas putida KT2440
cauuggagcguugc

SEQ ID NO: 3590160 - RNA, 21 nt, Pseudomonas putida KT2440
cauuggagcguugcaggcgcu

SEQ ID NO: 3590161 - RNA, 20 nt, Pseudomonas putida KT2440
cauuggcaaacgccuguuuc

SEQ ID NO: 3590162 - RNA, 23 nt, Pseudomonas putida KT2440
cauuggcaauugcggguguggcc

SEQ ID NO: 3590163 - RNA, 17 nt, Pseudomonas putida KT2440
cauuggcggcaggcgca

SEQ ID NO: 3590164 - RNA, 23 nt, Pseudomonas putida KT2440
cauuggcggcaggcgcagcugcc

SEQ ID NO: 3590165 - RNA, 18 nt, Pseudomonas putida KT2440
cauuggcgucagcguugc

SEQ ID NO: 3590166 - RNA, 18 nt, Pseudomonas putida KT2440
cauuggcgugcucgcgca

SEQ ID NO: 3590167 - RNA, 14 nt, Pseudomonas putida KT2440
cauuggcguugagc

SEQ ID NO: 3590168 - RNA, 19 nt, Pseudomonas putida KT2440
cauuggcguugagccgcca

SEQ ID NO: 3590169 - RNA, 16 nt, Pseudomonas putida KT2440
cauuggugccagcgcc

SEQ ID NO: 3590170 - RNA, 18 nt, Pseudomonas putida KT2440
cauuggugccagcgccaa

SEQ ID NO: 3590171 - RNA, 22 nt, Pseudomonas putida KT2440
cauuggugugggugaaguguua

SEQ ID NO: 3590172 - RNA, 20 nt, Pseudomonas putida KT2440
cauuguaucggaaagccgag

SEQ ID NO: 3590173 - RNA, 16 nt, Pseudomonas putida KT2440
cauugucauugcccaa

SEQ ID NO: 3590174 - RNA, 14 nt, Pseudomonas putida KT2440
cauugugcgccccc

SEQ ID NO: 3590175 - RNA, 16 nt, Pseudomonas putida KT2440
cauuguucgccucguc

SEQ ID NO: 3590176 - RNA, 18 nt, Pseudomonas putida KT2440
cauuguucuggccaccga

SEQ ID NO: 3590177 - RNA, 19 nt, Pseudomonas putida KT2440
cauuguugcaacgcagcgc

SEQ ID NO: 3590178 - RNA, 20 nt, Pseudomonas putida KT2440
cauuguugcaacgcagcgcg

SEQ ID NO: 3590179 - RNA, 21 nt, Pseudomonas putida KT2440
cauuucacgcacggccuuccc

SEQ ID NO: 3590180 - RNA, 13 nt, Pseudomonas putida KT2440
cauuucacuggcu

SEQ ID NO: 3590181 - RNA, 15 nt, Pseudomonas putida KT2440
cauuucccuacagcc

SEQ ID NO: 3590182 - RNA, 22 nt, Pseudomonas putida KT2440
cauuuccggcccgguuggcgcu

SEQ ID NO: 3590183 - RNA, 17 nt, Pseudomonas putida KT2440
cauuuccgggcaaugca

SEQ ID NO: 3590184 - RNA, 23 nt, Pseudomonas putida KT2440
cauuuccggguuaccgcacagca

SEQ ID NO: 3590185 - RNA, 15 nt, Pseudomonas putida KT2440
cauuucgaagcuguc

SEQ ID NO: 3590186 - RNA, 19 nt, Pseudomonas putida KT2440
cauuucggugaagaucgcc

SEQ ID NO: 3590187 - RNA, 14 nt, Pseudomonas putida KT2440
cauuucguccaggc

SEQ ID NO: 3590188 - RNA, 16 nt, Pseudomonas putida KT2440
cauuucguccaggcuc

SEQ ID NO: 3590189 - RNA, 19 nt, Pseudomonas putida KT2440
cauuucuucagcaggaagc

SEQ ID NO: 3590190 - RNA, 19 nt, Pseudomonas putida KT2440
cauuugcagcacaaggcug

SEQ ID NO: 3590191 - RNA, 16 nt, Pseudomonas putida KT2440
cauuugcuccagggca

SEQ ID NO: 3590192 - RNA, 18 nt, Pseudomonas putida KT2440
cauuugcucgacaaaccc

SEQ ID NO: 3590193 - RNA, 21 nt, Pseudomonas putida KT2440
cauuugcucgacaaacccgug

SEQ ID NO: 3590194 - RNA, 18 nt, Pseudomonas putida KT2440
cauuugcuuugcgggcau

SEQ ID NO: 3590195 - RNA, 21 nt, Pseudomonas putida KT2440
cauuuggcgccggugugcauu

SEQ ID NO: 3590196 - RNA, 21 nt, Pseudomonas putida KT2440
cauuuguggacgagguugcca

SEQ ID NO: 3590197 - RNA, 22 nt, Pseudomonas putida KT2440
cauuuuggauuuuuuguagauu

SEQ ID NO: 3590198 - RNA, 15 nt, Pseudomonas putida KT2440
ccaaaaccuguucca

SEQ ID NO: 3590199 - RNA, 18 nt, Pseudomonas putida KT2440
ccaaaaguugcucaaacc

SEQ ID NO: 3590200 - RNA, 22 nt, Pseudomonas putida KT2440
ccaaacaggaucuccucggcca

SEQ ID NO: 3590201 - RNA, 22 nt, Pseudomonas putida KT2440
ccaaacauaaggaguaccgagc

SEQ ID NO: 3590202 - RNA, 13 nt, Pseudomonas putida KT2440
ccaaaccccagca

SEQ ID NO: 3590203 - RNA, 17 nt, Pseudomonas putida KT2440
ccaaaccguccagguag

SEQ ID NO: 3590204 - RNA, 14 nt, Pseudomonas putida KT2440
ccaaacgcccgcgc

SEQ ID NO: 3590205 - RNA, 15 nt, Pseudomonas putida KT2440
ccaaagcuguugaag

SEQ ID NO: 3590206 - RNA, 21 nt, Pseudomonas putida KT2440
ccaaaggcccgugguuggagc

SEQ ID NO: 3590207 - RNA, 19 nt, Pseudomonas putida KT2440
ccaaaggcgcgucccccgg

SEQ ID NO: 3590208 - RNA, 11 nt, Pseudomonas putida KT2440
ccaaagggcug

SEQ ID NO: 3590209 - RNA, 22 nt, Pseudomonas putida KT2440
ccaaagggcugggcgaacgccu

SEQ ID NO: 3590210 - RNA, 14 nt, Pseudomonas putida KT2440
ccaaagucagccag

SEQ ID NO: 3590211 - RNA, 16 nt, Pseudomonas putida KT2440
ccaaagucagccagcc

SEQ ID NO: 3590212 - RNA, 18 nt, Pseudomonas putida KT2440
ccaaaguccggcgaagca

SEQ ID NO: 3590213 - RNA, 16 nt, Pseudomonas putida KT2440
ccaaaguccugcaaag

SEQ ID NO: 3590214 - RNA, 19 nt, Pseudomonas putida KT2440
ccaaaguccugcaaaggcc

SEQ ID NO: 3590215 - RNA, 21 nt, Pseudomonas putida KT2440
ccaaaugcccgccaaaaggcc

SEQ ID NO: 3590216 - RNA, 18 nt, Pseudomonas putida KT2440
ccaaauguuacggacccu

SEQ ID NO: 3590217 - RNA, 20 nt, Pseudomonas putida KT2440
ccaaauguuacggacccuau

SEQ ID NO: 3590218 - RNA, 18 nt, Pseudomonas putida KT2440
ccaaauucgaccagcagu

SEQ ID NO: 3590219 - RNA, 21 nt, Pseudomonas putida KT2440
ccaaauugggcugggcgucaa

SEQ ID NO: 3590220 - RNA, 18 nt, Pseudomonas putida KT2440
ccaacaaucgcgucagca

SEQ ID NO: 3590221 - RNA, 22 nt, Pseudomonas putida KT2440
ccaacacccggugugugcccac

SEQ ID NO: 3590222 - RNA, 17 nt, Pseudomonas putida KT2440
ccaacacccucacccac

SEQ ID NO: 3590223 - RNA, 20 nt, Pseudomonas putida KT2440
ccaacaccggcgaugccgag

SEQ ID NO: 3590224 - RNA, 20 nt, Pseudomonas putida KT2440
ccaacacggugaugcgcccu

SEQ ID NO: 3590225 - RNA, 12 nt, Pseudomonas putida KT2440
ccaacagaggcc

SEQ ID NO: 3590226 - RNA, 15 nt, Pseudomonas putida KT2440
ccaacaggcucucca

SEQ ID NO: 3590227 - RNA, 17 nt, Pseudomonas putida KT2440
ccaacaggcuggcaucg

SEQ ID NO: 3590228 - RNA, 16 nt, Pseudomonas putida KT2440
ccaacaguugaccaag

SEQ ID NO: 3590229 - RNA, 12 nt, Pseudomonas putida KT2440
ccaacauucacg

SEQ ID NO: 3590230 - RNA, 18 nt, Pseudomonas putida KT2440
ccaaccaaaggaggcugu

SEQ ID NO: 3590231 - RNA, 18 nt, Pseudomonas putida KT2440
ccaaccagccagccacca

SEQ ID NO: 3590232 - RNA, 13 nt, Pseudomonas putida KT2440
ccaaccagcucac

SEQ ID NO: 3590233 - RNA, 11 nt, Pseudomonas putida KT2440
ccaaccccagc

SEQ ID NO: 3590234 - RNA, 12 nt, Pseudomonas putida KT2440
ccaaccccagcg

SEQ ID NO: 3590235 - RNA, 14 nt, Pseudomonas putida KT2440
ccaaccccagcgca

SEQ ID NO: 3590236 - RNA, 16 nt, Pseudomonas putida KT2440
ccaaccccaggcgcac

SEQ ID NO: 3590237 - RNA, 18 nt, Pseudomonas putida KT2440
ccaaccccgcagacagcu

SEQ ID NO: 3590238 - RNA, 17 nt, Pseudomonas putida KT2440
ccaacccggucccgccc

SEQ ID NO: 3590239 - RNA, 24 nt, Pseudomonas putida KT2440
ccaacccggucccgcccuccagcc

SEQ ID NO: 3590240 - RNA, 18 nt, Pseudomonas putida KT2440
ccaacccucacucgcggc

SEQ ID NO: 3590241 - RNA, 15 nt, Pseudomonas putida KT2440
ccaacccugcgccca

SEQ ID NO: 3590242 - RNA, 15 nt, Pseudomonas putida KT2440
ccaaccgcaagcggc

SEQ ID NO: 3590243 - RNA, 13 nt, Pseudomonas putida KT2440
ccaaccgcgugcu

SEQ ID NO: 3590244 - RNA, 16 nt, Pseudomonas putida KT2440
ccaaccgcucucgauc

SEQ ID NO: 3590245 - RNA, 15 nt, Pseudomonas putida KT2440
ccaaccgcuucaccg

SEQ ID NO: 3590246 - RNA, 22 nt, Pseudomonas putida KT2440
ccaaccgcuucaccgcgcaccu

SEQ ID NO: 3590247 - RNA, 19 nt, Pseudomonas putida KT2440
ccaaccugccaugcagguc

SEQ ID NO: 3590248 - RNA, 21 nt, Pseudomonas putida KT2440
ccaaccugccgaucuucgccc

SEQ ID NO: 3590249 - RNA, 16 nt, Pseudomonas putida KT2440
ccaaccuuccagcaaa

SEQ ID NO: 3590250 - RNA, 15 nt, Pseudomonas putida KT2440
ccaacgauuggcagu

SEQ ID NO: 3590251 - RNA, 15 nt, Pseudomonas putida KT2440
ccaacgcaccgacca

SEQ ID NO: 3590252 - RNA, 14 nt, Pseudomonas putida KT2440
ccaacgcagcaugc

SEQ ID NO: 3590253 - RNA, 21 nt, Pseudomonas putida KT2440
ccaacgcugccuugcccagcu

SEQ ID NO: 3590254 - RNA, 15 nt, Pseudomonas putida KT2440
ccaacggcacucgaa

SEQ ID NO: 3590255 - RNA, 12 nt, Pseudomonas putida KT2440
ccaacuccagcg

SEQ ID NO: 3590256 - RNA, 18 nt, Pseudomonas putida KT2440
ccaacuccccacccaggu

SEQ ID NO: 3590257 - RNA, 20 nt, Pseudomonas putida KT2440
ccaacucgcgcauccagcca

SEQ ID NO: 3590258 - RNA, 21 nt, Pseudomonas putida KT2440
ccaacugcaauucgugaacca

SEQ ID NO: 3590259 - RNA, 15 nt, Pseudomonas putida KT2440
ccaacugcgcccgcc

SEQ ID NO: 3590260 - RNA, 16 nt, Pseudomonas putida KT2440
ccaacugcgcccgccc

SEQ ID NO: 3590261 - RNA, 15 nt, Pseudomonas putida KT2440
ccaacugcucuacca

SEQ ID NO: 3590262 - RNA, 18 nt, Pseudomonas putida KT2440
ccaacuggcgcaucuucc

SEQ ID NO: 3590263 - RNA, 17 nt, Pseudomonas putida KT2440
ccaacuguuucugcucu

SEQ ID NO: 3590264 - RNA, 19 nt, Pseudomonas putida KT2440
ccaacuguuucugcucuuc

SEQ ID NO: 3590265 - RNA, 22 nt, Pseudomonas putida KT2440
ccaacuucgugcucggcacugc

SEQ ID NO: 3590266 - RNA, 15 nt, Pseudomonas putida KT2440
ccaacuugccaaaau

SEQ ID NO: 3590267 - RNA, 22 nt, Pseudomonas putida KT2440
ccaacuuuuccgcuuugcacug

SEQ ID NO: 3590268 - RNA, 15 nt, Pseudomonas putida KT2440
ccaagcaacgcaaca

SEQ ID NO: 3590269 - RNA, 15 nt, Pseudomonas putida KT2440
ccaagcacgcacagu

SEQ ID NO: 3590270 - RNA, 14 nt, Pseudomonas putida KT2440
ccaagcacggcgcc

SEQ ID NO: 3590271 - RNA, 24 nt, Pseudomonas putida KT2440
ccaagccaccgccaccaucggcca

SEQ ID NO: 3590272 - RNA, 18 nt, Pseudomonas putida KT2440
ccaagccacuggccagca

SEQ ID NO: 3590273 - RNA, 17 nt, Pseudomonas putida KT2440
ccaagcccacacaccgc

SEQ ID NO: 3590274 - RNA, 18 nt, Pseudomonas putida KT2440
ccaagcccacacaccgca

SEQ ID NO: 3590275 - RNA, 21 nt, Pseudomonas putida KT2440
ccaagcccuucucgcucagca

SEQ ID NO: 3590276 - RNA, 17 nt, Pseudomonas putida KT2440
ccaagccgcugccacag

SEQ ID NO: 3590277 - RNA, 18 nt, Pseudomonas putida KT2440
ccaagccgcugccacagg

SEQ ID NO: 3590278 - RNA, 23 nt, Pseudomonas putida KT2440
ccaagcgcuccgccaauugcgcc

SEQ ID NO: 3590279 - RNA, 20 nt, Pseudomonas putida KT2440
ccaagcggcacuaccaggcc

SEQ ID NO: 3590280 - RNA, 18 nt, Pseudomonas putida KT2440
ccaagcggcagaacacau

SEQ ID NO: 3590281 - RNA, 21 nt, Pseudomonas putida KT2440
ccaagcggcagaacacaucgg

SEQ ID NO: 3590282 - RNA, 16 nt, Pseudomonas putida KT2440
ccaagcggccccagau

SEQ ID NO: 3590283 - RNA, 14 nt, Pseudomonas putida KT2440
ccaagcgucggcca

SEQ ID NO: 3590284 - RNA, 18 nt, Pseudomonas putida KT2440
ccaagcgucggccaccug

SEQ ID NO: 3590285 - RNA, 18 nt, Pseudomonas putida KT2440
ccaaggaacugcgcugcc

SEQ ID NO: 3590286 - RNA, 18 nt, Pseudomonas putida KT2440
ccaaggaccagacccgcu

SEQ ID NO: 3590287 - RNA, 18 nt, Pseudomonas putida KT2440
ccaaggaucagcucggca

SEQ ID NO: 3590288 - RNA, 20 nt, Pseudomonas putida KT2440
ccaaggaucagcucggcaac

SEQ ID NO: 3590289 - RNA, 22 nt, Pseudomonas putida KT2440
ccaaggcauaaaaaagggcccc

SEQ ID NO: 3590290 - RNA, 20 nt, Pseudomonas putida KT2440
ccaaggccaacugcgcccgc

SEQ ID NO: 3590291 - RNA, 22 nt, Pseudomonas putida KT2440
ccaaggccucgaacagcaguuc

SEQ ID NO: 3590292 - RNA, 15 nt, Pseudomonas putida KT2440
ccaaggccugcacca

SEQ ID NO: 3590293 - RNA, 14 nt, Pseudomonas putida KT2440
ccaaggcgguggag

SEQ ID NO: 3590294 - RNA, 20 nt, Pseudomonas putida KT2440
ccaagggucgacaccaggau

SEQ ID NO: 3590295 - RNA, 16 nt, Pseudomonas putida KT2440
ccaaggucagcaagcc

SEQ ID NO: 3590296 - RNA, 20 nt, Pseudomonas putida KT2440
ccaaggucagcaagccgccg

SEQ ID NO: 3590297 - RNA, 21 nt, Pseudomonas putida KT2440
ccaagguggaaaucgccugcu

SEQ ID NO: 3590298 - RNA, 14 nt, Pseudomonas putida KT2440
ccaagguugccacc

SEQ ID NO: 3590299 - RNA, 18 nt, Pseudomonas putida KT2440
ccaagguugccaccagca

SEQ ID NO: 3590300 - RNA, 21 nt, Pseudomonas putida KT2440
ccaagugaccggaauguuacc

SEQ ID NO: 3590301 - RNA, 16 nt, Pseudomonas putida KT2440
ccaagugcuaaugcuc

SEQ ID NO: 3590302 - RNA, 19 nt, Pseudomonas putida KT2440
ccaaguuuucgcaguacuu

SEQ ID NO: 3590303 - RNA, 12 nt, Pseudomonas putida KT2440
ccaauaaaaaca

SEQ ID NO: 3590304 - RNA, 18 nt, Pseudomonas putida KT2440
ccaauaaaaacaacaggu

SEQ ID NO: 3590305 - RNA, 14 nt, Pseudomonas putida KT2440
ccaauaaccggcac

SEQ ID NO: 3590306 - RNA, 18 nt, Pseudomonas putida KT2440
ccaauaacucgcagcgca

SEQ ID NO: 3590307 - RNA, 17 nt, Pseudomonas putida KT2440
ccaauaccgcugcaaca

SEQ ID NO: 3590308 - RNA, 17 nt, Pseudomonas putida KT2440
ccaaucaacccguucag

SEQ ID NO: 3590309 - RNA, 23 nt, Pseudomonas putida KT2440
ccaaucaacccguucaggucauu

SEQ ID NO: 3590310 - RNA, 24 nt, Pseudomonas putida KT2440
ccaaucaacccguucaggucauug

SEQ ID NO: 3590311 - RNA, 16 nt, Pseudomonas putida KT2440
ccaaucaccaggauug

SEQ ID NO: 3590312 - RNA, 15 nt, Pseudomonas putida KT2440
ccaaucagguuguuc

SEQ ID NO: 3590313 - RNA, 21 nt, Pseudomonas putida KT2440
ccaaucaucgccagcagcgcu

SEQ ID NO: 3590314 - RNA, 11 nt, Pseudomonas putida KT2440
ccaaucgccgc

SEQ ID NO: 3590315 - RNA, 19 nt, Pseudomonas putida KT2440
ccaaucggguaaaacgccc

SEQ ID NO: 3590316 - RNA, 23 nt, Pseudomonas putida KT2440
ccaaucggguaaaacgccccccg

SEQ ID NO: 3590317 - RNA, 18 nt, Pseudomonas putida KT2440
ccaaugaucgagcgcacc

SEQ ID NO: 3590318 - RNA, 18 nt, Pseudomonas putida KT2440
ccaaugcagaugguccgg

SEQ ID NO: 3590319 - RNA, 16 nt, Pseudomonas putida KT2440
ccaaugcagccgcccg

SEQ ID NO: 3590320 - RNA, 16 nt, Pseudomonas putida KT2440
ccaaugcccaugccca

SEQ ID NO: 3590321 - RNA, 17 nt, Pseudomonas putida KT2440
ccaaugcugccuuuucc

SEQ ID NO: 3590322 - RNA, 13 nt, Pseudomonas putida KT2440
ccaccaccgaccg

SEQ ID NO: 3590323 - RNA, 14 nt, Pseudomonas putida KT2440
ccaccaccgaccgc

SEQ ID NO: 3590324 - RNA, 21 nt, Pseudomonas putida KT2440
ccaccaccgcguacagcugcu

SEQ ID NO: 3590325 - RNA, 24 nt, Pseudomonas putida KT2440
ccaccaccggugcguacucgacca

SEQ ID NO: 3590326 - RNA, 13 nt, Pseudomonas putida KT2440
ccaccaccuccau

SEQ ID NO: 3590327 - RNA, 12 nt, Pseudomonas putida KT2440
ccaccaccuucu

SEQ ID NO: 3590328 - RNA, 14 nt, Pseudomonas putida KT2440
ccaccaccuucuca

SEQ ID NO: 3590329 - RNA, 18 nt, Pseudomonas putida KT2440
ccaccacgaacaguggcc

SEQ ID NO: 3590330 - RNA, 18 nt, Pseudomonas putida KT2440
ccaccacgaacgccccca

SEQ ID NO: 3590331 - RNA, 20 nt, Pseudomonas putida KT2440
ccaccacgguacuuggcgcu

SEQ ID NO: 3590332 - RNA, 17 nt, Pseudomonas putida KT2440
ccaccacguagugcuuc

SEQ ID NO: 3590333 - RNA, 22 nt, Pseudomonas putida KT2440
ccaccacuucuggcugggcuuc

SEQ ID NO: 3590334 - RNA, 23 nt, Pseudomonas putida KT2440
ccaccagaugaccaaagaucagc

SEQ ID NO: 3590335 - RNA, 12 nt, Pseudomonas putida KT2440
ccaccagcaaca

SEQ ID NO: 3590336 - RNA, 12 nt, Pseudomonas putida KT2440
ccaccagcaccu

SEQ ID NO: 3590337 - RNA, 13 nt, Pseudomonas putida KT2440
ccaccagcaggcu

SEQ ID NO: 3590338 - RNA, 15 nt, Pseudomonas putida KT2440
ccaccagcaggcugc

SEQ ID NO: 3590339 - RNA, 15 nt, Pseudomonas putida KT2440
ccaccagcagugccc

SEQ ID NO: 3590340 - RNA, 17 nt, Pseudomonas putida KT2440
ccaccagcaucaacagg

SEQ ID NO: 3590341 - RNA, 19 nt, Pseudomonas putida KT2440
ccaccagcaucaacagguc

SEQ ID NO: 3590342 - RNA, 15 nt, Pseudomonas putida KT2440
ccaccagcccaccga

SEQ ID NO: 3590343 - RNA, 16 nt, Pseudomonas putida KT2440
ccaccagccccagcgc

SEQ ID NO: 3590344 - RNA, 12 nt, Pseudomonas putida KT2440
ccaccagcgccg

SEQ ID NO: 3590345 - RNA, 20 nt, Pseudomonas putida KT2440
ccaccagcguugucccgccc

SEQ ID NO: 3590346 - RNA, 21 nt, Pseudomonas putida KT2440
ccaccagcguugucccgcccu

SEQ ID NO: 3590347 - RNA, 18 nt, Pseudomonas putida KT2440
ccaccagcugcaccaccu

SEQ ID NO: 3590348 - RNA, 21 nt, Pseudomonas putida KT2440
ccaccagcugcaccaccugcu

SEQ ID NO: 3590349 - RNA, 19 nt, Pseudomonas putida KT2440
ccaccaggaacaucgccgu

SEQ ID NO: 3590350 - RNA, 18 nt, Pseudomonas putida KT2440
ccaccaggaagcuggcca

SEQ ID NO: 3590351 - RNA, 16 nt, Pseudomonas putida KT2440
ccaccaggccgaucac

SEQ ID NO: 3590352 - RNA, 18 nt, Pseudomonas putida KT2440
ccaccaggccgaucacca

SEQ ID NO: 3590353 - RNA, 16 nt, Pseudomonas putida KT2440
ccaccaggccuuugac

SEQ ID NO: 3590354 - RNA, 19 nt, Pseudomonas putida KT2440
ccaccaggcgcggcagcau

SEQ ID NO: 3590355 - RNA, 23 nt, Pseudomonas putida KT2440
ccaccaggucgguagggaucacc

SEQ ID NO: 3590356 - RNA, 15 nt, Pseudomonas putida KT2440
ccaccagucugcuca

SEQ ID NO: 3590357 - RNA, 16 nt, Pseudomonas putida KT2440
ccaccagucugcucag

SEQ ID NO: 3590358 - RNA, 21 nt, Pseudomonas putida KT2440
ccaccagugccggguccaguu

SEQ ID NO: 3590359 - RNA, 13 nt, Pseudomonas putida KT2440
ccaccaguggguu

SEQ ID NO: 3590360 - RNA, 12 nt, Pseudomonas putida KT2440
ccaccaguucca

SEQ ID NO: 3590361 - RNA, 15 nt, Pseudomonas putida KT2440
ccaccaucgaccugg

SEQ ID NO: 3590362 - RNA, 17 nt, Pseudomonas putida KT2440
ccaccaucgccaggccu

SEQ ID NO: 3590363 - RNA, 15 nt, Pseudomonas putida KT2440
ccaccaucggccagg

SEQ ID NO: 3590364 - RNA, 17 nt, Pseudomonas putida KT2440
ccaccaucuccagcucg

SEQ ID NO: 3590365 - RNA, 23 nt, Pseudomonas putida KT2440
ccaccaucuccagcucgccgccc

SEQ ID NO: 3590366 - RNA, 15 nt, Pseudomonas putida KT2440
ccaccaucucgccca

SEQ ID NO: 3590367 - RNA, 20 nt, Pseudomonas putida KT2440
ccaccaucuugcccagggcu

SEQ ID NO: 3590368 - RNA, 21 nt, Pseudomonas putida KT2440
ccaccaugaacagcacgccca

SEQ ID NO: 3590369 - RNA, 22 nt, Pseudomonas putida KT2440
ccaccaugaacagcacgcccaa

SEQ ID NO: 3590370 - RNA, 14 nt, Pseudomonas putida KT2440
ccacccacaggcac

SEQ ID NO: 3590371 - RNA, 15 nt, Pseudomonas putida KT2440
ccacccaccagcagu

SEQ ID NO: 3590372 - RNA, 18 nt, Pseudomonas putida KT2440
ccacccagaacagccaca

SEQ ID NO: 3590373 - RNA, 21 nt, Pseudomonas putida KT2440
ccacccagaacagccacagcu

SEQ ID NO: 3590374 - RNA, 12 nt, Pseudomonas putida KT2440
ccacccaggccc

SEQ ID NO: 3590375 - RNA, 13 nt, Pseudomonas putida KT2440
ccacccaggcccu

SEQ ID NO: 3590376 - RNA, 14 nt, Pseudomonas putida KT2440
ccacccaggcccug

SEQ ID NO: 3590377 - RNA, 22 nt, Pseudomonas putida KT2440
ccaccccaagcauagccaaacu

SEQ ID NO: 3590378 - RNA, 18 nt, Pseudomonas putida KT2440
ccaccccagcguuccugg

SEQ ID NO: 3590379 - RNA, 21 nt, Pseudomonas putida KT2440
ccaccccagcguuccugggcg

SEQ ID NO: 3590380 - RNA, 14 nt, Pseudomonas putida KT2440
ccaccccaggccac

SEQ ID NO: 3590381 - RNA, 15 nt, Pseudomonas putida KT2440
ccaccccaggccacu

SEQ ID NO: 3590382 - RNA, 14 nt, Pseudomonas putida KT2440
ccacccccagcgac

SEQ ID NO: 3590383 - RNA, 15 nt, Pseudomonas putida KT2440
ccacccccagcgacc

SEQ ID NO: 3590384 - RNA, 19 nt, Pseudomonas putida KT2440
ccacccccagcgaccagcu

SEQ ID NO: 3590385 - RNA, 18 nt, Pseudomonas putida KT2440
ccacccccagcgccucca

SEQ ID NO: 3590386 - RNA, 17 nt, Pseudomonas putida KT2440
ccacccccgcacccggc

SEQ ID NO: 3590387 - RNA, 18 nt, Pseudomonas putida KT2440
ccacccccgccgccaggg

SEQ ID NO: 3590388 - RNA, 15 nt, Pseudomonas putida KT2440
ccaccccgcaggccg

SEQ ID NO: 3590389 - RNA, 19 nt, Pseudomonas putida KT2440
ccaccccgcaggccgcagc

SEQ ID NO: 3590390 - RNA, 20 nt, Pseudomonas putida KT2440
ccaccccgcaggccgcagcc

SEQ ID NO: 3590391 - RNA, 21 nt, Pseudomonas putida KT2440
ccaccccgcaggccgcagccu

SEQ ID NO: 3590392 - RNA, 12 nt, Pseudomonas putida KT2440
ccaccccggcag

SEQ ID NO: 3590393 - RNA, 21 nt, Pseudomonas putida KT2440
ccaccccggggcgcuccagca

SEQ ID NO: 3590394 - RNA, 16 nt, Pseudomonas putida KT2440
ccacccgacgccaccu

SEQ ID NO: 3590395 - RNA, 22 nt, Pseudomonas putida KT2440
ccacccgacgccaccuucgcca

SEQ ID NO: 3590396 - RNA, 21 nt, Pseudomonas putida KT2440
ccacccgcguuugcaacuggc

SEQ ID NO: 3590397 - RNA, 18 nt, Pseudomonas putida KT2440
ccacccggcugaaauggc

SEQ ID NO: 3590398 - RNA, 16 nt, Pseudomonas putida KT2440
ccacccggucccgccc

SEQ ID NO: 3590399 - RNA, 17 nt, Pseudomonas putida KT2440
ccacccggucggccagc

SEQ ID NO: 3590400 - RNA, 20 nt, Pseudomonas putida KT2440
ccacccuccgggucaggccg

SEQ ID NO: 3590401 - RNA, 20 nt, Pseudomonas putida KT2440
ccacccucgcacuccgcccg

SEQ ID NO: 3590402 - RNA, 17 nt, Pseudomonas putida KT2440
ccacccugaugcagcag

SEQ ID NO: 3590403 - RNA, 15 nt, Pseudomonas putida KT2440
ccacccuggcaugcc

SEQ ID NO: 3590404 - RNA, 17 nt, Pseudomonas putida KT2440
ccaccgaaaucagcaac

SEQ ID NO: 3590405 - RNA, 12 nt, Pseudomonas putida KT2440
ccaccgaaggcg

SEQ ID NO: 3590406 - RNA, 21 nt, Pseudomonas putida KT2440
ccaccgaccuguguccacccc

SEQ ID NO: 3590407 - RNA, 15 nt, Pseudomonas putida KT2440
ccaccgagccuuccg

SEQ ID NO: 3590408 - RNA, 20 nt, Pseudomonas putida KT2440
ccaccgagugcggcaggccg

SEQ ID NO: 3590409 - RNA, 17 nt, Pseudomonas putida KT2440
ccaccgaucucgccagc

SEQ ID NO: 3590410 - RNA, 18 nt, Pseudomonas putida KT2440
ccaccgaucucgccagcc

SEQ ID NO: 3590411 - RNA, 14 nt, Pseudomonas putida KT2440
ccaccgcacucugc

SEQ ID NO: 3590412 - RNA, 12 nt, Pseudomonas putida KT2440
ccaccgcagguc

SEQ ID NO: 3590413 - RNA, 13 nt, Pseudomonas putida KT2440
ccaccgcagguca

SEQ ID NO: 3590414 - RNA, 15 nt, Pseudomonas putida KT2440
ccaccgcaggugcag

SEQ ID NO: 3590415 - RNA, 23 nt, Pseudomonas putida KT2440
ccaccgcauacacaucggucggc

SEQ ID NO: 3590416 - RNA, 20 nt, Pseudomonas putida KT2440
ccaccgccacugaccagccc

SEQ ID NO: 3590417 - RNA, 23 nt, Pseudomonas putida KT2440
ccaccgccggccauucaucaucg

SEQ ID NO: 3590418 - RNA, 13 nt, Pseudomonas putida KT2440
ccaccgccgggug

SEQ ID NO: 3590419 - RNA, 22 nt, Pseudomonas putida KT2440
ccaccgccgggugggugaagaa

SEQ ID NO: 3590420 - RNA, 14 nt, Pseudomonas putida KT2440
ccaccgccgugccg

SEQ ID NO: 3590421 - RNA, 22 nt, Pseudomonas putida KT2440
ccaccgccgugccggucacugg

SEQ ID NO: 3590422 - RNA, 15 nt, Pseudomonas putida KT2440
ccaccgccucggcua

SEQ ID NO: 3590423 - RNA, 18 nt, Pseudomonas putida KT2440
ccaccgcgaaacacagca

SEQ ID NO: 3590424 - RNA, 13 nt, Pseudomonas putida KT2440
ccaccgcgcaacg

SEQ ID NO: 3590425 - RNA, 15 nt, Pseudomonas putida KT2440
ccaccgcgccagccu

SEQ ID NO: 3590426 - RNA, 16 nt, Pseudomonas putida KT2440
ccaccgcgcgccaguu

SEQ ID NO: 3590427 - RNA, 19 nt, Pseudomonas putida KT2440
ccaccgcgcgccaguucgc

SEQ ID NO: 3590428 - RNA, 20 nt, Pseudomonas putida KT2440
ccacggcaauucgccggcag

SEQ ID NO: 3590429 - RNA, 15 nt, Pseudomonas putida KT2440
ccacggccaccuugc

SEQ ID NO: 3590430 - RNA, 13 nt, Pseudomonas putida KT2440
ccacggccuggcc

SEQ ID NO: 3590431 - RNA, 15 nt, Pseudomonas putida KT2440
ccacggccuggccug

SEQ ID NO: 3590432 - RNA, 14 nt, Pseudomonas putida KT2440
ccacggccuucuuc

SEQ ID NO: 3590433 - RNA, 20 nt, Pseudomonas putida KT2440
ccacggcguccaggcccgcc

SEQ ID NO: 3590434 - RNA, 12 nt, Pseudomonas putida KT2440
ccacggcguugc

SEQ ID NO: 3590435 - RNA, 11 nt, Pseudomonas putida KT2440
ccacgggcaaa

SEQ ID NO: 3590436 - RNA, 15 nt, Pseudomonas putida KT2440
ccacgguaccggcaa

SEQ ID NO: 3590437 - RNA, 18 nt, Pseudomonas putida KT2440
ccacgguacuuggcgcug

SEQ ID NO: 3590438 - RNA, 22 nt, Pseudomonas putida KT2440
ccacgguacuuggcgcugucgg

SEQ ID NO: 3590439 - RNA, 20 nt, Pseudomonas putida KT2440
ccacggucagcauccagcca

SEQ ID NO: 3590440 - RNA, 17 nt, Pseudomonas putida KT2440
ccacggucggccugcgc

SEQ ID NO: 3590441 - RNA, 17 nt, Pseudomonas putida KT2440
ccacggugucggacagg

SEQ ID NO: 3590442 - RNA, 14 nt, Pseudomonas putida KT2440
ccacgguucuggca

SEQ ID NO: 3590443 - RNA, 16 nt, Pseudomonas putida KT2440
ccacgguucuggcagc

SEQ ID NO: 3590444 - RNA, 18 nt, Pseudomonas putida KT2440
ccacguagugcuucugcc

SEQ ID NO: 3590445 - RNA, 18 nt, Pseudomonas putida KT2440
ccacgucacgcaccaugu

SEQ ID NO: 3590446 - RNA, 19 nt, Pseudomonas putida KT2440
ccacguccacuaccuccag

SEQ ID NO: 3590447 - RNA, 23 nt, Pseudomonas putida KT2440
ccacguccacuaccuccagcccg

SEQ ID NO: 3590448 - RNA, 16 nt, Pseudomonas putida KT2440
ccacguccggccagca

SEQ ID NO: 3590449 - RNA, 20 nt, Pseudomonas putida KT2440
ccacguccggccagcaacag

SEQ ID NO: 3590450 - RNA, 18 nt, Pseudomonas putida KT2440
ccacguccuggucacggc

SEQ ID NO: 3590451 - RNA, 15 nt, Pseudomonas putida KT2440
ccacgucgccagcgg

SEQ ID NO: 3590452 - RNA, 19 nt, Pseudomonas putida KT2440
ccacgucuuccuggcggaa

SEQ ID NO: 3590453 - RNA, 14 nt, Pseudomonas putida KT2440
ccacguucccgcca

SEQ ID NO: 3590454 - RNA, 14 nt, Pseudomonas putida KT2440
ccacguucugcagc

SEQ ID NO: 3590455 - RNA, 16 nt, Pseudomonas putida KT2440
ccacguucugcagccu

SEQ ID NO: 3590456 - RNA, 18 nt, Pseudomonas putida KT2440
ccacucaauacucgcuga

SEQ ID NO: 3590457 - RNA, 16 nt, Pseudomonas putida KT2440
ccacucaccggcaucg

SEQ ID NO: 3590458 - RNA, 14 nt, Pseudomonas putida KT2440
ccacucagcggguc

SEQ ID NO: 3590459 - RNA, 15 nt, Pseudomonas putida KT2440
ccacucagcgggucc

SEQ ID NO: 3590460 - RNA, 18 nt, Pseudomonas putida KT2440
ccacucauaaugaaaacc

SEQ ID NO: 3590461 - RNA, 22 nt, Pseudomonas putida KT2440
ccacucauaaugaaaacccuuc

SEQ ID NO: 3590462 - RNA, 15 nt, Pseudomonas putida KT2440
ccacuccagggucug

SEQ ID NO: 3590463 - RNA, 17 nt, Pseudomonas putida KT2440
ccacuccagggucugcg

SEQ ID NO: 3590464 - RNA, 14 nt, Pseudomonas putida KT2440
ccacucgcgcagca

SEQ ID NO: 3590465 - RNA, 15 nt, Pseudomonas putida KT2440
ccacucgcgcagcac

SEQ ID NO: 3590466 - RNA, 21 nt, Pseudomonas putida KT2440
ccacucggugcacgggccgau

SEQ ID NO: 3590467 - RNA, 19 nt, Pseudomonas putida KT2440
ccacucguccgggcgccag

SEQ ID NO: 3590468 - RNA, 17 nt, Pseudomonas putida KT2440
ccacugaccagcccggc

SEQ ID NO: 3590469 - RNA, 19 nt, Pseudomonas putida KT2440
ccacugaccagcccggcuc

SEQ ID NO: 3590470 - RNA, 19 nt, Pseudomonas putida KT2440
ccacugaggcguagcacaa

SEQ ID NO: 3590471 - RNA, 16 nt, Pseudomonas putida KT2440
ccacugaugcgcgucc

SEQ ID NO: 3590472 - RNA, 20 nt, Pseudomonas putida KT2440
ccacugaugcgcguccagcc

SEQ ID NO: 3590473 - RNA, 13 nt, Pseudomonas putida KT2440
ccacugcaccaau

SEQ ID NO: 3590474 - RNA, 15 nt, Pseudomonas putida KT2440
ccacugcaggugcag

SEQ ID NO: 3590475 - RNA, 16 nt, Pseudomonas putida KT2440
ccacugcaggugcagg

SEQ ID NO: 3590476 - RNA, 22 nt, Pseudomonas putida KT2440
ccacugcguucaucgaacugca

SEQ ID NO: 3590477 - RNA, 21 nt, Pseudomonas putida KT2440
ccacugcuucugagccagccg

SEQ ID NO: 3590478 - RNA, 17 nt, Pseudomonas putida KT2440
ccacuggcgacuucggc

SEQ ID NO: 3590479 - RNA, 16 nt, Pseudomonas putida KT2440
ccacuggggcuucugc

SEQ ID NO: 3590480 - RNA, 18 nt, Pseudomonas putida KT2440
ccacuggggcuucugccg

SEQ ID NO: 3590481 - RNA, 16 nt, Pseudomonas putida KT2440
ccacuggugccggcac

SEQ ID NO: 3590482 - RNA, 21 nt, Pseudomonas putida KT2440
ccacugucaaucuugcgcacg

SEQ ID NO: 3590483 - RNA, 16 nt, Pseudomonas putida KT2440
ccacugucagccagcg

SEQ ID NO: 3590484 - RNA, 22 nt, Pseudomonas putida KT2440
ccacugucggguuggucgccag

SEQ ID NO: 3590485 - RNA, 14 nt, Pseudomonas putida KT2440
ccacugucugccag

SEQ ID NO: 3590486 - RNA, 15 nt, Pseudomonas putida KT2440
ccacugucugccagu

SEQ ID NO: 3590487 - RNA, 22 nt, Pseudomonas putida KT2440
ccacugugcccgccaggcgcaa

SEQ ID NO: 3590488 - RNA, 22 nt, Pseudomonas putida KT2440
ccacuguucagguguuccagca

SEQ ID NO: 3590489 - RNA, 15 nt, Pseudomonas putida KT2440
ccacuguugcagcgc

SEQ ID NO: 3590490 - RNA, 17 nt, Pseudomonas putida KT2440
ccacuguugcagcgcca

SEQ ID NO: 3590491 - RNA, 18 nt, Pseudomonas putida KT2440
ccacuguugcagcgccag

SEQ ID NO: 3590492 - RNA, 12 nt, Pseudomonas putida KT2440
ccacuucaagca

SEQ ID NO: 3590493 - RNA, 23 nt, Pseudomonas putida KT2440
ccacuucacugacaaagccugca

SEQ ID NO: 3590494 - RNA, 24 nt, Pseudomonas putida KT2440
ccacuucacugacaaagccugcac

SEQ ID NO: 3590495 - RNA, 20 nt, Pseudomonas putida KT2440
ccacuucgcaacgcuuggca

SEQ ID NO: 3590496 - RNA, 20 nt, Pseudomonas putida KT2440
ccacuucgugcaaggcgaug

SEQ ID NO: 3590497 - RNA, 14 nt, Pseudomonas putida KT2440
ccacuucugcggcc

SEQ ID NO: 3590498 - RNA, 13 nt, Pseudomonas putida KT2440
ccacuucuggcug

SEQ ID NO: 3590499 - RNA, 23 nt, Pseudomonas putida KT2440
ccacuugcagguagcgcccgggc

SEQ ID NO: 3590500 - RNA, 19 nt, Pseudomonas putida KT2440
ccacuugcguucgccgcuu

SEQ ID NO: 3590501 - RNA, 21 nt, Pseudomonas putida KT2440
ccacuugcucggugcugcugc

SEQ ID NO: 3590502 - RNA, 20 nt, Pseudomonas putida KT2440
ccacuugucccggcccagcc

SEQ ID NO: 3590503 - RNA, 22 nt, Pseudomonas putida KT2440
ccacuugucccggcccagccgc

SEQ ID NO: 3590504 - RNA, 16 nt, Pseudomonas putida KT2440
ccagaaaaguuggcca

SEQ ID NO: 3590505 - RNA, 21 nt, Pseudomonas putida KT2440
ccagaaacggcuugaacccgu

SEQ ID NO: 3590506 - RNA, 17 nt, Pseudomonas putida KT2440
ccagaaagccacugcac

SEQ ID NO: 3590507 - RNA, 15 nt, Pseudomonas putida KT2440
ccagaacagccacag

SEQ ID NO: 3590508 - RNA, 19 nt, Pseudomonas putida KT2440
ccagaacagccacagcugc

SEQ ID NO: 3590509 - RNA, 20 nt, Pseudomonas putida KT2440
ccagaacaugccacggccuu

SEQ ID NO: 3590510 - RNA, 16 nt, Pseudomonas putida KT2440
ccagaaccccggcccu

SEQ ID NO: 3590511 - RNA, 18 nt, Pseudomonas putida KT2440
ccagaacggcacgcccau

SEQ ID NO: 3590512 - RNA, 20 nt, Pseudomonas putida KT2440
ccagaagggcgcaaaagucc

SEQ ID NO: 3590513 - RNA, 19 nt, Pseudomonas putida KT2440
ccagaauagcaagcgccaa

SEQ ID NO: 3590514 - RNA, 19 nt, Pseudomonas putida KT2440
ccagaauggaggagggcug

SEQ ID NO: 3590515 - RNA, 18 nt, Pseudomonas putida KT2440
ccagacaacuggccaggg

SEQ ID NO: 3590516 - RNA, 12 nt, Pseudomonas putida KT2440
ccagacagcgcu

SEQ ID NO: 3590517 - RNA, 19 nt, Pseudomonas putida KT2440
ccagacauugaagaagccc

SEQ ID NO: 3590518 - RNA, 22 nt, Pseudomonas putida KT2440
ccagacauugaagaagcccccg

SEQ ID NO: 3590519 - RNA, 16 nt, Pseudomonas putida KT2440
ccagaccaccucaucc

SEQ ID NO: 3590520 - RNA, 14 nt, Pseudomonas putida KT2440
ccagaccagcagca

SEQ ID NO: 3590521 - RNA, 15 nt, Pseudomonas putida KT2440
ccagaccagcagcag

SEQ ID NO: 3590522 - RNA, 16 nt, Pseudomonas putida KT2440
ccagacccgcuucgcc

SEQ ID NO: 3590523 - RNA, 17 nt, Pseudomonas putida KT2440
ccagacccgcuucgccg

SEQ ID NO: 3590524 - RNA, 19 nt, Pseudomonas putida KT2440
ccagaccgguuacgcaacu

SEQ ID NO: 3590525 - RNA, 22 nt, Pseudomonas putida KT2440
ccagaccuugcgcacggccucc

SEQ ID NO: 3590526 - RNA, 23 nt, Pseudomonas putida KT2440
ccagaccuugcgcacggccucca

SEQ ID NO: 3590527 - RNA, 14 nt, Pseudomonas putida KT2440
ccagacgcaggcaa

SEQ ID NO: 3590528 - RNA, 18 nt, Pseudomonas putida KT2440
ccagacgccgcagugaca

SEQ ID NO: 3590529 - RNA, 16 nt, Pseudomonas putida KT2440
ccagacgcgcgcuggc

SEQ ID NO: 3590530 - RNA, 17 nt, Pseudomonas putida KT2440
ccagacgcuguacgucc

SEQ ID NO: 3590531 - RNA, 15 nt, Pseudomonas putida KT2440
ccagacggccuucga

SEQ ID NO: 3590532 - RNA, 14 nt, Pseudomonas putida KT2440
ccagacgggcaugg

SEQ ID NO: 3590533 - RNA, 18 nt, Pseudomonas putida KT2440
ccagcagcgacaccagcg

SEQ ID NO: 3590534 - RNA, 23 nt, Pseudomonas putida KT2440
ccagcagcgacaccagcgcacca

SEQ ID NO: 3590535 - RNA, 16 nt, Pseudomonas putida KT2440
ccagcagcgacacuga

SEQ ID NO: 3590536 - RNA, 23 nt, Pseudomonas putida KT2440
ccagcagcgacagguaguuggcc

SEQ ID NO: 3590537 - RNA, 16 nt, Pseudomonas putida KT2440
ccagcagcgcauggcu

SEQ ID NO: 3590538 - RNA, 12 nt, Pseudomonas putida KT2440
ccagcagcgccu

SEQ ID NO: 3590539 - RNA, 17 nt, Pseudomonas putida KT2440
ccagcagcgccugcagc

SEQ ID NO: 3590540 - RNA, 11 nt, Pseudomonas putida KT2440
ccagcagcgcg

SEQ ID NO: 3590541 - RNA, 13 nt, Pseudomonas putida KT2440
ccagcagcgggca

SEQ ID NO: 3590542 - RNA, 14 nt, Pseudomonas putida KT2440
ccagcagcgggcac

SEQ ID NO: 3590543 - RNA, 18 nt, Pseudomonas putida KT2440
ccagcagcgggcacaggc

SEQ ID NO: 3590544 - RNA, 18 nt, Pseudomonas putida KT2440
ccagcagcguacccagcu

SEQ ID NO: 3590545 - RNA, 15 nt, Pseudomonas putida KT2440
ccagcagcuucuuca

SEQ ID NO: 3590546 - RNA, 18 nt, Pseudomonas putida KT2440
ccagcaggccaccggcag

SEQ ID NO: 3590547 - RNA, 22 nt, Pseudomonas putida KT2440
ccagcaggccaccggcagcacc

SEQ ID NO: 3590548 - RNA, 23 nt, Pseudomonas putida KT2440
ccagcaggccaccggcagcaccu

SEQ ID NO: 3590549 - RNA, 14 nt, Pseudomonas putida KT2440
ccagcaggcccggc

SEQ ID NO: 3590550 - RNA, 16 nt, Pseudomonas putida KT2440
ccagcaggcugcgugc

SEQ ID NO: 3590551 - RNA, 20 nt, Pseudomonas putida KT2440
ccagcaggcuugccagcuug

SEQ ID NO: 3590552 - RNA, 13 nt, Pseudomonas putida KT2440
ccagcagggcagg

SEQ ID NO: 3590553 - RNA, 21 nt, Pseudomonas putida KT2440
ccagcagggcaggggacagcc

SEQ ID NO: 3590554 - RNA, 15 nt, Pseudomonas putida KT2440
ccagcagggccggcc

SEQ ID NO: 3590555 - RNA, 18 nt, Pseudomonas putida KT2440
ccagcaggguggccagca

SEQ ID NO: 3590556 - RNA, 17 nt, Pseudomonas putida KT2440
ccagcagguacagcacc

SEQ ID NO: 3590557 - RNA, 19 nt, Pseudomonas putida KT2440
ccagcaggucagcacgcgc

SEQ ID NO: 3590558 - RNA, 13 nt, Pseudomonas putida KT2440
ccagcaggucagg

SEQ ID NO: 3590559 - RNA, 14 nt, Pseudomonas putida KT2440
ccagcaggucaggc

SEQ ID NO: 3590560 - RNA, 17 nt, Pseudomonas putida KT2440
ccagcaggucaggcccu

SEQ ID NO: 3590561 - RNA, 14 nt, Pseudomonas putida KT2440
ccagcagguccagu

SEQ ID NO: 3590562 - RNA, 15 nt, Pseudomonas putida KT2440
ccagcaggucggcac

SEQ ID NO: 3590563 - RNA, 21 nt, Pseudomonas putida KT2440
ccagcaggucggcacgcaccu

SEQ ID NO: 3590564 - RNA, 17 nt, Pseudomonas putida KT2440
ccagcagguugaacagg

SEQ ID NO: 3590565 - RNA, 15 nt, Pseudomonas putida KT2440
ccagcagguuggaca

SEQ ID NO: 3590566 - RNA, 19 nt, Pseudomonas putida KT2440
ccagcagguuggacagcgc

SEQ ID NO: 3590567 - RNA, 22 nt, Pseudomonas putida KT2440
ccagcagguuggacagcgcccg

SEQ ID NO: 3590568 - RNA, 23 nt, Pseudomonas putida KT2440
ccagcagugcaucgaagcaggcc

SEQ ID NO: 3590569 - RNA, 15 nt, Pseudomonas putida KT2440
ccagcagugccgccu

SEQ ID NO: 3590570 - RNA, 15 nt, Pseudomonas putida KT2440
ccagcagugccgugg

SEQ ID NO: 3590571 - RNA, 17 nt, Pseudomonas putida KT2440
ccagcagugcggcaacc

SEQ ID NO: 3590572 - RNA, 19 nt, Pseudomonas putida KT2440
ccagcagugcggcaaccac

SEQ ID NO: 3590573 - RNA, 23 nt, Pseudomonas putida KT2440
ccagcaguucgucgagcaucugc

SEQ ID NO: 3590574 - RNA, 20 nt, Pseudomonas putida KT2440
ccagcaguuggcugccggcc

SEQ ID NO: 3590575 - RNA, 18 nt, Pseudomonas putida KT2440
ccagcaguuucagcggcc

SEQ ID NO: 3590576 - RNA, 18 nt, Pseudomonas putida KT2440
ccagcaucaacaggucgc

SEQ ID NO: 3590577 - RNA, 21 nt, Pseudomonas putida KT2440
ccagcaucagcacacccagca

SEQ ID NO: 3590578 - RNA, 22 nt, Pseudomonas putida KT2440
ccagcaucagcacacccagcac

SEQ ID NO: 3590579 - RNA, 17 nt, Pseudomonas putida KT2440
ccagcaucgaggaaggc

SEQ ID NO: 3590580 - RNA, 13 nt, Pseudomonas putida KT2440
ccagcaucggcac

SEQ ID NO: 3590581 - RNA, 15 nt, Pseudomonas putida KT2440
ccagcaugaaccgcu

SEQ ID NO: 3590582 - RNA, 13 nt, Pseudomonas putida KT2440
ccagcaugaacgc

SEQ ID NO: 3590583 - RNA, 20 nt, Pseudomonas putida KT2440
ccagcaugcgaagccgccag

SEQ ID NO: 3590584 - RNA, 23 nt, Pseudomonas putida KT2440
ccagcaugcgaagccgccagcgu

SEQ ID NO: 3590585 - RNA, 16 nt, Pseudomonas putida KT2440
ccagcaugcgcuugag

SEQ ID NO: 3590586 - RNA, 15 nt, Pseudomonas putida KT2440
ccagcauggaccauc

SEQ ID NO: 3590587 - RNA, 13 nt, Pseudomonas putida KT2440
ccagcauggccga

SEQ ID NO: 3590588 - RNA, 22 nt, Pseudomonas putida KT2440
ccagcauggccgaaaccagccc

SEQ ID NO: 3590589 - RNA, 22 nt, Pseudomonas putida KT2440
ccagcauguaagcuucagcgac

SEQ ID NO: 3590590 - RNA, 23 nt, Pseudomonas putida KT2440
ccagcauguaagcuucagcgacc

SEQ ID NO: 3590591 - RNA, 19 nt, Pseudomonas putida KT2440
ccagcauguccugcugcag

SEQ ID NO: 3590592 - RNA, 21 nt, Pseudomonas putida KT2440
ccagcauguccugcugcaggc

SEQ ID NO: 3590593 - RNA, 17 nt, Pseudomonas putida KT2440
ccagcauguucaccagg

SEQ ID NO: 3590594 - RNA, 16 nt, Pseudomonas putida KT2440
ccagccaaacccggcc

SEQ ID NO: 3590595 - RNA, 20 nt, Pseudomonas putida KT2440
ccagccaacccucgaccucg

SEQ ID NO: 3590596 - RNA, 20 nt, Pseudomonas putida KT2440
ccagccaacgccccacccgc

SEQ ID NO: 3590597 - RNA, 16 nt, Pseudomonas putida KT2440
ccagccaccaccaugc

SEQ ID NO: 3590598 - RNA, 23 nt, Pseudomonas putida KT2440
ccagccaccgacgaacagggccg

SEQ ID NO: 3590599 - RNA, 23 nt, Pseudomonas putida KT2440
ccagccacuuguucggguucagc

SEQ ID NO: 3590600 - RNA, 12 nt, Pseudomonas putida KT2440
ccagccagauug

SEQ ID NO: 3590601 - RNA, 13 nt, Pseudomonas putida KT2440
ccagccagccacc

SEQ ID NO: 3590602 - RNA, 16 nt, Pseudomonas putida KT2440
ccagccagccaccacc

SEQ ID NO: 3590603 - RNA, 14 nt, Pseudomonas putida KT2440
ccagccagcgacag

SEQ ID NO: 3590604 - RNA, 13 nt, Pseudomonas putida KT2440
ccagccaggcaca

SEQ ID NO: 3590605 - RNA, 14 nt, Pseudomonas putida KT2440
ccagccaggcacag

SEQ ID NO: 3590606 - RNA, 19 nt, Pseudomonas putida KT2440
ccagccagguauggccaga

SEQ ID NO: 3590607 - RNA, 22 nt, Pseudomonas putida KT2440
ccagccagguuguucaguggcg

SEQ ID NO: 3590608 - RNA, 18 nt, Pseudomonas putida KT2440
ccagccaguacggcagcc

SEQ ID NO: 3590609 - RNA, 15 nt, Pseudomonas putida KT2440
ccagccauuccaggc

SEQ ID NO: 3590610 - RNA, 15 nt, Pseudomonas putida KT2440
ccagcccaaggaaga

SEQ ID NO: 3590611 - RNA, 13 nt, Pseudomonas putida KT2440
ccagcccaccacg

SEQ ID NO: 3590612 - RNA, 15 nt, Pseudomonas putida KT2440
ccagcccaccacgaa

SEQ ID NO: 3590613 - RNA, 13 nt, Pseudomonas putida KT2440
ccagcccagcgcc

SEQ ID NO: 3590614 - RNA, 14 nt, Pseudomonas putida KT2440
ccagcccagcgcca

SEQ ID NO: 3590615 - RNA, 17 nt, Pseudomonas putida KT2440
ccagcccagcgccagua

SEQ ID NO: 3590616 - RNA, 22 nt, Pseudomonas putida KT2440
ccagcccaggcuggcacccgca

SEQ ID NO: 3590617 - RNA, 20 nt, Pseudomonas putida KT2440
ccagcccaguagaucgcgcc

SEQ ID NO: 3590618 - RNA, 21 nt, Pseudomonas putida KT2440
ccagcccaguagaucgcgcca

SEQ ID NO: 3590619 - RNA, 17 nt, Pseudomonas putida KT2440
ccagcccauccagggcu

SEQ ID NO: 3590620 - RNA, 18 nt, Pseudomonas putida KT2440
ccagcccauccagggcuu

SEQ ID NO: 3590621 - RNA, 19 nt, Pseudomonas putida KT2440
ccagcccauccagggcuuc

SEQ ID NO: 3590622 - RNA, 16 nt, Pseudomonas putida KT2440
ccagccccaacccacc

SEQ ID NO: 3590623 - RNA, 19 nt, Pseudomonas putida KT2440
ccagccccaacccaccagc

SEQ ID NO: 3590624 - RNA, 15 nt, Pseudomonas putida KT2440
ccagccccgcaugcu

SEQ ID NO: 3590625 - RNA, 21 nt, Pseudomonas putida KT2440
ccagccccucauucaaagccu

SEQ ID NO: 3590626 - RNA, 12 nt, Pseudomonas putida KT2440
ccagcccgaaac

SEQ ID NO: 3590627 - RNA, 19 nt, Pseudomonas putida KT2440
ccagcccgauuucgugcac

SEQ ID NO: 3590628 - RNA, 17 nt, Pseudomonas putida KT2440
ccagcccgccacaccga

SEQ ID NO: 3590629 - RNA, 12 nt, Pseudomonas putida KT2440
ccagcccgccgc

SEQ ID NO: 3590630 - RNA, 15 nt, Pseudomonas putida KT2440
ccagcccgccgccag

SEQ ID NO: 3590631 - RNA, 14 nt, Pseudomonas putida KT2440
ccagcccggacugc

SEQ ID NO: 3590632 - RNA, 23 nt, Pseudomonas putida KT2440
ccagcccggacugcaccaggucc

SEQ ID NO: 3590633 - RNA, 11 nt, Pseudomonas putida KT2440
ccagcccggcc

SEQ ID NO: 3590634 - RNA, 16 nt, Pseudomonas putida KT2440
ccagcccggcggccag

SEQ ID NO: 3590635 - RNA, 17 nt, Pseudomonas putida KT2440
ccagcccggcggccagc

SEQ ID NO: 3590636 - RNA, 21 nt, Pseudomonas putida KT2440
ccagcccgguauuggccacgu

SEQ ID NO: 3590637 - RNA, 13 nt, Pseudomonas putida KT2440
ccagcccucaagg

SEQ ID NO: 3590638 - RNA, 14 nt, Pseudomonas putida KT2440
ccagcuccuggccg

SEQ ID NO: 3590639 - RNA, 20 nt, Pseudomonas putida KT2440
ccagcuccuggccgcccgcc

SEQ ID NO: 3590640 - RNA, 17 nt, Pseudomonas putida KT2440
ccagcuccuucuucacc

SEQ ID NO: 3590641 - RNA, 14 nt, Pseudomonas putida KT2440
ccagcucgccaaca

SEQ ID NO: 3590642 - RNA, 12 nt, Pseudomonas putida KT2440
ccagcucgcccg

SEQ ID NO: 3590643 - RNA, 15 nt, Pseudomonas putida KT2440
ccagcucgcgcgggu

SEQ ID NO: 3590644 - RNA, 17 nt, Pseudomonas putida KT2440
ccagcucggcaaggcgu

SEQ ID NO: 3590645 - RNA, 12 nt, Pseudomonas putida KT2440
ccagcucggcag

SEQ ID NO: 3590646 - RNA, 18 nt, Pseudomonas putida KT2440
ccagcucggccgaugcca

SEQ ID NO: 3590647 - RNA, 12 nt, Pseudomonas putida KT2440
ccagcucggccu

SEQ ID NO: 3590648 - RNA, 13 nt, Pseudomonas putida KT2440
ccagcucggcugg

SEQ ID NO: 3590649 - RNA, 17 nt, Pseudomonas putida KT2440
ccagcucguucaacacc

SEQ ID NO: 3590650 - RNA, 18 nt, Pseudomonas putida KT2440
ccagcucuggagguagcc

SEQ ID NO: 3590651 - RNA, 20 nt, Pseudomonas putida KT2440
ccagcucuggucaccuucgu

SEQ ID NO: 3590652 - RNA, 21 nt, Pseudomonas putida KT2440
ccagcucuuugggggugcuga

SEQ ID NO: 3590653 - RNA, 22 nt, Pseudomonas putida KT2440
ccagcucuuugggggugcugag

SEQ ID NO: 3590654 - RNA, 11 nt, Pseudomonas putida KT2440
ccagcugaaag

SEQ ID NO: 3590655 - RNA, 22 nt, Pseudomonas putida KT2440
ccagcugaagugccaaggcuuu

SEQ ID NO: 3590656 - RNA, 16 nt, Pseudomonas putida KT2440
ccagcugagcgccauc

SEQ ID NO: 3590657 - RNA, 20 nt, Pseudomonas putida KT2440
ccagcugagcgccauccacc

SEQ ID NO: 3590658 - RNA, 14 nt, Pseudomonas putida KT2440
ccagcugcaacagc

SEQ ID NO: 3590659 - RNA, 15 nt, Pseudomonas putida KT2440
ccagcugcaacagcg

SEQ ID NO: 3590660 - RNA, 20 nt, Pseudomonas putida KT2440
ccagcugcaacagcggcgag

SEQ ID NO: 3590661 - RNA, 19 nt, Pseudomonas putida KT2440
ccagcugcaccaccugcuc

SEQ ID NO: 3590662 - RNA, 17 nt, Pseudomonas putida KT2440
ccagcugcaucagguag

SEQ ID NO: 3590663 - RNA, 15 nt, Pseudomonas putida KT2440
ccagcugcgccugca

SEQ ID NO: 3590664 - RNA, 20 nt, Pseudomonas putida KT2440
ccagcugcgcugccugcugg

SEQ ID NO: 3590665 - RNA, 22 nt, Pseudomonas putida KT2440
ccagcugcgggaugcgguugac

SEQ ID NO: 3590666 - RNA, 12 nt, Pseudomonas putida KT2440
ccagcugcugcc

SEQ ID NO: 3590667 - RNA, 19 nt, Pseudomonas putida KT2440
ccagcuggagacgaacagc

SEQ ID NO: 3590668 - RNA, 15 nt, Pseudomonas putida KT2440
ccagcuggccaucga

SEQ ID NO: 3590669 - RNA, 23 nt, Pseudomonas putida KT2440
ccagcuggccaucgacccgcugc

SEQ ID NO: 3590670 - RNA, 14 nt, Pseudomonas putida KT2440
ccagcuggcucauc

SEQ ID NO: 3590671 - RNA, 21 nt, Pseudomonas putida KT2440
ccagcuggcucaucugccggc

SEQ ID NO: 3590672 - RNA, 16 nt, Pseudomonas putida KT2440
ccagcuguucggucag

SEQ ID NO: 3590673 - RNA, 15 nt, Pseudomonas putida KT2440
ccagcuucugcuggu

SEQ ID NO: 3590674 - RNA, 17 nt, Pseudomonas putida KT2440
ccagcuucugcuggucc

SEQ ID NO: 3590675 - RNA, 20 nt, Pseudomonas putida KT2440
ccagcuucugcugguccuug

SEQ ID NO: 3590676 - RNA, 16 nt, Pseudomonas putida KT2440
ccagcuugaagcggcc

SEQ ID NO: 3590677 - RNA, 21 nt, Pseudomonas putida KT2440
ccagcuugacggugcgcgcca

SEQ ID NO: 3590678 - RNA, 17 nt, Pseudomonas putida KT2440
ccagcuugccaccaucg

SEQ ID NO: 3590679 - RNA, 13 nt, Pseudomonas putida KT2440
ccagcuugcccag

SEQ ID NO: 3590680 - RNA, 15 nt, Pseudomonas putida KT2440
ccagcuugccgucgc

SEQ ID NO: 3590681 - RNA, 18 nt, Pseudomonas putida KT2440
ccagcuugccgucgcugg

SEQ ID NO: 3590682 - RNA, 19 nt, Pseudomonas putida KT2440
ccagcuugccgucgcugga

SEQ ID NO: 3590683 - RNA, 21 nt, Pseudomonas putida KT2440
ccagcuuggaagugucgaacu

SEQ ID NO: 3590684 - RNA, 14 nt, Pseudomonas putida KT2440
ccagcuuggcgccc

SEQ ID NO: 3590685 - RNA, 14 nt, Pseudomonas putida KT2440
ccagcuuggucagg

SEQ ID NO: 3590686 - RNA, 13 nt, Pseudomonas putida KT2440
ccagcuugugccg

SEQ ID NO: 3590687 - RNA, 15 nt, Pseudomonas putida KT2440
ccaggaacagcgcag

SEQ ID NO: 3590688 - RNA, 16 nt, Pseudomonas putida KT2440
ccaggaacagcgccac

SEQ ID NO: 3590689 - RNA, 15 nt, Pseudomonas putida KT2440
ccaggaacgcugccu

SEQ ID NO: 3590690 - RNA, 20 nt, Pseudomonas putida KT2440
ccaggaagaucacgucggcc

SEQ ID NO: 3590691 - RNA, 22 nt, Pseudomonas putida KT2440
ccaggaagaucacgucggccug

SEQ ID NO: 3590692 - RNA, 15 nt, Pseudomonas putida KT2440
ccaggaagcuggcca

SEQ ID NO: 3590693 - RNA, 19 nt, Pseudomonas putida KT2440
ccaggaagcuggccagccg

SEQ ID NO: 3590694 - RNA, 20 nt, Pseudomonas putida KT2440
ccaggaagucgauguucagc

SEQ ID NO: 3590695 - RNA, 12 nt, Pseudomonas putida KT2440
ccaggacggugg

SEQ ID NO: 3590696 - RNA, 19 nt, Pseudomonas putida KT2440
ccaggacuucagcaguucg

SEQ ID NO: 3590697 - RNA, 21 nt, Pseudomonas putida KT2440
ccaggacuucccggcaccgcu

SEQ ID NO: 3590698 - RNA, 21 nt, Pseudomonas putida KT2440
ccaggagaacacccagcgcau

SEQ ID NO: 3590699 - RNA, 14 nt, Pseudomonas putida KT2440
ccaggagggcuggu

SEQ ID NO: 3590700 - RNA, 24 nt, Pseudomonas putida KT2440
ccaggagggcugguggcggcauac

SEQ ID NO: 3590701 - RNA, 20 nt, Pseudomonas putida KT2440
ccaggaguucugcacagcgc

SEQ ID NO: 3590702 - RNA, 16 nt, Pseudomonas putida KT2440
ccaggauauugccgac

SEQ ID NO: 3590703 - RNA, 13 nt, Pseudomonas putida KT2440
ccaggaucaacug

SEQ ID NO: 3590704 - RNA, 23 nt, Pseudomonas putida KT2440
ccaggaucaacugccgcgccgcc

SEQ ID NO: 3590705 - RNA, 15 nt, Pseudomonas putida KT2440
ccaggaucacuggcc

SEQ ID NO: 3590706 - RNA, 17 nt, Pseudomonas putida KT2440
ccaggaucacuggccug

SEQ ID NO: 3590707 - RNA, 15 nt, Pseudomonas putida KT2440
ccaggaucggcacga

SEQ ID NO: 3590708 - RNA, 22 nt, Pseudomonas putida KT2440
ccaggaucuucucggcgcggaa

SEQ ID NO: 3590709 - RNA, 20 nt, Pseudomonas putida KT2440
ccaggaugccaaggaucagc

SEQ ID NO: 3590710 - RNA, 14 nt, Pseudomonas putida KT2440
ccaggauggcauug

SEQ ID NO: 3590711 - RNA, 18 nt, Pseudomonas putida KT2440
ccaggauggcauuggcca

SEQ ID NO: 3590712 - RNA, 14 nt, Pseudomonas putida KT2440
ccaggauggcuuug

SEQ ID NO: 3590713 - RNA, 21 nt, Pseudomonas putida KT2440
ccaggauggcuuugccauucu

SEQ ID NO: 3590714 - RNA, 16 nt, Pseudomonas putida KT2440
ccaggauugccgggcu

SEQ ID NO: 3590715 - RNA, 20 nt, Pseudomonas putida KT2440
ccaggauugccgggcuacgc

SEQ ID NO: 3590716 - RNA, 16 nt, Pseudomonas putida KT2440
ccaggauuggccgcaa

SEQ ID NO: 3590717 - RNA, 17 nt, Pseudomonas putida KT2440
ccaggauuggccgcaac

SEQ ID NO: 3590718 - RNA, 19 nt, Pseudomonas putida KT2440
ccaggauuggccgcaacac

SEQ ID NO: 3590719 - RNA, 18 nt, Pseudomonas putida KT2440
ccaggcaaaaaaaagggg

SEQ ID NO: 3590720 - RNA, 23 nt, Pseudomonas putida KT2440
ccaggcaaaguugagcgccgcga

SEQ ID NO: 3590721 - RNA, 16 nt, Pseudomonas putida KT2440
ccaggcaauugugccg

SEQ ID NO: 3590722 - RNA, 21 nt, Pseudomonas putida KT2440
ccaggcacaccgagccauuga

SEQ ID NO: 3590723 - RNA, 15 nt, Pseudomonas putida KT2440
ccaggcacaggcgca

SEQ ID NO: 3590724 - RNA, 17 nt, Pseudomonas putida KT2440
ccaggcacaggcgcaca

SEQ ID NO: 3590725 - RNA, 15 nt, Pseudomonas putida KT2440
ccaggcaccgaguac

SEQ ID NO: 3590726 - RNA, 15 nt, Pseudomonas putida KT2440
ccaggcacuggccag

SEQ ID NO: 3590727 - RNA, 20 nt, Pseudomonas putida KT2440
ccaggcacuggccagcggcg

SEQ ID NO: 3590728 - RNA, 18 nt, Pseudomonas putida KT2440
ccaggcaguccugcaacu

SEQ ID NO: 3590729 - RNA, 19 nt, Pseudomonas putida KT2440
ccaggcaguuucaggcgcu

SEQ ID NO: 3590730 - RNA, 18 nt, Pseudomonas putida KT2440
ccaggcauacagcuggcc

SEQ ID NO: 3590731 - RNA, 20 nt, Pseudomonas putida KT2440
ccaggcauuccccggucagc

SEQ ID NO: 3590732 - RNA, 22 nt, Pseudomonas putida KT2440
ccaggcauugcaagguccuugu

SEQ ID NO: 3590733 - RNA, 16 nt, Pseudomonas putida KT2440
ccaggcauugcucgau

SEQ ID NO: 3590734 - RNA, 17 nt, Pseudomonas putida KT2440
ccaggccaaacaggccg

SEQ ID NO: 3590735 - RNA, 22 nt, Pseudomonas putida KT2440
ccaggccagcuucgacgaagaa

SEQ ID NO: 3590736 - RNA, 12 nt, Pseudomonas putida KT2440
ccaggcccagca

SEQ ID NO: 3590737 - RNA, 15 nt, Pseudomonas putida KT2440
ccaggcccagccccg

SEQ ID NO: 3590738 - RNA, 21 nt, Pseudomonas putida KT2440
ccaggcccagccccgcaugcu

SEQ ID NO: 3590739 - RNA, 16 nt, Pseudomonas putida KT2440
ccaggccccuuggcca

SEQ ID NO: 3590740 - RNA, 15 nt, Pseudomonas putida KT2440
ccaggcccgacucca

SEQ ID NO: 3590741 - RNA, 20 nt, Pseudomonas putida KT2440
ccaggcccgcaagggucugg

SEQ ID NO: 3590742 - RNA, 13 nt, Pseudomonas putida KT2440
ccaggcccgccag

SEQ ID NO: 3590743 - RNA, 18 nt, Pseudomonas putida KT2440
ccaggucgccagcaccau

SEQ ID NO: 3590744 - RNA, 21 nt, Pseudomonas putida KT2440
ccaggucgccggugugcaucc

SEQ ID NO: 3590745 - RNA, 16 nt, Pseudomonas putida KT2440
ccaggucgcggagcca

SEQ ID NO: 3590746 - RNA, 21 nt, Pseudomonas putida KT2440
ccaggucgcgguucgacugcc

SEQ ID NO: 3590747 - RNA, 12 nt, Pseudomonas putida KT2440
ccaggucggaca

SEQ ID NO: 3590748 - RNA, 16 nt, Pseudomonas putida KT2440
ccaggucggacagggu

SEQ ID NO: 3590749 - RNA, 17 nt, Pseudomonas putida KT2440
ccaggucggacaggguc

SEQ ID NO: 3590750 - RNA, 22 nt, Pseudomonas putida KT2440
ccaggucgggcuggcugcccga

SEQ ID NO: 3590751 - RNA, 14 nt, Pseudomonas putida KT2440
ccaggucggucagc

SEQ ID NO: 3590752 - RNA, 16 nt, Pseudomonas putida KT2440
ccaggucggucagcac

SEQ ID NO: 3590753 - RNA, 16 nt, Pseudomonas putida KT2440
ccaggucuuccuccga

SEQ ID NO: 3590754 - RNA, 20 nt, Pseudomonas putida KT2440
ccaggugaaucagcggcagg

SEQ ID NO: 3590755 - RNA, 18 nt, Pseudomonas putida KT2440
ccaggugaucgccacaac

SEQ ID NO: 3590756 - RNA, 18 nt, Pseudomonas putida KT2440
ccaggugaugcaggcaau

SEQ ID NO: 3590757 - RNA, 20 nt, Pseudomonas putida KT2440
ccaggugcaacccggccuug

SEQ ID NO: 3590758 - RNA, 21 nt, Pseudomonas putida KT2440
ccaggugcaccaacacuucca

SEQ ID NO: 3590759 - RNA, 16 nt, Pseudomonas putida KT2440
ccaggugccaggcuca

SEQ ID NO: 3590760 - RNA, 14 nt, Pseudomonas putida KT2440
ccaggugccgggcu

SEQ ID NO: 3590761 - RNA, 21 nt, Pseudomonas putida KT2440
ccaggugcgcgucgacaauac

SEQ ID NO: 3590762 - RNA, 19 nt, Pseudomonas putida KT2440
ccaggugcucagccacgcu

SEQ ID NO: 3590763 - RNA, 13 nt, Pseudomonas putida KT2440
ccaggugcucgau

SEQ ID NO: 3590764 - RNA, 12 nt, Pseudomonas putida KT2440
ccaggugcugcg

SEQ ID NO: 3590765 - RNA, 22 nt, Pseudomonas putida KT2440
ccagguggaagcgcgcaucagc

SEQ ID NO: 3590766 - RNA, 19 nt, Pseudomonas putida KT2440
ccaggugguaacuggccag

SEQ ID NO: 3590767 - RNA, 15 nt, Pseudomonas putida KT2440
ccaggugugccacuu

SEQ ID NO: 3590768 - RNA, 20 nt, Pseudomonas putida KT2440
ccagguuauccacagggccu

SEQ ID NO: 3590769 - RNA, 19 nt, Pseudomonas putida KT2440
ccagguucucgcuccagug

SEQ ID NO: 3590770 - RNA, 18 nt, Pseudomonas putida KT2440
ccagguucuguagcgcaa

SEQ ID NO: 3590771 - RNA, 20 nt, Pseudomonas putida KT2440
ccagguucuguagcgcaaug

SEQ ID NO: 3590772 - RNA, 16 nt, Pseudomonas putida KT2440
ccagguugagcacacg

SEQ ID NO: 3590773 - RNA, 15 nt, Pseudomonas putida KT2440
ccagguuggcaaacu

SEQ ID NO: 3590774 - RNA, 14 nt, Pseudomonas putida KT2440
ccagguuggcccug

SEQ ID NO: 3590775 - RNA, 16 nt, Pseudomonas putida KT2440
ccagguuggccgccgc

SEQ ID NO: 3590776 - RNA, 18 nt, Pseudomonas putida KT2440
ccagguuggccgccgcca

SEQ ID NO: 3590777 - RNA, 12 nt, Pseudomonas putida KT2440
ccagguuguagg

SEQ ID NO: 3590778 - RNA, 16 nt, Pseudomonas putida KT2440
ccagguuguggcccau

SEQ ID NO: 3590779 - RNA, 18 nt, Pseudomonas putida KT2440
ccagguuuaccggccgcu

SEQ ID NO: 3590780 - RNA, 14 nt, Pseudomonas putida KT2440
ccagguuugcugcc

SEQ ID NO: 3590781 - RNA, 17 nt, Pseudomonas putida KT2440
ccaguaaaggcgugccg

SEQ ID NO: 3590782 - RNA, 19 nt, Pseudomonas putida KT2440
ccaguaaugcagccggccc

SEQ ID NO: 3590783 - RNA, 15 nt, Pseudomonas putida KT2440
ccaguacaugaucgg

SEQ ID NO: 3590784 - RNA, 18 nt, Pseudomonas putida KT2440
ccaguaccacuuccaaca

SEQ ID NO: 3590785 - RNA, 15 nt, Pseudomonas putida KT2440
ccaguaccagcagca

SEQ ID NO: 3590786 - RNA, 21 nt, Pseudomonas putida KT2440
ccaguaccgcgccuccagcug

SEQ ID NO: 3590787 - RNA, 22 nt, Pseudomonas putida KT2440
ccaguaccuuggcguaggccug

SEQ ID NO: 3590788 - RNA, 15 nt, Pseudomonas putida KT2440
ccaguacgcaggcau

SEQ ID NO: 3590789 - RNA, 14 nt, Pseudomonas putida KT2440
ccaguacgccaccc

SEQ ID NO: 3590790 - RNA, 21 nt, Pseudomonas putida KT2440
ccaguacgccacccagaugcg

SEQ ID NO: 3590791 - RNA, 17 nt, Pseudomonas putida KT2440
ccaguacgccagcagcg

SEQ ID NO: 3590792 - RNA, 18 nt, Pseudomonas putida KT2440
ccaguacgccagcagcgc

SEQ ID NO: 3590793 - RNA, 19 nt, Pseudomonas putida KT2440
ccaguacgccagcagcgca

SEQ ID NO: 3590794 - RNA, 20 nt, Pseudomonas putida KT2440
ccaguacgccagcagcgcau

SEQ ID NO: 3590795 - RNA, 13 nt, Pseudomonas putida KT2440
ccaguacgccucg

SEQ ID NO: 3590796 - RNA, 21 nt, Pseudomonas putida KT2440
ccaguacgcgccugcaccugg

SEQ ID NO: 3590797 - RNA, 22 nt, Pseudomonas putida KT2440
ccaguacggccaucagcaagcc

SEQ ID NO: 3590798 - RNA, 17 nt, Pseudomonas putida KT2440
ccaguacugggcguccu

SEQ ID NO: 3590799 - RNA, 16 nt, Pseudomonas putida KT2440
ccaguagcacagugcg

SEQ ID NO: 3590800 - RNA, 16 nt, Pseudomonas putida KT2440
ccaguagcgccaccau

SEQ ID NO: 3590801 - RNA, 17 nt, Pseudomonas putida KT2440
ccaguaggcugcagccu

SEQ ID NO: 3590802 - RNA, 18 nt, Pseudomonas putida KT2440
ccaguaggcugcagccuu

SEQ ID NO: 3590803 - RNA, 23 nt, Pseudomonas putida KT2440
ccaguauucgcuaaccucugcau

SEQ ID NO: 3590804 - RNA, 16 nt, Pseudomonas putida KT2440
ccaguauugcgucagg

SEQ ID NO: 3590805 - RNA, 20 nt, Pseudomonas putida KT2440
ccagucaggccguagcgcug

SEQ ID NO: 3590806 - RNA, 23 nt, Pseudomonas putida KT2440
ccagucauccucagggguaaugc

SEQ ID NO: 3590807 - RNA, 19 nt, Pseudomonas putida KT2440
ccaguccgccucgucgaug

SEQ ID NO: 3590808 - RNA, 17 nt, Pseudomonas putida KT2440
ccaguccuuggccaaug

SEQ ID NO: 3590809 - RNA, 15 nt, Pseudomonas putida KT2440
ccagucgaucagcga

SEQ ID NO: 3590810 - RNA, 19 nt, Pseudomonas putida KT2440
ccagucgaucagcgacacc

SEQ ID NO: 3590811 - RNA, 23 nt, Pseudomonas putida KT2440
ccagucgcacagguccagccgcc

SEQ ID NO: 3590812 - RNA, 14 nt, Pseudomonas putida KT2440
ccagucgccccgcc

SEQ ID NO: 3590813 - RNA, 14 nt, Pseudomonas putida KT2440
ccagucgccuucgu

SEQ ID NO: 3590814 - RNA, 21 nt, Pseudomonas putida KT2440
ccagucgcgcaacugcccagg

SEQ ID NO: 3590815 - RNA, 15 nt, Pseudomonas putida KT2440
ccagucggcauccuc

SEQ ID NO: 3590816 - RNA, 14 nt, Pseudomonas putida KT2440
ccagucugcucagc

SEQ ID NO: 3590817 - RNA, 19 nt, Pseudomonas putida KT2440
ccagucugcucagccaacc

SEQ ID NO: 3590818 - RNA, 19 nt, Pseudomonas putida KT2440
ccagucugcuccaccgcau

SEQ ID NO: 3590819 - RNA, 16 nt, Pseudomonas putida KT2440
ccagugcaacguucac

SEQ ID NO: 3590820 - RNA, 12 nt, Pseudomonas putida KT2440
ccagugccgcaa

SEQ ID NO: 3590821 - RNA, 17 nt, Pseudomonas putida KT2440
ccagugccgcaagcagu

SEQ ID NO: 3590822 - RNA, 20 nt, Pseudomonas putida KT2440
ccagugccugaccggucagc

SEQ ID NO: 3590823 - RNA, 17 nt, Pseudomonas putida KT2440
ccagugcgaucugagua

SEQ ID NO: 3590824 - RNA, 20 nt, Pseudomonas putida KT2440
ccagugcggugaccgaggcg

SEQ ID NO: 3590825 - RNA, 15 nt, Pseudomonas putida KT2440
ccagugcgugcagug

SEQ ID NO: 3590826 - RNA, 20 nt, Pseudomonas putida KT2440
ccagugcugccugcugcagc

SEQ ID NO: 3590827 - RNA, 16 nt, Pseudomonas putida KT2440
ccagugcuucacugcc

SEQ ID NO: 3590828 - RNA, 19 nt, Pseudomonas putida KT2440
ccagugcuucacugccggc

SEQ ID NO: 3590829 - RNA, 20 nt, Pseudomonas putida KT2440
ccagugcuucacugccggca

SEQ ID NO: 3590830 - RNA, 20 nt, Pseudomonas putida KT2440
ccaguggcacccacagcgcc

SEQ ID NO: 3590831 - RNA, 24 nt, Pseudomonas putida KT2440
ccaguggcacccacagcgccugcu

SEQ ID NO: 3590832 - RNA, 18 nt, Pseudomonas putida KT2440
ccagugggcacgguuggc

SEQ ID NO: 3590833 - RNA, 20 nt, Pseudomonas putida KT2440
ccagugggugcuguggcgca

SEQ ID NO: 3590834 - RNA, 22 nt, Pseudomonas putida KT2440
ccaguguagacaugaggcccuc

SEQ ID NO: 3590835 - RNA, 20 nt, Pseudomonas putida KT2440
ccagugucaggugguagucc

SEQ ID NO: 3590836 - RNA, 19 nt, Pseudomonas putida KT2440
ccagugucaguugcucgcc

SEQ ID NO: 3590837 - RNA, 23 nt, Pseudomonas putida KT2440
ccaguucaaugccagcaguucgc

SEQ ID NO: 3590838 - RNA, 16 nt, Pseudomonas putida KT2440
ccaguucaccauccgc

SEQ ID NO: 3590839 - RNA, 16 nt, Pseudomonas putida KT2440
ccaguucacggaucgc

SEQ ID NO: 3590840 - RNA, 13 nt, Pseudomonas putida KT2440
ccaguucagcgcc

SEQ ID NO: 3590841 - RNA, 15 nt, Pseudomonas putida KT2440
ccaguucagcgcccg

SEQ ID NO: 3590842 - RNA, 21 nt, Pseudomonas putida KT2440
ccaguucauggcucacaccca

SEQ ID NO: 3590843 - RNA, 16 nt, Pseudomonas putida KT2440
ccaguucauucccggc

SEQ ID NO: 3590844 - RNA, 17 nt, Pseudomonas putida KT2440
ccaguucauucccggcc

SEQ ID NO: 3590845 - RNA, 14 nt, Pseudomonas putida KT2440
ccaguuccacgacc

SEQ ID NO: 3590846 - RNA, 16 nt, Pseudomonas putida KT2440
ccaguuccaguucgcc

SEQ ID NO: 3590847 - RNA, 20 nt, Pseudomonas putida KT2440
ccaguuccggcaggucgaug

SEQ ID NO: 3590848 - RNA, 21 nt, Pseudomonas putida KT2440
ccaucuugcugcucugcaaug

SEQ ID NO: 3590849 - RNA, 23 nt, Pseudomonas putida KT2440
ccaucuugguuggcggagccagc

SEQ ID NO: 3590850 - RNA, 14 nt, Pseudomonas putida KT2440
ccaucuuuggcagg

SEQ ID NO: 3590851 - RNA, 14 nt, Pseudomonas putida KT2440
ccaugaacagcaag

SEQ ID NO: 3590852 - RNA, 14 nt, Pseudomonas putida KT2440
ccaugaaguucauc

SEQ ID NO: 3590853 - RNA, 23 nt, Pseudomonas putida KT2440
ccaugaauucccuacugcgaaug

SEQ ID NO: 3590854 - RNA, 23 nt, Pseudomonas putida KT2440
ccaugagcgagcucaaccagcug

SEQ ID NO: 3590855 - RNA, 15 nt, Pseudomonas putida KT2440
ccaugagugcaggca

SEQ ID NO: 3590856 - RNA, 16 nt, Pseudomonas putida KT2440
ccaugagugcaggcau

SEQ ID NO: 3590857 - RNA, 14 nt, Pseudomonas putida KT2440
ccaugaucagcgcc

SEQ ID NO: 3590858 - RNA, 18 nt, Pseudomonas putida KT2440
ccaugaucagcgccugcu

SEQ ID NO: 3590859 - RNA, 14 nt, Pseudomonas putida KT2440
ccaugaucugcccg

SEQ ID NO: 3590860 - RNA, 19 nt, Pseudomonas putida KT2440
ccaugauguggcugguggc

SEQ ID NO: 3590861 - RNA, 13 nt, Pseudomonas putida KT2440
ccaugcaccgucu

SEQ ID NO: 3590862 - RNA, 20 nt, Pseudomonas putida KT2440
ccaugcaccgucuggaaguc

SEQ ID NO: 3590863 - RNA, 17 nt, Pseudomonas putida KT2440
ccaugcaggucgacgau

SEQ ID NO: 3590864 - RNA, 23 nt, Pseudomonas putida KT2440
ccaugcaggucgacgauacccag

SEQ ID NO: 3590865 - RNA, 22 nt, Pseudomonas putida KT2440
ccaugccaagcccacacaccgc

SEQ ID NO: 3590866 - RNA, 15 nt, Pseudomonas putida KT2440
ccaugccccccgcca

SEQ ID NO: 3590867 - RNA, 16 nt, Pseudomonas putida KT2440
ccaugccccuaccgcc

SEQ ID NO: 3590868 - RNA, 22 nt, Pseudomonas putida KT2440
ccaugccggcaacgauacccac

SEQ ID NO: 3590869 - RNA, 18 nt, Pseudomonas putida KT2440
ccaugccguaagccgcag

SEQ ID NO: 3590870 - RNA, 13 nt, Pseudomonas putida KT2440
ccaugccuucuuc

SEQ ID NO: 3590871 - RNA, 20 nt, Pseudomonas putida KT2440
ccaugcgaacugcagagccu

SEQ ID NO: 3590872 - RNA, 17 nt, Pseudomonas putida KT2440
ccaugcgaccaguaccg

SEQ ID NO: 3590873 - RNA, 20 nt, Pseudomonas putida KT2440
ccaugcgaccaguaccgcgc

SEQ ID NO: 3590874 - RNA, 15 nt, Pseudomonas putida KT2440
ccaugcgccgcugcu

SEQ ID NO: 3590875 - RNA, 14 nt, Pseudomonas putida KT2440
ccaugcgcgcagcg

SEQ ID NO: 3590876 - RNA, 21 nt, Pseudomonas putida KT2440
ccaugcggcucuguuucugcc

SEQ ID NO: 3590877 - RNA, 22 nt, Pseudomonas putida KT2440
ccaugcgggacucgaucugugg

SEQ ID NO: 3590878 - RNA, 23 nt, Pseudomonas putida KT2440
ccaugcucaccgccaacccgauc

SEQ ID NO: 3590879 - RNA, 13 nt, Pseudomonas putida KT2440
ccaugcucggcca

SEQ ID NO: 3590880 - RNA, 17 nt, Pseudomonas putida KT2440
ccaugcucggccagcuc

SEQ ID NO: 3590881 - RNA, 20 nt, Pseudomonas putida KT2440
ccaugcugcagaaccgccag

SEQ ID NO: 3590882 - RNA, 23 nt, Pseudomonas putida KT2440
ccaugcugcagaaccgccagcac

SEQ ID NO: 3590883 - RNA, 14 nt, Pseudomonas putida KT2440
ccaugcugcgccag

SEQ ID NO: 3590884 - RNA, 13 nt, Pseudomonas putida KT2440
ccaugcugcugcc

SEQ ID NO: 3590885 - RNA, 13 nt, Pseudomonas putida KT2440
ccaugcugucgau

SEQ ID NO: 3590886 - RNA, 20 nt, Pseudomonas putida KT2440
ccauggcaaucagcgacaac

SEQ ID NO: 3590887 - RNA, 21 nt, Pseudomonas putida KT2440
ccauggcaauuggcuuccagg

SEQ ID NO: 3590888 - RNA, 12 nt, Pseudomonas putida KT2440
ccauggccagcg

SEQ ID NO: 3590889 - RNA, 22 nt, Pseudomonas putida KT2440
ccauggccaggucggucagcac

SEQ ID NO: 3590890 - RNA, 21 nt, Pseudomonas putida KT2440
ccauggccgaucaguacgaug

SEQ ID NO: 3590891 - RNA, 13 nt, Pseudomonas putida KT2440
ccauggccuggcg

SEQ ID NO: 3590892 - RNA, 21 nt, Pseudomonas putida KT2440
ccauggcgcagcuccacugga

SEQ ID NO: 3590893 - RNA, 21 nt, Pseudomonas putida KT2440
ccauggcgggcgacgaaggcc

SEQ ID NO: 3590894 - RNA, 21 nt, Pseudomonas putida KT2440
ccauggcgguauucacaccug

SEQ ID NO: 3590895 - RNA, 15 nt, Pseudomonas putida KT2440
ccauggcuggcagca

SEQ ID NO: 3590896 - RNA, 16 nt, Pseudomonas putida KT2440
ccauggcuggcagcac

SEQ ID NO: 3590897 - RNA, 17 nt, Pseudomonas putida KT2440
ccauggggucaguucag

SEQ ID NO: 3590898 - RNA, 21 nt, Pseudomonas putida KT2440
ccaugguaaaagccgccacau

SEQ ID NO: 3590899 - RNA, 22 nt, Pseudomonas putida KT2440
ccauguaacgcuccacauauga

SEQ ID NO: 3590900 - RNA, 14 nt, Pseudomonas putida KT2440
ccauguagaccacc

SEQ ID NO: 3590901 - RNA, 16 nt, Pseudomonas putida KT2440
ccauguagaccaccag

SEQ ID NO: 3590902 - RNA, 17 nt, Pseudomonas putida KT2440
ccauguaggagcggguu

SEQ ID NO: 3590903 - RNA, 14 nt, Pseudomonas putida KT2440
ccauguccauggca

SEQ ID NO: 3590904 - RNA, 17 nt, Pseudomonas putida KT2440
ccaugucgaaccacauc

SEQ ID NO: 3590905 - RNA, 21 nt, Pseudomonas putida KT2440
ccaugucgugcugccggucgg

SEQ ID NO: 3590906 - RNA, 19 nt, Pseudomonas putida KT2440
ccaugugccuggcccggcc

SEQ ID NO: 3590907 - RNA, 21 nt, Pseudomonas putida KT2440
ccauguggcgcagcaucaucu

SEQ ID NO: 3590908 - RNA, 17 nt, Pseudomonas putida KT2440
ccauguguacgccgcug

SEQ ID NO: 3590909 - RNA, 21 nt, Pseudomonas putida KT2440
ccauguucaccguacccgcca

SEQ ID NO: 3590910 - RNA, 14 nt, Pseudomonas putida KT2440
ccauguugcgcagc

SEQ ID NO: 3590911 - RNA, 22 nt, Pseudomonas putida KT2440
ccauuauuugcguagggcgcug

SEQ ID NO: 3590912 - RNA, 15 nt, Pseudomonas putida KT2440
ccauucaccagcuuc

SEQ ID NO: 3590913 - RNA, 13 nt, Pseudomonas putida KT2440
ccauucauuuuug

SEQ ID NO: 3590914 - RNA, 13 nt, Pseudomonas putida KT2440
ccauucccugcac

SEQ ID NO: 3590915 - RNA, 18 nt, Pseudomonas putida KT2440
ccauucccugcacaucgc

SEQ ID NO: 3590916 - RNA, 14 nt, Pseudomonas putida KT2440
ccauuccggcugca

SEQ ID NO: 3590917 - RNA, 19 nt, Pseudomonas putida KT2440
ccauuccgggucgccagug

SEQ ID NO: 3590918 - RNA, 12 nt, Pseudomonas putida KT2440
ccauuccuugcg

SEQ ID NO: 3590919 - RNA, 19 nt, Pseudomonas putida KT2440
ccauucgcggguaaacccg

SEQ ID NO: 3590920 - RNA, 23 nt, Pseudomonas putida KT2440
ccauucggugacgaucaccaggg

SEQ ID NO: 3590921 - RNA, 15 nt, Pseudomonas putida KT2440
ccauucucgccgccg

SEQ ID NO: 3590922 - RNA, 18 nt, Pseudomonas putida KT2440
ccauucucgccgccgcug

SEQ ID NO: 3590923 - RNA, 15 nt, Pseudomonas putida KT2440
ccauugacccgcuug

SEQ ID NO: 3590924 - RNA, 22 nt, Pseudomonas putida KT2440
ccauugagguugacguuguagc

SEQ ID NO: 3590925 - RNA, 15 nt, Pseudomonas putida KT2440
ccauugaucaccucc

SEQ ID NO: 3590926 - RNA, 22 nt, Pseudomonas putida KT2440
ccauugcaccacccccagcgcc

SEQ ID NO: 3590927 - RNA, 23 nt, Pseudomonas putida KT2440
ccauugcaccacccccagcgccu

SEQ ID NO: 3590928 - RNA, 15 nt, Pseudomonas putida KT2440
ccauugcccagccug

SEQ ID NO: 3590929 - RNA, 12 nt, Pseudomonas putida KT2440
ccauugcccagu

SEQ ID NO: 3590930 - RNA, 17 nt, Pseudomonas putida KT2440
ccauugcccaguucguc

SEQ ID NO: 3590931 - RNA, 22 nt, Pseudomonas putida KT2440
ccauuggcgucagcguugcugg

SEQ ID NO: 3590932 - RNA, 23 nt, Pseudomonas putida KT2440
ccauuggcgucagcguugcuggc

SEQ ID NO: 3590933 - RNA, 22 nt, Pseudomonas putida KT2440
ccauuggggcugcauugcagcc

SEQ ID NO: 3590934 - RNA, 18 nt, Pseudomonas putida KT2440
ccauuggggggucugguu

SEQ ID NO: 3590935 - RNA, 21 nt, Pseudomonas putida KT2440
ccauuggugcccuugaugauc

SEQ ID NO: 3590936 - RNA, 15 nt, Pseudomonas putida KT2440
ccauuucaccugcuc

SEQ ID NO: 3590937 - RNA, 21 nt, Pseudomonas putida KT2440
ccauuucacuggcuuccucuu

SEQ ID NO: 3590938 - RNA, 23 nt, Pseudomonas putida KT2440
ccauuucccaaagauaccccugc

SEQ ID NO: 3590939 - RNA, 16 nt, Pseudomonas putida KT2440
ccauuuccgggcaaug

SEQ ID NO: 3590940 - RNA, 16 nt, Pseudomonas putida KT2440
ccauuucgcgggucag

SEQ ID NO: 3590941 - RNA, 17 nt, Pseudomonas putida KT2440
ccauuucgcgggucagg

SEQ ID NO: 3590942 - RNA, 14 nt, Pseudomonas putida KT2440
ccauuucuucagca

SEQ ID NO: 3590943 - RNA, 17 nt, Pseudomonas putida KT2440
ccauuucuucagcagga

SEQ ID NO: 3590944 - RNA, 19 nt, Pseudomonas putida KT2440
ccauuucuucagcaggaag

SEQ ID NO: 3590945 - RNA, 18 nt, Pseudomonas putida KT2440
ccauuugcgcuggcugcc

SEQ ID NO: 3590946 - RNA, 21 nt, Pseudomonas putida KT2440
cccaaacagcaucaaugcagg

SEQ ID NO: 3590947 - RNA, 20 nt, Pseudomonas putida KT2440
cccaaagcccgugccgcauc

SEQ ID NO: 3590948 - RNA, 19 nt, Pseudomonas putida KT2440
cccaaccucaacgccuccc

SEQ ID NO: 3590949 - RNA, 18 nt, Pseudomonas putida KT2440
cccaaccuuccagcaaag

SEQ ID NO: 3590950 - RNA, 17 nt, Pseudomonas putida KT2440
cccaacgaaaaaggccc

SEQ ID NO: 3590951 - RNA, 22 nt, Pseudomonas putida KT2440
cccaacgcaaauccuccugcgc

SEQ ID NO: 3590952 - RNA, 23 nt, Pseudomonas putida KT2440
cccaagccauccaccagccccag

SEQ ID NO: 3590953 - RNA, 16 nt, Pseudomonas putida KT2440
cccagcagguacagca

SEQ ID NO: 3590954 - RNA, 23 nt, Pseudomonas putida KT2440
cccagcagguacagcaccccguc

SEQ ID NO: 3590955 - RNA, 19 nt, Pseudomonas putida KT2440
cccagcagguagacgaugc

SEQ ID NO: 3590956 - RNA, 19 nt, Pseudomonas putida KT2440
cccagcaguucgcgcacca

SEQ ID NO: 3590957 - RNA, 16 nt, Pseudomonas putida KT2440
cccagcaucaacgcug

SEQ ID NO: 3590958 - RNA, 18 nt, Pseudomonas putida KT2440
cccagcaucaacgcugcc

SEQ ID NO: 3590959 - RNA, 13 nt, Pseudomonas putida KT2440
cccagcaugcgcu

SEQ ID NO: 3590960 - RNA, 18 nt, Pseudomonas putida KT2440
cccagcaugcgcuugagc

SEQ ID NO: 3590961 - RNA, 18 nt, Pseudomonas putida KT2440
cccagcauggccgaaacc

SEQ ID NO: 3590962 - RNA, 20 nt, Pseudomonas putida KT2440
cccagcauggccgaaaccag

SEQ ID NO: 3590963 - RNA, 18 nt, Pseudomonas putida KT2440
cccagccaacccucgacc

SEQ ID NO: 3590964 - RNA, 22 nt, Pseudomonas putida KT2440
cccagccaacgccccacccgcu

SEQ ID NO: 3590965 - RNA, 14 nt, Pseudomonas putida KT2440
cccagccacccggc

SEQ ID NO: 3590966 - RNA, 20 nt, Pseudomonas putida KT2440
cccagccaccgacgaacagg

SEQ ID NO: 3590967 - RNA, 22 nt, Pseudomonas putida KT2440
cccagccaccgacgaacagggc

SEQ ID NO: 3590968 - RNA, 13 nt, Pseudomonas putida KT2440
cccagccagcaga

SEQ ID NO: 3590969 - RNA, 17 nt, Pseudomonas putida KT2440
cccagccagcgacagca

SEQ ID NO: 3590970 - RNA, 17 nt, Pseudomonas putida KT2440
cccagccaggcacuggc

SEQ ID NO: 3590971 - RNA, 18 nt, Pseudomonas putida KT2440
cccagcccaugaacagca

SEQ ID NO: 3590972 - RNA, 15 nt, Pseudomonas putida KT2440
cccagccccgcaugc

SEQ ID NO: 3590973 - RNA, 22 nt, Pseudomonas putida KT2440
cccagcccggacugcaccaggu

SEQ ID NO: 3590974 - RNA, 23 nt, Pseudomonas putida KT2440
cccagcccggcgccgagccauag

SEQ ID NO: 3590975 - RNA, 15 nt, Pseudomonas putida KT2440
cccagccggcguugc

SEQ ID NO: 3590976 - RNA, 22 nt, Pseudomonas putida KT2440
cccagccgggccaacuugcgca

SEQ ID NO: 3590977 - RNA, 16 nt, Pseudomonas putida KT2440
cccagccggucaucac

SEQ ID NO: 3590978 - RNA, 22 nt, Pseudomonas putida KT2440
cccagccggucauccagcagcu

SEQ ID NO: 3590979 - RNA, 15 nt, Pseudomonas putida KT2440
cccagccucagcugg

SEQ ID NO: 3590980 - RNA, 16 nt, Pseudomonas putida KT2440
cccagccugcccgccg

SEQ ID NO: 3590981 - RNA, 23 nt, Pseudomonas putida KT2440
cccagccugggcgugaaagcagg

SEQ ID NO: 3590982 - RNA, 18 nt, Pseudomonas putida KT2440
cccagccuucaacccuuc

SEQ ID NO: 3590983 - RNA, 15 nt, Pseudomonas putida KT2440
cccagccuucagcag

SEQ ID NO: 3590984 - RNA, 16 nt, Pseudomonas putida KT2440
cccagccuucagcagg

SEQ ID NO: 3590985 - RNA, 17 nt, Pseudomonas putida KT2440
cccagccuucagcaggc

SEQ ID NO: 3590986 - RNA, 22 nt, Pseudomonas putida KT2440
cccagcgaauagcaacacaugu

SEQ ID NO: 3590987 - RNA, 16 nt, Pseudomonas putida KT2440
cccagcgaccagcugc

SEQ ID NO: 3590988 - RNA, 13 nt, Pseudomonas putida KT2440
cccagcgccaccg

SEQ ID NO: 3590989 - RNA, 14 nt, Pseudomonas putida KT2440
cccagcgccaccgg

SEQ ID NO: 3590990 - RNA, 15 nt, Pseudomonas putida KT2440
cccagcgccaccggc

SEQ ID NO: 3590991 - RNA, 19 nt, Pseudomonas putida KT2440
cccagcgccuuggccugcu

SEQ ID NO: 3590992 - RNA, 18 nt, Pseudomonas putida KT2440
cccagcgcgccagcaggu

SEQ ID NO: 3590993 - RNA, 19 nt, Pseudomonas putida KT2440
cccagcgcgccagcagguc

SEQ ID NO: 3590994 - RNA, 14 nt, Pseudomonas putida KT2440
cccagcgcggcaaa

SEQ ID NO: 3590995 - RNA, 20 nt, Pseudomonas putida KT2440
cccagcgcggucugcggcag

SEQ ID NO: 3590996 - RNA, 23 nt, Pseudomonas putida KT2440
cccagcggucagcaucuucuucc

SEQ ID NO: 3590997 - RNA, 18 nt, Pseudomonas putida KT2440
cccagcguauagccaccg

SEQ ID NO: 3590998 - RNA, 21 nt, Pseudomonas putida KT2440
cccagcguauagccaccgggc

SEQ ID NO: 3590999 - RNA, 18 nt, Pseudomonas putida KT2440
cccagcgucgucugcgug

SEQ ID NO: 3591000 - RNA, 20 nt, Pseudomonas putida KT2440
cccagcuacgcgagccaccg

SEQ ID NO: 3591001 - RNA, 22 nt, Pseudomonas putida KT2440
cccagcuacgcgagccaccguc

SEQ ID NO: 3591002 - RNA, 23 nt, Pseudomonas putida KT2440
cccagcuacgcgagccaccgucg

SEQ ID NO: 3591003 - RNA, 15 nt, Pseudomonas putida KT2440
cccagcucgaucagc

SEQ ID NO: 3591004 - RNA, 15 nt, Pseudomonas putida KT2440
cccagcucgccaaca

SEQ ID NO: 3591005 - RNA, 21 nt, Pseudomonas putida KT2440
cccagcucgccaacaccgccc

SEQ ID NO: 3591006 - RNA, 14 nt, Pseudomonas putida KT2440
cccagcucgcuggc

SEQ ID NO: 3591007 - RNA, 16 nt, Pseudomonas putida KT2440
cccagcucgcuggcca

SEQ ID NO: 3591008 - RNA, 21 nt, Pseudomonas putida KT2440
cccagcucgcuggccaccagc

SEQ ID NO: 3591009 - RNA, 20 nt, Pseudomonas putida KT2440
cccagcucuuugggggugcu

SEQ ID NO: 3591010 - RNA, 20 nt, Pseudomonas putida KT2440
cccagcuggcucaucugccg

SEQ ID NO: 3591011 - RNA, 16 nt, Pseudomonas putida KT2440
cccagcuucuccagca

SEQ ID NO: 3591012 - RNA, 23 nt, Pseudomonas putida KT2440
cccagcuucuccagcaagcgcuc

SEQ ID NO: 3591013 - RNA, 17 nt, Pseudomonas putida KT2440
cccagcuugaagcggcc

SEQ ID NO: 3591014 - RNA, 14 nt, Pseudomonas putida KT2440
cccaggacuucagc

SEQ ID NO: 3591015 - RNA, 14 nt, Pseudomonas putida KT2440
cccaggaucacugg

SEQ ID NO: 3591016 - RNA, 19 nt, Pseudomonas putida KT2440
cccaggaucacuggccugg

SEQ ID NO: 3591017 - RNA, 17 nt, Pseudomonas putida KT2440
cccaggauuaccggucu

SEQ ID NO: 3591018 - RNA, 15 nt, Pseudomonas putida KT2440
cccaggcagccucca

SEQ ID NO: 3591019 - RNA, 19 nt, Pseudomonas putida KT2440
cccaggcauacagcuggcc

SEQ ID NO: 3591020 - RNA, 16 nt, Pseudomonas putida KT2440
cccaggccauccagcg

SEQ ID NO: 3591021 - RNA, 16 nt, Pseudomonas putida KT2440
cccaggcccugacgcc

SEQ ID NO: 3591022 - RNA, 15 nt, Pseudomonas putida KT2440
cccaggccgacacgg

SEQ ID NO: 3591023 - RNA, 22 nt, Pseudomonas putida KT2440
cccaggccgacacgggguguug

SEQ ID NO: 3591024 - RNA, 14 nt, Pseudomonas putida KT2440
cccaggcgccgcag

SEQ ID NO: 3591025 - RNA, 18 nt, Pseudomonas putida KT2440
cccaggcgccgcagcagu

SEQ ID NO: 3591026 - RNA, 19 nt, Pseudomonas putida KT2440
cccaggcgcgccugcaccu

SEQ ID NO: 3591027 - RNA, 22 nt, Pseudomonas putida KT2440
cccaggcggcgugacgugcgcu

SEQ ID NO: 3591028 - RNA, 19 nt, Pseudomonas putida KT2440
cccaggcggugcacggccu

SEQ ID NO: 3591029 - RNA, 13 nt, Pseudomonas putida KT2440
cccaggcucgccc

SEQ ID NO: 3591030 - RNA, 20 nt, Pseudomonas putida KT2440
cccagggaucgaugcccugg

SEQ ID NO: 3591031 - RNA, 16 nt, Pseudomonas putida KT2440
cccagggcccucaacc

SEQ ID NO: 3591032 - RNA, 23 nt, Pseudomonas putida KT2440
cccagggcccucaacccucgccc

SEQ ID NO: 3591033 - RNA, 14 nt, Pseudomonas putida KT2440
cccaggggcagguc

SEQ ID NO: 3591034 - RNA, 17 nt, Pseudomonas putida KT2440
cccagggggcagcugcu

SEQ ID NO: 3591035 - RNA, 16 nt, Pseudomonas putida KT2440
cccagguaucgcaccg

SEQ ID NO: 3591036 - RNA, 16 nt, Pseudomonas putida KT2440
cccaggugaugcaggc

SEQ ID NO: 3591037 - RNA, 17 nt, Pseudomonas putida KT2440
cccaggugaugcaggca

SEQ ID NO: 3591038 - RNA, 18 nt, Pseudomonas putida KT2440
cccaggugaugcaggcaa

SEQ ID NO: 3591039 - RNA, 19 nt, Pseudomonas putida KT2440
cccaggugcaacccggccu

SEQ ID NO: 3591040 - RNA, 14 nt, Pseudomonas putida KT2440
cccaggugccaggc

SEQ ID NO: 3591041 - RNA, 17 nt, Pseudomonas putida KT2440
cccaggugccaggcuca

SEQ ID NO: 3591042 - RNA, 18 nt, Pseudomonas putida KT2440
cccaggugcugaugccca

SEQ ID NO: 3591043 - RNA, 21 nt, Pseudomonas putida KT2440
cccaggugcugaugcccaaac

SEQ ID NO: 3591044 - RNA, 19 nt, Pseudomonas putida KT2440
cccagguuauacgccgccg

SEQ ID NO: 3591045 - RNA, 23 nt, Pseudomonas putida KT2440
cccagguuuucucgucuggcgcg

SEQ ID NO: 3591046 - RNA, 18 nt, Pseudomonas putida KT2440
cccaguaaaaacuggcca

SEQ ID NO: 3591047 - RNA, 15 nt, Pseudomonas putida KT2440
cccaguacggcgcca

SEQ ID NO: 3591048 - RNA, 19 nt, Pseudomonas putida KT2440
cccaguagaucgcgccagu

SEQ ID NO: 3591049 - RNA, 18 nt, Pseudomonas putida KT2440
cccaguagcgccaccauc

SEQ ID NO: 3591050 - RNA, 14 nt, Pseudomonas putida KT2440
cccagucagucgcc

SEQ ID NO: 3591051 - RNA, 19 nt, Pseudomonas putida KT2440
cccagucauccgggccguc

SEQ ID NO: 3591052 - RNA, 22 nt, Pseudomonas putida KT2440
cccagucgaugggcccgagccc

SEQ ID NO: 3591053 - RNA, 18 nt, Pseudomonas putida KT2440
cccagucgccccgccagc

SEQ ID NO: 3591054 - RNA, 23 nt, Pseudomonas putida KT2440
cccagucgccccgccagcgccug

SEQ ID NO: 3591055 - RNA, 23 nt, Pseudomonas putida KT2440
cccagugcgcgcaacagugcccc

SEQ ID NO: 3591056 - RNA, 18 nt, Pseudomonas putida KT2440
cccaguggcacaccaugg

SEQ ID NO: 3591057 - RNA, 21 nt, Pseudomonas putida KT2440
ccccaguugaucaacccgugc

SEQ ID NO: 3591058 - RNA, 15 nt, Pseudomonas putida KT2440
ccccauaccucuuca

SEQ ID NO: 3591059 - RNA, 17 nt, Pseudomonas putida KT2440
ccccauaccucuucacu

SEQ ID NO: 3591060 - RNA, 23 nt, Pseudomonas putida KT2440
ccccauagccugcugcuccccaa

SEQ ID NO: 3591061 - RNA, 18 nt, Pseudomonas putida KT2440
ccccauagcuuuccagca

SEQ ID NO: 3591062 - RNA, 20 nt, Pseudomonas putida KT2440
ccccauagggccagcggcuu

SEQ ID NO: 3591063 - RNA, 16 nt, Pseudomonas putida KT2440
ccccaucaccagcccg

SEQ ID NO: 3591064 - RNA, 17 nt, Pseudomonas putida KT2440
ccccaucacgcagcgcg

SEQ ID NO: 3591065 - RNA, 15 nt, Pseudomonas putida KT2440
ccccaucagcagcug

SEQ ID NO: 3591066 - RNA, 22 nt, Pseudomonas putida KT2440
ccccaucagcgggcgauugcca

SEQ ID NO: 3591067 - RNA, 15 nt, Pseudomonas putida KT2440
ccccaucaguugcag

SEQ ID NO: 3591068 - RNA, 12 nt, Pseudomonas putida KT2440
ccccaucggcac

SEQ ID NO: 3591069 - RNA, 14 nt, Pseudomonas putida KT2440
ccccaucugcucgg

SEQ ID NO: 3591070 - RNA, 19 nt, Pseudomonas putida KT2440
ccccaugaugaccaccagg

SEQ ID NO: 3591071 - RNA, 20 nt, Pseudomonas putida KT2440
ccccaugaugaccaccagga

SEQ ID NO: 3591072 - RNA, 22 nt, Pseudomonas putida KT2440
ccccaugcgaacugcagagccu

SEQ ID NO: 3591073 - RNA, 17 nt, Pseudomonas putida KT2440
ccccaugcucaccagcu

SEQ ID NO: 3591074 - RNA, 17 nt, Pseudomonas putida KT2440
cccccaaucuccagccc

SEQ ID NO: 3591075 - RNA, 18 nt, Pseudomonas putida KT2440
cccccaaucuccagcccg

SEQ ID NO: 3591076 - RNA, 20 nt, Pseudomonas putida KT2440
cccccaaucuccagcccgaa

SEQ ID NO: 3591077 - RNA, 19 nt, Pseudomonas putida KT2440
cccccaaugggcaccggcc

SEQ ID NO: 3591078 - RNA, 14 nt, Pseudomonas putida KT2440
cccccacagggcaa

SEQ ID NO: 3591079 - RNA, 17 nt, Pseudomonas putida KT2440
cccccacccccgcccca

SEQ ID NO: 3591080 - RNA, 12 nt, Pseudomonas putida KT2440
cccccaccggcc

SEQ ID NO: 3591081 - RNA, 12 nt, Pseudomonas putida KT2440
cccccaccuggc

SEQ ID NO: 3591082 - RNA, 16 nt, Pseudomonas putida KT2440
cccccacgcuaauacc

SEQ ID NO: 3591083 - RNA, 23 nt, Pseudomonas putida KT2440
cccccagcacagauaaaccugcc

SEQ ID NO: 3591084 - RNA, 15 nt, Pseudomonas putida KT2440
cccccagcagcgggc

SEQ ID NO: 3591085 - RNA, 12 nt, Pseudomonas putida KT2440
cccccagcccug

SEQ ID NO: 3591086 - RNA, 18 nt, Pseudomonas putida KT2440
cccccagcgccuccaccu

SEQ ID NO: 3591087 - RNA, 15 nt, Pseudomonas putida KT2440
cccccagguuaucca

SEQ ID NO: 3591088 - RNA, 17 nt, Pseudomonas putida KT2440
cccccaucaguugcagc

SEQ ID NO: 3591089 - RNA, 18 nt, Pseudomonas putida KT2440
cccccaucauucgauagc

SEQ ID NO: 3591090 - RNA, 22 nt, Pseudomonas putida KT2440
cccccaucauucgauagccugc

SEQ ID NO: 3591091 - RNA, 18 nt, Pseudomonas putida KT2440
cccccaugcucaccagcu

SEQ ID NO: 3591092 - RNA, 12 nt, Pseudomonas putida KT2440
ccccccaccugg

SEQ ID NO: 3591093 - RNA, 13 nt, Pseudomonas putida KT2440
ccccccugcacca

SEQ ID NO: 3591094 - RNA, 13 nt, Pseudomonas putida KT2440
ccccccugccgcu

SEQ ID NO: 3591095 - RNA, 12 nt, Pseudomonas putida KT2440
ccccccuggccu

SEQ ID NO: 3591096 - RNA, 19 nt, Pseudomonas putida KT2440
cccccgaagcagccgccgc

SEQ ID NO: 3591097 - RNA, 21 nt, Pseudomonas putida KT2440
cccccgaucuauucgacccgc

SEQ ID NO: 3591098 - RNA, 12 nt, Pseudomonas putida KT2440
cccccgccagca

SEQ ID NO: 3591099 - RNA, 12 nt, Pseudomonas putida KT2440
cccccgccgaag

SEQ ID NO: 3591100 - RNA, 12 nt, Pseudomonas putida KT2440
cccccgcuccua

SEQ ID NO: 3591101 - RNA, 21 nt, Pseudomonas putida KT2440
cccccgcugcucgaggaagcu

SEQ ID NO: 3591102 - RNA, 17 nt, Pseudomonas putida KT2440
cccccggcccagccccg

SEQ ID NO: 3591103 - RNA, 13 nt, Pseudomonas putida KT2440
cccccggugccgg

SEQ ID NO: 3591104 - RNA, 13 nt, Pseudomonas putida KT2440
cccccguaggagc

SEQ ID NO: 3591105 - RNA, 16 nt, Pseudomonas putida KT2440
cccccguaggagcggg

SEQ ID NO: 3591106 - RNA, 13 nt, Pseudomonas putida KT2440
cccccgucagcgg

SEQ ID NO: 3591107 - RNA, 14 nt, Pseudomonas putida KT2440
cccccuccacccgg

SEQ ID NO: 3591108 - RNA, 20 nt, Pseudomonas putida KT2440
cccccuggccuggccaagcg

SEQ ID NO: 3591109 - RNA, 21 nt, Pseudomonas putida KT2440
cccccugguuuuccaccggca

SEQ ID NO: 3591110 - RNA, 19 nt, Pseudomonas putida KT2440
cccccuguagauaggcugu

SEQ ID NO: 3591111 - RNA, 14 nt, Pseudomonas putida KT2440
cccccuugccagca

SEQ ID NO: 3591112 - RNA, 22 nt, Pseudomonas putida KT2440
cccccuugccagcauggugcag

SEQ ID NO: 3591113 - RNA, 22 nt, Pseudomonas putida KT2440
cccccuuuggccuaccgcccgc

SEQ ID NO: 3591114 - RNA, 13 nt, Pseudomonas putida KT2440
ccccgaagcagcc

SEQ ID NO: 3591115 - RNA, 22 nt, Pseudomonas putida KT2440
ccccgaagcagccgccgccugu

SEQ ID NO: 3591116 - RNA, 21 nt, Pseudomonas putida KT2440
ccccgaccaaggccaacugcg

SEQ ID NO: 3591117 - RNA, 21 nt, Pseudomonas putida KT2440
ccccgacugacgcuacgccgc

SEQ ID NO: 3591118 - RNA, 14 nt, Pseudomonas putida KT2440
ccccgagcaaagcc

SEQ ID NO: 3591119 - RNA, 21 nt, Pseudomonas putida KT2440
ccccgagcaaagcccgcccca

SEQ ID NO: 3591120 - RNA, 22 nt, Pseudomonas putida KT2440
ccccgauacagcgcgccgccga

SEQ ID NO: 3591121 - RNA, 22 nt, Pseudomonas putida KT2440
ccccgaucuauucgacccgcgu

SEQ ID NO: 3591122 - RNA, 14 nt, Pseudomonas putida KT2440
ccccgcacaucacg

SEQ ID NO: 3591123 - RNA, 21 nt, Pseudomonas putida KT2440
ccccgcaggccgccgggguaa

SEQ ID NO: 3591124 - RNA, 13 nt, Pseudomonas putida KT2440
ccccgccaacaac

SEQ ID NO: 3591125 - RNA, 14 nt, Pseudomonas putida KT2440
ccccgccagugcaa

SEQ ID NO: 3591126 - RNA, 16 nt, Pseudomonas putida KT2440
ccccgcccaagcggca

SEQ ID NO: 3591127 - RNA, 13 nt, Pseudomonas putida KT2440
ccccgccccugcu

SEQ ID NO: 3591128 - RNA, 17 nt, Pseudomonas putida KT2440
ccccgccccugcuugac

SEQ ID NO: 3591129 - RNA, 12 nt, Pseudomonas putida KT2440
ccccgccgccag

SEQ ID NO: 3591130 - RNA, 13 nt, Pseudomonas putida KT2440
ccccgccgccccc

SEQ ID NO: 3591131 - RNA, 14 nt, Pseudomonas putida KT2440
ccccgccgcccccc

SEQ ID NO: 3591132 - RNA, 14 nt, Pseudomonas putida KT2440
ccccgcgccgccga

SEQ ID NO: 3591133 - RNA, 16 nt, Pseudomonas putida KT2440
ccccgcucgccuggcc

SEQ ID NO: 3591134 - RNA, 12 nt, Pseudomonas putida KT2440
ccccgcugcaca

SEQ ID NO: 3591135 - RNA, 13 nt, Pseudomonas putida KT2440
ccccggcaauaca

SEQ ID NO: 3591136 - RNA, 22 nt, Pseudomonas putida KT2440
ccccggcaauacaacgaucagc

SEQ ID NO: 3591137 - RNA, 16 nt, Pseudomonas putida KT2440
ccccggcagcgaugcc

SEQ ID NO: 3591138 - RNA, 16 nt, Pseudomonas putida KT2440
ccccggcaucgcugcc

SEQ ID NO: 3591139 - RNA, 17 nt, Pseudomonas putida KT2440
ccccggccaggccggcg

SEQ ID NO: 3591140 - RNA, 16 nt, Pseudomonas putida KT2440
ccccggccagugaagc

SEQ ID NO: 3591141 - RNA, 14 nt, Pseudomonas putida KT2440
ccccggcgccgcca

SEQ ID NO: 3591142 - RNA, 20 nt, Pseudomonas putida KT2440
ccccggcgccgccaggcagc

SEQ ID NO: 3591143 - RNA, 18 nt, Pseudomonas putida KT2440
ccccggggcgcuccagca

SEQ ID NO: 3591144 - RNA, 19 nt, Pseudomonas putida KT2440
ccccggguaaucagcuuga

SEQ ID NO: 3591145 - RNA, 13 nt, Pseudomonas putida KT2440
ccccgggugcagc

SEQ ID NO: 3591146 - RNA, 15 nt, Pseudomonas putida KT2440
ccccggucagcagga

SEQ ID NO: 3591147 - RNA, 16 nt, Pseudomonas putida KT2440
ccccggucagcaggaa

SEQ ID NO: 3591148 - RNA, 17 nt, Pseudomonas putida KT2440
ccccgguccagcacacu

SEQ ID NO: 3591149 - RNA, 19 nt, Pseudomonas putida KT2440
ccccggugcagguuggagc

SEQ ID NO: 3591150 - RNA, 14 nt, Pseudomonas putida KT2440
ccccggugcaucca

SEQ ID NO: 3591151 - RNA, 17 nt, Pseudomonas putida KT2440
ccccgguucucgcgaac

SEQ ID NO: 3591152 - RNA, 20 nt, Pseudomonas putida KT2440
ccccguaggagcgggcuugc

SEQ ID NO: 3591153 - RNA, 14 nt, Pseudomonas putida KT2440
ccccguccacagcg

SEQ ID NO: 3591154 - RNA, 15 nt, Pseudomonas putida KT2440
ccccguccagcccca

SEQ ID NO: 3591155 - RNA, 21 nt, Pseudomonas putida KT2440
ccccgucgaucacaugcggca

SEQ ID NO: 3591156 - RNA, 19 nt, Pseudomonas putida KT2440
ccccgucgccucaccucca

SEQ ID NO: 3591157 - RNA, 21 nt, Pseudomonas putida KT2440
ccccguguacgacugccgccc

SEQ ID NO: 3591158 - RNA, 22 nt, Pseudomonas putida KT2440
ccccguucgcccugcgccugca

SEQ ID NO: 3591159 - RNA, 13 nt, Pseudomonas putida KT2440
ccccguugcgcag

SEQ ID NO: 3591160 - RNA, 16 nt, Pseudomonas putida KT2440
ccccuagcgcauccug

SEQ ID NO: 3591161 - RNA, 11 nt, Pseudomonas putida KT2440
ccccuccaccc

SEQ ID NO: 3591162 - RNA, 16 nt, Pseudomonas putida KT2440
ccccuccacccaccuu

SEQ ID NO: 3591163 - RNA, 12 nt, Pseudomonas putida KT2440
cccgccccaaag

SEQ ID NO: 3591164 - RNA, 14 nt, Pseudomonas putida KT2440
cccgccccaauggc

SEQ ID NO: 3591165 - RNA, 20 nt, Pseudomonas putida KT2440
cccgccccucgucacugacc

SEQ ID NO: 3591166 - RNA, 16 nt, Pseudomonas putida KT2440
cccgccccugcuugac

SEQ ID NO: 3591167 - RNA, 21 nt, Pseudomonas putida KT2440
cccgcccgaagggcagggcga

SEQ ID NO: 3591168 - RNA, 14 nt, Pseudomonas putida KT2440
cccgcccgccaugc

SEQ ID NO: 3591169 - RNA, 13 nt, Pseudomonas putida KT2440
cccgcccgggcuu

SEQ ID NO: 3591170 - RNA, 15 nt, Pseudomonas putida KT2440
cccgcccuagcgguc

SEQ ID NO: 3591171 - RNA, 17 nt, Pseudomonas putida KT2440
cccgcccuccagccgcg

SEQ ID NO: 3591172 - RNA, 20 nt, Pseudomonas putida KT2440
cccgcccugagccaaggccg

SEQ ID NO: 3591173 - RNA, 23 nt, Pseudomonas putida KT2440
cccgccgaagccaugagcgagcu

SEQ ID NO: 3591174 - RNA, 14 nt, Pseudomonas putida KT2440
cccgccgccaccag

SEQ ID NO: 3591175 - RNA, 22 nt, Pseudomonas putida KT2440
cccgccgccaccagcgccgcca

SEQ ID NO: 3591176 - RNA, 12 nt, Pseudomonas putida KT2440
cccgccgccagc

SEQ ID NO: 3591177 - RNA, 21 nt, Pseudomonas putida KT2440
cccgccgccagcagcggguuc

SEQ ID NO: 3591178 - RNA, 14 nt, Pseudomonas putida KT2440
cccgccgcccccca

SEQ ID NO: 3591179 - RNA, 16 nt, Pseudomonas putida KT2440
cccgccgccccccagu

SEQ ID NO: 3591180 - RNA, 21 nt, Pseudomonas putida KT2440
cccgccgcuucgcggccaagc

SEQ ID NO: 3591181 - RNA, 17 nt, Pseudomonas putida KT2440
cccgccgguugcgcagc

SEQ ID NO: 3591182 - RNA, 19 nt, Pseudomonas putida KT2440
cccgccgguugcgcagccg

SEQ ID NO: 3591183 - RNA, 13 nt, Pseudomonas putida KT2440
cccgccgugcagu

SEQ ID NO: 3591184 - RNA, 22 nt, Pseudomonas putida KT2440
cccgccguguucccagcacccc

SEQ ID NO: 3591185 - RNA, 18 nt, Pseudomonas putida KT2440
cccgccuccugaagggcc

SEQ ID NO: 3591186 - RNA, 17 nt, Pseudomonas putida KT2440
cccgccugacgccgcca

SEQ ID NO: 3591187 - RNA, 19 nt, Pseudomonas putida KT2440
cccgccugacgccgccagc

SEQ ID NO: 3591188 - RNA, 12 nt, Pseudomonas putida KT2440
cccgccugcuca

SEQ ID NO: 3591189 - RNA, 14 nt, Pseudomonas putida KT2440
cccgccuggcgccu

SEQ ID NO: 3591190 - RNA, 16 nt, Pseudomonas putida KT2440
cccgccuggcgccugc

SEQ ID NO: 3591191 - RNA, 19 nt, Pseudomonas putida KT2440
cccgccuggcgccugcgcc

SEQ ID NO: 3591192 - RNA, 18 nt, Pseudomonas putida KT2440
cccgccugggggucgccc

SEQ ID NO: 3591193 - RNA, 18 nt, Pseudomonas putida KT2440
cccgccuggugccagcgg

SEQ ID NO: 3591194 - RNA, 14 nt, Pseudomonas putida KT2440
cccgcgaaagggcc

SEQ ID NO: 3591195 - RNA, 18 nt, Pseudomonas putida KT2440
cccgcgaaagggccagca

SEQ ID NO: 3591196 - RNA, 18 nt, Pseudomonas putida KT2440
cccgcgaaagggccagua

SEQ ID NO: 3591197 - RNA, 23 nt, Pseudomonas putida KT2440
cccgcgaaagggccggcccugcu

SEQ ID NO: 3591198 - RNA, 19 nt, Pseudomonas putida KT2440
cccgcgaaagggccgggcc

SEQ ID NO: 3591199 - RNA, 20 nt, Pseudomonas putida KT2440
cccgcgaaagggccgggccu

SEQ ID NO: 3591200 - RNA, 24 nt, Pseudomonas putida KT2440
cccgcgaacaaggcucagcugaug

SEQ ID NO: 3591201 - RNA, 15 nt, Pseudomonas putida KT2440
cccgcgaacaggccc

SEQ ID NO: 3591202 - RNA, 16 nt, Pseudomonas putida KT2440
cccgcgaacaggcccu

SEQ ID NO: 3591203 - RNA, 20 nt, Pseudomonas putida KT2440
cccgcgaagaagccaccgcg

SEQ ID NO: 3591204 - RNA, 22 nt, Pseudomonas putida KT2440
cccgcgaagaagccggcaucgc

SEQ ID NO: 3591205 - RNA, 23 nt, Pseudomonas putida KT2440
cccgcgaagaagccggcaucgcc

SEQ ID NO: 3591206 - RNA, 12 nt, Pseudomonas putida KT2440
cccgcgaagagg

SEQ ID NO: 3591207 - RNA, 14 nt, Pseudomonas putida KT2440
cccgcgaagaggcc

SEQ ID NO: 3591208 - RNA, 15 nt, Pseudomonas putida KT2440
cccgcgaagaggcca

SEQ ID NO: 3591209 - RNA, 20 nt, Pseudomonas putida KT2440
cccgcgaagaggccagcaca

SEQ ID NO: 3591210 - RNA, 23 nt, Pseudomonas putida KT2440
cccgcgaagaggccagcacaagc

SEQ ID NO: 3591211 - RNA, 20 nt, Pseudomonas putida KT2440
cccgcgaagaggccaggaca

SEQ ID NO: 3591212 - RNA, 20 nt, Pseudomonas putida KT2440
cccgcgaagaggccaguacc

SEQ ID NO: 3591213 - RNA, 23 nt, Pseudomonas putida KT2440
cccgcgaagaggccaguaccagc

SEQ ID NO: 3591214 - RNA, 17 nt, Pseudomonas putida KT2440
cccgcgaagaggccggc

SEQ ID NO: 3591215 - RNA, 18 nt, Pseudomonas putida KT2440
cccgcgaagaggccggca

SEQ ID NO: 3591216 - RNA, 22 nt, Pseudomonas putida KT2440
cccgcgaagaggccggcaaagc

SEQ ID NO: 3591217 - RNA, 19 nt, Pseudomonas putida KT2440
cccgcgaagaggccggcac

SEQ ID NO: 3591218 - RNA, 18 nt, Pseudomonas putida KT2440
cccgcgaagaggccggcc

SEQ ID NO: 3591219 - RNA, 19 nt, Pseudomonas putida KT2440
cccgcgaagaggccggccc

SEQ ID NO: 3591220 - RNA, 20 nt, Pseudomonas putida KT2440
cccgcgaagaggccggcccc

SEQ ID NO: 3591221 - RNA, 17 nt, Pseudomonas putida KT2440
cccgcgaagaggccggu

SEQ ID NO: 3591222 - RNA, 20 nt, Pseudomonas putida KT2440
cccgcgaagaggccgguaca

SEQ ID NO: 3591223 - RNA, 22 nt, Pseudomonas putida KT2440
cccgcgaagaggccgguacagc

SEQ ID NO: 3591224 - RNA, 23 nt, Pseudomonas putida KT2440
cccgcgaagaggccgguacagcc

SEQ ID NO: 3591225 - RNA, 23 nt, Pseudomonas putida KT2440
cccgcgaagaggccgguaggugc

SEQ ID NO: 3591226 - RNA, 17 nt, Pseudomonas putida KT2440
cccgcgaagcagccacc

SEQ ID NO: 3591227 - RNA, 22 nt, Pseudomonas putida KT2440
cccgcgaagcaggcgacgcagu

SEQ ID NO: 3591228 - RNA, 23 nt, Pseudomonas putida KT2440
cccgcgaagcguuuacugcugau

SEQ ID NO: 3591229 - RNA, 20 nt, Pseudomonas putida KT2440
cccgcgaaggcuccagcacc

SEQ ID NO: 3591230 - RNA, 20 nt, Pseudomonas putida KT2440
cccgcgaagggccgcaacgc

SEQ ID NO: 3591231 - RNA, 18 nt, Pseudomonas putida KT2440
cccgcgaagggccgccaa

SEQ ID NO: 3591232 - RNA, 15 nt, Pseudomonas putida KT2440
cccgcgaagggcugc

SEQ ID NO: 3591233 - RNA, 17 nt, Pseudomonas putida KT2440
cccgcgaagggcugccg

SEQ ID NO: 3591234 - RNA, 22 nt, Pseudomonas putida KT2440
cccgcgaagggcugccgcgcag

SEQ ID NO: 3591235 - RNA, 20 nt, Pseudomonas putida KT2440
cccgcgaaggggccggcccu

SEQ ID NO: 3591236 - RNA, 22 nt, Pseudomonas putida KT2440
cccgcgaauacgagggugaacc

SEQ ID NO: 3591237 - RNA, 22 nt, Pseudomonas putida KT2440
cccgcgaauacgguagcggcag

SEQ ID NO: 3591238 - RNA, 16 nt, Pseudomonas putida KT2440
cccgcgaauacggucg

SEQ ID NO: 3591239 - RNA, 22 nt, Pseudomonas putida KT2440
cccgcgaaugcuccggcgacag

SEQ ID NO: 3591240 - RNA, 18 nt, Pseudomonas putida KT2440
cccgcgaaugggccgcag

SEQ ID NO: 3591241 - RNA, 18 nt, Pseudomonas putida KT2440
cccgcgaaugggccgcca

SEQ ID NO: 3591242 - RNA, 16 nt, Pseudomonas putida KT2440
cccgcgaaugggcugc

SEQ ID NO: 3591243 - RNA, 22 nt, Pseudomonas putida KT2440
cccgcgaaugggcugcaaagca

SEQ ID NO: 3591244 - RNA, 14 nt, Pseudomonas putida KT2440
cccgcgaguccucc

SEQ ID NO: 3591245 - RNA, 20 nt, Pseudomonas putida KT2440
cccgcgaguccuccaacucg

SEQ ID NO: 3591246 - RNA, 12 nt, Pseudomonas putida KT2440
cccgcgaugccg

SEQ ID NO: 3591247 - RNA, 16 nt, Pseudomonas putida KT2440
cccgcgaugccgacag

SEQ ID NO: 3591248 - RNA, 21 nt, Pseudomonas putida KT2440
cccgcgaugccgacagccacc

SEQ ID NO: 3591249 - RNA, 18 nt, Pseudomonas putida KT2440
cccgcgcauccuccgccc

SEQ ID NO: 3591250 - RNA, 15 nt, Pseudomonas putida KT2440
cccgcgcaugaucag

SEQ ID NO: 3591251 - RNA, 14 nt, Pseudomonas putida KT2440
cccgcgcaugcugc

SEQ ID NO: 3591252 - RNA, 14 nt, Pseudomonas putida KT2440
cccgcgccaccagc

SEQ ID NO: 3591253 - RNA, 17 nt, Pseudomonas putida KT2440
cccgcgccgacagccuc

SEQ ID NO: 3591254 - RNA, 15 nt, Pseudomonas putida KT2440
cccgcgccgcccagc

SEQ ID NO: 3591255 - RNA, 12 nt, Pseudomonas putida KT2440
cccgcgccgccg

SEQ ID NO: 3591256 - RNA, 19 nt, Pseudomonas putida KT2440
cccgcgccuacaggcaacc

SEQ ID NO: 3591257 - RNA, 20 nt, Pseudomonas putida KT2440
cccgcgccuacgacggccug

SEQ ID NO: 3591258 - RNA, 12 nt, Pseudomonas putida KT2440
cccgcgccugca

SEQ ID NO: 3591259 - RNA, 13 nt, Pseudomonas putida KT2440
cccgcgcggcgca

SEQ ID NO: 3591260 - RNA, 14 nt, Pseudomonas putida KT2440
cccgcgcugccucg

SEQ ID NO: 3591261 - RNA, 23 nt, Pseudomonas putida KT2440
cccgcggaucgcgccuucgcugg

SEQ ID NO: 3591262 - RNA, 19 nt, Pseudomonas putida KT2440
cccgcggcucacccaccag

SEQ ID NO: 3591263 - RNA, 21 nt, Pseudomonas putida KT2440
cccgcggcucacccaccagcc

SEQ ID NO: 3591264 - RNA, 13 nt, Pseudomonas putida KT2440
cccgcgguaaugc

SEQ ID NO: 3591265 - RNA, 18 nt, Pseudomonas putida KT2440
cccgcggucuggcacaga

SEQ ID NO: 3591266 - RNA, 19 nt, Pseudomonas putida KT2440
cccgcggucuggcacagaa

SEQ ID NO: 3591267 - RNA, 20 nt, Pseudomonas putida KT2440
cccggcccuuucgcggguaa

SEQ ID NO: 3591268 - RNA, 21 nt, Pseudomonas putida KT2440
cccggccgacacaccaauggc

SEQ ID NO: 3591269 - RNA, 18 nt, Pseudomonas putida KT2440
cccggccgcuugcaaccg

SEQ ID NO: 3591270 - RNA, 15 nt, Pseudomonas putida KT2440
cccggccucggccgg

SEQ ID NO: 3591271 - RNA, 13 nt, Pseudomonas putida KT2440
cccggccuggcgc

SEQ ID NO: 3591272 - RNA, 14 nt, Pseudomonas putida KT2440
cccggccuggcgca

SEQ ID NO: 3591273 - RNA, 15 nt, Pseudomonas putida KT2440
cccggccuggcgcag

SEQ ID NO: 3591274 - RNA, 16 nt, Pseudomonas putida KT2440
cccggccuggcgcagg

SEQ ID NO: 3591275 - RNA, 21 nt, Pseudomonas putida KT2440
cccggccuuggccgcuggccc

SEQ ID NO: 3591276 - RNA, 17 nt, Pseudomonas putida KT2440
cccggccuuucgcgcca

SEQ ID NO: 3591277 - RNA, 19 nt, Pseudomonas putida KT2440
cccggccuuucgcgccagu

SEQ ID NO: 3591278 - RNA, 19 nt, Pseudomonas putida KT2440
cccggcgauacucaccgcc

SEQ ID NO: 3591279 - RNA, 14 nt, Pseudomonas putida KT2440
cccggcgcaaugcg

SEQ ID NO: 3591280 - RNA, 11 nt, Pseudomonas putida KT2440
cccggcgcagc

SEQ ID NO: 3591281 - RNA, 13 nt, Pseudomonas putida KT2440
cccggcgcagccg

SEQ ID NO: 3591282 - RNA, 15 nt, Pseudomonas putida KT2440
cccggcgccaugccc

SEQ ID NO: 3591283 - RNA, 17 nt, Pseudomonas putida KT2440
cccggcgccaugccccc

SEQ ID NO: 3591284 - RNA, 17 nt, Pseudomonas putida KT2440
cccggcgccgagccaua

SEQ ID NO: 3591285 - RNA, 16 nt, Pseudomonas putida KT2440
cccggcgccgccaggc

SEQ ID NO: 3591286 - RNA, 19 nt, Pseudomonas putida KT2440
cccggcgccgccaggcagc

SEQ ID NO: 3591287 - RNA, 13 nt, Pseudomonas putida KT2440
cccggcgccgccg

SEQ ID NO: 3591288 - RNA, 19 nt, Pseudomonas putida KT2440
cccggcgcgcgcgaccgcc

SEQ ID NO: 3591289 - RNA, 14 nt, Pseudomonas putida KT2440
cccggcggccagca

SEQ ID NO: 3591290 - RNA, 16 nt, Pseudomonas putida KT2440
cccggcggccagcacg

SEQ ID NO: 3591291 - RNA, 15 nt, Pseudomonas putida KT2440
cccggcuaucucagg

SEQ ID NO: 3591292 - RNA, 20 nt, Pseudomonas putida KT2440
cccggcuaucucaggccagu

SEQ ID NO: 3591293 - RNA, 21 nt, Pseudomonas putida KT2440
cccggcuaucucaggccaguu

SEQ ID NO: 3591294 - RNA, 15 nt, Pseudomonas putida KT2440
cccggcucaccgcag

SEQ ID NO: 3591295 - RNA, 20 nt, Pseudomonas putida KT2440
cccggcuccacaccccaagc

SEQ ID NO: 3591296 - RNA, 17 nt, Pseudomonas putida KT2440
cccggcuccgcgcaagc

SEQ ID NO: 3591297 - RNA, 15 nt, Pseudomonas putida KT2440
cccggcugaaauggc

SEQ ID NO: 3591298 - RNA, 16 nt, Pseudomonas putida KT2440
cccggcuugcuccaag

SEQ ID NO: 3591299 - RNA, 19 nt, Pseudomonas putida KT2440
cccggcuuucucaagccug

SEQ ID NO: 3591300 - RNA, 16 nt, Pseudomonas putida KT2440
cccgggaaaagccugc

SEQ ID NO: 3591301 - RNA, 19 nt, Pseudomonas putida KT2440
cccgggaaaagccugccag

SEQ ID NO: 3591302 - RNA, 21 nt, Pseudomonas putida KT2440
cccgggaacggcugccguccc

SEQ ID NO: 3591303 - RNA, 17 nt, Pseudomonas putida KT2440
cccgggagggugaacga

SEQ ID NO: 3591304 - RNA, 21 nt, Pseudomonas putida KT2440
cccgggagggugaacgaucag

SEQ ID NO: 3591305 - RNA, 13 nt, Pseudomonas putida KT2440
cccgggcaaagca

SEQ ID NO: 3591306 - RNA, 17 nt, Pseudomonas putida KT2440
cccgggcaaagcaccau

SEQ ID NO: 3591307 - RNA, 14 nt, Pseudomonas putida KT2440
cccgggcagcgggc

SEQ ID NO: 3591308 - RNA, 16 nt, Pseudomonas putida KT2440
cccgggcagcgggcuc

SEQ ID NO: 3591309 - RNA, 21 nt, Pseudomonas putida KT2440
cccgggcagcgggcucgccca

SEQ ID NO: 3591310 - RNA, 15 nt, Pseudomonas putida KT2440
cccgggccagccacu

SEQ ID NO: 3591311 - RNA, 14 nt, Pseudomonas putida KT2440
cccgggccaggccc

SEQ ID NO: 3591312 - RNA, 22 nt, Pseudomonas putida KT2440
cccgggccuucaaccucacugg

SEQ ID NO: 3591313 - RNA, 14 nt, Pseudomonas putida KT2440
cccggggcgcucca

SEQ ID NO: 3591314 - RNA, 21 nt, Pseudomonas putida KT2440
cccggggugcagauccaggug

SEQ ID NO: 3591315 - RNA, 17 nt, Pseudomonas putida KT2440
cccggguaaucagcuug

SEQ ID NO: 3591316 - RNA, 14 nt, Pseudomonas putida KT2440
cccggguccaccuc

SEQ ID NO: 3591317 - RNA, 14 nt, Pseudomonas putida KT2440
cccgggugcagccg

SEQ ID NO: 3591318 - RNA, 15 nt, Pseudomonas putida KT2440
cccgguaccagcagg

SEQ ID NO: 3591319 - RNA, 17 nt, Pseudomonas putida KT2440
cccgguagaagcggucg

SEQ ID NO: 3591320 - RNA, 20 nt, Pseudomonas putida KT2440
cccggucaccucgcaaccau

SEQ ID NO: 3591321 - RNA, 16 nt, Pseudomonas putida KT2440
cccgguccagcacacu

SEQ ID NO: 3591322 - RNA, 13 nt, Pseudomonas putida KT2440
cccggucccgccc

SEQ ID NO: 3591323 - RNA, 15 nt, Pseudomonas putida KT2440
cccggucccgcugcc

SEQ ID NO: 3591324 - RNA, 13 nt, Pseudomonas putida KT2440
cccggugaaguca

SEQ ID NO: 3591325 - RNA, 17 nt, Pseudomonas putida KT2440
cccggugaagucaccga

SEQ ID NO: 3591326 - RNA, 20 nt, Pseudomonas putida KT2440
cccggugcaaggucaaacuc

SEQ ID NO: 3591327 - RNA, 21 nt, Pseudomonas putida KT2440
cccggugcauccaacgcugcc

SEQ ID NO: 3591328 - RNA, 19 nt, Pseudomonas putida KT2440
cccggugcccuugccgccc

SEQ ID NO: 3591329 - RNA, 21 nt, Pseudomonas putida KT2440
cccggugcccuugccgccccg

SEQ ID NO: 3591330 - RNA, 14 nt, Pseudomonas putida KT2440
cccgguggcgcggc

SEQ ID NO: 3591331 - RNA, 16 nt, Pseudomonas putida KT2440
cccgguggcgcggccg

SEQ ID NO: 3591332 - RNA, 18 nt, Pseudomonas putida KT2440
cccggugguacagacaau

SEQ ID NO: 3591333 - RNA, 15 nt, Pseudomonas putida KT2440
cccgguuggcgcuuc

SEQ ID NO: 3591334 - RNA, 21 nt, Pseudomonas putida KT2440
cccgguuggggacggcagccg

SEQ ID NO: 3591335 - RNA, 15 nt, Pseudomonas putida KT2440
cccguaggagcgggu

SEQ ID NO: 3591336 - RNA, 18 nt, Pseudomonas putida KT2440
cccguaggagcggguuua

SEQ ID NO: 3591337 - RNA, 20 nt, Pseudomonas putida KT2440
cccguauugguagccacgug

SEQ ID NO: 3591338 - RNA, 22 nt, Pseudomonas putida KT2440
cccgucagccgaaacgauacuc

SEQ ID NO: 3591339 - RNA, 15 nt, Pseudomonas putida KT2440
cccgucagcggcaac

SEQ ID NO: 3591340 - RNA, 21 nt, Pseudomonas putida KT2440
cccgucagugcucggcaacgg

SEQ ID NO: 3591341 - RNA, 22 nt, Pseudomonas putida KT2440
cccgucaucgauccccaguuca

SEQ ID NO: 3591342 - RNA, 13 nt, Pseudomonas putida KT2440
cccguccgccuug

SEQ ID NO: 3591343 - RNA, 17 nt, Pseudomonas putida KT2440
cccgucgagccgggucc

SEQ ID NO: 3591344 - RNA, 23 nt, Pseudomonas putida KT2440
cccgucgagccggguccacccgg

SEQ ID NO: 3591345 - RNA, 16 nt, Pseudomonas putida KT2440
cccgucgccucaccuc

SEQ ID NO: 3591346 - RNA, 12 nt, Pseudomonas putida KT2440
cccgucgcugcc

SEQ ID NO: 3591347 - RNA, 19 nt, Pseudomonas putida KT2440
cccgugaagcgcacuuggc

SEQ ID NO: 3591348 - RNA, 18 nt, Pseudomonas putida KT2440
cccgugcaucugcucccc

SEQ ID NO: 3591349 - RNA, 18 nt, Pseudomonas putida KT2440
cccgugcccgaucaccgc

SEQ ID NO: 3591350 - RNA, 15 nt, Pseudomonas putida KT2440
cccgugccugccugc

SEQ ID NO: 3591351 - RNA, 14 nt, Pseudomonas putida KT2440
cccguggcagcccc

SEQ ID NO: 3591352 - RNA, 15 nt, Pseudomonas putida KT2440
cccguggcagccccc

SEQ ID NO: 3591353 - RNA, 20 nt, Pseudomonas putida KT2440
cccguguacgacugccgccc

SEQ ID NO: 3591354 - RNA, 18 nt, Pseudomonas putida KT2440
cccguguucgcgggcaag

SEQ ID NO: 3591355 - RNA, 19 nt, Pseudomonas putida KT2440
cccguguucgcgggcaagc

SEQ ID NO: 3591356 - RNA, 19 nt, Pseudomonas putida KT2440
cccguuccuacgcaggcac

SEQ ID NO: 3591357 - RNA, 16 nt, Pseudomonas putida KT2440
cccguucgcccugcgc

SEQ ID NO: 3591358 - RNA, 21 nt, Pseudomonas putida KT2440
cccguugaggguggcaaugcu

SEQ ID NO: 3591359 - RNA, 16 nt, Pseudomonas putida KT2440
cccguugcgcagcagc

SEQ ID NO: 3591360 - RNA, 22 nt, Pseudomonas putida KT2440
cccguugcgcagcagcaggccc

SEQ ID NO: 3591361 - RNA, 17 nt, Pseudomonas putida KT2440
cccguugguguccuugu

SEQ ID NO: 3591362 - RNA, 14 nt, Pseudomonas putida KT2440
cccuacccccuccu

SEQ ID NO: 3591363 - RNA, 22 nt, Pseudomonas putida KT2440
cccuaccgccaacgaaucagcc

SEQ ID NO: 3591364 - RNA, 22 nt, Pseudomonas putida KT2440
cccuacgaacaaauccgcgccg

SEQ ID NO: 3591365 - RNA, 23 nt, Pseudomonas putida KT2440
cccuacgaacaaauccgcgccga

SEQ ID NO: 3591366 - RNA, 23 nt, Pseudomonas putida KT2440
cccuaugcgugaaacgcagcuuu

SEQ ID NO: 3591367 - RNA, 19 nt, Pseudomonas putida KT2440
cccucaacccucgcccaga

SEQ ID NO: 3591368 - RNA, 24 nt, Pseudomonas putida KT2440
cccucaaugcugccuccgccaagc

SEQ ID NO: 3591369 - RNA, 19 nt, Pseudomonas putida KT2440
cccucacgaugacccuucc

SEQ ID NO: 3591370 - RNA, 16 nt, Pseudomonas putida KT2440
cccucacgcgccaggu

SEQ ID NO: 3591371 - RNA, 19 nt, Pseudomonas putida KT2440
cccucacgcgccaggucgg

SEQ ID NO: 3591372 - RNA, 19 nt, Pseudomonas putida KT2440
cccugugggagcggccuug

SEQ ID NO: 3591373 - RNA, 22 nt, Pseudomonas putida KT2440
cccugugggagcggccuugugc

SEQ ID NO: 3591374 - RNA, 18 nt, Pseudomonas putida KT2440
cccugugggagcgggcau

SEQ ID NO: 3591375 - RNA, 18 nt, Pseudomonas putida KT2440
cccugugggagcgggcgu

SEQ ID NO: 3591376 - RNA, 21 nt, Pseudomonas putida KT2440
cccuguuucgcccaaauguua

SEQ ID NO: 3591377 - RNA, 23 nt, Pseudomonas putida KT2440
cccuguuucuucaaggccgccac

SEQ ID NO: 3591378 - RNA, 16 nt, Pseudomonas putida KT2440
cccuucacgcucaugc

SEQ ID NO: 3591379 - RNA, 13 nt, Pseudomonas putida KT2440
cccuucacggcuu

SEQ ID NO: 3591380 - RNA, 15 nt, Pseudomonas putida KT2440
cccuucacggcuuug

SEQ ID NO: 3591381 - RNA, 18 nt, Pseudomonas putida KT2440
cccuucauacagcgccuc

SEQ ID NO: 3591382 - RNA, 18 nt, Pseudomonas putida KT2440
cccuucaucgccgggucc

SEQ ID NO: 3591383 - RNA, 14 nt, Pseudomonas putida KT2440
cccuucaugcgccc

SEQ ID NO: 3591384 - RNA, 23 nt, Pseudomonas putida KT2440
cccuucaugcgcccuggcggcca

SEQ ID NO: 3591385 - RNA, 14 nt, Pseudomonas putida KT2440
cccuuccagcccgc

SEQ ID NO: 3591386 - RNA, 16 nt, Pseudomonas putida KT2440
cccuuccagcccgccu

SEQ ID NO: 3591387 - RNA, 12 nt, Pseudomonas putida KT2440
cccuuccagcuu

SEQ ID NO: 3591388 - RNA, 21 nt, Pseudomonas putida KT2440
cccuuccagcuucugcaacuc

SEQ ID NO: 3591389 - RNA, 17 nt, Pseudomonas putida KT2440
cccuuccaugccccuca

SEQ ID NO: 3591390 - RNA, 20 nt, Pseudomonas putida KT2440
cccuuccccaggccgcccac

SEQ ID NO: 3591391 - RNA, 23 nt, Pseudomonas putida KT2440
cccuuccccaggccgcccaccca

SEQ ID NO: 3591392 - RNA, 15 nt, Pseudomonas putida KT2440
cccuuccccccuggc

SEQ ID NO: 3591393 - RNA, 15 nt, Pseudomonas putida KT2440
cccuuccggcaacuu

SEQ ID NO: 3591394 - RNA, 23 nt, Pseudomonas putida KT2440
cccuuccugaguauucuccuucu

SEQ ID NO: 3591395 - RNA, 17 nt, Pseudomonas putida KT2440
cccuucgacgcucaagu

SEQ ID NO: 3591396 - RNA, 22 nt, Pseudomonas putida KT2440
cccuucgcaggcacgcccgcuc

SEQ ID NO: 3591397 - RNA, 22 nt, Pseudomonas putida KT2440
cccuucgccggcacgcccgcuc

SEQ ID NO: 3591398 - RNA, 22 nt, Pseudomonas putida KT2440
cccuucgcggaagauacccgcc

SEQ ID NO: 3591399 - RNA, 21 nt, Pseudomonas putida KT2440
cccuucgcggcaagcccgcuc

SEQ ID NO: 3591400 - RNA, 14 nt, Pseudomonas putida KT2440
cccuucgcgggcac

SEQ ID NO: 3591401 - RNA, 20 nt, Pseudomonas putida KT2440
cccuucgcgggcacgcccgc

SEQ ID NO: 3591402 - RNA, 22 nt, Pseudomonas putida KT2440
cccuucgcgggcacgcccgcuc

SEQ ID NO: 3591403 - RNA, 17 nt, Pseudomonas putida KT2440
cccuucgcggguaaacc

SEQ ID NO: 3591404 - RNA, 20 nt, Pseudomonas putida KT2440
cccuucgcggguaaacccgc

SEQ ID NO: 3591405 - RNA, 22 nt, Pseudomonas putida KT2440
cccuucggcaaucaccgccagg

SEQ ID NO: 3591406 - RNA, 23 nt, Pseudomonas putida KT2440
cccuucggcaaucaccgccaggu

SEQ ID NO: 3591407 - RNA, 23 nt, Pseudomonas putida KT2440
cccuugaugaucaggucggcggc

SEQ ID NO: 3591408 - RNA, 16 nt, Pseudomonas putida KT2440
cccuugccaccagugc

SEQ ID NO: 3591409 - RNA, 13 nt, Pseudomonas putida KT2440
cccuugccagcau

SEQ ID NO: 3591410 - RNA, 18 nt, Pseudomonas putida KT2440
cccuugcgggaacaccca

SEQ ID NO: 3591411 - RNA, 17 nt, Pseudomonas putida KT2440
cccuugcugcagcaggc

SEQ ID NO: 3591412 - RNA, 18 nt, Pseudomonas putida KT2440
cccuuggcagcgcugcaa

SEQ ID NO: 3591413 - RNA, 18 nt, Pseudomonas putida KT2440
cccuugggcucagccgcc

SEQ ID NO: 3591414 - RNA, 19 nt, Pseudomonas putida KT2440
cccuugucagccgccgcug

SEQ ID NO: 3591415 - RNA, 19 nt, Pseudomonas putida KT2440
cccuuucgcgacgcaaggc

SEQ ID NO: 3591416 - RNA, 12 nt, Pseudomonas putida KT2440
cccuuucgcggg

SEQ ID NO: 3591417 - RNA, 23 nt, Pseudomonas putida KT2440
cccuuucgcgggagacccguucc

SEQ ID NO: 3591418 - RNA, 21 nt, Pseudomonas putida KT2440
cccuuucgcggguaaacccgc

SEQ ID NO: 3591419 - RNA, 22 nt, Pseudomonas putida KT2440
cccuuucgcggguagacccgcu

SEQ ID NO: 3591420 - RNA, 16 nt, Pseudomonas putida KT2440
cccuuuuaucugguug

SEQ ID NO: 3591421 - RNA, 18 nt, Pseudomonas putida KT2440
cccuuuuucaccaggcgg

SEQ ID NO: 3591422 - RNA, 19 nt, Pseudomonas putida KT2440
cccuuuuucaccaggcggu

SEQ ID NO: 3591423 - RNA, 21 nt, Pseudomonas putida KT2440
cccuuuuuuuauucccggccu

SEQ ID NO: 3591424 - RNA, 21 nt, Pseudomonas putida KT2440
ccgaaaaaaucaugcgcuggc

SEQ ID NO: 3591425 - RNA, 17 nt, Pseudomonas putida KT2440
ccgaaaaagccuacacc

SEQ ID NO: 3591426 - RNA, 13 nt, Pseudomonas putida KT2440
ccgaaaaggccaa

SEQ ID NO: 3591427 - RNA, 13 nt, Pseudomonas putida KT2440
ccgaaaccaugca

SEQ ID NO: 3591428 - RNA, 18 nt, Pseudomonas putida KT2440
ccgaaaccaugcaggucg

SEQ ID NO: 3591429 - RNA, 21 nt, Pseudomonas putida KT2440
ccgaaaccgccagccaaccgc

SEQ ID NO: 3591430 - RNA, 21 nt, Pseudomonas putida KT2440
ccgaaacugcgcucaaccagc

SEQ ID NO: 3591431 - RNA, 23 nt, Pseudomonas putida KT2440
ccgaaaucagcaacgccaccagu

SEQ ID NO: 3591432 - RNA, 14 nt, Pseudomonas putida KT2440
ccgaacaaaacccu

SEQ ID NO: 3591433 - RNA, 12 nt, Pseudomonas putida KT2440
ccgaacaccgcc

SEQ ID NO: 3591434 - RNA, 19 nt, Pseudomonas putida KT2440
ccgaacagacaacaucaaa

SEQ ID NO: 3591435 - RNA, 19 nt, Pseudomonas putida KT2440
ccgaacccgcugccaccca

SEQ ID NO: 3591436 - RNA, 17 nt, Pseudomonas putida KT2440
ccgaacccgcuggcgau

SEQ ID NO: 3591437 - RNA, 22 nt, Pseudomonas putida KT2440
ccgaacgauucugccagcuccu

SEQ ID NO: 3591438 - RNA, 24 nt, Pseudomonas putida KT2440
ccgaacgauucugccagcuccugg

SEQ ID NO: 3591439 - RNA, 21 nt, Pseudomonas putida KT2440
ccgaacgcagcgccgccaacu

SEQ ID NO: 3591440 - RNA, 21 nt, Pseudomonas putida KT2440
ccgaacgcgguaagcaccacc

SEQ ID NO: 3591441 - RNA, 13 nt, Pseudomonas putida KT2440
ccgaacgggccac

SEQ ID NO: 3591442 - RNA, 19 nt, Pseudomonas putida KT2440
ccgaacgggccaccaaagg

SEQ ID NO: 3591443 - RNA, 17 nt, Pseudomonas putida KT2440
ccgaacuccccaccagg

SEQ ID NO: 3591444 - RNA, 16 nt, Pseudomonas putida KT2440
ccgaacucuggcaaca

SEQ ID NO: 3591445 - RNA, 15 nt, Pseudomonas putida KT2440
ccgaagcaccacugg

SEQ ID NO: 3591446 - RNA, 18 nt, Pseudomonas putida KT2440
ccgaagcagccgccgccu

SEQ ID NO: 3591447 - RNA, 17 nt, Pseudomonas putida KT2440
ccgaagcgcagguccag

SEQ ID NO: 3591448 - RNA, 16 nt, Pseudomonas putida KT2440
ccgaagcuaucgccag

SEQ ID NO: 3591449 - RNA, 22 nt, Pseudomonas putida KT2440
ccgaagcuaucgccagcaggcc

SEQ ID NO: 3591450 - RNA, 23 nt, Pseudomonas putida KT2440
ccgaagcuaucgccagcaggccg

SEQ ID NO: 3591451 - RNA, 16 nt, Pseudomonas putida KT2440
ccgaaggcgucacccg

SEQ ID NO: 3591452 - RNA, 16 nt, Pseudomonas putida KT2440
ccgaagggcagggcga

SEQ ID NO: 3591453 - RNA, 16 nt, Pseudomonas putida KT2440
ccgaagucauccaugg

SEQ ID NO: 3591454 - RNA, 11 nt, Pseudomonas putida KT2440
ccgaagugaug

SEQ ID NO: 3591455 - RNA, 14 nt, Pseudomonas putida KT2440
ccgaaguggcggcu

SEQ ID NO: 3591456 - RNA, 19 nt, Pseudomonas putida KT2440
ccgacaaagaagcgccgca

SEQ ID NO: 3591457 - RNA, 22 nt, Pseudomonas putida KT2440
ccgacaaagaagcgccgcaggu

SEQ ID NO: 3591458 - RNA, 16 nt, Pseudomonas putida KT2440
ccgacaacagcaugcu

SEQ ID NO: 3591459 - RNA, 14 nt, Pseudomonas putida KT2440
ccgacaacagcugc

SEQ ID NO: 3591460 - RNA, 16 nt, Pseudomonas putida KT2440
ccgacaacagcugcau

SEQ ID NO: 3591461 - RNA, 15 nt, Pseudomonas putida KT2440
ccgacaaugccagca

SEQ ID NO: 3591462 - RNA, 19 nt, Pseudomonas putida KT2440
ccgacacagucgucggcac

SEQ ID NO: 3591463 - RNA, 23 nt, Pseudomonas putida KT2440
ccgacacaugcaaacccuggccc

SEQ ID NO: 3591464 - RNA, 19 nt, Pseudomonas putida KT2440
ccgacacgcggcaauccgc

SEQ ID NO: 3591465 - RNA, 18 nt, Pseudomonas putida KT2440
ccgacacgggguguugcu

SEQ ID NO: 3591466 - RNA, 14 nt, Pseudomonas putida KT2440
ccgacagcaacgcg

SEQ ID NO: 3591467 - RNA, 21 nt, Pseudomonas putida KT2440
ccgacagccaccgcgagcugu

SEQ ID NO: 3591468 - RNA, 23 nt, Pseudomonas putida KT2440
ccgacagccucaaggccggcagc

SEQ ID NO: 3591469 - RNA, 12 nt, Pseudomonas putida KT2440
ccgacagcgcag

SEQ ID NO: 3591470 - RNA, 16 nt, Pseudomonas putida KT2440
ccgacagcgcagucac

SEQ ID NO: 3591471 - RNA, 22 nt, Pseudomonas putida KT2440
ccgacagcggcgaaggauggac

SEQ ID NO: 3591472 - RNA, 19 nt, Pseudomonas putida KT2440
ccgacagcuugcccagcug

SEQ ID NO: 3591473 - RNA, 22 nt, Pseudomonas putida KT2440
ccgacagcuugcccagcugcgg

SEQ ID NO: 3591474 - RNA, 15 nt, Pseudomonas putida KT2440
ccgacaggguuacca

SEQ ID NO: 3591475 - RNA, 22 nt, Pseudomonas putida KT2440
ccgacaguguugccggcgagcg

SEQ ID NO: 3591476 - RNA, 20 nt, Pseudomonas putida KT2440
ccgauguagucguccugccc

SEQ ID NO: 3591477 - RNA, 16 nt, Pseudomonas putida KT2440
ccgaugucggcgugca

SEQ ID NO: 3591478 - RNA, 19 nt, Pseudomonas putida KT2440
ccgaugucggcgugcacca

SEQ ID NO: 3591479 - RNA, 22 nt, Pseudomonas putida KT2440
ccgaugucggcgugcaccacgg

SEQ ID NO: 3591480 - RNA, 13 nt, Pseudomonas putida KT2440
ccgaugugugucc

SEQ ID NO: 3591481 - RNA, 17 nt, Pseudomonas putida KT2440
ccgauuacaagggccug

SEQ ID NO: 3591482 - RNA, 19 nt, Pseudomonas putida KT2440
ccgauuacaagggccugug

SEQ ID NO: 3591483 - RNA, 23 nt, Pseudomonas putida KT2440
ccgauuaucgagcuacagccccu

SEQ ID NO: 3591484 - RNA, 17 nt, Pseudomonas putida KT2440
ccgauuccaagguauca

SEQ ID NO: 3591485 - RNA, 19 nt, Pseudomonas putida KT2440
ccgauugccugggcgagcc

SEQ ID NO: 3591486 - RNA, 16 nt, Pseudomonas putida KT2440
ccgauugcgaguugau

SEQ ID NO: 3591487 - RNA, 15 nt, Pseudomonas putida KT2440
ccgauugcugccgac

SEQ ID NO: 3591488 - RNA, 13 nt, Pseudomonas putida KT2440
ccgauuuggcccg

SEQ ID NO: 3591489 - RNA, 16 nt, Pseudomonas putida KT2440
ccgcaaagcccugccu

SEQ ID NO: 3591490 - RNA, 13 nt, Pseudomonas putida KT2440
ccgcaaagcggcc

SEQ ID NO: 3591491 - RNA, 16 nt, Pseudomonas putida KT2440
ccgcaaagcggccccc

SEQ ID NO: 3591492 - RNA, 18 nt, Pseudomonas putida KT2440
ccgcaaagcggcccccag

SEQ ID NO: 3591493 - RNA, 19 nt, Pseudomonas putida KT2440
ccgcaaagcggccccuucg

SEQ ID NO: 3591494 - RNA, 15 nt, Pseudomonas putida KT2440
ccgcaaauucucgag

SEQ ID NO: 3591495 - RNA, 20 nt, Pseudomonas putida KT2440
ccgcaaauucucgagcugau

SEQ ID NO: 3591496 - RNA, 14 nt, Pseudomonas putida KT2440
ccgcaacaccagga

SEQ ID NO: 3591497 - RNA, 18 nt, Pseudomonas putida KT2440
ccgcaacaccugccgcag

SEQ ID NO: 3591498 - RNA, 17 nt, Pseudomonas putida KT2440
ccgcaacauaaggugca

SEQ ID NO: 3591499 - RNA, 23 nt, Pseudomonas putida KT2440
ccgcaacauaaggugcaaagcgc

SEQ ID NO: 3591500 - RNA, 14 nt, Pseudomonas putida KT2440
ccgcaacaugaagc

SEQ ID NO: 3591501 - RNA, 15 nt, Pseudomonas putida KT2440
ccgcaacccagcccc

SEQ ID NO: 3591502 - RNA, 15 nt, Pseudomonas putida KT2440
ccgcaaccgaugaac

SEQ ID NO: 3591503 - RNA, 16 nt, Pseudomonas putida KT2440
ccgcaacgcggccccg

SEQ ID NO: 3591504 - RNA, 15 nt, Pseudomonas putida KT2440
ccgcaacgcggcccu

SEQ ID NO: 3591505 - RNA, 17 nt, Pseudomonas putida KT2440
ccgcaacgcggcccugg

SEQ ID NO: 3591506 - RNA, 19 nt, Pseudomonas putida KT2440
ccgcaacgcggcccugggu

SEQ ID NO: 3591507 - RNA, 21 nt, Pseudomonas putida KT2440
ccgcaacuggcccgcgccagg

SEQ ID NO: 3591508 - RNA, 16 nt, Pseudomonas putida KT2440
ccgcaagcagucccag

SEQ ID NO: 3591509 - RNA, 18 nt, Pseudomonas putida KT2440
ccgcaagcagucccagca

SEQ ID NO: 3591510 - RNA, 23 nt, Pseudomonas putida KT2440
ccgcaagcagucccagcaccgcg

SEQ ID NO: 3591511 - RNA, 12 nt, Pseudomonas putida KT2440
ccgcaagcgccg

SEQ ID NO: 3591512 - RNA, 23 nt, Pseudomonas putida KT2440
ccgcaagcgccgaugcucgucag

SEQ ID NO: 3591513 - RNA, 12 nt, Pseudomonas putida KT2440
ccgcaagcggcu

SEQ ID NO: 3591514 - RNA, 17 nt, Pseudomonas putida KT2440
ccgcaagcgggcagugc

SEQ ID NO: 3591515 - RNA, 13 nt, Pseudomonas putida KT2440
ccgcaagcugcac

SEQ ID NO: 3591516 - RNA, 13 nt, Pseudomonas putida KT2440
ccgcaauggcgcc

SEQ ID NO: 3591517 - RNA, 18 nt, Pseudomonas putida KT2440
ccgcacaaggccgcuccc

SEQ ID NO: 3591518 - RNA, 13 nt, Pseudomonas putida KT2440
ccgcacaggcugg

SEQ ID NO: 3591519 - RNA, 14 nt, Pseudomonas putida KT2440
ccgcacaucacggc

SEQ ID NO: 3591520 - RNA, 16 nt, Pseudomonas putida KT2440
ccgcacaucacggcgc

SEQ ID NO: 3591521 - RNA, 17 nt, Pseudomonas putida KT2440
ccgcacaucacggcgca

SEQ ID NO: 3591522 - RNA, 23 nt, Pseudomonas putida KT2440
ccgcacaucacggcgcaggccga

SEQ ID NO: 3591523 - RNA, 14 nt, Pseudomonas putida KT2440
ccgcaccaaagaaa

SEQ ID NO: 3591524 - RNA, 15 nt, Pseudomonas putida KT2440
ccgcaccagaccagc

SEQ ID NO: 3591525 - RNA, 17 nt, Pseudomonas putida KT2440
ccgcaccagaccagcag

SEQ ID NO: 3591526 - RNA, 13 nt, Pseudomonas putida KT2440
ccgcacccagcag

SEQ ID NO: 3591527 - RNA, 15 nt, Pseudomonas putida KT2440
ccgcacccaggccac

SEQ ID NO: 3591528 - RNA, 15 nt, Pseudomonas putida KT2440
ccgcacccaggugcg

SEQ ID NO: 3591529 - RNA, 16 nt, Pseudomonas putida KT2440
ccgcacccgcaagcgc

SEQ ID NO: 3591530 - RNA, 17 nt, Pseudomonas putida KT2440
ccgcacccgcaagcgcc

SEQ ID NO: 3591531 - RNA, 21 nt, Pseudomonas putida KT2440
ccgcacccgcaagcgccgaug

SEQ ID NO: 3591532 - RNA, 14 nt, Pseudomonas putida KT2440
ccgcacccggcgga

SEQ ID NO: 3591533 - RNA, 20 nt, Pseudomonas putida KT2440
ccgcaccgcggaugcgccug

SEQ ID NO: 3591534 - RNA, 17 nt, Pseudomonas putida KT2440
ccgcaccuccuuggccg

SEQ ID NO: 3591535 - RNA, 13 nt, Pseudomonas putida KT2440
ccgcaccugcccg

SEQ ID NO: 3591536 - RNA, 17 nt, Pseudomonas putida KT2440
ccgcacgauccccggcc

SEQ ID NO: 3591537 - RNA, 20 nt, Pseudomonas putida KT2440
ccgcacguuauccacagcgu

SEQ ID NO: 3591538 - RNA, 21 nt, Pseudomonas putida KT2440
ccgcacuccccaucagcagcu

SEQ ID NO: 3591539 - RNA, 14 nt, Pseudomonas putida KT2440
ccgcacucugcugc

SEQ ID NO: 3591540 - RNA, 14 nt, Pseudomonas putida KT2440
ccgcacugcaaugc

SEQ ID NO: 3591541 - RNA, 17 nt, Pseudomonas putida KT2440
ccgcacugcugccgccc

SEQ ID NO: 3591542 - RNA, 15 nt, Pseudomonas putida KT2440
ccgcagacagcucga

SEQ ID NO: 3591543 - RNA, 15 nt, Pseudomonas putida KT2440
ccgcagagcggcccu

SEQ ID NO: 3591544 - RNA, 23 nt, Pseudomonas putida KT2440
ccgcagcaacaguuucuugccuu

SEQ ID NO: 3591545 - RNA, 16 nt, Pseudomonas putida KT2440
ccgcagcaaucugcug

SEQ ID NO: 3591546 - RNA, 17 nt, Pseudomonas putida KT2440
ccgcagcaaucugcugg

SEQ ID NO: 3591547 - RNA, 18 nt, Pseudomonas putida KT2440
ccgcagcccagcgccgcc

SEQ ID NO: 3591548 - RNA, 15 nt, Pseudomonas putida KT2440
ccgcagccccgccgc

SEQ ID NO: 3591549 - RNA, 14 nt, Pseudomonas putida KT2440
ccgcagcgcauggu

SEQ ID NO: 3591550 - RNA, 15 nt, Pseudomonas putida KT2440
ccgcagcgcuucgau

SEQ ID NO: 3591551 - RNA, 22 nt, Pseudomonas putida KT2440
ccgcagcgcuucgaucagcgcc

SEQ ID NO: 3591552 - RNA, 17 nt, Pseudomonas putida KT2440
ccgcagcugcggucgag

SEQ ID NO: 3591553 - RNA, 22 nt, Pseudomonas putida KT2440
ccgcaggaauaacuggcccgaa

SEQ ID NO: 3591554 - RNA, 23 nt, Pseudomonas putida KT2440
ccgcaggcccaaacauugugcgc

SEQ ID NO: 3591555 - RNA, 15 nt, Pseudomonas putida KT2440
ccgcaggccgcagcc

SEQ ID NO: 3591556 - RNA, 17 nt, Pseudomonas putida KT2440
ccgcaggccgcagccuc

SEQ ID NO: 3591557 - RNA, 17 nt, Pseudomonas putida KT2440
ccgcaggcgacgagcca

SEQ ID NO: 3591558 - RNA, 11 nt, Pseudomonas putida KT2440
ccgcaggcgcc

SEQ ID NO: 3591559 - RNA, 20 nt, Pseudomonas putida KT2440
ccgcaggcuaucgaggggca

SEQ ID NO: 3591560 - RNA, 17 nt, Pseudomonas putida KT2440
ccgcaggggcugcgcaa

SEQ ID NO: 3591561 - RNA, 22 nt, Pseudomonas putida KT2440
ccgcaguacuuauaagcagcaa

SEQ ID NO: 3591562 - RNA, 20 nt, Pseudomonas putida KT2440
ccgcagucccgccauauucg

SEQ ID NO: 3591563 - RNA, 19 nt, Pseudomonas putida KT2440
ccgcagugaaguugcggca

SEQ ID NO: 3591564 - RNA, 17 nt, Pseudomonas putida KT2440
ccgcauaaccaccaccg

SEQ ID NO: 3591565 - RNA, 21 nt, Pseudomonas putida KT2440
ccgcauacacaucggucggcc

SEQ ID NO: 3591566 - RNA, 16 nt, Pseudomonas putida KT2440
ccgcauauacgccggc

SEQ ID NO: 3591567 - RNA, 21 nt, Pseudomonas putida KT2440
ccgcauauacgccggcgucgg

SEQ ID NO: 3591568 - RNA, 21 nt, Pseudomonas putida KT2440
ccgcauaucauagaucucgac

SEQ ID NO: 3591569 - RNA, 18 nt, Pseudomonas putida KT2440
ccgcaucaaacgaugcgg

SEQ ID NO: 3591570 - RNA, 13 nt, Pseudomonas putida KT2440
ccgcauccagcac

SEQ ID NO: 3591571 - RNA, 14 nt, Pseudomonas putida KT2440
ccgcauccaugccg

SEQ ID NO: 3591572 - RNA, 15 nt, Pseudomonas putida KT2440
ccgcauccgcacccc

SEQ ID NO: 3591573 - RNA, 14 nt, Pseudomonas putida KT2440
ccgcauccugcgug

SEQ ID NO: 3591574 - RNA, 16 nt, Pseudomonas putida KT2440
ccgcauccugcgugcu

SEQ ID NO: 3591575 - RNA, 18 nt, Pseudomonas putida KT2440
ccgcaugcucgcugcugc

SEQ ID NO: 3591576 - RNA, 17 nt, Pseudomonas putida KT2440
ccgcaugcuuggcgaag

SEQ ID NO: 3591577 - RNA, 20 nt, Pseudomonas putida KT2440
ccgcauggcaaucgggccgg

SEQ ID NO: 3591578 - RNA, 21 nt, Pseudomonas putida KT2440
ccgcauuggguggccccggcc

SEQ ID NO: 3591579 - RNA, 21 nt, Pseudomonas putida KT2440
ccgccaaaaaauccgccuggc

SEQ ID NO: 3591580 - RNA, 23 nt, Pseudomonas putida KT2440
ccgccaaaaaauccgccuggccg

SEQ ID NO: 3591581 - RNA, 15 nt, Pseudomonas putida KT2440
ccgccaaaccccagc

SEQ ID NO: 3591582 - RNA, 19 nt, Pseudomonas putida KT2440
ccgcccuugagcuucagcg

SEQ ID NO: 3591583 - RNA, 17 nt, Pseudomonas putida KT2440
ccgccgaacaggccggc

SEQ ID NO: 3591584 - RNA, 21 nt, Pseudomonas putida KT2440
ccgccgaacaggccggcugca

SEQ ID NO: 3591585 - RNA, 17 nt, Pseudomonas putida KT2440
ccgccgaacauggugcu

SEQ ID NO: 3591586 - RNA, 19 nt, Pseudomonas putida KT2440
ccgccgaacucuggcaaca

SEQ ID NO: 3591587 - RNA, 23 nt, Pseudomonas putida KT2440
ccgccgaacucuggcaacagcuc

SEQ ID NO: 3591588 - RNA, 15 nt, Pseudomonas putida KT2440
ccgccgaagccauga

SEQ ID NO: 3591589 - RNA, 13 nt, Pseudomonas putida KT2440
ccgccgacgaugc

SEQ ID NO: 3591590 - RNA, 17 nt, Pseudomonas putida KT2440
ccgccgauagcagcacc

SEQ ID NO: 3591591 - RNA, 13 nt, Pseudomonas putida KT2440
ccgccgaugcgcu

SEQ ID NO: 3591592 - RNA, 18 nt, Pseudomonas putida KT2440
ccgccgauguagucgucc

SEQ ID NO: 3591593 - RNA, 23 nt, Pseudomonas putida KT2440
ccgccgauguagucguccugccc

SEQ ID NO: 3591594 - RNA, 18 nt, Pseudomonas putida KT2440
ccgccgcaaugucagcgg

SEQ ID NO: 3591595 - RNA, 17 nt, Pseudomonas putida KT2440
ccgccgccaccagcgcc

SEQ ID NO: 3591596 - RNA, 22 nt, Pseudomonas putida KT2440
ccgccgccagaccaccucaucc

SEQ ID NO: 3591597 - RNA, 15 nt, Pseudomonas putida KT2440
ccgccgccagggcaa

SEQ ID NO: 3591598 - RNA, 17 nt, Pseudomonas putida KT2440
ccgccgccugucgcgac

SEQ ID NO: 3591599 - RNA, 21 nt, Pseudomonas putida KT2440
ccgccgcugaccacgccgaag

SEQ ID NO: 3591600 - RNA, 14 nt, Pseudomonas putida KT2440
ccgccgcugcgagg

SEQ ID NO: 3591601 - RNA, 14 nt, Pseudomonas putida KT2440
ccgccgcugcugcg

SEQ ID NO: 3591602 - RNA, 12 nt, Pseudomonas putida KT2440
ccgccggcaacu

SEQ ID NO: 3591603 - RNA, 20 nt, Pseudomonas putida KT2440
ccgccggcaacuccuccagc

SEQ ID NO: 3591604 - RNA, 15 nt, Pseudomonas putida KT2440
ccgccggcacuuccu

SEQ ID NO: 3591605 - RNA, 18 nt, Pseudomonas putida KT2440
ccgccggcucgucacugc

SEQ ID NO: 3591606 - RNA, 21 nt, Pseudomonas putida KT2440
ccgccgguguaccauccagua

SEQ ID NO: 3591607 - RNA, 16 nt, Pseudomonas putida KT2440
ccgccgguugcgcagc

SEQ ID NO: 3591608 - RNA, 19 nt, Pseudomonas putida KT2440
ccgccgguugcgcagccgg

SEQ ID NO: 3591609 - RNA, 21 nt, Pseudomonas putida KT2440
ccgccgguuucucgcagcagc

SEQ ID NO: 3591610 - RNA, 22 nt, Pseudomonas putida KT2440
ccgccgguuucucgcagcagca

SEQ ID NO: 3591611 - RNA, 20 nt, Pseudomonas putida KT2440
ccgccguaccuucggcgaca

SEQ ID NO: 3591612 - RNA, 14 nt, Pseudomonas putida KT2440
ccgccgugcaguuc

SEQ ID NO: 3591613 - RNA, 16 nt, Pseudomonas putida KT2440
ccgccgugccggucac

SEQ ID NO: 3591614 - RNA, 19 nt, Pseudomonas putida KT2440
ccgccguguucccagcacc

SEQ ID NO: 3591615 - RNA, 19 nt, Pseudomonas putida KT2440
ccgccguucaggcgccugc

SEQ ID NO: 3591616 - RNA, 21 nt, Pseudomonas putida KT2440
ccgccguucaggcgccugccg

SEQ ID NO: 3591617 - RNA, 14 nt, Pseudomonas putida KT2440
ccgccucccaggac

SEQ ID NO: 3591618 - RNA, 20 nt, Pseudomonas putida KT2440
ccgccucccaggacuucagc

SEQ ID NO: 3591619 - RNA, 20 nt, Pseudomonas putida KT2440
ccgccuccggcgcuuugcgc

SEQ ID NO: 3591620 - RNA, 15 nt, Pseudomonas putida KT2440
ccgccuccugcugcu

SEQ ID NO: 3591621 - RNA, 14 nt, Pseudomonas putida KT2440
ccgccucgaccugg

SEQ ID NO: 3591622 - RNA, 15 nt, Pseudomonas putida KT2440
ccgccucgaccuggc

SEQ ID NO: 3591623 - RNA, 23 nt, Pseudomonas putida KT2440
ccgccucggcuacgccgccgcug

SEQ ID NO: 3591624 - RNA, 12 nt, Pseudomonas putida KT2440
ccgccucgguac

SEQ ID NO: 3591625 - RNA, 18 nt, Pseudomonas putida KT2440
ccgccugacgccgccagc

SEQ ID NO: 3591626 - RNA, 19 nt, Pseudomonas putida KT2440
ccgccugacgccgccagcg

SEQ ID NO: 3591627 - RNA, 23 nt, Pseudomonas putida KT2440
ccgccugacgccgccagcgcucc

SEQ ID NO: 3591628 - RNA, 14 nt, Pseudomonas putida KT2440
ccgccugcccgccc

SEQ ID NO: 3591629 - RNA, 13 nt, Pseudomonas putida KT2440
ccgccugccgccu

SEQ ID NO: 3591630 - RNA, 12 nt, Pseudomonas putida KT2440
ccgccugcgcac

SEQ ID NO: 3591631 - RNA, 15 nt, Pseudomonas putida KT2440
ccgccugcggcaccg

SEQ ID NO: 3591632 - RNA, 13 nt, Pseudomonas putida KT2440
ccgccugcuggcc

SEQ ID NO: 3591633 - RNA, 18 nt, Pseudomonas putida KT2440
ccgccuggccgcugcgcc

SEQ ID NO: 3591634 - RNA, 15 nt, Pseudomonas putida KT2440
ccgccuggcgccugc

SEQ ID NO: 3591635 - RNA, 16 nt, Pseudomonas putida KT2440
ccgccuggcgccugcg

SEQ ID NO: 3591636 - RNA, 14 nt, Pseudomonas putida KT2440
ccgccugggucagg

SEQ ID NO: 3591637 - RNA, 14 nt, Pseudomonas putida KT2440
ccgccuucgccaag

SEQ ID NO: 3591638 - RNA, 15 nt, Pseudomonas putida KT2440
ccgccuucuccagcu

SEQ ID NO: 3591639 - RNA, 16 nt, Pseudomonas putida KT2440
ccgccuugcggccccg

SEQ ID NO: 3591640 - RNA, 14 nt, Pseudomonas putida KT2440
ccgccuuggcagcc

SEQ ID NO: 3591641 - RNA, 16 nt, Pseudomonas putida KT2440
ccgcgaaacacagcag

SEQ ID NO: 3591642 - RNA, 19 nt, Pseudomonas putida KT2440
ccgcgaaacacagcaggcc

SEQ ID NO: 3591643 - RNA, 12 nt, Pseudomonas putida KT2440
ccgcgaaagggc

SEQ ID NO: 3591644 - RNA, 17 nt, Pseudomonas putida KT2440
ccgcgaacaaggcucag

SEQ ID NO: 3591645 - RNA, 20 nt, Pseudomonas putida KT2440
ccgcgaacaaggcucagcug

SEQ ID NO: 3591646 - RNA, 21 nt, Pseudomonas putida KT2440
ccgcgaacaccggcagagccg

SEQ ID NO: 3591647 - RNA, 19 nt, Pseudomonas putida KT2440
ccgcgaacacgggcgaagc

SEQ ID NO: 3591648 - RNA, 22 nt, Pseudomonas putida KT2440
ccgcgaagaagcuaacccgguc

SEQ ID NO: 3591649 - RNA, 17 nt, Pseudomonas putida KT2440
ccgcgaagaggccagca

SEQ ID NO: 3591650 - RNA, 21 nt, Pseudomonas putida KT2440
ccgcgaagaggccaguaccag

SEQ ID NO: 3591651 - RNA, 14 nt, Pseudomonas putida KT2440
ccgcgaagcagaca

SEQ ID NO: 3591652 - RNA, 18 nt, Pseudomonas putida KT2440
ccgcgaagcagacaacgc

SEQ ID NO: 3591653 - RNA, 16 nt, Pseudomonas putida KT2440
ccgcgaagcagccacc

SEQ ID NO: 3591654 - RNA, 19 nt, Pseudomonas putida KT2440
ccgcgaagcagccaccacg

SEQ ID NO: 3591655 - RNA, 15 nt, Pseudomonas putida KT2440
ccgcgaagcaggcga

SEQ ID NO: 3591656 - RNA, 18 nt, Pseudomonas putida KT2440
ccgcgaagcaggcgacgc

SEQ ID NO: 3591657 - RNA, 14 nt, Pseudomonas putida KT2440
ccgcgaagcaggcu

SEQ ID NO: 3591658 - RNA, 15 nt, Pseudomonas putida KT2440
ccgcgaagcaggcug

SEQ ID NO: 3591659 - RNA, 16 nt, Pseudomonas putida KT2440
ccgcgaagcaggcugc

SEQ ID NO: 3591660 - RNA, 14 nt, Pseudomonas putida KT2440
ccgcgaagcggccc

SEQ ID NO: 3591661 - RNA, 16 nt, Pseudomonas putida KT2440
ccgcgaaggcuccagc

SEQ ID NO: 3591662 - RNA, 23 nt, Pseudomonas putida KT2440
ccgcgaagggccgcaacgcggcc

SEQ ID NO: 3591663 - RNA, 15 nt, Pseudomonas putida KT2440
ccgcgaagggccgcc

SEQ ID NO: 3591664 - RNA, 18 nt, Pseudomonas putida KT2440
ccgcgaaggggccggcac

SEQ ID NO: 3591665 - RNA, 20 nt, Pseudomonas putida KT2440
ccgcgaauacgagggugaac

SEQ ID NO: 3591666 - RNA, 21 nt, Pseudomonas putida KT2440
ccgcgaauacgagggugaacc

SEQ ID NO: 3591667 - RNA, 23 nt, Pseudomonas putida KT2440
ccgcgaauacgguagcggcggca

SEQ ID NO: 3591668 - RNA, 19 nt, Pseudomonas putida KT2440
ccgcgaauacggucgcggc

SEQ ID NO: 3591669 - RNA, 22 nt, Pseudomonas putida KT2440
ccgcgaauacgguggcggcagc

SEQ ID NO: 3591670 - RNA, 18 nt, Pseudomonas putida KT2440
ccgcgaaucgccuucagc

SEQ ID NO: 3591671 - RNA, 17 nt, Pseudomonas putida KT2440
ccgcgaaucguccugga

SEQ ID NO: 3591672 - RNA, 18 nt, Pseudomonas putida KT2440
ccgcgaaugaucaugucc

SEQ ID NO: 3591673 - RNA, 23 nt, Pseudomonas putida KT2440
ccgcgaaugaucauguccuugcu

SEQ ID NO: 3591674 - RNA, 23 nt, Pseudomonas putida KT2440
ccgcgaaugcuccggcgacagcu

SEQ ID NO: 3591675 - RNA, 16 nt, Pseudomonas putida KT2440
ccgcgaaugggccgca

SEQ ID NO: 3591676 - RNA, 15 nt, Pseudomonas putida KT2440
ccgcgaaugggcugc

SEQ ID NO: 3591677 - RNA, 24 nt, Pseudomonas putida KT2440
ccgcgacgaaacccaguacggcgc

SEQ ID NO: 3591678 - RNA, 20 nt, Pseudomonas putida KT2440
ccgcgacgcggcccugggau

SEQ ID NO: 3591679 - RNA, 14 nt, Pseudomonas putida KT2440
ccgcgacucguccg

SEQ ID NO: 3591680 - RNA, 14 nt, Pseudomonas putida KT2440
ccgcgagggcauca

SEQ ID NO: 3591681 - RNA, 18 nt, Pseudomonas putida KT2440
ccgcgagggcaucagcgc

SEQ ID NO: 3591682 - RNA, 21 nt, Pseudomonas putida KT2440
ccgcgagggcaucagcgcacc

SEQ ID NO: 3591683 - RNA, 22 nt, Pseudomonas putida KT2440
ccgcgaguaaagccagcagccu

SEQ ID NO: 3591684 - RNA, 20 nt, Pseudomonas putida KT2440
ccgcgauagcucagucggua

SEQ ID NO: 3591685 - RNA, 16 nt, Pseudomonas putida KT2440
ccgcgauaucagcgcc

SEQ ID NO: 3591686 - RNA, 19 nt, Pseudomonas putida KT2440
ccgcgauaucagcgccagc

SEQ ID NO: 3591687 - RNA, 12 nt, Pseudomonas putida KT2440
ccgcucccaggu

SEQ ID NO: 3591688 - RNA, 13 nt, Pseudomonas putida KT2440
ccgcucccagguu

SEQ ID NO: 3591689 - RNA, 13 nt, Pseudomonas putida KT2440
ccgcucccgcccc

SEQ ID NO: 3591690 - RNA, 19 nt, Pseudomonas putida KT2440
ccgcuccuacaagguaccc

SEQ ID NO: 3591691 - RNA, 14 nt, Pseudomonas putida KT2440
ccgcuccuacacag

SEQ ID NO: 3591692 - RNA, 18 nt, Pseudomonas putida KT2440
ccgcuccuacacagguca

SEQ ID NO: 3591693 - RNA, 16 nt, Pseudomonas putida KT2440
ccgcuccuacacgcgg

SEQ ID NO: 3591694 - RNA, 20 nt, Pseudomonas putida KT2440
ccgcuccuacaggauggccg

SEQ ID NO: 3591695 - RNA, 22 nt, Pseudomonas putida KT2440
ccgcuccuacaggauggccgca

SEQ ID NO: 3591696 - RNA, 18 nt, Pseudomonas putida KT2440
ccgcuccuacaggcgacc

SEQ ID NO: 3591697 - RNA, 21 nt, Pseudomonas putida KT2440
ccgcuccuaccggggggcuca

SEQ ID NO: 3591698 - RNA, 19 nt, Pseudomonas putida KT2440
ccgcuccuacgacggccug

SEQ ID NO: 3591699 - RNA, 16 nt, Pseudomonas putida KT2440
ccgcuccuacgggcaa

SEQ ID NO: 3591700 - RNA, 19 nt, Pseudomonas putida KT2440
ccgcuccuacgggcaaccg

SEQ ID NO: 3591701 - RNA, 23 nt, Pseudomonas putida KT2440
ccgcuccuacgggcaaccgcauc

SEQ ID NO: 3591702 - RNA, 17 nt, Pseudomonas putida KT2440
ccgcuccucggccguaa

SEQ ID NO: 3591703 - RNA, 14 nt, Pseudomonas putida KT2440
ccgcuccugcgguc

SEQ ID NO: 3591704 - RNA, 16 nt, Pseudomonas putida KT2440
ccgcucgaacaagcgc

SEQ ID NO: 3591705 - RNA, 14 nt, Pseudomonas putida KT2440
ccgcucgccuggcc

SEQ ID NO: 3591706 - RNA, 15 nt, Pseudomonas putida KT2440
ccgcucgcgccgccg

SEQ ID NO: 3591707 - RNA, 14 nt, Pseudomonas putida KT2440
ccgcucgcugcgau

SEQ ID NO: 3591708 - RNA, 21 nt, Pseudomonas putida KT2440
ccgcucggccuugucuggcac

SEQ ID NO: 3591709 - RNA, 19 nt, Pseudomonas putida KT2440
ccgcucgguaucggccagc

SEQ ID NO: 3591710 - RNA, 17 nt, Pseudomonas putida KT2440
ccgcucguacgucgccu

SEQ ID NO: 3591711 - RNA, 20 nt, Pseudomonas putida KT2440
ccgcucguacgucgccuggu

SEQ ID NO: 3591712 - RNA, 14 nt, Pseudomonas putida KT2440
ccgcucucacaggg

SEQ ID NO: 3591713 - RNA, 17 nt, Pseudomonas putida KT2440
ccgcucucacagggacc

SEQ ID NO: 3591714 - RNA, 12 nt, Pseudomonas putida KT2440
ccgcucugcgcc

SEQ ID NO: 3591715 - RNA, 16 nt, Pseudomonas putida KT2440
ccgcugaacaacuccg

SEQ ID NO: 3591716 - RNA, 16 nt, Pseudomonas putida KT2440
ccgcugaaccucaccg

SEQ ID NO: 3591717 - RNA, 20 nt, Pseudomonas putida KT2440
ccgcugaaccucaccgccgg

SEQ ID NO: 3591718 - RNA, 19 nt, Pseudomonas putida KT2440
ccgcugacaaugcgacuga

SEQ ID NO: 3591719 - RNA, 15 nt, Pseudomonas putida KT2440
ccgcugaccacaaag

SEQ ID NO: 3591720 - RNA, 16 nt, Pseudomonas putida KT2440
ccgcugaccacaaagc

SEQ ID NO: 3591721 - RNA, 15 nt, Pseudomonas putida KT2440
ccgcugaccacgccg

SEQ ID NO: 3591722 - RNA, 16 nt, Pseudomonas putida KT2440
ccgcugauaaccugca

SEQ ID NO: 3591723 - RNA, 13 nt, Pseudomonas putida KT2440
ccgcugcacaggc

SEQ ID NO: 3591724 - RNA, 16 nt, Pseudomonas putida KT2440
ccgcugcacaggccag

SEQ ID NO: 3591725 - RNA, 22 nt, Pseudomonas putida KT2440
ccgcugcacaggccagccccag

SEQ ID NO: 3591726 - RNA, 16 nt, Pseudomonas putida KT2440
ccgcugcacgucgcgc

SEQ ID NO: 3591727 - RNA, 17 nt, Pseudomonas putida KT2440
ccgcugcauaggugucg

SEQ ID NO: 3591728 - RNA, 12 nt, Pseudomonas putida KT2440
ccgcugcauggc

SEQ ID NO: 3591729 - RNA, 23 nt, Pseudomonas putida KT2440
ccgcugccaaaguccggcgaagc

SEQ ID NO: 3591730 - RNA, 16 nt, Pseudomonas putida KT2440
ccgcugccacccacag

SEQ ID NO: 3591731 - RNA, 22 nt, Pseudomonas putida KT2440
ccgcugccaccuuccaggucga

SEQ ID NO: 3591732 - RNA, 19 nt, Pseudomonas putida KT2440
ccgcugccagcagggcagg

SEQ ID NO: 3591733 - RNA, 16 nt, Pseudomonas putida KT2440
ccgcugccagcugcgc

SEQ ID NO: 3591734 - RNA, 20 nt, Pseudomonas putida KT2440
ccgcugccauagcgcugcac

SEQ ID NO: 3591735 - RNA, 22 nt, Pseudomonas putida KT2440
ccgcugccauagcgcugcaccg

SEQ ID NO: 3591736 - RNA, 13 nt, Pseudomonas putida KT2440
ccgcugcccagcg

SEQ ID NO: 3591737 - RNA, 13 nt, Pseudomonas putida KT2440
ccgcugcccgucc

SEQ ID NO: 3591738 - RNA, 16 nt, Pseudomonas putida KT2440
ccgcugccgaucagca

SEQ ID NO: 3591739 - RNA, 17 nt, Pseudomonas putida KT2440
ccgcugccgaucagcac

SEQ ID NO: 3591740 - RNA, 22 nt, Pseudomonas putida KT2440
ccgcugccgggcaaagcggguc

SEQ ID NO: 3591741 - RNA, 14 nt, Pseudomonas putida KT2440
ccgcugccguagca

SEQ ID NO: 3591742 - RNA, 15 nt, Pseudomonas putida KT2440
ccgcugccugcgcuu

SEQ ID NO: 3591743 - RNA, 11 nt, Pseudomonas putida KT2440
ccgcugccugg

SEQ ID NO: 3591744 - RNA, 13 nt, Pseudomonas putida KT2440
ccgcugcgcacca

SEQ ID NO: 3591745 - RNA, 22 nt, Pseudomonas putida KT2440
ccgcugcgccugccgggccagg

SEQ ID NO: 3591746 - RNA, 20 nt, Pseudomonas putida KT2440
ccgcugcggaucaucuccau

SEQ ID NO: 3591747 - RNA, 21 nt, Pseudomonas putida KT2440
ccgcugcugcaguucuuccag

SEQ ID NO: 3591748 - RNA, 20 nt, Pseudomonas putida KT2440
ccgcugcuuccggcugguac

SEQ ID NO: 3591749 - RNA, 11 nt, Pseudomonas putida KT2440
ccgcuggaccu

SEQ ID NO: 3591750 - RNA, 18 nt, Pseudomonas putida KT2440
ccgcuggaccuggcuggc

SEQ ID NO: 3591751 - RNA, 20 nt, Pseudomonas putida KT2440
ccgcuggcauccaccagguc

SEQ ID NO: 3591752 - RNA, 17 nt, Pseudomonas putida KT2440
ccgcuggccgcacccag

SEQ ID NO: 3591753 - RNA, 19 nt, Pseudomonas putida KT2440
ccgcuggccgcacccagca

SEQ ID NO: 3591754 - RNA, 18 nt, Pseudomonas putida KT2440
ccgcuggcgaucaggcag

SEQ ID NO: 3591755 - RNA, 18 nt, Pseudomonas putida KT2440
ccgcuggcgccugcggca

SEQ ID NO: 3591756 - RNA, 13 nt, Pseudomonas putida KT2440
ccgcuggcuucaa

SEQ ID NO: 3591757 - RNA, 18 nt, Pseudomonas putida KT2440
ccgcugggcacccugauc

SEQ ID NO: 3591758 - RNA, 16 nt, Pseudomonas putida KT2440
ccgcugguggcguggc

SEQ ID NO: 3591759 - RNA, 17 nt, Pseudomonas putida KT2440
ccgcugguggcguggcu

SEQ ID NO: 3591760 - RNA, 21 nt, Pseudomonas putida KT2440
ccgcugguggcguggcugcgu

SEQ ID NO: 3591761 - RNA, 22 nt, Pseudomonas putida KT2440
ccgcugugcagcgcucgcugcc

SEQ ID NO: 3591762 - RNA, 12 nt, Pseudomonas putida KT2440
ccgcuguucagc

SEQ ID NO: 3591763 - RNA, 23 nt, Pseudomonas putida KT2440
ccgcuguucugcccggcuggaug

SEQ ID NO: 3591764 - RNA, 16 nt, Pseudomonas putida KT2440
ccgcuguugagcagca

SEQ ID NO: 3591765 - RNA, 20 nt, Pseudomonas putida KT2440
ccgcuguugagcagcagccc

SEQ ID NO: 3591766 - RNA, 21 nt, Pseudomonas putida KT2440
ccgcuucacccucgcgcagca

SEQ ID NO: 3591767 - RNA, 22 nt, Pseudomonas putida KT2440
ccgcuucacccucgcgcagcau

SEQ ID NO: 3591768 - RNA, 14 nt, Pseudomonas putida KT2440
ccgcuucaccgcgc

SEQ ID NO: 3591769 - RNA, 15 nt, Pseudomonas putida KT2440
ccgcuucaccgcgca

SEQ ID NO: 3591770 - RNA, 18 nt, Pseudomonas putida KT2440
ccgcuucgaccauuggac

SEQ ID NO: 3591771 - RNA, 14 nt, Pseudomonas putida KT2440
ccgcuucgccagcg

SEQ ID NO: 3591772 - RNA, 17 nt, Pseudomonas putida KT2440
ccgcuucgccagcgcca

SEQ ID NO: 3591773 - RNA, 13 nt, Pseudomonas putida KT2440
ccgcuucgcgacc

SEQ ID NO: 3591774 - RNA, 17 nt, Pseudomonas putida KT2440
ccgcuucggcaugcacg

SEQ ID NO: 3591775 - RNA, 23 nt, Pseudomonas putida KT2440
ccgcuucguccagguaguacggc

SEQ ID NO: 3591776 - RNA, 20 nt, Pseudomonas putida KT2440
ccgcuugacgaucgccagcc

SEQ ID NO: 3591777 - RNA, 22 nt, Pseudomonas putida KT2440
ccgcuugaucuuguccuggauc

SEQ ID NO: 3591778 - RNA, 22 nt, Pseudomonas putida KT2440
ccgcuugccuuccucggccaug

SEQ ID NO: 3591779 - RNA, 20 nt, Pseudomonas putida KT2440
ccgcuugcgcggucgaugca

SEQ ID NO: 3591780 - RNA, 15 nt, Pseudomonas putida KT2440
ccgcuugcucaggcu

SEQ ID NO: 3591781 - RNA, 12 nt, Pseudomonas putida KT2440
ccgcuugcugug

SEQ ID NO: 3591782 - RNA, 23 nt, Pseudomonas putida KT2440
ccgcuugcuguguuaccagucca

SEQ ID NO: 3591783 - RNA, 15 nt, Pseudomonas putida KT2440
ccgcuuggcggccca

SEQ ID NO: 3591784 - RNA, 14 nt, Pseudomonas putida KT2440
ccgcuuguagcuca

SEQ ID NO: 3591785 - RNA, 14 nt, Pseudomonas putida KT2440
ccgcuuucacuuca

SEQ ID NO: 3591786 - RNA, 14 nt, Pseudomonas putida KT2440
ccgcuuucagccga

SEQ ID NO: 3591787 - RNA, 20 nt, Pseudomonas putida KT2440
ccgcuuucggucagggcgau

SEQ ID NO: 3591788 - RNA, 16 nt, Pseudomonas putida KT2440
ccgcuuuggcagcagc

SEQ ID NO: 3591789 - RNA, 17 nt, Pseudomonas putida KT2440
ccgcuuuggcagcagcc

SEQ ID NO: 3591790 - RNA, 23 nt, Pseudomonas putida KT2440
ccgcuuuggcagcagccucggcc

SEQ ID NO: 3591791 - RNA, 18 nt, Pseudomonas putida KT2440
ccgcuuuuggcugugcac

SEQ ID NO: 3591792 - RNA, 14 nt, Pseudomonas putida KT2440
ccggccaagcgccg

SEQ ID NO: 3591793 - RNA, 20 nt, Pseudomonas putida KT2440
ccggccaaggucagcaagcc

SEQ ID NO: 3591794 - RNA, 20 nt, Pseudomonas putida KT2440
ccggccaaucgaucugcucg

SEQ ID NO: 3591795 - RNA, 22 nt, Pseudomonas putida KT2440
ccggccaaucgaucugcucgcc

SEQ ID NO: 3591796 - RNA, 12 nt, Pseudomonas putida KT2440
ccggccaccaca

SEQ ID NO: 3591797 - RNA, 12 nt, Pseudomonas putida KT2440
ccggccaccagg

SEQ ID NO: 3591798 - RNA, 15 nt, Pseudomonas putida KT2440
ccggccaccaggcgc

SEQ ID NO: 3591799 - RNA, 16 nt, Pseudomonas putida KT2440
ccggccaccaggcgcg

SEQ ID NO: 3591800 - RNA, 12 nt, Pseudomonas putida KT2440
ccggccagaccu

SEQ ID NO: 3591801 - RNA, 13 nt, Pseudomonas putida KT2440
ccggccagcaaca

SEQ ID NO: 3591802 - RNA, 13 nt, Pseudomonas putida KT2440
ccggccagcagga

SEQ ID NO: 3591803 - RNA, 14 nt, Pseudomonas putida KT2440
ccggccagcaggac

SEQ ID NO: 3591804 - RNA, 19 nt, Pseudomonas putida KT2440
ccggccagcaggucagcac

SEQ ID NO: 3591805 - RNA, 22 nt, Pseudomonas putida KT2440
ccggccagcgauaaaccagcag

SEQ ID NO: 3591806 - RNA, 11 nt, Pseudomonas putida KT2440
ccggccagcgc

SEQ ID NO: 3591807 - RNA, 13 nt, Pseudomonas putida KT2440
ccggccagcgccu

SEQ ID NO: 3591808 - RNA, 16 nt, Pseudomonas putida KT2440
ccggccagcgccugca

SEQ ID NO: 3591809 - RNA, 21 nt, Pseudomonas putida KT2440
ccggccagcgccugcaggccc

SEQ ID NO: 3591810 - RNA, 15 nt, Pseudomonas putida KT2440
ccggccagcggcaug

SEQ ID NO: 3591811 - RNA, 21 nt, Pseudomonas putida KT2440
ccggccagcugcgcaccggcu

SEQ ID NO: 3591812 - RNA, 14 nt, Pseudomonas putida KT2440
ccggccaggccggc

SEQ ID NO: 3591813 - RNA, 16 nt, Pseudomonas putida KT2440
ccggccaggccgugcu

SEQ ID NO: 3591814 - RNA, 20 nt, Pseudomonas putida KT2440
ccggccaggcucgacggcgc

SEQ ID NO: 3591815 - RNA, 13 nt, Pseudomonas putida KT2440
ccggccagggcug

SEQ ID NO: 3591816 - RNA, 14 nt, Pseudomonas putida KT2440
ccggcccaaggcac

SEQ ID NO: 3591817 - RNA, 13 nt, Pseudomonas putida KT2440
ccggcccagcccc

SEQ ID NO: 3591818 - RNA, 15 nt, Pseudomonas putida KT2440
ccggcccagccgcga

SEQ ID NO: 3591819 - RNA, 17 nt, Pseudomonas putida KT2440
ccggcccauucgcgggu

SEQ ID NO: 3591820 - RNA, 23 nt, Pseudomonas putida KT2440
ccggccccacgcaguuggccauc

SEQ ID NO: 3591821 - RNA, 17 nt, Pseudomonas putida KT2440
ccggccccccagccagc

SEQ ID NO: 3591822 - RNA, 13 nt, Pseudomonas putida KT2440
ccggccccggcaa

SEQ ID NO: 3591823 - RNA, 20 nt, Pseudomonas putida KT2440
ccggccccggugcauccaac

SEQ ID NO: 3591824 - RNA, 14 nt, Pseudomonas putida KT2440
ccggccccugcucg

SEQ ID NO: 3591825 - RNA, 15 nt, Pseudomonas putida KT2440
ccggcccggcuggcc

SEQ ID NO: 3591826 - RNA, 16 nt, Pseudomonas putida KT2440
ccggcccgguuggcgc

SEQ ID NO: 3591827 - RNA, 15 nt, Pseudomonas putida KT2440
ccggcccugaaggcc

SEQ ID NO: 3591828 - RNA, 17 nt, Pseudomonas putida KT2440
ccggcccugaaggccgc

SEQ ID NO: 3591829 - RNA, 15 nt, Pseudomonas putida KT2440
ccggcccugaucggu

SEQ ID NO: 3591830 - RNA, 14 nt, Pseudomonas putida KT2440
ccggcccugugccg

SEQ ID NO: 3591831 - RNA, 19 nt, Pseudomonas putida KT2440
ccggcccuucugcugcucg

SEQ ID NO: 3591832 - RNA, 18 nt, Pseudomonas putida KT2440
ccggcccuuucgcgggua

SEQ ID NO: 3591833 - RNA, 20 nt, Pseudomonas putida KT2440
ccggccgaagugauggccug

SEQ ID NO: 3591834 - RNA, 14 nt, Pseudomonas putida KT2440
ccggccgacccgcc

SEQ ID NO: 3591835 - RNA, 13 nt, Pseudomonas putida KT2440
ccggccgccagga

SEQ ID NO: 3591836 - RNA, 15 nt, Pseudomonas putida KT2440
ccggccgcgccaccg

SEQ ID NO: 3591837 - RNA, 22 nt, Pseudomonas putida KT2440
ccggccgcgguaaagaacauga

SEQ ID NO: 3591838 - RNA, 22 nt, Pseudomonas putida KT2440
ccggccgcucaccggccagcgc

SEQ ID NO: 3591839 - RNA, 12 nt, Pseudomonas putida KT2440
ccggccgcucca

SEQ ID NO: 3591840 - RNA, 14 nt, Pseudomonas putida KT2440
ccggccgcuccagc

SEQ ID NO: 3591841 - RNA, 15 nt, Pseudomonas putida KT2440
ccggccgcuccagcu

SEQ ID NO: 3591842 - RNA, 21 nt, Pseudomonas putida KT2440
ccggccgcuugcaaccgacgc

SEQ ID NO: 3591843 - RNA, 15 nt, Pseudomonas putida KT2440
ccggccggcucgcca

SEQ ID NO: 3591844 - RNA, 20 nt, Pseudomonas putida KT2440
ccggccggucguuacccacc

SEQ ID NO: 3591845 - RNA, 23 nt, Pseudomonas putida KT2440
ccggccguggguccugcgccagg

SEQ ID NO: 3591846 - RNA, 17 nt, Pseudomonas putida KT2440
ccggccuauucgcgggu

SEQ ID NO: 3591847 - RNA, 13 nt, Pseudomonas putida KT2440
ccggccucggccg

SEQ ID NO: 3591848 - RNA, 14 nt, Pseudomonas putida KT2440
ccggccucuucgcg

SEQ ID NO: 3591849 - RNA, 22 nt, Pseudomonas putida KT2440
ccggccucuucgcgggcaagcc

SEQ ID NO: 3591850 - RNA, 13 nt, Pseudomonas putida KT2440
ccggccuggcgca

SEQ ID NO: 3591851 - RNA, 22 nt, Pseudomonas putida KT2440
ccggccuguugcgcacugccgc

SEQ ID NO: 3591852 - RNA, 23 nt, Pseudomonas putida KT2440
ccggccuguugcgcacugccgcc

SEQ ID NO: 3591853 - RNA, 23 nt, Pseudomonas putida KT2440
ccggccuugaccucgaccaggcg

SEQ ID NO: 3591854 - RNA, 21 nt, Pseudomonas putida KT2440
ccggccuugccgcuggcgaug

SEQ ID NO: 3591855 - RNA, 16 nt, Pseudomonas putida KT2440
ccggccuugccguaga

SEQ ID NO: 3591856 - RNA, 15 nt, Pseudomonas putida KT2440
ccggccuugcuccag

SEQ ID NO: 3591857 - RNA, 17 nt, Pseudomonas putida KT2440
ccggccuugcuccaguu

SEQ ID NO: 3591858 - RNA, 16 nt, Pseudomonas putida KT2440
ccggccuuggccagcu

SEQ ID NO: 3591859 - RNA, 16 nt, Pseudomonas putida KT2440
ccggccuuggccgcug

SEQ ID NO: 3591860 - RNA, 19 nt, Pseudomonas putida KT2440
ccggccuuggccgcuggcc

SEQ ID NO: 3591861 - RNA, 21 nt, Pseudomonas putida KT2440
ccggccuuggcgcggcggaua

SEQ ID NO: 3591862 - RNA, 22 nt, Pseudomonas putida KT2440
ccggccuuggcgcggcggauaa

SEQ ID NO: 3591863 - RNA, 18 nt, Pseudomonas putida KT2440
ccggccuuuucauccggc

SEQ ID NO: 3591864 - RNA, 20 nt, Pseudomonas putida KT2440
ccggcgaaaugauccccggc

SEQ ID NO: 3591865 - RNA, 14 nt, Pseudomonas putida KT2440
ccggcgaacagcaa

SEQ ID NO: 3591866 - RNA, 14 nt, Pseudomonas putida KT2440
ccggcgaacagcac

SEQ ID NO: 3591867 - RNA, 17 nt, Pseudomonas putida KT2440
ccggcgaacagcacugc

SEQ ID NO: 3591868 - RNA, 19 nt, Pseudomonas putida KT2440
ccggcgaacagcacugcca

SEQ ID NO: 3591869 - RNA, 14 nt, Pseudomonas putida KT2440
ccggcgaauccagc

SEQ ID NO: 3591870 - RNA, 16 nt, Pseudomonas putida KT2440
ccggcgaauccagcag

SEQ ID NO: 3591871 - RNA, 15 nt, Pseudomonas putida KT2440
ccggcgacagcucaa

SEQ ID NO: 3591872 - RNA, 21 nt, Pseudomonas putida KT2440
ccggcgacagcucaagcccug

SEQ ID NO: 3591873 - RNA, 22 nt, Pseudomonas putida KT2440
ccggcgacagcucaagcccugc

SEQ ID NO: 3591874 - RNA, 22 nt, Pseudomonas putida KT2440
ccggcgacguucuugccggugg

SEQ ID NO: 3591875 - RNA, 16 nt, Pseudomonas putida KT2440
ccggcgauacucaccg

SEQ ID NO: 3591876 - RNA, 22 nt, Pseudomonas putida KT2440
ccggcgauacucaccgccgccc

SEQ ID NO: 3591877 - RNA, 21 nt, Pseudomonas putida KT2440
ccggcgauacuuggccaucag

SEQ ID NO: 3591878 - RNA, 14 nt, Pseudomonas putida KT2440
ccggcgcaagccgg

SEQ ID NO: 3591879 - RNA, 21 nt, Pseudomonas putida KT2440
ccggcgcacgcaugcgcgaca

SEQ ID NO: 3591880 - RNA, 14 nt, Pseudomonas putida KT2440
ccggcgcagauggu

SEQ ID NO: 3591881 - RNA, 14 nt, Pseudomonas putida KT2440
ccggcgcaggucga

SEQ ID NO: 3591882 - RNA, 18 nt, Pseudomonas putida KT2440
ccggcgcaucgacgggca

SEQ ID NO: 3591883 - RNA, 18 nt, Pseudomonas putida KT2440
ccggcgccaaacgccagg

SEQ ID NO: 3591884 - RNA, 21 nt, Pseudomonas putida KT2440
ccggcgccaaacgccagggcc

SEQ ID NO: 3591885 - RNA, 22 nt, Pseudomonas putida KT2440
ccggcgccaaacgccagggccg

SEQ ID NO: 3591886 - RNA, 14 nt, Pseudomonas putida KT2440
ccggcgccaugccc

SEQ ID NO: 3591887 - RNA, 17 nt, Pseudomonas putida KT2440
ccggcgccaugcccccc

SEQ ID NO: 3591888 - RNA, 14 nt, Pseudomonas putida KT2440
ccggcgccgccagg

SEQ ID NO: 3591889 - RNA, 17 nt, Pseudomonas putida KT2440
ccggcgccgccaggcag

SEQ ID NO: 3591890 - RNA, 12 nt, Pseudomonas putida KT2440
ccggcgccgccc

SEQ ID NO: 3591891 - RNA, 13 nt, Pseudomonas putida KT2440
ccggcgccgccga

SEQ ID NO: 3591892 - RNA, 13 nt, Pseudomonas putida KT2440
ccggcgccggugg

SEQ ID NO: 3591893 - RNA, 14 nt, Pseudomonas putida KT2440
ccggcgccuccagc

SEQ ID NO: 3591894 - RNA, 17 nt, Pseudomonas putida KT2440
ccggcgcgcgcgaccgc

SEQ ID NO: 3591895 - RNA, 15 nt, Pseudomonas putida KT2440
ccggcgcggccugcu

SEQ ID NO: 3591896 - RNA, 17 nt, Pseudomonas putida KT2440
ccggcgcggccugcucc

SEQ ID NO: 3591897 - RNA, 14 nt, Pseudomonas putida KT2440
ccggcgcugaucag

SEQ ID NO: 3591898 - RNA, 19 nt, Pseudomonas putida KT2440
ccgggcgggugcauggcuc

SEQ ID NO: 3591899 - RNA, 20 nt, Pseudomonas putida KT2440
ccgggcgggugcauggcucg

SEQ ID NO: 3591900 - RNA, 21 nt, Pseudomonas putida KT2440
ccgggcgguugucgaccuggc

SEQ ID NO: 3591901 - RNA, 21 nt, Pseudomonas putida KT2440
ccgggcugcaaagcgggcaac

SEQ ID NO: 3591902 - RNA, 22 nt, Pseudomonas putida KT2440
ccgggcugcugcgcagcccugu

SEQ ID NO: 3591903 - RNA, 12 nt, Pseudomonas putida KT2440
ccggggaaaggu

SEQ ID NO: 3591904 - RNA, 13 nt, Pseudomonas putida KT2440
ccggggcaccuug

SEQ ID NO: 3591905 - RNA, 12 nt, Pseudomonas putida KT2440
ccggggcagcau

SEQ ID NO: 3591906 - RNA, 18 nt, Pseudomonas putida KT2440
ccggggccgcaaggcggc

SEQ ID NO: 3591907 - RNA, 20 nt, Pseudomonas putida KT2440
ccggggguggcgagcagguc

SEQ ID NO: 3591908 - RNA, 21 nt, Pseudomonas putida KT2440
ccgggguagaccuucuggcag

SEQ ID NO: 3591909 - RNA, 16 nt, Pseudomonas putida KT2440
ccggggucaucaggac

SEQ ID NO: 3591910 - RNA, 23 nt, Pseudomonas putida KT2440
ccggguaaucgccaggcccagcc

SEQ ID NO: 3591911 - RNA, 15 nt, Pseudomonas putida KT2440
ccggguacagccccu

SEQ ID NO: 3591912 - RNA, 13 nt, Pseudomonas putida KT2440
ccggguaggcccc

SEQ ID NO: 3591913 - RNA, 16 nt, Pseudomonas putida KT2440
ccgggucaaggccagc

SEQ ID NO: 3591914 - RNA, 18 nt, Pseudomonas putida KT2440
ccgggucaaggccagcgc

SEQ ID NO: 3591915 - RNA, 20 nt, Pseudomonas putida KT2440
ccgggucaaggccagcgccu

SEQ ID NO: 3591916 - RNA, 12 nt, Pseudomonas putida KT2440
ccgggucagcuc

SEQ ID NO: 3591917 - RNA, 13 nt, Pseudomonas putida KT2440
ccgggucagcucg

SEQ ID NO: 3591918 - RNA, 15 nt, Pseudomonas putida KT2440
ccgggucaggccgau

SEQ ID NO: 3591919 - RNA, 13 nt, Pseudomonas putida KT2440
ccgggucauccgg

SEQ ID NO: 3591920 - RNA, 14 nt, Pseudomonas putida KT2440
ccggguccaccagc

SEQ ID NO: 3591921 - RNA, 22 nt, Pseudomonas putida KT2440
ccggguccaccagcccguccgc

SEQ ID NO: 3591922 - RNA, 16 nt, Pseudomonas putida KT2440
ccggguccacccggua

SEQ ID NO: 3591923 - RNA, 13 nt, Pseudomonas putida KT2440
ccggguccagcaa

SEQ ID NO: 3591924 - RNA, 18 nt, Pseudomonas putida KT2440
ccgggucgaccugggcca

SEQ ID NO: 3591925 - RNA, 14 nt, Pseudomonas putida KT2440
ccgggucgacgcgc

SEQ ID NO: 3591926 - RNA, 19 nt, Pseudomonas putida KT2440
ccgggucgauagccagccc

SEQ ID NO: 3591927 - RNA, 21 nt, Pseudomonas putida KT2440
ccgggucgcuugucgccaccc

SEQ ID NO: 3591928 - RNA, 13 nt, Pseudomonas putida KT2440
ccgggucggccug

SEQ ID NO: 3591929 - RNA, 16 nt, Pseudomonas putida KT2440
ccgggucggccugcuc

SEQ ID NO: 3591930 - RNA, 21 nt, Pseudomonas putida KT2440
ccgggucggccugcucgcugg

SEQ ID NO: 3591931 - RNA, 14 nt, Pseudomonas putida KT2440
ccgggucggcgcca

SEQ ID NO: 3591932 - RNA, 14 nt, Pseudomonas putida KT2440
ccgggugugagaac

SEQ ID NO: 3591933 - RNA, 20 nt, Pseudomonas putida KT2440
ccggguguugaauguugacg

SEQ ID NO: 3591934 - RNA, 20 nt, Pseudomonas putida KT2440
ccggguuacccaucugcucg

SEQ ID NO: 3591935 - RNA, 23 nt, Pseudomonas putida KT2440
ccggguuacccaucugcucgcca

SEQ ID NO: 3591936 - RNA, 17 nt, Pseudomonas putida KT2440
ccggguuccaccagggg

SEQ ID NO: 3591937 - RNA, 21 nt, Pseudomonas putida KT2440
ccggguugcucaggcgcucca

SEQ ID NO: 3591938 - RNA, 19 nt, Pseudomonas putida KT2440
ccgguaaaaccgcucgaac

SEQ ID NO: 3591939 - RNA, 18 nt, Pseudomonas putida KT2440
ccgguaacgggccagccg

SEQ ID NO: 3591940 - RNA, 14 nt, Pseudomonas putida KT2440
ccgguaacuggccc

SEQ ID NO: 3591941 - RNA, 20 nt, Pseudomonas putida KT2440
ccgguaacuggcccacccgg

SEQ ID NO: 3591942 - RNA, 16 nt, Pseudomonas putida KT2440
ccgguacagccagcaa

SEQ ID NO: 3591943 - RNA, 19 nt, Pseudomonas putida KT2440
ccgguacagccuaccaacg

SEQ ID NO: 3591944 - RNA, 21 nt, Pseudomonas putida KT2440
ccgguacagccuaccaacgca

SEQ ID NO: 3591945 - RNA, 14 nt, Pseudomonas putida KT2440
ccgguaccagcagg

SEQ ID NO: 3591946 - RNA, 13 nt, Pseudomonas putida KT2440
ccgguacggccaa

SEQ ID NO: 3591947 - RNA, 21 nt, Pseudomonas putida KT2440
ccgguacugcccauaaaagcc

SEQ ID NO: 3591948 - RNA, 15 nt, Pseudomonas putida KT2440
ccgguagcgcgccug

SEQ ID NO: 3591949 - RNA, 14 nt, Pseudomonas putida KT2440
ccgguaggacaaaa

SEQ ID NO: 3591950 - RNA, 23 nt, Pseudomonas putida KT2440
ccgguaggucuaaccgcgcuggu

SEQ ID NO: 3591951 - RNA, 16 nt, Pseudomonas putida KT2440
ccgguaggugcucaag

SEQ ID NO: 3591952 - RNA, 21 nt, Pseudomonas putida KT2440
ccgguagugaugcaucagcuc

SEQ ID NO: 3591953 - RNA, 15 nt, Pseudomonas putida KT2440
ccgguauagcgacag

SEQ ID NO: 3591954 - RNA, 17 nt, Pseudomonas putida KT2440
ccgguaucacccaguaa

SEQ ID NO: 3591955 - RNA, 23 nt, Pseudomonas putida KT2440
ccgguaucgaugcacagcucgcg

SEQ ID NO: 3591956 - RNA, 13 nt, Pseudomonas putida KT2440
ccgguaugcccau

SEQ ID NO: 3591957 - RNA, 14 nt, Pseudomonas putida KT2440
ccggucacccccau

SEQ ID NO: 3591958 - RNA, 23 nt, Pseudomonas putida KT2440
ccggucacccccaucagcgggcg

SEQ ID NO: 3591959 - RNA, 14 nt, Pseudomonas putida KT2440
ccggucaccgacca

SEQ ID NO: 3591960 - RNA, 14 nt, Pseudomonas putida KT2440
ccggucacugcgcg

SEQ ID NO: 3591961 - RNA, 13 nt, Pseudomonas putida KT2440
ccggucagcagga

SEQ ID NO: 3591962 - RNA, 16 nt, Pseudomonas putida KT2440
ccggucagcauggcca

SEQ ID NO: 3591963 - RNA, 13 nt, Pseudomonas putida KT2440
ccggucagcccgg

SEQ ID NO: 3591964 - RNA, 12 nt, Pseudomonas putida KT2440
ccggucagggug

SEQ ID NO: 3591965 - RNA, 15 nt, Pseudomonas putida KT2440
ccggucauccagcag

SEQ ID NO: 3591966 - RNA, 18 nt, Pseudomonas putida KT2440
ccggucauccagcagcuc

SEQ ID NO: 3591967 - RNA, 20 nt, Pseudomonas putida KT2440
ccggucauggcgcgccaugc

SEQ ID NO: 3591968 - RNA, 16 nt, Pseudomonas putida KT2440
ccggucccgcccggcc

SEQ ID NO: 3591969 - RNA, 14 nt, Pseudomonas putida KT2440
ccggucgccgacgg

SEQ ID NO: 3591970 - RNA, 21 nt, Pseudomonas putida KT2440
ccggucgccgacggcauggcc

SEQ ID NO: 3591971 - RNA, 12 nt, Pseudomonas putida KT2440
ccggucgcucaa

SEQ ID NO: 3591972 - RNA, 18 nt, Pseudomonas putida KT2440
ccggucgggcaaggccag

SEQ ID NO: 3591973 - RNA, 23 nt, Pseudomonas putida KT2440
ccggucgggcaaggccagugccg

SEQ ID NO: 3591974 - RNA, 21 nt, Pseudomonas putida KT2440
ccggucguacacucaccgcgc

SEQ ID NO: 3591975 - RNA, 20 nt, Pseudomonas putida KT2440
ccggucguuacccaccagcu

SEQ ID NO: 3591976 - RNA, 16 nt, Pseudomonas putida KT2440
ccggucucccagcgcu

SEQ ID NO: 3591977 - RNA, 20 nt, Pseudomonas putida KT2440
ccggucuugucugacagcag

SEQ ID NO: 3591978 - RNA, 22 nt, Pseudomonas putida KT2440
ccggucuugucugacagcagga

SEQ ID NO: 3591979 - RNA, 19 nt, Pseudomonas putida KT2440
ccggugcaacugccacgcc

SEQ ID NO: 3591980 - RNA, 20 nt, Pseudomonas putida KT2440
ccggugcaacugccacgccc

SEQ ID NO: 3591981 - RNA, 19 nt, Pseudomonas putida KT2440
ccggugcaagccaauggua

SEQ ID NO: 3591982 - RNA, 18 nt, Pseudomonas putida KT2440
ccggugcauccaacgcug

SEQ ID NO: 3591983 - RNA, 22 nt, Pseudomonas putida KT2440
ccggugccauccaccgcgccag

SEQ ID NO: 3591984 - RNA, 19 nt, Pseudomonas putida KT2440
ccggugccccgguccagca

SEQ ID NO: 3591985 - RNA, 15 nt, Pseudomonas putida KT2440
ccggugccgcgccau

SEQ ID NO: 3591986 - RNA, 19 nt, Pseudomonas putida KT2440
ccggugccgcgccauugcc

SEQ ID NO: 3591987 - RNA, 15 nt, Pseudomonas putida KT2440
ccggugcgcgggcgu

SEQ ID NO: 3591988 - RNA, 23 nt, Pseudomonas putida KT2440
ccggugcguacucgaccacuguc

SEQ ID NO: 3591989 - RNA, 13 nt, Pseudomonas putida KT2440
ccggugcuggcug

SEQ ID NO: 3591990 - RNA, 19 nt, Pseudomonas putida KT2440
ccgguggcgcggccgggcu

SEQ ID NO: 3591991 - RNA, 18 nt, Pseudomonas putida KT2440
ccggugggcaacagcugc

SEQ ID NO: 3591992 - RNA, 18 nt, Pseudomonas putida KT2440
ccggugguaauuggccgg

SEQ ID NO: 3591993 - RNA, 21 nt, Pseudomonas putida KT2440
ccggugguaauuggccggcag

SEQ ID NO: 3591994 - RNA, 20 nt, Pseudomonas putida KT2440
ccgguguaccauccaguacc

SEQ ID NO: 3591995 - RNA, 18 nt, Pseudomonas putida KT2440
ccgguguaguugaccgac

SEQ ID NO: 3591996 - RNA, 19 nt, Pseudomonas putida KT2440
ccgguguccuggcgucgcc

SEQ ID NO: 3591997 - RNA, 16 nt, Pseudomonas putida KT2440
ccggugucuuccggca

SEQ ID NO: 3591998 - RNA, 13 nt, Pseudomonas putida KT2440
ccggugugcauuu

SEQ ID NO: 3591999 - RNA, 19 nt, Pseudomonas putida KT2440
ccggugugcauuuucggca

SEQ ID NO: 3592000 - RNA, 18 nt, Pseudomonas putida KT2440
ccgguguucgcgggcaug

SEQ ID NO: 3592001 - RNA, 20 nt, Pseudomonas putida KT2440
ccgguguuuccacagguacc

SEQ ID NO: 3592002 - RNA, 16 nt, Pseudomonas putida KT2440
ccgguuccagcgcacc

SEQ ID NO: 3592003 - RNA, 13 nt, Pseudomonas putida KT2440
ccguggcaacgcc

SEQ ID NO: 3592004 - RNA, 14 nt, Pseudomonas putida KT2440
ccguggcaaggccc

SEQ ID NO: 3592005 - RNA, 16 nt, Pseudomonas putida KT2440
ccguggcaaggcccgc

SEQ ID NO: 3592006 - RNA, 17 nt, Pseudomonas putida KT2440
ccguggcgaucccugua

SEQ ID NO: 3592007 - RNA, 17 nt, Pseudomonas putida KT2440
ccguggcguauugcugg

SEQ ID NO: 3592008 - RNA, 13 nt, Pseudomonas putida KT2440
ccguggcugggga

SEQ ID NO: 3592009 - RNA, 17 nt, Pseudomonas putida KT2440
ccguggguugaacaggu

SEQ ID NO: 3592010 - RNA, 12 nt, Pseudomonas putida KT2440
ccgugguacacg

SEQ ID NO: 3592011 - RNA, 21 nt, Pseudomonas putida KT2440
ccguggucgccuucacugcgc

SEQ ID NO: 3592012 - RNA, 22 nt, Pseudomonas putida KT2440
ccguggucgccuucacugcgcg

SEQ ID NO: 3592013 - RNA, 18 nt, Pseudomonas putida KT2440
ccguggucuccaacguca

SEQ ID NO: 3592014 - RNA, 19 nt, Pseudomonas putida KT2440
ccgugguucaucaccagcc

SEQ ID NO: 3592015 - RNA, 19 nt, Pseudomonas putida KT2440
ccguguaggagcggguuua

SEQ ID NO: 3592016 - RNA, 14 nt, Pseudomonas putida KT2440
ccguguucccagca

SEQ ID NO: 3592017 - RNA, 15 nt, Pseudomonas putida KT2440
ccguguucccagcac

SEQ ID NO: 3592018 - RNA, 17 nt, Pseudomonas putida KT2440
ccguguugcagcggguu

SEQ ID NO: 3592019 - RNA, 14 nt, Pseudomonas putida KT2440
ccguuaacacaggu

SEQ ID NO: 3592020 - RNA, 20 nt, Pseudomonas putida KT2440
ccguucaccguugccgccac

SEQ ID NO: 3592021 - RNA, 13 nt, Pseudomonas putida KT2440
ccguucaggcgcc

SEQ ID NO: 3592022 - RNA, 13 nt, Pseudomonas putida KT2440
ccguucaggucau

SEQ ID NO: 3592023 - RNA, 11 nt, Pseudomonas putida KT2440
ccguuccgcaa

SEQ ID NO: 3592024 - RNA, 21 nt, Pseudomonas putida KT2440
ccguucgcccugcgccugcag

SEQ ID NO: 3592025 - RNA, 14 nt, Pseudomonas putida KT2440
ccguucgcggucgg

SEQ ID NO: 3592026 - RNA, 17 nt, Pseudomonas putida KT2440
ccguucggcgcgcugcu

SEQ ID NO: 3592027 - RNA, 13 nt, Pseudomonas putida KT2440
ccguucggcguac

SEQ ID NO: 3592028 - RNA, 21 nt, Pseudomonas putida KT2440
ccguucuggccuuggcgugca

SEQ ID NO: 3592029 - RNA, 15 nt, Pseudomonas putida KT2440
ccguugaaagacugc

SEQ ID NO: 3592030 - RNA, 16 nt, Pseudomonas putida KT2440
ccguugaccagguuua

SEQ ID NO: 3592031 - RNA, 21 nt, Pseudomonas putida KT2440
ccguugaccagguuuaccggc

SEQ ID NO: 3592032 - RNA, 22 nt, Pseudomonas putida KT2440
ccguugaccagguuuaccggcc

SEQ ID NO: 3592033 - RNA, 20 nt, Pseudomonas putida KT2440
ccguugaggccgaacaccgc

SEQ ID NO: 3592034 - RNA, 18 nt, Pseudomonas putida KT2440
ccguugaggguggcaaug

SEQ ID NO: 3592035 - RNA, 21 nt, Pseudomonas putida KT2440
ccguugaggguggcaaugcuc

SEQ ID NO: 3592036 - RNA, 16 nt, Pseudomonas putida KT2440
ccguugaucagcgaca

SEQ ID NO: 3592037 - RNA, 14 nt, Pseudomonas putida KT2440
ccguugcgcagcag

SEQ ID NO: 3592038 - RNA, 15 nt, Pseudomonas putida KT2440
ccguugcgcagcagc

SEQ ID NO: 3592039 - RNA, 14 nt, Pseudomonas putida KT2440
ccguuggagcagcc

SEQ ID NO: 3592040 - RNA, 17 nt, Pseudomonas putida KT2440
ccguuggccaccaccag

SEQ ID NO: 3592041 - RNA, 13 nt, Pseudomonas putida KT2440
ccguuggccagca

SEQ ID NO: 3592042 - RNA, 14 nt, Pseudomonas putida KT2440
ccguuggcccgcca

SEQ ID NO: 3592043 - RNA, 23 nt, Pseudomonas putida KT2440
ccguugguaucgaucaggaaggc

SEQ ID NO: 3592044 - RNA, 16 nt, Pseudomonas putida KT2440
ccguuggucagcgacu

SEQ ID NO: 3592045 - RNA, 19 nt, Pseudomonas putida KT2440
ccguuggucagcgacugcc

SEQ ID NO: 3592046 - RNA, 14 nt, Pseudomonas putida KT2440
ccguugguguccuu

SEQ ID NO: 3592047 - RNA, 14 nt, Pseudomonas putida KT2440
ccguugucacgcgc

SEQ ID NO: 3592048 - RNA, 16 nt, Pseudomonas putida KT2440
ccguuuaccaaggcgg

SEQ ID NO: 3592049 - RNA, 23 nt, Pseudomonas putida KT2440
ccguuucauucaagaaugcccgg

SEQ ID NO: 3592050 - RNA, 19 nt, Pseudomonas putida KT2440
ccguuucauugccgugcuc

SEQ ID NO: 3592051 - RNA, 20 nt, Pseudomonas putida KT2440
ccguuugcuggccugcagcc

SEQ ID NO: 3592052 - RNA, 23 nt, Pseudomonas putida KT2440
ccuaacggggggcucagcccgcc

SEQ ID NO: 3592053 - RNA, 19 nt, Pseudomonas putida KT2440
ccuaagggcuagaugcugg

SEQ ID NO: 3592054 - RNA, 18 nt, Pseudomonas putida KT2440
ccuaagguugcuccugca

SEQ ID NO: 3592055 - RNA, 14 nt, Pseudomonas putida KT2440
ccuacaacggcugu

SEQ ID NO: 3592056 - RNA, 18 nt, Pseudomonas putida KT2440
ccuacaagggugaaguac

SEQ ID NO: 3592057 - RNA, 17 nt, Pseudomonas putida KT2440
ccuacacgacccaccau

SEQ ID NO: 3592058 - RNA, 12 nt, Pseudomonas putida KT2440
ccuacagcaacc

SEQ ID NO: 3592059 - RNA, 16 nt, Pseudomonas putida KT2440
ccuacagcaaccgcgu

SEQ ID NO: 3592060 - RNA, 21 nt, Pseudomonas putida KT2440
ccuacaggaaucugucagccu

SEQ ID NO: 3592061 - RNA, 12 nt, Pseudomonas putida KT2440
ccuacaggcaac

SEQ ID NO: 3592062 - RNA, 13 nt, Pseudomonas putida KT2440
ccuacaggcaacc

SEQ ID NO: 3592063 - RNA, 22 nt, Pseudomonas putida KT2440
ccuacaggggacgcauauccuu

SEQ ID NO: 3592064 - RNA, 17 nt, Pseudomonas putida KT2440
ccuacauggaucgcauu

SEQ ID NO: 3592065 - RNA, 15 nt, Pseudomonas putida KT2440
ccuaccaacgcagca

SEQ ID NO: 3592066 - RNA, 13 nt, Pseudomonas putida KT2440
ccuacccaggcaa

SEQ ID NO: 3592067 - RNA, 18 nt, Pseudomonas putida KT2440
ccuacccccuccuccagc

SEQ ID NO: 3592068 - RNA, 15 nt, Pseudomonas putida KT2440
ccuaccgcccgcgcu

SEQ ID NO: 3592069 - RNA, 17 nt, Pseudomonas putida KT2440
ccuacgacggccugcgc

SEQ ID NO: 3592070 - RNA, 16 nt, Pseudomonas putida KT2440
ccuacgcccccagccu

SEQ ID NO: 3592071 - RNA, 17 nt, Pseudomonas putida KT2440
ccuacgcccccagccuu

SEQ ID NO: 3592072 - RNA, 22 nt, Pseudomonas putida KT2440
ccuacgggcaaccgcauccccg

SEQ ID NO: 3592073 - RNA, 16 nt, Pseudomonas putida KT2440
ccuacgggggggcgca

SEQ ID NO: 3592074 - RNA, 22 nt, Pseudomonas putida KT2440
ccuacgggggggcgcagggugu

SEQ ID NO: 3592075 - RNA, 19 nt, Pseudomonas putida KT2440
ccuacggggguucacagcc

SEQ ID NO: 3592076 - RNA, 14 nt, Pseudomonas putida KT2440
ccuacugccgucuu

SEQ ID NO: 3592077 - RNA, 21 nt, Pseudomonas putida KT2440
ccuagauaagcgacaaaggcg

SEQ ID NO: 3592078 - RNA, 17 nt, Pseudomonas putida KT2440
ccuagcaaggccuccag

SEQ ID NO: 3592079 - RNA, 15 nt, Pseudomonas putida KT2440
ccuaucaguuucgcg

SEQ ID NO: 3592080 - RNA, 13 nt, Pseudomonas putida KT2440
ccuaugaaaccga

SEQ ID NO: 3592081 - RNA, 19 nt, Pseudomonas putida KT2440
ccuaugaaaccgagcgccg

SEQ ID NO: 3592082 - RNA, 18 nt, Pseudomonas putida KT2440
ccuauucgcggguaaacc

SEQ ID NO: 3592083 - RNA, 15 nt, Pseudomonas putida KT2440
ccuauuggcuaugcc

SEQ ID NO: 3592084 - RNA, 17 nt, Pseudomonas putida KT2440
ccucaaaggcagccucg

SEQ ID NO: 3592085 - RNA, 15 nt, Pseudomonas putida KT2440
ccucaacaagcugau

SEQ ID NO: 3592086 - RNA, 10 nt, Pseudomonas putida KT2440
ccucaacccu

SEQ ID NO: 3592087 - RNA, 15 nt, Pseudomonas putida KT2440
ccucaacccucgccc

SEQ ID NO: 3592088 - RNA, 16 nt, Pseudomonas putida KT2440
ccucaacccucgccca

SEQ ID NO: 3592089 - RNA, 14 nt, Pseudomonas putida KT2440
ccucaacgccuccc

SEQ ID NO: 3592090 - RNA, 19 nt, Pseudomonas putida KT2440
ccucaagccucgcgcaaca

SEQ ID NO: 3592091 - RNA, 15 nt, Pseudomonas putida KT2440
ccucaagcggccucg

SEQ ID NO: 3592092 - RNA, 19 nt, Pseudomonas putida KT2440
ccucaaggccggcagccag

SEQ ID NO: 3592093 - RNA, 23 nt, Pseudomonas putida KT2440
ccucaagggguacgaacgccagu

SEQ ID NO: 3592094 - RNA, 21 nt, Pseudomonas putida KT2440
ccucaagguaggggcagccag

SEQ ID NO: 3592095 - RNA, 13 nt, Pseudomonas putida KT2440
ccucacacagcau

SEQ ID NO: 3592096 - RNA, 17 nt, Pseudomonas putida KT2440
ccucacacugguaacuc

SEQ ID NO: 3592097 - RNA, 11 nt, Pseudomonas putida KT2440
ccucaccaacu

SEQ ID NO: 3592098 - RNA, 14 nt, Pseudomonas putida KT2440
ccucaccaacugcc

SEQ ID NO: 3592099 - RNA, 21 nt, Pseudomonas putida KT2440
ccucaccgacccacaggcaca

SEQ ID NO: 3592100 - RNA, 15 nt, Pseudomonas putida KT2440
ccucacggcagugca

SEQ ID NO: 3592101 - RNA, 14 nt, Pseudomonas putida KT2440
ccucacucaccgca

SEQ ID NO: 3592102 - RNA, 20 nt, Pseudomonas putida KT2440
ccucacucaccgcacaggca

SEQ ID NO: 3592103 - RNA, 15 nt, Pseudomonas putida KT2440
ccucagaagucgaag

SEQ ID NO: 3592104 - RNA, 14 nt, Pseudomonas putida KT2440
ccucagccaggcug

SEQ ID NO: 3592105 - RNA, 15 nt, Pseudomonas putida KT2440
ccucagccaggcuga

SEQ ID NO: 3592106 - RNA, 21 nt, Pseudomonas putida KT2440
ccucagcccaguaccacuucc

SEQ ID NO: 3592107 - RNA, 16 nt, Pseudomonas putida KT2440
ccucagcgcccgcugc

SEQ ID NO: 3592108 - RNA, 14 nt, Pseudomonas putida KT2440
ccucagcgcgugcu

SEQ ID NO: 3592109 - RNA, 21 nt, Pseudomonas putida KT2440
ccucggcaucgaacagcuugc

SEQ ID NO: 3592110 - RNA, 13 nt, Pseudomonas putida KT2440
ccucggccaccug

SEQ ID NO: 3592111 - RNA, 15 nt, Pseudomonas putida KT2440
ccucggccaggccca

SEQ ID NO: 3592112 - RNA, 14 nt, Pseudomonas putida KT2440
ccucggccaugucg

SEQ ID NO: 3592113 - RNA, 19 nt, Pseudomonas putida KT2440
ccucggccaugucguacca

SEQ ID NO: 3592114 - RNA, 17 nt, Pseudomonas putida KT2440
ccucggccgcauccugc

SEQ ID NO: 3592115 - RNA, 15 nt, Pseudomonas putida KT2440
ccucggccggggcca

SEQ ID NO: 3592116 - RNA, 16 nt, Pseudomonas putida KT2440
ccucggccggguuuuu

SEQ ID NO: 3592117 - RNA, 22 nt, Pseudomonas putida KT2440
ccucggccucgguacccgccag

SEQ ID NO: 3592118 - RNA, 21 nt, Pseudomonas putida KT2440
ccucggcgaaaagccggguac

SEQ ID NO: 3592119 - RNA, 17 nt, Pseudomonas putida KT2440
ccucggcuacgccgccg

SEQ ID NO: 3592120 - RNA, 13 nt, Pseudomonas putida KT2440
ccucgggacugug

SEQ ID NO: 3592121 - RNA, 12 nt, Pseudomonas putida KT2440
ccucgggcagcc

SEQ ID NO: 3592122 - RNA, 17 nt, Pseudomonas putida KT2440
ccucgggcuuggcacgc

SEQ ID NO: 3592123 - RNA, 21 nt, Pseudomonas putida KT2440
ccucgguaaaggugcccugcu

SEQ ID NO: 3592124 - RNA, 16 nt, Pseudomonas putida KT2440
ccucgguacccgccag

SEQ ID NO: 3592125 - RNA, 18 nt, Pseudomonas putida KT2440
ccucgguacccgccagca

SEQ ID NO: 3592126 - RNA, 19 nt, Pseudomonas putida KT2440
ccucggucgccgagccgau

SEQ ID NO: 3592127 - RNA, 18 nt, Pseudomonas putida KT2440
ccucguaacgagccuugg

SEQ ID NO: 3592128 - RNA, 21 nt, Pseudomonas putida KT2440
ccucguaacgagccuuggcca

SEQ ID NO: 3592129 - RNA, 14 nt, Pseudomonas putida KT2440
ccucguaaggccug

SEQ ID NO: 3592130 - RNA, 13 nt, Pseudomonas putida KT2440
ccucguaggagcg

SEQ ID NO: 3592131 - RNA, 18 nt, Pseudomonas putida KT2440
ccucgucaugcagcgcca

SEQ ID NO: 3592132 - RNA, 15 nt, Pseudomonas putida KT2440
ccucguccagguuga

SEQ ID NO: 3592133 - RNA, 15 nt, Pseudomonas putida KT2440
ccucguccccgcgcu

SEQ ID NO: 3592134 - RNA, 19 nt, Pseudomonas putida KT2440
ccucguccggugccgccug

SEQ ID NO: 3592135 - RNA, 23 nt, Pseudomonas putida KT2440
ccucgucggcgcgguucuucgcc

SEQ ID NO: 3592136 - RNA, 17 nt, Pseudomonas putida KT2440
ccucgugaccgaccacc

SEQ ID NO: 3592137 - RNA, 15 nt, Pseudomonas putida KT2440
ccucgugcagcugca

SEQ ID NO: 3592138 - RNA, 20 nt, Pseudomonas putida KT2440
ccucguuggcgaagucggcc

SEQ ID NO: 3592139 - RNA, 17 nt, Pseudomonas putida KT2440
ccucuaccacgccgcug

SEQ ID NO: 3592140 - RNA, 16 nt, Pseudomonas putida KT2440
ccucuaucaccuguuc

SEQ ID NO: 3592141 - RNA, 22 nt, Pseudomonas putida KT2440
ccucucagcaccauuugucuug

SEQ ID NO: 3592142 - RNA, 18 nt, Pseudomonas putida KT2440
ccucuccaauccgcagcu

SEQ ID NO: 3592143 - RNA, 17 nt, Pseudomonas putida KT2440
ccucugccaucucaauc

SEQ ID NO: 3592144 - RNA, 15 nt, Pseudomonas putida KT2440
ccucugcccgcagcu

SEQ ID NO: 3592145 - RNA, 15 nt, Pseudomonas putida KT2440
ccucugccugcccau

SEQ ID NO: 3592146 - RNA, 13 nt, Pseudomonas putida KT2440
ccucuuagcgggc

SEQ ID NO: 3592147 - RNA, 18 nt, Pseudomonas putida KT2440
ccucuucaccgucggcgc

SEQ ID NO: 3592148 - RNA, 19 nt, Pseudomonas putida KT2440
ccucuucgaagacgccgcc

SEQ ID NO: 3592149 - RNA, 12 nt, Pseudomonas putida KT2440
ccucuucgcggg

SEQ ID NO: 3592150 - RNA, 20 nt, Pseudomonas putida KT2440
ccucuucgcgggcaagcccg

SEQ ID NO: 3592151 - RNA, 17 nt, Pseudomonas putida KT2440
ccucuucgcggguaaac

SEQ ID NO: 3592152 - RNA, 18 nt, Pseudomonas putida KT2440
ccucuucgcggguaaacc

SEQ ID NO: 3592153 - RNA, 19 nt, Pseudomonas putida KT2440
ccucuucgcggguaaaccc

SEQ ID NO: 3592154 - RNA, 20 nt, Pseudomonas putida KT2440
ccucuugaauccccuuauaa

SEQ ID NO: 3592155 - RNA, 19 nt, Pseudomonas putida KT2440
ccucuugcaccugucccag

SEQ ID NO: 3592156 - RNA, 12 nt, Pseudomonas putida KT2440
ccucuugcugca

SEQ ID NO: 3592157 - RNA, 20 nt, Pseudomonas putida KT2440
ccucuugcugcaacagcucc

SEQ ID NO: 3592158 - RNA, 17 nt, Pseudomonas putida KT2440
ccugaaauuuuugaaau

SEQ ID NO: 3592159 - RNA, 18 nt, Pseudomonas putida KT2440
ccugaacaaggccuggcc

SEQ ID NO: 3592160 - RNA, 20 nt, Pseudomonas putida KT2440
ccugaacaaggccuggccca

SEQ ID NO: 3592161 - RNA, 18 nt, Pseudomonas putida KT2440
ccugaaccaugcgccgcu

SEQ ID NO: 3592162 - RNA, 16 nt, Pseudomonas putida KT2440
ccugaacgaugcccgg

SEQ ID NO: 3592163 - RNA, 21 nt, Pseudomonas putida KT2440
ccugaacggugaagucaacca

SEQ ID NO: 3592164 - RNA, 13 nt, Pseudomonas putida KT2440
ccugaagcccugg

SEQ ID NO: 3592165 - RNA, 17 nt, Pseudomonas putida KT2440
ccugaagcccuggauga

SEQ ID NO: 3592166 - RNA, 15 nt, Pseudomonas putida KT2440
ccugaaucuugcgcg

SEQ ID NO: 3592167 - RNA, 22 nt, Pseudomonas putida KT2440
ccugacaagcgagguaggccgu

SEQ ID NO: 3592168 - RNA, 19 nt, Pseudomonas putida KT2440
ccugacacauaggcagcca

SEQ ID NO: 3592169 - RNA, 17 nt, Pseudomonas putida KT2440
ccugaccaucagccugu

SEQ ID NO: 3592170 - RNA, 14 nt, Pseudomonas putida KT2440
ccugacccgcgccu

SEQ ID NO: 3592171 - RNA, 14 nt, Pseudomonas putida KT2440
ccugaccuugcugc

SEQ ID NO: 3592172 - RNA, 15 nt, Pseudomonas putida KT2440
ccugaccuugcugcu

SEQ ID NO: 3592173 - RNA, 17 nt, Pseudomonas putida KT2440
ccugaccuugcugcuca

SEQ ID NO: 3592174 - RNA, 20 nt, Pseudomonas putida KT2440
ccugacgcaagcgcgccgcc

SEQ ID NO: 3592175 - RNA, 20 nt, Pseudomonas putida KT2440
ccugacgcuucaucgaggca

SEQ ID NO: 3592176 - RNA, 15 nt, Pseudomonas putida KT2440
ccugacucgaccgcc

SEQ ID NO: 3592177 - RNA, 19 nt, Pseudomonas putida KT2440
ccugacucgaccgccgcac

SEQ ID NO: 3592178 - RNA, 19 nt, Pseudomonas putida KT2440
ccugagccaaggccgccca

SEQ ID NO: 3592179 - RNA, 20 nt, Pseudomonas putida KT2440
ccugagccaaggccgcccag

SEQ ID NO: 3592180 - RNA, 21 nt, Pseudomonas putida KT2440
ccugagccuuguucgcgcagg

SEQ ID NO: 3592181 - RNA, 21 nt, Pseudomonas putida KT2440
ccugagcuucaaucaugaagc

SEQ ID NO: 3592182 - RNA, 23 nt, Pseudomonas putida KT2440
ccugagcuucaaucaugaagcua

SEQ ID NO: 3592183 - RNA, 17 nt, Pseudomonas putida KT2440
ccugagggagcgggcuu

SEQ ID NO: 3592184 - RNA, 20 nt, Pseudomonas putida KT2440
ccugagggagcgggcuugcc

SEQ ID NO: 3592185 - RNA, 18 nt, Pseudomonas putida KT2440
ccugagggucgugagccu

SEQ ID NO: 3592186 - RNA, 19 nt, Pseudomonas putida KT2440
ccugagucuggcgccugac

SEQ ID NO: 3592187 - RNA, 23 nt, Pseudomonas putida KT2440
ccugaguuagacauuagaaaaug

SEQ ID NO: 3592188 - RNA, 19 nt, Pseudomonas putida KT2440
ccugauaguugcgcccgug

SEQ ID NO: 3592189 - RNA, 22 nt, Pseudomonas putida KT2440
ccugaucaagguuucagcagcg

SEQ ID NO: 3592190 - RNA, 15 nt, Pseudomonas putida KT2440
ccugaucauucacga

SEQ ID NO: 3592191 - RNA, 14 nt, Pseudomonas putida KT2440
ccugaucgccucca

SEQ ID NO: 3592192 - RNA, 16 nt, Pseudomonas putida KT2440
ccugaucgccuccagg

SEQ ID NO: 3592193 - RNA, 17 nt, Pseudomonas putida KT2440
ccugaucgccuccaggc

SEQ ID NO: 3592194 - RNA, 16 nt, Pseudomonas putida KT2440
ccugaugaaagcgcau

SEQ ID NO: 3592195 - RNA, 17 nt, Pseudomonas putida KT2440
ccugaugcaccaggccc

SEQ ID NO: 3592196 - RNA, 19 nt, Pseudomonas putida KT2440
ccugaugcaccaggcccag

SEQ ID NO: 3592197 - RNA, 13 nt, Pseudomonas putida KT2440
ccugaugcagcag

SEQ ID NO: 3592198 - RNA, 19 nt, Pseudomonas putida KT2440
ccugaugcagcagugccag

SEQ ID NO: 3592199 - RNA, 23 nt, Pseudomonas putida KT2440
ccugauguccaaauugggcuggg

SEQ ID NO: 3592200 - RNA, 14 nt, Pseudomonas putida KT2440
ccugauguggcugc

SEQ ID NO: 3592201 - RNA, 22 nt, Pseudomonas putida KT2440
ccugauguucggugcucaggcu

SEQ ID NO: 3592202 - RNA, 20 nt, Pseudomonas putida KT2440
ccugauuggcaucgcugccc

SEQ ID NO: 3592203 - RNA, 16 nt, Pseudomonas putida KT2440
ccugcaaacgcaggug

SEQ ID NO: 3592204 - RNA, 19 nt, Pseudomonas putida KT2440
ccugcaaaggcaugggcca

SEQ ID NO: 3592205 - RNA, 13 nt, Pseudomonas putida KT2440
ccugcaaaggccc

SEQ ID NO: 3592206 - RNA, 14 nt, Pseudomonas putida KT2440
ccugcaacaccucc

SEQ ID NO: 3592207 - RNA, 15 nt, Pseudomonas putida KT2440
ccugcaaccccugga

SEQ ID NO: 3592208 - RNA, 19 nt, Pseudomonas putida KT2440
ccugcaaccccuggaaacc

SEQ ID NO: 3592209 - RNA, 16 nt, Pseudomonas putida KT2440
ccugcaacgucgccac

SEQ ID NO: 3592210 - RNA, 20 nt, Pseudomonas putida KT2440
ccugcaagccggcgaacagc

SEQ ID NO: 3592211 - RNA, 21 nt, Pseudomonas putida KT2440
ccugcaagccggcgaacagca

SEQ ID NO: 3592212 - RNA, 21 nt, Pseudomonas putida KT2440
ccugcaaggcaaugcccaugg

SEQ ID NO: 3592213 - RNA, 22 nt, Pseudomonas putida KT2440
ccugcaaggcaaugcccauggc

SEQ ID NO: 3592214 - RNA, 22 nt, Pseudomonas putida KT2440
ccugcgccaaaaccuguuccag

SEQ ID NO: 3592215 - RNA, 20 nt, Pseudomonas putida KT2440
ccugcgccaccucggcgaaa

SEQ ID NO: 3592216 - RNA, 13 nt, Pseudomonas putida KT2440
ccugcgccaggca

SEQ ID NO: 3592217 - RNA, 19 nt, Pseudomonas putida KT2440
ccugcgcccaaucaccaau

SEQ ID NO: 3592218 - RNA, 17 nt, Pseudomonas putida KT2440
ccugcgcggccuugccg

SEQ ID NO: 3592219 - RNA, 17 nt, Pseudomonas putida KT2440
ccugcgcuugcaccagg

SEQ ID NO: 3592220 - RNA, 16 nt, Pseudomonas putida KT2440
ccugcggcugccccaa

SEQ ID NO: 3592221 - RNA, 19 nt, Pseudomonas putida KT2440
ccugcggcuguucgcagca

SEQ ID NO: 3592222 - RNA, 15 nt, Pseudomonas putida KT2440
ccugcggucagccug

SEQ ID NO: 3592223 - RNA, 16 nt, Pseudomonas putida KT2440
ccugcggucagccugc

SEQ ID NO: 3592224 - RNA, 13 nt, Pseudomonas putida KT2440
ccugcgucaggac

SEQ ID NO: 3592225 - RNA, 13 nt, Pseudomonas putida KT2440
ccugcgucuugcg

SEQ ID NO: 3592226 - RNA, 18 nt, Pseudomonas putida KT2440
ccugcgugcugugcacug

SEQ ID NO: 3592227 - RNA, 20 nt, Pseudomonas putida KT2440
ccugcgugcugugcacugcg

SEQ ID NO: 3592228 - RNA, 12 nt, Pseudomonas putida KT2440
ccugcucacccg

SEQ ID NO: 3592229 - RNA, 13 nt, Pseudomonas putida KT2440
ccugcucacgcag

SEQ ID NO: 3592230 - RNA, 12 nt, Pseudomonas putida KT2440
ccugcucaucca

SEQ ID NO: 3592231 - RNA, 13 nt, Pseudomonas putida KT2440
ccugcucauccag

SEQ ID NO: 3592232 - RNA, 17 nt, Pseudomonas putida KT2440
ccugcucauccagcaaa

SEQ ID NO: 3592233 - RNA, 15 nt, Pseudomonas putida KT2440
ccugcuccacccgug

SEQ ID NO: 3592234 - RNA, 14 nt, Pseudomonas putida KT2440
ccugcuccagcacc

SEQ ID NO: 3592235 - RNA, 16 nt, Pseudomonas putida KT2440
ccugcuccagcacccg

SEQ ID NO: 3592236 - RNA, 20 nt, Pseudomonas putida KT2440
ccugcuccaugggcaggccc

SEQ ID NO: 3592237 - RNA, 17 nt, Pseudomonas putida KT2440
ccugcucgacaagccgc

SEQ ID NO: 3592238 - RNA, 22 nt, Pseudomonas putida KT2440
ccugcucgacaagccgcugggc

SEQ ID NO: 3592239 - RNA, 13 nt, Pseudomonas putida KT2440
ccugcucguccau

SEQ ID NO: 3592240 - RNA, 17 nt, Pseudomonas putida KT2440
ccugcucguccaucacc

SEQ ID NO: 3592241 - RNA, 21 nt, Pseudomonas putida KT2440
ccugcucguugcugagcaagc

SEQ ID NO: 3592242 - RNA, 16 nt, Pseudomonas putida KT2440
ccugcucuggcccgaa

SEQ ID NO: 3592243 - RNA, 19 nt, Pseudomonas putida KT2440
ccugcucuggcccgaacag

SEQ ID NO: 3592244 - RNA, 23 nt, Pseudomonas putida KT2440
ccugcugacgcaggguagccccg

SEQ ID NO: 3592245 - RNA, 14 nt, Pseudomonas putida KT2440
ccugcugcagcucc

SEQ ID NO: 3592246 - RNA, 12 nt, Pseudomonas putida KT2440
ccugcugcuccc

SEQ ID NO: 3592247 - RNA, 22 nt, Pseudomonas putida KT2440
ccugcugcuccccaaccaccuc

SEQ ID NO: 3592248 - RNA, 15 nt, Pseudomonas putida KT2440
ccugcugcuggauca

SEQ ID NO: 3592249 - RNA, 15 nt, Pseudomonas putida KT2440
ccugcugcuggcacg

SEQ ID NO: 3592250 - RNA, 23 nt, Pseudomonas putida KT2440
ccugcugcugucgguaccuggcc

SEQ ID NO: 3592251 - RNA, 15 nt, Pseudomonas putida KT2440
ccugcuggcacugcg

SEQ ID NO: 3592252 - RNA, 15 nt, Pseudomonas putida KT2440
ccugcuggcccgcga

SEQ ID NO: 3592253 - RNA, 22 nt, Pseudomonas putida KT2440
ccugcuggcggcugagccggcu

SEQ ID NO: 3592254 - RNA, 18 nt, Pseudomonas putida KT2440
ccugcuggcucagcgagc

SEQ ID NO: 3592255 - RNA, 14 nt, Pseudomonas putida KT2440
ccugcugggcgaug

SEQ ID NO: 3592256 - RNA, 20 nt, Pseudomonas putida KT2440
ccugcugguacagccggcug

SEQ ID NO: 3592257 - RNA, 15 nt, Pseudomonas putida KT2440
ccugcuguagcgccc

SEQ ID NO: 3592258 - RNA, 15 nt, Pseudomonas putida KT2440
ccugcuuaucggcug

SEQ ID NO: 3592259 - RNA, 19 nt, Pseudomonas putida KT2440
ccugcuucgcgggcacgcc

SEQ ID NO: 3592260 - RNA, 14 nt, Pseudomonas putida KT2440
ccugcuuggccgac

SEQ ID NO: 3592261 - RNA, 23 nt, Pseudomonas putida KT2440
ccuggaaaaugcccccgccgaag

SEQ ID NO: 3592262 - RNA, 17 nt, Pseudomonas putida KT2440
ccuggaaccccauccac

SEQ ID NO: 3592263 - RNA, 13 nt, Pseudomonas putida KT2440
ccuggaaccgugg

SEQ ID NO: 3592264 - RNA, 20 nt, Pseudomonas putida KT2440
ccuggaagcgaaagcuuucg

SEQ ID NO: 3592265 - RNA, 23 nt, Pseudomonas putida KT2440
ccuggaauuccugccggggcgcc

SEQ ID NO: 3592266 - RNA, 23 nt, Pseudomonas putida KT2440
ccuggacgguauaggccccgaau

SEQ ID NO: 3592267 - RNA, 20 nt, Pseudomonas putida KT2440
ccuggacuggcccuuucgcg

SEQ ID NO: 3592268 - RNA, 14 nt, Pseudomonas putida KT2440
ccuggaggucaugu

SEQ ID NO: 3592269 - RNA, 15 nt, Pseudomonas putida KT2440
ccuggaucgcgccuu

SEQ ID NO: 3592270 - RNA, 13 nt, Pseudomonas putida KT2440
ccuggaugcguug

SEQ ID NO: 3592271 - RNA, 16 nt, Pseudomonas putida KT2440
ccuggcacgcccggca

SEQ ID NO: 3592272 - RNA, 19 nt, Pseudomonas putida KT2440
ccuggcauagcaguccugc

SEQ ID NO: 3592273 - RNA, 23 nt, Pseudomonas putida KT2440
ccuggcaugccccucgaacagcg

SEQ ID NO: 3592274 - RNA, 11 nt, Pseudomonas putida KT2440
ccuggccaccc

SEQ ID NO: 3592275 - RNA, 20 nt, Pseudomonas putida KT2440
ccuggccacuguugcagcgc

SEQ ID NO: 3592276 - RNA, 23 nt, Pseudomonas putida KT2440
ccuggccacuguugcagcgccag

SEQ ID NO: 3592277 - RNA, 19 nt, Pseudomonas putida KT2440
ccuggcccaguacgccacc

SEQ ID NO: 3592278 - RNA, 22 nt, Pseudomonas putida KT2440
ccuggcccaguacgccacccag

SEQ ID NO: 3592279 - RNA, 20 nt, Pseudomonas putida KT2440
ccuggcccgaacgcagcgcc

SEQ ID NO: 3592280 - RNA, 16 nt, Pseudomonas putida KT2440
ccuggcccgcagcgcu

SEQ ID NO: 3592281 - RNA, 16 nt, Pseudomonas putida KT2440
ccuggcccgccgccac

SEQ ID NO: 3592282 - RNA, 17 nt, Pseudomonas putida KT2440
ccuggcccgccgccacc

SEQ ID NO: 3592283 - RNA, 13 nt, Pseudomonas putida KT2440
ccuggcccggccc

SEQ ID NO: 3592284 - RNA, 15 nt, Pseudomonas putida KT2440
ccuggcccugcucac

SEQ ID NO: 3592285 - RNA, 17 nt, Pseudomonas putida KT2440
ccuggccgcguucgccc

SEQ ID NO: 3592286 - RNA, 15 nt, Pseudomonas putida KT2440
ccuggccgugacgcc

SEQ ID NO: 3592287 - RNA, 16 nt, Pseudomonas putida KT2440
ccuggccguguucgac

SEQ ID NO: 3592288 - RNA, 17 nt, Pseudomonas putida KT2440
ccuggccuuccuugccc

SEQ ID NO: 3592289 - RNA, 12 nt, Pseudomonas putida KT2440
ccuggcgacacu

SEQ ID NO: 3592290 - RNA, 21 nt, Pseudomonas putida KT2440
ccuggcgacacuugguccagg

SEQ ID NO: 3592291 - RNA, 21 nt, Pseudomonas putida KT2440
ccuggcgcaguucguccaggc

SEQ ID NO: 3592292 - RNA, 20 nt, Pseudomonas putida KT2440
ccuggcggaacgacagcuug

SEQ ID NO: 3592293 - RNA, 13 nt, Pseudomonas putida KT2440
ccuggcggguuuc

SEQ ID NO: 3592294 - RNA, 17 nt, Pseudomonas putida KT2440
ccuggcgguaaacgugg

SEQ ID NO: 3592295 - RNA, 23 nt, Pseudomonas putida KT2440
ccuggcgugcuguugagccaggg

SEQ ID NO: 3592296 - RNA, 16 nt, Pseudomonas putida KT2440
ccuggcucgaucacga

SEQ ID NO: 3592297 - RNA, 15 nt, Pseudomonas putida KT2440
ccuggcucggcuggg

SEQ ID NO: 3592298 - RNA, 19 nt, Pseudomonas putida KT2440
ccuggcucuucaacaccag

SEQ ID NO: 3592299 - RNA, 20 nt, Pseudomonas putida KT2440
ccuggcucuucaacaccagc

SEQ ID NO: 3592300 - RNA, 21 nt, Pseudomonas putida KT2440
ccuggcucuucaacaccagca

SEQ ID NO: 3592301 - RNA, 21 nt, Pseudomonas putida KT2440
ccuggcugagguucagcgcac

SEQ ID NO: 3592302 - RNA, 22 nt, Pseudomonas putida KT2440
ccuggcugcagugaagaauuca

SEQ ID NO: 3592303 - RNA, 23 nt, Pseudomonas putida KT2440
ccuggcugcgggugcccgggcuu

SEQ ID NO: 3592304 - RNA, 20 nt, Pseudomonas putida KT2440
ccuggcugcugugguuuggc

SEQ ID NO: 3592305 - RNA, 12 nt, Pseudomonas putida KT2440
ccuggcuggcag

SEQ ID NO: 3592306 - RNA, 15 nt, Pseudomonas putida KT2440
ccuggcuggcagccg

SEQ ID NO: 3592307 - RNA, 18 nt, Pseudomonas putida KT2440
ccuggcuggcagccggcg

SEQ ID NO: 3592308 - RNA, 16 nt, Pseudomonas putida KT2440
ccuggcugucccaugc

SEQ ID NO: 3592309 - RNA, 14 nt, Pseudomonas putida KT2440
ccuggcuuuccagg

SEQ ID NO: 3592310 - RNA, 20 nt, Pseudomonas putida KT2440
ccugggaaaccgugucgggc

SEQ ID NO: 3592311 - RNA, 20 nt, Pseudomonas putida KT2440
ccugggaagcugcagcagcu

SEQ ID NO: 3592312 - RNA, 19 nt, Pseudomonas putida KT2440
ccugggauuucggcggcga

SEQ ID NO: 3592313 - RNA, 19 nt, Pseudomonas putida KT2440
ccugggccaguaccuucug

SEQ ID NO: 3592314 - RNA, 24 nt, Pseudomonas putida KT2440
ccugggccaguaccuucuggcugg

SEQ ID NO: 3592315 - RNA, 15 nt, Pseudomonas putida KT2440
ccugggccuucgccc

SEQ ID NO: 3592316 - RNA, 14 nt, Pseudomonas putida KT2440
ccugggcgcuuugc

SEQ ID NO: 3592317 - RNA, 12 nt, Pseudomonas putida KT2440
ccugggcugucg

SEQ ID NO: 3592318 - RNA, 17 nt, Pseudomonas putida KT2440
ccuggggguggguugac

SEQ ID NO: 3592319 - RNA, 19 nt, Pseudomonas putida KT2440
ccuuccagcaaagugcgca

SEQ ID NO: 3592320 - RNA, 12 nt, Pseudomonas putida KT2440
ccuuccagcccg

SEQ ID NO: 3592321 - RNA, 18 nt, Pseudomonas putida KT2440
ccuuccagcccgccugcu

SEQ ID NO: 3592322 - RNA, 21 nt, Pseudomonas putida KT2440
ccuuccagcugcggcuggguc

SEQ ID NO: 3592323 - RNA, 22 nt, Pseudomonas putida KT2440
ccuuccagcugcggcuggguca

SEQ ID NO: 3592324 - RNA, 18 nt, Pseudomonas putida KT2440
ccuucccgucgagccggg

SEQ ID NO: 3592325 - RNA, 17 nt, Pseudomonas putida KT2440
ccuuccgaccggucaua

SEQ ID NO: 3592326 - RNA, 13 nt, Pseudomonas putida KT2440
ccuuccgcgugcc

SEQ ID NO: 3592327 - RNA, 20 nt, Pseudomonas putida KT2440
ccuuccucgacguugagcca

SEQ ID NO: 3592328 - RNA, 13 nt, Pseudomonas putida KT2440
ccuuccucggcca

SEQ ID NO: 3592329 - RNA, 20 nt, Pseudomonas putida KT2440
ccuuccucggccaugcgcgg

SEQ ID NO: 3592330 - RNA, 21 nt, Pseudomonas putida KT2440
ccuuccugggcuucaugcugc

SEQ ID NO: 3592331 - RNA, 13 nt, Pseudomonas putida KT2440
ccuuccuugccca

SEQ ID NO: 3592332 - RNA, 16 nt, Pseudomonas putida KT2440
ccuuccuuguaggcca

SEQ ID NO: 3592333 - RNA, 13 nt, Pseudomonas putida KT2440
ccuucgauucagg

SEQ ID NO: 3592334 - RNA, 14 nt, Pseudomonas putida KT2440
ccuucgauucaggc

SEQ ID NO: 3592335 - RNA, 16 nt, Pseudomonas putida KT2440
ccuucgcaggcacgcc

SEQ ID NO: 3592336 - RNA, 23 nt, Pseudomonas putida KT2440
ccuucgcaggcacgcccgcuccc

SEQ ID NO: 3592337 - RNA, 20 nt, Pseudomonas putida KT2440
ccuucgccaagguccagcca

SEQ ID NO: 3592338 - RNA, 23 nt, Pseudomonas putida KT2440
ccuucgccaagguccagccacga

SEQ ID NO: 3592339 - RNA, 17 nt, Pseudomonas putida KT2440
ccuucgccacgaacagg

SEQ ID NO: 3592340 - RNA, 22 nt, Pseudomonas putida KT2440
ccuucgcggaagauacccgcca

SEQ ID NO: 3592341 - RNA, 18 nt, Pseudomonas putida KT2440
ccuucgcgggcacgcccg

SEQ ID NO: 3592342 - RNA, 23 nt, Pseudomonas putida KT2440
ccuucgcgggcacgcccgcuccc

SEQ ID NO: 3592343 - RNA, 19 nt, Pseudomonas putida KT2440
ccuucgcgggugaacccgc

SEQ ID NO: 3592344 - RNA, 21 nt, Pseudomonas putida KT2440
ccuucgcucaggugcaccucc

SEQ ID NO: 3592345 - RNA, 23 nt, Pseudomonas putida KT2440
ccuucgcuggcgacgaagcugcu

SEQ ID NO: 3592346 - RNA, 13 nt, Pseudomonas putida KT2440
ccuucgcuucgcg

SEQ ID NO: 3592347 - RNA, 21 nt, Pseudomonas putida KT2440
ccuucggaaacaguuucuuca

SEQ ID NO: 3592348 - RNA, 20 nt, Pseudomonas putida KT2440
ccuucggcaaucaccgccag

SEQ ID NO: 3592349 - RNA, 19 nt, Pseudomonas putida KT2440
ccuucguaguaauggccga

SEQ ID NO: 3592350 - RNA, 16 nt, Pseudomonas putida KT2440
ccuucgucgcuggcca

SEQ ID NO: 3592351 - RNA, 23 nt, Pseudomonas putida KT2440
ccuucguuugcgaagguaaccug

SEQ ID NO: 3592352 - RNA, 15 nt, Pseudomonas putida KT2440
ccuucuccagcucgc

SEQ ID NO: 3592353 - RNA, 18 nt, Pseudomonas putida KT2440
ccuucucgaacagcuggc

SEQ ID NO: 3592354 - RNA, 19 nt, Pseudomonas putida KT2440
ccuucucgaacagcuggcg

SEQ ID NO: 3592355 - RNA, 12 nt, Pseudomonas putida KT2440
ccuucucuuccg

SEQ ID NO: 3592356 - RNA, 14 nt, Pseudomonas putida KT2440
ccuucucuuccgcc

SEQ ID NO: 3592357 - RNA, 20 nt, Pseudomonas putida KT2440
ccuucugccguuugcuggcc

SEQ ID NO: 3592358 - RNA, 21 nt, Pseudomonas putida KT2440
ccuucugcgcgagugaugcgg

SEQ ID NO: 3592359 - RNA, 16 nt, Pseudomonas putida KT2440
ccuucuggcagccgcc

SEQ ID NO: 3592360 - RNA, 23 nt, Pseudomonas putida KT2440
ccuucuggugaaagucgaccagc

SEQ ID NO: 3592361 - RNA, 19 nt, Pseudomonas putida KT2440
ccuucugugauuuccagcg

SEQ ID NO: 3592362 - RNA, 18 nt, Pseudomonas putida KT2440
ccuucuucggucagcugg

SEQ ID NO: 3592363 - RNA, 20 nt, Pseudomonas putida KT2440
ccuugaagaacaccugcagc

SEQ ID NO: 3592364 - RNA, 22 nt, Pseudomonas putida KT2440
ccuugaagaacaccugcagcgc

SEQ ID NO: 3592365 - RNA, 23 nt, Pseudomonas putida KT2440
ccuugaagugcgcaauccuugcc

SEQ ID NO: 3592366 - RNA, 15 nt, Pseudomonas putida KT2440
ccuugaccagcaacg

SEQ ID NO: 3592367 - RNA, 20 nt, Pseudomonas putida KT2440
ccuugacggggcacaacccg

SEQ ID NO: 3592368 - RNA, 17 nt, Pseudomonas putida KT2440
ccuugagaucagcaacc

SEQ ID NO: 3592369 - RNA, 17 nt, Pseudomonas putida KT2440
ccuugaucaaugcccgu

SEQ ID NO: 3592370 - RNA, 23 nt, Pseudomonas putida KT2440
ccuugaucaggaaggcgucguac

SEQ ID NO: 3592371 - RNA, 20 nt, Pseudomonas putida KT2440
ccuugaucuguccuccugcc

SEQ ID NO: 3592372 - RNA, 18 nt, Pseudomonas putida KT2440
ccuugauuaccagcgccc

SEQ ID NO: 3592373 - RNA, 20 nt, Pseudomonas putida KT2440
ccuugauuaccagcgccccg

SEQ ID NO: 3592374 - RNA, 22 nt, Pseudomonas putida KT2440
ccuugauuaccagcgccccgcc

SEQ ID NO: 3592375 - RNA, 12 nt, Pseudomonas putida KT2440
ccuugcagcgcc

SEQ ID NO: 3592376 - RNA, 21 nt, Pseudomonas putida KT2440
ccuugcagcgccgcauccagc

SEQ ID NO: 3592377 - RNA, 13 nt, Pseudomonas putida KT2440
ccuugcagcgccu

SEQ ID NO: 3592378 - RNA, 16 nt, Pseudomonas putida KT2440
ccuugcagggcaccag

SEQ ID NO: 3592379 - RNA, 14 nt, Pseudomonas putida KT2440
ccuugccaacggca

SEQ ID NO: 3592380 - RNA, 17 nt, Pseudomonas putida KT2440
ccuugcccaaccguucc

SEQ ID NO: 3592381 - RNA, 13 nt, Pseudomonas putida KT2440
ccuugcccagcuc

SEQ ID NO: 3592382 - RNA, 14 nt, Pseudomonas putida KT2440
ccuugcccagcucc

SEQ ID NO: 3592383 - RNA, 14 nt, Pseudomonas putida KT2440
ccuugcccugcagc

SEQ ID NO: 3592384 - RNA, 13 nt, Pseudomonas putida KT2440
ccuugccgccccg

SEQ ID NO: 3592385 - RNA, 17 nt, Pseudomonas putida KT2440
ccuugccgcucaccacc

SEQ ID NO: 3592386 - RNA, 20 nt, Pseudomonas putida KT2440
ccuugccgcuggcuuccuca

SEQ ID NO: 3592387 - RNA, 20 nt, Pseudomonas putida KT2440
ccuugccgcuguugaucagg

SEQ ID NO: 3592388 - RNA, 23 nt, Pseudomonas putida KT2440
ccuugccguaggugaucagcuug

SEQ ID NO: 3592389 - RNA, 14 nt, Pseudomonas putida KT2440
ccuugccuuccggc

SEQ ID NO: 3592390 - RNA, 17 nt, Pseudomonas putida KT2440
ccuugccuuccggcccg

SEQ ID NO: 3592391 - RNA, 19 nt, Pseudomonas putida KT2440
ccuugcgagccugggucac

SEQ ID NO: 3592392 - RNA, 15 nt, Pseudomonas putida KT2440
ccuugcgauaccccg

SEQ ID NO: 3592393 - RNA, 13 nt, Pseudomonas putida KT2440
ccuugcgcacgcc

SEQ ID NO: 3592394 - RNA, 14 nt, Pseudomonas putida KT2440
ccuugcgcaucaag

SEQ ID NO: 3592395 - RNA, 14 nt, Pseudomonas putida KT2440
ccuugcgcugggca

SEQ ID NO: 3592396 - RNA, 16 nt, Pseudomonas putida KT2440
ccuugcggaccaccug

SEQ ID NO: 3592397 - RNA, 21 nt, Pseudomonas putida KT2440
ccuugcgucgcgaugggcugc

SEQ ID NO: 3592398 - RNA, 18 nt, Pseudomonas putida KT2440
ccuugcgugccucagcca

SEQ ID NO: 3592399 - RNA, 23 nt, Pseudomonas putida KT2440
ccuugcgugccucagccaggcug

SEQ ID NO: 3592400 - RNA, 19 nt, Pseudomonas putida KT2440
ccuugcucaauuucuaaaa

SEQ ID NO: 3592401 - RNA, 21 nt, Pseudomonas putida KT2440
ccuugcucgaaugccgcugcu

SEQ ID NO: 3592402 - RNA, 13 nt, Pseudomonas putida KT2440
ccuugcucggcca

SEQ ID NO: 3592403 - RNA, 14 nt, Pseudomonas putida KT2440
ccuugcucggccag

SEQ ID NO: 3592404 - RNA, 18 nt, Pseudomonas putida KT2440
ccuugcucuguucgcugg

SEQ ID NO: 3592405 - RNA, 15 nt, Pseudomonas putida KT2440
ccuugcugcagcagg

SEQ ID NO: 3592406 - RNA, 20 nt, Pseudomonas putida KT2440
ccuugcuggaacugcugcac

SEQ ID NO: 3592407 - RNA, 16 nt, Pseudomonas putida KT2440
ccuugcuggccaccgc

SEQ ID NO: 3592408 - RNA, 15 nt, Pseudomonas putida KT2440
ccuugcuugaccuug

SEQ ID NO: 3592409 - RNA, 18 nt, Pseudomonas putida KT2440
ccuugcuuggcagcggcu

SEQ ID NO: 3592410 - RNA, 15 nt, Pseudomonas putida KT2440
ccuuggacaccaggc

SEQ ID NO: 3592411 - RNA, 16 nt, Pseudomonas putida KT2440
ccuuggacaccaggcu

SEQ ID NO: 3592412 - RNA, 18 nt, Pseudomonas putida KT2440
ccuuggacaccaggcugg

SEQ ID NO: 3592413 - RNA, 15 nt, Pseudomonas putida KT2440
ccuuggacgcuggca

SEQ ID NO: 3592414 - RNA, 16 nt, Pseudomonas putida KT2440
ccuuggacgcuggcag

SEQ ID NO: 3592415 - RNA, 17 nt, Pseudomonas putida KT2440
ccuuggacgcuggcagc

SEQ ID NO: 3592416 - RNA, 19 nt, Pseudomonas putida KT2440
ccuuggacgcuggcagcuu

SEQ ID NO: 3592417 - RNA, 18 nt, Pseudomonas putida KT2440
ccuuggagcgcgcccccg

SEQ ID NO: 3592418 - RNA, 19 nt, Pseudomonas putida KT2440
ccuuggcacggccagccag

SEQ ID NO: 3592419 - RNA, 16 nt, Pseudomonas putida KT2440
ccuuggccaacugcag

SEQ ID NO: 3592420 - RNA, 14 nt, Pseudomonas putida KT2440
ccuuggccaaugcc

SEQ ID NO: 3592421 - RNA, 14 nt, Pseudomonas putida KT2440
ccuuggccaccuuc

SEQ ID NO: 3592422 - RNA, 13 nt, Pseudomonas putida KT2440
ccuuggcgcagca

SEQ ID NO: 3592423 - RNA, 17 nt, Pseudomonas putida KT2440
ccuuggcggcggaucgg

SEQ ID NO: 3592424 - RNA, 19 nt, Pseudomonas putida KT2440
cgaaccaaggugcuaccgg

SEQ ID NO: 3592425 - RNA, 18 nt, Pseudomonas putida KT2440
cgaaccaccgaugcugug

SEQ ID NO: 3592426 - RNA, 14 nt, Pseudomonas putida KT2440
cgaacccacuguca

SEQ ID NO: 3592427 - RNA, 17 nt, Pseudomonas putida KT2440
cgaacccgcugccaccc

SEQ ID NO: 3592428 - RNA, 18 nt, Pseudomonas putida KT2440
cgaacccgcugccaccca

SEQ ID NO: 3592429 - RNA, 15 nt, Pseudomonas putida KT2440
cgaaccggcgaucag

SEQ ID NO: 3592430 - RNA, 17 nt, Pseudomonas putida KT2440
cgaaccggcgcuggcca

SEQ ID NO: 3592431 - RNA, 21 nt, Pseudomonas putida KT2440
cgaaccggcgcuggccaggcu

SEQ ID NO: 3592432 - RNA, 22 nt, Pseudomonas putida KT2440
cgaaccggcgcuggccaggcuu

SEQ ID NO: 3592433 - RNA, 18 nt, Pseudomonas putida KT2440
cgaaccguucacguucaa

SEQ ID NO: 3592434 - RNA, 14 nt, Pseudomonas putida KT2440
cgaaccuacgacca

SEQ ID NO: 3592435 - RNA, 13 nt, Pseudomonas putida KT2440
cgaaccucaguac

SEQ ID NO: 3592436 - RNA, 16 nt, Pseudomonas putida KT2440
cgaaccuugcuugacc

SEQ ID NO: 3592437 - RNA, 15 nt, Pseudomonas putida KT2440
cgaacgacuucggca

SEQ ID NO: 3592438 - RNA, 23 nt, Pseudomonas putida KT2440
cgaacgauucugccagcuccugg

SEQ ID NO: 3592439 - RNA, 17 nt, Pseudomonas putida KT2440
cgaacgcaagaaggcug

SEQ ID NO: 3592440 - RNA, 16 nt, Pseudomonas putida KT2440
cgaacgcagcgccgcc

SEQ ID NO: 3592441 - RNA, 16 nt, Pseudomonas putida KT2440
cgaacgcccccagccc

SEQ ID NO: 3592442 - RNA, 20 nt, Pseudomonas putida KT2440
cgaacgcccccagcccggcg

SEQ ID NO: 3592443 - RNA, 14 nt, Pseudomonas putida KT2440
cgaacgcccgaccu

SEQ ID NO: 3592444 - RNA, 22 nt, Pseudomonas putida KT2440
cgaacgcgaguaacgcccuuca

SEQ ID NO: 3592445 - RNA, 20 nt, Pseudomonas putida KT2440
cgaacgcgguaagcaccacc

SEQ ID NO: 3592446 - RNA, 16 nt, Pseudomonas putida KT2440
cgaacgcuugcccggc

SEQ ID NO: 3592447 - RNA, 15 nt, Pseudomonas putida KT2440
cgaacggcgccagca

SEQ ID NO: 3592448 - RNA, 14 nt, Pseudomonas putida KT2440
cgaacgggccacca

SEQ ID NO: 3592449 - RNA, 14 nt, Pseudomonas putida KT2440
cgaacgggcucacc

SEQ ID NO: 3592450 - RNA, 18 nt, Pseudomonas putida KT2440
cgaacguuucgucaucca

SEQ ID NO: 3592451 - RNA, 22 nt, Pseudomonas putida KT2440
cgaacguuucgucauccaccgc

SEQ ID NO: 3592452 - RNA, 16 nt, Pseudomonas putida KT2440
cgaacucaugcuccug

SEQ ID NO: 3592453 - RNA, 17 nt, Pseudomonas putida KT2440
cgaacucaugcuccugc

SEQ ID NO: 3592454 - RNA, 20 nt, Pseudomonas putida KT2440
cgaacuccgcgagggcauca

SEQ ID NO: 3592455 - RNA, 23 nt, Pseudomonas putida KT2440
cgaacuccgcgagggcaucagcg

SEQ ID NO: 3592456 - RNA, 13 nt, Pseudomonas putida KT2440
cgaacuccugcac

SEQ ID NO: 3592457 - RNA, 20 nt, Pseudomonas putida KT2440
cgaacucgauucgccgggcc

SEQ ID NO: 3592458 - RNA, 14 nt, Pseudomonas putida KT2440
cgaacucgcgccca

SEQ ID NO: 3592459 - RNA, 14 nt, Pseudomonas putida KT2440
cgaacugaugaccg

SEQ ID NO: 3592460 - RNA, 17 nt, Pseudomonas putida KT2440
cgaacugcagagccugc

SEQ ID NO: 3592461 - RNA, 14 nt, Pseudomonas putida KT2440
cgaacuucuccagc

SEQ ID NO: 3592462 - RNA, 18 nt, Pseudomonas putida KT2440
cgaacuucuccagcgucc

SEQ ID NO: 3592463 - RNA, 14 nt, Pseudomonas putida KT2440
cgaacuugccgaug

SEQ ID NO: 3592464 - RNA, 17 nt, Pseudomonas putida KT2440
cgaacuuguuggccacc

SEQ ID NO: 3592465 - RNA, 15 nt, Pseudomonas putida KT2440
cgaagaagccaccgc

SEQ ID NO: 3592466 - RNA, 15 nt, Pseudomonas putida KT2440
cgaagaaggcgagcu

SEQ ID NO: 3592467 - RNA, 15 nt, Pseudomonas putida KT2440
cgaagaccgccgccc

SEQ ID NO: 3592468 - RNA, 16 nt, Pseudomonas putida KT2440
cgaagaggccagcaca

SEQ ID NO: 3592469 - RNA, 23 nt, Pseudomonas putida KT2440
cgaagaggcccucaagggcgcug

SEQ ID NO: 3592470 - RNA, 18 nt, Pseudomonas putida KT2440
cgaagaggccggaccugc

SEQ ID NO: 3592471 - RNA, 14 nt, Pseudomonas putida KT2440
cgaagaggccggca

SEQ ID NO: 3592472 - RNA, 13 nt, Pseudomonas putida KT2440
cgaagaggccggu

SEQ ID NO: 3592473 - RNA, 23 nt, Pseudomonas putida KT2440
cgaagaggccgguacagccagca

SEQ ID NO: 3592474 - RNA, 15 nt, Pseudomonas putida KT2440
cgaagagggcgacac

SEQ ID NO: 3592475 - RNA, 15 nt, Pseudomonas putida KT2440
cgaagaucagcaccg

SEQ ID NO: 3592476 - RNA, 15 nt, Pseudomonas putida KT2440
cgaagaucagcucau

SEQ ID NO: 3592477 - RNA, 19 nt, Pseudomonas putida KT2440
cgaagaugucgauguacuu

SEQ ID NO: 3592478 - RNA, 12 nt, Pseudomonas putida KT2440
cgaagcaccacu

SEQ ID NO: 3592479 - RNA, 14 nt, Pseudomonas putida KT2440
cgaagcaccacugg

SEQ ID NO: 3592480 - RNA, 15 nt, Pseudomonas putida KT2440
cgaagcaccacugga

SEQ ID NO: 3592481 - RNA, 13 nt, Pseudomonas putida KT2440
cgaagcagcagcu

SEQ ID NO: 3592482 - RNA, 14 nt, Pseudomonas putida KT2440
cgaagcagccacca

SEQ ID NO: 3592483 - RNA, 15 nt, Pseudomonas putida KT2440
cgaagcaggcgacgc

SEQ ID NO: 3592484 - RNA, 15 nt, Pseudomonas putida KT2440
cgaagcaggcugcgc

SEQ ID NO: 3592485 - RNA, 19 nt, Pseudomonas putida KT2440
cgaagcaggcugcgcuuug

SEQ ID NO: 3592486 - RNA, 16 nt, Pseudomonas putida KT2440
cgaagcagugcugcca

SEQ ID NO: 3592487 - RNA, 21 nt, Pseudomonas putida KT2440
cgaagccgaaucgcucugccg

SEQ ID NO: 3592488 - RNA, 18 nt, Pseudomonas putida KT2440
cgaagccgacccgggcca

SEQ ID NO: 3592489 - RNA, 14 nt, Pseudomonas putida KT2440
cgaagccgccagcg

SEQ ID NO: 3592490 - RNA, 22 nt, Pseudomonas putida KT2440
cgaagccguugaggccgaacac

SEQ ID NO: 3592491 - RNA, 15 nt, Pseudomonas putida KT2440
cgaagcgaacacagu

SEQ ID NO: 3592492 - RNA, 13 nt, Pseudomonas putida KT2440
cgaagcgacagcg

SEQ ID NO: 3592493 - RNA, 16 nt, Pseudomonas putida KT2440
cgaagcgacagcggcc

SEQ ID NO: 3592494 - RNA, 20 nt, Pseudomonas putida KT2440
cgaagcgcaccucggccagu

SEQ ID NO: 3592495 - RNA, 18 nt, Pseudomonas putida KT2440
cgaagcgccuggagagcc

SEQ ID NO: 3592496 - RNA, 14 nt, Pseudomonas putida KT2440
cgaagcgcucaugc

SEQ ID NO: 3592497 - RNA, 19 nt, Pseudomonas putida KT2440
cgaagcguuuacugcugau

SEQ ID NO: 3592498 - RNA, 15 nt, Pseudomonas putida KT2440
cgaagcuaucgccag

SEQ ID NO: 3592499 - RNA, 21 nt, Pseudomonas putida KT2440
cgaagcuaucgccagcaggcc

SEQ ID NO: 3592500 - RNA, 15 nt, Pseudomonas putida KT2440
cgaagcugccacugc

SEQ ID NO: 3592501 - RNA, 21 nt, Pseudomonas putida KT2440
cgaagcuugcagucaccuggc

SEQ ID NO: 3592502 - RNA, 19 nt, Pseudomonas putida KT2440
cgaaggcaauguggccgau

SEQ ID NO: 3592503 - RNA, 14 nt, Pseudomonas putida KT2440
cgaaggccagcaaa

SEQ ID NO: 3592504 - RNA, 18 nt, Pseudomonas putida KT2440
cgaaggccgccggcaacu

SEQ ID NO: 3592505 - RNA, 20 nt, Pseudomonas putida KT2440
cgaaggccgccggcaacugg

SEQ ID NO: 3592506 - RNA, 17 nt, Pseudomonas putida KT2440
cgaaggccuucagguug

SEQ ID NO: 3592507 - RNA, 15 nt, Pseudomonas putida KT2440
cgaaggccuuggcca

SEQ ID NO: 3592508 - RNA, 18 nt, Pseudomonas putida KT2440
cgaaggcgcuccccugcu

SEQ ID NO: 3592509 - RNA, 16 nt, Pseudomonas putida KT2440
cgaaggcggucgcgcg

SEQ ID NO: 3592510 - RNA, 18 nt, Pseudomonas putida KT2440
cgaaggcuucguggaaga

SEQ ID NO: 3592511 - RNA, 16 nt, Pseudomonas putida KT2440
cgaagggccgcaacgc

SEQ ID NO: 3592512 - RNA, 22 nt, Pseudomonas putida KT2440
cgaaggggaucagcacgcgauc

SEQ ID NO: 3592513 - RNA, 14 nt, Pseudomonas putida KT2440
cgaaggggccggca

SEQ ID NO: 3592514 - RNA, 16 nt, Pseudomonas putida KT2440
cgaaggggcgcccaga

SEQ ID NO: 3592515 - RNA, 18 nt, Pseudomonas putida KT2440
cgaaggugcgauagaugu

SEQ ID NO: 3592516 - RNA, 22 nt, Pseudomonas putida KT2440
cgaagguguucaccacgcccug

SEQ ID NO: 3592517 - RNA, 14 nt, Pseudomonas putida KT2440
cgaagguguuugac

SEQ ID NO: 3592518 - RNA, 21 nt, Pseudomonas putida KT2440
cgaaguacggcuugccggcaa

SEQ ID NO: 3592519 - RNA, 22 nt, Pseudomonas putida KT2440
cgaaguacggcuugccggcaau

SEQ ID NO: 3592520 - RNA, 22 nt, Pseudomonas putida KT2440
cgaagucagguaggugcugacc

SEQ ID NO: 3592521 - RNA, 17 nt, Pseudomonas putida KT2440
cgaagucauccauggca

SEQ ID NO: 3592522 - RNA, 17 nt, Pseudomonas putida KT2440
cgaagucgaacaccagu

SEQ ID NO: 3592523 - RNA, 19 nt, Pseudomonas putida KT2440
cgaaguggauauccagcga

SEQ ID NO: 3592524 - RNA, 13 nt, Pseudomonas putida KT2440
cgaaguggcggcu

SEQ ID NO: 3592525 - RNA, 21 nt, Pseudomonas putida KT2440
cgaaguucagcacgggcagcu

SEQ ID NO: 3592526 - RNA, 15 nt, Pseudomonas putida KT2440
cgaaguugagcaccg

SEQ ID NO: 3592527 - RNA, 14 nt, Pseudomonas putida KT2440
cgaaguugcccgaa

SEQ ID NO: 3592528 - RNA, 18 nt, Pseudomonas putida KT2440
cgaauaaccgcuguacag

SEQ ID NO: 3592529 - RNA, 13 nt, Pseudomonas putida KT2440
cgaauaccaguaa

SEQ ID NO: 3592530 - RNA, 22 nt, Pseudomonas putida KT2440
cgaccaauugguuaaaagccaa

SEQ ID NO: 3592531 - RNA, 16 nt, Pseudomonas putida KT2440
cgaccaccaucgccag

SEQ ID NO: 3592532 - RNA, 14 nt, Pseudomonas putida KT2440
cgaccacccgguga

SEQ ID NO: 3592533 - RNA, 15 nt, Pseudomonas putida KT2440
cgaccaccgcaggug

SEQ ID NO: 3592534 - RNA, 18 nt, Pseudomonas putida KT2440
cgaccacgaucuuggcca

SEQ ID NO: 3592535 - RNA, 20 nt, Pseudomonas putida KT2440
cgaccacgaucuuggccagg

SEQ ID NO: 3592536 - RNA, 15 nt, Pseudomonas putida KT2440
cgaccacgcacagcu

SEQ ID NO: 3592537 - RNA, 17 nt, Pseudomonas putida KT2440
cgaccacgguaccggca

SEQ ID NO: 3592538 - RNA, 15 nt, Pseudomonas putida KT2440
cgaccacugcaggug

SEQ ID NO: 3592539 - RNA, 17 nt, Pseudomonas putida KT2440
cgaccacugcaggugca

SEQ ID NO: 3592540 - RNA, 17 nt, Pseudomonas putida KT2440
cgaccagaagggcgcaa

SEQ ID NO: 3592541 - RNA, 14 nt, Pseudomonas putida KT2440
cgaccagaucagcc

SEQ ID NO: 3592542 - RNA, 20 nt, Pseudomonas putida KT2440
cgaccagaucagccguuacc

SEQ ID NO: 3592543 - RNA, 18 nt, Pseudomonas putida KT2440
cgaccagaucaggccgcu

SEQ ID NO: 3592544 - RNA, 11 nt, Pseudomonas putida KT2440
cgaccagcagu

SEQ ID NO: 3592545 - RNA, 17 nt, Pseudomonas putida KT2440
cgaccagcaugcgaagc

SEQ ID NO: 3592546 - RNA, 13 nt, Pseudomonas putida KT2440
cgaccagcugcca

SEQ ID NO: 3592547 - RNA, 21 nt, Pseudomonas putida KT2440
cgaccaggcgcucgcuccagg

SEQ ID NO: 3592548 - RNA, 15 nt, Pseudomonas putida KT2440
cgaccagggccuugg

SEQ ID NO: 3592549 - RNA, 19 nt, Pseudomonas putida KT2440
cgaccagggccuuggccug

SEQ ID NO: 3592550 - RNA, 20 nt, Pseudomonas putida KT2440
cgaccagggccuuggccugg

SEQ ID NO: 3592551 - RNA, 21 nt, Pseudomonas putida KT2440
cgaccagggccuuggccuggg

SEQ ID NO: 3592552 - RNA, 22 nt, Pseudomonas putida KT2440
cgaccaggugguaacuggccag

SEQ ID NO: 3592553 - RNA, 15 nt, Pseudomonas putida KT2440
cgaccaguucgacgc

SEQ ID NO: 3592554 - RNA, 14 nt, Pseudomonas putida KT2440
cgaccaucaccagu

SEQ ID NO: 3592555 - RNA, 18 nt, Pseudomonas putida KT2440
cgaccaucaccgccagca

SEQ ID NO: 3592556 - RNA, 13 nt, Pseudomonas putida KT2440
cgaccaucggcag

SEQ ID NO: 3592557 - RNA, 17 nt, Pseudomonas putida KT2440
cgacccacaggcacagg

SEQ ID NO: 3592558 - RNA, 20 nt, Pseudomonas putida KT2440
cgacccacaggcacaggccc

SEQ ID NO: 3592559 - RNA, 14 nt, Pseudomonas putida KT2440
cgacccaccgacca

SEQ ID NO: 3592560 - RNA, 23 nt, Pseudomonas putida KT2440
cgaccccagcaugaaccgcuccg

SEQ ID NO: 3592561 - RNA, 17 nt, Pseudomonas putida KT2440
cgacccccuugccagca

SEQ ID NO: 3592562 - RNA, 14 nt, Pseudomonas putida KT2440
cgacccgcccgcca

SEQ ID NO: 3592563 - RNA, 17 nt, Pseudomonas putida KT2440
cgacccgcccgccaugc

SEQ ID NO: 3592564 - RNA, 11 nt, Pseudomonas putida KT2440
cgacccgccgg

SEQ ID NO: 3592565 - RNA, 18 nt, Pseudomonas putida KT2440
cgacccgccuggugccag

SEQ ID NO: 3592566 - RNA, 22 nt, Pseudomonas putida KT2440
cgacccgccuggugccagcggc

SEQ ID NO: 3592567 - RNA, 23 nt, Pseudomonas putida KT2440
cgacccgccuggugccagcggcc

SEQ ID NO: 3592568 - RNA, 15 nt, Pseudomonas putida KT2440
cgacccgcgucagcu

SEQ ID NO: 3592569 - RNA, 20 nt, Pseudomonas putida KT2440
cgacccggauaccgacccua

SEQ ID NO: 3592570 - RNA, 17 nt, Pseudomonas putida KT2440
cgacccgggccagccac

SEQ ID NO: 3592571 - RNA, 16 nt, Pseudomonas putida KT2440
cgacccgucgcugcca

SEQ ID NO: 3592572 - RNA, 20 nt, Pseudomonas putida KT2440
cgacccugugggagcgggcu

SEQ ID NO: 3592573 - RNA, 15 nt, Pseudomonas putida KT2440
cgaccgaaccggcgc

SEQ ID NO: 3592574 - RNA, 19 nt, Pseudomonas putida KT2440
cgaccgauaaagagaagcu

SEQ ID NO: 3592575 - RNA, 15 nt, Pseudomonas putida KT2440
cgaccgcacccgcga

SEQ ID NO: 3592576 - RNA, 17 nt, Pseudomonas putida KT2440
cgaccgccagcccgcca

SEQ ID NO: 3592577 - RNA, 14 nt, Pseudomonas putida KT2440
cgaccggcaggcgc

SEQ ID NO: 3592578 - RNA, 17 nt, Pseudomonas putida KT2440
cgaccgggcagaccugc

SEQ ID NO: 3592579 - RNA, 18 nt, Pseudomonas putida KT2440
cgaccgggcagaccugcu

SEQ ID NO: 3592580 - RNA, 17 nt, Pseudomonas putida KT2440
cgaccggguaaucgcca

SEQ ID NO: 3592581 - RNA, 18 nt, Pseudomonas putida KT2440
cgaccggguaaucgccag

SEQ ID NO: 3592582 - RNA, 22 nt, Pseudomonas putida KT2440
cgaccggguaaucgccaggccc

SEQ ID NO: 3592583 - RNA, 21 nt, Pseudomonas putida KT2440
cgaccggucauacauccagcu

SEQ ID NO: 3592584 - RNA, 15 nt, Pseudomonas putida KT2440
cgaccggucggccau

SEQ ID NO: 3592585 - RNA, 23 nt, Pseudomonas putida KT2440
cgaccgguggccugagccggucg

SEQ ID NO: 3592586 - RNA, 14 nt, Pseudomonas putida KT2440
cgaccgucgcugga

SEQ ID NO: 3592587 - RNA, 17 nt, Pseudomonas putida KT2440
cgaccgucgcuggacgc

SEQ ID NO: 3592588 - RNA, 18 nt, Pseudomonas putida KT2440
cgaccgucgcuggacgcu

SEQ ID NO: 3592589 - RNA, 14 nt, Pseudomonas putida KT2440
cgaccucacgcagg

SEQ ID NO: 3592590 - RNA, 20 nt, Pseudomonas putida KT2440
cgaccucgauuuccaccggc

SEQ ID NO: 3592591 - RNA, 15 nt, Pseudomonas putida KT2440
cgaccucggccaggu

SEQ ID NO: 3592592 - RNA, 17 nt, Pseudomonas putida KT2440
cgaccucggccaggucg

SEQ ID NO: 3592593 - RNA, 11 nt, Pseudomonas putida KT2440
cgaccugcagg

SEQ ID NO: 3592594 - RNA, 15 nt, Pseudomonas putida KT2440
cgaccugcaggcccu

SEQ ID NO: 3592595 - RNA, 16 nt, Pseudomonas putida KT2440
cgaccugcaggcccug

SEQ ID NO: 3592596 - RNA, 14 nt, Pseudomonas putida KT2440
cgaccugccagccu

SEQ ID NO: 3592597 - RNA, 12 nt, Pseudomonas putida KT2440
cgaccugccagu

SEQ ID NO: 3592598 - RNA, 15 nt, Pseudomonas putida KT2440
cgaccuggcccgcuu

SEQ ID NO: 3592599 - RNA, 17 nt, Pseudomonas putida KT2440
cgaccuggcccgcuugc

SEQ ID NO: 3592600 - RNA, 16 nt, Pseudomonas putida KT2440
cgaccuggcucuucaa

SEQ ID NO: 3592601 - RNA, 20 nt, Pseudomonas putida KT2440
cgaccuguguccacccccgc

SEQ ID NO: 3592602 - RNA, 16 nt, Pseudomonas putida KT2440
cgaccuucacgccagc

SEQ ID NO: 3592603 - RNA, 18 nt, Pseudomonas putida KT2440
cgaccuuggacgcuggca

SEQ ID NO: 3592604 - RNA, 18 nt, Pseudomonas putida KT2440
cgacgaagcugcuggcgu

SEQ ID NO: 3592605 - RNA, 15 nt, Pseudomonas putida KT2440
cgacgaaggccuugg

SEQ ID NO: 3592606 - RNA, 18 nt, Pseudomonas putida KT2440
cgacgaaggccuuggcca

SEQ ID NO: 3592607 - RNA, 15 nt, Pseudomonas putida KT2440
cgacgacacggcugc

SEQ ID NO: 3592608 - RNA, 13 nt, Pseudomonas putida KT2440
cgacgaccaguuc

SEQ ID NO: 3592609 - RNA, 21 nt, Pseudomonas putida KT2440
cgacgaccaguucgacgcugc

SEQ ID NO: 3592610 - RNA, 21 nt, Pseudomonas putida KT2440
cgacgacgaucucguccaggg

SEQ ID NO: 3592611 - RNA, 15 nt, Pseudomonas putida KT2440
cgacgagccaguucg

SEQ ID NO: 3592612 - RNA, 18 nt, Pseudomonas putida KT2440
cgacgauaccgcccaggu

SEQ ID NO: 3592613 - RNA, 12 nt, Pseudomonas putida KT2440
cgacgaucgccg

SEQ ID NO: 3592614 - RNA, 15 nt, Pseudomonas putida KT2440
cgacgauggacagcc

SEQ ID NO: 3592615 - RNA, 16 nt, Pseudomonas putida KT2440
cgacgauggacagccc

SEQ ID NO: 3592616 - RNA, 18 nt, Pseudomonas putida KT2440
cgacgauggacagcccaa

SEQ ID NO: 3592617 - RNA, 13 nt, Pseudomonas putida KT2440
cgacgauggccac

SEQ ID NO: 3592618 - RNA, 15 nt, Pseudomonas putida KT2440
cgacgauggccacca

SEQ ID NO: 3592619 - RNA, 20 nt, Pseudomonas putida KT2440
cgacgauguaugccaaccca

SEQ ID NO: 3592620 - RNA, 23 nt, Pseudomonas putida KT2440
cgacgcaccagguuggccgccgc

SEQ ID NO: 3592621 - RNA, 23 nt, Pseudomonas putida KT2440
cgacgcagacaaaacgcugcgac

SEQ ID NO: 3592622 - RNA, 15 nt, Pseudomonas putida KT2440
cgacgcagcagcgcg

SEQ ID NO: 3592623 - RNA, 14 nt, Pseudomonas putida KT2440
cgacgcaguuacuc

SEQ ID NO: 3592624 - RNA, 15 nt, Pseudomonas putida KT2440
cgacgccccggccug

SEQ ID NO: 3592625 - RNA, 18 nt, Pseudomonas putida KT2440
cgacgccggccugccgcu

SEQ ID NO: 3592626 - RNA, 17 nt, Pseudomonas putida KT2440
cgacgccuuggcgcagc

SEQ ID NO: 3592627 - RNA, 21 nt, Pseudomonas putida KT2440
cgacgccuuggcgcagcaagg

SEQ ID NO: 3592628 - RNA, 14 nt, Pseudomonas putida KT2440
cgacgcgacccguc

SEQ ID NO: 3592629 - RNA, 17 nt, Pseudomonas putida KT2440
cgacgcgacccguccag

SEQ ID NO: 3592630 - RNA, 12 nt, Pseudomonas putida KT2440
cgacgcgcgcag

SEQ ID NO: 3592631 - RNA, 12 nt, Pseudomonas putida KT2440
cgacgcgggcca

SEQ ID NO: 3592632 - RNA, 16 nt, Pseudomonas putida KT2440
cgacgcgggccaaggu

SEQ ID NO: 3592633 - RNA, 21 nt, Pseudomonas putida KT2440
cgacgcgggccaaggucagca

SEQ ID NO: 3592634 - RNA, 15 nt, Pseudomonas putida KT2440
cgacgcggugcucga

SEQ ID NO: 3592635 - RNA, 23 nt, Pseudomonas putida KT2440
cgacgcgguggagggcaccggcu

SEQ ID NO: 3592636 - RNA, 14 nt, Pseudomonas putida KT2440
cgagcguuuuucuc

SEQ ID NO: 3592637 - RNA, 15 nt, Pseudomonas putida KT2440
cgagcuacagccccu

SEQ ID NO: 3592638 - RNA, 19 nt, Pseudomonas putida KT2440
cgagcuaccugacuugccu

SEQ ID NO: 3592639 - RNA, 13 nt, Pseudomonas putida KT2440
cgagcucgaucgg

SEQ ID NO: 3592640 - RNA, 14 nt, Pseudomonas putida KT2440
cgagcugagcagcg

SEQ ID NO: 3592641 - RNA, 16 nt, Pseudomonas putida KT2440
cgagcugauccgccug

SEQ ID NO: 3592642 - RNA, 17 nt, Pseudomonas putida KT2440
cgagcugcccaccaagg

SEQ ID NO: 3592643 - RNA, 19 nt, Pseudomonas putida KT2440
cgagcuugcucgcgaugcg

SEQ ID NO: 3592644 - RNA, 14 nt, Pseudomonas putida KT2440
cgaggaaacccgcg

SEQ ID NO: 3592645 - RNA, 18 nt, Pseudomonas putida KT2440
cgaggaaguacgccggcg

SEQ ID NO: 3592646 - RNA, 24 nt, Pseudomonas putida KT2440
cgaggaaguacgccggcgcacgca

SEQ ID NO: 3592647 - RNA, 15 nt, Pseudomonas putida KT2440
cgaggaauugcgcca

SEQ ID NO: 3592648 - RNA, 23 nt, Pseudomonas putida KT2440
cgaggaauugcgccaggauggcu

SEQ ID NO: 3592649 - RNA, 19 nt, Pseudomonas putida KT2440
cgaggacaacaaggacugc

SEQ ID NO: 3592650 - RNA, 14 nt, Pseudomonas putida KT2440
cgaggacagcaucu

SEQ ID NO: 3592651 - RNA, 15 nt, Pseudomonas putida KT2440
cgaggacagcaucuc

SEQ ID NO: 3592652 - RNA, 12 nt, Pseudomonas putida KT2440
cgaggaucagcg

SEQ ID NO: 3592653 - RNA, 17 nt, Pseudomonas putida KT2440
cgaggaucagcgcagac

SEQ ID NO: 3592654 - RNA, 15 nt, Pseudomonas putida KT2440
cgaggaucagcgcau

SEQ ID NO: 3592655 - RNA, 17 nt, Pseudomonas putida KT2440
cgaggaugcggcugacc

SEQ ID NO: 3592656 - RNA, 21 nt, Pseudomonas putida KT2440
cgaggcauccacacccugcga

SEQ ID NO: 3592657 - RNA, 13 nt, Pseudomonas putida KT2440
cgaggccccagac

SEQ ID NO: 3592658 - RNA, 20 nt, Pseudomonas putida KT2440
cgaggccccagaccaucagg

SEQ ID NO: 3592659 - RNA, 19 nt, Pseudomonas putida KT2440
cgaggcccgaacuggccgg

SEQ ID NO: 3592660 - RNA, 20 nt, Pseudomonas putida KT2440
cgaggcccgaacuggccggu

SEQ ID NO: 3592661 - RNA, 16 nt, Pseudomonas putida KT2440
cgaggccgggcagagu

SEQ ID NO: 3592662 - RNA, 16 nt, Pseudomonas putida KT2440
cgaggcgaauggcagg

SEQ ID NO: 3592663 - RNA, 22 nt, Pseudomonas putida KT2440
cgaggcgacgaucaucgcgccg

SEQ ID NO: 3592664 - RNA, 20 nt, Pseudomonas putida KT2440
cgaggcggcugucgcagaag

SEQ ID NO: 3592665 - RNA, 15 nt, Pseudomonas putida KT2440
cgaggcgggccgcag

SEQ ID NO: 3592666 - RNA, 14 nt, Pseudomonas putida KT2440
cgaggcguuggcca

SEQ ID NO: 3592667 - RNA, 11 nt, Pseudomonas putida KT2440
cgagggcauca

SEQ ID NO: 3592668 - RNA, 17 nt, Pseudomonas putida KT2440
cgagggcaucagcgcac

SEQ ID NO: 3592669 - RNA, 16 nt, Pseudomonas putida KT2440
cgagggcaugggccac

SEQ ID NO: 3592670 - RNA, 19 nt, Pseudomonas putida KT2440
cgaggggacgaucugcagc

SEQ ID NO: 3592671 - RNA, 17 nt, Pseudomonas putida KT2440
cgagggugaacccaccg

SEQ ID NO: 3592672 - RNA, 19 nt, Pseudomonas putida KT2440
cgaggguuccaggccacgg

SEQ ID NO: 3592673 - RNA, 20 nt, Pseudomonas putida KT2440
cgagguagcugucggucagc

SEQ ID NO: 3592674 - RNA, 15 nt, Pseudomonas putida KT2440
cgaggucagguagcu

SEQ ID NO: 3592675 - RNA, 20 nt, Pseudomonas putida KT2440
cgagguggucgaggcaaaga

SEQ ID NO: 3592676 - RNA, 19 nt, Pseudomonas putida KT2440
cgagguguacgcgaaggcg

SEQ ID NO: 3592677 - RNA, 11 nt, Pseudomonas putida KT2440
cgagguuuugc

SEQ ID NO: 3592678 - RNA, 15 nt, Pseudomonas putida KT2440
cgaguaacccuggca

SEQ ID NO: 3592679 - RNA, 20 nt, Pseudomonas putida KT2440
cgaguaccgucggcacgagc

SEQ ID NO: 3592680 - RNA, 19 nt, Pseudomonas putida KT2440
cgaguagaucaucagcgcc

SEQ ID NO: 3592681 - RNA, 21 nt, Pseudomonas putida KT2440
cgaguagaucaucagcgccag

SEQ ID NO: 3592682 - RNA, 15 nt, Pseudomonas putida KT2440
cgaguauccuccagc

SEQ ID NO: 3592683 - RNA, 16 nt, Pseudomonas putida KT2440
cgaguaucgccucgau

SEQ ID NO: 3592684 - RNA, 13 nt, Pseudomonas putida KT2440
cgagucagggcuu

SEQ ID NO: 3592685 - RNA, 13 nt, Pseudomonas putida KT2440
cgaguccugccuu

SEQ ID NO: 3592686 - RNA, 17 nt, Pseudomonas putida KT2440
cgaguccugccuuccac

SEQ ID NO: 3592687 - RNA, 23 nt, Pseudomonas putida KT2440
cgagugccaacaaucucggucug

SEQ ID NO: 3592688 - RNA, 23 nt, Pseudomonas putida KT2440
cgagugcguagccuucagcggcc

SEQ ID NO: 3592689 - RNA, 12 nt, Pseudomonas putida KT2440
cgagugcucgaa

SEQ ID NO: 3592690 - RNA, 20 nt, Pseudomonas putida KT2440
cgaguucaggcgcccugcgc

SEQ ID NO: 3592691 - RNA, 13 nt, Pseudomonas putida KT2440
cgaguuuccggca

SEQ ID NO: 3592692 - RNA, 17 nt, Pseudomonas putida KT2440
cgaguuuccggcaaaga

SEQ ID NO: 3592693 - RNA, 22 nt, Pseudomonas putida KT2440
cgauaaaccagcagcgccugca

SEQ ID NO: 3592694 - RNA, 22 nt, Pseudomonas putida KT2440
cgauaaggaacuugucgacgau

SEQ ID NO: 3592695 - RNA, 14 nt, Pseudomonas putida KT2440
cgauacccaauaaa

SEQ ID NO: 3592696 - RNA, 13 nt, Pseudomonas putida KT2440
cgauacccagcca

SEQ ID NO: 3592697 - RNA, 14 nt, Pseudomonas putida KT2440
cgauacccaggcgc

SEQ ID NO: 3592698 - RNA, 20 nt, Pseudomonas putida KT2440
cgauaccccgcugccugcgc

SEQ ID NO: 3592699 - RNA, 15 nt, Pseudomonas putida KT2440
cgauaccgccaucga

SEQ ID NO: 3592700 - RNA, 18 nt, Pseudomonas putida KT2440
cgauaccuggguccaggc

SEQ ID NO: 3592701 - RNA, 18 nt, Pseudomonas putida KT2440
cgauacggaaagcccccg

SEQ ID NO: 3592702 - RNA, 20 nt, Pseudomonas putida KT2440
cgauacggucuuuuccccuu

SEQ ID NO: 3592703 - RNA, 18 nt, Pseudomonas putida KT2440
cgauacucacccgcuugc

SEQ ID NO: 3592704 - RNA, 20 nt, Pseudomonas putida KT2440
cgauacucacccgcuugcca

SEQ ID NO: 3592705 - RNA, 18 nt, Pseudomonas putida KT2440
cgauacuugcagcggauu

SEQ ID NO: 3592706 - RNA, 23 nt, Pseudomonas putida KT2440
cgauagacaaaaaaaucggccgc

SEQ ID NO: 3592707 - RNA, 17 nt, Pseudomonas putida KT2440
cgauagccagcuggcca

SEQ ID NO: 3592708 - RNA, 18 nt, Pseudomonas putida KT2440
cgauagccagcuggccac

SEQ ID NO: 3592709 - RNA, 23 nt, Pseudomonas putida KT2440
cgauagcgugaagcggccaccug

SEQ ID NO: 3592710 - RNA, 20 nt, Pseudomonas putida KT2440
cgauagggaacagggcagac

SEQ ID NO: 3592711 - RNA, 16 nt, Pseudomonas putida KT2440
cgauagggcgguggca

SEQ ID NO: 3592712 - RNA, 21 nt, Pseudomonas putida KT2440
cgauaguggcguuuuucacac

SEQ ID NO: 3592713 - RNA, 18 nt, Pseudomonas putida KT2440
cgauaucagguugacgca

SEQ ID NO: 3592714 - RNA, 21 nt, Pseudomonas putida KT2440
cgauaugcccgucaucgaucc

SEQ ID NO: 3592715 - RNA, 21 nt, Pseudomonas putida KT2440
cgauaugccgccguucaggcg

SEQ ID NO: 3592716 - RNA, 22 nt, Pseudomonas putida KT2440
cgauauguggggcgugcucggc

SEQ ID NO: 3592717 - RNA, 17 nt, Pseudomonas putida KT2440
cgaucaaaacucugcag

SEQ ID NO: 3592718 - RNA, 15 nt, Pseudomonas putida KT2440
cgaucaaugggccga

SEQ ID NO: 3592719 - RNA, 19 nt, Pseudomonas putida KT2440
cgaucaaugggccgaucac

SEQ ID NO: 3592720 - RNA, 16 nt, Pseudomonas putida KT2440
cgaucacaccggcaau

SEQ ID NO: 3592721 - RNA, 21 nt, Pseudomonas putida KT2440
cgaucacauaaggcagcagcu

SEQ ID NO: 3592722 - RNA, 13 nt, Pseudomonas putida KT2440
cgaucaccagccc

SEQ ID NO: 3592723 - RNA, 13 nt, Pseudomonas putida KT2440
cgaucaccugcgg

SEQ ID NO: 3592724 - RNA, 13 nt, Pseudomonas putida KT2440
cgaucaccugggc

SEQ ID NO: 3592725 - RNA, 23 nt, Pseudomonas putida KT2440
cgaucacgaacacaucaccugcu

SEQ ID NO: 3592726 - RNA, 20 nt, Pseudomonas putida KT2440
cgaucacgcaggcccagcag

SEQ ID NO: 3592727 - RNA, 23 nt, Pseudomonas putida KT2440
cgaucacggggcgacgcaucugc

SEQ ID NO: 3592728 - RNA, 19 nt, Pseudomonas putida KT2440
cgaucacgucguacucggc

SEQ ID NO: 3592729 - RNA, 13 nt, Pseudomonas putida KT2440
cgaucacucggca

SEQ ID NO: 3592730 - RNA, 16 nt, Pseudomonas putida KT2440
cgaucacuuccuggcc

SEQ ID NO: 3592731 - RNA, 19 nt, Pseudomonas putida KT2440
cgaucacuuccuggccgcc

SEQ ID NO: 3592732 - RNA, 21 nt, Pseudomonas putida KT2440
cgaucagauaggcgccgugcu

SEQ ID NO: 3592733 - RNA, 17 nt, Pseudomonas putida KT2440
cgaucagcagcaaaggu

SEQ ID NO: 3592734 - RNA, 12 nt, Pseudomonas putida KT2440
cgaucagccaga

SEQ ID NO: 3592735 - RNA, 13 nt, Pseudomonas putida KT2440
cgaucagccguga

SEQ ID NO: 3592736 - RNA, 15 nt, Pseudomonas putida KT2440
cgaucagcgccgaac

SEQ ID NO: 3592737 - RNA, 13 nt, Pseudomonas putida KT2440
cgaucagcgccug

SEQ ID NO: 3592738 - RNA, 15 nt, Pseudomonas putida KT2440
cgaucagcgccugcu

SEQ ID NO: 3592739 - RNA, 15 nt, Pseudomonas putida KT2440
cgaucagcggcgcca

SEQ ID NO: 3592740 - RNA, 20 nt, Pseudomonas putida KT2440
cgaucagcggcgccacccag

SEQ ID NO: 3592741 - RNA, 17 nt, Pseudomonas putida KT2440
cgauggccaccagcacc

SEQ ID NO: 3592742 - RNA, 18 nt, Pseudomonas putida KT2440
cgauggccaccagcaccu

SEQ ID NO: 3592743 - RNA, 14 nt, Pseudomonas putida KT2440
cgauggccaccagg

SEQ ID NO: 3592744 - RNA, 17 nt, Pseudomonas putida KT2440
cgauggccuugaucagg

SEQ ID NO: 3592745 - RNA, 20 nt, Pseudomonas putida KT2440
cgauggccuugaucaggccc

SEQ ID NO: 3592746 - RNA, 14 nt, Pseudomonas putida KT2440
cgaugggcaggcca

SEQ ID NO: 3592747 - RNA, 18 nt, Pseudomonas putida KT2440
cgaugggcaugccgcgca

SEQ ID NO: 3592748 - RNA, 19 nt, Pseudomonas putida KT2440
cgaugggcaugccgcgcac

SEQ ID NO: 3592749 - RNA, 21 nt, Pseudomonas putida KT2440
cgaugggcuguuccagcagcg

SEQ ID NO: 3592750 - RNA, 23 nt, Pseudomonas putida KT2440
cgauggggcugcauugcagcccc

SEQ ID NO: 3592751 - RNA, 20 nt, Pseudomonas putida KT2440
cgaugggugcaaaaccugcc

SEQ ID NO: 3592752 - RNA, 22 nt, Pseudomonas putida KT2440
cgauggucacccgcgaccacag

SEQ ID NO: 3592753 - RNA, 15 nt, Pseudomonas putida KT2440
cgauggugaaggcca

SEQ ID NO: 3592754 - RNA, 22 nt, Pseudomonas putida KT2440
cgauguacaccccgaccaaggc

SEQ ID NO: 3592755 - RNA, 23 nt, Pseudomonas putida KT2440
cgauguacaccccgaccaaggcc

SEQ ID NO: 3592756 - RNA, 22 nt, Pseudomonas putida KT2440
cgauguacucaggggcauugcg

SEQ ID NO: 3592757 - RNA, 17 nt, Pseudomonas putida KT2440
cgauguacuuguucagg

SEQ ID NO: 3592758 - RNA, 23 nt, Pseudomonas putida KT2440
cgauguacuuguucaggaucucg

SEQ ID NO: 3592759 - RNA, 18 nt, Pseudomonas putida KT2440
cgauguaggcagcugccu

SEQ ID NO: 3592760 - RNA, 21 nt, Pseudomonas putida KT2440
cgauguccuugcuggccaccg

SEQ ID NO: 3592761 - RNA, 14 nt, Pseudomonas putida KT2440
cgaugucgauccac

SEQ ID NO: 3592762 - RNA, 16 nt, Pseudomonas putida KT2440
cgaugucgauccacuc

SEQ ID NO: 3592763 - RNA, 16 nt, Pseudomonas putida KT2440
cgaugucggcgugcac

SEQ ID NO: 3592764 - RNA, 21 nt, Pseudomonas putida KT2440
cgaugucguggucgccgucgc

SEQ ID NO: 3592765 - RNA, 23 nt, Pseudomonas putida KT2440
cgaugucugccgcuucguccagg

SEQ ID NO: 3592766 - RNA, 19 nt, Pseudomonas putida KT2440
cgaugucuuccagaccaga

SEQ ID NO: 3592767 - RNA, 14 nt, Pseudomonas putida KT2440
cgaugugcgagccc

SEQ ID NO: 3592768 - RNA, 16 nt, Pseudomonas putida KT2440
cgaugugcgugaacac

SEQ ID NO: 3592769 - RNA, 16 nt, Pseudomonas putida KT2440
cgauguuggucaccac

SEQ ID NO: 3592770 - RNA, 15 nt, Pseudomonas putida KT2440
cgauguugucaaagc

SEQ ID NO: 3592771 - RNA, 21 nt, Pseudomonas putida KT2440
cgauuacaagggccugugccg

SEQ ID NO: 3592772 - RNA, 18 nt, Pseudomonas putida KT2440
cgauuagcuccaccagcg

SEQ ID NO: 3592773 - RNA, 19 nt, Pseudomonas putida KT2440
cgauuagcuccaccagcgg

SEQ ID NO: 3592774 - RNA, 21 nt, Pseudomonas putida KT2440
cgauucaaagccauaccgcau

SEQ ID NO: 3592775 - RNA, 13 nt, Pseudomonas putida KT2440
cgauuccagcagg

SEQ ID NO: 3592776 - RNA, 16 nt, Pseudomonas putida KT2440
cgauuccuugcagcgc

SEQ ID NO: 3592777 - RNA, 15 nt, Pseudomonas putida KT2440
cgauucgccgggccu

SEQ ID NO: 3592778 - RNA, 15 nt, Pseudomonas putida KT2440
cgauucugccagcuc

SEQ ID NO: 3592779 - RNA, 17 nt, Pseudomonas putida KT2440
cgauucugccagcuccu

SEQ ID NO: 3592780 - RNA, 18 nt, Pseudomonas putida KT2440
cgauucugccagcuccug

SEQ ID NO: 3592781 - RNA, 16 nt, Pseudomonas putida KT2440
cgauugaucagcgccu

SEQ ID NO: 3592782 - RNA, 17 nt, Pseudomonas putida KT2440
cgauugaucagcgccuc

SEQ ID NO: 3592783 - RNA, 12 nt, Pseudomonas putida KT2440
cgauugccaggg

SEQ ID NO: 3592784 - RNA, 18 nt, Pseudomonas putida KT2440
cgauugccagggugccag

SEQ ID NO: 3592785 - RNA, 19 nt, Pseudomonas putida KT2440
cgauugccagggugccaga

SEQ ID NO: 3592786 - RNA, 15 nt, Pseudomonas putida KT2440
cgauuggcaguccug

SEQ ID NO: 3592787 - RNA, 21 nt, Pseudomonas putida KT2440
cgauuuccuucuuguuguuca

SEQ ID NO: 3592788 - RNA, 14 nt, Pseudomonas putida KT2440
cgcaaaaaaccgca

SEQ ID NO: 3592789 - RNA, 19 nt, Pseudomonas putida KT2440
cgcaaaaaaccgcacccag

SEQ ID NO: 3592790 - RNA, 14 nt, Pseudomonas putida KT2440
cgcaaaaaacuuca

SEQ ID NO: 3592791 - RNA, 17 nt, Pseudomonas putida KT2440
cgcaaaaaaugugcgca

SEQ ID NO: 3592792 - RNA, 16 nt, Pseudomonas putida KT2440
cgcaaaaccaccagcc

SEQ ID NO: 3592793 - RNA, 15 nt, Pseudomonas putida KT2440
cgcaaagcccugccu

SEQ ID NO: 3592794 - RNA, 17 nt, Pseudomonas putida KT2440
cgcaaagcggccccagc

SEQ ID NO: 3592795 - RNA, 20 nt, Pseudomonas putida KT2440
cgcaaagcggccccaguggc

SEQ ID NO: 3592796 - RNA, 21 nt, Pseudomonas putida KT2440
cgcaaagcggcccccacgccg

SEQ ID NO: 3592797 - RNA, 17 nt, Pseudomonas putida KT2440
cgcaaagcggccccuuc

SEQ ID NO: 3592798 - RNA, 16 nt, Pseudomonas putida KT2440
cgcaaauccccaacca

SEQ ID NO: 3592799 - RNA, 22 nt, Pseudomonas putida KT2440
cgcaaauccuccugcgcaugca

SEQ ID NO: 3592800 - RNA, 15 nt, Pseudomonas putida KT2440
cgcaaaugcuugccc

SEQ ID NO: 3592801 - RNA, 20 nt, Pseudomonas putida KT2440
cgcaaaugcuugcccgccuu

SEQ ID NO: 3592802 - RNA, 17 nt, Pseudomonas putida KT2440
cgcaaaugguuguccac

SEQ ID NO: 3592803 - RNA, 21 nt, Pseudomonas putida KT2440
cgcaacaaccccgucgccuca

SEQ ID NO: 3592804 - RNA, 13 nt, Pseudomonas putida KT2440
cgcaacaaccugg

SEQ ID NO: 3592805 - RNA, 21 nt, Pseudomonas putida KT2440
cgcaacacauuauccaccagg

SEQ ID NO: 3592806 - RNA, 16 nt, Pseudomonas putida KT2440
cgcaacaccaggacaa

SEQ ID NO: 3592807 - RNA, 14 nt, Pseudomonas putida KT2440
cgcaacaccgccau

SEQ ID NO: 3592808 - RNA, 20 nt, Pseudomonas putida KT2440
cgcaacagaucccgcuccuc

SEQ ID NO: 3592809 - RNA, 21 nt, Pseudomonas putida KT2440
cgcaacaugaagccaugggca

SEQ ID NO: 3592810 - RNA, 21 nt, Pseudomonas putida KT2440
cgcaacccagccccagugugc

SEQ ID NO: 3592811 - RNA, 17 nt, Pseudomonas putida KT2440
cgcaaccgggucggcgc

SEQ ID NO: 3592812 - RNA, 17 nt, Pseudomonas putida KT2440
cgcaaccucguugcugg

SEQ ID NO: 3592813 - RNA, 13 nt, Pseudomonas putida KT2440
cgcaaccugggca

SEQ ID NO: 3592814 - RNA, 16 nt, Pseudomonas putida KT2440
cgcaacgaucggcauc

SEQ ID NO: 3592815 - RNA, 16 nt, Pseudomonas putida KT2440
cgcaacgcccgcgcau

SEQ ID NO: 3592816 - RNA, 13 nt, Pseudomonas putida KT2440
cgcaacgcggccc

SEQ ID NO: 3592817 - RNA, 19 nt, Pseudomonas putida KT2440
cgcaacgcggccccggcua

SEQ ID NO: 3592818 - RNA, 14 nt, Pseudomonas putida KT2440
cgcaacgcggcccu

SEQ ID NO: 3592819 - RNA, 15 nt, Pseudomonas putida KT2440
cgcaacgugcgccga

SEQ ID NO: 3592820 - RNA, 12 nt, Pseudomonas putida KT2440
cgcaacucagcg

SEQ ID NO: 3592821 - RNA, 17 nt, Pseudomonas putida KT2440
cgcaacucagcgcagcu

SEQ ID NO: 3592822 - RNA, 19 nt, Pseudomonas putida KT2440
cgcaacucagcgcagcuuc

SEQ ID NO: 3592823 - RNA, 18 nt, Pseudomonas putida KT2440
cgcaagaaggcugcccuc

SEQ ID NO: 3592824 - RNA, 18 nt, Pseudomonas putida KT2440
cgcaagcagucccagcac

SEQ ID NO: 3592825 - RNA, 11 nt, Pseudomonas putida KT2440
cgcaagcccgc

SEQ ID NO: 3592826 - RNA, 17 nt, Pseudomonas putida KT2440
cgcaagccgugccuggg

SEQ ID NO: 3592827 - RNA, 14 nt, Pseudomonas putida KT2440
cgcaagcgccugau

SEQ ID NO: 3592828 - RNA, 12 nt, Pseudomonas putida KT2440
cgcaagcggcuc

SEQ ID NO: 3592829 - RNA, 18 nt, Pseudomonas putida KT2440
cgcaagcguucgagcauc

SEQ ID NO: 3592830 - RNA, 23 nt, Pseudomonas putida KT2440
cgcaagcguucgagcaucggcuc

SEQ ID NO: 3592831 - RNA, 17 nt, Pseudomonas putida KT2440
cgcaagcugcaccgcca

SEQ ID NO: 3592832 - RNA, 13 nt, Pseudomonas putida KT2440
cgcaaggcauuca

SEQ ID NO: 3592833 - RNA, 17 nt, Pseudomonas putida KT2440
cgcaaggccgcggcuga

SEQ ID NO: 3592834 - RNA, 22 nt, Pseudomonas putida KT2440
cgcaaggccgcggcugaacacg

SEQ ID NO: 3592835 - RNA, 16 nt, Pseudomonas putida KT2440
cgcaaggccgcuccca

SEQ ID NO: 3592836 - RNA, 18 nt, Pseudomonas putida KT2440
cgcaaggcggcccaacga

SEQ ID NO: 3592837 - RNA, 23 nt, Pseudomonas putida KT2440
cgcaaggugccaacaggcagcau

SEQ ID NO: 3592838 - RNA, 19 nt, Pseudomonas putida KT2440
cgcaaguucccgugcgccu

SEQ ID NO: 3592839 - RNA, 18 nt, Pseudomonas putida KT2440
cgcaaucaaagcagacag

SEQ ID NO: 3592840 - RNA, 16 nt, Pseudomonas putida KT2440
cgcaauccccuccgcc

SEQ ID NO: 3592841 - RNA, 20 nt, Pseudomonas putida KT2440
cgcaauccgugagccaggag

SEQ ID NO: 3592842 - RNA, 14 nt, Pseudomonas putida KT2440
cgcaauccuugccc

SEQ ID NO: 3592843 - RNA, 15 nt, Pseudomonas putida KT2440
cgcaauccuugcccu

SEQ ID NO: 3592844 - RNA, 15 nt, Pseudomonas putida KT2440
cgcaaucgucgacca

SEQ ID NO: 3592845 - RNA, 18 nt, Pseudomonas putida KT2440
cgcaaucgucguaggcgc

SEQ ID NO: 3592846 - RNA, 13 nt, Pseudomonas putida KT2440
cgcagcagcaccg

SEQ ID NO: 3592847 - RNA, 23 nt, Pseudomonas putida KT2440
cgcagcagcaggcccgccaccgc

SEQ ID NO: 3592848 - RNA, 12 nt, Pseudomonas putida KT2440
cgcagcagcucg

SEQ ID NO: 3592849 - RNA, 18 nt, Pseudomonas putida KT2440
cgcagcaucuuccugcca

SEQ ID NO: 3592850 - RNA, 20 nt, Pseudomonas putida KT2440
cgcagcaucuuccugccacu

SEQ ID NO: 3592851 - RNA, 22 nt, Pseudomonas putida KT2440
cgcagcaucuuccugccacucg

SEQ ID NO: 3592852 - RNA, 20 nt, Pseudomonas putida KT2440
cgcagccaaucggcgccagg

SEQ ID NO: 3592853 - RNA, 13 nt, Pseudomonas putida KT2440
cgcagccaccagc

SEQ ID NO: 3592854 - RNA, 15 nt, Pseudomonas putida KT2440
cgcagccaccagcuu

SEQ ID NO: 3592855 - RNA, 22 nt, Pseudomonas putida KT2440
cgcagccaggauuuucagcgcg

SEQ ID NO: 3592856 - RNA, 18 nt, Pseudomonas putida KT2440
cgcagccauaguuuugug

SEQ ID NO: 3592857 - RNA, 13 nt, Pseudomonas putida KT2440
cgcagcccacggc

SEQ ID NO: 3592858 - RNA, 16 nt, Pseudomonas putida KT2440
cgcagccccaccucgg

SEQ ID NO: 3592859 - RNA, 12 nt, Pseudomonas putida KT2440
cgcagccccagc

SEQ ID NO: 3592860 - RNA, 11 nt, Pseudomonas putida KT2440
cgcagccccgc

SEQ ID NO: 3592861 - RNA, 16 nt, Pseudomonas putida KT2440
cgcagccccgccgccc

SEQ ID NO: 3592862 - RNA, 18 nt, Pseudomonas putida KT2440
cgcagccccgccgccccc

SEQ ID NO: 3592863 - RNA, 11 nt, Pseudomonas putida KT2440
cgcagcccugu

SEQ ID NO: 3592864 - RNA, 19 nt, Pseudomonas putida KT2440
cgcagcccugucacgacag

SEQ ID NO: 3592865 - RNA, 16 nt, Pseudomonas putida KT2440
cgcagccggcaccgcc

SEQ ID NO: 3592866 - RNA, 21 nt, Pseudomonas putida KT2440
cgcagccggcaccgccauggu

SEQ ID NO: 3592867 - RNA, 14 nt, Pseudomonas putida KT2440
cgcagccggccuug

SEQ ID NO: 3592868 - RNA, 21 nt, Pseudomonas putida KT2440
cgcagccucuucggccagcaa

SEQ ID NO: 3592869 - RNA, 17 nt, Pseudomonas putida KT2440
cgcagccuugucucuga

SEQ ID NO: 3592870 - RNA, 14 nt, Pseudomonas putida KT2440
cgcagccuugugcu

SEQ ID NO: 3592871 - RNA, 17 nt, Pseudomonas putida KT2440
cgcagccuugugcugcg

SEQ ID NO: 3592872 - RNA, 21 nt, Pseudomonas putida KT2440
cgcagcgcaaaaaacgccgca

SEQ ID NO: 3592873 - RNA, 19 nt, Pseudomonas putida KT2440
cgcagcgcaugcucgcggg

SEQ ID NO: 3592874 - RNA, 14 nt, Pseudomonas putida KT2440
cgcagcgccgccaa

SEQ ID NO: 3592875 - RNA, 13 nt, Pseudomonas putida KT2440
cgcagcgcgugcu

SEQ ID NO: 3592876 - RNA, 21 nt, Pseudomonas putida KT2440
cgcagcggggauucaacagcg

SEQ ID NO: 3592877 - RNA, 19 nt, Pseudomonas putida KT2440
cgcagcguaauagcuggug

SEQ ID NO: 3592878 - RNA, 20 nt, Pseudomonas putida KT2440
cgcagcguaauagcugguga

SEQ ID NO: 3592879 - RNA, 22 nt, Pseudomonas putida KT2440
cgcagcugcggucgagcugccc

SEQ ID NO: 3592880 - RNA, 17 nt, Pseudomonas putida KT2440
cgcagcuuccgccacca

SEQ ID NO: 3592881 - RNA, 19 nt, Pseudomonas putida KT2440
cgcagcuuccgccaccacg

SEQ ID NO: 3592882 - RNA, 21 nt, Pseudomonas putida KT2440
cgcaggaacaggcugaugcgc

SEQ ID NO: 3592883 - RNA, 14 nt, Pseudomonas putida KT2440
cgcaggaaggugcc

SEQ ID NO: 3592884 - RNA, 15 nt, Pseudomonas putida KT2440
cgcaggaaggugcca

SEQ ID NO: 3592885 - RNA, 17 nt, Pseudomonas putida KT2440
cgcaggauauccacacc

SEQ ID NO: 3592886 - RNA, 22 nt, Pseudomonas putida KT2440
cgcaggauauccacacccgcca

SEQ ID NO: 3592887 - RNA, 19 nt, Pseudomonas putida KT2440
cgcaggaucaugugcgcca

SEQ ID NO: 3592888 - RNA, 21 nt, Pseudomonas putida KT2440
cgcaggaucaugugcgccacu

SEQ ID NO: 3592889 - RNA, 15 nt, Pseudomonas putida KT2440
cgcaggcaccgcacc

SEQ ID NO: 3592890 - RNA, 22 nt, Pseudomonas putida KT2440
cgcaggcagcucgauguacaac

SEQ ID NO: 3592891 - RNA, 17 nt, Pseudomonas putida KT2440
cgcaggcauacaggacc

SEQ ID NO: 3592892 - RNA, 14 nt, Pseudomonas putida KT2440
cgcaggccacggua

SEQ ID NO: 3592893 - RNA, 21 nt, Pseudomonas putida KT2440
cgcaggccacgguaggccuug

SEQ ID NO: 3592894 - RNA, 16 nt, Pseudomonas putida KT2440
cgcaggccagcgcaca

SEQ ID NO: 3592895 - RNA, 12 nt, Pseudomonas putida KT2440
cgcaggccgaca

SEQ ID NO: 3592896 - RNA, 23 nt, Pseudomonas putida KT2440
cgcaggccgcagccucuucggcc

SEQ ID NO: 3592897 - RNA, 13 nt, Pseudomonas putida KT2440
cgcaggccgccgg

SEQ ID NO: 3592898 - RNA, 15 nt, Pseudomonas putida KT2440
cgcaggccgcuggcc

SEQ ID NO: 3592899 - RNA, 14 nt, Pseudomonas putida KT2440
cgcaggcgcaggug

SEQ ID NO: 3592900 - RNA, 12 nt, Pseudomonas putida KT2440
cgcaggcgcccc

SEQ ID NO: 3592901 - RNA, 16 nt, Pseudomonas putida KT2440
cgcaggcgccgccagc

SEQ ID NO: 3592902 - RNA, 18 nt, Pseudomonas putida KT2440
cgcaggcgccgccagcug

SEQ ID NO: 3592903 - RNA, 15 nt, Pseudomonas putida KT2440
cgcaggcggcugacc

SEQ ID NO: 3592904 - RNA, 16 nt, Pseudomonas putida KT2440
cgcaggcgguucaaau

SEQ ID NO: 3592905 - RNA, 18 nt, Pseudomonas putida KT2440
cgcaggcgguuggccaug

SEQ ID NO: 3592906 - RNA, 21 nt, Pseudomonas putida KT2440
cgcaggcuaugccggucagca

SEQ ID NO: 3592907 - RNA, 15 nt, Pseudomonas putida KT2440
cgcaggcuccaaagc

SEQ ID NO: 3592908 - RNA, 16 nt, Pseudomonas putida KT2440
cgcaggcuccaaagcc

SEQ ID NO: 3592909 - RNA, 19 nt, Pseudomonas putida KT2440
cgcaggcucuccacgucca

SEQ ID NO: 3592910 - RNA, 18 nt, Pseudomonas putida KT2440
cgcaggcucugcgccagc

SEQ ID NO: 3592911 - RNA, 19 nt, Pseudomonas putida KT2440
cgcaggcucugcgccagca

SEQ ID NO: 3592912 - RNA, 19 nt, Pseudomonas putida KT2440
cgcaggcugucgaacaggc

SEQ ID NO: 3592913 - RNA, 20 nt, Pseudomonas putida KT2440
cgcagggaagguggccggca

SEQ ID NO: 3592914 - RNA, 21 nt, Pseudomonas putida KT2440
cgcagggaagguggccggcaa

SEQ ID NO: 3592915 - RNA, 22 nt, Pseudomonas putida KT2440
cgcagggcccccgauuccaagg

SEQ ID NO: 3592916 - RNA, 23 nt, Pseudomonas putida KT2440
cgcagggcccccgauuccaaggu

SEQ ID NO: 3592917 - RNA, 16 nt, Pseudomonas putida KT2440
cgcagggccucguuga

SEQ ID NO: 3592918 - RNA, 20 nt, Pseudomonas putida KT2440
cgcaggggcugcgcaaggcg

SEQ ID NO: 3592919 - RNA, 15 nt, Pseudomonas putida KT2440
cgcaggguagccccg

SEQ ID NO: 3592920 - RNA, 18 nt, Pseudomonas putida KT2440
cgcagggucgcgccccaa

SEQ ID NO: 3592921 - RNA, 20 nt, Pseudomonas putida KT2440
cgcagggucgcgccccaagc

SEQ ID NO: 3592922 - RNA, 13 nt, Pseudomonas putida KT2440
cgcaggguggcgc

SEQ ID NO: 3592923 - RNA, 18 nt, Pseudomonas putida KT2440
cgcaggguggcgcugacc

SEQ ID NO: 3592924 - RNA, 14 nt, Pseudomonas putida KT2440
cgcagggugucggu

SEQ ID NO: 3592925 - RNA, 15 nt, Pseudomonas putida KT2440
cgcagggugugcugc

SEQ ID NO: 3592926 - RNA, 17 nt, Pseudomonas putida KT2440
cgcagggugugcugcug

SEQ ID NO: 3592927 - RNA, 18 nt, Pseudomonas putida KT2440
cgcagguaaucggccugu

SEQ ID NO: 3592928 - RNA, 22 nt, Pseudomonas putida KT2440
cgcagguacgccaugugcgccc

SEQ ID NO: 3592929 - RNA, 16 nt, Pseudomonas putida KT2440
cgcagguagucgaagu

SEQ ID NO: 3592930 - RNA, 13 nt, Pseudomonas putida KT2440
cgcaggucggggc

SEQ ID NO: 3592931 - RNA, 18 nt, Pseudomonas putida KT2440
cgcaggucuugcccacuu

SEQ ID NO: 3592932 - RNA, 18 nt, Pseudomonas putida KT2440
cgcaggugcagccagccc

SEQ ID NO: 3592933 - RNA, 13 nt, Pseudomonas putida KT2440
cgcaggugcaggc

SEQ ID NO: 3592934 - RNA, 14 nt, Pseudomonas putida KT2440
cgcaggugcgcacg

SEQ ID NO: 3592935 - RNA, 17 nt, Pseudomonas putida KT2440
cgcagguuguucggcag

SEQ ID NO: 3592936 - RNA, 19 nt, Pseudomonas putida KT2440
cgcagguuguucggcaggc

SEQ ID NO: 3592937 - RNA, 22 nt, Pseudomonas putida KT2440
cgcagguuguucggcaggcucu

SEQ ID NO: 3592938 - RNA, 23 nt, Pseudomonas putida KT2440
cgcagguuguucggcaggcucug

SEQ ID NO: 3592939 - RNA, 16 nt, Pseudomonas putida KT2440
cgcaguaacaggcgca

SEQ ID NO: 3592940 - RNA, 14 nt, Pseudomonas putida KT2440
cgcaguacaggcug

SEQ ID NO: 3592941 - RNA, 13 nt, Pseudomonas putida KT2440
cgcagucaccaca

SEQ ID NO: 3592942 - RNA, 20 nt, Pseudomonas putida KT2440
cgcagucaccacacggcagc

SEQ ID NO: 3592943 - RNA, 20 nt, Pseudomonas putida KT2440
cgcagucccguuggcccgcc

SEQ ID NO: 3592944 - RNA, 23 nt, Pseudomonas putida KT2440
cgcagucccguuggcccgccagu

SEQ ID NO: 3592945 - RNA, 15 nt, Pseudomonas putida KT2440
cgcagugcagccgcg

SEQ ID NO: 3592946 - RNA, 22 nt, Pseudomonas putida KT2440
cgcagugccgugaguggccucg

SEQ ID NO: 3592947 - RNA, 20 nt, Pseudomonas putida KT2440
cgcaguggucauagucaccg

SEQ ID NO: 3592948 - RNA, 14 nt, Pseudomonas putida KT2440
cgcaguucguccag

SEQ ID NO: 3592949 - RNA, 21 nt, Pseudomonas putida KT2440
cgcaucaacgccucgcugccu

SEQ ID NO: 3592950 - RNA, 22 nt, Pseudomonas putida KT2440
cgcaucaacguucccaauguca

SEQ ID NO: 3592951 - RNA, 13 nt, Pseudomonas putida KT2440
cgccaccaugcuc

SEQ ID NO: 3592952 - RNA, 20 nt, Pseudomonas putida KT2440
cgccaccaugcucggccagc

SEQ ID NO: 3592953 - RNA, 21 nt, Pseudomonas putida KT2440
cgccaccaugcucggccagcu

SEQ ID NO: 3592954 - RNA, 19 nt, Pseudomonas putida KT2440
cgccacccaccacggccug

SEQ ID NO: 3592955 - RNA, 15 nt, Pseudomonas putida KT2440
cgccacccaggcaua

SEQ ID NO: 3592956 - RNA, 13 nt, Pseudomonas putida KT2440
cgccaccccaggc

SEQ ID NO: 3592957 - RNA, 16 nt, Pseudomonas putida KT2440
cgccaccccaggccac

SEQ ID NO: 3592958 - RNA, 15 nt, Pseudomonas putida KT2440
cgccacccccgccgc

SEQ ID NO: 3592959 - RNA, 20 nt, Pseudomonas putida KT2440
cgccacccccgccgccaggg

SEQ ID NO: 3592960 - RNA, 17 nt, Pseudomonas putida KT2440
cgccaccccggcuugcu

SEQ ID NO: 3592961 - RNA, 15 nt, Pseudomonas putida KT2440
cgccacccucgcacc

SEQ ID NO: 3592962 - RNA, 14 nt, Pseudomonas putida KT2440
cgccaccgaaggcg

SEQ ID NO: 3592963 - RNA, 22 nt, Pseudomonas putida KT2440
cgccaccgacuccggcaaggca

SEQ ID NO: 3592964 - RNA, 19 nt, Pseudomonas putida KT2440
cgccaccgaucucgccagc

SEQ ID NO: 3592965 - RNA, 12 nt, Pseudomonas putida KT2440
cgccaccgccgu

SEQ ID NO: 3592966 - RNA, 14 nt, Pseudomonas putida KT2440
cgccaccgccgugc

SEQ ID NO: 3592967 - RNA, 15 nt, Pseudomonas putida KT2440
cgccaccgcgcgcca

SEQ ID NO: 3592968 - RNA, 14 nt, Pseudomonas putida KT2440
cgccaccgcgcggu

SEQ ID NO: 3592969 - RNA, 14 nt, Pseudomonas putida KT2440
cgccaccggcagca

SEQ ID NO: 3592970 - RNA, 18 nt, Pseudomonas putida KT2440
cgccaccggcauucccgg

SEQ ID NO: 3592971 - RNA, 19 nt, Pseudomonas putida KT2440
cgccaccggcauucccggc

SEQ ID NO: 3592972 - RNA, 18 nt, Pseudomonas putida KT2440
cgccaccggucgccugua

SEQ ID NO: 3592973 - RNA, 23 nt, Pseudomonas putida KT2440
cgccaccugccacacacccgggc

SEQ ID NO: 3592974 - RNA, 15 nt, Pseudomonas putida KT2440
cgccaccuucgccag

SEQ ID NO: 3592975 - RNA, 21 nt, Pseudomonas putida KT2440
cgccaccuuguucgagcgcca

SEQ ID NO: 3592976 - RNA, 24 nt, Pseudomonas putida KT2440
cgccaccuuguucgagcgccauga

SEQ ID NO: 3592977 - RNA, 21 nt, Pseudomonas putida KT2440
cgccacgcaccagggcuggca

SEQ ID NO: 3592978 - RNA, 19 nt, Pseudomonas putida KT2440
cgccacgcccaacccagcc

SEQ ID NO: 3592979 - RNA, 19 nt, Pseudomonas putida KT2440
cgccacgcccauggcucca

SEQ ID NO: 3592980 - RNA, 13 nt, Pseudomonas putida KT2440
cgccacgccgcca

SEQ ID NO: 3592981 - RNA, 14 nt, Pseudomonas putida KT2440
cgccacgccgccag

SEQ ID NO: 3592982 - RNA, 15 nt, Pseudomonas putida KT2440
cgccacgccgccaga

SEQ ID NO: 3592983 - RNA, 23 nt, Pseudomonas putida KT2440
cgccacgccggucgggcacuugu

SEQ ID NO: 3592984 - RNA, 19 nt, Pseudomonas putida KT2440
cgccacgccugcagucgau

SEQ ID NO: 3592985 - RNA, 18 nt, Pseudomonas putida KT2440
cgccacgcgggcuaugcg

SEQ ID NO: 3592986 - RNA, 14 nt, Pseudomonas putida KT2440
cgccacggccaccu

SEQ ID NO: 3592987 - RNA, 16 nt, Pseudomonas putida KT2440
cgccacggccaccuug

SEQ ID NO: 3592988 - RNA, 16 nt, Pseudomonas putida KT2440
cgccacggcgcugacc

SEQ ID NO: 3592989 - RNA, 15 nt, Pseudomonas putida KT2440
cgccacggcggcauc

SEQ ID NO: 3592990 - RNA, 23 nt, Pseudomonas putida KT2440
cgccacggcggcauccaggcggg

SEQ ID NO: 3592991 - RNA, 16 nt, Pseudomonas putida KT2440
cgccacgggcgugacc

SEQ ID NO: 3592992 - RNA, 22 nt, Pseudomonas putida KT2440
cgccacgggcgugaccguagcg

SEQ ID NO: 3592993 - RNA, 20 nt, Pseudomonas putida KT2440
cgccacgguacgggcaaagc

SEQ ID NO: 3592994 - RNA, 21 nt, Pseudomonas putida KT2440
cgccacgguacgggcaaagcc

SEQ ID NO: 3592995 - RNA, 16 nt, Pseudomonas putida KT2440
cgccacggugccgaac

SEQ ID NO: 3592996 - RNA, 21 nt, Pseudomonas putida KT2440
cgccacuaccguauucgcggg

SEQ ID NO: 3592997 - RNA, 16 nt, Pseudomonas putida KT2440
cgccacugaccagccc

SEQ ID NO: 3592998 - RNA, 17 nt, Pseudomonas putida KT2440
cgccacugaccagcccg

SEQ ID NO: 3592999 - RNA, 22 nt, Pseudomonas putida KT2440
cgccacuggcgacuucggcgau

SEQ ID NO: 3593000 - RNA, 19 nt, Pseudomonas putida KT2440
cgccacuucccguucgcgg

SEQ ID NO: 3593001 - RNA, 17 nt, Pseudomonas putida KT2440
cgccagaagcguaccgc

SEQ ID NO: 3593002 - RNA, 21 nt, Pseudomonas putida KT2440
cgccagaagcguaccgccagu

SEQ ID NO: 3593003 - RNA, 19 nt, Pseudomonas putida KT2440
cgccagaagguaucggcca

SEQ ID NO: 3593004 - RNA, 17 nt, Pseudomonas putida KT2440
cgccagacaacuggcca

SEQ ID NO: 3593005 - RNA, 20 nt, Pseudomonas putida KT2440
cgccagacaacuggccaggg

SEQ ID NO: 3593006 - RNA, 21 nt, Pseudomonas putida KT2440
cgccagacaacuggccagggu

SEQ ID NO: 3593007 - RNA, 21 nt, Pseudomonas putida KT2440
cgccagacgcgcgcuggcucg

SEQ ID NO: 3593008 - RNA, 16 nt, Pseudomonas putida KT2440
cgccagagcauggcca

SEQ ID NO: 3593009 - RNA, 20 nt, Pseudomonas putida KT2440
cgccagcaagcgcauaggca

SEQ ID NO: 3593010 - RNA, 21 nt, Pseudomonas putida KT2440
cgccagcaaugcccgcucgcu

SEQ ID NO: 3593011 - RNA, 18 nt, Pseudomonas putida KT2440
cgccagcaauugcgaggu

SEQ ID NO: 3593012 - RNA, 19 nt, Pseudomonas putida KT2440
cgccagcacgcaggccagc

SEQ ID NO: 3593013 - RNA, 14 nt, Pseudomonas putida KT2440
cgccagcagcgcuc

SEQ ID NO: 3593014 - RNA, 14 nt, Pseudomonas putida KT2440
cgccagcagcuggu

SEQ ID NO: 3593015 - RNA, 15 nt, Pseudomonas putida KT2440
cgccagcagcugguc

SEQ ID NO: 3593016 - RNA, 19 nt, Pseudomonas putida KT2440
cgccagcaggccaccggca

SEQ ID NO: 3593017 - RNA, 22 nt, Pseudomonas putida KT2440
cgccagcaggccaccggcagca

SEQ ID NO: 3593018 - RNA, 15 nt, Pseudomonas putida KT2440
cgccagcaggccgcc

SEQ ID NO: 3593019 - RNA, 20 nt, Pseudomonas putida KT2440
cgccagcagugcaucgaagc

SEQ ID NO: 3593020 - RNA, 15 nt, Pseudomonas putida KT2440
cgccagcaucacccu

SEQ ID NO: 3593021 - RNA, 16 nt, Pseudomonas putida KT2440
cgccagcaucacccuc

SEQ ID NO: 3593022 - RNA, 19 nt, Pseudomonas putida KT2440
cgccagcaucacgccgcgc

SEQ ID NO: 3593023 - RNA, 13 nt, Pseudomonas putida KT2440
cgccagcauggcc

SEQ ID NO: 3593024 - RNA, 14 nt, Pseudomonas putida KT2440
cgccagcauggccg

SEQ ID NO: 3593025 - RNA, 19 nt, Pseudomonas putida KT2440
cgccagccaaccgcgugcu

SEQ ID NO: 3593026 - RNA, 13 nt, Pseudomonas putida KT2440
cgccagccccagc

SEQ ID NO: 3593027 - RNA, 15 nt, Pseudomonas putida KT2440
cgccagccgccacga

SEQ ID NO: 3593028 - RNA, 13 nt, Pseudomonas putida KT2440
cgccagccgcggg

SEQ ID NO: 3593029 - RNA, 17 nt, Pseudomonas putida KT2440
cgccagccgcucagcca

SEQ ID NO: 3593030 - RNA, 24 nt, Pseudomonas putida KT2440
cgccagccgcucagccaccugugg

SEQ ID NO: 3593031 - RNA, 14 nt, Pseudomonas putida KT2440
cgccagccugcagc

SEQ ID NO: 3593032 - RNA, 15 nt, Pseudomonas putida KT2440
cgccagccugcagcg

SEQ ID NO: 3593033 - RNA, 14 nt, Pseudomonas putida KT2440
cgccagcgaugcug

SEQ ID NO: 3593034 - RNA, 14 nt, Pseudomonas putida KT2440
cgccagcgcaugca

SEQ ID NO: 3593035 - RNA, 15 nt, Pseudomonas putida KT2440
cgccagcgcuccagc

SEQ ID NO: 3593036 - RNA, 23 nt, Pseudomonas putida KT2440
cgccagcggcaaacacacccucg

SEQ ID NO: 3593037 - RNA, 13 nt, Pseudomonas putida KT2440
cgccagcggcagu

SEQ ID NO: 3593038 - RNA, 23 nt, Pseudomonas putida KT2440
cgccagcggcaguugcaggcgca

SEQ ID NO: 3593039 - RNA, 19 nt, Pseudomonas putida KT2440
cgccagcggccagcgccug

SEQ ID NO: 3593040 - RNA, 16 nt, Pseudomonas putida KT2440
cgccagcggcucgacc

SEQ ID NO: 3593041 - RNA, 15 nt, Pseudomonas putida KT2440
cgccagcggcucgau

SEQ ID NO: 3593042 - RNA, 18 nt, Pseudomonas putida KT2440
cgccagcgugcccgccac

SEQ ID NO: 3593043 - RNA, 13 nt, Pseudomonas putida KT2440
cgccagcuccaca

SEQ ID NO: 3593044 - RNA, 22 nt, Pseudomonas putida KT2440
cgccagcuccacacucgacgcu

SEQ ID NO: 3593045 - RNA, 12 nt, Pseudomonas putida KT2440
cgccagcugcug

SEQ ID NO: 3593046 - RNA, 22 nt, Pseudomonas putida KT2440
cgccagcugcugccccaugcga

SEQ ID NO: 3593047 - RNA, 22 nt, Pseudomonas putida KT2440
cgccaggaagucgauguucagc

SEQ ID NO: 3593048 - RNA, 15 nt, Pseudomonas putida KT2440
cgccaggaguucugc

SEQ ID NO: 3593049 - RNA, 19 nt, Pseudomonas putida KT2440
cgccaggaguucugcacag

SEQ ID NO: 3593050 - RNA, 20 nt, Pseudomonas putida KT2440
cgccaggaguucugcacagc

SEQ ID NO: 3593051 - RNA, 15 nt, Pseudomonas putida KT2440
cgccaggaucaacug

SEQ ID NO: 3593052 - RNA, 17 nt, Pseudomonas putida KT2440
cgccaggaucaccucgg

SEQ ID NO: 3593053 - RNA, 14 nt, Pseudomonas putida KT2440
cgccaggaucggca

SEQ ID NO: 3593054 - RNA, 14 nt, Pseudomonas putida KT2440
cgccaggauggcac

SEQ ID NO: 3593055 - RNA, 15 nt, Pseudomonas putida KT2440
cgccaggauggcacc

SEQ ID NO: 3593056 - RNA, 14 nt, Pseudomonas putida KT2440
cgcccagaaucuca

SEQ ID NO: 3593057 - RNA, 22 nt, Pseudomonas putida KT2440
cgcccagaaucucaaccaccuc

SEQ ID NO: 3593058 - RNA, 14 nt, Pseudomonas putida KT2440
cgcccagaucagca

SEQ ID NO: 3593059 - RNA, 17 nt, Pseudomonas putida KT2440
cgcccagaucagcagca

SEQ ID NO: 3593060 - RNA, 21 nt, Pseudomonas putida KT2440
cgcccagaucagcagcaccga

SEQ ID NO: 3593061 - RNA, 23 nt, Pseudomonas putida KT2440
cgcccagaucagcagcaccgagg

SEQ ID NO: 3593062 - RNA, 14 nt, Pseudomonas putida KT2440
cgcccagaugaguu

SEQ ID NO: 3593063 - RNA, 21 nt, Pseudomonas putida KT2440
cgcccagcaacaugccggccc

SEQ ID NO: 3593064 - RNA, 15 nt, Pseudomonas putida KT2440
cgcccagcaacugcg

SEQ ID NO: 3593065 - RNA, 11 nt, Pseudomonas putida KT2440
cgcccagcagc

SEQ ID NO: 3593066 - RNA, 17 nt, Pseudomonas putida KT2440
cgcccagcagcaacgca

SEQ ID NO: 3593067 - RNA, 16 nt, Pseudomonas putida KT2440
cgcccagcagccaacg

SEQ ID NO: 3593068 - RNA, 14 nt, Pseudomonas putida KT2440
cgcccagcccauga

SEQ ID NO: 3593069 - RNA, 18 nt, Pseudomonas putida KT2440
cgcccagcuggagacgaa

SEQ ID NO: 3593070 - RNA, 15 nt, Pseudomonas putida KT2440
cgcccagcuggcuca

SEQ ID NO: 3593071 - RNA, 24 nt, Pseudomonas putida KT2440
cgcccagcuucuccagcaagcgcu

SEQ ID NO: 3593072 - RNA, 18 nt, Pseudomonas putida KT2440
cgcccaggcgcaucacga

SEQ ID NO: 3593073 - RNA, 16 nt, Pseudomonas putida KT2440
cgcccaggucaaucuu

SEQ ID NO: 3593074 - RNA, 19 nt, Pseudomonas putida KT2440
cgcccaggucaaucuugug

SEQ ID NO: 3593075 - RNA, 22 nt, Pseudomonas putida KT2440
cgcccagguuacgcagaauauu

SEQ ID NO: 3593076 - RNA, 18 nt, Pseudomonas putida KT2440
cgcccagguuauacgccg

SEQ ID NO: 3593077 - RNA, 19 nt, Pseudomonas putida KT2440
cgcccagguuauacgccgc

SEQ ID NO: 3593078 - RNA, 20 nt, Pseudomonas putida KT2440
cgcccaguagcgccaccauc

SEQ ID NO: 3593079 - RNA, 12 nt, Pseudomonas putida KT2440
cgcccagugccu

SEQ ID NO: 3593080 - RNA, 16 nt, Pseudomonas putida KT2440
cgcccagugccugacc

SEQ ID NO: 3593081 - RNA, 14 nt, Pseudomonas putida KT2440
cgcccagugcgcgc

SEQ ID NO: 3593082 - RNA, 23 nt, Pseudomonas putida KT2440
cgcccaguggcacaccaugggca

SEQ ID NO: 3593083 - RNA, 13 nt, Pseudomonas putida KT2440
cgcccauaccgcc

SEQ ID NO: 3593084 - RNA, 16 nt, Pseudomonas putida KT2440
cgcccaucaccggcac

SEQ ID NO: 3593085 - RNA, 20 nt, Pseudomonas putida KT2440
cgcccaucaccggcaccggg

SEQ ID NO: 3593086 - RNA, 15 nt, Pseudomonas putida KT2440
cgcccaucucaggcc

SEQ ID NO: 3593087 - RNA, 16 nt, Pseudomonas putida KT2440
cgcccaucucaggccc

SEQ ID NO: 3593088 - RNA, 20 nt, Pseudomonas putida KT2440
cgcccaucucaggcccacca

SEQ ID NO: 3593089 - RNA, 19 nt, Pseudomonas putida KT2440
cgcccaugaaguucaucca

SEQ ID NO: 3593090 - RNA, 20 nt, Pseudomonas putida KT2440
cgcccaugccacccaugcca

SEQ ID NO: 3593091 - RNA, 17 nt, Pseudomonas putida KT2440
cgcccaugcgcgugcgu

SEQ ID NO: 3593092 - RNA, 15 nt, Pseudomonas putida KT2440
cgcccauggcuccac

SEQ ID NO: 3593093 - RNA, 19 nt, Pseudomonas putida KT2440
cgccccaagcgccugacgc

SEQ ID NO: 3593094 - RNA, 16 nt, Pseudomonas putida KT2440
cgccccaauggcgaac

SEQ ID NO: 3593095 - RNA, 14 nt, Pseudomonas putida KT2440
cgccccacccgcuc

SEQ ID NO: 3593096 - RNA, 14 nt, Pseudomonas putida KT2440
cgccccaccucuuc

SEQ ID NO: 3593097 - RNA, 12 nt, Pseudomonas putida KT2440
cgccccacgccc

SEQ ID NO: 3593098 - RNA, 20 nt, Pseudomonas putida KT2440
cgccccacucgcgcagcaca

SEQ ID NO: 3593099 - RNA, 19 nt, Pseudomonas putida KT2440
cgccccagaaucaucaacg

SEQ ID NO: 3593100 - RNA, 16 nt, Pseudomonas putida KT2440
cgccccagcagcgcuu

SEQ ID NO: 3593101 - RNA, 13 nt, Pseudomonas putida KT2440
cgccccagcgcgc

SEQ ID NO: 3593102 - RNA, 15 nt, Pseudomonas putida KT2440
cgccccaggagggcu

SEQ ID NO: 3593103 - RNA, 17 nt, Pseudomonas putida KT2440
cgccccauagccugcug

SEQ ID NO: 3593104 - RNA, 12 nt, Pseudomonas putida KT2440
cgcccccaaacc

SEQ ID NO: 3593105 - RNA, 13 nt, Pseudomonas putida KT2440
cgcccccacgggc

SEQ ID NO: 3593106 - RNA, 13 nt, Pseudomonas putida KT2440
cgcccccagcccg

SEQ ID NO: 3593107 - RNA, 14 nt, Pseudomonas putida KT2440
cgcccccaugauga

SEQ ID NO: 3593108 - RNA, 23 nt, Pseudomonas putida KT2440
cgccccccaguaaaaacuggcca

SEQ ID NO: 3593109 - RNA, 15 nt, Pseudomonas putida KT2440
cgccccccggcucca

SEQ ID NO: 3593110 - RNA, 18 nt, Pseudomonas putida KT2440
cgcccccgaccacccggu

SEQ ID NO: 3593111 - RNA, 13 nt, Pseudomonas putida KT2440
cgcccccugggcg

SEQ ID NO: 3593112 - RNA, 19 nt, Pseudomonas putida KT2440
cgccccgaaccuacccggu

SEQ ID NO: 3593113 - RNA, 19 nt, Pseudomonas putida KT2440
cgccccgacugguucgggg

SEQ ID NO: 3593114 - RNA, 20 nt, Pseudomonas putida KT2440
cgccccgcaccagaccagca

SEQ ID NO: 3593115 - RNA, 23 nt, Pseudomonas putida KT2440
cgccccgcaccagaccagcagca

SEQ ID NO: 3593116 - RNA, 12 nt, Pseudomonas putida KT2440
cgccccgccagc

SEQ ID NO: 3593117 - RNA, 13 nt, Pseudomonas putida KT2440
cgccccgcgccgc

SEQ ID NO: 3593118 - RNA, 14 nt, Pseudomonas putida KT2440
cgccccgcgccgcc

SEQ ID NO: 3593119 - RNA, 21 nt, Pseudomonas putida KT2440
cgccccuauacacaugcacag

SEQ ID NO: 3593120 - RNA, 23 nt, Pseudomonas putida KT2440
cgccccugcguccccggguccac

SEQ ID NO: 3593121 - RNA, 18 nt, Pseudomonas putida KT2440
cgcccgacaauacgcaca

SEQ ID NO: 3593122 - RNA, 15 nt, Pseudomonas putida KT2440
cgcccgaccgccagc

SEQ ID NO: 3593123 - RNA, 13 nt, Pseudomonas putida KT2440
cgcccgaccuugg

SEQ ID NO: 3593124 - RNA, 23 nt, Pseudomonas putida KT2440
cgcccgaccuuggcgacauaggc

SEQ ID NO: 3593125 - RNA, 12 nt, Pseudomonas putida KT2440
cgcccgacuggc

SEQ ID NO: 3593126 - RNA, 17 nt, Pseudomonas putida KT2440
cgcccgcaacaaccugg

SEQ ID NO: 3593127 - RNA, 21 nt, Pseudomonas putida KT2440
cgcccgcaacaaccuggccgg

SEQ ID NO: 3593128 - RNA, 14 nt, Pseudomonas putida KT2440
cgcccgcaacagau

SEQ ID NO: 3593129 - RNA, 16 nt, Pseudomonas putida KT2440
cgcccgcacagcacgu

SEQ ID NO: 3593130 - RNA, 12 nt, Pseudomonas putida KT2440
cgcccgcccgac

SEQ ID NO: 3593131 - RNA, 16 nt, Pseudomonas putida KT2440
cgcccgcccgacgcuu

SEQ ID NO: 3593132 - RNA, 13 nt, Pseudomonas putida KT2440
cgcccgcccgcuu

SEQ ID NO: 3593133 - RNA, 13 nt, Pseudomonas putida KT2440
cgcccgccggcac

SEQ ID NO: 3593134 - RNA, 16 nt, Pseudomonas putida KT2440
cgcccgccggcacuuc

SEQ ID NO: 3593135 - RNA, 18 nt, Pseudomonas putida KT2440
cgcccgccggcacuuccu

SEQ ID NO: 3593136 - RNA, 23 nt, Pseudomonas putida KT2440
cgcccgccguguucccagcaccc

SEQ ID NO: 3593137 - RNA, 12 nt, Pseudomonas putida KT2440
cgcccgccugcg

SEQ ID NO: 3593138 - RNA, 13 nt, Pseudomonas putida KT2440
cgcccgccugcgc

SEQ ID NO: 3593139 - RNA, 18 nt, Pseudomonas putida KT2440
cgcccgccugcgccagcg

SEQ ID NO: 3593140 - RNA, 17 nt, Pseudomonas putida KT2440
cgcccgcgaaaugccca

SEQ ID NO: 3593141 - RNA, 17 nt, Pseudomonas putida KT2440
cgcccgcgcagcuucca

SEQ ID NO: 3593142 - RNA, 20 nt, Pseudomonas putida KT2440
cgcccgcgcagcuuccacca

SEQ ID NO: 3593143 - RNA, 17 nt, Pseudomonas putida KT2440
cgcccgcgccgcccagc

SEQ ID NO: 3593144 - RNA, 12 nt, Pseudomonas putida KT2440
cgcccgcgcggc

SEQ ID NO: 3593145 - RNA, 15 nt, Pseudomonas putida KT2440
cgcccgcgcggcgcu

SEQ ID NO: 3593146 - RNA, 12 nt, Pseudomonas putida KT2440
cgcccgcggcga

SEQ ID NO: 3593147 - RNA, 15 nt, Pseudomonas putida KT2440
cgcccgcggcgaaca

SEQ ID NO: 3593148 - RNA, 22 nt, Pseudomonas putida KT2440
cgcccgcggcgaacacagcggc

SEQ ID NO: 3593149 - RNA, 20 nt, Pseudomonas putida KT2440
cgcccgcguccggcuugaga

SEQ ID NO: 3593150 - RNA, 14 nt, Pseudomonas putida KT2440
cgcccgcucacgca

SEQ ID NO: 3593151 - RNA, 15 nt, Pseudomonas putida KT2440
cgcccgcucacgcag

SEQ ID NO: 3593152 - RNA, 15 nt, Pseudomonas putida KT2440
cgcccgcucccacag

SEQ ID NO: 3593153 - RNA, 20 nt, Pseudomonas putida KT2440
cgcccgcucccacaggaaug

SEQ ID NO: 3593154 - RNA, 19 nt, Pseudomonas putida KT2440
cgcccgcucccacaggcca

SEQ ID NO: 3593155 - RNA, 16 nt, Pseudomonas putida KT2440
cgcccgcugcaugcuc

SEQ ID NO: 3593156 - RNA, 14 nt, Pseudomonas putida KT2440
cgcccgcugcgccg

SEQ ID NO: 3593157 - RNA, 15 nt, Pseudomonas putida KT2440
cgcccgcugcgccgc

SEQ ID NO: 3593158 - RNA, 16 nt, Pseudomonas putida KT2440
cgcccgcugcgccgcu

SEQ ID NO: 3593159 - RNA, 16 nt, Pseudomonas putida KT2440
cgcccgcugcuuccgg

SEQ ID NO: 3593160 - RNA, 21 nt, Pseudomonas putida KT2440
cgcccgcuuuuggcugugcac

SEQ ID NO: 3593161 - RNA, 17 nt, Pseudomonas putida KT2440
cgcccggauggggcgug

SEQ ID NO: 3593162 - RNA, 21 nt, Pseudomonas putida KT2440
cgccgccaaaaaauccgccug

SEQ ID NO: 3593163 - RNA, 21 nt, Pseudomonas putida KT2440
cgccgccacauccagcgccuc

SEQ ID NO: 3593164 - RNA, 14 nt, Pseudomonas putida KT2440
cgccgccaccagcg

SEQ ID NO: 3593165 - RNA, 14 nt, Pseudomonas putida KT2440
cgccgccaccaucg

SEQ ID NO: 3593166 - RNA, 20 nt, Pseudomonas putida KT2440
cgccgccaccugcggcaggu

SEQ ID NO: 3593167 - RNA, 13 nt, Pseudomonas putida KT2440
cgccgccagcagc

SEQ ID NO: 3593168 - RNA, 16 nt, Pseudomonas putida KT2440
cgccgccagcgcucca

SEQ ID NO: 3593169 - RNA, 15 nt, Pseudomonas putida KT2440
cgccgccaggcagca

SEQ ID NO: 3593170 - RNA, 18 nt, Pseudomonas putida KT2440
cgccgccaggcagcagac

SEQ ID NO: 3593171 - RNA, 14 nt, Pseudomonas putida KT2440
cgccgccaggcggu

SEQ ID NO: 3593172 - RNA, 14 nt, Pseudomonas putida KT2440
cgccgccagggcaa

SEQ ID NO: 3593173 - RNA, 16 nt, Pseudomonas putida KT2440
cgccgccaugcagccc

SEQ ID NO: 3593174 - RNA, 12 nt, Pseudomonas putida KT2440
cgccgcccagcu

SEQ ID NO: 3593175 - RNA, 16 nt, Pseudomonas putida KT2440
cgccgcccagcucuuu

SEQ ID NO: 3593176 - RNA, 12 nt, Pseudomonas putida KT2440
cgccgcccaggu

SEQ ID NO: 3593177 - RNA, 19 nt, Pseudomonas putida KT2440
cgccgcccaguaccggggu

SEQ ID NO: 3593178 - RNA, 14 nt, Pseudomonas putida KT2440
cgccgcccaguggc

SEQ ID NO: 3593179 - RNA, 19 nt, Pseudomonas putida KT2440
cgccgccccacucgcgcag

SEQ ID NO: 3593180 - RNA, 20 nt, Pseudomonas putida KT2440
cgccgccccacucgcgcagc

SEQ ID NO: 3593181 - RNA, 21 nt, Pseudomonas putida KT2440
cgccgccccacucgcgcagca

SEQ ID NO: 3593182 - RNA, 15 nt, Pseudomonas putida KT2440
cgccgcccgcgcggc

SEQ ID NO: 3593183 - RNA, 19 nt, Pseudomonas putida KT2440
cgccgcccgguauucgggu

SEQ ID NO: 3593184 - RNA, 14 nt, Pseudomonas putida KT2440
cgccgcccuggaug

SEQ ID NO: 3593185 - RNA, 15 nt, Pseudomonas putida KT2440
cgccgcccuggaugc

SEQ ID NO: 3593186 - RNA, 19 nt, Pseudomonas putida KT2440
cgccgcccuggaugcucug

SEQ ID NO: 3593187 - RNA, 23 nt, Pseudomonas putida KT2440
cgccgcccuugaggggcggcguu

SEQ ID NO: 3593188 - RNA, 19 nt, Pseudomonas putida KT2440
cgccgcccuuggugcacca

SEQ ID NO: 3593189 - RNA, 19 nt, Pseudomonas putida KT2440
cgccgccgaggcaccggua

SEQ ID NO: 3593190 - RNA, 19 nt, Pseudomonas putida KT2440
cgccgccgaugcgcuucca

SEQ ID NO: 3593191 - RNA, 12 nt, Pseudomonas putida KT2440
cgccgccgccuc

SEQ ID NO: 3593192 - RNA, 13 nt, Pseudomonas putida KT2440
cgccgccgccucg

SEQ ID NO: 3593193 - RNA, 15 nt, Pseudomonas putida KT2440
cgccgccgcugacca

SEQ ID NO: 3593194 - RNA, 21 nt, Pseudomonas putida KT2440
cgccgccgcugauuuccgccg

SEQ ID NO: 3593195 - RNA, 13 nt, Pseudomonas putida KT2440
cgccgccgcuggc

SEQ ID NO: 3593196 - RNA, 21 nt, Pseudomonas putida KT2440
cgccgccgguuucucgcagca

SEQ ID NO: 3593197 - RNA, 13 nt, Pseudomonas putida KT2440
cgccgccgucggg

SEQ ID NO: 3593198 - RNA, 13 nt, Pseudomonas putida KT2440
cgccgccuccacc

SEQ ID NO: 3593199 - RNA, 17 nt, Pseudomonas putida KT2440
cgccgccuccaccggga

SEQ ID NO: 3593200 - RNA, 20 nt, Pseudomonas putida KT2440
cgccgccucgaacaccugcg

SEQ ID NO: 3593201 - RNA, 17 nt, Pseudomonas putida KT2440
cgccgccuggcucaccu

SEQ ID NO: 3593202 - RNA, 21 nt, Pseudomonas putida KT2440
cgccgcgcggcuugcucgcgg

SEQ ID NO: 3593203 - RNA, 22 nt, Pseudomonas putida KT2440
cgccgcgcggcuugcucgcggc

SEQ ID NO: 3593204 - RNA, 18 nt, Pseudomonas putida KT2440
cgccgcgcgggcggcgcu

SEQ ID NO: 3593205 - RNA, 19 nt, Pseudomonas putida KT2440
cgccgcgcgggcggcgcuu

SEQ ID NO: 3593206 - RNA, 19 nt, Pseudomonas putida KT2440
cgccgcgcuggcgcgcugu

SEQ ID NO: 3593207 - RNA, 18 nt, Pseudomonas putida KT2440
cgccgcgcuguggcgccc

SEQ ID NO: 3593208 - RNA, 12 nt, Pseudomonas putida KT2440
cgccgcggccaa

SEQ ID NO: 3593209 - RNA, 14 nt, Pseudomonas putida KT2440
cgccgcggccaaca

SEQ ID NO: 3593210 - RNA, 15 nt, Pseudomonas putida KT2440
cgccgcggguaccac

SEQ ID NO: 3593211 - RNA, 20 nt, Pseudomonas putida KT2440
cgccgcggguaccaccuggg

SEQ ID NO: 3593212 - RNA, 16 nt, Pseudomonas putida KT2440
cgccgcucgcccagca

SEQ ID NO: 3593213 - RNA, 19 nt, Pseudomonas putida KT2440
cgccgcucugcccgcgcca

SEQ ID NO: 3593214 - RNA, 20 nt, Pseudomonas putida KT2440
cgccgcugaccacgccgaag

SEQ ID NO: 3593215 - RNA, 19 nt, Pseudomonas putida KT2440
cgccgcugccaaccggcuu

SEQ ID NO: 3593216 - RNA, 16 nt, Pseudomonas putida KT2440
cgccgcugccagcagg

SEQ ID NO: 3593217 - RNA, 13 nt, Pseudomonas putida KT2440
cgccgcugccugg

SEQ ID NO: 3593218 - RNA, 19 nt, Pseudomonas putida KT2440
cgccgcugcugcgccucgc

SEQ ID NO: 3593219 - RNA, 14 nt, Pseudomonas putida KT2440
cgccgcuggcuuca

SEQ ID NO: 3593220 - RNA, 14 nt, Pseudomonas putida KT2440
cgccgcuguacacc

SEQ ID NO: 3593221 - RNA, 18 nt, Pseudomonas putida KT2440
cgccgcuguacaccagga

SEQ ID NO: 3593222 - RNA, 13 nt, Pseudomonas putida KT2440
cgccgcuguucag

SEQ ID NO: 3593223 - RNA, 20 nt, Pseudomonas putida KT2440
cgccgcuucgcggccaagcc

SEQ ID NO: 3593224 - RNA, 14 nt, Pseudomonas putida KT2440
cgccggcaagcugg

SEQ ID NO: 3593225 - RNA, 17 nt, Pseudomonas putida KT2440
cgccggcaagcugguca

SEQ ID NO: 3593226 - RNA, 20 nt, Pseudomonas putida KT2440
cgccggcacgcccgcuccca

SEQ ID NO: 3593227 - RNA, 13 nt, Pseudomonas putida KT2440
cgccggcacuucc

SEQ ID NO: 3593228 - RNA, 14 nt, Pseudomonas putida KT2440
cgccggcagcugau

SEQ ID NO: 3593229 - RNA, 21 nt, Pseudomonas putida KT2440
cgccggcaucgccuccagcgc

SEQ ID NO: 3593230 - RNA, 22 nt, Pseudomonas putida KT2440
cgccggcaucgccuccagcgca

SEQ ID NO: 3593231 - RNA, 18 nt, Pseudomonas putida KT2440
cgccggccaaggucagca

SEQ ID NO: 3593232 - RNA, 19 nt, Pseudomonas putida KT2440
cgccggccaaguggccuug

SEQ ID NO: 3593233 - RNA, 17 nt, Pseudomonas putida KT2440
cgccggccggcucgcca

SEQ ID NO: 3593234 - RNA, 18 nt, Pseudomonas putida KT2440
cgccggccggcucgccau

SEQ ID NO: 3593235 - RNA, 14 nt, Pseudomonas putida KT2440
cgccggccugccgc

SEQ ID NO: 3593236 - RNA, 22 nt, Pseudomonas putida KT2440
cgccggcgaaaugauccccggc

SEQ ID NO: 3593237 - RNA, 19 nt, Pseudomonas putida KT2440
cgccgggacagcaccaugc

SEQ ID NO: 3593238 - RNA, 20 nt, Pseudomonas putida KT2440
cgccgggcacaucaccagca

SEQ ID NO: 3593239 - RNA, 22 nt, Pseudomonas putida KT2440
cgccgggcacaucaccagcagc

SEQ ID NO: 3593240 - RNA, 23 nt, Pseudomonas putida KT2440
cgccgggcacaucaccagcagcu

SEQ ID NO: 3593241 - RNA, 14 nt, Pseudomonas putida KT2440
cgccgggcgcacca

SEQ ID NO: 3593242 - RNA, 14 nt, Pseudomonas putida KT2440
cgccggguccacca

SEQ ID NO: 3593243 - RNA, 16 nt, Pseudomonas putida KT2440
cgccggguccaccagc

SEQ ID NO: 3593244 - RNA, 21 nt, Pseudomonas putida KT2440
cgccgguagcggcugggcgcg

SEQ ID NO: 3593245 - RNA, 14 nt, Pseudomonas putida KT2440
cgccgguagcugcg

SEQ ID NO: 3593246 - RNA, 18 nt, Pseudomonas putida KT2440
cgccgguagcugcgcagg

SEQ ID NO: 3593247 - RNA, 13 nt, Pseudomonas putida KT2440
cgccgguaucacc

SEQ ID NO: 3593248 - RNA, 18 nt, Pseudomonas putida KT2440
cgccgguaucacccagua

SEQ ID NO: 3593249 - RNA, 21 nt, Pseudomonas putida KT2440
cgccgguggcggccgcagccc

SEQ ID NO: 3593250 - RNA, 15 nt, Pseudomonas putida KT2440
cgccgguguaccauc

SEQ ID NO: 3593251 - RNA, 16 nt, Pseudomonas putida KT2440
cgccggugugcauuuu

SEQ ID NO: 3593252 - RNA, 19 nt, Pseudomonas putida KT2440
cgccgguguucgcgggcau

SEQ ID NO: 3593253 - RNA, 21 nt, Pseudomonas putida KT2440
cgccgguguucuucaggcaaa

SEQ ID NO: 3593254 - RNA, 15 nt, Pseudomonas putida KT2440
cgccgguugcgcagc

SEQ ID NO: 3593255 - RNA, 18 nt, Pseudomonas putida KT2440
cgccgguuucccgaugaa

SEQ ID NO: 3593256 - RNA, 19 nt, Pseudomonas putida KT2440
cgccgguuucgucaggaag

SEQ ID NO: 3593257 - RNA, 19 nt, Pseudomonas putida KT2440
cgccgguuucucgcagcag

SEQ ID NO: 3593258 - RNA, 20 nt, Pseudomonas putida KT2440
cgccgguuucucgcagcagc

SEQ ID NO: 3593259 - RNA, 22 nt, Pseudomonas putida KT2440
cgccgguuucucgcagcagcac

SEQ ID NO: 3593260 - RNA, 14 nt, Pseudomonas putida KT2440
cgccgucaccagcg

SEQ ID NO: 3593261 - RNA, 17 nt, Pseudomonas putida KT2440
cgccgucaccagcguca

SEQ ID NO: 3593262 - RNA, 15 nt, Pseudomonas putida KT2440
cgccgucaccgccgc

SEQ ID NO: 3593263 - RNA, 16 nt, Pseudomonas putida KT2440
cgccgucaucaccacu

SEQ ID NO: 3593264 - RNA, 12 nt, Pseudomonas putida KT2440
cgccgucaucga

SEQ ID NO: 3593265 - RNA, 15 nt, Pseudomonas putida KT2440
cgccguccaccaucu

SEQ ID NO: 3593266 - RNA, 21 nt, Pseudomonas putida KT2440
cgccguccaccaucuccagcu

SEQ ID NO: 3593267 - RNA, 12 nt, Pseudomonas putida KT2440
cgccguccagca

SEQ ID NO: 3593268 - RNA, 17 nt, Pseudomonas putida KT2440
cgccuugaagcuggccg

SEQ ID NO: 3593269 - RNA, 23 nt, Pseudomonas putida KT2440
cgccuugagguugccguuggcgu

SEQ ID NO: 3593270 - RNA, 14 nt, Pseudomonas putida KT2440
cgccuugaucguca

SEQ ID NO: 3593271 - RNA, 18 nt, Pseudomonas putida KT2440
cgccuugauuaccagcgc

SEQ ID NO: 3593272 - RNA, 13 nt, Pseudomonas putida KT2440
cgccuugcgcacg

SEQ ID NO: 3593273 - RNA, 13 nt, Pseudomonas putida KT2440
cgccuugcgccag

SEQ ID NO: 3593274 - RNA, 19 nt, Pseudomonas putida KT2440
cgccuugcgucggccgaug

SEQ ID NO: 3593275 - RNA, 14 nt, Pseudomonas putida KT2440
cgccuuggcuuccu

SEQ ID NO: 3593276 - RNA, 15 nt, Pseudomonas putida KT2440
cgccuugucggcacg

SEQ ID NO: 3593277 - RNA, 22 nt, Pseudomonas putida KT2440
cgccuugucggcacgcgccagc

SEQ ID NO: 3593278 - RNA, 13 nt, Pseudomonas putida KT2440
cgccuuguuccgc

SEQ ID NO: 3593279 - RNA, 16 nt, Pseudomonas putida KT2440
cgccuuuuccaccagc

SEQ ID NO: 3593280 - RNA, 21 nt, Pseudomonas putida KT2440
cgccuuuuccaccagcccuuc

SEQ ID NO: 3593281 - RNA, 14 nt, Pseudomonas putida KT2440
cgcgaaaagccugc

SEQ ID NO: 3593282 - RNA, 22 nt, Pseudomonas putida KT2440
cgcgaaagcgaagaagcuaaag

SEQ ID NO: 3593283 - RNA, 15 nt, Pseudomonas putida KT2440
cgcgaaagggccagu

SEQ ID NO: 3593284 - RNA, 19 nt, Pseudomonas putida KT2440
cgcgaaagggccgcaacgc

SEQ ID NO: 3593285 - RNA, 20 nt, Pseudomonas putida KT2440
cgcgaaagggccgcgacgcg

SEQ ID NO: 3593286 - RNA, 14 nt, Pseudomonas putida KT2440
cgcgaacaccggca

SEQ ID NO: 3593287 - RNA, 17 nt, Pseudomonas putida KT2440
cgcgaagaagacaccgc

SEQ ID NO: 3593288 - RNA, 18 nt, Pseudomonas putida KT2440
cgcgaagaagccggcauc

SEQ ID NO: 3593289 - RNA, 13 nt, Pseudomonas putida KT2440
cgcgaagaggccg

SEQ ID NO: 3593290 - RNA, 18 nt, Pseudomonas putida KT2440
cgcgaagaggccggcccc

SEQ ID NO: 3593291 - RNA, 18 nt, Pseudomonas putida KT2440
cgcgaagcaggcgacgca

SEQ ID NO: 3593292 - RNA, 15 nt, Pseudomonas putida KT2440
cgcgaagcaggcugc

SEQ ID NO: 3593293 - RNA, 19 nt, Pseudomonas putida KT2440
cgcgaagcccagcuugccc

SEQ ID NO: 3593294 - RNA, 16 nt, Pseudomonas putida KT2440
cgcgaagcggccaacc

SEQ ID NO: 3593295 - RNA, 13 nt, Pseudomonas putida KT2440
cgcgaagcggccc

SEQ ID NO: 3593296 - RNA, 16 nt, Pseudomonas putida KT2440
cgcgaaggcuccagca

SEQ ID NO: 3593297 - RNA, 18 nt, Pseudomonas putida KT2440
cgcgaaggcuccagcacc

SEQ ID NO: 3593298 - RNA, 18 nt, Pseudomonas putida KT2440
cgcgaagggccgcaacgc

SEQ ID NO: 3593299 - RNA, 15 nt, Pseudomonas putida KT2440
cgcgaagggcugccg

SEQ ID NO: 3593300 - RNA, 23 nt, Pseudomonas putida KT2440
cgcgaauacgauauccgcagccc

SEQ ID NO: 3593301 - RNA, 18 nt, Pseudomonas putida KT2440
cgcgaauacgguagcggc

SEQ ID NO: 3593302 - RNA, 22 nt, Pseudomonas putida KT2440
cgcgaauacgguagcggcagca

SEQ ID NO: 3593303 - RNA, 21 nt, Pseudomonas putida KT2440
cgcgaauacgguaguggcggc

SEQ ID NO: 3593304 - RNA, 20 nt, Pseudomonas putida KT2440
cgcgaauacggucgcggcgg

SEQ ID NO: 3593305 - RNA, 18 nt, Pseudomonas putida KT2440
cgcgaaucagcgccucca

SEQ ID NO: 3593306 - RNA, 19 nt, Pseudomonas putida KT2440
cgcgaaucagcgccuccag

SEQ ID NO: 3593307 - RNA, 15 nt, Pseudomonas putida KT2440
cgcgaaucgccuuca

SEQ ID NO: 3593308 - RNA, 22 nt, Pseudomonas putida KT2440
cgcgaaugaucauguccuugcu

SEQ ID NO: 3593309 - RNA, 21 nt, Pseudomonas putida KT2440
cgcgaaugcuccggcgacagc

SEQ ID NO: 3593310 - RNA, 15 nt, Pseudomonas putida KT2440
cgcgaauggccuuua

SEQ ID NO: 3593311 - RNA, 16 nt, Pseudomonas putida KT2440
cgcgaaugggccgcca

SEQ ID NO: 3593312 - RNA, 22 nt, Pseudomonas putida KT2440
cgcgaaugggccgccaagcggc

SEQ ID NO: 3593313 - RNA, 19 nt, Pseudomonas putida KT2440
cgcgaaugggucaggaugc

SEQ ID NO: 3593314 - RNA, 19 nt, Pseudomonas putida KT2440
cgcgacaccugcuucgcgg

SEQ ID NO: 3593315 - RNA, 18 nt, Pseudomonas putida KT2440
cgcgacagcguugcucca

SEQ ID NO: 3593316 - RNA, 21 nt, Pseudomonas putida KT2440
cgcgacagcguugcuccagcu

SEQ ID NO: 3593317 - RNA, 17 nt, Pseudomonas putida KT2440
cgcgacaugaucagcgg

SEQ ID NO: 3593318 - RNA, 16 nt, Pseudomonas putida KT2440
cgcgaccacaggcgcu

SEQ ID NO: 3593319 - RNA, 20 nt, Pseudomonas putida KT2440
cgcgaccaucaccgccagca

SEQ ID NO: 3593320 - RNA, 21 nt, Pseudomonas putida KT2440
cgcgaccaucaccgccagcau

SEQ ID NO: 3593321 - RNA, 14 nt, Pseudomonas putida KT2440
cgcgacgaugauca

SEQ ID NO: 3593322 - RNA, 17 nt, Pseudomonas putida KT2440
cgcgacgaugaucaggu

SEQ ID NO: 3593323 - RNA, 12 nt, Pseudomonas putida KT2440
cgcgacgcagca

SEQ ID NO: 3593324 - RNA, 13 nt, Pseudomonas putida KT2440
cgcgacgcggccc

SEQ ID NO: 3593325 - RNA, 14 nt, Pseudomonas putida KT2440
cgcgacgggaagug

SEQ ID NO: 3593326 - RNA, 18 nt, Pseudomonas putida KT2440
cgcgacgggcugcucccg

SEQ ID NO: 3593327 - RNA, 21 nt, Pseudomonas putida KT2440
cgcgacggucauaccucgacc

SEQ ID NO: 3593328 - RNA, 21 nt, Pseudomonas putida KT2440
cgcgacgguugacagcacggc

SEQ ID NO: 3593329 - RNA, 13 nt, Pseudomonas putida KT2440
cgcgacuccugug

SEQ ID NO: 3593330 - RNA, 22 nt, Pseudomonas putida KT2440
cgcgacuggugcucugcaggca

SEQ ID NO: 3593331 - RNA, 20 nt, Pseudomonas putida KT2440
cgcgagccagaucauggcgg

SEQ ID NO: 3593332 - RNA, 23 nt, Pseudomonas putida KT2440
cgcgagccucuguuugcugguca

SEQ ID NO: 3593333 - RNA, 18 nt, Pseudomonas putida KT2440
cgcgagcguuaccaacag

SEQ ID NO: 3593334 - RNA, 23 nt, Pseudomonas putida KT2440
cgcgagcuggagaucuugucgac

SEQ ID NO: 3593335 - RNA, 20 nt, Pseudomonas putida KT2440
cgcgaggaaacccgcgccua

SEQ ID NO: 3593336 - RNA, 22 nt, Pseudomonas putida KT2440
cgcgaggcauccacacccugcg

SEQ ID NO: 3593337 - RNA, 19 nt, Pseudomonas putida KT2440
cgcgagggcaucagcgcac

SEQ ID NO: 3593338 - RNA, 18 nt, Pseudomonas putida KT2440
cgcgaguaaagccagcag

SEQ ID NO: 3593339 - RNA, 21 nt, Pseudomonas putida KT2440
cgcgaguaaagccagcagccu

SEQ ID NO: 3593340 - RNA, 14 nt, Pseudomonas putida KT2440
cgcgaguaacgccc

SEQ ID NO: 3593341 - RNA, 18 nt, Pseudomonas putida KT2440
cgcgagugaugcgguaac

SEQ ID NO: 3593342 - RNA, 12 nt, Pseudomonas putida KT2440
cgcgauacgccg

SEQ ID NO: 3593343 - RNA, 19 nt, Pseudomonas putida KT2440
cgcgauagggcugcggggc

SEQ ID NO: 3593344 - RNA, 16 nt, Pseudomonas putida KT2440
cgcgauaucagcgcca

SEQ ID NO: 3593345 - RNA, 13 nt, Pseudomonas putida KT2440
cgcgauaucccaa

SEQ ID NO: 3593346 - RNA, 13 nt, Pseudomonas putida KT2440
cgcgaucaccagc

SEQ ID NO: 3593347 - RNA, 19 nt, Pseudomonas putida KT2440
cgcgaucacgcaggcccag

SEQ ID NO: 3593348 - RNA, 21 nt, Pseudomonas putida KT2440
cgcgaucacgcaggcccagca

SEQ ID NO: 3593349 - RNA, 19 nt, Pseudomonas putida KT2440
cgcgauccccugugggagc

SEQ ID NO: 3593350 - RNA, 14 nt, Pseudomonas putida KT2440
cgcgaucggcagcg

SEQ ID NO: 3593351 - RNA, 17 nt, Pseudomonas putida KT2440
cgcgaugccgacagcca

SEQ ID NO: 3593352 - RNA, 22 nt, Pseudomonas putida KT2440
cgcgaugccgacagccaccgcg

SEQ ID NO: 3593353 - RNA, 19 nt, Pseudomonas putida KT2440
cgcgaugcgccgcgcgggc

SEQ ID NO: 3593354 - RNA, 20 nt, Pseudomonas putida KT2440
cgcgaugcuugaggugcucg

SEQ ID NO: 3593355 - RNA, 16 nt, Pseudomonas putida KT2440
cgcgauggauggcacc

SEQ ID NO: 3593356 - RNA, 16 nt, Pseudomonas putida KT2440
cgcgauugaucagcgc

SEQ ID NO: 3593357 - RNA, 17 nt, Pseudomonas putida KT2440
cgcgcaaaggcuagcag

SEQ ID NO: 3593358 - RNA, 19 nt, Pseudomonas putida KT2440
cgcgcaaaggcuagcagca

SEQ ID NO: 3593359 - RNA, 16 nt, Pseudomonas putida KT2440
cgcgcaaaucgccgca

SEQ ID NO: 3593360 - RNA, 17 nt, Pseudomonas putida KT2440
cgcgcaaaugcuugccc

SEQ ID NO: 3593361 - RNA, 14 nt, Pseudomonas putida KT2440
cgcgcaacaccgcc

SEQ ID NO: 3593362 - RNA, 15 nt, Pseudomonas putida KT2440
cgcgcaacaccgcca

SEQ ID NO: 3593363 - RNA, 19 nt, Pseudomonas putida KT2440
cgcgcaacaccgccagcgg

SEQ ID NO: 3593364 - RNA, 21 nt, Pseudomonas putida KT2440
cgcgcaacacuucaggcugcg

SEQ ID NO: 3593365 - RNA, 22 nt, Pseudomonas putida KT2440
cgcgcaacagcaaggcaucggc

SEQ ID NO: 3593366 - RNA, 13 nt, Pseudomonas putida KT2440
cgcgcaacgcgcc

SEQ ID NO: 3593367 - RNA, 22 nt, Pseudomonas putida KT2440
cgcgcaacgcgccauggccugg

SEQ ID NO: 3593368 - RNA, 14 nt, Pseudomonas putida KT2440
cgcgcaacugccca

SEQ ID NO: 3593369 - RNA, 19 nt, Pseudomonas putida KT2440
cgcgcaagcaggugcgcag

SEQ ID NO: 3593370 - RNA, 20 nt, Pseudomonas putida KT2440
cgcgcaagccuuugcgccuu

SEQ ID NO: 3593371 - RNA, 21 nt, Pseudomonas putida KT2440
cgcgcaccaucggcuccagcg

SEQ ID NO: 3593372 - RNA, 15 nt, Pseudomonas putida KT2440
cgcgcacgcaucugc

SEQ ID NO: 3593373 - RNA, 15 nt, Pseudomonas putida KT2440
cgcgcgggcggcgcu

SEQ ID NO: 3593374 - RNA, 15 nt, Pseudomonas putida KT2440
cgcgcguugcagcca

SEQ ID NO: 3593375 - RNA, 15 nt, Pseudomonas putida KT2440
cgcgcguugcggaac

SEQ ID NO: 3593376 - RNA, 14 nt, Pseudomonas putida KT2440
cgcgcuaaaggccg

SEQ ID NO: 3593377 - RNA, 20 nt, Pseudomonas putida KT2440
cgcgcuaccugguucaucga

SEQ ID NO: 3593378 - RNA, 22 nt, Pseudomonas putida KT2440
cgcgcucacgcuugccaaggcu

SEQ ID NO: 3593379 - RNA, 14 nt, Pseudomonas putida KT2440
cgcgcucacugcau

SEQ ID NO: 3593380 - RNA, 13 nt, Pseudomonas putida KT2440
cgcgcucugcgcc

SEQ ID NO: 3593381 - RNA, 18 nt, Pseudomonas putida KT2440
cgcgcugaaguagcgcag

SEQ ID NO: 3593382 - RNA, 16 nt, Pseudomonas putida KT2440
cgcgcugacgcagggc

SEQ ID NO: 3593383 - RNA, 23 nt, Pseudomonas putida KT2440
cgcgcugacgcagggccucgaug

SEQ ID NO: 3593384 - RNA, 15 nt, Pseudomonas putida KT2440
cgcgcugagcagguu

SEQ ID NO: 3593385 - RNA, 13 nt, Pseudomonas putida KT2440
cgcgcugccaggc

SEQ ID NO: 3593386 - RNA, 20 nt, Pseudomonas putida KT2440
cgcgcugcgcaaggacgacg

SEQ ID NO: 3593387 - RNA, 12 nt, Pseudomonas putida KT2440
cgcgcugcgcag

SEQ ID NO: 3593388 - RNA, 12 nt, Pseudomonas putida KT2440
cgcgcuggccgc

SEQ ID NO: 3593389 - RNA, 14 nt, Pseudomonas putida KT2440
cgcgcuguuccagc

SEQ ID NO: 3593390 - RNA, 13 nt, Pseudomonas putida KT2440
cgcgcuucccggg

SEQ ID NO: 3593391 - RNA, 18 nt, Pseudomonas putida KT2440
cgcgcuugaagggggcua

SEQ ID NO: 3593392 - RNA, 21 nt, Pseudomonas putida KT2440
cgcgcuugcgguccugcacca

SEQ ID NO: 3593393 - RNA, 20 nt, Pseudomonas putida KT2440
cgcgcuuggcaccggcagca

SEQ ID NO: 3593394 - RNA, 15 nt, Pseudomonas putida KT2440
cgcgcuuggcggccc

SEQ ID NO: 3593395 - RNA, 21 nt, Pseudomonas putida KT2440
cgcgcuuucucuuugaucagc

SEQ ID NO: 3593396 - RNA, 17 nt, Pseudomonas putida KT2440
cgcgcuuugugugccca

SEQ ID NO: 3593397 - RNA, 15 nt, Pseudomonas putida KT2440
cgcgcuuuuccagca

SEQ ID NO: 3593398 - RNA, 17 nt, Pseudomonas putida KT2440
cgcggaagauacccgcc

SEQ ID NO: 3593399 - RNA, 18 nt, Pseudomonas putida KT2440
cgcggaagauacccgcca

SEQ ID NO: 3593400 - RNA, 22 nt, Pseudomonas putida KT2440
cgcggaaggccucacgcaucug

SEQ ID NO: 3593401 - RNA, 14 nt, Pseudomonas putida KT2440
cgcggacccggcau

SEQ ID NO: 3593402 - RNA, 17 nt, Pseudomonas putida KT2440
cgcggacccggcauccu

SEQ ID NO: 3593403 - RNA, 23 nt, Pseudomonas putida KT2440
cgcggaucgugacggucugccgg

SEQ ID NO: 3593404 - RNA, 22 nt, Pseudomonas putida KT2440
cgcggaugcgccuggcccgcag

SEQ ID NO: 3593405 - RNA, 12 nt, Pseudomonas putida KT2440
cgcggcaaagau

SEQ ID NO: 3593406 - RNA, 20 nt, Pseudomonas putida KT2440
cgcggcaaagaucgcccagc

SEQ ID NO: 3593407 - RNA, 16 nt, Pseudomonas putida KT2440
cgcggcaaagguggca

SEQ ID NO: 3593408 - RNA, 17 nt, Pseudomonas putida KT2440
cgcggcaaaugcggcgc

SEQ ID NO: 3593409 - RNA, 13 nt, Pseudomonas putida KT2440
cgcggcaaccugc

SEQ ID NO: 3593410 - RNA, 14 nt, Pseudomonas putida KT2440
cgcggcaaccugca

SEQ ID NO: 3593411 - RNA, 22 nt, Pseudomonas putida KT2440
cgcggcaaccugcacuaucugc

SEQ ID NO: 3593412 - RNA, 19 nt, Pseudomonas putida KT2440
cgcggcaagcccgcuccua

SEQ ID NO: 3593413 - RNA, 15 nt, Pseudomonas putida KT2440
cgcggcaaucacgaa

SEQ ID NO: 3593414 - RNA, 21 nt, Pseudomonas putida KT2440
cgcggcacaacgcgccaccgc

SEQ ID NO: 3593415 - RNA, 14 nt, Pseudomonas putida KT2440
cgcggcaccggcuu

SEQ ID NO: 3593416 - RNA, 13 nt, Pseudomonas putida KT2440
cgcggcagcagca

SEQ ID NO: 3593417 - RNA, 14 nt, Pseudomonas putida KT2440
cgcggcagcagcag

SEQ ID NO: 3593418 - RNA, 17 nt, Pseudomonas putida KT2440
cgcggcagcagcagccc

SEQ ID NO: 3593419 - RNA, 21 nt, Pseudomonas putida KT2440
cgcggcagcagcagccccagc

SEQ ID NO: 3593420 - RNA, 18 nt, Pseudomonas putida KT2440
cgcggcagcaugaacagc

SEQ ID NO: 3593421 - RNA, 19 nt, Pseudomonas putida KT2440
cgcggcagcccuucgcggg

SEQ ID NO: 3593422 - RNA, 20 nt, Pseudomonas putida KT2440
cgcggcagcccuucgcgggc

SEQ ID NO: 3593423 - RNA, 17 nt, Pseudomonas putida KT2440
cgcggcaugcccgcccc

SEQ ID NO: 3593424 - RNA, 21 nt, Pseudomonas putida KT2440
cgcggcaugcccgccccugcc

SEQ ID NO: 3593425 - RNA, 21 nt, Pseudomonas putida KT2440
cgcggccaagccgcugccaca

SEQ ID NO: 3593426 - RNA, 22 nt, Pseudomonas putida KT2440
cgcggccaagccgcugccacag

SEQ ID NO: 3593427 - RNA, 16 nt, Pseudomonas putida KT2440
cgcggcccagcccagu

SEQ ID NO: 3593428 - RNA, 18 nt, Pseudomonas putida KT2440
cgcggccgaaguggcggc

SEQ ID NO: 3593429 - RNA, 22 nt, Pseudomonas putida KT2440
cgcggccgaaguggcggcucgc

SEQ ID NO: 3593430 - RNA, 20 nt, Pseudomonas putida KT2440
cgcggccgccuccugcugcu

SEQ ID NO: 3593431 - RNA, 23 nt, Pseudomonas putida KT2440
cgcggccggucacccccaucagc

SEQ ID NO: 3593432 - RNA, 16 nt, Pseudomonas putida KT2440
cgcggccuacccgggc

SEQ ID NO: 3593433 - RNA, 14 nt, Pseudomonas putida KT2440
cgcggccugugccc

SEQ ID NO: 3593434 - RNA, 17 nt, Pseudomonas putida KT2440
cgcggccugugcccaac

SEQ ID NO: 3593435 - RNA, 15 nt, Pseudomonas putida KT2440
cgcggcgaacacagc

SEQ ID NO: 3593436 - RNA, 14 nt, Pseudomonas putida KT2440
cgcggcgcaccgcu

SEQ ID NO: 3593437 - RNA, 14 nt, Pseudomonas putida KT2440
cgcggcgcagggug

SEQ ID NO: 3593438 - RNA, 15 nt, Pseudomonas putida KT2440
cgcggcgcaucgcga

SEQ ID NO: 3593439 - RNA, 16 nt, Pseudomonas putida KT2440
cgcggcgcaucgcgag

SEQ ID NO: 3593440 - RNA, 17 nt, Pseudomonas putida KT2440
cgcggcgcccagcaaca

SEQ ID NO: 3593441 - RNA, 12 nt, Pseudomonas putida KT2440
cgcggcgcgccc

SEQ ID NO: 3593442 - RNA, 15 nt, Pseudomonas putida KT2440
cgcggcgcuggccgg

SEQ ID NO: 3593443 - RNA, 20 nt, Pseudomonas putida KT2440
cgcggcgcuuauggcgccgc

SEQ ID NO: 3593444 - RNA, 22 nt, Pseudomonas putida KT2440
cgcggcggcuaagcgccagcaa

SEQ ID NO: 3593445 - RNA, 15 nt, Pseudomonas putida KT2440
cgcggcgucaccggc

SEQ ID NO: 3593446 - RNA, 12 nt, Pseudomonas putida KT2440
cgcggcuacgcu

SEQ ID NO: 3593447 - RNA, 14 nt, Pseudomonas putida KT2440
cgcggcuacgcucg

SEQ ID NO: 3593448 - RNA, 18 nt, Pseudomonas putida KT2440
cgcggcucacccaccagc

SEQ ID NO: 3593449 - RNA, 17 nt, Pseudomonas putida KT2440
cgcggcucggccaccac

SEQ ID NO: 3593450 - RNA, 13 nt, Pseudomonas putida KT2440
cgcggcugaacac

SEQ ID NO: 3593451 - RNA, 16 nt, Pseudomonas putida KT2440
cgcggcuggugucggc

SEQ ID NO: 3593452 - RNA, 19 nt, Pseudomonas putida KT2440
cgcggcuucgaugcccggc

SEQ ID NO: 3593453 - RNA, 22 nt, Pseudomonas putida KT2440
cgcggcuucgaugcccggcagg

SEQ ID NO: 3593454 - RNA, 17 nt, Pseudomonas putida KT2440
cgcggcuugcucgcggc

SEQ ID NO: 3593455 - RNA, 17 nt, Pseudomonas putida KT2440
cgcgggaagcccguaca

SEQ ID NO: 3593456 - RNA, 14 nt, Pseudomonas putida KT2440
cgcgggagacccgu

SEQ ID NO: 3593457 - RNA, 20 nt, Pseudomonas putida KT2440
cgcgggcaaacccgcgccua

SEQ ID NO: 3593458 - RNA, 22 nt, Pseudomonas putida KT2440
cgcgggcaaacccgcgccuaca

SEQ ID NO: 3593459 - RNA, 15 nt, Pseudomonas putida KT2440
cgcgggcaagcccgc

SEQ ID NO: 3593460 - RNA, 16 nt, Pseudomonas putida KT2440
cgcgggcaagcccgca

SEQ ID NO: 3593461 - RNA, 16 nt, Pseudomonas putida KT2440
cgcgggcaagcccgcu

SEQ ID NO: 3593462 - RNA, 20 nt, Pseudomonas putida KT2440
cgcgggcaagcccgcuccca

SEQ ID NO: 3593463 - RNA, 20 nt, Pseudomonas putida KT2440
cgcgggcaagcccgcuccga

SEQ ID NO: 3593464 - RNA, 21 nt, Pseudomonas putida KT2440
cgcgggcaagcccgcuccuac

SEQ ID NO: 3593465 - RNA, 15 nt, Pseudomonas putida KT2440
cgcgggcaauggcca

SEQ ID NO: 3593466 - RNA, 21 nt, Pseudomonas putida KT2440
cgcgggcaauguccaggugcu

SEQ ID NO: 3593467 - RNA, 14 nt, Pseudomonas putida KT2440
cgcgggcaugcccg

SEQ ID NO: 3593468 - RNA, 20 nt, Pseudomonas putida KT2440
cgcgggcaugcccgcuccca

SEQ ID NO: 3593469 - RNA, 13 nt, Pseudomonas putida KT2440
cgcgggccaaggu

SEQ ID NO: 3593470 - RNA, 22 nt, Pseudomonas putida KT2440
cgcgggccagguggccuucccu

SEQ ID NO: 3593471 - RNA, 16 nt, Pseudomonas putida KT2440
cgcgggccuucugcug

SEQ ID NO: 3593472 - RNA, 12 nt, Pseudomonas putida KT2440
cgcgggcgcgcc

SEQ ID NO: 3593473 - RNA, 12 nt, Pseudomonas putida KT2440
cgcgggcgugcc

SEQ ID NO: 3593474 - RNA, 19 nt, Pseudomonas putida KT2440
cgcgggcgugcccgcgaau

SEQ ID NO: 3593475 - RNA, 22 nt, Pseudomonas putida KT2440
cgcgggcucguuauccgcgagu

SEQ ID NO: 3593476 - RNA, 14 nt, Pseudomonas putida KT2440
cgcggggcccgacc

SEQ ID NO: 3593477 - RNA, 21 nt, Pseudomonas putida KT2440
cgcggguaaacccccuccuga

SEQ ID NO: 3593478 - RNA, 22 nt, Pseudomonas putida KT2440
cgcggguaaacccccuccugau

SEQ ID NO: 3593479 - RNA, 13 nt, Pseudomonas putida KT2440
cgcuaccauggcc

SEQ ID NO: 3593480 - RNA, 19 nt, Pseudomonas putida KT2440
cgcuaccugugggagcggg

SEQ ID NO: 3593481 - RNA, 22 nt, Pseudomonas putida KT2440
cgcuaccugugggagcgggcgu

SEQ ID NO: 3593482 - RNA, 14 nt, Pseudomonas putida KT2440
cgcuacgccgcccc

SEQ ID NO: 3593483 - RNA, 18 nt, Pseudomonas putida KT2440
cgcuacggcgucgacacc

SEQ ID NO: 3593484 - RNA, 15 nt, Pseudomonas putida KT2440
cgcuacugccgucgu

SEQ ID NO: 3593485 - RNA, 13 nt, Pseudomonas putida KT2440
cgcuaggcggccc

SEQ ID NO: 3593486 - RNA, 20 nt, Pseudomonas putida KT2440
cgcucaaauggguacgcacc

SEQ ID NO: 3593487 - RNA, 20 nt, Pseudomonas putida KT2440
cgcucaacacgucggcuggc

SEQ ID NO: 3593488 - RNA, 19 nt, Pseudomonas putida KT2440
cgcucaacagguccacugc

SEQ ID NO: 3593489 - RNA, 15 nt, Pseudomonas putida KT2440
cgcucaaccagccgc

SEQ ID NO: 3593490 - RNA, 16 nt, Pseudomonas putida KT2440
cgcucaacuccauggc

SEQ ID NO: 3593491 - RNA, 20 nt, Pseudomonas putida KT2440
cgcucaacuccauggccagg

SEQ ID NO: 3593492 - RNA, 21 nt, Pseudomonas putida KT2440
cgcucaagcgaggugacugca

SEQ ID NO: 3593493 - RNA, 22 nt, Pseudomonas putida KT2440
cgcucaagucugcauaggcgcu

SEQ ID NO: 3593494 - RNA, 17 nt, Pseudomonas putida KT2440
cgcucaauggcaccguc

SEQ ID NO: 3593495 - RNA, 20 nt, Pseudomonas putida KT2440
cgcucaauggcaccgucagg

SEQ ID NO: 3593496 - RNA, 16 nt, Pseudomonas putida KT2440
cgcucaccggccagcg

SEQ ID NO: 3593497 - RNA, 20 nt, Pseudomonas putida KT2440
cgcucaccggccagcgcgcu

SEQ ID NO: 3593498 - RNA, 22 nt, Pseudomonas putida KT2440
cgcucaccguucuucuccaaca

SEQ ID NO: 3593499 - RNA, 16 nt, Pseudomonas putida KT2440
cgcucacgcagcccuu

SEQ ID NO: 3593500 - RNA, 17 nt, Pseudomonas putida KT2440
cgcucagccgauacgcu

SEQ ID NO: 3593501 - RNA, 21 nt, Pseudomonas putida KT2440
cgcucagccgauacgcuguac

SEQ ID NO: 3593502 - RNA, 14 nt, Pseudomonas putida KT2440
cgcucagcgggcgu

SEQ ID NO: 3593503 - RNA, 14 nt, Pseudomonas putida KT2440
cgcucaggccaugc

SEQ ID NO: 3593504 - RNA, 16 nt, Pseudomonas putida KT2440
cgcucaggccaugcug

SEQ ID NO: 3593505 - RNA, 18 nt, Pseudomonas putida KT2440
cgcucaggccaugcugcg

SEQ ID NO: 3593506 - RNA, 22 nt, Pseudomonas putida KT2440
cgcucaggccaugcugcgccag

SEQ ID NO: 3593507 - RNA, 23 nt, Pseudomonas putida KT2440
cgcucaggccaugcugcgccagg

SEQ ID NO: 3593508 - RNA, 22 nt, Pseudomonas putida KT2440
cgcucaggcgcagcgcaugcuc

SEQ ID NO: 3593509 - RNA, 12 nt, Pseudomonas putida KT2440
cgcucaggcggc

SEQ ID NO: 3593510 - RNA, 17 nt, Pseudomonas putida KT2440
cgcucaggcucuugaac

SEQ ID NO: 3593511 - RNA, 23 nt, Pseudomonas putida KT2440
cgcucagggcgucaugcucaugc

SEQ ID NO: 3593512 - RNA, 16 nt, Pseudomonas putida KT2440
cgcucagguagcgcgc

SEQ ID NO: 3593513 - RNA, 16 nt, Pseudomonas putida KT2440
cgcucagguaggcagc

SEQ ID NO: 3593514 - RNA, 17 nt, Pseudomonas putida KT2440
cgcucagguaggcagca

SEQ ID NO: 3593515 - RNA, 18 nt, Pseudomonas putida KT2440
cgcucaugaacagcgccc

SEQ ID NO: 3593516 - RNA, 20 nt, Pseudomonas putida KT2440
cgcucaugaacagcgcccag

SEQ ID NO: 3593517 - RNA, 21 nt, Pseudomonas putida KT2440
cgcucaugcaacaacccgccc

SEQ ID NO: 3593518 - RNA, 16 nt, Pseudomonas putida KT2440
cgcucaugccccgcac

SEQ ID NO: 3593519 - RNA, 15 nt, Pseudomonas putida KT2440
cgcucauguccaggu

SEQ ID NO: 3593520 - RNA, 13 nt, Pseudomonas putida KT2440
cgcuccaacuggc

SEQ ID NO: 3593521 - RNA, 22 nt, Pseudomonas putida KT2440
cgcuccagacgcuguacgucca

SEQ ID NO: 3593522 - RNA, 18 nt, Pseudomonas putida KT2440
cgcuccagggcaggcuga

SEQ ID NO: 3593523 - RNA, 21 nt, Pseudomonas putida KT2440
cgcuccagucguggcgcuggc

SEQ ID NO: 3593524 - RNA, 13 nt, Pseudomonas putida KT2440
cgcuccaguggug

SEQ ID NO: 3593525 - RNA, 18 nt, Pseudomonas putida KT2440
cgcuccaguggugcaagg

SEQ ID NO: 3593526 - RNA, 17 nt, Pseudomonas putida KT2440
cgcuccaucaugcgguc

SEQ ID NO: 3593527 - RNA, 16 nt, Pseudomonas putida KT2440
cgcuccauccagucgg

SEQ ID NO: 3593528 - RNA, 20 nt, Pseudomonas putida KT2440
cgcuccauccagucggcgcu

SEQ ID NO: 3593529 - RNA, 11 nt, Pseudomonas putida KT2440
cgcuccaugua

SEQ ID NO: 3593530 - RNA, 22 nt, Pseudomonas putida KT2440
cgcucccacagggaucgcgcca

SEQ ID NO: 3593531 - RNA, 20 nt, Pseudomonas putida KT2440
cgcucccacagguaaugcac

SEQ ID NO: 3593532 - RNA, 15 nt, Pseudomonas putida KT2440
cgcucccacaggugc

SEQ ID NO: 3593533 - RNA, 24 nt, Pseudomonas putida KT2440
cgcuccgacaaaugcaccacgcgc

SEQ ID NO: 3593534 - RNA, 14 nt, Pseudomonas putida KT2440
cgcuccgccaaacc

SEQ ID NO: 3593535 - RNA, 23 nt, Pseudomonas putida KT2440
cgcuccgccaauugcgccagccg

SEQ ID NO: 3593536 - RNA, 17 nt, Pseudomonas putida KT2440
cgcuccuacaaagcggc

SEQ ID NO: 3593537 - RNA, 24 nt, Pseudomonas putida KT2440
cgcuccuacaaagcggcgcggccc

SEQ ID NO: 3593538 - RNA, 15 nt, Pseudomonas putida KT2440
cgcuccuacaacggc

SEQ ID NO: 3593539 - RNA, 20 nt, Pseudomonas putida KT2440
cgcuccuacaauggauugca

SEQ ID NO: 3593540 - RNA, 20 nt, Pseudomonas putida KT2440
cgcuccuacaggauggccgc

SEQ ID NO: 3593541 - RNA, 16 nt, Pseudomonas putida KT2440
cgcuccuacagguucu

SEQ ID NO: 3593542 - RNA, 16 nt, Pseudomonas putida KT2440
cgcuccuacgacggcc

SEQ ID NO: 3593543 - RNA, 19 nt, Pseudomonas putida KT2440
cgcuccuacgacggccugc

SEQ ID NO: 3593544 - RNA, 14 nt, Pseudomonas putida KT2440
cgcuccuacgcggg

SEQ ID NO: 3593545 - RNA, 21 nt, Pseudomonas putida KT2440
cgcuccuacggaaucugcacc

SEQ ID NO: 3593546 - RNA, 17 nt, Pseudomonas putida KT2440
cgcuccuacggccgaca

SEQ ID NO: 3593547 - RNA, 21 nt, Pseudomonas putida KT2440
cgcuccuacgggcgagcgcgc

SEQ ID NO: 3593548 - RNA, 23 nt, Pseudomonas putida KT2440
cgcuccuacggggguucacagcc

SEQ ID NO: 3593549 - RNA, 14 nt, Pseudomonas putida KT2440
cgcuccucggccgu

SEQ ID NO: 3593550 - RNA, 17 nt, Pseudomonas putida KT2440
cgcucgaacaacgccuc

SEQ ID NO: 3593551 - RNA, 23 nt, Pseudomonas putida KT2440
cgcucgaacaacgccucgggcgc

SEQ ID NO: 3593552 - RNA, 15 nt, Pseudomonas putida KT2440
cgcucgaacaagcgc

SEQ ID NO: 3593553 - RNA, 19 nt, Pseudomonas putida KT2440
cgcucgaagucguccacgc

SEQ ID NO: 3593554 - RNA, 11 nt, Pseudomonas putida KT2440
cgcucgacagc

SEQ ID NO: 3593555 - RNA, 12 nt, Pseudomonas putida KT2440
cgcucgacagca

SEQ ID NO: 3593556 - RNA, 14 nt, Pseudomonas putida KT2440
cgcucgacagcaac

SEQ ID NO: 3593557 - RNA, 13 nt, Pseudomonas putida KT2440
cgcucgaccagau

SEQ ID NO: 3593558 - RNA, 14 nt, Pseudomonas putida KT2440
cgcucgacgcgcgc

SEQ ID NO: 3593559 - RNA, 22 nt, Pseudomonas putida KT2440
cgcucgagaaaugccucggcaa

SEQ ID NO: 3593560 - RNA, 19 nt, Pseudomonas putida KT2440
cgcucgagcccgccagcag

SEQ ID NO: 3593561 - RNA, 23 nt, Pseudomonas putida KT2440
cgcucgagcccgccagcaggcca

SEQ ID NO: 3593562 - RNA, 14 nt, Pseudomonas putida KT2440
cgcucgauccugug

SEQ ID NO: 3593563 - RNA, 19 nt, Pseudomonas putida KT2440
cgcucgaucucacaggcga

SEQ ID NO: 3593564 - RNA, 12 nt, Pseudomonas putida KT2440
cgcucgccacac

SEQ ID NO: 3593565 - RNA, 16 nt, Pseudomonas putida KT2440
cgcucgcccagcagcc

SEQ ID NO: 3593566 - RNA, 17 nt, Pseudomonas putida KT2440
cgcucgcccagcagcca

SEQ ID NO: 3593567 - RNA, 16 nt, Pseudomonas putida KT2440
cgcucgccuggccaua

SEQ ID NO: 3593568 - RNA, 18 nt, Pseudomonas putida KT2440
cgcucggguaaaucaucg

SEQ ID NO: 3593569 - RNA, 16 nt, Pseudomonas putida KT2440
cgcucgguaucggcca

SEQ ID NO: 3593570 - RNA, 20 nt, Pseudomonas putida KT2440
cgcucggucucacaggcgcu

SEQ ID NO: 3593571 - RNA, 15 nt, Pseudomonas putida KT2440
cgcucgguugaugca

SEQ ID NO: 3593572 - RNA, 21 nt, Pseudomonas putida KT2440
cgcucgguugaugcagcgccc

SEQ ID NO: 3593573 - RNA, 14 nt, Pseudomonas putida KT2440
cgcucguagagcuu

SEQ ID NO: 3593574 - RNA, 23 nt, Pseudomonas putida KT2440
cgcucguccaggcccugcagcgc

SEQ ID NO: 3593575 - RNA, 18 nt, Pseudomonas putida KT2440
cgcucgucgaacucgcgc

SEQ ID NO: 3593576 - RNA, 22 nt, Pseudomonas putida KT2440
cgcucgugacagguaggcgcca

SEQ ID NO: 3593577 - RNA, 21 nt, Pseudomonas putida KT2440
cgcucguugcgagcgaacagc

SEQ ID NO: 3593578 - RNA, 13 nt, Pseudomonas putida KT2440
cgcucguugucca

SEQ ID NO: 3593579 - RNA, 17 nt, Pseudomonas putida KT2440
cgcucguuguccagcag

SEQ ID NO: 3593580 - RNA, 14 nt, Pseudomonas putida KT2440
cgcucugcccgcgc

SEQ ID NO: 3593581 - RNA, 13 nt, Pseudomonas putida KT2440
cgcucugcgccug

SEQ ID NO: 3593582 - RNA, 21 nt, Pseudomonas putida KT2440
cgcucugcggcccauucgcgg

SEQ ID NO: 3593583 - RNA, 17 nt, Pseudomonas putida KT2440
cgcucuucaaccgccuc

SEQ ID NO: 3593584 - RNA, 23 nt, Pseudomonas putida KT2440
cgcuuggcguaauccagcugcug

SEQ ID NO: 3593585 - RNA, 20 nt, Pseudomonas putida KT2440
cgcuuggcucaucaccggcg

SEQ ID NO: 3593586 - RNA, 20 nt, Pseudomonas putida KT2440
cgcuugucgagguugcgcuc

SEQ ID NO: 3593587 - RNA, 18 nt, Pseudomonas putida KT2440
cgcuuguucggacccuac

SEQ ID NO: 3593588 - RNA, 18 nt, Pseudomonas putida KT2440
cgcuuuccaaaccugcga

SEQ ID NO: 3593589 - RNA, 20 nt, Pseudomonas putida KT2440
cgcuuuccugguuauccagg

SEQ ID NO: 3593590 - RNA, 20 nt, Pseudomonas putida KT2440
cgcuuucgccgaucagcugg

SEQ ID NO: 3593591 - RNA, 20 nt, Pseudomonas putida KT2440
cgcuuugcacccgcgcgcug

SEQ ID NO: 3593592 - RNA, 21 nt, Pseudomonas putida KT2440
cgcuuugugcacaagcugcug

SEQ ID NO: 3593593 - RNA, 12 nt, Pseudomonas putida KT2440
cgcuuuucaggg

SEQ ID NO: 3593594 - RNA, 14 nt, Pseudomonas putida KT2440
cgcuuuugcuugca

SEQ ID NO: 3593595 - RNA, 20 nt, Pseudomonas putida KT2440
cggaaaacuccugcuggucg

SEQ ID NO: 3593596 - RNA, 19 nt, Pseudomonas putida KT2440
cggaaacucacgcgccagg

SEQ ID NO: 3593597 - RNA, 15 nt, Pseudomonas putida KT2440
cggaaaggucggcgg

SEQ ID NO: 3593598 - RNA, 18 nt, Pseudomonas putida KT2440
cggaaauaccagacgcag

SEQ ID NO: 3593599 - RNA, 13 nt, Pseudomonas putida KT2440
cggaacaccccuu

SEQ ID NO: 3593600 - RNA, 14 nt, Pseudomonas putida KT2440
cggaacaggaucag

SEQ ID NO: 3593601 - RNA, 23 nt, Pseudomonas putida KT2440
cggaacagguugaccaacgccag

SEQ ID NO: 3593602 - RNA, 22 nt, Pseudomonas putida KT2440
cggaacauacgcaucagcgcag

SEQ ID NO: 3593603 - RNA, 22 nt, Pseudomonas putida KT2440
cggaacaucgaggcgcgcgccu

SEQ ID NO: 3593604 - RNA, 19 nt, Pseudomonas putida KT2440
cggaacaugguguugggca

SEQ ID NO: 3593605 - RNA, 16 nt, Pseudomonas putida KT2440
cggaacguuuccagca

SEQ ID NO: 3593606 - RNA, 16 nt, Pseudomonas putida KT2440
cggaacguuuccaggc

SEQ ID NO: 3593607 - RNA, 21 nt, Pseudomonas putida KT2440
cggaacuaaaccggugaagcg

SEQ ID NO: 3593608 - RNA, 18 nt, Pseudomonas putida KT2440
cggaacucggcgaucugg

SEQ ID NO: 3593609 - RNA, 22 nt, Pseudomonas putida KT2440
cggaacucggcgaucuggucga

SEQ ID NO: 3593610 - RNA, 15 nt, Pseudomonas putida KT2440
cggaacuggcugacc

SEQ ID NO: 3593611 - RNA, 16 nt, Pseudomonas putida KT2440
cggaagauacccgcca

SEQ ID NO: 3593612 - RNA, 16 nt, Pseudomonas putida KT2440
cggaagcaaccgugac

SEQ ID NO: 3593613 - RNA, 13 nt, Pseudomonas putida KT2440
cggaagcucucca

SEQ ID NO: 3593614 - RNA, 22 nt, Pseudomonas putida KT2440
cggaaggcaucgaacuccugca

SEQ ID NO: 3593615 - RNA, 21 nt, Pseudomonas putida KT2440
cggaaggccucacgcaucugc

SEQ ID NO: 3593616 - RNA, 22 nt, Pseudomonas putida KT2440
cggaaggcgucacgcagggcca

SEQ ID NO: 3593617 - RNA, 16 nt, Pseudomonas putida KT2440
cggaaggggccgcaaa

SEQ ID NO: 3593618 - RNA, 19 nt, Pseudomonas putida KT2440
cggaaggucuucagcucac

SEQ ID NO: 3593619 - RNA, 18 nt, Pseudomonas putida KT2440
cggaaucaccgguaccgg

SEQ ID NO: 3593620 - RNA, 20 nt, Pseudomonas putida KT2440
cggaaucacgcggcgucacc

SEQ ID NO: 3593621 - RNA, 21 nt, Pseudomonas putida KT2440
cggaauccgcacacgcuccag

SEQ ID NO: 3593622 - RNA, 13 nt, Pseudomonas putida KT2440
cggaaugcccggg

SEQ ID NO: 3593623 - RNA, 20 nt, Pseudomonas putida KT2440
cggaaugcucgucaccaucg

SEQ ID NO: 3593624 - RNA, 15 nt, Pseudomonas putida KT2440
cggacaacaccguug

SEQ ID NO: 3593625 - RNA, 15 nt, Pseudomonas putida KT2440
cggacaaccaagcga

SEQ ID NO: 3593626 - RNA, 17 nt, Pseudomonas putida KT2440
cggacagguuggcgccc

SEQ ID NO: 3593627 - RNA, 15 nt, Pseudomonas putida KT2440
cggaccaccugggcc

SEQ ID NO: 3593628 - RNA, 20 nt, Pseudomonas putida KT2440
cggaccaccugggccaguac

SEQ ID NO: 3593629 - RNA, 14 nt, Pseudomonas putida KT2440
cggaccagcgccgc

SEQ ID NO: 3593630 - RNA, 19 nt, Pseudomonas putida KT2440
cggaccagcgccgcaucgc

SEQ ID NO: 3593631 - RNA, 15 nt, Pseudomonas putida KT2440
cggacccagcgguca

SEQ ID NO: 3593632 - RNA, 20 nt, Pseudomonas putida KT2440
cggacccagcggucagcauc

SEQ ID NO: 3593633 - RNA, 24 nt, Pseudomonas putida KT2440
cggacccuugugugggccuugcuc

SEQ ID NO: 3593634 - RNA, 11 nt, Pseudomonas putida KT2440
cggaccgcaua

SEQ ID NO: 3593635 - RNA, 15 nt, Pseudomonas putida KT2440
cggaccugccgcagc

SEQ ID NO: 3593636 - RNA, 19 nt, Pseudomonas putida KT2440
cggacgacgcgaaugauga

SEQ ID NO: 3593637 - RNA, 14 nt, Pseudomonas putida KT2440
cggacgaugaggcc

SEQ ID NO: 3593638 - RNA, 22 nt, Pseudomonas putida KT2440
cggacgcuugccacccaggccc

SEQ ID NO: 3593639 - RNA, 18 nt, Pseudomonas putida KT2440
cggacggguuucgccgua

SEQ ID NO: 3593640 - RNA, 14 nt, Pseudomonas putida KT2440
cggacgucccagca

SEQ ID NO: 3593641 - RNA, 15 nt, Pseudomonas putida KT2440
cggacgucccagcag

SEQ ID NO: 3593642 - RNA, 14 nt, Pseudomonas putida KT2440
cggacucauagcuc

SEQ ID NO: 3593643 - RNA, 15 nt, Pseudomonas putida KT2440
cggagaacaugaaag

SEQ ID NO: 3593644 - RNA, 18 nt, Pseudomonas putida KT2440
cggagaacaugaaaguga

SEQ ID NO: 3593645 - RNA, 16 nt, Pseudomonas putida KT2440
cggagauuggccagca

SEQ ID NO: 3593646 - RNA, 13 nt, Pseudomonas putida KT2440
cggagcugguggu

SEQ ID NO: 3593647 - RNA, 15 nt, Pseudomonas putida KT2440
cggagguagccaccu

SEQ ID NO: 3593648 - RNA, 20 nt, Pseudomonas putida KT2440
cggaggugucaccgcgagca

SEQ ID NO: 3593649 - RNA, 14 nt, Pseudomonas putida KT2440
cggauacagcgccc

SEQ ID NO: 3593650 - RNA, 17 nt, Pseudomonas putida KT2440
cggauacaucgcauaca

SEQ ID NO: 3593651 - RNA, 24 nt, Pseudomonas putida KT2440
cggauacaucgcauacagcgcacu

SEQ ID NO: 3593652 - RNA, 15 nt, Pseudomonas putida KT2440
cggauaccgcuggcc

SEQ ID NO: 3593653 - RNA, 17 nt, Pseudomonas putida KT2440
cggauaccgcuggccgc

SEQ ID NO: 3593654 - RNA, 17 nt, Pseudomonas putida KT2440
cggauagaacgggucau

SEQ ID NO: 3593655 - RNA, 19 nt, Pseudomonas putida KT2440
cggauagccccgcccagca

SEQ ID NO: 3593656 - RNA, 19 nt, Pseudomonas putida KT2440
cggaucacuuccauggcau

SEQ ID NO: 3593657 - RNA, 15 nt, Pseudomonas putida KT2440
cggaucagcgcgucc

SEQ ID NO: 3593658 - RNA, 21 nt, Pseudomonas putida KT2440
cggaucagcgcguccagcaac

SEQ ID NO: 3593659 - RNA, 22 nt, Pseudomonas putida KT2440
cggaucagcgcguccagcaaca

SEQ ID NO: 3593660 - RNA, 22 nt, Pseudomonas putida KT2440
cggaucaucggcacgcccagca

SEQ ID NO: 3593661 - RNA, 23 nt, Pseudomonas putida KT2440
cggaucaucuccaugaaggccgg

SEQ ID NO: 3593662 - RNA, 19 nt, Pseudomonas putida KT2440
cggaucgacgcaaugaucg

SEQ ID NO: 3593663 - RNA, 18 nt, Pseudomonas putida KT2440
cggaucggcgugguccag

SEQ ID NO: 3593664 - RNA, 21 nt, Pseudomonas putida KT2440
cggaucggugccacccaaggc

SEQ ID NO: 3593665 - RNA, 20 nt, Pseudomonas putida KT2440
cggaucgugacggucugccg

SEQ ID NO: 3593666 - RNA, 18 nt, Pseudomonas putida KT2440
cggaucguugcgggucag

SEQ ID NO: 3593667 - RNA, 14 nt, Pseudomonas putida KT2440
cggaucucaagcaa

SEQ ID NO: 3593668 - RNA, 20 nt, Pseudomonas putida KT2440
cggaucugacggcgcugcug

SEQ ID NO: 3593669 - RNA, 16 nt, Pseudomonas putida KT2440
cggaucuggcagcuuc

SEQ ID NO: 3593670 - RNA, 17 nt, Pseudomonas putida KT2440
cggaucuuguauuggcc

SEQ ID NO: 3593671 - RNA, 21 nt, Pseudomonas putida KT2440
cggaugacguccggcugcggg

SEQ ID NO: 3593672 - RNA, 14 nt, Pseudomonas putida KT2440
cggaugcgccuggc

SEQ ID NO: 3593673 - RNA, 15 nt, Pseudomonas putida KT2440
cggaugcgccuggcc

SEQ ID NO: 3593674 - RNA, 20 nt, Pseudomonas putida KT2440
cggaugcgcuucauccagcg

SEQ ID NO: 3593675 - RNA, 14 nt, Pseudomonas putida KT2440
cggauggcggugau

SEQ ID NO: 3593676 - RNA, 16 nt, Pseudomonas putida KT2440
cggauggugugcagca

SEQ ID NO: 3593677 - RNA, 17 nt, Pseudomonas putida KT2440
cggauggugugcagcaa

SEQ ID NO: 3593678 - RNA, 20 nt, Pseudomonas putida KT2440
cggauggugugcagcaacac

SEQ ID NO: 3593679 - RNA, 17 nt, Pseudomonas putida KT2440
cggauguucuugaccuu

SEQ ID NO: 3593680 - RNA, 18 nt, Pseudomonas putida KT2440
cggauguucuugaccuug

SEQ ID NO: 3593681 - RNA, 14 nt, Pseudomonas putida KT2440
cggauguuggccac

SEQ ID NO: 3593682 - RNA, 15 nt, Pseudomonas putida KT2440
cggauguuggccacg

SEQ ID NO: 3593683 - RNA, 15 nt, Pseudomonas putida KT2440
cggauuucgccaccc

SEQ ID NO: 3593684 - RNA, 19 nt, Pseudomonas putida KT2440
cggcaaacaaaaagcaccu

SEQ ID NO: 3593685 - RNA, 23 nt, Pseudomonas putida KT2440
cggcaaacaaaaagcaccucuug

SEQ ID NO: 3593686 - RNA, 12 nt, Pseudomonas putida KT2440
cggcaaacacac

SEQ ID NO: 3593687 - RNA, 16 nt, Pseudomonas putida KT2440
cggcaaacacacccuc

SEQ ID NO: 3593688 - RNA, 20 nt, Pseudomonas putida KT2440
cggcaaacacauccaccagg

SEQ ID NO: 3593689 - RNA, 16 nt, Pseudomonas putida KT2440
cggcagagcgccagca

SEQ ID NO: 3593690 - RNA, 18 nt, Pseudomonas putida KT2440
cggcagagcgccagcauc

SEQ ID NO: 3593691 - RNA, 22 nt, Pseudomonas putida KT2440
cggcagaggcguagcaagcaga

SEQ ID NO: 3593692 - RNA, 20 nt, Pseudomonas putida KT2440
cggcagaucacgcaaccucg

SEQ ID NO: 3593693 - RNA, 17 nt, Pseudomonas putida KT2440
cggcagaucaggcaauc

SEQ ID NO: 3593694 - RNA, 17 nt, Pseudomonas putida KT2440
cggcagauccugcagcc

SEQ ID NO: 3593695 - RNA, 18 nt, Pseudomonas putida KT2440
cggcagauccugcagccg

SEQ ID NO: 3593696 - RNA, 19 nt, Pseudomonas putida KT2440
cggcagauccugcagccgc

SEQ ID NO: 3593697 - RNA, 23 nt, Pseudomonas putida KT2440
cggcagauccugcagccgcaccu

SEQ ID NO: 3593698 - RNA, 23 nt, Pseudomonas putida KT2440
cggcagcaaacccgacaacagcu

SEQ ID NO: 3593699 - RNA, 23 nt, Pseudomonas putida KT2440
cggcagcaacacgacgauggcca

SEQ ID NO: 3593700 - RNA, 14 nt, Pseudomonas putida KT2440
cggcagcaaggcau

SEQ ID NO: 3593701 - RNA, 19 nt, Pseudomonas putida KT2440
cggcagcaaucgccgccug

SEQ ID NO: 3593702 - RNA, 17 nt, Pseudomonas putida KT2440
cggcagcacccgcuugg

SEQ ID NO: 3593703 - RNA, 22 nt, Pseudomonas putida KT2440
cggcagcacccgcuuggccacc

SEQ ID NO: 3593704 - RNA, 17 nt, Pseudomonas putida KT2440
cggcagcaccugccagc

SEQ ID NO: 3593705 - RNA, 18 nt, Pseudomonas putida KT2440
cggcagcaccugccagcc

SEQ ID NO: 3593706 - RNA, 20 nt, Pseudomonas putida KT2440
cggcagcaccugccagccgc

SEQ ID NO: 3593707 - RNA, 17 nt, Pseudomonas putida KT2440
cggcagcacgucggcgc

SEQ ID NO: 3593708 - RNA, 14 nt, Pseudomonas putida KT2440
cggcagcagcaaug

SEQ ID NO: 3593709 - RNA, 16 nt, Pseudomonas putida KT2440
cggcagcagcagcccc

SEQ ID NO: 3593710 - RNA, 19 nt, Pseudomonas putida KT2440
cggcagcagcagccccagc

SEQ ID NO: 3593711 - RNA, 14 nt, Pseudomonas putida KT2440
cggcagcaggccaa

SEQ ID NO: 3593712 - RNA, 17 nt, Pseudomonas putida KT2440
cggcagcaucgaccugc

SEQ ID NO: 3593713 - RNA, 21 nt, Pseudomonas putida KT2440
cggcagcaucgaccugccacu

SEQ ID NO: 3593714 - RNA, 13 nt, Pseudomonas putida KT2440
cggcagcaucuuc

SEQ ID NO: 3593715 - RNA, 15 nt, Pseudomonas putida KT2440
cggcagcaugaacag

SEQ ID NO: 3593716 - RNA, 17 nt, Pseudomonas putida KT2440
cggcagcaugaacagcg

SEQ ID NO: 3593717 - RNA, 13 nt, Pseudomonas putida KT2440
cggcagccaccgc

SEQ ID NO: 3593718 - RNA, 19 nt, Pseudomonas putida KT2440
cggcagccaccgccggcca

SEQ ID NO: 3593719 - RNA, 17 nt, Pseudomonas putida KT2440
cggcagccaugcugucg

SEQ ID NO: 3593720 - RNA, 15 nt, Pseudomonas putida KT2440
cggcagcgaucagcg

SEQ ID NO: 3593721 - RNA, 18 nt, Pseudomonas putida KT2440
cggcagcgaucagcgcag

SEQ ID NO: 3593722 - RNA, 14 nt, Pseudomonas putida KT2440
cggcagcucaccgg

SEQ ID NO: 3593723 - RNA, 16 nt, Pseudomonas putida KT2440
cggcagcucaccggca

SEQ ID NO: 3593724 - RNA, 15 nt, Pseudomonas putida KT2440
cggcagcucgccgug

SEQ ID NO: 3593725 - RNA, 21 nt, Pseudomonas putida KT2440
cggcagcucgcgcugcgcagc

SEQ ID NO: 3593726 - RNA, 13 nt, Pseudomonas putida KT2440
cggcagcugauac

SEQ ID NO: 3593727 - RNA, 12 nt, Pseudomonas putida KT2440
cggcaggccgaa

SEQ ID NO: 3593728 - RNA, 20 nt, Pseudomonas putida KT2440
cggcaggcgcuucagguaag

SEQ ID NO: 3593729 - RNA, 20 nt, Pseudomonas putida KT2440
cggcaggcgguccagcaagc

SEQ ID NO: 3593730 - RNA, 19 nt, Pseudomonas putida KT2440
cggcaggcucugcuccagc

SEQ ID NO: 3593731 - RNA, 13 nt, Pseudomonas putida KT2440
cggcaggcuggca

SEQ ID NO: 3593732 - RNA, 15 nt, Pseudomonas putida KT2440
cggcaggcuggcgug

SEQ ID NO: 3593733 - RNA, 21 nt, Pseudomonas putida KT2440
cggcagggugaaguugaucac

SEQ ID NO: 3593734 - RNA, 15 nt, Pseudomonas putida KT2440
cggcagguaggccca

SEQ ID NO: 3593735 - RNA, 20 nt, Pseudomonas putida KT2440
cggcagguaggcccagccca

SEQ ID NO: 3593736 - RNA, 19 nt, Pseudomonas putida KT2440
cggcaggucauuggcgcca

SEQ ID NO: 3593737 - RNA, 16 nt, Pseudomonas putida KT2440
cggcaggucgaugauc

SEQ ID NO: 3593738 - RNA, 17 nt, Pseudomonas putida KT2440
cggcagguugcuggccu

SEQ ID NO: 3593739 - RNA, 20 nt, Pseudomonas putida KT2440
cggcagguugcuggccuugg

SEQ ID NO: 3593740 - RNA, 18 nt, Pseudomonas putida KT2440
cggcaguagagcccccag

SEQ ID NO: 3593741 - RNA, 21 nt, Pseudomonas putida KT2440
cggcaguagagcccccagcac

SEQ ID NO: 3593742 - RNA, 19 nt, Pseudomonas putida KT2440
cggcagucuugcugaucac

SEQ ID NO: 3593743 - RNA, 18 nt, Pseudomonas putida KT2440
cggcaguggccgaguugg

SEQ ID NO: 3593744 - RNA, 20 nt, Pseudomonas putida KT2440
cggcaguucauacaccccgc

SEQ ID NO: 3593745 - RNA, 15 nt, Pseudomonas putida KT2440
cggcaguugccugcc

SEQ ID NO: 3593746 - RNA, 19 nt, Pseudomonas putida KT2440
cggcauaacggcuggcgca

SEQ ID NO: 3593747 - RNA, 19 nt, Pseudomonas putida KT2440
cggcauaccaucuucugca

SEQ ID NO: 3593748 - RNA, 12 nt, Pseudomonas putida KT2440
cggcaucagggc

SEQ ID NO: 3593749 - RNA, 14 nt, Pseudomonas putida KT2440
cggcauccaggcgg

SEQ ID NO: 3593750 - RNA, 14 nt, Pseudomonas putida KT2440
cggcauccgccuca

SEQ ID NO: 3593751 - RNA, 17 nt, Pseudomonas putida KT2440
cggcauccucaagcugc

SEQ ID NO: 3593752 - RNA, 20 nt, Pseudomonas putida KT2440
cggcauccuugggguacacc

SEQ ID NO: 3593753 - RNA, 13 nt, Pseudomonas putida KT2440
cggcaucgaacag

SEQ ID NO: 3593754 - RNA, 13 nt, Pseudomonas putida KT2440
cggcaucgaagcg

SEQ ID NO: 3593755 - RNA, 16 nt, Pseudomonas putida KT2440
cggcaucgaagguggu

SEQ ID NO: 3593756 - RNA, 17 nt, Pseudomonas putida KT2440
cggcaucgacgaugccg

SEQ ID NO: 3593757 - RNA, 14 nt, Pseudomonas putida KT2440
cggcaucgcugccg

SEQ ID NO: 3593758 - RNA, 15 nt, Pseudomonas putida KT2440
cggcaucgcugccgg

SEQ ID NO: 3593759 - RNA, 17 nt, Pseudomonas putida KT2440
cggcaucggccuggggc

SEQ ID NO: 3593760 - RNA, 14 nt, Pseudomonas putida KT2440
cggcaucgggcgcg

SEQ ID NO: 3593761 - RNA, 20 nt, Pseudomonas putida KT2440
cggcaucggugcuuucugcu

SEQ ID NO: 3593762 - RNA, 16 nt, Pseudomonas putida KT2440
cggcaucugccggguc

SEQ ID NO: 3593763 - RNA, 21 nt, Pseudomonas putida KT2440
cggcaucugccgggucggccu

SEQ ID NO: 3593764 - RNA, 23 nt, Pseudomonas putida KT2440
cggcaugaacacauacccggcca

SEQ ID NO: 3593765 - RNA, 13 nt, Pseudomonas putida KT2440
cggcaugaucagc

SEQ ID NO: 3593766 - RNA, 22 nt, Pseudomonas putida KT2440
cggcaugaucagcuugaucugg

SEQ ID NO: 3593767 - RNA, 16 nt, Pseudomonas putida KT2440
cggcaugcacggcagc

SEQ ID NO: 3593768 - RNA, 17 nt, Pseudomonas putida KT2440
cggcaugcacggcagca

SEQ ID NO: 3593769 - RNA, 15 nt, Pseudomonas putida KT2440
cggcaugcacuucca

SEQ ID NO: 3593770 - RNA, 20 nt, Pseudomonas putida KT2440
cggcaugcacuuccaggaag

SEQ ID NO: 3593771 - RNA, 14 nt, Pseudomonas putida KT2440
cggcaugcagcggc

SEQ ID NO: 3593772 - RNA, 16 nt, Pseudomonas putida KT2440
cggcaugcagcggcca

SEQ ID NO: 3593773 - RNA, 23 nt, Pseudomonas putida KT2440
cggcaugcccgccccugccagca

SEQ ID NO: 3593774 - RNA, 15 nt, Pseudomonas putida KT2440
cggcauggcgugccc

SEQ ID NO: 3593775 - RNA, 22 nt, Pseudomonas putida KT2440
cggcauggcgugcccggcaauc

SEQ ID NO: 3593776 - RNA, 18 nt, Pseudomonas putida KT2440
cggcaugugcacuggcag

SEQ ID NO: 3593777 - RNA, 15 nt, Pseudomonas putida KT2440
cggcaugugcggguu

SEQ ID NO: 3593778 - RNA, 18 nt, Pseudomonas putida KT2440
cggcauuuccagcgucag

SEQ ID NO: 3593779 - RNA, 17 nt, Pseudomonas putida KT2440
cggccaacaacgacugg

SEQ ID NO: 3593780 - RNA, 20 nt, Pseudomonas putida KT2440
cggccaacgcugcucggccu

SEQ ID NO: 3593781 - RNA, 19 nt, Pseudomonas putida KT2440
cggccaagccgcugccaca

SEQ ID NO: 3593782 - RNA, 21 nt, Pseudomonas putida KT2440
cggccaaguacaaacgccaga

SEQ ID NO: 3593783 - RNA, 18 nt, Pseudomonas putida KT2440
cggccaauaucuggugca

SEQ ID NO: 3593784 - RNA, 18 nt, Pseudomonas putida KT2440
cggccaaucgaucugcuc

SEQ ID NO: 3593785 - RNA, 13 nt, Pseudomonas putida KT2440
cggccaaucgcgg

SEQ ID NO: 3593786 - RNA, 18 nt, Pseudomonas putida KT2440
cggccaaucgcggccgaa

SEQ ID NO: 3593787 - RNA, 22 nt, Pseudomonas putida KT2440
cggccaaugaucgagcgcaccu

SEQ ID NO: 3593788 - RNA, 19 nt, Pseudomonas putida KT2440
cggccaaugcacgccuguc

SEQ ID NO: 3593789 - RNA, 15 nt, Pseudomonas putida KT2440
cggccacacgggcgu

SEQ ID NO: 3593790 - RNA, 14 nt, Pseudomonas putida KT2440
cggccacagcgcca

SEQ ID NO: 3593791 - RNA, 18 nt, Pseudomonas putida KT2440
cggccacagcgccaacgc

SEQ ID NO: 3593792 - RNA, 12 nt, Pseudomonas putida KT2440
cggccaccagcc

SEQ ID NO: 3593793 - RNA, 20 nt, Pseudomonas putida KT2440
cggccaccaggcgcggcagc

SEQ ID NO: 3593794 - RNA, 14 nt, Pseudomonas putida KT2440
cggccacccggacc

SEQ ID NO: 3593795 - RNA, 14 nt, Pseudomonas putida KT2440
cggccaccgccucg

SEQ ID NO: 3593796 - RNA, 14 nt, Pseudomonas putida KT2440
cggccaccugcccc

SEQ ID NO: 3593797 - RNA, 16 nt, Pseudomonas putida KT2440
cggccaccugccccag

SEQ ID NO: 3593798 - RNA, 17 nt, Pseudomonas putida KT2440
cggccaccugccccagc

SEQ ID NO: 3593799 - RNA, 18 nt, Pseudomonas putida KT2440
cggccaccugccccagcg

SEQ ID NO: 3593800 - RNA, 15 nt, Pseudomonas putida KT2440
cggccaccuggccuu

SEQ ID NO: 3593801 - RNA, 16 nt, Pseudomonas putida KT2440
cggccaccuggccuuc

SEQ ID NO: 3593802 - RNA, 21 nt, Pseudomonas putida KT2440
cggccaccuggccuuccagcu

SEQ ID NO: 3593803 - RNA, 14 nt, Pseudomonas putida KT2440
cggccaccuggucg

SEQ ID NO: 3593804 - RNA, 18 nt, Pseudomonas putida KT2440
cggccaccuugccaucgg

SEQ ID NO: 3593805 - RNA, 14 nt, Pseudomonas putida KT2440
cggccacgaaggcc

SEQ ID NO: 3593806 - RNA, 21 nt, Pseudomonas putida KT2440
cggccacgguguauccagccc

SEQ ID NO: 3593807 - RNA, 12 nt, Pseudomonas putida KT2440
cggccacuuaca

SEQ ID NO: 3593808 - RNA, 15 nt, Pseudomonas putida KT2440
cggccacuucgcgga

SEQ ID NO: 3593809 - RNA, 18 nt, Pseudomonas putida KT2440
cggccacuucgcggaagg

SEQ ID NO: 3593810 - RNA, 21 nt, Pseudomonas putida KT2440
cggccagaccuugcgcacggc

SEQ ID NO: 3593811 - RNA, 18 nt, Pseudomonas putida KT2440
cggccagaucggccagcu

SEQ ID NO: 3593812 - RNA, 13 nt, Pseudomonas putida KT2440
cggccagcaacag

SEQ ID NO: 3593813 - RNA, 23 nt, Pseudomonas putida KT2440
cggccagcaacuggugaaucagc

SEQ ID NO: 3593814 - RNA, 19 nt, Pseudomonas putida KT2440
cggccagcaccgaaccggc

SEQ ID NO: 3593815 - RNA, 21 nt, Pseudomonas putida KT2440
cggccagcacgaacagcaaca

SEQ ID NO: 3593816 - RNA, 11 nt, Pseudomonas putida KT2440
cggccagcagg

SEQ ID NO: 3593817 - RNA, 19 nt, Pseudomonas putida KT2440
cggccagcaggacgauacc

SEQ ID NO: 3593818 - RNA, 17 nt, Pseudomonas putida KT2440
cggccagcaggucagca

SEQ ID NO: 3593819 - RNA, 19 nt, Pseudomonas putida KT2440
cggccagcaggucagcacg

SEQ ID NO: 3593820 - RNA, 15 nt, Pseudomonas putida KT2440
cggccagcagguuga

SEQ ID NO: 3593821 - RNA, 16 nt, Pseudomonas putida KT2440
cggccagccagcagcg

SEQ ID NO: 3593822 - RNA, 20 nt, Pseudomonas putida KT2440
cggccagcccgccacccgcu

SEQ ID NO: 3593823 - RNA, 16 nt, Pseudomonas putida KT2440
cggccagccgccgccg

SEQ ID NO: 3593824 - RNA, 14 nt, Pseudomonas putida KT2440
cggccagcgacccu

SEQ ID NO: 3593825 - RNA, 19 nt, Pseudomonas putida KT2440
cggccagcgauaaaccagc

SEQ ID NO: 3593826 - RNA, 12 nt, Pseudomonas putida KT2440
cggccagcgcau

SEQ ID NO: 3593827 - RNA, 15 nt, Pseudomonas putida KT2440
cggccagcgccugca

SEQ ID NO: 3593828 - RNA, 18 nt, Pseudomonas putida KT2440
cggccagcgccugcaggc

SEQ ID NO: 3593829 - RNA, 19 nt, Pseudomonas putida KT2440
cggccagcgccugcaggcc

SEQ ID NO: 3593830 - RNA, 16 nt, Pseudomonas putida KT2440
cggccagcgcgcugag

SEQ ID NO: 3593831 - RNA, 16 nt, Pseudomonas putida KT2440
cggccagcggcaugug

SEQ ID NO: 3593832 - RNA, 16 nt, Pseudomonas putida KT2440
cggccagcucgccaaa

SEQ ID NO: 3593833 - RNA, 17 nt, Pseudomonas putida KT2440
cggccagcucgccaaac

SEQ ID NO: 3593834 - RNA, 17 nt, Pseudomonas putida KT2440
cggccagcugcgcaccg

SEQ ID NO: 3593835 - RNA, 20 nt, Pseudomonas putida KT2440
cggccagcugcgcaccggcu

SEQ ID NO: 3593836 - RNA, 22 nt, Pseudomonas putida KT2440
cggccagcugcgcaccggcuuc

SEQ ID NO: 3593837 - RNA, 15 nt, Pseudomonas putida KT2440
cggccagcugcugcg

SEQ ID NO: 3593838 - RNA, 16 nt, Pseudomonas putida KT2440
cggccaggccggcgca

SEQ ID NO: 3593839 - RNA, 22 nt, Pseudomonas putida KT2440
cggccaggccgugcuugaggcc

SEQ ID NO: 3593840 - RNA, 11 nt, Pseudomonas putida KT2440
cggccaggcuc

SEQ ID NO: 3593841 - RNA, 12 nt, Pseudomonas putida KT2440
cggccagggccc

SEQ ID NO: 3593842 - RNA, 22 nt, Pseudomonas putida KT2440
cggccagggcccgccgcgcggc

SEQ ID NO: 3593843 - RNA, 22 nt, Pseudomonas putida KT2440
cggccaguaccaggucgccagc

SEQ ID NO: 3593844 - RNA, 17 nt, Pseudomonas putida KT2440
cggccagugaagcucga

SEQ ID NO: 3593845 - RNA, 20 nt, Pseudomonas putida KT2440
cggccagugaagcucgaucu

SEQ ID NO: 3593846 - RNA, 21 nt, Pseudomonas putida KT2440
cggccagugaagcucgaucug

SEQ ID NO: 3593847 - RNA, 15 nt, Pseudomonas putida KT2440
cggccagugcgcccg

SEQ ID NO: 3593848 - RNA, 19 nt, Pseudomonas putida KT2440
cggccagugcgcccgaggc

SEQ ID NO: 3593849 - RNA, 23 nt, Pseudomonas putida KT2440
cggccagugcgcccgaggcaauc

SEQ ID NO: 3593850 - RNA, 15 nt, Pseudomonas putida KT2440
cggccaguggccuug

SEQ ID NO: 3593851 - RNA, 16 nt, Pseudomonas putida KT2440
cggccaguugccccag

SEQ ID NO: 3593852 - RNA, 18 nt, Pseudomonas putida KT2440
cggccaguugccccaggc

SEQ ID NO: 3593853 - RNA, 20 nt, Pseudomonas putida KT2440
cggccaguugccccaggccc

SEQ ID NO: 3593854 - RNA, 19 nt, Pseudomonas putida KT2440
cggccaguuucagcgccuu

SEQ ID NO: 3593855 - RNA, 16 nt, Pseudomonas putida KT2440
cggccaucagcaagcc

SEQ ID NO: 3593856 - RNA, 22 nt, Pseudomonas putida KT2440
cggccaucgaacaccacccggu

SEQ ID NO: 3593857 - RNA, 21 nt, Pseudomonas putida KT2440
cggccaugaucucgcccauga

SEQ ID NO: 3593858 - RNA, 12 nt, Pseudomonas putida KT2440
cggccaugccac

SEQ ID NO: 3593859 - RNA, 15 nt, Pseudomonas putida KT2440
cggccaugccacccc

SEQ ID NO: 3593860 - RNA, 12 nt, Pseudomonas putida KT2440
cggccauggccg

SEQ ID NO: 3593861 - RNA, 13 nt, Pseudomonas putida KT2440
cggccauggccga

SEQ ID NO: 3593862 - RNA, 14 nt, Pseudomonas putida KT2440
cggccauggccgag

SEQ ID NO: 3593863 - RNA, 14 nt, Pseudomonas putida KT2440
cggccauucaucau

SEQ ID NO: 3593864 - RNA, 18 nt, Pseudomonas putida KT2440
cggcccaaggcaccaacu

SEQ ID NO: 3593865 - RNA, 21 nt, Pseudomonas putida KT2440
cggcccaaggcaccaacugca

SEQ ID NO: 3593866 - RNA, 18 nt, Pseudomonas putida KT2440
cggcccacagugcuucca

SEQ ID NO: 3593867 - RNA, 21 nt, Pseudomonas putida KT2440
cggcccacagugcuuccagca

SEQ ID NO: 3593868 - RNA, 14 nt, Pseudomonas putida KT2440
cggcccacugcacg

SEQ ID NO: 3593869 - RNA, 18 nt, Pseudomonas putida KT2440
cggcccagccagucgcgc

SEQ ID NO: 3593870 - RNA, 21 nt, Pseudomonas putida KT2440
cggcccagccagucgcgcaac

SEQ ID NO: 3593871 - RNA, 14 nt, Pseudomonas putida KT2440
cggcccagccgcga

SEQ ID NO: 3593872 - RNA, 19 nt, Pseudomonas putida KT2440
cggcccagccgcgacugga

SEQ ID NO: 3593873 - RNA, 22 nt, Pseudomonas putida KT2440
cggcccaucccgcuucgccagc

SEQ ID NO: 3593874 - RNA, 16 nt, Pseudomonas putida KT2440
cggcccaugucgauca

SEQ ID NO: 3593875 - RNA, 18 nt, Pseudomonas putida KT2440
cggcccaugucgaucagc

SEQ ID NO: 3593876 - RNA, 15 nt, Pseudomonas putida KT2440
cggcccauuccgggu

SEQ ID NO: 3593877 - RNA, 15 nt, Pseudomonas putida KT2440
cggcccauucgcggg

SEQ ID NO: 3593878 - RNA, 16 nt, Pseudomonas putida KT2440
cggcccauucgcgggu

SEQ ID NO: 3593879 - RNA, 14 nt, Pseudomonas putida KT2440
cggccccaaugaau

SEQ ID NO: 3593880 - RNA, 18 nt, Pseudomonas putida KT2440
cggccccaauugcuucaa

SEQ ID NO: 3593881 - RNA, 14 nt, Pseudomonas putida KT2440
cggccccaggguua

SEQ ID NO: 3593882 - RNA, 17 nt, Pseudomonas putida KT2440
cggccccaggguuaccu

SEQ ID NO: 3593883 - RNA, 14 nt, Pseudomonas putida KT2440
cggccccaggugcc

SEQ ID NO: 3593884 - RNA, 15 nt, Pseudomonas putida KT2440
cggccccaggugcca

SEQ ID NO: 3593885 - RNA, 14 nt, Pseudomonas putida KT2440
cggcccccacgccg

SEQ ID NO: 3593886 - RNA, 17 nt, Pseudomonas putida KT2440
cggcccccacgccgacc

SEQ ID NO: 3593887 - RNA, 21 nt, Pseudomonas putida KT2440
cggcccccacgccgaccgcgc

SEQ ID NO: 3593888 - RNA, 13 nt, Pseudomonas putida KT2440
cggcccccagcaa

SEQ ID NO: 3593889 - RNA, 17 nt, Pseudomonas putida KT2440
cggccccccagccagca

SEQ ID NO: 3593890 - RNA, 16 nt, Pseudomonas putida KT2440
cggccccggcgccgcc

SEQ ID NO: 3593891 - RNA, 24 nt, Pseudomonas putida KT2440
cggccccggcgccgccaggcagca

SEQ ID NO: 3593892 - RNA, 14 nt, Pseudomonas putida KT2440
cggccccucgacca

SEQ ID NO: 3593893 - RNA, 21 nt, Pseudomonas putida KT2440
cggccccuuccgaccggucau

SEQ ID NO: 3593894 - RNA, 17 nt, Pseudomonas putida KT2440
cggcccgaucagccaga

SEQ ID NO: 3593895 - RNA, 11 nt, Pseudomonas putida KT2440
cggcccggcau

SEQ ID NO: 3593896 - RNA, 12 nt, Pseudomonas putida KT2440
cggcccggcugg

SEQ ID NO: 3593897 - RNA, 15 nt, Pseudomonas putida KT2440
cggcccggcuggcca

SEQ ID NO: 3593898 - RNA, 18 nt, Pseudomonas putida KT2440
cggcccuaucgcgacgca

SEQ ID NO: 3593899 - RNA, 21 nt, Pseudomonas putida KT2440
cggcccucgguggcucuccuc

SEQ ID NO: 3593900 - RNA, 14 nt, Pseudomonas putida KT2440
cggcgacggcgagg

SEQ ID NO: 3593901 - RNA, 22 nt, Pseudomonas putida KT2440
cggcgagcgcaggaacaggcug

SEQ ID NO: 3593902 - RNA, 12 nt, Pseudomonas putida KT2440
cggcgagcgcgu

SEQ ID NO: 3593903 - RNA, 20 nt, Pseudomonas putida KT2440
cggcgaggugauugaaggca

SEQ ID NO: 3593904 - RNA, 20 nt, Pseudomonas putida KT2440
cggcgaguccugccuuccac

SEQ ID NO: 3593905 - RNA, 18 nt, Pseudomonas putida KT2440
cggcgauacucaccgccg

SEQ ID NO: 3593906 - RNA, 22 nt, Pseudomonas putida KT2440
cggcgauacuuggccaucagcu

SEQ ID NO: 3593907 - RNA, 21 nt, Pseudomonas putida KT2440
cggcgauagggaacagggcag

SEQ ID NO: 3593908 - RNA, 22 nt, Pseudomonas putida KT2440
cggcgauauggcuccaccacag

SEQ ID NO: 3593909 - RNA, 20 nt, Pseudomonas putida KT2440
cggcgaucgacaccuaucag

SEQ ID NO: 3593910 - RNA, 15 nt, Pseudomonas putida KT2440
cggcgaucgccaggu

SEQ ID NO: 3593911 - RNA, 18 nt, Pseudomonas putida KT2440
cggcgaucugucaggugu

SEQ ID NO: 3593912 - RNA, 14 nt, Pseudomonas putida KT2440
cggcgaugcgcccc

SEQ ID NO: 3593913 - RNA, 23 nt, Pseudomonas putida KT2440
cggcgaugcgccccccaggcggu

SEQ ID NO: 3593914 - RNA, 15 nt, Pseudomonas putida KT2440
cggcgauggucaacc

SEQ ID NO: 3593915 - RNA, 14 nt, Pseudomonas putida KT2440
cggcgcaaugaaaa

SEQ ID NO: 3593916 - RNA, 13 nt, Pseudomonas putida KT2440
cggcgcacccggc

SEQ ID NO: 3593917 - RNA, 15 nt, Pseudomonas putida KT2440
cggcgcaccgcuugc

SEQ ID NO: 3593918 - RNA, 13 nt, Pseudomonas putida KT2440
cggcgcacgcaug

SEQ ID NO: 3593919 - RNA, 15 nt, Pseudomonas putida KT2440
cggcgcacgcaugcg

SEQ ID NO: 3593920 - RNA, 17 nt, Pseudomonas putida KT2440
cggcgcacgcaugcgcg

SEQ ID NO: 3593921 - RNA, 15 nt, Pseudomonas putida KT2440
cggcgcagcgcugag

SEQ ID NO: 3593922 - RNA, 15 nt, Pseudomonas putida KT2440
cggcgcaggccgaca

SEQ ID NO: 3593923 - RNA, 13 nt, Pseudomonas putida KT2440
cggcgcagggccu

SEQ ID NO: 3593924 - RNA, 16 nt, Pseudomonas putida KT2440
cggcgcauccaccacg

SEQ ID NO: 3593925 - RNA, 15 nt, Pseudomonas putida KT2440
cggcgcaucgacggg

SEQ ID NO: 3593926 - RNA, 18 nt, Pseudomonas putida KT2440
cggcgcaucgacgggcau

SEQ ID NO: 3593927 - RNA, 21 nt, Pseudomonas putida KT2440
cggcgccaaucaucgccagca

SEQ ID NO: 3593928 - RNA, 20 nt, Pseudomonas putida KT2440
cggcgccaggccuuucagcg

SEQ ID NO: 3593929 - RNA, 17 nt, Pseudomonas putida KT2440
cggcgccauaggcuugc

SEQ ID NO: 3593930 - RNA, 20 nt, Pseudomonas putida KT2440
cggcgcccagcaacaugccg

SEQ ID NO: 3593931 - RNA, 13 nt, Pseudomonas putida KT2440
cggcgccccuuuu

SEQ ID NO: 3593932 - RNA, 14 nt, Pseudomonas putida KT2440
cggcgcccuggccg

SEQ ID NO: 3593933 - RNA, 23 nt, Pseudomonas putida KT2440
cggcgccgaacgaauagccgguc

SEQ ID NO: 3593934 - RNA, 19 nt, Pseudomonas putida KT2440
cggcgccgaccgaaccggc

SEQ ID NO: 3593935 - RNA, 15 nt, Pseudomonas putida KT2440
cggcgccgccaggca

SEQ ID NO: 3593936 - RNA, 16 nt, Pseudomonas putida KT2440
cggcgccgccaggcag

SEQ ID NO: 3593937 - RNA, 13 nt, Pseudomonas putida KT2440
cggcgccggccgc

SEQ ID NO: 3593938 - RNA, 18 nt, Pseudomonas putida KT2440
cggcgccgucuucagaca

SEQ ID NO: 3593939 - RNA, 14 nt, Pseudomonas putida KT2440
cggcgccuccagca

SEQ ID NO: 3593940 - RNA, 13 nt, Pseudomonas putida KT2440
cggcgccugccac

SEQ ID NO: 3593941 - RNA, 18 nt, Pseudomonas putida KT2440
cggcgccugugaucgagc

SEQ ID NO: 3593942 - RNA, 22 nt, Pseudomonas putida KT2440
cggcgcgacagcguugcuccag

SEQ ID NO: 3593943 - RNA, 20 nt, Pseudomonas putida KT2440
cggcgcgaucaucgaagcca

SEQ ID NO: 3593944 - RNA, 22 nt, Pseudomonas putida KT2440
cggcgcgcaacagcaaggcauc

SEQ ID NO: 3593945 - RNA, 12 nt, Pseudomonas putida KT2440
cggcgcgcagcg

SEQ ID NO: 3593946 - RNA, 13 nt, Pseudomonas putida KT2440
cggcgcgcgcauc

SEQ ID NO: 3593947 - RNA, 21 nt, Pseudomonas putida KT2440
cggcgcggaauucgcggcggc

SEQ ID NO: 3593948 - RNA, 14 nt, Pseudomonas putida KT2440
cggcgcggcccugu

SEQ ID NO: 3593949 - RNA, 14 nt, Pseudomonas putida KT2440
cggcgcggccugcu

SEQ ID NO: 3593950 - RNA, 15 nt, Pseudomonas putida KT2440
cggcgcggccugcuc

SEQ ID NO: 3593951 - RNA, 21 nt, Pseudomonas putida KT2440
cggcgcguggggucugcccgg

SEQ ID NO: 3593952 - RNA, 17 nt, Pseudomonas putida KT2440
cggcgcucagcgggcgu

SEQ ID NO: 3593953 - RNA, 20 nt, Pseudomonas putida KT2440
cggcgcucgaucucacaggc

SEQ ID NO: 3593954 - RNA, 20 nt, Pseudomonas putida KT2440
cggcgcucggucucacaggc

SEQ ID NO: 3593955 - RNA, 23 nt, Pseudomonas putida KT2440
cggcgcucggucucacaggcgcu

SEQ ID NO: 3593956 - RNA, 20 nt, Pseudomonas putida KT2440
cggcgcucggucucauaggc

SEQ ID NO: 3593957 - RNA, 17 nt, Pseudomonas putida KT2440
cggcgcugaccgaugau

SEQ ID NO: 3593958 - RNA, 23 nt, Pseudomonas putida KT2440
cggcgcugacgaacaacgccacc

SEQ ID NO: 3593959 - RNA, 17 nt, Pseudomonas putida KT2440
cggcgcugagcgacagc

SEQ ID NO: 3593960 - RNA, 15 nt, Pseudomonas putida KT2440
cggcgcugaucagcu

SEQ ID NO: 3593961 - RNA, 14 nt, Pseudomonas putida KT2440
cggcgcuggccggu

SEQ ID NO: 3593962 - RNA, 22 nt, Pseudomonas putida KT2440
cggcgcugggacagguccaugu

SEQ ID NO: 3593963 - RNA, 13 nt, Pseudomonas putida KT2440
cggcgcugggcuu

SEQ ID NO: 3593964 - RNA, 19 nt, Pseudomonas putida KT2440
cggcgcuggugcaggcguu

SEQ ID NO: 3593965 - RNA, 17 nt, Pseudomonas putida KT2440
cggcgcuugaucugcca

SEQ ID NO: 3593966 - RNA, 20 nt, Pseudomonas putida KT2440
cggcggaacaauugcucuug

SEQ ID NO: 3593967 - RNA, 21 nt, Pseudomonas putida KT2440
cggcggauagccccgcccagc

SEQ ID NO: 3593968 - RNA, 22 nt, Pseudomonas putida KT2440
cggcggauagccccgcccagca

SEQ ID NO: 3593969 - RNA, 23 nt, Pseudomonas putida KT2440
cggcggcagauacaaccccagau

SEQ ID NO: 3593970 - RNA, 13 nt, Pseudomonas putida KT2440
cggcggcagcggc

SEQ ID NO: 3593971 - RNA, 21 nt, Pseudomonas putida KT2440
cggcggcauccaggcgggcga

SEQ ID NO: 3593972 - RNA, 23 nt, Pseudomonas putida KT2440
cggcggcauccaggcgggcgaag

SEQ ID NO: 3593973 - RNA, 14 nt, Pseudomonas putida KT2440
cggcggccagcacg

SEQ ID NO: 3593974 - RNA, 18 nt, Pseudomonas putida KT2440
cggcggccagcacgaaca

SEQ ID NO: 3593975 - RNA, 21 nt, Pseudomonas putida KT2440
cggcggccagcacgaacagca

SEQ ID NO: 3593976 - RNA, 17 nt, Pseudomonas putida KT2440
cggcggcccggccaaca

SEQ ID NO: 3593977 - RNA, 14 nt, Pseudomonas putida KT2440
cggcggccugcagc

SEQ ID NO: 3593978 - RNA, 18 nt, Pseudomonas putida KT2440
cggcggcgaucagcgcgg

SEQ ID NO: 3593979 - RNA, 13 nt, Pseudomonas putida KT2440
cggcggcgugagc

SEQ ID NO: 3593980 - RNA, 16 nt, Pseudomonas putida KT2440
cggcggcuaagcgcca

SEQ ID NO: 3593981 - RNA, 17 nt, Pseudomonas putida KT2440
cggcggcuuccagggcu

SEQ ID NO: 3593982 - RNA, 19 nt, Pseudomonas putida KT2440
cggcggggcccggacaggg

SEQ ID NO: 3593983 - RNA, 23 nt, Pseudomonas putida KT2440
cggcggguggaaauuggccagca

SEQ ID NO: 3593984 - RNA, 23 nt, Pseudomonas putida KT2440
cggcggguggaaauuggcgagca

SEQ ID NO: 3593985 - RNA, 16 nt, Pseudomonas putida KT2440
cggcgguaacaggggu

SEQ ID NO: 3593986 - RNA, 16 nt, Pseudomonas putida KT2440
cggcgguaccccgccu

SEQ ID NO: 3593987 - RNA, 17 nt, Pseudomonas putida KT2440
cggcggugacacugcca

SEQ ID NO: 3593988 - RNA, 14 nt, Pseudomonas putida KT2440
cggcggugacccgu

SEQ ID NO: 3593989 - RNA, 14 nt, Pseudomonas putida KT2440
cggcggugccugca

SEQ ID NO: 3593990 - RNA, 22 nt, Pseudomonas putida KT2440
cggcgguugcaccguggcagca

SEQ ID NO: 3593991 - RNA, 23 nt, Pseudomonas putida KT2440
cggcgguuggugcgccuccagca

SEQ ID NO: 3593992 - RNA, 22 nt, Pseudomonas putida KT2440
cggcguacucucgucgaggcug

SEQ ID NO: 3593993 - RNA, 16 nt, Pseudomonas putida KT2440
cggcguagaccagugc

SEQ ID NO: 3593994 - RNA, 14 nt, Pseudomonas putida KT2440
cggcguauacccgg

SEQ ID NO: 3593995 - RNA, 18 nt, Pseudomonas putida KT2440
cggcguauacccggucag

SEQ ID NO: 3593996 - RNA, 23 nt, Pseudomonas putida KT2440
cggcguauacccggucaggguga

SEQ ID NO: 3593997 - RNA, 17 nt, Pseudomonas putida KT2440
cggcguauggcuucacg

SEQ ID NO: 3593998 - RNA, 20 nt, Pseudomonas putida KT2440
cggcgucaccggccaugccg

SEQ ID NO: 3593999 - RNA, 15 nt, Pseudomonas putida KT2440
cggcgucagcguggu

SEQ ID NO: 3594000 - RNA, 17 nt, Pseudomonas putida KT2440
cggcguccacugcaccc

SEQ ID NO: 3594001 - RNA, 19 nt, Pseudomonas putida KT2440
cggcguccacugcacccgu

SEQ ID NO: 3594002 - RNA, 12 nt, Pseudomonas putida KT2440
cggcguccaggc

SEQ ID NO: 3594003 - RNA, 20 nt, Pseudomonas putida KT2440
cggcgucccggccagcgacc

SEQ ID NO: 3594004 - RNA, 19 nt, Pseudomonas putida KT2440
cggcgucgaacaacggcag

SEQ ID NO: 3594005 - RNA, 23 nt, Pseudomonas putida KT2440
cgggaaguuacgggucgaggugg

SEQ ID NO: 3594006 - RNA, 16 nt, Pseudomonas putida KT2440
cgggaauaccaggccc

SEQ ID NO: 3594007 - RNA, 18 nt, Pseudomonas putida KT2440
cgggaaugaacugcaacu

SEQ ID NO: 3594008 - RNA, 17 nt, Pseudomonas putida KT2440
cgggaauugcagcccgc

SEQ ID NO: 3594009 - RNA, 19 nt, Pseudomonas putida KT2440
cgggacagcaccaugcgcg

SEQ ID NO: 3594010 - RNA, 15 nt, Pseudomonas putida KT2440
cgggagagcagggcu

SEQ ID NO: 3594011 - RNA, 17 nt, Pseudomonas putida KT2440
cgggagagcagggcugc

SEQ ID NO: 3594012 - RNA, 20 nt, Pseudomonas putida KT2440
cgggagagcagggcugcgcg

SEQ ID NO: 3594013 - RNA, 23 nt, Pseudomonas putida KT2440
cgggagagcagggcugcgcgccc

SEQ ID NO: 3594014 - RNA, 17 nt, Pseudomonas putida KT2440
cgggagcgggcgugccc

SEQ ID NO: 3594015 - RNA, 15 nt, Pseudomonas putida KT2440
cgggauaaccgcaga

SEQ ID NO: 3594016 - RNA, 22 nt, Pseudomonas putida KT2440
cgggauacugcgcacgaauacg

SEQ ID NO: 3594017 - RNA, 23 nt, Pseudomonas putida KT2440
cgggaucaccgcaagcugcaccg

SEQ ID NO: 3594018 - RNA, 11 nt, Pseudomonas putida KT2440
cgggaucagca

SEQ ID NO: 3594019 - RNA, 16 nt, Pseudomonas putida KT2440
cgggaucaugccgaag

SEQ ID NO: 3594020 - RNA, 17 nt, Pseudomonas putida KT2440
cgggaugcucugcagca

SEQ ID NO: 3594021 - RNA, 19 nt, Pseudomonas putida KT2440
cgggaugcucugcagcagc

SEQ ID NO: 3594022 - RNA, 16 nt, Pseudomonas putida KT2440
cgggauggcaccggca

SEQ ID NO: 3594023 - RNA, 17 nt, Pseudomonas putida KT2440
cgggauggcaccggcag

SEQ ID NO: 3594024 - RNA, 19 nt, Pseudomonas putida KT2440
cgggauggcggcgccugcc

SEQ ID NO: 3594025 - RNA, 19 nt, Pseudomonas putida KT2440
cgggaugguaacgggcaaa

SEQ ID NO: 3594026 - RNA, 17 nt, Pseudomonas putida KT2440
cgggauguucaggucgc

SEQ ID NO: 3594027 - RNA, 23 nt, Pseudomonas putida KT2440
cgggauguuggucuugaugccgu

SEQ ID NO: 3594028 - RNA, 22 nt, Pseudomonas putida KT2440
cgggauucgacuaucaggggag

SEQ ID NO: 3594029 - RNA, 18 nt, Pseudomonas putida KT2440
cgggauuguucccacagg

SEQ ID NO: 3594030 - RNA, 21 nt, Pseudomonas putida KT2440
cgggauuguucccacagggag

SEQ ID NO: 3594031 - RNA, 16 nt, Pseudomonas putida KT2440
cgggauuugccgucgc

SEQ ID NO: 3594032 - RNA, 20 nt, Pseudomonas putida KT2440
cgggcaaacccgcgccuaca

SEQ ID NO: 3594033 - RNA, 20 nt, Pseudomonas putida KT2440
cgggcaaacuggcgcccggc

SEQ ID NO: 3594034 - RNA, 12 nt, Pseudomonas putida KT2440
cgggcaaagcac

SEQ ID NO: 3594035 - RNA, 16 nt, Pseudomonas putida KT2440
cgggcaaagcaccaug

SEQ ID NO: 3594036 - RNA, 20 nt, Pseudomonas putida KT2440
cgggcaaagcgggucgccag

SEQ ID NO: 3594037 - RNA, 14 nt, Pseudomonas putida KT2440
cgggcaacugcgcc

SEQ ID NO: 3594038 - RNA, 15 nt, Pseudomonas putida KT2440
cgggcaacugcgccu

SEQ ID NO: 3594039 - RNA, 16 nt, Pseudomonas putida KT2440
cgggcaacugcgccug

SEQ ID NO: 3594040 - RNA, 14 nt, Pseudomonas putida KT2440
cgggcaagcccgca

SEQ ID NO: 3594041 - RNA, 15 nt, Pseudomonas putida KT2440
cgggcaagcccgcac

SEQ ID NO: 3594042 - RNA, 14 nt, Pseudomonas putida KT2440
cgggcaagcccgcu

SEQ ID NO: 3594043 - RNA, 22 nt, Pseudomonas putida KT2440
cgggcaagcccgcucccacagg

SEQ ID NO: 3594044 - RNA, 20 nt, Pseudomonas putida KT2440
cgggcaagcccgcuccgaca

SEQ ID NO: 3594045 - RNA, 20 nt, Pseudomonas putida KT2440
cgggcaagcccgcuccuaca

SEQ ID NO: 3594046 - RNA, 19 nt, Pseudomonas putida KT2440
cgggcaaggcaaguuccuu

SEQ ID NO: 3594047 - RNA, 13 nt, Pseudomonas putida KT2440
cgggcaaggcugg

SEQ ID NO: 3594048 - RNA, 16 nt, Pseudomonas putida KT2440
cgggcaaggucgaugc

SEQ ID NO: 3594049 - RNA, 23 nt, Pseudomonas putida KT2440
cgggcaaggucgaugcugcugag

SEQ ID NO: 3594050 - RNA, 16 nt, Pseudomonas putida KT2440
cgggcaauggccacac

SEQ ID NO: 3594051 - RNA, 22 nt, Pseudomonas putida KT2440
cgggcaauggccacacgcugcu

SEQ ID NO: 3594052 - RNA, 14 nt, Pseudomonas putida KT2440
cgggcacaccuggu

SEQ ID NO: 3594053 - RNA, 17 nt, Pseudomonas putida KT2440
cgggcacaccuggugcg

SEQ ID NO: 3594054 - RNA, 20 nt, Pseudomonas putida KT2440
cgggcacaccuggugcgccu

SEQ ID NO: 3594055 - RNA, 14 nt, Pseudomonas putida KT2440
cgggcacaggccca

SEQ ID NO: 3594056 - RNA, 16 nt, Pseudomonas putida KT2440
cgggcacaggcccagc

SEQ ID NO: 3594057 - RNA, 22 nt, Pseudomonas putida KT2440
cgggcacaggccgcgcaugaug

SEQ ID NO: 3594058 - RNA, 14 nt, Pseudomonas putida KT2440
cgggcacaucacca

SEQ ID NO: 3594059 - RNA, 17 nt, Pseudomonas putida KT2440
cgggcacaucaccagca

SEQ ID NO: 3594060 - RNA, 20 nt, Pseudomonas putida KT2440
cgggcacaucaccagcagcu

SEQ ID NO: 3594061 - RNA, 18 nt, Pseudomonas putida KT2440
cgggcacgaucagcagca

SEQ ID NO: 3594062 - RNA, 12 nt, Pseudomonas putida KT2440
cgggcacgcccg

SEQ ID NO: 3594063 - RNA, 17 nt, Pseudomonas putida KT2440
cgggcacgcccgcuccc

SEQ ID NO: 3594064 - RNA, 21 nt, Pseudomonas putida KT2440
cgggcacucggguucgcagac

SEQ ID NO: 3594065 - RNA, 23 nt, Pseudomonas putida KT2440
cgggcagaccugcuggcacugcg

SEQ ID NO: 3594066 - RNA, 22 nt, Pseudomonas putida KT2440
cgggcagacuucggucuggccg

SEQ ID NO: 3594067 - RNA, 23 nt, Pseudomonas putida KT2440
cgggcagacuucggucuggccga

SEQ ID NO: 3594068 - RNA, 13 nt, Pseudomonas putida KT2440
cgggcagccgacu

SEQ ID NO: 3594069 - RNA, 17 nt, Pseudomonas putida KT2440
cgggcagccgucggcgu

SEQ ID NO: 3594070 - RNA, 16 nt, Pseudomonas putida KT2440
cgggcagcgggcucgc

SEQ ID NO: 3594071 - RNA, 21 nt, Pseudomonas putida KT2440
cgggcagcgggcucgcccaca

SEQ ID NO: 3594072 - RNA, 14 nt, Pseudomonas putida KT2440
cgggcaggccaugc

SEQ ID NO: 3594073 - RNA, 19 nt, Pseudomonas putida KT2440
cgggcaggccccugcaaca

SEQ ID NO: 3594074 - RNA, 14 nt, Pseudomonas putida KT2440
cgggcagugcaaua

SEQ ID NO: 3594075 - RNA, 23 nt, Pseudomonas putida KT2440
cgggcagugcaauaccagccugg

SEQ ID NO: 3594076 - RNA, 21 nt, Pseudomonas putida KT2440
cgggcaugcaggucgaccugc

SEQ ID NO: 3594077 - RNA, 14 nt, Pseudomonas putida KT2440
cgggcaugcccgcg

SEQ ID NO: 3594078 - RNA, 18 nt, Pseudomonas putida KT2440
cgggcaugcccgcgaagg

SEQ ID NO: 3594079 - RNA, 17 nt, Pseudomonas putida KT2440
cgggcaugcccgcuccc

SEQ ID NO: 3594080 - RNA, 20 nt, Pseudomonas putida KT2440
cgggcaugcccgcucccaca

SEQ ID NO: 3594081 - RNA, 14 nt, Pseudomonas putida KT2440
cgggccaacuugcg

SEQ ID NO: 3594082 - RNA, 17 nt, Pseudomonas putida KT2440
cgggccaacuugcgcag

SEQ ID NO: 3594083 - RNA, 19 nt, Pseudomonas putida KT2440
cgggccaccaaaggccuug

SEQ ID NO: 3594084 - RNA, 13 nt, Pseudomonas putida KT2440
cgggccaccaccg

SEQ ID NO: 3594085 - RNA, 19 nt, Pseudomonas putida KT2440
cgggccaccaccgcguaca

SEQ ID NO: 3594086 - RNA, 14 nt, Pseudomonas putida KT2440
cgggccaccaggcc

SEQ ID NO: 3594087 - RNA, 15 nt, Pseudomonas putida KT2440
cgggccaccaggccu

SEQ ID NO: 3594088 - RNA, 17 nt, Pseudomonas putida KT2440
cgggccaccuugugcgc

SEQ ID NO: 3594089 - RNA, 23 nt, Pseudomonas putida KT2440
cgggccagccgcgccaggucggc

SEQ ID NO: 3594090 - RNA, 17 nt, Pseudomonas putida KT2440
cgggccagcgcgguagc

SEQ ID NO: 3594091 - RNA, 12 nt, Pseudomonas putida KT2440
cgggccaggugg

SEQ ID NO: 3594092 - RNA, 16 nt, Pseudomonas putida KT2440
cgggccaucggugccg

SEQ ID NO: 3594093 - RNA, 14 nt, Pseudomonas putida KT2440
cgggccaucugcuu

SEQ ID NO: 3594094 - RNA, 14 nt, Pseudomonas putida KT2440
cgggccaugugcug

SEQ ID NO: 3594095 - RNA, 13 nt, Pseudomonas putida KT2440
cgggccgccgaac

SEQ ID NO: 3594096 - RNA, 18 nt, Pseudomonas putida KT2440
cgggccgccguggugccg

SEQ ID NO: 3594097 - RNA, 20 nt, Pseudomonas putida KT2440
cgggccgccguggugccggu

SEQ ID NO: 3594098 - RNA, 17 nt, Pseudomonas putida KT2440
cgggccgucaccgcugc

SEQ ID NO: 3594099 - RNA, 21 nt, Pseudomonas putida KT2440
cgggccuucaaccucacuggc

SEQ ID NO: 3594100 - RNA, 23 nt, Pseudomonas putida KT2440
cgggccuucaaccucacuggcau

SEQ ID NO: 3594101 - RNA, 15 nt, Pseudomonas putida KT2440
cgggccuuugggcca

SEQ ID NO: 3594102 - RNA, 23 nt, Pseudomonas putida KT2440
cgggcgaagcccgugccauccac

SEQ ID NO: 3594103 - RNA, 24 nt, Pseudomonas putida KT2440
cgggcgaagcccgugccauccacc

SEQ ID NO: 3594104 - RNA, 21 nt, Pseudomonas putida KT2440
cgggcgaagcccguggcccuc

SEQ ID NO: 3594105 - RNA, 17 nt, Pseudomonas putida KT2440
cgggcgagcgcgcaggc

SEQ ID NO: 3594106 - RNA, 13 nt, Pseudomonas putida KT2440
cgggcgcaggcag

SEQ ID NO: 3594107 - RNA, 18 nt, Pseudomonas putida KT2440
cgggcgcaggcagcacau

SEQ ID NO: 3594108 - RNA, 14 nt, Pseudomonas putida KT2440
cgggcgcgauugcc

SEQ ID NO: 3594109 - RNA, 22 nt, Pseudomonas putida KT2440
cgggcgcgcccgcucccacagg

SEQ ID NO: 3594110 - RNA, 12 nt, Pseudomonas putida KT2440
cggguccaccca

SEQ ID NO: 3594111 - RNA, 17 nt, Pseudomonas putida KT2440
cggguccacccacccuc

SEQ ID NO: 3594112 - RNA, 18 nt, Pseudomonas putida KT2440
cggguccaccucugcggc

SEQ ID NO: 3594113 - RNA, 13 nt, Pseudomonas putida KT2440
cggguccagcaac

SEQ ID NO: 3594114 - RNA, 14 nt, Pseudomonas putida KT2440
cggguccgauccgg

SEQ ID NO: 3594115 - RNA, 13 nt, Pseudomonas putida KT2440
cgggucgaaggca

SEQ ID NO: 3594116 - RNA, 17 nt, Pseudomonas putida KT2440
cgggucgacgcgcaagc

SEQ ID NO: 3594117 - RNA, 19 nt, Pseudomonas putida KT2440
cgggucgagguggagacca

SEQ ID NO: 3594118 - RNA, 20 nt, Pseudomonas putida KT2440
cgggucgauagccagcccgg

SEQ ID NO: 3594119 - RNA, 16 nt, Pseudomonas putida KT2440
cgggucgcacucggca

SEQ ID NO: 3594120 - RNA, 22 nt, Pseudomonas putida KT2440
cgggucgcugccgugcagguca

SEQ ID NO: 3594121 - RNA, 14 nt, Pseudomonas putida KT2440
cgggucggccugcu

SEQ ID NO: 3594122 - RNA, 16 nt, Pseudomonas putida KT2440
cgggucggcgccaggc

SEQ ID NO: 3594123 - RNA, 23 nt, Pseudomonas putida KT2440
cgggucguucaacuucgguggcu

SEQ ID NO: 3594124 - RNA, 14 nt, Pseudomonas putida KT2440
cgggucuacccgcg

SEQ ID NO: 3594125 - RNA, 23 nt, Pseudomonas putida KT2440
cgggucugauugggcccgccauu

SEQ ID NO: 3594126 - RNA, 16 nt, Pseudomonas putida KT2440
cgggucuuccaccacc

SEQ ID NO: 3594127 - RNA, 20 nt, Pseudomonas putida KT2440
cgggucuuuuuucauucagg

SEQ ID NO: 3594128 - RNA, 22 nt, Pseudomonas putida KT2440
cgggugaacccgauuacaaggg

SEQ ID NO: 3594129 - RNA, 20 nt, Pseudomonas putida KT2440
cgggugaacccgcuccuacg

SEQ ID NO: 3594130 - RNA, 20 nt, Pseudomonas putida KT2440
cgggugaacccgcuccugca

SEQ ID NO: 3594131 - RNA, 19 nt, Pseudomonas putida KT2440
cgggugaaccgcgccuaca

SEQ ID NO: 3594132 - RNA, 13 nt, Pseudomonas putida KT2440
cgggugaccaggc

SEQ ID NO: 3594133 - RNA, 20 nt, Pseudomonas putida KT2440
cgggugaccaggcccagcag

SEQ ID NO: 3594134 - RNA, 12 nt, Pseudomonas putida KT2440
cgggugagcgcg

SEQ ID NO: 3594135 - RNA, 16 nt, Pseudomonas putida KT2440
cgggugauuuccugca

SEQ ID NO: 3594136 - RNA, 18 nt, Pseudomonas putida KT2440
cgggugcagccgcaccca

SEQ ID NO: 3594137 - RNA, 17 nt, Pseudomonas putida KT2440
cgggugccgcagcaccg

SEQ ID NO: 3594138 - RNA, 16 nt, Pseudomonas putida KT2440
cgggugcgagaggcgc

SEQ ID NO: 3594139 - RNA, 19 nt, Pseudomonas putida KT2440
cgggugcgggcuccacugc

SEQ ID NO: 3594140 - RNA, 22 nt, Pseudomonas putida KT2440
cgggugcuggcucgcugcccca

SEQ ID NO: 3594141 - RNA, 21 nt, Pseudomonas putida KT2440
cggguggaaauuggccagcag

SEQ ID NO: 3594142 - RNA, 19 nt, Pseudomonas putida KT2440
cggguggaaauuggcgagc

SEQ ID NO: 3594143 - RNA, 21 nt, Pseudomonas putida KT2440
cggguggagauuggccagcag

SEQ ID NO: 3594144 - RNA, 17 nt, Pseudomonas putida KT2440
cgggugguauccggggg

SEQ ID NO: 3594145 - RNA, 20 nt, Pseudomonas putida KT2440
cggguguuggacacaggccg

SEQ ID NO: 3594146 - RNA, 17 nt, Pseudomonas putida KT2440
cggguucaagggcaggg

SEQ ID NO: 3594147 - RNA, 14 nt, Pseudomonas putida KT2440
cggguucacccgcg

SEQ ID NO: 3594148 - RNA, 15 nt, Pseudomonas putida KT2440
cggguucacccgcga

SEQ ID NO: 3594149 - RNA, 18 nt, Pseudomonas putida KT2440
cggguucagcuucucgcg

SEQ ID NO: 3594150 - RNA, 20 nt, Pseudomonas putida KT2440
cggguucagguacagcagcu

SEQ ID NO: 3594151 - RNA, 13 nt, Pseudomonas putida KT2440
cggguucuccccc

SEQ ID NO: 3594152 - RNA, 15 nt, Pseudomonas putida KT2440
cggguucucccccau

SEQ ID NO: 3594153 - RNA, 23 nt, Pseudomonas putida KT2440
cggguucucccccaucaguugca

SEQ ID NO: 3594154 - RNA, 17 nt, Pseudomonas putida KT2440
cggguugcucaggcgcu

SEQ ID NO: 3594155 - RNA, 21 nt, Pseudomonas putida KT2440
cggguuguggcuggcgucgau

SEQ ID NO: 3594156 - RNA, 14 nt, Pseudomonas putida KT2440
cggguuuacccgcg

SEQ ID NO: 3594157 - RNA, 15 nt, Pseudomonas putida KT2440
cggguuuacccgcga

SEQ ID NO: 3594158 - RNA, 19 nt, Pseudomonas putida KT2440
cggguuuacccgcgaagcg

SEQ ID NO: 3594159 - RNA, 20 nt, Pseudomonas putida KT2440
cggguuuacccgcgaauacg

SEQ ID NO: 3594160 - RNA, 19 nt, Pseudomonas putida KT2440
cggguuuacccgcgaaugg

SEQ ID NO: 3594161 - RNA, 14 nt, Pseudomonas putida KT2440
cggguuugcguggu

SEQ ID NO: 3594162 - RNA, 15 nt, Pseudomonas putida KT2440
cgguaaaacagccuu

SEQ ID NO: 3594163 - RNA, 20 nt, Pseudomonas putida KT2440
cgguaaacaauucccagccu

SEQ ID NO: 3594164 - RNA, 18 nt, Pseudomonas putida KT2440
cgguaacguggacagcag

SEQ ID NO: 3594165 - RNA, 17 nt, Pseudomonas putida KT2440
cgguaacuggcccaccc

SEQ ID NO: 3594166 - RNA, 13 nt, Pseudomonas putida KT2440
cgguaaugcccgc

SEQ ID NO: 3594167 - RNA, 16 nt, Pseudomonas putida KT2440
cgguaaugcccgcagg

SEQ ID NO: 3594168 - RNA, 20 nt, Pseudomonas putida KT2440
cgguaaugcuggugguggcc

SEQ ID NO: 3594169 - RNA, 18 nt, Pseudomonas putida KT2440
cgguaauggccggcugug

SEQ ID NO: 3594170 - RNA, 15 nt, Pseudomonas putida KT2440
cgguacagcacccag

SEQ ID NO: 3594171 - RNA, 22 nt, Pseudomonas putida KT2440
cgguacagcacugcauuggcca

SEQ ID NO: 3594172 - RNA, 22 nt, Pseudomonas putida KT2440
cgguaccacugcuucugagcca

SEQ ID NO: 3594173 - RNA, 14 nt, Pseudomonas putida KT2440
cgguaccagcaggc

SEQ ID NO: 3594174 - RNA, 15 nt, Pseudomonas putida KT2440
cgguacccgccagca

SEQ ID NO: 3594175 - RNA, 18 nt, Pseudomonas putida KT2440
cgguacccgccagcaauu

SEQ ID NO: 3594176 - RNA, 20 nt, Pseudomonas putida KT2440
cgguaccggccagcugcgca

SEQ ID NO: 3594177 - RNA, 15 nt, Pseudomonas putida KT2440
cgguacgacgcacca

SEQ ID NO: 3594178 - RNA, 20 nt, Pseudomonas putida KT2440
cgguacugcgucuuguaguu

SEQ ID NO: 3594179 - RNA, 19 nt, Pseudomonas putida KT2440
cgguagacuucugcgugcg

SEQ ID NO: 3594180 - RNA, 18 nt, Pseudomonas putida KT2440
cgguagauuucaccgagu

SEQ ID NO: 3594181 - RNA, 13 nt, Pseudomonas putida KT2440
cgguagccccagc

SEQ ID NO: 3594182 - RNA, 17 nt, Pseudomonas putida KT2440
cgguagccccagccggc

SEQ ID NO: 3594183 - RNA, 22 nt, Pseudomonas putida KT2440
cgguagccucgacccgcuggcg

SEQ ID NO: 3594184 - RNA, 14 nt, Pseudomonas putida KT2440
cgguagcggcuggg

SEQ ID NO: 3594185 - RNA, 21 nt, Pseudomonas putida KT2440
cgguagggaucaccgccagca

SEQ ID NO: 3594186 - RNA, 12 nt, Pseudomonas putida KT2440
cgguaguccugc

SEQ ID NO: 3594187 - RNA, 21 nt, Pseudomonas putida KT2440
cgguauaggccgcaagcccgc

SEQ ID NO: 3594188 - RNA, 23 nt, Pseudomonas putida KT2440
cgguauagugguaugauuucagg

SEQ ID NO: 3594189 - RNA, 16 nt, Pseudomonas putida KT2440
cggucaauacccccga

SEQ ID NO: 3594190 - RNA, 14 nt, Pseudomonas putida KT2440
cggucaccugcaac

SEQ ID NO: 3594191 - RNA, 23 nt, Pseudomonas putida KT2440
cggucacgauccccaccagcauc

SEQ ID NO: 3594192 - RNA, 20 nt, Pseudomonas putida KT2440
cggucacugagccaggccga

SEQ ID NO: 3594193 - RNA, 22 nt, Pseudomonas putida KT2440
cggucacugagccaggccgaca

SEQ ID NO: 3594194 - RNA, 17 nt, Pseudomonas putida KT2440
cggucacugcgcggccg

SEQ ID NO: 3594195 - RNA, 15 nt, Pseudomonas putida KT2440
cggucacuggcgaca

SEQ ID NO: 3594196 - RNA, 12 nt, Pseudomonas putida KT2440
cggucagacgcg

SEQ ID NO: 3594197 - RNA, 21 nt, Pseudomonas putida KT2440
cggucagacgcggaacuggcu

SEQ ID NO: 3594198 - RNA, 18 nt, Pseudomonas putida KT2440
cggucagcaccuggcagc

SEQ ID NO: 3594199 - RNA, 15 nt, Pseudomonas putida KT2440
cggucagcauccagc

SEQ ID NO: 3594200 - RNA, 16 nt, Pseudomonas putida KT2440
cggucagcauccagcc

SEQ ID NO: 3594201 - RNA, 16 nt, Pseudomonas putida KT2440
cggucagcauggccag

SEQ ID NO: 3594202 - RNA, 18 nt, Pseudomonas putida KT2440
cggucagcccggcuugca

SEQ ID NO: 3594203 - RNA, 15 nt, Pseudomonas putida KT2440
cggucaggccaagua

SEQ ID NO: 3594204 - RNA, 12 nt, Pseudomonas putida KT2440
cggucaggccug

SEQ ID NO: 3594205 - RNA, 16 nt, Pseudomonas putida KT2440
cggucagggcacggcu

SEQ ID NO: 3594206 - RNA, 20 nt, Pseudomonas putida KT2440
cggucagggcggcagcgauc

SEQ ID NO: 3594207 - RNA, 13 nt, Pseudomonas putida KT2440
cggucagguagcc

SEQ ID NO: 3594208 - RNA, 17 nt, Pseudomonas putida KT2440
cggucaguaccuggccg

SEQ ID NO: 3594209 - RNA, 19 nt, Pseudomonas putida KT2440
cggucagugaagcgaggug

SEQ ID NO: 3594210 - RNA, 12 nt, Pseudomonas putida KT2440
cggucaucacca

SEQ ID NO: 3594211 - RNA, 20 nt, Pseudomonas putida KT2440
cggucaucaccacccccagc

SEQ ID NO: 3594212 - RNA, 14 nt, Pseudomonas putida KT2440
cggucaucacgcuc

SEQ ID NO: 3594213 - RNA, 16 nt, Pseudomonas putida KT2440
cggucauccagcagcu

SEQ ID NO: 3594214 - RNA, 17 nt, Pseudomonas putida KT2440
cggucaugcagcgucgg

SEQ ID NO: 3594215 - RNA, 17 nt, Pseudomonas putida KT2440
cggugucgucgcuguca

SEQ ID NO: 3594216 - RNA, 19 nt, Pseudomonas putida KT2440
cggugucuucuucgcgggu

SEQ ID NO: 3594217 - RNA, 17 nt, Pseudomonas putida KT2440
cggugugcauccagccc

SEQ ID NO: 3594218 - RNA, 20 nt, Pseudomonas putida KT2440
cggugugcggaucgccgccg

SEQ ID NO: 3594219 - RNA, 22 nt, Pseudomonas putida KT2440
cggugugcuccagcuccaggcg

SEQ ID NO: 3594220 - RNA, 20 nt, Pseudomonas putida KT2440
cggugugcugcggccaccgc

SEQ ID NO: 3594221 - RNA, 15 nt, Pseudomonas putida KT2440
cgguguggccaaggc

SEQ ID NO: 3594222 - RNA, 13 nt, Pseudomonas putida KT2440
cgguguggccagu

SEQ ID NO: 3594223 - RNA, 14 nt, Pseudomonas putida KT2440
cggugugggcgaag

SEQ ID NO: 3594224 - RNA, 16 nt, Pseudomonas putida KT2440
cgguguucgcgggcac

SEQ ID NO: 3594225 - RNA, 16 nt, Pseudomonas putida KT2440
cgguguucgcgggcau

SEQ ID NO: 3594226 - RNA, 16 nt, Pseudomonas putida KT2440
cgguuaagcgccacca

SEQ ID NO: 3594227 - RNA, 15 nt, Pseudomonas putida KT2440
cgguucaccagcagc

SEQ ID NO: 3594228 - RNA, 23 nt, Pseudomonas putida KT2440
cgguuccaauacauacaccaacg

SEQ ID NO: 3594229 - RNA, 21 nt, Pseudomonas putida KT2440
cgguuccagcgcaccgaugcg

SEQ ID NO: 3594230 - RNA, 20 nt, Pseudomonas putida KT2440
cgguucgaccaauggcugcg

SEQ ID NO: 3594231 - RNA, 20 nt, Pseudomonas putida KT2440
cgguucuccugugccggccu

SEQ ID NO: 3594232 - RNA, 15 nt, Pseudomonas putida KT2440
cgguucugccggggc

SEQ ID NO: 3594233 - RNA, 16 nt, Pseudomonas putida KT2440
cgguucuggucaccca

SEQ ID NO: 3594234 - RNA, 17 nt, Pseudomonas putida KT2440
cgguucuggucacccag

SEQ ID NO: 3594235 - RNA, 19 nt, Pseudomonas putida KT2440
cgguucuggucacccagcg

SEQ ID NO: 3594236 - RNA, 13 nt, Pseudomonas putida KT2440
cgguucuucgccu

SEQ ID NO: 3594237 - RNA, 19 nt, Pseudomonas putida KT2440
cgguucuucgccugcagca

SEQ ID NO: 3594238 - RNA, 20 nt, Pseudomonas putida KT2440
cgguugaccagggcgucgaa

SEQ ID NO: 3594239 - RNA, 14 nt, Pseudomonas putida KT2440
cgguugaccgccgc

SEQ ID NO: 3594240 - RNA, 16 nt, Pseudomonas putida KT2440
cgguugaccgccgcca

SEQ ID NO: 3594241 - RNA, 22 nt, Pseudomonas putida KT2440
cgguugaccgccgccaccaucg

SEQ ID NO: 3594242 - RNA, 17 nt, Pseudomonas putida KT2440
cgguugaugcagcgccc

SEQ ID NO: 3594243 - RNA, 16 nt, Pseudomonas putida KT2440
cgguugcagcacacuc

SEQ ID NO: 3594244 - RNA, 21 nt, Pseudomonas putida KT2440
cgguugcagcacacuccacga

SEQ ID NO: 3594245 - RNA, 19 nt, Pseudomonas putida KT2440
cgguugcaggacuacaucu

SEQ ID NO: 3594246 - RNA, 16 nt, Pseudomonas putida KT2440
cgguugcccgcugcau

SEQ ID NO: 3594247 - RNA, 15 nt, Pseudomonas putida KT2440
cgguugccuugucgg

SEQ ID NO: 3594248 - RNA, 19 nt, Pseudomonas putida KT2440
cgguugcgcaaaucgccaa

SEQ ID NO: 3594249 - RNA, 17 nt, Pseudomonas putida KT2440
cgguugcgcagccggcc

SEQ ID NO: 3594250 - RNA, 14 nt, Pseudomonas putida KT2440
cgguugcgcccggc

SEQ ID NO: 3594251 - RNA, 17 nt, Pseudomonas putida KT2440
cgguugcuccagcgugu

SEQ ID NO: 3594252 - RNA, 21 nt, Pseudomonas putida KT2440
cgguuggcgcuuccuggccuu

SEQ ID NO: 3594253 - RNA, 14 nt, Pseudomonas putida KT2440
cgguuguacggcga

SEQ ID NO: 3594254 - RNA, 20 nt, Pseudomonas putida KT2440
cgguuguagaucgccggcag

SEQ ID NO: 3594255 - RNA, 16 nt, Pseudomonas putida KT2440
cgguugucgaccuggc

SEQ ID NO: 3594256 - RNA, 22 nt, Pseudomonas putida KT2440
cgguuucacccuugggcucagc

SEQ ID NO: 3594257 - RNA, 19 nt, Pseudomonas putida KT2440
cgguuucccgaugaagaau

SEQ ID NO: 3594258 - RNA, 17 nt, Pseudomonas putida KT2440
cgguuuccucgacgcca

SEQ ID NO: 3594259 - RNA, 16 nt, Pseudomonas putida KT2440
cgguuucgucaggaag

SEQ ID NO: 3594260 - RNA, 17 nt, Pseudomonas putida KT2440
cgguuucucgcagcagc

SEQ ID NO: 3594261 - RNA, 21 nt, Pseudomonas putida KT2440
cgguuuguccuggccgaugcg

SEQ ID NO: 3594262 - RNA, 21 nt, Pseudomonas putida KT2440
cgguuuuuccaugcgcgcagc

SEQ ID NO: 3594263 - RNA, 13 nt, Pseudomonas putida KT2440
cguaaccgcccgc

SEQ ID NO: 3594264 - RNA, 15 nt, Pseudomonas putida KT2440
cguaaccgcccgcca

SEQ ID NO: 3594265 - RNA, 15 nt, Pseudomonas putida KT2440
cguaacgagccuugg

SEQ ID NO: 3594266 - RNA, 12 nt, Pseudomonas putida KT2440
cguaacggucac

SEQ ID NO: 3594267 - RNA, 19 nt, Pseudomonas putida KT2440
cguaacggucacugagcca

SEQ ID NO: 3594268 - RNA, 14 nt, Pseudomonas putida KT2440
cguaagcgcugcgc

SEQ ID NO: 3594269 - RNA, 16 nt, Pseudomonas putida KT2440
cguaaggccugaggcc

SEQ ID NO: 3594270 - RNA, 19 nt, Pseudomonas putida KT2440
cguaauccucguccagcuc

SEQ ID NO: 3594271 - RNA, 15 nt, Pseudomonas putida KT2440
cguacacucaccgcg

SEQ ID NO: 3594272 - RNA, 21 nt, Pseudomonas putida KT2440
cguacagcgacaugccggcca

SEQ ID NO: 3594273 - RNA, 15 nt, Pseudomonas putida KT2440
cguacaucagccucg

SEQ ID NO: 3594274 - RNA, 12 nt, Pseudomonas putida KT2440
cguaccagcagg

SEQ ID NO: 3594275 - RNA, 13 nt, Pseudomonas putida KT2440
cguaccagccgca

SEQ ID NO: 3594276 - RNA, 14 nt, Pseudomonas putida KT2440
cguaccagccgcac

SEQ ID NO: 3594277 - RNA, 18 nt, Pseudomonas putida KT2440
cguaccaguuccuugagc

SEQ ID NO: 3594278 - RNA, 12 nt, Pseudomonas putida KT2440
cguacccaggug

SEQ ID NO: 3594279 - RNA, 21 nt, Pseudomonas putida KT2440
cguacccaggugaugcaggca

SEQ ID NO: 3594280 - RNA, 22 nt, Pseudomonas putida KT2440
cguaccccuggcgcuuuccagc

SEQ ID NO: 3594281 - RNA, 19 nt, Pseudomonas putida KT2440
cguacccgccaccccaggc

SEQ ID NO: 3594282 - RNA, 22 nt, Pseudomonas putida KT2440
cguacccgccaccccaggccac

SEQ ID NO: 3594283 - RNA, 20 nt, Pseudomonas putida KT2440
cguaccugugggagcgggcg

SEQ ID NO: 3594284 - RNA, 13 nt, Pseudomonas putida KT2440
cguacgcucuggu

SEQ ID NO: 3594285 - RNA, 13 nt, Pseudomonas putida KT2440
cguacggccuugg

SEQ ID NO: 3594286 - RNA, 15 nt, Pseudomonas putida KT2440
cguacggcgucaguu

SEQ ID NO: 3594287 - RNA, 21 nt, Pseudomonas putida KT2440
cguacugcugggucagcacuu

SEQ ID NO: 3594288 - RNA, 23 nt, Pseudomonas putida KT2440
cguacugcuucaucugcgccugu

SEQ ID NO: 3594289 - RNA, 17 nt, Pseudomonas putida KT2440
cguacuggcugcacugg

SEQ ID NO: 3594290 - RNA, 23 nt, Pseudomonas putida KT2440
cguacugguaaugcucuccagcg

SEQ ID NO: 3594291 - RNA, 19 nt, Pseudomonas putida KT2440
cguagcacaagggccaggu

SEQ ID NO: 3594292 - RNA, 18 nt, Pseudomonas putida KT2440
cguagcagguacgcgcag

SEQ ID NO: 3594293 - RNA, 22 nt, Pseudomonas putida KT2440
cguagcagguacgcgcaggcag

SEQ ID NO: 3594294 - RNA, 15 nt, Pseudomonas putida KT2440
cguagcccucgaugu

SEQ ID NO: 3594295 - RNA, 23 nt, Pseudomonas putida KT2440
cguagcccucgaugucuuccaga

SEQ ID NO: 3594296 - RNA, 23 nt, Pseudomonas putida KT2440
cguagccguuugaagccaacccc

SEQ ID NO: 3594297 - RNA, 15 nt, Pseudomonas putida KT2440
cguagccugaggggu

SEQ ID NO: 3594298 - RNA, 22 nt, Pseudomonas putida KT2440
cguagccuucagcggccgcgca

SEQ ID NO: 3594299 - RNA, 21 nt, Pseudomonas putida KT2440
cguagcgcccggacaacuugg

SEQ ID NO: 3594300 - RNA, 18 nt, Pseudomonas putida KT2440
cguagcggucaugcagcg

SEQ ID NO: 3594301 - RNA, 19 nt, Pseudomonas putida KT2440
cguagcuguugcgcugggc

SEQ ID NO: 3594302 - RNA, 22 nt, Pseudomonas putida KT2440
cguaggagcgggcuugcccgcg

SEQ ID NO: 3594303 - RNA, 14 nt, Pseudomonas putida KT2440
cguaggagcggguu

SEQ ID NO: 3594304 - RNA, 20 nt, Pseudomonas putida KT2440
cguaggcacacccggccaag

SEQ ID NO: 3594305 - RNA, 18 nt, Pseudomonas putida KT2440
cguaggcgcaucgggccg

SEQ ID NO: 3594306 - RNA, 14 nt, Pseudomonas putida KT2440
cguaggcugcagcg

SEQ ID NO: 3594307 - RNA, 21 nt, Pseudomonas putida KT2440
cguaggucacggucuuggccg

SEQ ID NO: 3594308 - RNA, 13 nt, Pseudomonas putida KT2440
cguaggucagguc

SEQ ID NO: 3594309 - RNA, 13 nt, Pseudomonas putida KT2440
cguaguaacggcg

SEQ ID NO: 3594310 - RNA, 15 nt, Pseudomonas putida KT2440
cguaguaacggcgga

SEQ ID NO: 3594311 - RNA, 15 nt, Pseudomonas putida KT2440
cguaguacuccagca

SEQ ID NO: 3594312 - RNA, 16 nt, Pseudomonas putida KT2440
cguaguacuccagcag

SEQ ID NO: 3594313 - RNA, 20 nt, Pseudomonas putida KT2440
cguaguacuccagcagcgca

SEQ ID NO: 3594314 - RNA, 15 nt, Pseudomonas putida KT2440
cguagugcaggcgca

SEQ ID NO: 3594315 - RNA, 13 nt, Pseudomonas putida KT2440
cguauagccaccg

SEQ ID NO: 3594316 - RNA, 15 nt, Pseudomonas putida KT2440
cguaucaggcaucgc

SEQ ID NO: 3594317 - RNA, 14 nt, Pseudomonas putida KT2440
cguauggcguugcu

SEQ ID NO: 3594318 - RNA, 20 nt, Pseudomonas putida KT2440
cguauggcuucacggccaau

SEQ ID NO: 3594319 - RNA, 18 nt, Pseudomonas putida KT2440
cguauucgcccagcgcuc

SEQ ID NO: 3594320 - RNA, 23 nt, Pseudomonas putida KT2440
cgucgagcaacuugcgcagcuug

SEQ ID NO: 3594321 - RNA, 19 nt, Pseudomonas putida KT2440
cgucgagcaugaugauguc

SEQ ID NO: 3594322 - RNA, 18 nt, Pseudomonas putida KT2440
cgucgagccggguccacc

SEQ ID NO: 3594323 - RNA, 23 nt, Pseudomonas putida KT2440
cgucgagccggguccacccggua

SEQ ID NO: 3594324 - RNA, 15 nt, Pseudomonas putida KT2440
cgucgagguacuuga

SEQ ID NO: 3594325 - RNA, 15 nt, Pseudomonas putida KT2440
cgucgaucagcuucu

SEQ ID NO: 3594326 - RNA, 17 nt, Pseudomonas putida KT2440
cgucgaucauuuccggg

SEQ ID NO: 3594327 - RNA, 19 nt, Pseudomonas putida KT2440
cgucgaucuggaugaaguc

SEQ ID NO: 3594328 - RNA, 18 nt, Pseudomonas putida KT2440
cgucgauguccagcgagg

SEQ ID NO: 3594329 - RNA, 13 nt, Pseudomonas putida KT2440
cgucgccaaucuc

SEQ ID NO: 3594330 - RNA, 16 nt, Pseudomonas putida KT2440
cgucgccacgcgggcu

SEQ ID NO: 3594331 - RNA, 12 nt, Pseudomonas putida KT2440
cgucgcccgcga

SEQ ID NO: 3594332 - RNA, 11 nt, Pseudomonas putida KT2440
cgucgccugca

SEQ ID NO: 3594333 - RNA, 22 nt, Pseudomonas putida KT2440
cgucgccugcaaccccuggaaa

SEQ ID NO: 3594334 - RNA, 20 nt, Pseudomonas putida KT2440
cgucgcgaaagggccgcaag

SEQ ID NO: 3594335 - RNA, 22 nt, Pseudomonas putida KT2440
cgucgcgaugggcugcaaagca

SEQ ID NO: 3594336 - RNA, 18 nt, Pseudomonas putida KT2440
cgucgcgauugaucagcg

SEQ ID NO: 3594337 - RNA, 20 nt, Pseudomonas putida KT2440
cgucgcgauugaucagcgcc

SEQ ID NO: 3594338 - RNA, 21 nt, Pseudomonas putida KT2440
cgucgcgauugaucagcgccu

SEQ ID NO: 3594339 - RNA, 15 nt, Pseudomonas putida KT2440
cgucgcgcagggccu

SEQ ID NO: 3594340 - RNA, 14 nt, Pseudomonas putida KT2440
cgucgcgcuggccg

SEQ ID NO: 3594341 - RNA, 16 nt, Pseudomonas putida KT2440
cgucgcgcuggccgcc

SEQ ID NO: 3594342 - RNA, 18 nt, Pseudomonas putida KT2440
cgucgcgcuggccgcccg

SEQ ID NO: 3594343 - RNA, 17 nt, Pseudomonas putida KT2440
cgucgcgugaggcaugg

SEQ ID NO: 3594344 - RNA, 16 nt, Pseudomonas putida KT2440
cgucgcuggccagcuu

SEQ ID NO: 3594345 - RNA, 13 nt, Pseudomonas putida KT2440
cgucgcuucaucg

SEQ ID NO: 3594346 - RNA, 18 nt, Pseudomonas putida KT2440
cgucggcaagcuugccag

SEQ ID NO: 3594347 - RNA, 11 nt, Pseudomonas putida KT2440
cgucggcaccg

SEQ ID NO: 3594348 - RNA, 15 nt, Pseudomonas putida KT2440
cgucggcaccggcga

SEQ ID NO: 3594349 - RNA, 18 nt, Pseudomonas putida KT2440
cgucggcaccggcgacgc

SEQ ID NO: 3594350 - RNA, 15 nt, Pseudomonas putida KT2440
cgucggcagagcgcc

SEQ ID NO: 3594351 - RNA, 17 nt, Pseudomonas putida KT2440
cgucggcagagcgccag

SEQ ID NO: 3594352 - RNA, 20 nt, Pseudomonas putida KT2440
cgucggcagagcgccagcau

SEQ ID NO: 3594353 - RNA, 12 nt, Pseudomonas putida KT2440
cgucggcagcca

SEQ ID NO: 3594354 - RNA, 16 nt, Pseudomonas putida KT2440
cgucggcagccaugcu
